United States Patent 7,834,146 (RECOMBINANT POLYPEPTIDES ASSOCIATED WITH PLANTS) - sequence listing, part 7

SEQ ID NO: 22245 - DNA, 508 bp, Sorghum bicolor
  Clone ID: 13586407
gcacgaggcccttcgcggcatcccatctccgcgccgccgtctcctcgctcgccgcctcgctcaccgcgatcccggggcctgacccggacccggtgcccgccctccacgagcactccttccctaccctcctcgccgtctctccgctcgcgtcgctcgagctcctctcgctgctccggtccaggccgcggctagggctcgccgtattctcattccgccgcgcgctctccccggtcccctcgctcggcgagttcgccctcgccatctcgctcgcgagccgcgcccgcgaccatgacgcggcggccgcgctctttgccgacggcaccgctacccattccccgaaccaggggctgtacaacgctcttatggcggcatacatgcacaacggcctcctagacagctgcatcgagaccttccacgcgctggagcgcgacccaaggtgcggtccgcccaacgtggactcgtacaacatcctcatagccctgtacggtcgctccctcctcgttgacca

SEQ ID NO: 22246 - DNA, 107 bp, Sorghum bicolor
  Clone ID: 13586410
gcacgagggagctgttcaggccatgcatgaagtggtgttatctaacaaggcaaaatattcttcaaatgagaatgctcaacaaagtggtagcgctaccgttgaagcac

SEQ ID NO: 22247 - DNA, 434 bp, Sorghum bicolor
  Clone ID: 13586424
gcacgaggccattatacccagcttcattatttcagaatgaaactgacggggaagggatgagctttgttttgtactttaggctttctgatggttactcaaaagagcttccaccttcatttattgaaagtattagaaggttggttgatgatcatgtagagaagataaaatcatttccaatggaaaccactataccattccgagagcggctgaagatacttggccgggtggctaatctggaggatcttcctttgagtgcagcagagaggaagctaatgcatgcgtataatgagaagcctgtcctttcaaggccacaacatgagttttacctgggtgataactactttgagatcgacattgacatgcacagatttagctacatctcaaggaaaggttttgaaacatttttggacaggctaaaagcatgcgttctagat

SEQ ID NO: 22248 - DNA, 393 bp, Sorghum bicolor
  Clone ID: 13586426
ctccggtcaggcaaattcggctgagggtggcagccaaacaagcccctgatgccggagcagtccagatccggcgccccgatggagtggacgacggtgcagcacctggacctgcgccactccggcggccgccgcggcgcctcggcccgccctatgcagccgcacgccgccgccttccgctcctcacaggccatcgtcgctgtggccatgggcacccacgtcgtcgagttcgatgctctgacgggaagcaagatagcttctattgaccttggcgcccgtgttgttcgtatggcatatagccctacaactagtcatgttgtcattgctattcttgaggatgctacaatcagatcctgtgatttcgccacggagcagacacttgtgctgcactcgcct

SEQ ID NO: 22249 - DNA, 452 bp, Sorghum bicolor
  Clone ID: 13586428
gcacgaggcttttcttgagcttgaagctgctgcacgttcatatttccaagaacggaatgggcgtccttctgaagtaggttcttctgcaaagagcagcagtattgactcttctccacattcacgatggacctgcttctggttctcttgctgagtccaatcaaataaatcaagctcttactcgtggtagcagtctgacaggagcaactggtaatggtgtgcttggagaagctatcttagatcagtctgatgagcatgttagtagtgccttgaatcacaggaaagggaaccttgtattggaacatgatggtagaaatggatcagtagtgtcttataggggagttgtttcagaagaggaccgtgattctaatcccggccatgctcggaaggactctgctgaaagtattgggagtgatttgagttctttaagaggaagtgaattatctgttccaggg

SEQ ID NO: 22250 - DNA, 452 bp, Sorghum bicolor
  Clone ID: 13586439
gcacgagggacccttccgcgccgtcctcgccgtccgcctcggccggcgccggcgccgccatggagctgcgcgtgctggcctgcatccacggcggtcaggacgtgcccgcggtgatcaacctcatcgagaccatccgcggccacacgcagccgcgccgcctcgtcaagctctacatcctccgcatggtggagctgacggagcgcacctcctccatcctcatggcgcgcgccgcgcgccggaacgggctgccgttcctgcgcccgcgccgcgcgggggagccgcacgaccaggtggacgtggccttcgacacgtacgcgcagctcggccacgtccacgtccgcgccatgaccgccgtgtccgcgctccacaccatgcacgacgacgtcgcggcagtcgccgaggacaagcgcgtctccctcgtcgtcctgccgttccacaagcgccagacggga

SEQ ID NO: 22251 - DNA, 457 bp, Sorghum bicolor
  Clone ID: 13586441
gcacgaggatttggtataagatcctgagcttcaatgacattgacacggagataccaaatgacaagaccaggttccctgaggtttatgtcaaagcaatgctaggcaaccaagtacttagaaccagggtattagcgagccggaccttgaatccaatgtggaatgaagatttgatgtttgtcgcagctgagccatttgaggagcacctaattttgagcgtagaggacagggtggccccaggaaaggatgaagtaattggaaggacaatcatttcactgcagcatgtaccccggaggttggatcacaggttgctaaccagccagtggtatccccttgagaagcatgtgattattgatggtgagcagaagaaagagaccaagttttcaagccggattcacttgagaatttgtcttgaaggtggatatcatgtcttggatgagtcaacacattacagtagtga

SEQ ID NO: 22252 - DNA, 563 bp, Sorghum bicolor
  Clone ID: 13586445
gcacgaggctctctctctctccctcttggcctcttctcctcttcgcctcttccttcccccacgccatccccgggacaaggcggcaaataacctctctcccggcgacgaggccgatggagtcgacctccggcgaggacgctccgaagcgcaacccgctcccggccgcgctcgtctccaacctccagtccgtgctcgccgcacgccgcccgcccggggccgaggtcagcactgaggcgtcggctccggaggcggaggcttccgatgtacccgcgggagatggggcgccggcgaggcccatcgtgctgctgacctgtgccggggggatccggtccgcgggtctcgcggcgctcgtcgacgccctcgttgccagcggccgctgcgatgtccacgtgtgtgcccccgaatcggacaagccagcctgtggccactcaattaccatccgtgaaaccatcaccgcgacatccgtggatttcacaggtgctaaagcttttgagatatcaggcacgccggttgactgtgtctcgttggccttatctgggaggctgtttccttggtcgtctcct

SEQ ID NO: 22253 - DNA, 441 bp, Sorghum bicolor
  Clone ID: 13586463
cgcgcgccgcctcccgctccgcctccaccgccgcggcccgctccacttcctccgcctcttcccgcgcgtgttccacctccgcgccccgctcccgctctcgctgtccctgacccccgccgccgcgggcctcctcgcagtcgccagctcccccgccgacgcggcgcggacgctccaccgcctcctcgccatgtcggtcagccgctccttgcccctccgcgctgtcttccgcgtctggcgcgagctcgccctccccgacgacttcgaggactccgtcgtcgaggggcacccgcacctcttccgccttgcccccaatcccgacgagcccaacacccacattctccacctcgtcgccgatccggcgactgaggaattcaccccggcggtggagaagacccggccggacaggtacgccttcaagctgcagtttccgccggggttcag

SEQ ID NO: 22254 - DNA, 445 bp, Sorghum bicolor
  Clone ID: 13586470
gcacgaggctcgcaaaaccctccccgtcgatggccggtgtgccgccgccgccgcggcagctcgaggtgcggcgcttcgcggccgcccgcgccggcgagctccgctcgctctacgcagccgtgtcgtcccgactcgacgacgccggcggtcggcagcagccccgttccgcgcgccgccgcaccacagggcacctccctaacaagcgccgccgccggggacccggagaggtcggtaccgaggacgacgggggcctcccgccgcggaaacagtcgaggagggtgaggcggcggcgggagctcgccggcaaccccgcggaggggttctcggtcgccggcgacggcgcgaggcggctgcgcacgcacctgtggtatgcgaaaaggttctccatggagaggcggtggggattcatcttgcctgtcggcacacaggggagtgggaggggctc

SEQ ID NO: 22255 - DNA, 405 bp, Sorghum bicolor
  Clone ID: 13586482
gcacgagggcggagcgcgctcaacacagcgcacgtgggcatgtacctggtgtcggtgcgcttcggcacgccggcgctgccgtacaacctggtgctggacaccgccaacgacctgacgtggatcaactgccggctgcggcgacgcaagggcaagcactacgggcggcagtcgtccaagacgatgtcggtgggcggggatgacgacgtggtggcggcgctggcgaagaaggaggcgagaaagaactggtaccggccggccaagtcgtcgtcgtggcgccggatccggtgctcggagcagcagtgcgcgcacctgccgtacaacacgtgccagagccccagcaagctggagtcgtgcagctactaccaaaagacgcaggacgggacggtgacgatcggcatctacggc

SEQ ID NO: 22256 - DNA, 554 bp, Sorghum bicolor
  Clone ID: 13586498
gcacgagggtgaggttatgggatgttgaaagaaaaagctgtattggcattggcaaaggccatctgggtgctgttggttctgttgccttctcaaagaaaacaaagaacttctttgttagtggcagcagcgatcggaccatcaaggtatggacctgggacgatgcacttggtgatgctgaggatgaagtctctcttaaagcaaaggctgttgtagctgcacatgataaagatattaattctctggcaatttcacctaatgatggccttgtttgcagtggttctgaggaccgaactgcctgcatatggaaactccctaacctagtgtcctctattgtccttaagggacacaaaagaggaatctggtcagttgagttttctcccattgaacaatgtgtcatgacatcctctggtgatagaacaatcaaaatatggtctgttgctgatggctcatgcttgaagacatttgagggccatacatcaagtgttctgcgagcttctttcctttcacgtggaactcaaattgtttcttgtggaagtgatggcctagtgaagtta

SEQ ID NO: 22257 - DNA, 325 bp, Sorghum bicolor
  Clone ID: 13586511
gcacgaggatcatcaatgcctagggtttgatcctccctccctcactccgcgctccgctcgtgctagccagccagtccccccacccacgacccgccacggcgatggcttcgccgcacccgctcagctgggccgacgcgccgcccttttactaccacgggacgacaccccagccggcacccgactcctcctccgacggggccgggccgcgctcgctctggatcggcggcctgctgcactggatggacgaggactacctctacgcctgcttcaccacctcgcccgagcttctttccgatgtcatcagacggagcaagcagactgggca

SEQ ID NO: 22258 - DNA, 487 bp, Sorghum bicolor
  Clone ID: 13586515
gcacgaggggacgaaggtgaggagtgaagaaaccaaagccaaattaagccatagaatattgttgatagagaatatatacatcatcatggtgcaactactagtattaccatcgtcgtccttgatcctcctcctggtgctgctgatgatggcgccgtcgtcatcatgcgcgcaggagcaggagcaggagcagcagcagctgaagcagcagatgcaggagcatcagcagcagcataccatgttgcaggggtggataaaggagcaggttgccaaagatgcagcagcggggtgcacgtgcggcaagaaggacgctgcactctccgcagccgaggctaacagggtggtcctccacgtcgaacccgccgacgatagtagtacctcagatcctgctatctacctcaacagcatcggcgaggccatcgccaagatccccgacggcaacaccaaacggtacatcatcagtatccagcccggcgccgtgtaccgtgag

SEQ ID NO: 22259 - DNA, 514 bp, Sorghum bicolor
  unsure (1)..(514): unsure at all n locations
  Clone ID: 13586516
tggtcgcggagacgcggacggagaggtcgaagccgggtagcagagggcttgagagtctgcggggggtcagctcgacgtctggaggcgacggctagacgaacgccggcagccatggcccatgggcagtgcaacgcgcggcgacgggtagcgcgaggttatcctggttctgctgactccactactcccaatccctccatcttctggccaaggcggtggctttgccaaattccagctgcccagagagctgcggtgatgttaaaattgtatacccatttgggattggtgctctctgtgcaatggaaggatttgacctcgagtgcaacaaaactgaggatggcagcgccaatgtgacattttttggcagcatgccgttgctgaatatatcattactccatggtgagattcnggtgaaacaccacatctcgtccatgtgctacaacctctcgagcaggagtatctcctatagggaagggggcatgaaactcgacacacaccattcacattctcggagctg

SEQ ID NO: 22260 - DNA, 482 bp, Sorghum bicolor
  Clone ID: 13586529
gcacgagggtcacccccgcttagaagacctgcacacctcatttaactgtattttcctcttatcttgcattaccttacaggctttccagtttattatattacactcttcctattcaacgcaggacaagaacaagttacaaatcttactttttttgggactgctttccttaattcatcgtctcaggcttacatatattagtttgggacacaacctcatactactttcagatgcacatgtttatcaggcttacatatattagtttgggacacaacctcatactactatcagaggcacatatttatcgtacaaattccattattgcacaattttttttactgatttcggtgcgctgtgtccatgacatattgtttcatcccccctaatatttggtgcaagtcatggaaacgtgtgggacacaatctcatactactatctgatgcacatgtttatcatacaaatgccattattgcacaatatttttg

SEQ ID NO: 22261 - DNA, 362 bp, Sorghum bicolor
  Clone ID: 13586530
gcacgaggggaagccttctttccggaacaagaaaatgcattatacaccacagaggacacaaaggagtacattcaagcggaggaagctctttgatcgccattcagttctagcatctgaatttggtgcagcaaatggaaagggaagcacacaggttaccggaagagactctcatgctgaagcaaacaatgggactaattcaatgccattccagaaatcttgtgtgtcaaatgattgccatgtgaaacttacaattaagtcttttaaggtgcctgaacttcttggtgaaatcccacaaagtgcaactgttggctcactaaagagaactgatcttgaggcggtgactgcgattcttggaggtggtc

SEQ ID NO: 22262 - DNA, 525 bp, Sorghum bicolor
  Clone ID: 13586544
gcacgagggcacaaagtgtttttgaagcaggtttaaagagatttatgcatgagccaggatacatccttgaatatgcagacttcctgtgtcgtttaaatgacgacagaaatgtacgtgctttatttgagagggcactgagcttacttccacctgaggaatccacagaggtatggagacgatttgcccaatttgagcagatctacggggatttatcaagcatgcttaaggttgaacaaagaaggaaagaggctctttctaggacatcagaagatgtcctatctgcatcggaaaacactcttcatgacatagtttctcgatacagttatatggatctttggccatgctcatcaaaagaattggattatctagcgagacaagagtggctatcgaaaaacatttttaagaaggttgacaaatcagctatgctaaatagcagtagcatgctagacaaaggtgctgcaggatttagtgcgagtgcaaggttactaccacaatctgccaaagttgttcgtcctgagacttctc

SEQ ID NO: 22263 - DNA, 584 bp, Sorghum bicolor
  Clone ID: 13586559
gcattgaggatgatgatgcagtgttcgaagagaagatgaagggcgtttctttgctggaagctgatgggttcgacgtggagcacctgcgatcacgcctggaaacattgctgcgcataaagaaggctcgtgccaaactgcagggcacaattaaagatatggaacagaagttttctcacgaagagactgagaggcgcacccagatgggtgtgctaaatatgactgtccgtcagcttgaactgcaggcttgtctcttccgctgcatgatgcattctgctatttcacaggagctaagtgatgcctcggagatctcgaggctgaaagcagaagttagcaagctggagcaccgcttcagcagcaccaccgcatcaccgtggtgaggcgcaccacctgcagactgcagtgtggtgaaccagttggccgcgcacagcacatggttagtgctaactagggctgccttctggtgtattttgccgaaactggcgaaccttatgctggttatgattctgggtgtttactgcacctgcgtggctgctgctatgtttctgggatatcactgaacctgtgctttatttatgtaagtcatc

SEQ ID NO: 22264 - DNA, 250 bp, Sorghum bicolor
  Clone ID: 13586575
aaaatacaaggaccaggataaccgagttgagatggcaatcaaggtggccctgtggtgcattcaggaggacttctatcagaggccatccatgtcgaaggttgtccagatgctggaaggcgtctgcgacgtgccccagccaccaatatcttagcatatcggataccggctgtacacgaatgctttcaaatctagcagcgaagagggcacgtcatctgggatgtcagactacaacagtgatgctttaccttct

SEQ ID NO: 22265 - DNA, 510 bp, Sorghum bicolor
  Clone ID: 13586588
tccctcgtcccgaacgtcctgatcgacagcatcgccgtggtccagctgtcattgagcttgtctgtctgaggaagtccaccggaagcgtcagctgctgcaacacggggagtgtaactgtgtaagagtgtgagtttcagctatacagacacatgaaagaatgccgtttcaggctttcggctttcagcctatcacttacgccgagccaagcctgcgctgaattctgcagatctcctgctgcgaggcgatccatgaagcttggtctgcatccagttgagaacctgcatccgccacagcagcaagaattaaacacctgcagtgacattcagccatagcaagttcagacgaaacagtgacaacgcctgcgtagcgtacccccatggttaccggtgctctattctcttgtgtaagcagctcggacaaatgtaggtggtgaggtgaatgaatggttcttgatatatagctagcgcatggtcgcatgaatgatgcaagtgtgtatatatatataaatct

SEQ ID NO: 22266 - DNA, 663 bp, Sorghum bicolor
  unsure (1)..(663): unsure at all n locations
  Clone ID: 13586608
cagaaaattgacatttggtctcttggctgcatcttagctgaactgtacactggtgaagtgctctttcctaatgaatcagtaccaatcattcttgcccgtatgattgggacaattggtccaattgatatggaaatgcttgtatcaggacgggagacccagaagtacttcacagatgactatgaccttttccacaagaatgaggagacagatcagttggagtatttgatcccagagaaatcttctttgcggcgccacttgcagtgcccagacaaaaaatttgttgattttctgtcttacctgctgcaaataaatcccagaaagagaccaacggccagcgaagcattgcaacaccgatggctttcgttcaaatatagttcaacggccaatcaaactcgttcctgacaagtagtctacactttctgaagctactggctcctgaaacagcatgtttccttttgcaacaggatttggcttcatggttttgttttttttaggtcaacacatggcattgaaaaccctgttttgcaaggtgaatcaatcgtgtgtacacgctagttctgcatgtaaatatgagaaaagttgcttcttcttttttgtgtacagttgccatgtactacgatgttgtccaacctncatggtatagcaaatggaattccaagattt

SEQ ID NO: 22267 - DNA, 588 bp, Sorghum bicolor
  unsure (1)..(588): unsure at all n locations
  Clone ID: 13586621
cggcgcgatgcaggcggcgcagaataagcactccaccacgcggtccctggcgaaggagtagtcgcccacgcncaggccgctctccttccaccacctcgtcacctccgcgagctctcgccggtggagagcctgcaccaggttgaagtccacctgagccagctgcaggatggccggatcgacgacggcgaccttcttgttatggttatggtcgtcgcccttgcccttgagcgaccacatggcctgcagcctcggagctgtccagtgcaacggcaacggcaacggcaggcgtgtgcagtcagagtcatcgtcatcgtcacgtcgtcctgcagctcgcttgccgatagccaacgctcttgcttggtccagcaccgtctctcccggtcccgggaaggcaagatatgaagcttggtacagagcgagcactccgtcgctgtcagttattaccttgtcgtcttcctctctcaatgcactcatcaacatgtctgtagcagtgatagtgaaatataccaaggccttgtttagatacgaaaagattttggatttcgctaccgtagcattttcgtttgtttgtggcaaatatgtaccaat

SEQ ID NO: 22268 - DNA, 549 bp, Sorghum bicolor
  Clone ID: 13586638
gggcctttgtccttgcatggtattttaacaggtaaatgttttccttatgtttaatataatatattacaatctcatatactatttgtcggctgcacttaggttgatccatggagtccttagcaaacataagcctttttccttaccaattcacccttaaaatatgatgctggatgaaaaacatcgtctaccaaaaaatgtcggtacacaaacctgtgacagatatgcaaagatgctttataaggttcacgaataattgataactcaaacctgtttatgtttgaatttctaacttctcttctttacaactgtatgggttatatatctggatgcagccaccacatcaagtgcatgtgccactacaaagactcgggttcatctgacttttcaagcaacacaacaacatagtgccagataacaagatcagcgttaccatatcaataacctgaggctttccatgttccttgtcaaaaaaaagaggctttccatgtacaatatgtgtcctcatgtatacaccactaccactatctatgttgttgccctaatgtgcta

SEQ ID NO: 22269 - DNA, 275 bp, Sorghum bicolor
  Clone ID: 13586660
gccctcaaggggccacgggcgccaagagtctcctatcctggaactgtcagggcgtcggcgggagccttgtcagtccaaagatgagtcctctcgccaggctcatcaactctaggaatgctcagctgaaggtctttctggtggtctatggcttctatctagggatcaagtagaggtttcagttatcgagtcctgtaatttttatttctcagctatttgctaccacaagcatgtcagcaaaaaatttggtcttgtttgcgtttatggagaccctgacg

SEQ ID NO: 22270 - DNA, 240 bp, Sorghum bicolor
  Clone ID: 13586663
gctgccgatgttccatcaaatgctaaagagaccccacaaaacactcagccagtaaaggttactgatgatcagtacaagagaggtgatgatgcacttgcagctgctagagcgcgagcactggcccgaaagaaagcaaaggagcagcaattgtgaagtacaaggcagaaaagtttaccgatccttgaggcataatttcatattttatttaataggattgtgtaaagatgttacatggtagct

SEQ ID NO: 22271 - DNA, 566 bp, Sorghum bicolor
  Clone ID: 13586708
acatatgaaccagtgactcaaggatcacaagagcagcaaagccttggcatggaggatcaccagcaagtagatgacattccatgggatgatgctctgatatctgtggggcttattaacttattagatgaaccaatgactgaagaagctgtcattggaggatcacaagatcaggaaagccttgccccagaggtcctgcaagtaggtgataatgcatggggtgattatcttaggtcggcggggatggtcaacttattagatgaaccaatagctcaagaagccgctatttggcaatgctctgatggatgaccctgtgagcccgatgtgttgtggacttggagtcctgctgtgccagcgggtggggggtgactatggcatgctcttctgaatcagatgaacaagtgacagataacatcgatgttaaaaataagaaccccctagcagaaaaataactgaattctgctggagagcacataagaccgtgtagaacttattaatcgttatatactctactgtttggtttcaatatgattacattgttatgtagaacttattaatcgttatatatt

SEQ ID NO: 22272 - DNA, 480 bp, Sorghum bicolor
  Clone ID: 13586731
acttattatcccctgtcgctctacttcatgttgctgcatttgctcttgggtactggttatcaagattatctacctttggggaatcaacctctaggaccatcgcaatcgaatgtgggatgcagagttctgcacttggatttttacttgctcaaaagcatttcacaaatccacttgttgctgttccttcagctgtcagcgttgtgtgcatggctcttggagggagtgctcttgcagtttactggagaaacaaagggcttccaacggatgacaaagatgatttcaaggagtaaagaaactcaactactcaagacatgagctcctagctattagagtgcagttgcatcagaaggatattcatgtttcattactttaggcatagataggaaggcctactctattgttgattatcattaggagttccgcttagcctatatgtttgttgtgtagtatttcatactccctcaattcatgaataaatca

SEQ ID NO: 22273 - DNA, 140 bp, Sorghum bicolor
  Clone ID: 13586763
gctcggaatgttcccctccatcgggtacacgctggtggaggagaacggcgcgctcaagctcggctggaaggacctctgcctcctcaccgcgtcggcatggcgccccatccacatgcccccgtgccgttgatgacagctgt

SEQ ID NO: 22274 - DNA, 636 bp, Sorghum bicolor
  unsure (1)..(636): unsure at all n locations
  Clone ID: 13586766
actgtanagagtgatgtgtacagttttggagtggtaatgttagagctattgacagggcggaagccactagacagttccagagagaggtccgaacagtctcttgttagatgggctacccctcagcttcatgatattgatgcacttgctaggatggttgatccagcattaaatggaatgtacccagctaaatcactctctcgttttgcagacataattgcactctgtgttcagcctgaaccagagttccgtccaccaatgtcagaggttgtccagcaacttgtgcgcttgatgcagagggctagcatagtaaggcggcaatcaggagaagagctagggttttcatacagagctccagaacgagaaggagacctgagagacctttccttctaagcaagtgcttccatgatacaagcgcaaagcagttgggaggctcaatttgcaaggaaaatatccaaaacactcgtatagtcatatgacttggaggtcttggggaactcgagctgatcgcaacaattcaggatcgaatgagtttgagaagatagttttggtacctattgttcaactttgttcattcttctacattcgtcccttttccagtcagtatacttgctgctgtatcaaaactgagggtctgag

SEQ ID NO: 22275 - DNA, 481 bp, Sorghum bicolor
  Clone ID: 13586771
agcttgggtggtggtcactatacagcttatgtttatcatgaaggaaaaaaggggtggtatgatttcgatgaccgtcatgtgggtcctataaccgaggacagtataaagacatcggcggcttatgttcttttttaccggcggatacaggaggatagcttagatacaggtacacacatagattctgacattccaacttgagatggtggaggcaaattttgagcctagtcccggacagtgtatagttcattggtttggggggacagttgtgcggcaatgccgcaattgaagtgagagataggaacaggtgggaagaggtgtgatttggctccaggtagtggaggagggcttgagatggggatttactgtttccagcgtgcagaatcaggtggcagcagtgcaccgcaggcaggctgttgtaggctgatacaatacatgttgtttctagggttcagagggggagataatttatcctagttccgat

SEQ ID NO: 22276 - DNA, 637 bp, Sorghum bicolor
  Clone ID: 13586773
caacagagtatctgactgaggagaatgggtatccattggatgtagacaggctgactgaggtcacagaagggccattcaagggccacctatgtgctgagccatcaattgatcggctgagggatttaatgagacatgtcgttgacgatagagatgaggcaaggaataaagggaagaaggcaagggaggacatgatcgagaggttctctccagaagttgttgctaggattgttgctgaaaagattcaacaagtgcttacccacactcagttgacaaatgactagatacaatgtgaaaccagaaagttgatgcaccatggaatgccacgtatgtatgtttaacactattcttactcgttatttttccaaagagtcatacatatcctttccttgtgattgagttaatgtagaattagtgtggccaaataagttttgattcgatgcatcgatcttaattgtattcgttgccgattaggacttcaaaattcttttattgagtttagttgttcagtggttgctaaacctaatacagatagtttgggggttgtaccaacttgtgttgtcaagttggaattacaatgtttaaatgtgctatcaatatatgtataatgcataatcaactagagtgcttacctatgaat

SEQ ID NO: 22277 - DNA, 656 bp, Sorghum bicolor
  Clone ID: 13586774
tgaagttgatcatgttgacttcttgaaaccagtggatgttggagactctcttcgattcaaatcatgtgtcttgtatacccagcttgacaatccagagcagcccctggtcaacgttgaagttgtcgctcatgtaacaagacctgagctccggaaaagtgaggtttccaacacgtttcatttcaccttcacggtctgtagtgacatgttgaagaacgggttgaagatacgcaatgttgttccctcaacggaagaagaggcgcggcggatattggagcgcatggaggcagagggtttatgtaactaatccttctgcagatccacttgtttcggacgtactttactttgtttccacaccgaaccaagggggattgaggagactttgacttggaagggattagggggttaaatcctccttaatcccctccaacccttggtttggggtataaacgaacaaggccgtaccacggtaccagctaacggggaatttagcgacgatttgagcagcagctatcagcagataagtaacaagccggcaatagaacggcatagttgtagctccatggtactatttgtgattattttttacacagaccgcatggtgcgtataataacatactcctcgagactcaaaatgtctttagagaaagcacctcttc

SEQ ID NO: 22278 - DNA, 492 bp, Sorghum bicolor
  Clone ID: 13586780
gcacgaggggcgcgcttgcacatccggcttcgtcgtcacaaggtgcgtatagctagcttcaccggccctacttattgctactgtgtatgcgcatcccatatagtagtatatgtgaagaatctacaaaattgcttgcctctgctggtatcaaattagtttaataaatcttgctttaggaaaaattcctttagcaagtttcgattcaaaaaagttagaatagagatgactgcagattgtaaaagtaattatgaggatagatgcagaccttcttcttttaataattgaatttagaacagagatgactgcagattgtaaaagtagatgaatgccggctttatattattatatacacatgcgcgcagatcatcagcaaatgtgtgcgaattccaattccaacagtggtgaccagaacgacgacgacgactacgtcgttgatagccacatcgtcgaactctccaagatcatcgatcgtgagatacgtagcaacacctg

SEQ ID NO: 22279 - DNA, 498 bp, Sorghum bicolor
  Clone ID: 13586781
gcacgagggcttgttagagaaaccagttagtaaggggcttcaatcaacatctcaaaaaaggcgagcttctgttgtcttggcaatggcatcatgtaacgatagtgttgatattgctagcttggcaccatgtattgacaatgacagcatcagctatgaatctggctcacatcttatggaaaaggtaaataaagatgtagtatcggaaccgttttggcctgacttggtgtccaatgaaaatgatcctaacaagcataaggcaagcacttgtcctgaaaaagtggtgaagcaacaaggtacattattgtcatttaagccccacttgcctaccaagcgtaagaaaagcagttatcctgaaaaagtggtgaagcagcaaggtacagtgttgtcattcgagtcgcacttgacacttccttcacgaccatcagtgactgggtttggcaatttaaactatggtcctaaactttatctgagtgatcaacttgaacgatcctcttctca

SEQ ID NO: 22280 - DNA, 290 bp, Sorghum bicolor
  Clone ID: 13586797
gcacgaggattgcatcacgccatcaccacggctcctcctccacttctctgctctccctcgctgcgcccagtagcgccaaatcattttatcggaggccatcgcccgccctcgccccgctgcttccaggccctgagtctgtctgggactcaactgaactgtcaaatgttagtaaaggaggttgagaaaccagtacgaagctttatcaggaattgcttccactcaagatggagggaatgagtggatggttgtggaaggctacgctcatggaaattccgaacaaacatcacagc

SEQ ID NO: 22281 - DNA, 470 bp, Sorghum bicolor
  Clone ID: 13586814
cgacatcagctcagctcagctcagaggaaggacggacggcgagatggcaagcggggaacaaggcaagggggagacggtgctggtcaccggcgccagcggcttcatcggctcgaccctcgtccgaggcctccttggccgcggctacaacgtccgcgccggcgtcctcaaccccgatgacagggcggagacggaccacctcctcgatctcgccgccggcgccggcgacggccgcctcagcttcttccgctgcgacctcctggacggcgccgcgctgctcgacgccgcgcgcgggtgctcgggtatcttccacctcgcgtcgccctgcaccgtcgaccccgtcaaggacccccagaatcagctgatggtgcccgcggtggaagggacgcggaacgtggtgcgcgcggccaaggacgccggcggagtgcggcgggtggtggtgacctcgtccatctcggccatggtgcccagcc

SEQ ID NO: 22282 - DNA, 551 bp, Sorghum bicolor
  unsure (1)..(551): unsure at all n locations
  Clone ID: 13586815
gcacgaggactcattctgctacagttatcattgcaccaattggagatttgcctgatgaaaatgctagggcatcgtcccaagacaatatggaaacatcgacatctaaattggttgaccatgatgctgataacaatgaatcaaataatttattggagaggatttcacagttgcaggattcaattagcacagtagaatcacagctgagtatggcatccttgagaagagactgcctgggtagggattctgttggtcgattgtattgggttacaggaagacctagtaagcgtcctcgtcttgttgcagatggaagcatgctgatacccaaggacagagacattagcatggttacaagccattctcagtcaacatttgataaaggatggaattcggcatcgcttgttatgtatgaatctgatgaagaaatcaagtctcttgttgactggctaagagacattgatccaagggagaaggacctgaaagactctatcttgcactggcaaaagtctctttatcaccaggctagttntcccatcactgatcctccagtgtcc

SEQ ID NO: 22283 - DNA, 525 bp, Sorghum bicolor
  Clone ID: 13586816
gcacgagggagatgagtactatgatcaagatgagtatgaggaggaaggttcgggtgctggggatgagtatgttgaggaggaagagcctacagagggacaaaaggagatacttgaactgagagaacgattaaaagagcagattaggcgaaaggcaaaggctgctgctgcctgcactgctggccgctcatcttcttcacaaatacctcaagccagggacaaatttggctctttctttgggccatccaagccggtgatttctcgtcgagtgattgaagaaaggaaatcattgaaagaactgcatagcacaattgcaagggagccaaggccttctggagtacataaagatattccatcgtcctctaataaagtgcaaagtaaaggaaatggacatcagcataaacagaagattgttaatcagcagttgcaatttgcaggtaaagaggaaggttgaggcacttaaggataaccgggattattcatttctactctcggatgatgctgacctttcttcaccctctccaaagg

SEQ ID NO: 22284 - DNA, 487 bp, Sorghum bicolor
  Clone ID: 13586832
gcacgagggccagtcgccacgcgacagcgacgccccgcgcccgcggacgccgacggctgggccctgcctgccgcctgcgcctctgcactctggggcgcggcgcggggcccaggcgtcggagctacacgctcgcacactctagaagagttgttgtgcggcgcccgccgggcgcggcggctgttggatcccgtgccgctgcctcgcctcggtgcgtcgtcagcgtccccgcgtcattgtagctgccgctgcgtgcctgcgccggccagcccgattggctgcttcgccctcgcttcgcttcaaatgatagaagccgcagccggtgcaggctgagcgaccgcgagcttgacccgggcgcacgcggcacgtcggctcgcacccagccatgtcggcgcctggattcgatgacccccagcttccgccgctgcggctgcgcgcctcgtgcagcggcagcggcggcggcggcggcgcgatcgccagcccacgctcc

SEQ ID NO: 22285 - DNA, 488 bp, Sorghum bicolor
  Clone ID: 13586842
ggaggatacaacatgcataatttggtcgaccatttccatcagcgtggtctttatcgctcaatattcctcagcataatggaaggagaggaatcattgtcacgttattctcctgaaattgttgccaagacatcaagtgctgaaaccatagctcttctgcctcttattgttcttatgcatggaactgaagattattcaataccatcatctgccaggttggttcatattctttttatagatgtttgtttaggtgaagggcaaaaatcaagtaaacctagagttttggttgacatgatttctctatgcttgtcatgctgttctgttgaaatgaaactctacgacggtccaaatacgttagcccttgaatttgacaaaagcaactttcctacagatgcttaactcattggactaaaaatcattggctattgacaatttgacatgatagaaaccagttcaatagaatttactagatggactcatgaagccatgca

SEQ ID NO: 22286 - DNA, 312 bp, Sorghum bicolor
  Clone ID: 13586846
gcacgaggatcctagctacccaccctgcactacgctgcagcaggcttcagaaattcatcagtcactgcagagcggtgcaggcggcctgaacctgcatcaccaaaccaattcctgaatcaatctgatactgcgatttgcgaggcaggtcaggtactgacgtagtgcatgcctagcagctagctgaaagatgatcttgtttcttctgctattgtaacgactttgtaattgcaaatcgtctcacaatttgcactgacaacaagagttcaatttgtttgcacctgcaatcttggtgcagcagtaaacctgtaccaa

SEQ ID NO: 22287 - DNA, 482 bp, Sorghum bicolor
  unsure (1)..(482): unsure at all n locations
  Clone ID: 13586848
gcacgaggccaagctcgacgtccctacccagccgccgccgcctcctctcctgccgtccgtagagccgtcgcgatggcagcagcccctgccggtgcccccgcaatcaccgcctcatcctcctttcttgcttcgccgccgttcgctctcaaggcatcgacgactagccaccgccgacctgcggggagagtctccgtcaacatccgctgcgtcagtagcccgccggccgtcgacacatcttacaagactaatgtcccgcgcaatgctaacatggccaagctccaagcaggatatctgtttcctgagattgccaggagaagagcagctcatttgctgaagtatccagatgccaagataataagccttgggataggtgacactaccgagcccattccaaatgtcataacaaatgccatggcagagagagcacttgccttgtcaacaattgatggctacagcggttatggagccgagcaaggtgaana

SEQ ID NO: 22288 - DNA, 298 bp, Sorghum bicolor
  Clone ID: 13586856
gcacgaggcgcaattccatcctgctgttcggtaagtccacctctgatttgtttatctatacgaccttctctgcctgtatccgtcacgctggattgaacatggattcagactccggcgagggtaatcggggctctatgttggtcgccttgtgctcatcctccctgtgatgagttctttcctctactgttgcctgctttgtctgatctgggccctgtctgataaatgataaaaatatgtccccctttttttccggtggaatagcatcttgaggtaggcgatgatacatgaggaatttgag

SEQ ID NO: 22289 - DNA, 512 bp, Sorghum bicolor
  Clone ID: 13586858
gcacgaggcttgctgacggtttcttctcgtccggtcgccatggtcagctccgtcttctccctgctcgtccttgcccacgaacattgctctcatctaggtctttttcattgttctgtgaagtacagtagtaaactactacgcagttacatgttcgctcgctgtcattgtttgttttgttgggtcgaaataggtggatgcgtggttcttggtgtctatttttgcacaagttagattggatgtcacgggaatgtgccttatttgactgtggccgctagcatggttcgccaatcgatgacaagtgtacacctcactgtttcatttgttcagcatccgctgatctgaaatgcccttagttgtaactgtacctaagattatctcagcaatcatgagtagttccaattctttaacttgcaccgaaaagtttgctcattgatctgtgtaaattttgctactttttgcctgtcagattagatgtgcccattatgttagaactgccagtcgtatatttccat

SEQ ID NO: 22290 - DNA, 524 bp, Sorghum bicolor
  Clone ID: 13586865
gcacgagggccgctttcgcccccgcccccgcccccgccctcgccgccggcgagatggggtacacgcattgcggctgcgacggcggaggaggcgccggcgggttctggagcctggacaacatcttcaagtggcagaaggtgagcgacctgctcatcgcggcggcctacttctccatcccgctcgagatcctctacttcgtcgcggggctccgccacctgctcccgttccggtgggtgctggtccagttcggcgccttcatcgtgctctgcggcctcacccacctgctggcggccttcacctacgagccccacccgttcatggtcgtgctgctcctcaccgccgccaagttcctcaccgcgctcgtctccttcctcaccgccatcacgctgctcacgctcatcccgcagctgctgcgcgtcaaggtccgcgagagcctgctctggatcaaggcccgcgagctcgaccgcgaggtggtgctcatgaagcgccaggaggaggccagctggcacgtccgcatgctcacc

SEQ ID NO: 22291 - DNA, 424 bp, Sorghum bicolor
  Clone ID: 13586877
gcacgaggcaccctctccgcctccgcctccactgccgctcaccggagttgatctgctccgacgacgacagccatctatacatgtagattaaaggagctgcagctgcttttggaggacaacccagttgcctttgaagttgaaaatgacggtggtgaaggtggaggaggtggcgaaggcggacgagaaccctgcgctggttggagggctggacgatgaggccgagacggggtatgtctcgcccgacgacgacgaagacgacgagaccgacagcgacggggactacgagatccccagcggcggcgacggcgtgcccgagctgaggaagggtccatggacgcccgacgaggacaagcgtctcaagacctacgtggaggcgcacggcgaggggaactggaacaaggtgcagcggaacgccgggctcaac

SEQ ID NO: 22292 - DNA, 446 bp, Sorghum bicolor
  Clone ID: 13586879
gcacgagggggcgccgtcgccgactcgcccgcgatcacgccctccaactccgagcgctacacgctcgattccagcgtcatggactcggagacccgcagcggctccttccgccacgagcccgccgccgccgacgacctggccgccgccgccgccgggctgcagcgcccctgcaggagcttcggcgagaccaccttccggaccatctcgggggcctccgtcagcgccaacgcgtcctccgcaaggacgggcaacctcaccgtctccctcctcgccggtgacgtgcaggagcccgccgccgcgttcgagagcaccggctccttcgctgccgtgcccttgcagccggtgccgcgggggtcggggccgctcaacaccttcctgtcgggcccgctggagaggggattcgcgtacggcccgctcgacaaaggctccggcttcatgtctgggcc

SEQ ID NO: 22293 - DNA, 491 bp, Sorghum bicolor
  Clone ID: 13586884
gcacgaggattaatttgcctcaaggtatcatgagcaatcaagtgggagagaataattgtactgaattttccagagacaatggccacatgcagaacattaattttaatttgcttgaaggttgcgtggacactgatctgttgaagattaagcatcctgttaactagttttctttgctaatactttaccttattatcatctaattttggatgctggtgagacagtttatgctgcgtccatagaaattgccagtttaagaagcctgttaacaagtgatcaagttggacaaaacaatcttactgaagctgccagaaacaatgacaccggggaacaatagtttccttgaaggtgtatcatggacctggagtacaatgcatcaacggatttttctgttgcttgggcgcacctagagagcaatgatctggacctgacaggcccttctgatgaccgggaggaagcagattcattttggatgagtcagctggaaatccttg

SEQ ID NO: 22294 - DNA, 559 bp, Sorghum bicolor
  Clone ID: 13586905
ctccttccctccccgtcaggccgtctcccctcccatatttgtcctctgcagggactggcttgccatgacagaatctcttcctgctgacgaggtatgcaagtccctcaaagatgtgatgcagctcctccgtgactcgtttgagcaccaggatgagcagaacaagcccagaagtgagtcgcaggagtgtgggatgctggagaacaacagcgaaccagaggcggcgaagagtgggagtgggagtgtagcgtcagctgaagggctgcagtcgagactaacagcagttcttgaccgcctgacaaagttctcggaggcatcactgaagtgctacgaggagctcaagcagaactatgagatggcttgtgatgattacaagagagttggaccaaatgctccacatgcttaagatatgtcgattgtggtgtatgacttcttcctatctgttctggatgacaaattctagtgttttggtatatattttgtgaacaatcaggttgtagtacaatcttttgcctaatattagtgatagtgcagtcagttatgtatgcctcagtgttacaga

SEQ ID NO: 22295 - DNA, 404 bp, Sorghum bicolor
  Clone ID: 13586919
atgcgagagcagcgacagcgacgaatttgtgatgacaccgccagcgccgaggagcaatgccaacatccagtcctacatcaacctcgcatttgatgtcgacgacgactccgcctctgtcagcagtaacgacttcattgcagccaacacctccttggaagagtatctgaagggaagatggagccgatcatcgagctttgactgaccgatacatggcagagttaccccttattagtgtatagatctttttcttttcttcttctaatttaagtctcaattttgcgccttggatgagagttggcacatgcaatgccctccaccaggaaatcctttgattatgtcttagttcttttttttttatcgttttcttttgggggtctgtcttactctctgaagagacaaccctg

SEQ ID NO: 22296 - DNA, 460 bp, Sorghum bicolor
  Clone ID: 13586935
ctatttccatggtgtacatcgccgccttcttatcgaccgaacccaagatgggtgtggtggacggctatgagcctccggaggccaaagccggcgccagtcgcggagccattgcaatgatttacatctctggagttggctgggcgcttgggtggaactcaatgcagtatttgctgacagccgagcttttcccgctgcgaattcgtgcgttggcgacttcaatggccatgaccttgcattttgtgaaccagtacggcaactcgcgggccgtgcccaacatgctgcttccgacacccgacggcattacacccctgggaaccttctggttcttcgcggctgtgacgatcgtgggtgggatatgggtcctgtttaccgtgcccgaaacggcggggcgaagtctggaaagcatggaccggctgtttgaacttaccgtggtataagattggattgtatggtaaccggg

SEQ ID NO: 22297 - DNA, 260 bp, Sorghum bicolor
  Clone ID: 13586947
catggagactccaaaccgatggaatgttctggaatcagatgctgctgcaagctctgttccaggtaacgagtggaggagggctgttccatgcaccgatgcttcatacagcgcaataccaaacgctgggaatgctgggccatcagtgaccaagctgcagccggatgtggacgtggacgactgggaagaagcttgtgaatgaggtggcattgggaagttcagtccagatgttttttgttcttctgggatcttgttttagttta

SEQ ID NO: 22298 - DNA, 333 bp, Sorghum bicolor
  Clone ID: 13586957
ctaaccgaagcgcagcgcgggcacccaagcagcagcccatccagaggccacaacctgcatccaaccggtcgctgccaccaccagcccagaagccaagccgccgccgggattgtgttgtctgcaagaaggaggaggcttgtgtgatcctactccagtgtgcccaccaggttctgtgtgttggctgcaataagctgcacgaggataaaggcatctctcgctgcccctgctgcagcgccgaagtggaagagagaatcagggttttcggtgcgagctccaactgaggcaccaccaggttggggtgaagtggaacttgtggttgagttttcttttttc

SEQ ID NO: 22299 - DNA, 335 bp, Sorghum bicolor
  Clone ID: 13586958
tcccactccggccaactcgcccctgtggcactgcccccttcccctccgcatcgcgctgccccttcaactgctgcggtgtgcggctgcctcctcccagagccccagcgcgaagtagtcggcaccagcggtggcggcagcgccccttctgcagcaccggcgaacaacctccctcggcggcttcaagcaagttgagcacagtagatacagaacaccctagtccgtagatccacccttcagtcaactgttgaaaagttccttatctaattcttttgattgcacatttggtttacaaaatgagttcaaaaattggtcaaactagaaactatgcgcggtgt

SEQ ID NO: 22300 - DNA, 432 bp, Sorghum bicolor
  Clone ID: 13586963
ggtcaatgagagcatatgccactgcaatagttgctgctgagtatatcctcagatggcttcctagaggcacacatgaatggtccaaactggttacccctgaggagcttgtcctaatgctgcaaagggcttctgtctccgtcgaagagatggcagggttcgtttataatccgttgagtggagagtggtccctgtcagatgatatcggtgtgaactacattgcttttggcgtcaagaagagcgaagcatcgtcgacaaatggaagagaagcaggtttatcatagttgaagaaaaagaaccgaccttgaattattggtgcatcattttcagaggaccaaatcatcatgtcactgaaatcttaatgctaaggatgcaaccaagtagcaaaagagaactcccttgcccttttttttttttgtcagcattggaatatga

SEQ ID NO: 22301 - DNA, 389 bp, Sorghum bicolor
  Clone ID: 13586968
gcatggcatttcaaggttaagtgatacgttctctatcacacaaatggcttcaacgttttggttgaaagctgcattcatatgtatatttctcttcaaaggaattatataggttactggttagtggttacaaggtctagcaaagttgccattgcaaaaacattgatacatacaaaagtggtttctgttatcctgcttcctccttgaatcactgatgctagcttttctttgatttcgttcatacctgtaatgctagatcgtaccttagccactggtttggaaccttttgggttgcaggcttcatgatctgctgaatttgttcattaagagaagtgttgcagcttctagcttacctttcgcctgataatgtgtcagatcatgtaacatgcaat

SEQ ID NO: 22302 - DNA, 472 bp, Sorghum bicolor
  Clone ID: 13586973
tgcacattaccaatcaccgaggcagatgttgtgtttgtgggacaagctacaggctggaaaagcccaatgttgcaatatgagatagcgacaatggaggtggtggtactggtaggcccatccttattcacgaagaagttgagaacctagaagcctcgagactaacttaaagaatgttggctgaaaataaattaagccctcgagatgactaacgaatggccatttaaaggatttcttttggtatagctgaccaggcggtgtttcagctggaaatggaaacaaggggaatggacagcagcctgtaacccctttcctgattgagcatgcggcgcacttcttttctcaacgtatagatggagttctgtgagcagtatgagacctgcttggggacttgatttgtaaatgggacgggtagaaagcttagttaaatatctgttacttttggcatgattggctgtggttgcagtcataaaca

SEQ ID NO: 22303 - DNA, 547 bp, Sorghum bicolor
  unsure (1)..(547): unsure at all n locations
  Clone ID: 13784249
gcacgagggcaagtcttctgctgcaatgagccgtgttgggagcccctgtatgtcagccagtgaggcacgctccgttgggtcaagaagaagcactttagggcatggaactgaggatacacgactgaggtcgaatgatgtcgtgggatcgaattttagtggctgtggtataagctactgctggtcaggagcatcgaagtaccgagaactttattcagatagtgatggtccagatcaacctctcttgtctacagatgggaccgaggctgcattccaaggcaatgtaccatacactgagacaccgaggtgtttaagccagaaattccgccctcgttctttcagtgaattgatcggcctaaatgttgttgcccagtccctcttatattcctcttgcaaaggaaaagttgctccaatgtacttgtttcatggcccccggggtacaggcaagacatccacagcaaggatttttgccgcagcactaaattgtgtatctcttgaagagcanaggccatgtgggttctgtaaagagtgtgtcattcttttctctggg

SEQ ID NO: 22304 - DNA, 515 bp, Sorghum bicolor
  Clone ID: 13784250
gcacgaggcataccggtacaccaacagcttctcgtcagtcgtcacgggaatagcagtagaccgtgagacctgagtagatcaaatcccttgcagttgcaggccagcaaggttgcgcggcggcgacgcagttgagacgagggagcaacagcaacctgatccacaagcgcgccggggacaagcccgccgggaccccgacgtacgtgcggctctcccggcgcccccatcgatttccgtcgtccccactccgcttccctgtttccctcgacgacgacacatcttctcggctgggtcgacgtctccctccactcgtcgactcttaaaccctccccctccccctccccgtcagttccacgagcttcggagcaccaccacctatcagcatctcgtgattgcctcctactcctaggttccgccgcatggcgccgtccgccgcctgctccatggcctccgtctcccgggccctccgcccgcgaccgcgaccgcgcgccgccgtctgctcggctgctcgcctcggg

SEQ ID NO: 22305 - DNA, 460 bp, Sorghum bicolor
  Clone ID: 13784279
ttaattacctttccgtaatgttgaatgaaagctccacgtctggtggggatgtgctcatctacatcgctcttgccgtcgttggcatcgattggcagccgtgtcatagggcttgcattgcatcggtgtgtcgtccttcgggtgcgggtgcgggtgcggcgcggagtgcgagtgggattcctcgccgcgggcggcagttcctgatctgctcccttcctctccgcggcgaccggccggcgccatggattctcggcggctgcatcgtgcgcctggtcgcaatggttgtgcggtctttggcttgcttcatcgaagccatcggtcctgttcctgtcgctgtgacgctgttgctgtggtttgtgccgcgctgctggtggcgttggcatgcgtgggctcttcctaaacaggaaggacacgtaggtacatgtgtcgaacatgcacatcgcagtcggttcagtactctgct

SEQ ID NO: 22306 - DNA, 677 bp, Sorghum bicolor
  Clone ID: 13784281
aatatactctcgataatagcatcgtcactcgactaagtgccggattctcggaaatagaggagctccggtttggattatcccaactaagtacagaaacagtatatgctgctttgcgctgtcctaaacttaaagttctccatatcctacataggaacccagtaaaggcaggaaccaagctgatgcttcaggattctatcctgaagcttctaaacgaaggactcgcaagtaccttaaggtacattatctttgatgacgatccagtctatgaaatcctcatgaagccctaccgtcgggtacaagcacgatctcttgttggctatgtggccaatacaatacttctgggcgagaaaatgtttagttggatggggaacgcataagttgaaaaaaaggcagatgaagcggttctttgtttttttctttaccttttttgtttctctgctttccttggtttactactatcattgactcattcggtgttgagtaatgccagagagcacactctttaccagaaatgaatggcattgactgccacaggaaagcaagaagtttacagggagggaagacgaaaggggggggaatttgatcagtaatatggctgcttagggttataaattgtcagttgatctacccactgtctcgttaggcttgatcttgaagatttatgtgttatgtcaact

SEQ ID NO: 22307 - DNA, 576 bp, Sorghum bicolor
  Clone ID: 13784289
gtacgctagcaggtaggcgaagattatgtcggaatgatcagatgtcgaagtcggtcgaaggcacctaatttttctcgcttttaattgttgtgcactttttaccctttcctttgtgttttttcctccccgcccctgctagtgtttctattatctgatttcgacgccaacggtgggacgtcgttgtttctgttcttctatgtcacgcacaaaaaagtcgtctttcgcatctccttgtcgtctcggtgaaatcgaaacgctattcaatcttgcggccaacttctcaactgtccacacacaagaaaaggaacaatacatgtcgccgcgcttcgatcactggaatactgttttcaattttttattctcgatactctccagacaatcatggcggcaaggacgaggaacagatctacatttacgttgtaattctcggattatctcatgggtcagcactgctacatttcaactcttcgggatgttttcgctagtcagctcttcgccttattgcgtcttgttcacaaacacaccctttacgtaacgactcgatttattcgaccagaaaacacaaaaacaaaaaaa

SEQ ID NO: 22308 - DNA, 695 bp, Sorghum bicolor
  Clone ID: 13784295
ctgaagcagctgcaatgttaataaggtttggaattgccagatgcagtgcaaagcctgaacatgtacagttccatgatctgatcaggctatatgctcgaaagcgaggaggcacaagaacagctcaggccgtggtccaatcagtgtacctccaaggctcaatcaaacattcctccgagcacctgtgggcttcgtgcttcatggtttttggatttggttctgatcctctgttggtagaactgagaccatctgaactaatgttctttgtgaaacagattgtcatgccacttgcaatacacacatttataacatactcccgctgtaacgcagcactagacctgcttcgcctgtgcactgatgcattagagagagcagctgagtccatgcttgttcatgctggaaaatggagagaaacatcattctcctgctttagacaagctcattcagaagctcagtacacttatatttggcaggagctggctcttctgaaagcttctgtactggaaacaagggccaagctgatgctccggggtggacaatatgacattggagatgacctgataagaaaggcgatatttatccgcacttctatctgtggcgagcaccatcctgatactgtttctgctcgagaaaccctcagtaaacttacaaggcttcttacaactgttcagcttagttgattcatatagtttaggagt

SEQ ID NO: 22309 - DNA, 477 bp, Sorghum bicolor
  Clone ID: 13784303
tcctgcctcagcaagacgccgtccacgcggggccagccgaagcggaccgtgcggttcctggacagcgacgacggcggcgaggcggcggcgcccgcccccgggctcgagcgccggagggtgcaggtcggggtggcggagctggagcagatgctgctccaccggatggagatggacagcgacgaggaggacgacgaggaggacgaggagagcagcgacgccagctccgacctgttcgacctcgagaatttcgcggccgttgcccccgacgccggcgccgccgccgcggcgtacagggacgagctgccagtgtacgagacgacgagggtggtgctgggccaccgcgccattggccacgggtacgcgcacgggaggagtaccagagtcgtgtgatcttgctgccgggattcatcattcatttctttccgggtccggagcgccaggggtaactgtaaaatggtggtggagtaactgtaaaat

SEQ ID NO: 22310 - DNA, 500 bp, Sorghum bicolor
  Clone ID: 13784314
cgtctgcgccgccgtctcagcgaggagctcatcgtcaagcgtatggtcgctgccgcccctgctcctgctggtactggcaacggcgccatcgccgccaacgtccccgcgcctgcggggcagacagagccctctcgcgcctcgcacctgcacactctgcacgcgtggacgggcatgctgaacgatgaactcgagaacgacgaccgcaaggtggcgacgtggtacgaggagaacaagaaggcgatccagacgaggattgagagtctgaagacgaagtccgttgcgacggatgtggcgtcgctgcttattggtaacaaggagggtggtttgaagggtgtgcagcaggtgcttagcatgttgcctgttgaggagaaggaggctgttcttaagtatttgtcttcttagtttactttgatttgatgtttatatgcatgcatggatataaaatgggatgattggttttgtttggtgttgagattgtttgatgatttatgtcgtgttat

SEQ ID NO: 22311 - DNA, 628 bp, Sorghum bicolor
  Clone ID: 13784326
ttctatgcatgcaatggcagttaaacatgggggaaagtttatcgacacatttctgaaagccttcagctttctagagacacatttcgagcaacataatggcaccatagtcaaaatgctaagaatacttcagaaagcaacaagaataatccaatccatatgttcagatgctaagggtaacaagcggacaatgatcacaagcaaagtacctcctgcaaagagatctatggaacggttcttgttccaagttaaggcgctgctacacaactgctccgccgagaaggaattccagatgggcaatttgaagcacaaggacttgcaaggccatgtggtgagctctcaagcgtatgggagcgtggatgaggaagatgaggagcagatggagaccgactccgatgctccggctgatgaggagaacaataacgacaatgccatggacgaggatgcagtgggagggagtaacgagacgccgatggaggaggaagaggaatagtggcataggtaccaatctgtacatctctctctaacctgagcaaaatttctccccaaaattagcagtttgtgtagaaagataggatcccatcaggttgcaatgtcacttgtaaatacaaagtctaatcaggagcccaag

SEQ ID NO: 22312 - DNA, 650 bp, Sorghum bicolor
  Clone ID: 13784345
tgtacaactcagttgttaatcagtacgatgtgctcaaatctgctatctttagagatcgtggagcagctgtatcaaacaatgtcatctcattgtcacaaccatggagatgaatgttagctttctcagtttgggtccagatttattactgaagttaccttttcagaagagcaggtgaactgccattgtgcaatttcaccggagaaactcttgacctttaatctttttgataccactcgactttatcagtcatggtggagcctgtcattgtcatgcagatccttgctaagaagtctgtggacaactgttggttggtcaagggtgactggtgactctgcacatagggatcctcgtaactgttgcatgcggtcgtccgcaaattactggttgctcagcaacgtgctggttgggcactgaggaatccgtcaggttgcatcctttttgccttgacgtcaatttgtgtagttgaaggttgaagtgataaattgttttatcttgtcttgtcatcatgtatataggctcgagtcttttttggctccacatttttttggagatataaaagcagcaggagttatgacatgccctcagtcggccctccttgttgaaaccctttggatgtaacctgtctatttcttatatatactcacgaaagt

SEQ ID NO: 22313 - DNA, 481 bp, Sorghum bicolor
  Clone ID: 13784353
cgcatcggggctgtctgcgacaaccttgagctgcccagcggatgtaatcaaaacaaggatgatgaaccaaggtaaggagggtaaagctatatacaggagttcttacgattgtttggtcaagactgtcagacatgagggcgcaatggcactatggaagggtttcttgcctacatgggcaaggcttggcccatggcagtttgtgttctgggtttcctatgagaaactgcgccaagcatcaggtatttcatcattttgataatggaggctctgtttcattcgagaggtttctagaatacagaaattttcgttgctgtaacttcattgtggcttcatataatcatatgggatagagccctttttattttaatttactggactctgggtttttatcctttgttgtttccaagggaaaacacagatgaagctggtatgtctcacattgtaatttgactatgtacaaggctattagactctacagaaa

SEQ ID NO: 22314 - DNA, 103 bp, Sorghum bicolor
  Clone ID: 13784362
ccctaaattgcgtgcttttgtatctcgtgtcaacgatgatgtaaagcagagcttgccttctcacgcgatcattgaattatgtctgatctcaactttgttttct

SEQ ID NO: 22315 - DNA, 689 bp, Sorghum bicolor
  unsure (1)..(689): unsure at all n locations
  Clone ID: 13784385
ccacggggaaccntaatagggcaagcatccctaatggtgtgactgatggtggcagcggtagcgcaaggggagattacagcaaccatgcatcgtaggggtgctgactgagcctgttctcaggtttggttgtgccgtagggggtgctgactcacctgtactcaggttgccttgaacacgtttcgttgataagtatggtctatgaactgcgaataccactggtgatcagtgaaggtcaggagccatgacgaaggttgaatcctgcttttagaacctgttgagaagatcacctgttggtcagtggatttctacgttttgtacagcttcttgtttcgatcagtattcagtactagtttgttacagtacctatagtagagctctttgtatggtggatctatggcatatcttttttgaaaaaggtaaaggttccattgcatcacaaacatgttataaacatgttacagagattaggattttgttaccccagtcattgttttttgtagcacatgcttgattttacaagtcggatgatgcgcaaatgcctggcaagaaaaaagacctgaattcaagatgtttgcttgtcttgccttttttgcaaggctatcagcaatcttgccttgtttagttcccanaaaagttttgcaaaaaaattcagattcaattgcacagtttgtctgtaatttgcgagaatg

SEQ ID NO: 22316 - DNA, 227 bp, Sorghum bicolor
  Clone ID: 13784387
cgagaagattgaacgcttgacgcccctgcatgaaccccgtttccagcattggcactttcacatatggggacgaagggggggggcgttgtgttgtacgtgcaggttcataaactgcctagcatgagggggagctagagcaggggttgtttttatttagcatgagtttggggcagaatttttttgcccgaggcacgagctttgttttagtaatacagaaccgtatggct

SEQ ID NO: 22317 - DNA, 542 bp, Sorghum bicolor
  Clone ID: 13784393
cacctccagggaagatgttgacttcttttttcacttggagatgcatcttcgtcaggagcatccaccattatgtggaagagatcacatggcttacagatctgcttattttccagtgaaggatgtgatagatggtgatctctgcgagcagtatccctccctcccagctgatatgcagaggaagattgctgatgaactggacagaactcctggtgagatcctgaagaagctagaagacatcaggaacaaaatcatctaagcccccggcttagtgtgaagaaactaggcagggcaatgcaactgtccggtgctctttgcttcaagactgtatccagttcgagctgttgggcagcacttcaagatgtggcagcattcaacaagtttggagcatgctgatctgtacaatctttcctgatgctaactggtccatggtccagtccgcgttttatagttgatgagatagagcatgtacggcaccagaatggtttttttgtgtatctcttagaagtgatttagctgatgtcattgactgtttgttacttggc

SEQ ID NO: 22318 - DNA, 629 bp, Sorghum bicolor
  Clone ID: 13784399
acctgcttctgcttttgagtatgggtgacagtgccaacttccatacagtgctggagggtctggttgaagaggcaagctcgaagggtgctcatgttgaggatgatgcatacatcaagtaccccgttgagttggagcgcaacttgatggaaggtagctacgacaaggtctggcgggagactaagtcggagcgtgttccgtccgaggatttcggtctcttctctaatgttctcatcggtaccatccgcagtgaaatcgcagactgctccgagaaagcttacccttcccttcctatttccaacgccaagaacctcctcttcctcgagtccgagggtgcagtcattgaattcgctcagcagcgcggctggatcctccgcgatggtcggatattcttccccgtcgagcctgaggcgtctggcaggtccgagaaggatatcctgatggccagcggaaccgtgattgagaatgcattgggttatgctcgcgagctggagaccattgtctaaataacgcgctcaattggaacgataatacttcggatatgaaccatcttttttctttcgggcgcggatgtacttgtatacctgtcgctaatgcatgttattaatctagcgtgttcatgaccacaatca

SEQ ID NO: 22319 - DNA, 472 bp, Sorghum bicolor
  Clone ID: 13784428
gcacgaggctcttccgtcctcggcctttttctagggtttcctcccgccccactccgcgacagccggcggcgtcgtctcgcggcggcgccggcgaaaccctctcgcccgtctcctcctcggacgcgcctcgcaggcccctccccgctcgagcaagaaatggcagggcaagcagggaacccagtaaaccaccctataagtcctcacgtgataggtggtgcttttgtccagcaatattataaaattctacatgagcaaccagatcaagtgcacaagttttaccaagattcaagtattcttggtcgaccagattccaatggaactatggtgtatgtaagcactatgagtgacattaatgaaaaaattatggctatggatgtcaggaactgcttaacagagatagagactgcagatgcacagttatctcacaaggatggggtgctcattgttgtgactggatccttgacttcagaag

SEQ ID NO: 22320 - DNA, 414 bp, Sorghum bicolor
  Clone ID: 13784431
gcacgagggttggtaagcatgatggtgatgtgactgatttgtccatatctcaatggatgagcacacgcctggcctctggatccaaggatggcacggttaagatctgggatgatcgcaaacaagtgccattatcaatttttaagccccatgatggtcaagctgtttattcagttgcttttcttacagcacctgaacgaccaaatcatataaatctaattactgcgggtcctctgaatcgagaagttaaaatttgggcttctactaatgaagatggctggttattgccaagcgattctgagacttggaagtgtactcagaccttggaacttgttagttctctggaacctagagtcgaagaggcatttttcaaccaggttgcagtgctgcctcaagcaagcctgattttgcttgcga

SEQ ID NO: 22321 - DNA, 507 bp, Sorghum bicolor
  Clone ID: 13784457
cgtcgagcggctgctggaccgcctgacgctggagcggaagccggacgccatcgtggccgacaccttcctgacttggggcgtgacggccggagctgcgcgggggataccggtgtgctcgctgtggacgcagccggccacgttcttcttggcgctctggcacctggaccgatggccgccggttgatgaagaaggcctaagctgcaaatccttggatcaatatttcccattcccagccctctcgtcagtaaaatgttctgacatcaagatcttccgctccatggtactgccaatgaaacgattagcagaagtgttctccaacgtgcgcaaggcacagtgtgtcctcttcacctccttctatgagcttgaaaccggtgccatcaatggaacaaggcaagtggttccttgccccatatatacagttggtccttcaattccatatctgtcactgaagggtgattcagccaagcttcaccatgagaactactttgattggctggattgccaacc

SEQ ID NO: 22322 - DNA, 359 bp, Sorghum bicolor
  Clone ID: 13784461
gcacgaggcacgtgccactgagagtatcagcaaccgtggagcaatggattcccctactcatggagataaaacccatgatggacactcatggggcccatcttttgatcatggcatggataatgactctctatggaactttggtcataaggacggtgagaatggtgattcagatctcttctttggtccacaaggtcttcccccgataagaaccggaggttcctcatctggtagttcatttgtcaaggaacagaagccgttctttgattctgttcctggtactccaatggagaaacctttctttgattccatcccaggcacgccagttcagaaatccgtctttgattccatcccaggcacac

SEQ ID NO: 22323 - DNA, 625 bp, Sorghum bicolor
  Clone ID: 13784470
gcacgaggctcttgtagccggccagtagtatagccagtgccactacacttgagattcccctccatctttccttctccaaaaggcccatatgctttctcccacctctgtctagaggttgacctcaacaagtaaaagagcttgcgatcgaagcagagatggtggcgatcgatcgacgagtgcacatcaaaagctagagcgagagagagagagagagagaggacggcaagcaagtgcttgttgcactttgtttgtgtgtgtgtgtgtgagagagagagagagatcgagggatcgcttggtggcagagagaatatggataggggagtcgtccacaaatcatcggcggctctagtgcgcgagatgggggaggcaggccatggccatggatggtggagcatgaataatttgatgaggcccccctttgagcagcagcagcaccacccttctcttttcatgccgtccaccaccaccaccaccggtaccgccaccgccgctgtgccatcttcttcttcttctgcttcgtcagctctccattccttctcctcgctgctgctctcgaaccactacccgctgcctacgacgaccggcacgtcgccgccgtggcagcatgacagcagcagccatggcc

SEQ ID NO: 22324 - DNA, 378 bp, Sorghum bicolor
  Clone ID: 13784475
ccctgagtttctcctctgtgtagcacaacattcaccaggataaatcctccctgtatcagaaattgcatgacttctaggcgaagtgttactcctatttgtttgaatcttcgaaggttctcctacagaacttccgagaaaactattactctgcctagagtgatcgccccaatttccagaaagaagaggcctatctatatcctcatcctggacagcgaccggggtcggggccgcctccgcggtctggagcgggcggcgctgccgctgccgctgcccacgccgccgccaccatcgccggaaggcgaagacgaccaggaccaggatggcgagcgcggctatggcagcgaagactaacaccagaggaggggcggccatggaggg

SEQ ID NO: 22325 - DNA, 534 bp, Sorghum bicolor
  Clone ID: 13784478
gcacgaggaatactctcaccttcgccctcgccgcgctcgactgcgggttcgacaaccccgtcttcgccgccatcgagctcgagtacgccgagtctgaccgcgaccccacgggacaggctgccaaccaggcgcagaagctcctcaccttctacgagcttgacctggggctcaaccatgtctcccgcaaggtctctgagcccattgataatggtgccaatcttctagtgactgtccctggtggcggtgacggtccgagtggggttctcgtgtgctgcgacaatttcgtgctgtaccggaaccagggtcacccagagattcgtgctgttattccacggcgtgctgacctccctgctgagcgtggcgtcctcattgttgctgccgccacacacaaacaaaagatgagctcaggatcaagtactttgacaccataccagtgacatcagctgtctgtgtgctgcgatcgggtttcctctttgctgcttctgagtttggcgaccatgcactttaccagttccgtgatattggcagagatgc

SEQ ID NO: 22326 - DNA, 481 bp, Sorghum bicolor
  Clone ID: 13784485
gcacgagggtgctttacttagtaatcatgcgaagacatttaaggataaatatttcccatcagagcctgtctcaagtgacattgcagttactgatgatctccttaaactgagggcactttgtgcaaaactgaatacaacagctgacactatcaaaacaaaagctaaaggaaaatcaaaggctgtggtaggcaataactttgatgtgctatgcaatgttgaggagcaattggatggtataatagctgaaatgttgtctgagcttaacaagggggatggtgtatcgacatttgagttcattggaagtggagttgtttcagctttgctaacctatctgtcatgtggaacatttgggagggaaaaggtgtctgaagcaaacataccaaatttgcgtcatcaagcagtcagacgatacaaggcatttatatcgcttgcccttccaaatgataaaaatgggaataaaaacccctatgacattcctagt

SEQ ID NO: 22327 - DNA, 277 bp, Sorghum bicolor
  Clone ID: 13784501
gcacgaggcttcctcctcctcgaccccttccccctccaccaggcgccctaccaccacgctccgcttgctctgcccctccagccgcgccgccgcgctccgcccctcacgggacctccacgtggaccagccccccgtgggggatgaggccgtgctcgtcatctccgggccggacgcccccgccgcggcggtcagggcgtgggagcacgtggtgggccacagagtcgagggcgacgaggcgatgggaggggaagaggaggagagggaggtgaccggcgcc

SEQ ID NO: 22328 - DNA, 381 bp, Sorghum bicolor
  Clone ID: 13784516
gcacgaggccacgaggccacgacgtatacgcgcgcgccgccgcctcgtttctttaacgaaggcgagatcgatcggtgcgccgccgggatatagcagctcgaggagacaagggaggagagagaggggagcagcgcagagtagcgttccgttcccattcgcggccgccacgatcccaccgtcccggagaacgggcggaaggggcgcaacgccacgagcctctctcatcattgttcgtgcgggaaggaacggccgggggtctcgggccctgccggccatttcgccccgcctcgcgagattctcgccaagccgttggcgtagcgcgggggaaggcggcgatctcgggcagggtcgcggatgctgcacaaatggaaggtcgcggag

SEQ ID NO: 22329 - DNA, 484 bp, Sorghum bicolor
  Clone ID: 13784524
gcacgagggcccacgccgacgccggcggcggccgtggcgggaccctggccaaggtctccctctcgtcggtctcggccgccatggcggaggcctccacctaccccttagacgcagtcaagacgcgcctccagctccaccgcagccccggcggcgcgggcgggcgcagcgcagtccgggtcgcggccgagctcgtccgcgatggcggggtttaccggggcttctcccccgccgtcctccgccacctgatgtacaccccacttcgcatcgtcgggtacgagcatcttcggtccaccctcgctagcgaggggcgggaggttggcctttttgagaaggcgctcgctggggggctctccggcgttgcggcgcagtgcaggtggtggcaagccctgctgatctcatgaaggtaaggatgcaagcagacagcaggatgttgagccaaggcattcagccacggtacactggaatcccagatgctttcactaaa

SEQ ID NO: 22330 - DNA, 580 bp, Sorghum bicolor
  Clone ID: 13784532
gcacgagggccgctcgagccttcgccgcgccgcctggaactgtggccatcggcccaccgctgtacaggcctcgtcttctccgccggcgatgtcggcgccgcctgtgcggacgctcgccgaccttgatggcgacgtgctggctcactgcgctggctacctcggcgcccgcgacgtcgccagcctctccatgtgttgccgccccctgcgcgccgccgcctactgcgacgcggtctggtaccgcctcttcagggatcaatggccatttgagaaagtgccttgtgatgctttggggataagagaactatacatccataggcacactgatatacatcagatgaaatttggtgaccccgtatcagttctttattacttagattctgcggaaacaacaccaagccatctaatgctggataggaactccatctggttttgtcaaggtccagctgccaaaaaactgaatattaattggccagaaactgaaatgacggagaaccacaggaatcatagtgcaaggatcacttgtctgaggttattttctctgattgataccccactgtttcgaagtgatacacaaaagaat

SEQ ID NO: 22331 - DNA, 385 bp, Sorghum bicolor
  Clone ID: 13784545
caaaaaagctgacagacaatgagactactgaggctgcatcaatccattgttgtccagtttctaatttttcagcttatgtcagtccagaagcagctgcacagtcagctactaccaccacctgggggtctggggtcacttcagttgcttttgatcctactcgtggaggatcagtcattacagttgtaatagttgaagggcagtacatgtctccttatgatcctgatgaaggaccttctatcactggatggagggtgcaatgctgggaatcttcgcgtcaacctgttgttcttcatccaatatttggaagccctactagcttaggtgggcagcctcccatgcaaactgtgtggtctactagagttaataaaagcattccaccaacaga

SEQ ID NO: 22332 - DNA, 397 bp, Sorghum bicolor
  Clone ID: 13784549
gcacgaggccgggacgaccgcggatggaccgcctcgtcgccttctcccgccgccgccgccgctggatcctcctcgccgcggccggcgcggcggcggccgtcggcgcgtacaagatctatcaccatccggccgtcgcggagcgtcgccgccgcctcgtgcgcctcgccgccgccatcgcggccttcgctgacgccgccgcgtcgtccgccgacgccgcggccctggtggcctccgatctcgccgacttcgtccggtccgacgcggacgaggtcccccgcagcgtcaagcagctggccaagctcgccgcgtcccctgaggtttccgccaccgtctccaccctatccgaggcggtaacctccgggatgcttcgcggcgcgggatccgggcccggatccgg

SEQ ID NO: 22333 - DNA, 495 bp, Sorghum bicolor
  Clone ID: 13784560
gcacgaggccgacgaggagctcgtctcctactacctccgccgccgcgtcctcggccgccgcctccgcgtcgacgccatcgccgaggtcgatctctaccgcctcgagccctgggacctgccctccctctcccgcatccgcagccgcgacgcccagtggtacttcttcgcccgcctcgaccgcaaggtcgccggcgccggcgccgggggccggggcggccccggcaacaggaccaaccgcgccacgccgagggggtactggaagaccacgggcaaggaccgcgaggtgcaccaccgcggcaagcccgttgggatgaagaagacgctcgtcttccacgccgggagggcgcctaagggcgagaggaccaactgggtcatgcacgagtaccgcctcctcgacgcagacgggcctcaggatctgcatgtggtgtgtagaatcttccagaagcatggatctggaccacagaacggtgcgcagtatggtgcaccatacatgga

SEQ ID NO: 22334 - DNA, 494 bp, Sorghum bicolor
  Clone ID: 13784564
gcacgagggtggagagcagcccgcagcagcagcagcaaggctgagccgccgccgccagctgagagctagtagagcatccgccagtcccagtggcggcagcagctagcgacaaggctgagtgaatccgagagaggagcgcagcgcgcgccgcagccgccgtggctgccgtcgcaggcgccgccgccgccgccacggtttgtgagaggcgctcgacttgtattcacgaggagggcggcgacgacccccgcgcggcaaaggagctgaacactggccccgccctgtgattgatggctgctgcccgtgccccggcggcggagaggggaggcgtcgtaggtgctccggaggcggtggcgtggaggggcggcggtctccgcgcgaagcaggccggtcgcgccagctgccgcggcgcctagagcgagcgcctggacgcggtctctctcgcagctagggttttggcgcggaggggcgccggggttcttctcgttctagcggag

SEQ ID NO: 22335 - DNA, 460 bp, Sorghum bicolor
  Clone ID: 13784568
gcacgaggtgagaatctcgtgaacaaaagaattgttgttgcggttgattcatgggatgttttgtctcgatatccatcaggacactatgtacgcaccattggagatattggtgacaaagaaactgaaacagaggttgtcttaatagagaatgatatcaacaccaggcctttctctactcaagtccttgcttgtttgccacctttaccttggacattatcaccagaggatctggctaatcctaatagacaagacttgcgccaagtgagagtctttagtgtggatccaccaggttgtcgagacattgatgatgcactacattgcacgctacttccaaatgggaattttgaagttggagtccatatcgctgatgtcactaattttgttcatcctggtacccctcttgatgaggaagctgcgcagaggggcacttctgtttatcttgttgggcagcggattgata

SEQ ID NO: 22336 - DNA, 457 bp, Sorghum bicolor
  unsure (1)..(457): unsure at all n locations
  Clone ID: 13784570
gcacgaggctcatctgagggcccaggcttcccagcgtcctctagaccgcacagcaaccccaagtcccaactactaatcgagcacctactgttgctgccagggagctcaacgactcggccattcgggaccaaatttatcttctgccgttgctccttcctcgcgggatcgagctccgccccgtggagcaggcgagccaggctggcggtgctggtggttggtttacatagggatgggagtcgagatccatccggattcgtcatttcagttcctctgctttgctgttttaaacttgtagaccgtcgaggaagaagacttgggaatgctgaaaaatgtgcttgcaaagcagcaggaaaatcttttgcgcaaacaagattcgacctctgttcaagcagatattgttggcttctcatgagcatgggcttcatgctgatactgttcttcttttcagtgatttana

SEQ ID NO: 22337 - DNA, 594 bp, Sorghum bicolor
  Clone ID: 13784573
gcacgaggagagcatcagccactcgacgagcacagaaaaaaccagatagacacgggacaacctcggccgctgagagttcttgtgccatcctctcgtacgtacagctgtgcagctccgatccatcgagagacggacatgaacatggacttcaccggagacgccgacggcttcgccctcgacttcatcggcgacctcatgttcggcgtcgacggcggcagcgtccccgtggccagccctgtcgtagtttccgacgacctcaccttccccgtcctgctgccacctcatcagccggagttccagcccgtgtcgttcttaccacagcagcagcagcatcaaggatacatagacgtgggagctgctccgaccgccgcttcggtcgttggcgaggcgccggcggcgttccgggcgcaggagccggcgcgaccggtgatgataaagttcgggagcgagccgtcgtcgcccgtggccaccaccatgaggcagccgctcaccatctccgtgccgccgagctcatacgcctgggccgccgcgccggccgtcgaggacttccgcaagtaccgcggcgtccggcagcggccctggggcaagtacgcg

SEQ ID NO: 22338 - DNA, 227 bp, Sorghum bicolor
  Clone ID: 13784575
gcacgagggttgaggcccgccgcttcggcttccaaaattgagcaatgctcttttgcgcacctgcagctcttttttatattattagctttccagtcgacgcgccgctgcctactctagtttagtgctctgccatggtgccttgctaactgcactgcggcgacgcgagcacggcgcaagcggagacgacagtcgccgccgcgtagtggcctacgaaactcccagaattt

SEQ ID NO: 22339 - DNA, 495 bp, Sorghum bicolor
  Clone ID: 13784576
gcacgaggcccaggaggaggtgaacaaggtgatggacgcggccaaggtcgcgcagaaggcgtgggcccggacaccgctgtggaagcgcgcggagctcctccacaaggcggctgcgatcctgaaggagcacaaggcacccatcgccgagtgccttgtcaaggagatagccaagccggccaaggatgctgtttctgaggttgtgcggtctggggatttgatttcgtatacagctgaggagggtgtgcggatactgggggagggcaagctgcttgtttctgatagcttccctggtaatgagcggaacaagtactgtctcagctccaagataccccttggagtagttttggcaatccctccattcaactatcctgtcaacttagcggtttctaagattggcccagcactaattgcgggcaattctcttgtgctcaagcctccaactcagggtgctgtggctgcacttcatatggtacactgcttccacctggctggttt

SEQ ID NO: 22340 - DNA, 311 bp, Sorghum bicolor
  Clone ID: 13784583
gcacgaggtctcgctctctctctcctcccccctccattttcaaatcaatcatcgggcgaactcaaacaaaaccctagctcccaatctccgctccgaccatggccctcgccatgcccccgcacggccccgaagaagacgccgacgcgcacctcttcgccggcgtccgcttcgtgctccacggattcgaccaggtctccgcctcccaatatcggctggagataaagcggtgcggcggcgtccatgtgggaagttgggacggagactgcacccacgttatagtttccaacaccttatatgatgatccagtgtgt

SEQ ID NO: 22341 - DNA, 441 bp, Sorghum bicolor
  Clone ID: 13784587
gcacgagggcaacattacctccggttgatgagcaagtcattagcatgaaactggttacccctgccaaagggacaatagagttatcgagggagaaggatcctgagttattttatcttgctcgctgtggacttggtggcctaggtgtcgtcgcagaagttaccttgcaatgtgtagaaagacaccagcttgtggaacatacatttgtttccaatgcagatgaagtcaagaaaaaccacaagaagtggctctctgaaaacaaacatatcaagtacttgtggattccatatactgatacggttgttgttgtccaatgcaatcctccctcaaagtggagaaccccaaagttgggatcaaaatatggaaatgacgaagctttacagcatgttcgggacctttatcgtgagtcactgaaaaaatatagaactgaagcagaaagtaatg

SEQ ID NO: 22342 - DNA, 394 bp, Sorghum bicolor
  Clone ID: 13784588
gcacgaggcacatgcacataccgaataacgaccagtcagcttcgacaatcagtgcgcacatgcatgtgcctgatcactgatctgatgagatgccgctgttcttctgttgcagcgacgcagctgatgacaccggagaggaggagggcaatctgggcaatatacgtgtggtgcaggagaacggacgagctggtcgacgggcccaacgcgtcccacatctcggcggtggcgctggaccggtgggagtcgcggctggaggacatcttcgccggccggccgtacgacatgctcgacgccgccctgtccgacaccgtcgccaacttccccgtcgacatacagccgttcagggacatgatcgaggggatgcgcatggacctgaagaggtcccggtaccgga

SEQ ID NO: 22343 - DNA, 477 bp, Sorghum bicolor
  Clone ID: 13784592
gcacgaggctcccgctccgccccgccgcgcaccgcgtggtggccgtcgtcggcccgcacgccgacgccaccgtcgccatgatcgggaactacgccgggaagccctgcaggtacaccacgccgctgcagggcgtggcggcgtacgcggcgcgggtcgtgcaccaggccgggtgcgccgacgtcgcgtgccaggggaagaaccagcccatcgccgcggcggtggacgcggcgcgccaggctgacgccaccgtcgtcgtcgccgggcttgaccagaaggtggaggctgagggactcgaccggaccagccttctcctccctgggcgacaggccgagctcatctccgccgtcgctaaggcggccaagggccccgtcatcctcgtcctcatgtccggcggacccatcgacatcgcgttcgcgcagaacgaccccaggatcgacggcatcctctgggtgggataccctggccaggccggcggcc

SEQ ID NO: 22344 - DNA, 547 bp, Sorghum bicolor
  Clone ID: 13784595
gcacgagggaagcagctcactcccactcacactcctcgctctcctctctctcactggagctggagcggggaagaagtgaggcgagcggacacgagagagaaggggagggagatcgaagcagcgaggcagttcgagagctctccgatctgctgcggggatggggtgcacggcgtccaaggtggagcaggaggacacggtccggcgctgcaaggagcgccgccgccacatgaaggacgcggtggcggcgcgccagctgctggcctccgcgcacgctgactacctccgctccctccgcgtcaccgccgccgcgctctcgcgcttcgcgcagggccacccctcgctcgccgtttcgcaccacactgcccccgttctcctctccgccgccgcgccgccgcctgccccaagcgccgcccacgcgctccccacaccggcgccctccaccgccacgtcgtcatcgctcccgcctccgacgccgctcgctcagcacccgcacccgcacccgccgtcccagccgcagccgcagccggcagcggcgatggcggtgccg

SEQ ID NO: 22345 - DNA, 510 bp, Sorghum bicolor
  Clone ID: 13784602
gcacgagggcatcccgctgtcccgcagccgcacaggcgcacaggtcgcgactcggactcgcgtctcgcgagcggccgagcgccgccgcgccggagcgcaaggaggagccgccgccgccgcggtccgccaggcgccagcgctcccgtgaccccgtccactcccggctccctcacaggcgctcccgtcgttcgctcccgtccggctccggtccagctgttccctccgctcgacccccgagccgaggccccgagcccccgacggcggacggctcacggccggcactcaagcagcgccgcagcggcagcggccacggcccggaagcacgaaaggaaaggcatgtcgtcgtccaaggacgctcccctgagccctcgatcccagctggcgctgagttgcttcgaggagctcctcgactgcgccgtggcggacgtcgcgtccgagtgccaccgcatcgcgcgcctcggcctggaccgcagcgtcgacgccgaggaggaggagctccgcgtctgggcg

SEQ ID NO: 22346 - DNA, 455 bp, Sorghum bicolor
  Clone ID: 13784610
ctgtggcggtggagggatttcgagcgtgcgcgacctctaccgcaaggatcgggaggagtggacggacggcgcaatcagcagcctcctcgacgcctacacggaccgatttgagcaactcaaccggggacacctgcggggtcgggactgggaggacgtggccagcgtcgtgaccgacgggaagggcaagactaccgggggcaagagcgtggagcaatgtaagaacaagatcgacaaccttaagaaacgctacaaggtggagtgccagcgtctcaccagttccggcggaggcgccgtcagccactggccctggttcaaaaagatggagcagatcgtcggagactccatgtctcctgcctcctccaagcctcttgctgcagccgaggatgtgaaaccgaggcagcagcagcagcagcacggcagcaaaaggtatcctctttccagcactggtcctccta

SEQ ID NO: 22347 - DNA, 570 bp, Sorghum bicolor
  Clone ID: 13784617
gcacgaggcgcaatgcaggttttctatcaccatttgggtactcaacacctacagtgacggcagcagttgatgctatatgttcgatggagtggtattggctcttggcatcaaaatcccaagtatgcgtcgaggggaaatatcctacaagaatttggagatggaagggttatcttgtacagtacacctttcttggcaacgaaggtccagctgttcttcttgtgcatggttttggagctttcctggagcattttcgtgacaatatagacaagattgctgatatgggccaccgagtttgggcaattactcttgttggctttgggaaatcagagaaaccaaatgccaactattcagaacttttctggtcagaactactgagagacttcattgtcgatattgtgagggagcctgttcatcttcttggcaactctattggaggttatatctgtgcaattgctgctggtttatggccttctcttgcaaaatctctggttcttttaaactcagctggttcagttattccaaattactccttcgtcccactgagtgaagaaagacgaacatcatcatggc

SEQ ID NO: 22348 - DNA, 493 bp, Sorghum bicolor
  Clone ID: 13784624
gcacgagggctgactcaagcaagtgcatggccaccggctgcctcgtggacctcaatggcgcgtgcccggccgacctgagggtcatggccacgtcgacgacgtccggcgccggcggcggggccgtggcgtgccgcagcgcgtgcgaggcgttcgggacgccgcagtactgctgcagcggcgcttatgggaatccaaacacttgccggccatcgacgtactcgcagttcttcaagaacgcttgcccgcgcgcttacagctacgcctacgacgactccacctcgacgttcacgtgcgccaccggcatcacctacgccatcaccttctgcccgagcaccaccagctgtgctgctcgccatcggctgatcggctgcttgtgcctgtcagaaaaagtgtctagccgttgatgattccgacgagaggcggtaacggacgatccaacggctaatagacagtactgtaacgtcaacggctatggatcattggatccaaggcc

SEQ ID NO: 22349 - DNA, 499 bp, Sorghum bicolor
  Clone ID: 13784628
gcacgagggttacgggtcagctatcggacacacgttctcgattccttggcctgagacctccaaagttgttcccttgtgtagttagccacaggcaagcaatgctctgcctatccagccgtccttggctgggctatatacatcaaggccattttctcttgacaccactgtcctgtgatacgcttgaatctgcatcatcattttcttctgatcagtgctcagaaggtgtagttgctgttgcgggagatgccctacggattttcaccattgaacgcttgggagagactttcaatgagacggccatccctctgcggtacaccccaaggaagtttgtgattctaccaaagaaaaaatatattgctgtcattgagagtgataagggcgcgttcagcgcagaagagcgagaagctgctaagaaagagtgcctcgaggcttctggtgcagcagagaatggaaatgcaaataatggcgatccaatggagaatggtgatggtcaagaaga

SEQ ID NO: 22350 - DNA, 501 bp, Sorghum bicolor
  Clone ID: 13784634
ctcgttcgccgataaagtcactgctttcgttaagctacggctaggctataaattccatctttccagcatcgttctgaacccacatccccaacgccatgtccgatctacagtcccttgtgtcagagctccacggtgctcttgagcgcaagcagctggatgccgccaacgacctcctcagccgtgccaagcgagctctccttttgcaaaacgcattgattcccacctcatccacatctccccagctggtcgtcctcgcacgccaagtcctcgagctcggagcccttgcctcaatccgccagaccgacgcacagttgttcacacgatactaccagcaactgcagccattctacgacatcgagagacatgctggtctgccaggacaaagctcatcagaagttgacttcagcacaagccagcgtagcaaagtgacggggctgtacctgcttctgcttttgagtatgggtgacagtgccaacttccatacagtgctggagggtctgg

SEQ ID NO: 22351 - DNA, 541 bp, Sorghum bicolor
  Clone ID: 13784638
gcacgaggctctgttagagccttttctacttcgccttgtgtccgcaagtctacacattgcgcgcacgttttatttgtatggccttaaattgtcctcatgcattgtctttatttgcgcaacgaagagtcaagaagggatatttttaatcaaattatgtgcttatattaattcttatgttgtccttactttgcccttgtttgtcgtttccccccattttactttttgtagttacaacgtgctggatttgcaagcccaacacctatccaagcccagtcatggccaattgctatgcaaagtcaagatgtagtagctattgcgaagactggatcaggcaaaactcttgggtatctacttcctggatttatgcatatcaagcgcctgcagaacagcactaggaatggtccaacagtcctagttttggccccaacaagggaacttgcaacacagattctggatgaagctgtgaaatttggaagatcttctagaatttcttgcacgtgcctatatggtggtgctcctaaaggtcctcagttgagagatt

SEQ ID NO: 22352 - DNA, 528 bp, Sorghum bicolor
  Clone ID: 13784642
gcacgaggcaaattcccaatcggcctgcgcccctgcctgcccattcgcgccgcccccgtcgacctagaagacgccgccgtcccatttctcccgtcaaaccccacggcggccccttccaccgctagctccactgcgccggatccccttcccccttgtccagcgcagcgctcgttggccgaggagacgccgtcgccctttcttattcgctcataagtcatatcccgtccccttctccgccgtccactgcccctgccggctgccgagcgggccttccaacgggcgaactgagcaccggcgcccggcacctgttcgacgcaatgcctccgaggcgcgtgggagctgctgcagcgaggggcgaggaccacatcggcgccctcccagacgatctcctcctccacgtgctgtccttcctgccggcgcatgatgccgtgcgcacgtgcgtgctctcccgccgctggcgcccggtctggaagtccttgcgcgtcctgcgcttcaccaagcaccagagctggggaagcgcgaccaagt

SEQ ID NO: 22353 - DNA, 574 bp, Sorghum bicolor
  Clone ID: 13784661
gcacgagggaaccttctgctcccgcgccgccgaaaccctagtcccccccacgccatggccctcgcgctgcgcttccggcgtgtcctcgccgcggcctccacctcggcgcccctgctccgcccgtccgcctcagtcgcccgtccctcccccctcgcggcccccgcctcctcccctgtcgcgccgctcccgcgggcgccgtggcggctcctccccggcggcgccgccgccgggttccggtccacggcggcggcggctgcgcggggcggtgccgactacggggcggacgacagcaagatctcccccgacgagatcctcttcgagggctgcgactacaaccactggctcatcaccatggagttcccggaccccaagccgtcgcgcgaggagatgatcgagacattcctccagaccctcgccaaggtcgtcgggagttatgaggaggccaagaagaggatgtatgcttttagcacgacgacttatgttggttttcaggctgtaatgactgaggaaatgtcagaaaaatttaaaggtttacctggagtagttttcattctgcctgattcatacctatacc

SEQ ID NO: 22354 - DNA, 517 bp, Sorghum bicolor
  Clone ID: 13784667
gcacgaggcaggagttgatgaggtttgccccaacaattttgcttgttggattagtttatgtggcggggaaaaagatgaaaggcggaattagtattggtggtcctgggggaggagctcgtggtatttttaatattggaaaagcccaagtgacaaagatggacaaaaattcaaaaaacaaggtgttctttaaggacgtagctggctgtgatgaagctaaacaagaaataatggaatttgtgcatttcctgaaaaatcccaagaaatatgaagatctgggagctaaaataccaaagggtgctcttcttgtgggcccccctggtacagggaaaacactccttgctaaagctactgcaggagagtccgatgtgcccttcttgtctatttctggctcagacttcatggagatgtttgttggtgtcggaccatccagggtgcggaatttatttcaagaagctcgacaatgtgcaccgagcattgtattcattgatgaaattgatgcaattggtcgtgcaaggga

SEQ ID NO: 22355 - DNA, 378 bp, Sorghum bicolor
  Clone ID: 13784669
gcacgaggccacaatggcggcagctcgttgtgtggaacccctggttggtttactggttagtgaagctaaccctgcccagctttctgtggttcgtgcattggataggcttctagatgatgagcaactggcagaattagtggcagcacatggggctgttattcctcttgtcgggcttttgtatggcaaaaactacatgcttcatgaggcagttgctagagctttggtgaaacttggaaaggacagaccagcttgcaaattggaaatggtcaaggctggtgtaattgagagcattcttgatattctccatgacgctccagattttctttgcattgcattgtcagaaatgcttcgaatattgacaaacaatgctaccatagc

SEQ ID NO: 22356 - DNA, 468 bp, Sorghum bicolor
  Clone ID: 13784673
gcacgaggaccgcagattggaaatattgatggctagacgaagatccaggaagaacataaagttcgaaattgataacaacctgacagatgttgatagtaatggtgctggtaggagtttagatgatttgtcacgcttccgtgcacttgtacctcctattgcagtgccaaggaggaacccttttgaccttccgtatgattctgaagaagcagtgattcctggctcagctccttcaattctgcatgcacggaagaacccatttgatcttccccttgaacagttgaatgacagtgttgtcgtccctgccccagatagtttaaactctggagaatctgcgatgtctcctcgtcgtgacatgatcttcagaaggcatgaaagctttaactttggaaggatggatgcaatccaagagaagcatttttctagactaaagccatattttgtccctgaaactgtggaatggaatgcaag

SEQ ID NO: 22357 - DNA, 515 bp, Sorghum bicolor
  Clone ID: 13784676
gcacgaggcggcggcgttgtgggagacgctgctggcggcatcggcggcggatgggaccggtgggagcagcaccacggtggtgtccatctgcgtgttcacggcggtgctgtgcctgtgcctcgtcgccggccacctcctcgaggagaacaagtgggtcaacgagtccatcaccgccctcatcatcgggtgcatcgtaggagccatcatatttctgctcaccgaagggaagcactcgcacatcctgaggttcgacgagcagctcttctttatctacgtgcttccaccgataatcttcaatgccgggtttcaggtcaagaagaagcagttcttccacaacttcatgaccatcatgtccttcggcgtgttcggcgttttcatttcaggtgcaatagtttcggcaggctgctattggctcttcccgaaagtcggatttggaaaacttgatgcggtagattatttagcactgggagcaatattttcttcgacagataccgtgtgcacattgcaggtcataa

SEQ ID NO: 22358 - DNA, 627 bp, Sorghum bicolor
  unsure (1)..(627): unsure at all n locations
  Clone ID: 14007792
atactagaagatgaagccaagaagtcanccgataagaagagagaaatgtttcagaaggagcgcgttatgacatctgatcaagcttctacacagaatcaactccttcctccaggatatttttatgttcctcgggactctttatctaaagagaagctatggaatcgtacacagccccataatccacaggagcctggtggataggatcagttgaaaccaatccggttcatttctctcgcggaaggccataaaaaatttgtgcaagcttgttctttgcaactgaaaatgacaagcggcaagcagggctggccagtgctattgccgcaagggttacagccaatccgtgatcttttttggacccaagttgcataatggtgcagactgagttatttgtgtgaatgtatggtgtggcaccataacaagaaggctgccccccacccaggtaactcgaatgatcagcaatatgggtgaattgacctacctgtgctataccaaagagcgtgccaactgtatatatgagtttcttagtgcgcagattttgtaaaattgccctgtacattctttcctttgcaaataatagtttagttgcgcaggagaaaagtaattataaatcgtttttggccggataag

SEQ ID NO: 22359 - DNA, 488 bp, Sorghum bicolor
  Clone ID: 14088969
ttgcgataagcagcaacgctctctctgtttccccgttcttgcgtggcgaacatcattcaaagaagaacacgatcttgccttgatccccactccattcaactgctgccacatcgtcgacgaaaagagtcttatcgaagacaaccacgcgacgatcgcccagcaatttcaccagtcctagccgcggctgccttcgcgcaacacatttcctatggacctgtcatgtacgagaatctgcttctatctcagactgctgaaccccaatcttaccgctgcctctctgcttcaaagctggggtgaagcgatggttgttgtgcgctggtgactttgttgcgtttcgctcactggtttgagagagcgcgatggagctgcaatctgtgccacaacacttttctgaccctttggccttgacgtttttggggagacactggaggcgcttgcggaggaatgcaagtgcggatggatgaatatgcctaggtggttgtaggtag

SEQ ID NO: 22360 - DNA, 505 bp, Sorghum bicolor
  Clone ID: 14088981
ctgcccttcgggtccggccgccggtcctgccccggcacggcgctgggcctgtacgcgctggagctcgccgtcgcccagctcgcgcacggcttcaactggtcgctgcccgacgggatgaagccctcggagctggacatgagcgacgtcttcgggctcaccgcgccgcgcgccacaaggctctacgccgtgccgacgccccggctcaactgccccctgtactgaaagctgaaactgatgacggcgtatgcatgtgtgtttggactctggactttggggaatggggtgtggggagtttagagggctttctctgtcgtcttttttttaatctgtttattataattttccggacccttcattaaaattaaaccatgcctgatcgatgttgtaggttaataataagggtattctcatggctagctgtgcatgcctaggcaaggaagtaaaatgatccaagattccaagttgtgggtgtgtaagaactcatcaaatgttttaaaacatacca

SEQ ID NO: 22361 - DNA, 605 bp, Sorghum bicolor
  Clone ID: 14089006
ggctgacaacgtacgatatgggccacagttgcgcggcaagaagctcactgaagccgaagtgaagaacctgctgagcctggccgatctggaccctgctctgtgctccaagccggcgtccgagctgtcggtcggacaggcacagcgcgtcgccttggcacggaccctcgccaacgaccccgaggtgctcctgctggatgagccgacgagcgcgctggacccgatctcgacacagaacatcgaggaggccatcgtgcggctgaagaagacgagggggctcaccacggtgatcgtctcccacagcgtgaagcagatccagcggatcgccgacctggtgtgcctcgtcgtcgccggcgagatcgtggaggtgctcgcgccgtcagagctgtccgatgccaagcacccgatggccaggcgtttcttggagctcagcagctaaagcctggttgcagcttcgttcaggttccatcacctcagatgctttctagctgttccggattggaaaggatcggacgtggttatctttccaatcttttctgatgttctactttgttttcctagtatacaatctgttaaagtagcttctgacagctaaaaagtgtatgcaa

SEQ ID NO: 22362 - DNA, 528 bp, Sorghum bicolor
  Clone ID: 14089035
acgtggtgcttccaaaagaggcaggggaagaggcaccagctcaatgaagcagaccactcttactttcagccagtggaggtcaactacggttatccgtagtgaggatgtctcctcagaggaagaagcagatgcaaatgaagttgttgaaaattcagaagaagagagtgcgcaacaagttgggcgtaaaagagcagctcctagaggtagaggaagaggtagaggttccactgcaaagagggggcggaaaacagatattgcttctatccaaagtatgatgagcaaagatgatgatgattcagaagatgagccgccaaagaaagctcctcctcgggtcacaaggaactatggcgctgtcaggaggagatgacccttaagaaagttcttgctcatgagggtttagggtaggtatgtgtcttagaagagccggtgttttcatcaaccaggacgtttgacacagtttgttttgccgtgaactgactgtatcttgtccacgcccgagtgtaacgaatttatacatcttgtagctga

SEQ ID NO: 22363 - DNA, 538 bp, Sorghum bicolor
  Clone ID: 14089120
ccgcccgacatgccgctagacggcggcaggggcggcctcccggcggcggccggggccggcgccggcgggatgaacccgacgcaccggcagaagatggaggagatgctgcagctgttcgacaagagccgcaaggagctgagcaagctgctggacatctacgagcagcgcctgggcgaggaggacttcctggccggcaccaagttcacgctcgccgacctgtcccacctgcccaacgccgaccgcctcgccgcggacccgcggtcggcgcgcctcatcaggtcgcgcaggaacgtcagcaagtggtgggacaccatctcccgccgcgattcctgggtcagggtcaaggagctgcagcgcccgccgtccgcggaggcgcccttctgagagcccgatcgcaagttaaagcggtggccattggcaagcgtacctacgggttttcggctgtgatgccggtctctgcatatttccattgttctgaatgaataaacgccgctggccctgggtcagtggccattgttcatggtgtaataaatcgttc

SEQ ID NO: 22364 - DNA, 284 bp, Sorghum bicolor
  Clone ID: 14089132
gcgaaaacgttctcgaggagacagttcatctaatgaacgatctagtgtgttatcatctggaggagttacacctaaaaatgctcctcagagccatttaaatgcagatgatatggaacctggacttcagagagaagagaggacaaagaatggaggacaaaataggagaatacgtacatccatggtggagatggatgcaaggacagctggtccatcacgaggccccggacctactgatagaatctcagatcctggcaaagccaccaatggcagttctgcagtcccag

SEQ ID NO: 22365 - DNA, 541 bp, Sorghum bicolor
  Clone ID: 14089142
gcacgagggccagccagtgactcccgccttagagcccactacctagcactcatcatccgcagtcggaagaccttcaaacgcagcggcacgatgcagatggagatggagaagggtgacacgcagttctttttcgatttgttcgtggccatgtgcaatcacattgatgatatctcggaggagatcggccacgtccaatcacccaatatcaccaagtgattgcgacatgcccaactcacagcaccaatgaaattcaacaaaaaaaaaacatggatcttgctgacttgtacttgtcgattatttgcattcccactcagactgccaggaggacttcgtgcgctgctacgagccagcgacaagccctcacatctcttttccggcgtttgggcttctcgctactctcggctgtatgatttccttcacagactgtatcggatcgagtttgcgataagcagcaacgctctctctgtttccccgttcttgcgtggcgaacatcattcaaagaagaacacgatcttgccttgatccccactccattcaactg

SEQ ID NO: 22366 - DNA, 530 bp, Sorghum bicolor
  Clone ID: 14089151
gcacgaggtggatattgatttggaggaccagaaggtccaaagaatcccagccgatgagttcgtgccgaagaagctcacactgcagttggatttggagaagcccagtcttggtgatgaaaaatcaccatcagagcgacggcagccacagccgcagccgcaacaattgcagcagcagaagccctcgaaggctgagataaagcatgagaaatctgctatgcctgctgttacaccacctatgcctatacctgttggaggctggcttgggaatttcccaccgtttggttaccttagtccagtcccaggcctatcagcagctggtcttcatcatcccatggacgtgaagccagggtcttctagtggattacagcatgctgcattgcttccaccgcctacacgctcaaagagatgtgctacacattgctacgttgcacaatttatccagcaccagcagcgagttgcaaagatgaactcattctggccgccagctgctgcagcggcagcagccgccgccgccaatagatcggggccat

SEQ ID NO: 22367 - DNA, 589 bp, Sorghum bicolor
  Clone ID: 14089152
gcacgaggctctctctccgctaagtagtcccacctacccctctctcacactcgctggttggtggaccccacttgtcggtccatccctaacctctggccagacccttatctccctttcttccatccatggctgttgcccccatatcgttcgcactaatcagagtagcagcatgtcgcgagtgctaacccgagcgagaggcgcgcacgagcagcggctgctactactgcgagcttagaaccaacgagtagggggctggtgcgtgcgaatggcacgtggctcagctcgacggcggcggttccgtggctggagctccatgcgcggaaacggcgccctagcgctggtggagggcatggagcttgtcatcgcactcagcgcctgctgcgactgcacggcaagacccacctcagccaacctcttcctgacgacggcgataagcatggcgggagcatgcgagcgacatggccagtgtgagctcgggaggcagcgatggtgtagcgaccgagcgcgagcacaagcagccgcgacaagtatcagagtcagcgcgggtcatggcggtggaaagccagctgctctggccctcgacgctagt

SEQ ID NO: 22368 - DNA, 514 bp, Sorghum bicolor
  Clone ID: 14089154
gcacgaggcaagagcgctctacacacaagtccacaatctatctaaaacccaaacgacaaaaaagaaaaggaagggtgcgctgcggatcgttcatggcggccgttgccaagatcgccatggagtggctccaagaccctctgagctgtgtgttcctggtcacgctggccgtggtgctcctgcagctccgtcgacggggcaaagcgcctctgccgcctggcccgaagccgctgccgatcgtgggcaacatggcgatgatggaccagctgacccaccgcggcctggcggcgctggccgacaagtacggcgggctgctccacctccgccttggccggctgcacgcgttcgccgtgtccacgcccgagtacgcgcgcgaggtgctgcagacgcatgacggcgtgttctcgaaccgcccggcgaccatcgccatcgcgtacctgacgtacgaccgcgcggacatggcgttcgcgcactacgggcccttctggcgccagatgcggaagctgtgcgtgatgaa

SEQ ID NO: 22369 - DNA, 410 bp, Sorghum bicolor
  Clone ID: 14089175
gcacgaggctcgctgctagcagctccggacgcctcctccgccgccgccgccgccaataatgggctcagcttcgtcagatgatctccgggagcacctgctggacgtggacggcggcgcggcggcggcggcggcggagcccaagatacgggtgcgcgggctgcggcgccgcgccgagtccgccgacgccgccaccggcgaggagatcctccggggcgtccacctggacgtgccgcgcggggtcgtcatgggcgtcatcgggcccagcggcagcggcaagtccacgctgctccgcgcgctcaaccgcctctgggagcccgcgcccggcgccgtgctcctcgacggcgccgacatctgcgccatcgacgtcctcaccctgcgccgcaaggtcggcatgctcttccagacccccg

SEQ ID NO: 22370 - DNA, 607 bp, Sorghum bicolor
  Clone ID: 14089195
gcacgaggtctcagtctctctcatctccagcctcctctcctttttcaacctttgacgctgtagcttgagagcaagcttagcgccaaccagattcctgagcgctgctctgctctggtctcccataggctttgctatgcaggtgcgctgcgacttctgcggcgccgcgccggccgccgtgctctgctgggccgacgaggccgcgctctgctccgcctgcgaccgccgcgtccaccgcgccaacaagctcgtccacaagcaccgccgcatcccgctcgtccagcccgcctccggcaacgtctccgacgccgacgccgatgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgagctcgtcgaccaggcgcccgcctcccctgacgacgacgacgacgacgacgacgcctgcggccgcgacaccagagccgccgccgagcccgacgctgtgcccgccctcggcgcgcagggctcctgc

SEQ ID NO: 22371 - DNA, 530 bp, Sorghum bicolor
  Clone ID: 14089202
gcacgaggcccgtgtcctctctcgtggcgacgactgggggacccccggcctcttccgccctaaaccctaaacccttcccttgctgcacctgccagttttagattttacagcaacggattgatttggccaacacgttgagtttggggtccaatgtctgaatcagcacaacctaggggaggggaagttgatagcaatacactgcgaatacttgtagcaactgactgccatctaggctacatggagagagatgagatacgcaggtttgattcctttcaagcatttgaggagatttgtgcattggcggatcaaaacaaggtagatcttattcttcttggcggtgatctattccatgagaacaagccgtcgcgctcaaccctggtaaaaacaattgagattctacggcgctactgcctaaatgatcaaccaataaagttccaggttgtcagtgatcagacagtcaacttcccaaacagatttggtaaggtaaattatgaggaccctaacttcaacgttggtctgcctgtgttcac

SEQ ID NO: 22372 - DNA, 563 bp, Sorghum bicolor
  Clone ID: 14089207
gtcccaggctcggcgtcggcggctccccctcccgcctctcgccagtcgcctggcgccctcgcctccatcctccgcgcaccggccggcgaccctgcattaagaagatcccaagagaggatcaaggctgtggaagcaaaggaggaggaagggaaaaagcaagcatgcataagaggcagaagacttcatctctgcttaacttcaagctagaagatttcaagagtagattacgcaggctttacatgctccgtggctatcctatgccatctgaatctcaacgtggtgcgggcatgcacttggtgaatacatttgaagagcgttttgatgacttggatggctacagtgaagaacatgctctgggaatgtgaggcgtttcacatgcacgggtactattttcagacacatgccttacgaaatgactattctaacttcggctagcttggttagatgccttggagatgaagctaagtttgttaataagttgaagattaaggtgtgcctgcccaatggcaagttagctgtagggaagttatggaaatatgattgtaactataatattgctattg

SEQ ID NO: 22373 - DNA, 212 bp, Sorghum bicolor
  unsure (1)..(212): unsure at all n locations
  Clone ID: 14089216
ttcggcacgaggaaaagtctccgcctccagagagatgtcggcggcgacggaggtggcgccagtacagcagcggagccatgcggcggcggtgtgcgggcggtggcggggtggctcnncctgctcttccagatcctgctccggatcatccgcagcacgccctcctcctgggcgcagctgctctccttcgtgggcctgcgccacccgctcctccc

SEQ ID NO: 22374 - DNA, 522 bp, Sorghum bicolor
  Clone ID: 14089241
gcacgaggaggatatcttgtttgtcctgatgaactacttagggtgaccagcatagatgttgccatggttgttctgaaagaaaacttaatacttcctctgttcagagatgagtacatcttacttcatgaaaattatcaactttatgttcttccaaaagttctagaatcaaagagaatggctaaatctggccgaactaagcaaaaggaagctgatttggagtacaatgttgcaaagcaggttgagagaatgttaacggaagtgcatgagcaagcactagtctcatgtgatgctatgcatcgtgaaaggagaattcttcttaagcaggaaattggaaggatggttttatttttcacagatcaacctagcctcctagcacctaatattcagatggtcttttctgctcttgctttgtctcaatgcgaggtgatttggtacttccaacatgtgggggttgcagcatcaaaatctactcgagtgaaaactgttgacattgatgcgacagacccaactattggtttctta

SEQ ID NO: 22375 - DNA, 542 bp, Sorghum bicolor
  Clone ID: 14089248
gcacgagggtacacttggctggagcattctgcagtgaatgatgatgaggaaacatggactgataataatcttcctgtggcttgtgggaactttacgttaggcaacacagaggagtcacaagatcccctcatgttttctcacattgtttcatgggctaaaggaagaaaaaggggttcttatgtaatatatccaaataaaggtgaggtttgggctctttataagggctggagtatgcagtgggtctcagatgcagacaatcatagatcctatgagtatgaagtggtggaggtcctttccaacttcacaatggaagctggtgtcactgttatccccttggtcaaggttaaaggttttgtgagtctgtttgcaccagcaaaggacaaatcatcatttgttatatcgtcaagtgaactacttcggttttcccacagtatcccatttttcagaacagtgggaaatgagaaagttggtgtcccttgtggatttcttgaactagataccgtatcccttcctagtaatctggacgtagcatttccaccagt

SEQ ID NO: 22376 - DNA, 152 bp, Sorghum bicolor
  Clone ID: 14089280
gcacgaggccaccccgagacctccaaacgtccgtcccctgaaccctcaaccttcaccgcccccgactcggcactcggcggccgtcggtacgcaccgaggagtctcgagacaggaaccggaggagcgaagcgatggaggaggactctccgctg

SEQ ID NO: 22377 - DNA, 611 bp, Sorghum bicolor
  Clone ID: 14089286
gcacgagggcgaattgcagaaggaggagcagcaggaggatgaggaggaaagaggtgctgcacttgaggtagaggttgtggataaggtggcagatgacgccgaggcgccggtggccgcggagaaactggaaccagaaattgagaagggcgaggaggtaggttctgggagtggagatggcggtgagttgagcgatgagaaggaggttgaggtctctcctccaagcgaggaggtggcggaaccacaggataaggtagcccccgaagctaatggtgaattgggtgatgagaaggaagaaagtgatgatgtggtggctcttggaggtgaagaagccccagaagaatcgactaacaaggatgctgatggtgatgatgtggtggctcttggaggtgaagaagccccagaagaatcgactaacaaggatgctgatggcgatgatgtggtggctctgggaggtgatgaagccccagaagaatcaactaagaaggatgctgatgtagaagacgaagccaccaagcctgagccaccgagtgaggcaagtccagtggttctgaatgatgaaagcatagaggagcttgctcctgcaactgctgacagtgtgcttgaggatagtc

SEQ ID NO: 22378 - DNA, 213 bp, Sorghum bicolor
  Clone ID: 14089299
gcacgaggcaagactagtcactcaccatggccgtgcctgtggcgttcccgccgcacatcatggcgctcaccaaggtgcagcggctctacgacgcctgcgacgtcgtcttctcctcgccggcggcggcgcccacgctcggggacatcaggtggctgcagaacatccttgatggcgtggaggcagccgacgtcggtatcgacgacgggggagaac

SEQ ID NO: 22379 - DNA, 348 bp, Sorghum bicolor
  Clone ID: 14089302
gcacgagggtccgctttgcacggattctacgtccccacggcgcccatcctggttccgattcctggacacggcttggagccaccggtgcttccgaatgaccgtttcgcaggcgctgcggcccgagctgccgccgctgcacaaaatgagcagatggaattggcccgcttggaaatggccaagctcgagcacgatttgctcaagaagaccgaggctcgagtgccccaggattcagaaagtggcatcgagattaatttgcatgattcgtccgaggtcttgtcgacggatctgaacgtcgtccgcatcgatcccgtgtcttatcttcccgcagaggtcatgtcacatgtgctc

SEQ ID NO: 22380 - DNA, 467 bp, Sorghum bicolor
  Clone ID: 14089307
gcacgaggccttcttcgagcacatcgtcatcatcgtcgtgctcgtgctcttcgcgggactcatgtcgggcctcaccctcggcctcatgtccctcagcctcgtcgatctcgaggtgctcgccaagtccggcaccgagcaggaccgcaagcacgcagctaagattttacctgttgtgaagaaccagcaccttctgctatgcactcttctaatctgcaatgctgccgcaatggaggctttgcccatattccttgatagcttggtgactgcttggggtgcgattttgatatcagtgacactgattctgctgtttggtgagatcttaccacagtccatctgctcacattatgggctggctattggtgcttcagttgctccattagtccgtgtgcttgtttggatctgctttcctgttgcctatcctataagcaagctattggactatgtgctgggtcatggtcagacagctc

SEQ ID NO: 22381 - DNA, 380 bp, Sorghum bicolor
  Clone ID: 14089309
gcacgaggcccccccgccgttgccgcggctaccggaaccagtcatggcttcgacgcatgctctaaagaagaactaccgctgcgaccgctccctgcagcagttctacactggcgggccctttgcggtcgggctcgcccccggcggcgatggcgagggcgagggcggcgcccaggctgaggccttcctcgcgtgcgcatgcggtggggaggtgcgcgtggtgtccgccgcggacgcctccgccataggggagcccgtcgacggcgactcggaggccatcaccgcgctggcgctgtcccccgactcacggctcatcttcgccgcgggccacagcaggcttattagggtctgggacctcgcgtcccgaacttgcatacgcagct

SEQ ID NO: 22382 - DNA, 388 bp, Sorghum bicolor
  Clone ID: 14089310
gcacgagggtctgggcaccagccggtgtcagctccaacaactttgccttcagtcaacttgtctgaacctagctcttcagactggcaagagcacactgccgccgagggaaaaaagtactactataataagaagacaaggcaatcaagttgggagaaaccagttgagttgatgacacctttggagagggctgatgcctcaaccgaatggaaagaatttactacaccagaaggacggaagtactatttcaacaaagtgaccaagcaatcaaaatggactattcctgatgagttaaaggttgcacgtgaattggcaaagaacgcatcaaatcaacaacctgatctagaatcacgaatagctgctagtgctcttgttggatctgctgcctctg

SEQ ID NO: 22383 - DNA, 318 bp, Sorghum bicolor
  Clone ID: 14089319
cgcggatcggccctgaccaggacgaagacggccagggggctcccgaggcgtacgaagacgaggtggacgaggaggatgaggggtactacgacgaggaagaggatgacttgggagaggggttcgaggaggagtatgaaggacgcgcggcacctcccatggaggagggcggcggcggcggcggccaggtctcgcgcggagaggatggcgtgactggggaagagggattgccggagggggaggccaagggcgagggggaagagaaggagcaggagcccttcgccgtgcccacttccggcgccttctacatgcacgatgaca

SEQ ID NO: 22384 - DNA, 430 bp, Sorghum bicolor
  Clone ID: 14089324
gcacgaggttacagaggcttcccggcttcgctgccagggcagggcacaacaagaaagactacactacacatacgagcagcagagttgtgagctcgtgatactgctgacctgcgaggcgaggcgattggttaggacctaggcctcgctcggatccatgcaggtccctgcgggtttcctcggcaagctctggagcttcgtgtccttcgtgcccttcttcatcctcctcctgctcctgggatccatcaaagctgtcctaatcggtccggttacggcttccatcgtattctttggaaactctgcggttattattggtctctggcctgcacatttcatctggacatactattgtgttcttaaaaccgaaaggatcgggctggagttgaagattcttattggaattctgttgccattaccactgcttctcttgcca

SEQ ID NO: 22385 - DNA, 351 bp, Sorghum bicolor
  Clone ID: 14089352
gcacgaggcgcaagcgaacaaaacaattttctggtggatggcgcatgagaatagctctagcacgcgctctgttcattgagcctgatttgctactacttgatgagccgacaaaccaccttgatcttcatgctgtgttatggctagaaacgtatctcctgaagtggccaaagacattcattgttgtatcacacgcaagggagtttttaaatacggttgtcaccgatatccttcatctacatggtagaaaactacatgcttacaaaggtgactatgacacatttgagaggacaagggaagagcaccttaagaatcagcagaaagcctttgaaacaaatgagaaggccagacagc

SEQ ID NO: 22386 - DNA, 610 bp, Sorghum bicolor
  Clone ID: 14089354
gcgggatcgattcttccaatcgcataaataaaagaaaacctccgtgaatactaaaaaaaggctgcaacctaatgctgtgggatcgattcttgccgatcgcacactagcaaaaaatctacgtcaattactcgctccttaggaaatccacctctgtcaacgagtcaagcacgattcaatttttgaatagaccataatttccgcctccttcatctaccacaactgacgctcggccgtggaggaccgtcgtcgggctggtgccgtagccaggtcgcatgatccacctccgtcttccagcgatcgccgcgcttgggatttcaaggcattgactgtatcacgtcgtctttgtcatcaccgtcgacctccttcgccggaaccatgttcgacgccaacagggatctctgaacgtcgcatgaagaaccagtggttgagaaagtcacagattctctatgaggtagcacatggagacgaggatggcaccgcgaccacaggcgacgaggacagcggcaagcagatctcaaccctcatctcggcccctgtcggacagtgctaatgatggtgaccatagcacaaacccgtgcgcttcccatcgcgcatgttgaaccctattgag

SEQ ID NO: 22387 - DNA, 556 bp, Sorghum bicolor
  Clone ID: 14089358
gcacgaggcacgcgtgagatctgtgccttccgccacggccacatgccacacaacgacgcccggcaacggcaagcttcaccgatcgaggtaggcctgcccgataccgaggaggatggcagcggtgggcgtaggtgcagcggacgagcggtgggcttcgttgtgcaactgcgtggtgaacttcttgctggaggagcggtatcacctcacggcgctagagctaatgcaggagctccaggaggacggccgctccgcgcacgccctccgcctccgcgccttcttctccgatccagcgctcttcccgcccgatctcgtcgcccgcgcatcctctgcgccgcccggagctgatccacagattttgctacaagagaaaatagcagcagaagaaaagttggcactcgtggagtatgatctgcgcctagccaaagaagacctttcacagttcaagcttgacttgcaaaaacaaaaagaatcatctcctgatgattcaaatgggctccttttgggtgcttctatacgtgaaggatctactagccaacaagacaaatgggatacgaaa

SEQ ID NO: 22388 - DNA, 355 bp, Sorghum bicolor
  Clone ID: 14089360
gcacgagggcaaaacccaaaattttgaacccttgggtgcctccgctgctgctactatagtctactacccccatcaaatcaaactcctccctccggcttcccctccatttccttcctctccccaccaatccgccatcattccccgttcccgttccgacagccaaaccctagcctgaccgccgccgccatgccggacctcccctgcgacggcgatggcgtctgcatggtctgccgcgccgcctccccgccggaggtcgacctcctccgctgctccacctgcgccacgccctggcactccccgtgcctctccaagccccccgccctcgccgacgccgccagctggagctgccccgact

SEQ ID NO: 22389 - DNA, 575 bp, Sorghum bicolor
  Clone ID: 14089367
ctgacataatccagtggccacccaatctgcctgtccagagcaaccttagagttccgattgaacaacctgtttctaatgaaaagtttactgtgcaactacctaacgctggtgctcaggttcctgctgggcctcttctacagcatcctaaagaaatgcccaatcacttggtttctgctccccccaatggcagcagtaaatttccattgcaggttactgttggaattgatcctgttgaagttacacatgaaccagcttacacagattcacttttctcaaatcaggatccttggaaagcagtgggcaatgcttctttagtgcctccaagaccaagcaagttaactaaggagcctgttgttcttggaggtcaatatactgatggccatatggctgatatgaacacgcatgctgccgtactctttgaagaagacccaagttttaaggatatccacacagttaagttgaacaaaggatttggagaagataatattaagcaacaattgcaagctgttgctgaaggggtagcagcatcagttcttcagccaccctttcctgagaaaccagctgcattctctggg

SEQ ID NO: 22390 - DNA, 382 bp, Sorghum bicolor
  Clone ID: 14089370
gcacgaggcagaagtgacatcaaatttgacaaggataatcattctactgttccagcaaacataaactggaaggacaacaaggagcataggagtaaaagatattttgaacagccagctgatactgtggattggcgtttgccccgtcctagtttacaaagtattgatgaagctcccaaaggtctgatttctgtggaagagcgtaactccaaggatgcaaatgaatctgctggtgataacaaagctgaaccaaaaagtgaagataggttcagagacaaggacaggaaaaagaaggacgagaagcatagggactttggtgcaagagaaggtgatagaaatgatcgtcggactggtgtacagcttggtagtagtggtgttgagcgaa

SEQ ID NO: 22391 - DNA, 390 bp, Sorghum bicolor
  Clone ID: 14188345
gcacgagggtggagtaccatgatgagcttgaggaggtcgaggaggaggaggaagtggtaccaccacggccgaagagtgttgcaaaatgtggtgcccgtggccggaatgtgaagctgtctccgggagcgaagcgatctcacaagcgaaagcaggaggagggcgatgaggatagggactttgaccctgagttggatgacgcacaggatgaggacattgattttgatcccgatgtgaatgtcaagctgtctccggcagtgaagcgatctcacaagcgaaagcaggaggaggaggatgaggatattgactttgaccctgagttggatgacgaggatgatgagttagatgaggacattgattttgatcccgacgtggatggtgatgaggaggatg

SEQ ID NO: 22392 - DNA, 587 bp, Sorghum bicolor
  Clone ID: 14188348
gcacgaggcccgttcttccctgcctacccctccatccctcgccgccgccgccgttcccatcaccgccgctgggatgaagaaccccgacttcgccgcagacaaagcgctcgccaaggacttcctgtccaacttcgccggccctcacggcgagcccaagtacctgaacatcctgcaagatgtcgccaataggaagatacgcgcggtccagatcgagctggacgacatgttccattataaggatatcgacgaggagttcttgcagcgtgtcactgagaacacgcggcgctacatcggcgtcttcgcggaggccatggacgagatcatgccggagcccacggaggcgtacaccgtcgacgaggaccgggacatcctcatgacgcagcgtgtgggatgagggtgccgacggcggcgccgacggcacagacccgctacagaggatgccaccagagatcaaacggttctttgaggtttacatcaagacattctcaaaggcgactccgctcaccattaggcaagtaaaggcatccaacattgggcagcttgtgaaaatatctgggattgttacccgctgctcggatgtgaagccc

SEQ ID NO: 22393 - DNA, 449 bp, Sorghum bicolor
  Clone ID: 14188349
gcacgaggcgtcacggcagaagaagcggaggaggaagaagcacagggagcaggaggaggcaatagcggcttcctcgaaggctcctcgacctccgacaacaccggaatccaagcgcgagtccacagtcccagtcgctcccgaaaccctagcatcggctgggatggcggcggcgggggagtctccccgacctcctgcaaacccggaatccaagtccgagtccccggtaccagtcgctaccgaaaccctaacctcggtggtgatggtggcggcggctgcagtgagtctggttaaggagcgcgagaggaagaatcaggtggcaccgccggcatgtccattaatggaggagtccgtgggcaaggaggaaaagaggcgcaagaaaaggaaacatggggaggctgcagtggtgattccatcgacgcccactcctgctgcggcccaaaacttgcaga

SEQ ID NO: 22394 - DNA, 592 bp, Sorghum bicolor
  Clone ID: 14188350
gcacgaggttccaaaatgaagcgcaagacaggaagagaatcgcagggtgccaatggccagcccgactccaagaagcgcgcgttgtcgaacgaagaagcggccacgcgctttcgtgatggtctgtttgacagtgcggagctgcagaagtacaccacggattatgccaaatcaaagccgtacctacatggcgtgatccaccccgtattcaacgattccctactgcgatcggtccgcgacgaaatccaagaacatctccactttaccgaaaaggaaacggacatttacaagatcttccaatcgggcgacttggccaacctggatggtttggacgatgcgtctctctcgcgactcccgtcggtgctgaagctccgcgatgccatgtactcgcagcgattccgtgagtatctctccggagtgaccgggtcaggcaagctgagtggacgcaaaacggacatggccattaacgtctacaacgagggatgtcatctactgtgccacgacgatgtcatcggaagccgtcgtctgagttatattctgtacctgaccgacccggataccccatggcaagctgagtggggtggtgcgctgcggt

SEQ ID NO: 22395 - DNA, 408 bp, Sorghum bicolor
  Clone ID: 14188357
gcacgaggcgccattggactgcctgccttgtgtgcctgagcagagacgcggaggggaggaggagacagacagggcagcgaaggaccgagaagctagcaacggcaacgagcagaggcccggcacttgcgctccgcgtccccctccctccgccacctctcccgctctccattccgccacccacaccaccacccgttgctcgctgccggccgcccacgccacgcctgcctcttctcttccatcctccctcccgtgccccgccccggccggacctcttaattttagccgccgccgccaccgccgtcgtcgttggatcgtgtcgtgtcgatcgccgccgccggccggagagcagcaggcagcccgcccgccatggaggggaaaagcgtggtgatgtcggcgctcgggatcggg

SEQ ID NO: 22396 - DNA, 497 bp, Sorghum bicolor
  Clone ID: 14188368
gcacgaggcgagtatagagaccactagcaggcaggcacacggcaatccaaaccacactgtttgtgttgcgtttaatttgtggccaagttccagactcggggcaggcatggcggaggctctgccgttgccactgttgctcatcgccgtggccaccaccgccgtcgccgcgtactgcgcgcccgccacgccggcagcagcggcggcactccgcacctccagctacagccatttcttcgcgttcggcgactcgctgaccgacactggcaacttcatccactactccacggcgccgggccccgtggcgcactccccctacggcgagaccttcttccaccgccccaccggccgctggtccgacggccgcctcatcgtcgacttcatcgtggagcggctggggtacccacggtggtcgccgtacctggacgggaagagcaaggaggacttccagcacggcgccaacttcgcggtggccagcggcacggcgctgagcaggcgct

SEQ ID NO: 22397 - DNA, 401 bp, Sorghum bicolor
  Clone ID: 14188371
gcacgaggcgtctatcgcgtggggcatttccccttgtacttaccaatcatgtctgaacctataccttcttcaattcttatcattggcgccggcgttttcagcctgggcactgcgtatgcccttgcacaaagggaagaatacaaaaacaccaaaattactgtccttgatcgatctggcttccctgctccggatgctgcgagtgttgactccagccgcattattcgtgccgactatgcggattactactacagcgcactatgtatggagtcgctgaaggagtggcgaggctaatggggccagtagggacgctaccacgagcctggacttgcgtattctgctcgatggcaagaacttggaccgtggtggcaaggatgccatgcagagggagatgctggagaacc

SEQ ID NO: 22398 - DNA, 449 bp, Sorghum bicolor
  Clone ID: 14188383
caaccaccacccccccctcccctacacattcttttcgaacctcccttcgtccccagcagccaatatgtcggattctactgttggccagacgaagcagtttggaaagggtcagaggaccgttccggctcagaaggcccagaagtggtaccccgtggatgacgagtcgcagcccaagaaagtccgcaagactcttcgtcccaccaaggtccgggagagcctccagcccggtaccattctgatcctccttgccggccgcttccgtggcaagcgtgtcatcctcctcaagcacctcgaccagggtgttctcctcgttaccggtcccttcaagatcaacggtgtccccctccgccgggtgaactcccgctatgtgatcgccaccagcaagcgcatcgacatcagcggtgttgaccagtcggctctcgagaaggtttctgcgtcggactacttca

SEQ ID NO: 22399 - DNA, 471 bp, Sorghum bicolor
  Clone ID: 14188400
gcacgaggcagcctcgctcctcctgctgggctttgctttggcgttgcggcaaaaagcgagcaaacctgcagctggcgggcattatcagcatatgcaaagcaacaagatcgatcgagaatttcaactagaatactagattggtcgagaagaacgaagtgaccgaccgagaaacagcgcgctcggcgacttgtcgttgcttctttagtttcccggatctgaaagactggcgaagctttgcgctgatggttgccgttgttggttccggacggaatccccggtggtggtgtcgtggtgacgtcgcaacgattggtctgactaaaccgttcaatcaatcaatcagtcaaagtttgtcctcagcaagacactgttaatttctaaggacacattgctgcatcagctcggcttccaggaagtgtcatatggaaaggccgtattatgacctgctggtctgtacgtggtcttcgacgctca

SEQ ID NO: 22400 - DNA, 451 bp, Sorghum bicolor
  Clone ID: 14188401
tcccgatcgaaatcctgcgccgccgccgccaccgccgccgccggcgataatgtcggcaagcgccgagcccgagaaggacgccgcggccgcggccgccgccgagggcgacgagaagacggaggcgaagggcaccggctccggctgggagctgctgtactgcggcgggacgagcttcgacgccatgggccggaaggtggtaggcggggcgcagggcaacctggtgtcgccgacgcggctgcggccgctcgtgggcgttgatatccgcttcgtcgcctctggatgcactgcttgccactgtgttgctttacatgctgaaggcaaatgttatacatggggtcgcaatgagaagggacagctaggacatggagatactcttctacgtaacctgccgactgttgtttctcaactatcaaaatacaaaatcatcaaagcaagtgttggaagaaaccat

SEQ ID NO: 22401 - DNA, 535 bp, Sorghum bicolor
  Clone ID: 14188411
gcacgaggctcgctctctgtcgaggagcaccagaccgacgttctgcaatcaccggaaggcactttctcctgtggcttccacagcatctatgaaagtgccttcaccttctcgatatggtacaccaactcagtgaacaagacggtcgtctggaccgcgaaccgtgaccgccccgtgcatgccaggggcgcggtggtcaccctgcggaaggacggcaccatggttctcacggactatgatggcgcagtggtgtggcaaacagaaggagacctggtgggtgttcagtacgcgaggctcctggacactgggaacctagtcatggcgaactccagcggcatggttgtgtggcagagcttcgattcgccaacagacaccctcctgccgacccaacacatcacttcaactacgacgctggtttccaccactcatctgcatgttccaggtccctacatattccatttcacggattcatcgatactgtccctcatttatgatgatgcccgtgtccatgaaatatattggccaaaccctgacaacg

SEQ ID NO: 22402 - DNA, 601 bp, Sorghum bicolor
  Clone ID: 14188436
gaaaggtttcctgccgacccaagggaaaggtatgggtatcagagcaaggagtttatggatacaagagaaccaaatgactatctgcggagtaggcaatctcgtgatcgttatgatgatgggccttgggaaagatctgaacctcgaagggattatcggtatcctgcaccatgcattaattttgccaaagggaaatgcatcagaggtgctagttgcctatttgcgcatggtgattctgcttctcatggtagatggagagatgaggctagggaaagtgcccatgatagagttggccctgattcatcctatgggaataggactgagcaccgtagggtaaataaaaacccttgtaagttttttgctgaaggtcgttgtcgccgtggtgaaaattgtccatatctccatgaggaagctccccagagtcagataggagtgagtgcacctgatgaggatttgaatcacagtgatgggcatgcagcaagaggaaactattcaaactggggtgaacaaaataatgctgtgcatgcaacctctcagattttatccagggatgacagggaaaatcctatttctcagagtattggcagaaatgattctcgcaatg

SEQ ID NO: 22403 - DNA, 618 bp, Sorghum bicolor
  Clone ID: 14188447
gcacgagggactcttccatttccaagctggaaatgagctaccacgcagatacagaacttaggaattcgaagatagaggttgctgaacacaaggcacctgatgaagctgacatgacaacaccctccaatggtgaggctttgaggtctgaggttagtgctgggattactatcgatgaaaatgtggagattgataagccggcttcaacatcatctgctcagaattctcaagatagggatcttgcagcagttcctccaaaagttgaatctgacaatgatgaagatatggatgtggaaatggaagttgatgaagataatgttgaagagcaggcacattgcagtcctgtacctaaaaaggagcatcctccatcagaacagttgaattcatctaatttgtcatcatttgaagatcctacatctcctgaggatagttctttccctccgcctccaccagaagatgaatggattccacctccaccacctgaaaatgaaccagttcctgaagctcccccagaagagccagctgcatcatatgttcaggtggatacaattcctcagccatatatagctcaagcaaatgttggctatacaatttcaggaatggagtactatggtactgtcg

SEQ ID NO: 22404 - DNA, 404 bp, Sorghum bicolor
  Clone ID: 14188460
gcacgaggctgaaccctgtgtcactcacggaaccacggtcctagcgccgccgcgagagccgagacgaaacatggcggccgcgctcctgccggagacggcgccacggctgctgacgccggagacgctccgcacggcggcgaagcagtcccaggggatccacctcgtccccctctccctccgccgcgccatcaagcgctacctccgcgaccaggacaaggcgcacatgaaccgcaaggtgctgctgctctcggcgtccttcgaccgcgccaagggcaccggcgccgagctcgccgcggccgccacccgcggcgcgctcctcgacgaccccaacgcgccgtcgggcgccgagcagcgggcgggcgcgctggaaggtgcggtcggcctacggcgatatcggcctccgg

SEQ ID NO: 22405 - DNA, 479 bp, Sorghum bicolor
  Clone ID: 14188462
gcacgaggccgattcggcaggcggttcgcctcccaaatccccgctcggccgcagcgccgccattcagccatggcgatggtctccggagccaagaggaggagaggactggaggaagaacaagaggaagatgaagaccgcatcagccgcctccctgacggcgttctcggcgacatcgtcacccttctcccgaccaacgacggcgcccgcacgcaggtgctctcctcccgctggcgccacatctggcgctccgctcctctcaacatcgatctggacatcgatcccgattaccccctcggcgcccacaacgtcaccgaaggcgtaatctcgcgcattctctccgcgcatcaaggcccctgccgccgcttctccatcccggagcactacctcctctacagggacctccgcgtcacaagcctggacggctggctcgagtcccccgccctcgacagactccaagagcttgagttccactacggccg

SEQ ID NO: 22406 - DNA, 574 bp, Sorghum bicolor
  Clone ID: 14188465
gcacgaggcgatcgctttcacgagccgcctttcgtagcgccgcagatccatcgccgaagtttcggatctcgtttccggcgaacttttccggtgaaagttcggcgagcttttccggccaactccggcatcctctgcgaaaaccgtcaccgctgcgagcaccatggccagctatctccttcgactccggccgcccgatgccaatccagcctccacccaatggcatctcctacgcatctcacagccatgtgctcgtggccccctttttcccgagcagcagcagcagacgttgctgctcagccaagttgcggccgtcggccatgcccgcgagccgtgcggcccgtagtcggccccaccaccgcggcccggtgggataggcgcgccgctgccaccgctagcctgctgtctggtcgagcccctcccttcccttctcggtgcacagcagctgctgcttcccatctccaacttggccagcgccgttcacgaacatgaccaaaggaagaagatgatgaaggagcgtggttcgtcaacagtgaagatcaggagctgaggaccgacagtcgaagcagaagataga

SEQ ID NO: 22407 - DNA, 521 bp, Sorghum bicolor
  Clone ID: 14188470
gcacgagggagaggaccacgaccaggaggagtacatggaccacctcgtgtccaaggagaccagcttctgctgctccccttcctcctcctcgcccgtcttctccgacgccggcgccgagccatgcccttcgtccacggcttcctccgacgagtggttccgttgcgcgcgccgcgccaccgtcgagtggatctttgagacgcgggcttacttcggcttctcccaccgcacggcgtacctggccgtctcctacatggaccgcttctgcctccgccggtgcatggacagttcagtgatgccctgggcggcgcggctgctggcggtggcgtgcgtgtccctggcggcgaagatggaggagtaccgcgcgccggcgctgtccgagttccgcgccgacgacgactacgacttctgcagcgtctccatccggcgcatggagctgctggtgctgtccacgctggggtggcgcatgggcgacgtcacgccactcgactacctcccctgcctctcctccaggctacaccgag

SEQ ID NO: 22408 - DNA, 445 bp, Sorghum bicolor
  Clone ID: 14188471
gcacgaggaggatcgatggcatctatgattccttagacaaggggcgagaatgcatgctcagaaatgcaggaatcgtgctacaggagaataatagcatggtggcagctggctcaacgacaccatggagaaccgtgacctgcaaagtgtgcttcgaggaattctccatggctgctgtttcgaccatggactgtgggcattgcttctgcaatgactgttggacagggcatttccacgctgcagtagagagtggaaaaaaacaaattcggtgcatggaggtcaagtgctcggctttctgtgatgagaacctcgtgctgtttctccttggccaaaagtatccagacatggccaagcgtttcaatcgcttcctgcttgagtcctacattgaggacaacgcctctgtgaagtggtgccccagcaccccaaactgtggccatgccatccgcgt

SEQ ID NO: 22409 - DNA, 501 bp, Sorghum bicolor
  Clone ID: 14188473
gcacgagggagaaatcccgtgggcagttgcagaatgcaaagcgtaaacatgcagggttcagaagccctatatgtgaggttgcaaattctccatcaagtaatgatgaagctgatgctcctgccaatgagtttacaactgccaagagaatgatggggatggatgttgtgcataagtctgtacgtagtggtctacaaggtgcttctgtatcaccgcaatgtgataacaaccatagtacacggaattatggcgtgagaccaagctggaattctcgtcgtggaccacgtggtagttttataccccctatcagaaataatggaggatcaggtacaacaatctcacgggtcactggcaaaaatgacgagtccatggaagtttcaacaaggaaatgtattgacatgctttgtggccctgatggtgagcttcctgagaagctgaggaatctggaatctcgccttattgaacatgtcagtaatgaaataatggatagggatcctaatgttc

SEQ ID NO: 22410 - DNA, 441 bp, Sorghum bicolor
  Clone ID: 14188488
gcacgagggcggcttccgcgctccaccttcgcctcctcccctcgccgccggcgagtgtgaagcttcagcagcgacagctgcgctcgttgagccccagaatacagagacagggtggactatctcgaagattttcgaaagttgtgtcctattacggtctcacaactccaccatataaactggatgctctggaaccttatatgagcaagagaacagttgaacttcactggggtaagcaccatcaagattacgtggatggcttgaataagcagctggctaccagccctctgtatggatacactctggaggatctgataaaagaagcctacaacaatggcaatccattaccagagtataacaatgcagcacaggtctggaaccatcacttcttctgggaatcaatgcaaccagaaggtggtggcgtacctgtgggaggtgtgctgc

SEQ ID NO: 22411 - DNA, 417 bp, Sorghum bicolor
  Clone ID: 14188489
gcacgagggttgttctctacccttgttaagttggagctgtcagcattaaggtactatgttattaatgctttgaaatctggaagacaagacaaagtaattgaattctttggtgaaaatggcaattatctgttgcaaaaacgtggagattggttggcatggtttgctattccatatattaagaacccaagcttggatccgcagttccgtgtatatttctccaaagagtggctggacactttggttctttcattcaggaattttttgagcgggatattcaatgatactcggaccccagctcttatgagaattagtagtgaaaagaataccatcaaatccctcaagaatgacataaagcaactgaacaataaattggcggagctacaagcatccttagaggcgaaggaagatgagatctct

SEQ ID NO: 22412 - DNA, 337 bp, Sorghum bicolor
  Clone ID: 14188492
gcacgaggggacatgggcatgcctggaacaatccgccaaactggccttctccagtttctaatggttttgtccccatccaacatggtggtgctcctggttttcatccacctgtccatcagtttccaggcccacctatgtttaatcttagacctcaaatgaagttaaaccaacctggagtttcatatcccatgcatgatgctgttgataggttttcgactcacatgcgtccatttgggtggcctaatcatctggatgaagcatgcccacctcatatgcaagtttggaatggaggcagtggtgtatttcctggtgaaccctatatgtatggtaggcaaga

SEQ ID NO: 22413 - DNA, 361 bp, Sorghum bicolor
  Clone ID: 14188533
gcacgaggctcttctctcctgttcgccgctagagtcgcctcgaggctgcggtgaggagaagcggcagcgcctcacctctccaatggcggcctcctccctcctccttgcgacctgtgcgcttctcgtttactgaggctccctgagacaagcttgcgctcacgatggagggtttttcgagggacttgctgtgtgggattgggaagggagacgcgccgccaccggagcagaggccggggcagctgcgcgaggagatggaggcggtcgagctcagcctcggactgtcgctcggcggccggttcgggctagacaggaagggggacaagctcccccggtcctcgtccgtggcggccatgctgacgcc

SEQ ID NO: 22414 - DNA, 266 bp, Sorghum bicolor
  unsure (1)..(266): unsure at all n locations
  Clone ID: 14188540
gcacgaggctacgacggaggagagagagaaacgcccagagctcgcaggacaggccgtacggtgtccggcgaatggcggcnatgggcgggagcggcgggcccggcgacgacgcggcggagggcgcaggagccgggttcgaatgggatgccgactcccagctctactaccgcgccagtactgctttttaccatgaccctgtcgctggatggtactacagcagcagagatggccaatactacatctaccaaaatggaaattacatgcca

SEQ ID NO: 22415 - DNA, 528 bp, Sorghum bicolor
  Clone ID: 14327978
ttcgacggcatgcagagcgtgctctcgggcgttgtccggggctgtggccgccaaaaggccggcgcgtacatcaacctcgccgcgtactacctcgccggcgtcccgtcggcgttcgtcttcgccttcgtttgccgtctaggaggaatgggcctgtggttgggcatcatgtgcggcctggtggtgcagatgctgctgctgctctccatcacactatgcaccaactggaacaacgaagcgctgaaagcgaaggatcgggtgttcagctctgctcttcctccattagattagacatggcagccggccacatgagattgcgcggagggagaacacaaggggatgcagtcttgttgaggtattgattggcacaaggaagaagaaacgctaatgtggtgtggtggaaggaataatttaccgatcgataatggccatgtggcagttgaagcagttttgtccgtcaatctgtcttagatgcagatttgaggcatcaacgcaactaatgattcgttctgacacccaaccgggccatat

SEQ ID NO: 22416 - DNA, 558 bp, Sorghum bicolor
  Clone ID: 14328105
gaagcgtctgattggtggatgaagatgattgtctgcgatttatgagacatgagcaacgacaccgtccatgtcgaagaatacgaaacacgttattgctgtggccattacagcaacggctggacatgcacgacgcccccgaaagaacgactccccccatacttacgacttctgtcccctcgaaaacacgcacttccggtcgagtcgaccgtttgactgtcctggccatatggcgcctttccctggctaccctgccgcacgtcgcggattccaagacgcagaagcattgagacaaggagccaaagaacatgtcggtggggaaggatgaatcgagccatgaggaatatctctgggagtagtatgtcgcctacgcggtctattacaacagggaaagacgttgacagaaccgtcgagcaagttagctcgctacttaataaaagttgtgtccagggcacgatggccatttcagtcgatgccagtcgtggatcaaaaggccaatgcacttctcactgctgtttaagaccatggcctcttagttttgggtctgagcgttgtagtcta

SEQ ID NO: 22417 - DNA, 631 bp, Sorghum bicolor
  Clone ID: 14328119
gtaccaatggcggaagtacgggcagaaggtgaccaaggacaacccgtgcccgcgcgcctactaccggtgctccttcgcgccgtcgtgcccggtgaagaagaaggtgcagcgcagcgcggacgacagcaccgtcctggtggccacgtacgagggcgagcacaaccacggccagccgccgcagcacgacggaggcagggccgcgaggtcgacggcgacggcgcaggcgcaggtggcgagcgaggccgccgtgcgaccggtggcggcaccactgccgctgcagcacccgcaccagcagcagaagcagaagcagaagcaagaggcggcgacgacggtgccgtcgtcggaggtggcgaggaagaacctcgcggagcacatggcggtgaccctgaccagggatcccgggttcaaggcggcgctagtcagcgcgctctccggccggatcctcgagctctccccgaccagggattaactagcagtagacgaacatgatgatgaattaacgagttagtccgtagacagcgaatttattcagaatcgtagctcagaatttcgccaccaagcgatcgaagaagtgaattcgagctgcttattgcgtgtgcgttcgaatatcaactggcgtgcggaccattca

SEQ ID NO: 22418 - DNA, 538 bp, Sorghum bicolor
  Clone ID: 14328219
gcacgaggcatgtttgcaagggaactaacaggatcatcaccgagctgatctaacttgatggaaaattcattattgaaagttttatcatcagcttccaagacatctttagtagagttagtgaccgtatttggcatcatttcacatgatttatcttcaggtgctgaggaacaatatggaggtgcagtaactggagatgagcatcccacgggggctgacaaaagcacaggcgcagcaggtggtgccggtggtgctggcgcaggcacaggatcaggcactggtgcagcaggaggtacaggtgcaacagaaggcacaggcgtaggcgtaggcgcaggtgcaagggaggcggtcttctgttcgccatcagctggacttccatcagcaacagcttcagcaggatccacagggccttgcaccttctgcttctcatacttggccaaaccttgcccccatccaaggcgtgccttcttccttggtgcctcgtcctcggtcccatgaggacctgccacggccagaggctgagctgaagcctccttccctg

SEQ ID NO: 22419 - DNA, 490 bp, Sorghum bicolor
  Clone ID: 14328233
gcacgaggctctgacccgtccgggatgaggaacccggcggcaccgggcgccgtcactgagtcggcggagctggtcctgccgttgctgccgccgcaggacctggcagccgtggcatccgcctgccgcgccctccgcgcggctgtgactggtgtcaccgcgcgccgcgccgccgacgccgcacgtggcctagagccgctccccatcccgttccgcaactgcgtcgactccaagccctatgcctacttcctgtacactcccttctccctcacccggctggctcccggcgcctccgcccccagcgcccagccgtggggtgccgcctgggtccggccgccaggccctacctggccccgccccaacctcgacggcttcccatcgtccgtgtgcgggtgcgcgtgcgccgcggcagagtgcggcggtacccagtgcgcgtgcagcgatgcggatgccgacgcagcgggcccgggcttcgaggctgggatggggagcc

SEQ ID NO: 22420 - DNA, 492 bp, Sorghum bicolor
  Clone ID: 14328234
gcacgaggctagaacctaggatcacttgtcgggattcttgcagctccctgcataagatttgtacgtcgtttccgataatacacaaacgggccacttactagcaacatcccggccatcactacctcaaaaccaagaacagataacttctcttctccaaccaatggcacacaacttctgtaagtaatataatgctttggaccacctgatgcggatttcgtaccacctgatgtggatgcatcatccaatatcttcctctgcttggtcttgtttccttcttttgtagcattttgtgcctctacacatttcaagggcaggcgatagccagtttcgctgcagctatacttttcatcattctccggcctccctttgagactctctcacacatcgagcatggccagaggcggcaagcttgccagctgtgaacccattagagcggcaagctcagccagcagccatgaggcctgccttgaggtggcgtgctcagccagtggg

SEQ ID NO: 22421 - DNA, 494 bp, Sorghum bicolor
  Clone ID: 14328245
gcacgaggcgccatctgcagcccggcgctggataacgcaacgagcgcgtcgccgtcgtccctcggccatcccggcggcggccacccgcttcccgccgcggtgggcggcaacacagtgctcagcgacctcaccagcagcaacaacaacggttgcttcttgccgaggaagcgcgcgcgggttggggacgtgtccggcgccggcgcgggcttgatcatggacctgcaaggccaacgcgctctgctgccgccagtgccggtgccggtgccggtgctcgcgggagacgtccagaggaggctgctctgctctgccgccgcgtccaccactaccagtggccgcccgaccgccagcgtcgcgccggtgtcgcagtcgcagggcctcctgtcgcacctctaccaccacggcgtcgagattgacgcgctcgtccgcatcgagaacgagaggctgcgagcggggctgcgggaggcgcggcgccggcacgtccggacggtggtgtc

SEQ ID NO: 22422 - DNA, 160 bp, Sorghum bicolor
  Clone ID: 14328246
gttgcgggcttggatgctctaggagtcgtcatgtacacttgtgttgtatgggttgtcaactgtcaaatggatctctctgtgaactacttcaccataatccactacatattcatatggggcagcattgcagtatggtacctcttcctcttggataatggtg

SEQ ID NO: 22423 - DNA, 584 bp, Sorghum bicolor
  Clone ID: 14328278
cttgctcatatttgacccgtgaaaggaggaaactggccaacatcaaggagagatactttcgacaacatgggggtctgctgcttctggagcagataagcacagggcaaggcactacattcacaatcttcacagaagcagagctcatggaggcgacagaccaatttgacgacaagaatgttcttggtcgtggcggtcatggaactgtctacaaaggcacgctcaagaacggcattctggtcgcgatcaaacggtgcatatcaatgacagatgaacagcgcaggaaggagtttggcaaggagatgctcattctgtcccaggtcaaccataagaatatcgtgaagctcctaggatgttgcctcgaagtagaggtcccgatgctagtctatgagttcatccccaacggcacactattccatttcatccatggtgtcagtgggtgctgtgatgccccgttctcaactcggttacagatcgcccatgaatctgccctagcattggattacctacattcatgtgcgtcaccgccaatccttcacggtgatgtgaaatcctccaacatacttcttgatgacaagtactccgcg

SEQ ID NO: 22424 - DNA, 559 bp, Sorghum bicolor
  Clone ID: 14328317
ctacaatctgggcacggggcgcggcacatccgttctggagatggtggcggcgttcaagaaggcctccggcaaggagattcccaccaagttgtgccccaggagaccgggtgacgcgacggaggtttacgcgtccaccgagaaggctggaagggagcttggatggagagcccagtatggaatcgaggagatgtgcagggaccagtggaactgggccaagaagaacccgtatggctactgcggcagtgccgaaaaatagagtgggttcatcagaactccggaatgaattgtccatagtagttctttgcaacctatcagtggaacatgtaataagtaaaaaaaaaaaaccacctaaatgtgcctacaaagtttcatacgatctcccggcttaatacgtgatttttttttgaaccaagcttaatacgtgatgtttattggctgctaccggccgggtgatgacttcagatggttggtacgtgccaagatttgggtgtgttaactaagctgcgctctgactcggatcgtgtccccaccgtcttgtcttccttttgctcattcccac

SEQ ID NO: 22425 - DNA, 705 bp, Sorghum bicolor
  Clone ID: 14328370
ccttggcggcaccatggaggaccctccatggtggacctgtggaggtagactatcaggatccggtgggtcttgacgaagcatcgaggagcatccatggtggacctttgtggatctatggaggaaggagatctcttcgttcagggcactagcatctccagacggtggcgcaggcccaggcgctagcacgagcagaggaggctccgactagcagaggcgcaggtttgagcagtagtagctccgaccagtggagcaggaatgggcgcagggtagctctgctcacatcatgattggttgaagcatgtgatttggtgtcggcggccacacggtgagatgcatgggatgtgggcaacagtatgttaccaactggtgatctggtgaggcgaggtcccgtcctgatggctgatctgtcgtccccaactatagtgttctgatctgttgaggtcctgcaactgcaaggtatgcaacaaaagctttagtttactcgagagtaacacactctgcaacaacagctttagtatttggtctttggaagttataatcaagagaaacataagcctagtctttagaggttatacctgttgtgcagtttttttactttagtgtacaccattactgagttgcaacgggttgtaccttgggtttgaacttgtattctcttgtaaagcattatttatgaattatgaatgagaattatgtatggttatt

SEQ ID NO: 22426 - DNA, 681 bp, Sorghum bicolor
  Clone ID: 14328389
acaaaggatagaagaagcaggagggtttgtgatgtgggctggaacgtggcgtgtcggtggcgtccttgctgtttctcgagcatttggggacaagctcttgaagcagtatgtggttgctgatccagagatcaaggtctgttcttcaatctcagtgtgaaaacctgcaaatgccgtggcccgtgggatttgactaggaagatcgccggtttggtgcaggaggaggtggtggacagctccctcgagttcctcatccttgcaagcgatggcctctgggacgtggtgaccaacgaggaagccgttgccatggcgaagccgatcctggactcggagcaggcggccaagacgctgctggctgaggcctcccagcgcggcagcgccgacaacatcacctgcgtggtcgtgcgcttcctggagcagcaaaacgggcttgccggcagggccaccaacgatcaggcatcgtgagatcaccctggtgccggtgctgttaaaagagctagcgtggtccattgcaaaattcattattctcgttcacagcgccaagtgcagctgcagctgattgtatattgtgcataatgtgccgagttaattctttaattttaacttggggattgtttgtaccaatagtttgctgcactaaaaatctaaaatgagatgcaatgtttgcgtttggttgggctccgc

SEQ ID NO: 22427 - DNA, 724 bp, Sorghum bicolor
  Clone ID: 14328422
gtggcgtccgagtacagggacacggtggcgcggcggtacttcacggtgacggggacgcagcccgacgaggcgacgctggacgcgctggcggagtccggggaaggggagcggttcctgcagcgcgccatcgcggagcaagggagagggcaggtgctgggcgtggtggcggagatccaggagcggcacggcgccgtggcggagctggagcggtccctgcttgagctgcagcaggtgttcaacgacatggccgtgctcgtggccgcgcagggggagcagctggacgacatcgaggggaacgtggggcgggcaaggtcgttcgtcgatcgcgggcgcgagcagctgcaggtggcgaggaagcaccagaagagcacgcgcaagtggacctgcatcgccatcctcatcctcctcgtcatcatcctcgtcatcgtcctccccatcgtgctccaaaacaccaagaagaactagcccgccgcgctgtgctctgcctgcgtttgttcatgcatggtgatcactgatcaggttgctgccgtcttgtggtggatacgtatacaccgggagagatgattatcgttgggtttttccacaaccccagattcgttctagttctttttgttcgtggcctttgtatgatacggttagttgattgatctggtcgacttgattatagttatttattaccggtggttttgtttataactgttgacgcccttttgcatcaacaata

SEQ ID NO: 22428 - DNA, 292 bp, Sorghum bicolor
  unsure (1)..(292): unsure at all n locations
  Clone ID: 14328446
gcacgagggcctcagtcagtaggtaaaatagaaaggcaagttactggtgcaccaccaccactgtctacgataggctattctgttgatgttttcgatggaaatgaagtgccacctcctgagaagaaagaatgtaactataggaatggaaagtgggtttctgacaatcggagaccactgtactcagggtttggttgtaaacagtggctttcagagagttggtcctgcagattaacccagcgaacagattttgcatatgagaaatttagatggcagcctgaagcttgtganatgc

SEQ ID NO: 22429 - DNA, 123 bp, Sorghum bicolor
  Clone ID: 14328543
gcacgaggatcgcttccaccacactgctgcctctttcgcatatctctcccaacatcagggcgcgagagcaggggatgccggcctcctactgctcccaccacgccgctgcctccgcaccagcag

SEQ ID NO: 22430 - DNA, 326 bp, Sorghum bicolor
  Clone ID: 14328547
gcacgaggattgattccatcccttcagcatcgctcgacgcgataaaggagtggctggacacaactgacctcaagtactacgagagcaggctgaatctgaactggcgtcctatcctgaaaactataatcgatgatcctcagaagttcattgacgatggcggctgggagttccttaacatggaagcgagtgactcagagactgaggacacagaggagtcagaccaaggctatgtgccttctgatgctgagcctgagtccgagtcagaagatgatgactctgacagcgagtccttggtggaatctgatgatgatgatgaagagtcagac

SEQ ID NO: 22431 - DNA, 404 bp, Sorghum bicolor
  unsure (1)..(404): unsure at all n locations
  Clone ID: 14328573
gcacgaggcagtctgttgttgctttgtctactactgaggcagaatatatggctatttgtgaagcgtgcaaggagttgatttggttaaaaggtttgtacgctgagctcagtggagttgaatcttgcataagtttgcattgtgatagtcaaagtgcaatttacctcactaaagatcagatgttccataagagaactaagcacatagatatcaaatatcattttgtgcgtgatgtgattgaggaaggtaagctgaaggtatgcaagattagtactcatgataatcctgctgatatgatgacaaagcctatttctgttgctaagtttgagttatgctcaagcttagtaggtttgattgaatagtccgagagactattgttggcaccactggttttctatctttgttgn

SEQ ID NO: 22432 - DNA, 402 bp, Sorghum bicolor
  Clone ID: 14328595
gcacgaggcaggcctccagcgatcgaggtcaagcttgtaagtaaaaccggccgtgagctgctgccctgtcgctgttctgttctgcccaaatatcaaacatgcccccctctcttgcgccgccgccgccgcctgcggctgatcacaaggcctggccgaggcagcagagacacgcggagaagaagaagaaggccgcggggtcgccggcaccgcggagggcgtcgttccacgggcgcggcacgtccgagcaggaggagcagcagcggcagcagcgagaccaccacctgctgagacagaggccccggacgcatccggacctgctgctgctggccggcgtcagggagcgtggcttccggcgagcgggcgtcggtcacgctaccaccacaccagcgatgctgctgtccc

SEQ ID NO: 22433 - DNA, 164 bp, Sorghum bicolor
  Clone ID: 14328647
gcacgaggacgactgtacccatcaggtgctggccggagagggagggagatggacctgacgatgggtgatagctttgcgtgcttctgggattgcctcgacgactccgaggggatgcagagcttgtacatcgggccggacggcgacgccgcggtgtccggcggcgg

SEQ ID NO: 22434 - DNA, 280 bp, Sorghum bicolor
  Clone ID: 14328649
gcacgagggcgtagcgggagtgtcgggagcaatatcagcctagatatgcgagagggtcgcggtatcagtgtcggtgcaagtaaggctgctggtggcattgtgacgaagagcggcgccagcggaatcaacgtggaggagagtcctagaagggacagctctgcagaaaagaaaaagaagtaggtggctaagtggaagcgcaatggaggaagagttggattcagtcatgtcttcgatcgacgattcagaaataatgcttattctttttatctgttaaaaaaaa

SEQ ID NO: 22435 - DNA, 495 bp, Sorghum bicolor
  Clone ID: 14328659
gcacgaggcttggttttgtgagaggggaccaatatgctattgctcttgccttgattgaagatggagaagttatacttggtgttcttgggtgcccaaattatccaatgaagaaggagtggctcaactatcatcaaaagtactacaggttgatgtctaaggttgctcctcctccactggggtcctggaataagggttgtgtgatgtatgcccagaaaggttgtggccaagcttggatgcagccactggtccatgacttcggtaagctaaattggcaccacccaagggagattcaagtatcatccatcagtgatccaatctcagctacgttctgtgaaccagttgagaaagccaactcaagccattccttcacagcaggacttgctcaaagtgtaggattaaggaatcaacctctgcgcgtgtacagcatggtgaaatatgctgcaatagcacgaggtgatgctgagatcttcatgaaatttgcaagagctggataca

SEQ ID NO: 22436 - DNA, 255 bp, Sorghum bicolor
  Clone ID: 14328678
gcacgaggctctctctctctctctctctctctctctctctctctctctctctctctccgactttgtacaacgccctttgatcgatatttgttcttgagcttcttcgtttttgcaccaaaagacaagcatgatgtcttgcagctgcggatcaagctgcaactgcggctcaagctgcaagtgcggcaagaagtaccccgacctgtaggagaagagcaccgcggcgcatgccaccgtcgtcctgggtgtcaccccgga

SEQ ID NO: 22437 - DNA, 534 bp, Sorghum bicolor
  unsure (1)..(534): unsure at all n locations
  Clone ID: 14328688
tatcaacacagacaaagtcaaagataaaaatggtgcatatctggaagtctcaaggttggaaatattttttcatgaactctccatgtatgaagagaaaattttcctcaaaagatataaactggaacaggatttgttgctgaagacatatcacgaaatgttgcgtgaagcttcagaaagtgaaagaccagaactgagacaaaaattagatgatctcctttttaatgaagaacgcccgtatgacagaataagactaggattaccaggatggaagtcccggttcttcagggagtattttggtgccgaaacttctaatgaaattggaaagctgcagaacgacatggctcaaaaatatttagaaggactttgttgggtgcttcaatgctattttgcagacgttccatcatggagctggtactacccattctatgttgctccttttgtatctgatctcanaggtctatctagggttgatatatctttcactgtggacaaaccactacgaccatttgatcagcttatggcagttttaccaat

SEQ ID NO: 22438 - DNA, 533 bp, Sorghum bicolor
  Clone ID: 14328689
gcacgagggcgggagctggaggcagagctgcgcaagatggcgccgcccaacggccgtaccgtcctcatcttccgcgccccctgctgctgccccaagggccgcatggaggtctggggcgccaagaaggtgcgccggatcaagaagtaaagaggagcaaggatcggatggttactagttagtgcaatagtattagtgcactcttgttccttcctcaatcctcgatcataagtagctactgctagaaaaaaaataaatcctcagtaataataagtatgtataagtatagggagaaataaacggagcacagaaccagttatatcacagatagcttatatagacaattatatactccttgtattatgaactggtggggaatttggacagaaatacatgctctttacttgttcattctctagttttcatgggatcctggatacctgatacagtagcaacatagacaatatcttaatcagcatctggctactccttttgctgccttttgaatccttgatttttgtctatatattgtggtg

SEQ ID NO: 22439 - DNA, 557 bp, Sorghum bicolor
  Clone ID: 14328692
gcacgagggtcaaatggaagccttgacaagtatctttattgccaagagagcaagggtactctgaattgggcacaaaggcttggtatcatcaaaggcattgcatcaggcttgctctacctccatgaggaatgggagaaggtcgtcgtccaccgggacatcaaggcgagcaatgtgttacttgacagtggtatgaatggccgattaggggactttgggcttgcaatgttgtatgaccatagtgccaaccctcaaacctcacatgttgttggcaccatagggtaccttgcccctgagcttggccgcaccagcaaggcgaccactttgaccgatgttttcgcctttggtgtatttgttcttgaggtcatttgtgggcaaaaacccatcatgcaggactcagatgacaaccaaatcatgttggtagactgggtggtggagcattggaacaagacatcgctagttgatacggtggatgcaaagctccaaggtgactacaatgctgatgaggcatgcatggggctgaaggtagggttgctatgctctcatcccttccctgaagc

SEQ ID NO: 22440 - DNA, 663 bp, Sorghum bicolor
  Clone ID: 14328713
ttattcgaggatccaacaatgggtcaatgaagaacaacccaaatgcgcatcatgttgatttcctggggcaggaatcctttgatcatttttcgcgaacaagtctattttgtgaaggcactacttcaggggatttgggtaatgttggcagcccaacacgacaactgaaataccaatccacatctttggaccctgagataacggaacgcccacctgaacagccggtaggtgtgatggagaacaccctgaaggcaaaattacttcaagcaaggctagaggggcgacatgcccgattaaaggcagcaggtggctcctcaaccagcaggagaaagtgagagtgctgcagattctggggttttactgtttgaggcccacatgaagaaataaaaggtgtaatatagctaacttgtatctatggaattttctttggctgcgtcaattggttcagtatccatgtacatgggttatgaactatctgaatatatgaatcctagttccatatgtgaatcaccttccatgtcaattaggctgttagttagatgccagcacactttaggctgatagctcaaaactcagaaggattttggctatgacaccttgtgtcttgttaatctctctgacactttgcttagaagtctattttgatgtattacatatgaacagcca

SEQ ID NO: 22441 - DNA, 631 bp, Sorghum bicolor
  Clone ID: 14328722
cctggtccgccgtggcgggcgcagcacaccagatcccacagaagctggcgaacctctggcggtggctccaggccgctgccccggtcgcgctcccgtacgtgctcgccgtggctgcggtcgtcctcgtcgcgacgctcgtgtggttctgctggccggtcctcttggaagctagcgtgggggtcgggaaggcactcgtgatcggcgcctgcttcttcgtgcaggggctgttgcacgttggccgcgccgttctgtcggtgttcgtcttcctcctgccgtgcctgaactgcgccgtggtcaccatgaaggcccctggcgccgccggcatacggatatcgcgcgcggccttcgaggccgccccggcgctattcttccagatcctgcgctccgctccaaccatcgtggccgccaccgtcttctgcacgaaaacggtggccttgctcgtcgctttcccggtcgccgctcttttcggcgcccggtgaactggtgaagcatgcaagcaaaagtcagggaaatggatcctaggtgacctggtctcatgcatgttatcgatcgagtatatgagtatgcgtcaagctcgtctggtcgtcgtcaagatttgcaaatgtgtgtgttttcatccatcgtttaagtg

SEQ ID NO: 22442 - DNA, 564 bp, Sorghum bicolor
  Clone ID: 14328737
agaggcaagagacaccagcttaattctctgttctacaggtagaaggcaagcagtatctctcagaatggggctgcggtatctgtcaggcgaaatgtaactctgtatctcagtttgagaatcactgcagcagcaggggacaccaacagaaggtagaagctctacggaaaggaggccaaattgcaagctcaagtggttccaagacagctaagtgtgcaagctctgaggagacggagatacatagggcgacatacttttgcaagctttgctatttgcactgcaacagcaagaatacactagccgagcatcggaaggggaagaagcacacagagaaggtggagcaacggatgtcgttgagtttttgcgagatttgcaatctgcaatgcaacagcgaaaagatgctcgctcaccatcgtactgggaagggtcatctgtcaaagctcaacaactaatgattggagaggctgtggagcgagaaatgacagcaccatccattcatcttgaagatattcaattggattttcatttaccaagtcttacaacctattatttgacatgataatttat

SEQ ID NO: 22443 - DNA, 463 bp, Sorghum bicolor
  Clone ID: 14328743
tctacctggatcaaagaggaaatgtcctcacttcaagtccaatgaagaggatgtagaactctcggatagttttactcgctccgtccatcttacaccaataaagcgactcaaggaaagtcacgacgctagatatggagtgggggaatcccacaaagttatccatttttctagtagctcctcagattaccacgaggagacgcatttacacaactcaagaggttgtcttcagaactccccttgtaatgttgaggatgccctgtcgaaagggtttgagggttgtatttcgatgaaatgccctttttgatgtaaccaggaatgaataggttagtcattcttgtggcagcccagaaaacattcccactagctccaaaatcatcttgtgtatttagtccttttttcttgagaggtcatatatccgattgtgcctgaatgatgagcatcagtaacccgcaacggagtatat

SEQ ID NO: 22444 - DNA, 626 bp, Sorghum bicolor
  Clone ID: 14328762
tcccgagaaggtgaaggcttccaatggtagctttctgaagcatagcgatgttgacagctccaaggcaccagtggttgaactacttggagagttcatgtgtgcaaatagctcaagaggaagatctatcaagagattgaatcagaatgccggagatgctacagttcaggaattgttggaacatttgggaaaggatgaggatgtcgaaaagatgcaggtgcattcaagcatcattcaaagccctagtgttcaaggagcaaaaaaagagcaggagaaatctgtaagactggagaagaccgatgcgacgccaactccactgacaccgactccattgagacgctcaagccgcctccgcagcaaggtgacttccccttgagcaaggacgacgatgcatgctaaccttgatgctgggttcctttgtggtgtggcggaaagctgtggacgggacagcacctagttgttacccaagctttgatgttgtgctttaggagcagaagaacaatattttaccagaaaatgctgcgtatttgtccccttttaatcctcacgtgcatgtatttctcgtaccgatggctacacttaacggtagatccggctttccggctagagacgtctgtaatgaacaaatc

SEQ ID NO: 22445 - DNA, 582 bp, Sorghum bicolor
  Clone ID: 14328772
gggcaggctttgctctgcaggttgggaaggccttggccaaggatggaacctttgtggagtgccatttgtttaacccaccgtcagtgtcacttggcacgggcctcagaaaaattcaggagaaagccagcagtgtcctcaagcgatatatcagtagaagcagcagcagctcttcatcaaatgtttccccaggagaggagctacaagccgcctctcaagttgaagttggagaagaagaactgaacaatgaggttaaaagatgggtgccaaacctatacatcaacagcagcgattacatttgttgcttctacgctgatcgtagcggtgttgctaccgtcaccacggagaagcattccggggtgcattccaagctgtacgtgattgccaaaggaccaagcaagttcctggaggctcacgggctgcagcaatggtggtccgatgattccgagctccacttggccgtgcacgacagcaaactcatgtacaggcaccttaagtccctctatgtctaacaacaatagagaagtcaatagtacttatttctcagaaatgccttagttctcttttctagacaagaagacatga

SEQ ID NO: 22446 - DNA, 720 bp, Sorghum bicolor
  Clone ID: 14328773
attgcaaaggccattcagagaagccgtgcaaggattgctgcggctcaacagcaaagccaaaggatcgagcagtcaccgcagtctgtgaacgtgactactccagcacaagcagagcaggatgctcctcacattgctgaagcctcccatgctgttgcatctggctccggttcaactgaaagagaaactgtagcaaaccctgctactgtcttggctgatgacaatttgaatgtgtcttcctcgccagcagaaagctcactgaatactccatccaaaccaatggatcctgcccttgctgacattgttgagaagaaactttccagttcaatagagaagatagagaagttggtgaggaaaaacatgaaacgaacaccgaaggctgcccgggcctccaggagggccacccagaggcgcaatctcatgtccatgcgatgaatttactgctgtactttgctgggggaagagaagaaagtccacctcaggcttgtcctccttcctcttgtctgctgtttccttagtcgctagcctaagtgccaatgccccgggtgtgctgctcttcttccaacacttgccatggaatgatgcccgcggccattcctggttcccttctcgagaaccaaagaatatggggctattggctctctgcttgaggctctaggactgcagctactagtgtgaggcgtgatctggttcatgctattgctgatgtatgcatacttttct

SEQ ID NO: 22447 - DNA, 586 bp, Sorghum bicolor
  Clone ID: 14364980
gcacgagggtgcggtcgcctcggctctggttatcccgctaggcgactccatccatccatagtcgtcgtatcagccgaatctcgtcgccgttcttcccatccacaggcgagaccgcggccggaaacctcgacatctgcaccgcgtcctgcacttctctttccgaggttatcacctcgtccttcctgcgtatatttccgccatgagaccggcacttgcaacccccgcggctatccgctctgcatcttcaatcgcacacctctctcgccgtcagacgtgctcttttgcgacacgctgcttagcttctcacactactgcgacatcggcccagctcttgagcccacgacgaacagccgccaacaacaacactgccattgctgcgcccgccaggctatacacacagctcggaaactacaggatggcgtcgtctactgcattcagcaaaataaaggtcaagaaccccgtcgtggagcttgacggagatgagatgaccaggatcatctggcagtccatcaaggacaagttcatctacccctacctcgacatcgacctcaagtactacgatcttggtctcgaataccgtgacaag

SEQ ID NO: 22448 - DNA, 484 bp, Sorghum bicolor
  Clone ID: 14364992
gcacgaggccgatctcgatcgagcacctggggagaccacgagacgcgcgccctgcttcgcttcccgcatcacagctctcaagttctctgcctctcttttttttttcagtttttcaagtaatccgattgttgtagttgcatcttcaatttaccattttaattaatttgcgtttgatctgttagttccattgcttcttctttgattgcggttagtatagtttcgctgtttgttgctccgtgcttcttgttgttctgttgcttctaaccatggacgcaggcacctactccatctcatcagagaagagccacaaggcggcgaaggcagcggcggcgccacggccgcctctccaggaggccggctctcagccctacatgccgtcgctgagcacggggtcgcgcaacccgtcggccaagtgctacggcgataggttcatcccagacaggtcggcgatggatatggacgtggcgcagtacctgctcacggg

SEQ ID NO: 22449 - DNA, 528 bp, Sorghum bicolor
  Clone ID: 14364997
tttcgtactgcaatcagaacataccaagagtatatgctgatgtatatctaccatttgaggaccaaacactgatgcttcgatgccgtggcaagagttgggaagtgcggtgtgtgattaagaaggacaaaaaaagagtcaaaaggcttatgaaagggtggaaacagtttgctcgtgacaacaagttgcggctgggagatctctgcctctttgagctacttgagaatacgaagtacacgatgaatgtgcatgtcattcgtgcaaaatgaaatttggcaagcagttcgttaacactgttggttccaccttttggagtatgttggtagcagagtgatattaaggtttgagcgcctagcttaccctgatgatatctatggcttgtccatcctctgaatgggcaattggttacctcatgttcttgcctaattaagttcagaccgtttctcttgcaatccatctatctatgtttctgtttctgctgtgatgtaattagctactgcaacaacgtcaagccatgacggtttcaccggt

SEQ ID NO: 22450 - DNA, 571 bp, Sorghum bicolor
  Clone ID: 14365012
agtggtagccgtgatgacaggcagaaacgtgaacaacagcgagaagagaaggagctggcaaaaattgcgcaacttgcggatgctcataggaagcagcagcagcagcagcatcaggagaaacaagaaaagtcagagacagaagttgttgcaccaaaaaacatggcagcccctagaaaccaggatcagcgaggaaccttgaagtttggattctccaaaatggctccttccaaggttcaagttggcaatgccagcaagaagccaaaggtggctacaaaagtttcttcggtcttcggcaatgagagtgacgaggactcgtgatctttgccagagggtggtagtgcttccaaggaaaaaaacatcaaaggcccatgagaagtgaggtgccatgtatgtatcaccttctgttgtgccactggcttggccccctctacagatcctggtgtcatctcaacagcctcatgcgaacaaactgggacttgaaaacagcatcatgaattgtatgaacttttgagggtacatcgtacaaggaaatctgtatcgttcttgctgtattttgaaagctatttaagcc

SEQ ID NO: 22451 - DNA, 534 bp, Sorghum bicolor
  unsure (1)..(534): unsure at all n locations
  Clone ID: 14365022
ncagggcaggtgacgctgtactaccaggagtttcccccttcgctcaagaacacggccacaggcatggtagccatgatcgtcgcgctcgggttctaccttagcacggcgctcatcggcattgtccggcgcgccacggcgtggctgccggacaacatgaacgcgtccaggctggagaacctctactggcttctcgccggcctggtgtctttcaacttcggctactacatgttgtgtgccaggttgtacaagtaccagaacgtcggcaagtaaagtaactgaagtctgaagatgatatgctaggatgagggccatcaggtgacttgacactcgcgctgcattctggccaatttgtgtatgctgtgtgttgtgcgatcatgcactaaacaaattttataaatgtgtctactactactatgaagaataagattctgctgtgtgagagaatctgtataataggatcacctccatcagaaatgaatggtccatcatcatatatactacatgccaatggaatatgcgagccggtaaaccttt

SEQ ID NO: 22452 - DNA, 318 bp, Sorghum bicolor
  Clone ID: 14365024
gcactggtcttttatcagttattgttagggtgatccacccttttgggagattcaggtaatatatatgggggtatatgtccgggtatgaaaacatgttccaaaattgggaatggaataatttcatgtcggaccaatattagagtaagctgtttacagcatgttgctgttatgggagtaagagaattattccacatgttgcatgttgtttttttgggagtaacagaacatctttgctactgattacttgtcttagctcaactccttgctagaggcaaaacccttgtaatacaagggtagtctcaatgttgtagtgtctaa

SEQ ID NO: 22453 - DNA, 583 bp, Sorghum bicolor
  Clone ID: 14365026
cagagcagctcagagaagatgagctgctggtgactcgtacaaattagcgtgggacctttcattgcagctagaagactggttcttttgctctgtaaagtggattttgcttttccaagacttgaaggatttgttgtttgaggaggagaggcctcaggatcagaaggctcgggcaagggcacttaacaaatttgctgcagtcctctcacagactgatgaaaatacaagatcttcaaacagcggtcgccttttgagctgcgtgcgtagatgataacaatgctgtaggagatttgtcttctgtctttttgctttgttgcacctggtatccgaactgtaagggatgttgttaacttcaaggtggttacgtagcttgtatcttgtgtgctagcaggtgcaattttgcgggaaaatctccaatttgagagagcaaaaaatgtctttcaaaattgcctcaggttttgttaaggctgttattatgcctttgtggtctgaacttttgtaggcataggcatagcatctgacactacaacgcaagatgtttaattccttgagaactattacggctataacacactactcggatggt

SEQ ID NO: 22454 - DNA, 711 bp, Sorghum bicolor
  Clone ID: 14365032
gaagtaagctacttgcttattttaattactttatttactaatgatagtatgctatcttatatgacggaaataatcaactatgtctaatgctttgtaggaagccttgggttaaaggttttcatccctctatgattgctctaagtgtttaggatctgtaagagttgttaatgaataatcgagacatccctgagaactgtttcgaaataggagttcattttcaggcggctcgagagtataatataatgaaaaattataataatattatgaagcatcacatggacttgaaattttgcgtaagtatatttttgcatggagtctaacttcaataagataaattaggtgatatattatattgtcttatttttttaagtcatactaatactgactctcgttattctttgctttcagagaatgtgtgctttaacaaagatgtcagaatatcgtaaaaaatacactacaacagaaatggctgctgcgattggtatatgtgaggatatgaagtacaacttagcacaatgcagatacataagtcagatacatgagtcttttgctcagcattgtattaattgttccctatagactattctaatcgtaccgtgtttgcagtttctaatttagtttaggtggttaatgatgacacaaatatagtgactaatttgtgttttgtaacgacattacttaagtgaggccacgataatgatgattgtgggc

SEQ ID NO: 22455 - DNA, 495 bp, Sorghum bicolor
  Clone ID: 14365040
actcttggctaacccaggcccggttggagtggacgagggacacggacgcatcagaggagaactggagggcatggaagatggcaccaccaacatctgatgaatcatctgctaactcgggtggccaagctgatgatgagccggagatgcagttccctctttctctgtaggtgaggcagagagcccagagaccgattcatcgtgtcaatatgtggaagcttcttttcgatcttgcgattcagatacatagagtagagcttgcagctttgtgtcatggacatctcatttgagttcatgaaagccaaggaacaatcataccgggaccgttagttgttatggggatgtgtttgcagttccagtactggaatgccagtcctgtggtaacctcttcatattttttgtttgtttgtttcggaatggattgcctttgtccgttgggctgtgaaaacatgcaatgtgtcgcatgtcgatctgtcaatacaaatggaattcagtttg

SEQ ID NO: 22456 - DNA, 551 bp, Sorghum bicolor
  Clone ID: 14365046
gatccatgctgttgtcattcaacaagctgaggaacagaagcagaagaagaggtcagagtctgcattcaaagaatttgagaagaaggcagaggagctgagatccctagagtcaaaatatgggtcatatatcggtgctgaaggttacagagaaatgtcacgaaaatcaccagtagctgacaagcgggcaaaggttgaggctctgaggagccgcgccgatgaggagaagagcaagtatgagaagagcattggggtcacaagagcaatgaccttgaataacctgcagactggcttccctaacgttttccaggcgatgacgggcttcgccagtgtctgcatggaggcatttgagtcggtgtacaacttcaagcgaagctcagatcggatccttgacgtgaagaggctgctgacctgaagcaatgttgcctcactgtataaaatgtactatacagtcctagatttctagtaacataataaccttgcaacctttgtgtggcggttatcaggtttaatggcactatagtagtcgcaaaaatcctgtcaagttcatttac

SEQ ID NO: 22457 - DNA, 406 bp, Sorghum bicolor
  Clone ID: 14365056
cctcgccgtttacatcgcctgtgccatgtggtacaagggcatcaagcttgacggcggcgacggcgatgacagtagaaaggtctttgcgcatgtttagccactgggcctgggcctttagttctttttggttcagagacgtgccgggctggccgtatatatagaaaataaaaggaatgtcaaagaagctgcttgtaaaccatccgctcagtattggacggcccatgctgttttgcatctttggtcagagcagaggctccaagtaacttcatgtgaagtactaatgctagtatatgtatgtatttatgtatatggatgtcggctgaacttgcttgtaaccatcctctcaatagacaagttgtgatcgatccaaaactccaaatggaagcaaagctgcctgatccatgtc

SEQ ID NO: 22458 - DNA, 477 bp, Sorghum bicolor
  Clone ID: 14365080
gcacgagggttgcaggggatgctgatggaggttaacttgggtgaaggtagagataaaatgttttgggccttagaacaatccaggaaatacacctcaggttctttatatagagctattacgtttggaggcgttagagatcagcgattgatgaatgtgtggaaatgtaatattcctctgaaagtcaagatttttatctggatggcggcacatgatagaatccaatcaggggttcagcttaagaaaaaacagtggtcagggccggaggaatgcgctgcttgtgataatttggaaacaaccgatcacattttattccagtgcccacttgcagtatatctttggtcattcttgagagtttccttgaactggtcggcctccccgaccaattgcacagatttcctaatggagtttgctgaagattgtagaggtgctaagcgcaaggtgacgctttttatatgtgcaggtgcgttatggacaatc

SEQ ID NO: 22459 - DNA, 400 bp, Sorghum bicolor
  Clone ID: 14365094
cgaattctgggagccgccgcaatcctcctcccgtccccgccgccggccgccggctgcccggatcgccgccccagcccgccgcccgccgcgcgttccgctccctctccaaccccaacgaaaccccaggggcaccctcaccccccttctcctccccttttactgggggaccagacatggagagcagaaggcagtgggggaaggcgcaccaggaggcggtgggcggaggcggaggcggcggtcaccgagtggatctagatgaagaggatgacctggaggagttccggctgcccatgagccaccgccctactgagaacctcgacacggaggggcttgagcaggcctctgtccacacccagctcaccgcgtccaacgtcggctttaggctcctgcagaagatggg

SEQ ID NO: 22460 - DNA, 485 bp, Sorghum bicolor
  Clone ID: 14365095
gcacgagggggagtttgagcagaaagagaaaaaaaaagagaaaaaggtctgtattttaagcccctgaataaatttgggggaaaatacaatttcagaggtgttcgtggcttcgaatctccgtcaattcgctccacttctccagcagatccactcaggttgtggcgctcaaagtccagctttgggattgatgcgagtgtagtaagttcttgctcggtggttggtcttgggctcatctgttccagctccggagtcaaggccaaccgagttctgtgctgaagatgaagatgggtgcagacccaagtacccaggatgcgatggtggaggcagccctaaaagcaaagcatgcagcagagcgcaagttccatgcatgtaacatcaagggtgcccggaggtcagcgatcaaggctcataacttgtgcccatcacttgagggcatatctcagatgatctccacacttgatgttcacgttgcatctgagtcgaag

SEQ ID NO: 22461 - DNA, 496 bp, Sorghum bicolor
  Clone ID: 14365101
gcacgaggctgccttttaccccacaagcatgcatgaagtgcagctacagaaggcattgcggtcctttggctcgatggttaaaggaccagcagtcagggtattcttaaagaagctagaagatgagtgccgggcaatatgggaatctggaaggcagcaatgtgacgctgttagcctaactggcagaccatgtaagcaccgcaggcatggcgatttctcttcatcagatgcaatgaaacaacattctagtggatatgtattcctccatgcatgtgcttgtggccggtcacgtcgccttagagatgatccttttgactttgagactgccaatgtgtcttttaattgtttccaaaattgtgatgatctactacctacccttgcgcttccaagaggcagtgatgctggttcgttttcagtatcttcttggcgcttggtgcgtctcggaggagccagatattacaagccaacaaaggggcttctccaaagtggatttagctcc

SEQ ID NO: 22462 - DNA, 588 bp, Sorghum bicolor
  Clone ID: 14365102
gcacgagggcgaggagcgagcgagagatcgagagagattcagcagcatggaaacaaacgtgccggaagaaaaaaggaccagtgcctctcgccaaggccttcacgtcgatcacgagtccctgcagcagccgcagagcgatcacaggaggaagggtggatggatcaccttccctttcctcggagcggctatgatgggtctgggtgtggcgatgagcggcgtgctgagcaacctagtggtctacctgatcaaggagtacaacgtgccgagcgtggacgcagctcagatctccaacatcgtcgccggctgcctcagcttggcccctgtggctggagccgtcgtcgccgatgccttcttcggctgctaccctatcgttgccatctccatggccttctccgtcctgtcctcggttgtcttcaccctcacggcaagcctgcgcggcctccgcccagcgccgtgtcatctcggcgccggcagcccctgcgagcccgcatcggccgggcagatggctgcgttgtacgccggggtgttcctgatgtgcgtgagcgccgcgggctcgcggttcaaccaggcgaccatgggcgccgacca

SEQ ID NO: 22463 - DNA, 598 bp, Sorghum bicolor
  Clone ID: 14365111
gcacgagggttccgtcctcctcgcctggctgggactcggcagagcggcagcaaggtccaggacaccaaggtgctggagcctccgtcgcccgtagtccgccgcgggccggcacgaagcgcgtccatcttccagcaacagcaggaggcagtgtccacggtcgggggcgtcgttgggaaggggtccacggaggagaagctgcggcagcggcaggccaacgagaactccttcctccttgcctggctgggactcgccatcatcatccttgtcgagggcatcggactcgttgcctccggtcacgtactgctgttgctccactcgaacgaatgaaaatcttgcttcaggtgtgaattttcctaggttctttttaacgtttcaaatcaacagtgtattcctttatataacaagttaacaacctgttatgtgcaatgtctccgtaaatcaggatcgcattgaatggtttaagaacttgggttgtgagttgtataaaattgttgtacatgaactttccttattaatgtggtaacaatgttttttagtactaacatagctagagacaggatgcaaattgaatcttgaccgtggaattcgtatttaatga

SEQ ID NO: 22464 - DNA, 449 bp, Sorghum bicolor
  Clone ID: 14365119
gcacgagggtccaggtcgtcgaaggcaaccagccggacttcttcctctgcaacacccacagacgtaccgtcacacatcctccccccggtgccttcctatatccaggccaggggcgatcccatccgcccccgtctcagcatcggcctcatcgccgacccgcaccaccacggccactacgtggtcgtccagttccaccccgccacctccgtcgaccaactcaacaggatcctcttctactccaccgcccacggccggtggctcatcagggggctcaacatgccacaggcccgccgcatgcgcaaccccttctccgagaccggcgtgctcgcccacgacggccgcctctggtggatcgccctcgcctatggcgtgttcttctgcgacccctgcgcgccccgattcgagtgtcccgagctgcgcttcctcccgctcccggacgactgcgagat

SEQ ID NO: 22465 - DNA, 517 bp, Sorghum bicolor
  Clone ID: 14365125
gcacgaggctggaggcggtctcgcggtgcaaggcgcggcggcggtacaccaagcacctggtgcaggcgcggcgggacatggccgcggcgcacgcgctctacctgcgcgcgctccgggccacgggcgcctcgctgctgcacttcgccagcgccgagtccgaccacccgcacccccattcctccgcggcccaccaccaccacgggccgccgccgtccccgccgccgcccgcgacgccgccgccaccgccgcctcccccgccgccgccgccgccgctcagcccctccccgaccaccaggtcctggacgacgaattcgtcctcgatctccgcgtccacgatcttgccccctccgccgccgccgccaatgccgtccagctgggacttctgggaccccttcgcgccttcctcctcccgctccgccaccgaggacgccgactgggacgacgccgccaccaccgtcgtcgacgcgcccatcgccgccgccgcgccgcccgtcgtcacggccgccgcggcggtggc

SEQ ID NO: 22466 - DNA, 557 bp, Sorghum bicolor
  Clone ID: 14365137
gcacgaggggaaacccagctgtcaagacaaccaccggaggatggagatctgccatcctgctgttagctaactatggactcgcgacgtgcgccttcttcggcgtcggcgtgaacctcgtggtgttcctgcgccgggtgctccaccagggcaacgccgaggcggccaacaacatcagcaagtggacagggaccgtctacatcttctccctcatcggcgccttcctcagcgactcctactggggccgttacgtcacctgcgccatctttcagatcatctatgtgacgggcctggtgatcctgtcgcttgcgtcatggttcttgttggtgaagccctccggctgcggcggcgtcaaggtgcactgcgacgagccgtcggcgcccggcgtcgcgctgttctacctgtccacctacatgatcgcgttcggcaacggagggtaccagccttccatcgcgaccttcggatcggaccagttcgacgagacggaccccaaggaggggcgctccaaggtcgccttcttcagctacttctacctggcgctcaacgtggggtccctgttt

SEQ ID NO: 22467 - DNA, 332 bp, Sorghum bicolor
  Clone ID: 14365139
gcacgaggtactcctccgcctccagtccacacgcagcagatcggcgtcgaaatccatcgcctcgcctcgcctcctccgcggcgacggcgtggtgcttatggcccgcagggcactagagcccgcggcggttctgctcgttctggcggcgctcgcggccgtggcggccggaggggacatcacgcaccaggacgacgacgcgcccaagatccccgggtgctccaacgacttcgtgctggtaaaagtgcggacctggatcaaccaaaaagataaaattgagtttgttggtgttggtgctcgatttggccccaacatagagtcaaaggaaaagcaat

SEQ ID NO: 22468 - DNA, 472 bp, Sorghum bicolor
  Clone ID: 14365147
gcacgaggctactcctggcgtccttctcggcagcaccaaccgcagcagcagcgcggccgtcctccacccccaagaagccagctgctgctttcccggctgccgtcgctcctctgcacctgcaagctctgaagcgccaccagcgggcaagcagcagcatcagggccggcggcgagctcttcgtcgccgcggccgccgatggcacggccaacggcaccgcggcgaagaagcccttcacggttcactacttcgcgcaggagctggaccacttcaccttcacgcccaacgcgtccatggtcttccgccagaagtacctcctcaacgacaccttctggcggaggcccagcgccggcgacggcgacggcgccgggccgctgttcgtgtacaccggcaacgagggcgacatcgagtggttcgccaccaacacgggattcatgttcgacatcgcgcccaagttcggcgccctcctcgtctt

SEQ ID NO: 22469 - DNA, 625 bp, Sorghum bicolor
  Clone ID: 14365161
ctcagagagtggatgtgtggaagcagcaaagatgggctatatttcaccaaagctctatgagctcatgcgagtatttctttctttcagtgactctgataacgtccgatgccttatttttgtggaccgaaagattagtgctagagtcattgagcggacaatgaagaaaataggccgactctcctgtttcagagtctcttttctaactggagggagttcttcagtggatgcactcacccctaaaatgcaaaaggatacgctggattcattccgctctggaaagatgttgcagaagagggtatacatattccagactgctcgtgtgtaataagatttgatttgccaaggactacccgcagctatgtgcaatcacgtggacgagcacgacagcgggactctcagtacatactaatgattgaaaaggggaatgtgaaacaaagtgatttaatatctaggattatgagaagtaagacctcgatgactgagattgcttcaaaccgagagcctgaggattcacaccgcaatttcttccccattgaagaaataaatgaataccatataagcacaacaggagccaaaataactactgattctagcatcagtgttctcaaccagtactgtgacaagc

SEQ ID NO: 22470 - DNA, 651 bp, Sorghum bicolor
  Clone ID: 14365220
ctaccaacaggagacattgatggtaggcaatgaagaagtcaggggatgggggtcaggggatgtatctcaccaattggatcagcatgatcaagcattctgcaaggatgatgagatgcttgatgatgatgatactgactttggctcaagccttggacctattgtgtcatgggataggatggcagcagagtgcgaggataggaagatgctcatgggtgatagcccaaagtgtgacaagtggatgcttaaggatgatgtgggtgactttgatgcgaagagtattcttaactgtggggatgatgatggtgtggaggattccaaggtcatcaagccattgatgcatgatgacaccatggtaactgacccaagtttggtaggtattcatgtagagggattttacactggaccgaaatggtatgattcaccaggtttggattccagtgttgatggaggggatagcagttttaggcatggtggaatcgtgtgagttgtgataacctgatacctggaaagtcctgtaaatgctgtatactagatgtatttagctcacaccagtttgattaagtgtctgtaggtggagcttcagtcaaagtaacctgtcttgccctgatatatacaggctgcattatcaaagcaacttttgttttaacttgt

SEQ ID NO: 22471 - DNA, 555 bp, Sorghum bicolor
  unsure (1)..(555): unsure at all n locations
  Clone ID: 14365277
gcacgaggaaaggacactgctcttgccttttctggacagaagcttattcaagttgaagagccagatgctcaagttgaccttgtcttaaattctgctggccctgctttagttggagagttatttactgtaccagtgaccatagagtcaaaagggcatgcagtccattctggtgagctgaaaattaacctcgttgatgccagaggtggtggtctgttgttgagtccaagggaagcagaagattctgaaagtcatcatgttgaacttcttggtgtctcaactgcgtccgaggataaagagtcaaaggaagaagctgatagcataagaaagatccagtattcatttggggttatatctgttccaacgttgagtgtcggtgattcctggtcatgcaaattagaaatcaaatggcatcgagcaaaatcagtcatgctttatgtttcacttggttactccctgngctcaagtgaagaagaagcattgcaccggcttaacgtccatagaagcttgcaaattgaagggcagatccccttattaattagtcaccagtttttgaga

SEQ ID NO: 22472 - DNA, 518 bp, Sorghum bicolor
  Clone ID: 14365298
gcacgagggtagattgccccccaaacatgcagctaatggctgaagctggaatcctagaagcacttaccaaatacttatctcttagcccacaagatgcaacagaagaagctacaactgaattgctgggcattcttttcagtagtccagaaataaggcaccatgaatcagcacttggtgttgttaaccaacttgtggcagtcctacgtctaggaggaaggaattcacgttacagtgctgcaaaggcattagagagtttgttttttgctgaccatgtgaggaacagtgagtcagctaggcaagctattcaaccgcttgtggagattctgagtactggcatggagagggagcagcatgcagctatatcagcccttgttaggctgctttctgacaatccttcaagagcacttgcggttgcggatgttgagatgaatgctgtagatgttatgtgccggattctttcttctgactgttcagtggagttgaaaggagatgctgcagaactatgctgtgttctattt

SEQ ID NO: 22473 - DNA, 507 bp, Sorghum bicolor
  Clone ID: 14365299
gcacgaggcagaatcatttatccgtgtatgtgttgctgcatgccccgtttgtaaagctgcgcctgctggccaacctgattctgtcatatcatcgcctggacgtgggaagcggcggcgcagatttgaatatactgagacattggatgtgccggctcgagacgtgcctcgtaggttacagcaattggctgccaagcacaaggttgtcctttgtataaggcagaagtatataaggtataagcccttcatggctgaggtgaaagattatgcgtgccaccgtgctggagtgccgacttcaaatagtggtaatgcttcatcctcagccagtaattcagagggtaagaaggcacgggttctaaagcgagagccataccagtcaaagaggtgtggttgtgggttccgtattcgggcaattgtgccaatagctaattataatgaaaaagacaagacttttgtgtacttggaggagggcactgcagtgttcaagcttttcgctgtgcattcagggca

SEQ ID NO: 22474 - DNA, 438 bp, Sorghum bicolor
  Clone ID: 14365300
gcacgagggaggggcaccaccaccatggaggtgcgcgcagacggcgtcgccgtcatcaccatctccaacccgcccgtcaacgccctctccctcgacgtcattgctagtttgcagaggaactatacagaggctctaagcaggaatgatatcaaggcaatcgtcctcactggtgccaaaggaaggttctgcggcggattcgatatatctgcgtttggaaagaagccaaaaaatgagaagcctggatccatgtctattgatttcttgactgacatagtggaagatgcacataaaccgtcagtggctgctatagatggcattgctctaggaggtgggttggagcttgctatggtttgccatgctcgcatttcaacaccatcagctcaattaggactacctgaacttcaacttggaatcattcctggactgggagggacgcag

SEQ ID NO: 22475 - DNA, 554 bp, Sorghum bicolor
  Clone ID: 14365311
gcacgaaggctagctgcaggtcgagttacgggtgtaggtgtacgtacggtggtacgcagacgtacgctaccatggcttgctccagcagccggctcgccgaggcctcgctgctgctcctcgtcgtcatcctcctagccgccgtcggagcttgtgcttctgccgaggcggagatgagtgcgaagaccatcgcggcggtggctacccggaggaagctggacgatgtcgtcaccaccaccagcagcagtggatcatcctcgccgtcgtcgtcaccctctccagcagcgggaggaggagcagagaagaaggagagcaaggacgataacgggaacaaggagaaggagaaggagaagcccaagggcggcgcgacgtcgacgaagaagccgccgccgccgctgccggccaagtgcgtgacgagcaaggactgccacctgaagcggctggtgtgcgccaagaagtgcaccatggccgcccacaagaagtgcgccgccaagtgttcccactcctgcaacgccctccccatctgcacctgatgaagacgatggattatccatcca

SEQ ID NO: 22476 - DNA, 525 bp, Sorghum bicolor
  Clone ID: 14365335
cgccgtcgtgaatgggcagctcttcaggggcgttctatttgctcctgggcctggagtcacagctccgagaccgacggtgcatcaccagatcctgacgagctcagccgtgcctccccagcaacaacggccactgttggcgcacgccatccctgtccacacccggccggtgccgcaggcaaccggcttcgtgctgccggactgtgccccccacgcgaggcaagggttcccggcaaagcccgccaagtcggagccggagcgaggcagcagcgacctgcacgatgttgtgctcacgctgggagggcctggagggggcaagtgagcccctcagcctcacggaaggcctcaagaacggtcgtggtcctggcctactactgctgtttgcctcttctcttggattgctctgtaaattagatgttctggttgagggaaaaataagagtagtagttttctgtcatctttcccgggtgattctagggttccttaacctgtgactttacatatatgaatatagtgttagcttcatgc

SEQ ID NO: 22477 - DNA, 592 bp, Sorghum bicolor
  Clone ID: 14365344
atggttttgttgtagctttgagagcaagagataattcagggtaccatgttgcaagacaaagagtagttggtggtggtggctggattcttgatgttgtctcaaccaccacaaacagggatcccgctgcccagttcctcgttactttcaaaaacaaggtacggttataggcttatagccatcgttccttccttcagttttcatgcctgctacggttttatgcacatgtaggcactgacaagacatgtacttttcaggatactatggggctccgatcctttgttgctggtggtaagctactacagattaataggaagatggagtttgtgtttgcaagccattcttttgatgtttgggagagctggatgctggacggttccttgctggagggtagcaagcttatcaattgcagaaatccttcggtatgtacctttctaattgttattcttcttaggtcatagctagttcatagctttttttaatcaacatttgtgaaacaacccccatggaccagctcggaatgaggtggtagtgcttgtaagggtctgttactttttctctctttaatacaaagatacgcaactctcccggaggt

SEQ ID NO: 22478 - DNA, 417 bp, Sorghum bicolor
  Clone ID: 14365350
acattctccgtgctaaaagattagctgcagcaagggaagctccttatgcaaaatcaaggacccagttcacccgggacgtgcaaatgaccaagcatcaacgcacacatgaaagtgttcggagcagcaacaatgaaagctcaccgcatttgctttcctagctcggcaaaagactgcaacggtgacttggcttccatccataattcagttctttgtatgctcctccgtaggcttgaaacacgaagctgtacatactagctaggtcattaatgttgtatatacttgtatttttggtgacctagaactcaggagaggcatcagtctatcagataggagaaattacccattccatcctacttactgttttgactactgctgttgaattctccttcactgttcaagtatgcttattgtcagttt

SEQ ID NO: 22479 - DNA, 554 bp, Sorghum bicolor
  Clone ID: 14365357
tacacaattcagcaaatattttgttaggtgcatattatttctccctatttcacatatcttacgacctacctaacttaaaattttatggaaaataagacttccatcacttacctgctagattagtttgcctcagccgtgttttcttatgcatgctatgtgtctggcttttctcatgtaccctttcaatatttcttacaatatttatatactcgaagcatcatggttctatgataccccttctgtcttggatgccgtagatctgtaagctacatcatgaaattcagtttggtttcagtttctggtttttgaagtcatttctgaaaatacattcactcattgagacatgtttggtttaagcaggagcaattgccaagtgaggacaataggaactaggaaggctggtagtgaggcaacatatattcagttgtatttacacttgtgatgtgaacatgttaggctttttatctctcttaaagggagcaatgcaatctggttacaaatgtaactatgtatgtctgcaagattaaaataaaaatgtttggagtatatagtgt

SEQ ID NO: 22480 - DNA, 614 bp, Sorghum bicolor
  Clone ID: 14365372
ctttgttggaagtgacaagctgttgccatcatccagccaaagcatgctgcaaaggcaaatgtccggtggtgtgcctatacatggtcatggcattggtggccaggtgcagctacaacagtctcggcagcaactgcagtctcagcagcagcagcagcagcagcagaggcctgttgttcaaggcggtgtatatgctcatccctcaaattccggaccaggatgatgatggaccaaactgggcccgtatttccgaagagcattccttccccttgtaaagttacttgtacaggcgtccgtgctgtggaagatgtgcggatgatagtgctctttattctcaactttgagctaattgtagcctcctcagtgtcaggtagataattatttctcgtaccattttggtgccacactgctgccttccatgtagcttgaccctagattgctggaggtggttcttgtgagggcaaattcctttggttgtcaaattgtaacccgacactgggcccagttgtatattttgccttttgaggtccatgttagagacgatctcttcttttgtataagcctgtatattcagctcacaagtcaatgaatgcaaaagaaaagtctttctttgcgtc

SEQ ID NO: 22481 - DNA, 433 bp, Sorghum bicolor
  Clone ID: 14365398
cttacgcgcagcggcagagcttccaccacaccggccacgccatggcgcattaaggagcgccgtcgcggttgcaggtgctgtttgcagccgatctcctccagattcagaagtggagatggcgagaggcccgagaagaagaagaagattcaggttccaggtgcgtgagatcgatggtgaagatatcgctgtcccgtccgttataagtgaaaactagtagctcggtgaatcgatgatgaatgaaatggatcttcatgtaggttttaccatcctgtgctgtgtagatctagtgccccatgtagaggtgaacaagtgttatatgctctcgttctttatattctttggggttcttttggacgatgtaaatgtacaatgtttggttgattttgtactgtttttccctccagcagtaaataaaactaatgcaaattgtgcc

SEQ ID NO: 22482 - DNA, 163 bp, Sorghum bicolor
  Clone ID: 14365400
ggggggagaaaaagaaaagccggcaaaaacccatcattcattttttagggggcaattttagggccattcattcatttaaagagtttgggggttgcgcaagttcctttttggggagaattattgtcgcaatccatagtgggacccggcgcgggatccaaacttt

SEQ ID NO: 22483 - DNA, 523 bp, Sorghum bicolor
  Clone ID: 14365413
gcacgaggctgcagggtgaccaaccatatgacttctcagatagtgctgcatcaatgacgccatatgtgcagcttgttagtgaagtcatcctaccagctgtgagaatatcaggaaccaattcgtgggaggctagggaaccagaaccaatgctccactttcttgagttatgggataataagaagttgctgcctcctgttttgcttcaatcaatactagagcatgtaatcatgccaaagctctcagctgccgtggattcatgggatcctcgcagggaaagtgtaccaatccatgtctgggtgcatccatggctgccaatgctaagggaaaggatagagaccttgtgtcattctattcgatacaagttgagcactgtcctccatgtatggcaagcacatgatgcttcagcatatgcagtgttgtctccgtggaaagacgtgtttgattcagcaagctgggaagacctgattgtgcggtatatcattcctaaactgagattggcactgcaagactttcagatcaaccc

SEQ ID NO: 22484 - DNA, 606 bp, Sorghum bicolor
  Clone ID: 14365421
gcacgaggccaccatgacgtggtccacgccggaggtcaaggcgccgcccgcgcccagggacagccacagcgccgtggccgtcggcagcaggctcttcgtcttcggcggggactgcggcgaccggtaccacggcgaggtggacgtgctcgacgtcgacaccatgacgtggtcaaggtttccggttaagggtgcgtcgcctggtgtcagagcaggtcatgcagctatgagtgttggttctaaggtctatattattggaggagttggtgacaagcaatactacagcgatgtctgggttcttgatgtcacaaaccgttcgtggagtcagcttgaagtatgcgggcagcaaccgcagggacggttttctcataccgcagtagtcatgaatactgacattgcagtctatggaggatgtggtgaagatgaacgtcccctgaatgagcttctcattctgcaattgggttctgagcatccaaatggccgttacaacatttcaatgtgcaaggttcttagcaaccattggagccaagagaagaggaaatttctcagatcagaaactaaagatgctagtgtgagcaatggaaaaatggttcagaaacctcgagaagc

SEQ ID NO: 22485 - DNA, 460 bp, Sorghum bicolor
  Clone ID: 14365422
gcacgaggcctcaccaggccgacctcgccctcgccaaggtcgacgccaccgaggaaaccgacctcgcccagaggtacgacgtccagggcttccccaccatcctcttcttcatcgacggcgtccccaaggactacaacggcgccaggaccaaggacgccatcgtcgactggatcaacaagaagctcggcccggccgtgcaaaatgtcaccagcgtcgacgaggcggagaggatactcaccggggatgacaaagccgtccttgccttcctcgacactctatccggtgctcacagtgacgagcttgctgctgcttcaaggctggaagatagcatcaacttttatcagactttgactcccgatgttgctaagcttttccatattgacgcagcaacaaagcgtccatccatagtacttctgaagaaagaggaggagaagttgaccttctatgatggggagtttaa

SEQ ID NO: 22486 - DNA, 534 bp, Sorghum bicolor
  Clone ID: 14365427
gcacgaggcgaggatggacgccggggagatggaggacgtgcgggccgccgcggccgccgaggaggtcatcagcagcaggggcggctccgtgctcgggaagaagaccatcctcaagagcgaccacttcccgggctgccagaacaagcgcctcaccccgcaaatcgacggcgcgcccaattaccgccaggctgggtcgctgcgtgttcatggtgttgcaatgcccacaatggaagggattgctaatgtgctaaatcatatcggagcacacaagaaaggaaagcaaacccggattctatggcatagtcttcgggaggaaccagttatctacatcaatggtcgaccctttgttttgcgagatgttgaaaggcccttctcaaatcttgaatacacgggaattaaccgggagagagtggaacaaatggagtttcgccttaaggaagatattcttcaggaagcttcaaggtatgggaataagatactagtcactgatgagctgccaagtggtcagatggtggatcagtgggaatcagttga

SEQ ID NO: 22487 - DNA, 467 bp, Sorghum bicolor
  Clone ID: 14365430
gcacgagggctgctgctctgcctcggctccgcggaccgcgcggccgacgcggcggtggccgccgacctgggactccgcctcgtccacgtcgatgccaaccgcgccgaggaggtcgccgacaccgtcatggcgctcatcctcggcctgctccgccggacccacctgctctcgcgccacgcctcgtcggccccggccgccgtcgccgccggctggcttggctccgtccagcccatgtgccgtggcatgcggcgctgccgtggcctcgtgctcggcatcattggccggtccgcggccgcccgctgcctcgccactcgtagtctcgcgtttcggatgagcgtgctctacttcgatccgcgctacgtggtaagtgggaaaacaaagcggccttctattgttttcccttctgcagcaaggagaatggacacactcaatgatttattagcagcaagtgaccttgtttcactgca

SEQ ID NO: 22488 - DNA, 336 bp, Sorghum bicolor
  Clone ID: 14365431
gcacgaggcactcttttaaagaacctagggtctgttgccaaatcactggagccaaaagaactatgtaaactcctggaggcataccaaagcctgcaaaatggatcgaatgctggaacctctggaacagctaatgttgcagaagaagctgcagggccatctaactctaagttgccttttgtgaatggtagtcactgtggacaggcatcatcatctgttgtgccagtacaatcaaaggctaccatggtggtaactccagagcctgcatcatgcaagcttaaggattttgatctgaatgacacttgcaatgatatggaaggctttgaggatgggcaagaa

SEQ ID NO: 22489 - DNA, 464 bp, Sorghum bicolor
  Clone ID: 14365436
gcacgaggatggatgttactccgaataagaactattcagtatggcttcattttgcagagattgataatggggtaactgcagaagaacaaagagtatttgatgtactcatcaatggagacactgcttttaaggatgtagatataattcgcatgacaggagagcgttttactgcacttgtcctgaataaaactgttgctgtcagtggaacaacgctaaaagtcatcttgcaacctgtgaaaggaacccgtgctattattaatgccattgaggtgtttgagataatcccagctgaaaagaagactttgcctcaggaagtgagtgcattgcgaacgttgaagggttcacttggtcttcctcttcgacttggctggaatggtgatccctgtgttcctcagcagcatccatggagtggagttgattgccagtttgataacaccaaagggaattggatcattgatggatta

SEQ ID NO: 22490 - DNA, 453 bp, Sorghum bicolor
  Clone ID: 14365442
gcacgaggagacgacccttctcagcccgcccccggccacccccacccgctcctccatggccgcccctgcctgcgcgccgccccggccgccctgcccgcacctccccagctgtatctgattgcctccgcgaccaagtgttcggccgtctctgaccaccctaggctcgcccttctccaatcaccagatctagccaggccgcgcatggataaacccgccctagcatcaggtcggacggtgctacgcctgaccatggtcgcgaatccacacgttccggcttcgagtccggggatacaggtgtagatctactccccatatcacctggaggcacactgcaccctccgctatcccagtgcaccgtccgtcgtctcagtgcgctgtcatgtggctcgtaacgcctggagcagcaccgccccgacaccccctttgatccatccagtcgctctgcagtttaca

SEQ ID NO: 22491 - DNA, 463 bp, Sorghum bicolor
  Clone ID: 14365443
gcacgaggccacaacatccatctggaccagataaattgcttcctcagcatatgatgaatcctggtcataagcatggtttctctgaaaataaccgtcctccgttgcaacaaccatatggtttgtttcattctggaacgataccaaggccatttggagagaaccagattcagatgccaatgtcacagcctgggggtatcagacctggtgatggtattcgacctcatgtggttggcgcattacctggacatcatggtgcagtattgcctccttttgatcttgaacgtttgggccagccacatcttcttggaatgttgaacagcaatgactttggtggtgagaggttcaacacttcagggggtgcagcatatcctggaagacatgataatatcaaagacgaccggaaacattttccggcgccagcccccctggatggtcagggcttgcaaagggaccctagacattt

SEQ ID NO: 22492 - DNA, 329 bp, Sorghum bicolor
  Clone ID: 14365447
gcacgagggctgcttcttgtgatggttgccatcccacattgtgacattgggcgatgattgcacctgcaaacaaggaacaataaaaagtcctcaggtaactctttagagtagaagcagaaagatatattttcagctgtagaatatgtggaggctcaagattgccaagggtggaccgtggctcaagagtggcaacagtcacattggaagagaaacatgggagtttgatcaagattttggatcaaaagaagagagggaagctgttgactctgcacgggaagaattcaagaagaacaggttccaaatgagacacagctccgatattttggccc

SEQ ID NO: 22493 - DNA, 425 bp, Sorghum bicolor
  Clone ID: 14365453
gcacgaggcagactcgtgagacatggcgaggctgttcgccaccgagagtgtcgggttcagggcgagggcgctgtacggggtctacgccgtcacggtgtccgtggggatatgcctggtgctctactgccgggcggccggcgtgctgagaaggtccgccgccgccggcgaagcaggcagccaggcgtggctgtggctggggatgctcgcggcggagctgtggttcggcctctgctgggtcgtcgcgcagtccgtgcggtggcgccccgtccgccgccgcgccttcagggacaggctcgccgccaggcacggcgacaaggtcccttgcgtggacatcttcgtctgcaccgcggacccgcggtcggagccgccaatcttggtagtctccgcggtgctctcggtcatggcgtacagctacccggctgacc

SEQ ID NO: 22494 - DNA, 635 bp, Sorghum bicolor
  unsure (1)..(635): unsure at all n locations
  Clone ID: 14365456
gcacgagggttgaatcaagcaccagatatttcactggaaggtcttacaccagttggtccaatggcctctcctgctgcatcacaaatgagcaacatggcaaaccctacgaaggtcataaagattagcacccgtggaagaaaaaataaaggactcaagatgccagctggtcattcaggtcctggaggtccatggtcaagttttgaggatcaggctcttgttgtccttgtccatgatatgggtgaaaactgggaattggtgagcgatgcccttaacagcattatccaattgaagtgcatatacagaaggcctaatgagtgcaaggaacgccataaacttctgatggataaaagttgtgacggtgctgacagtgctgatgactcaggctcatctcaacactattcttctgcattgcctgggattccaaagggtagtgcaaggcaactgtttcaacgccttcaaggaccgttcgaggaagagactctcaagacacactttgagaaaataatattccttggacaaaaattgcatcaaactcgtagaaagggtgaaatccaggaactgaggcaaataaatccgcttcatacttctcatgnttttgcactttctcaagcatgtccaggcaacttatctggtgt

SEQ ID NO: 22495 - DNA, 496 bp, Sorghum bicolor
  unsure (1)..(496): unsure at all n locations
  Clone ID: 14365463
gcacgaggccgcctccgggactcctgcctacgtcagggataccatcgggccgccgaaccctcaattggccgccgccaccaccgccgccgtaagagagaccgacgtcctcctttcaccgccgagcgacacctcgaatttctctctcctcgtcctcccctctcccctttattcgcgtggcgcagacgggagatccaaccagcgtgatttgtttcatcggtagctttggatttgtttccgacccggcgctaatccaacccgtgcgggggtggattcagctccttggataccttggtgggggatgttctgctcgtagcagcttgtttcccggaaatatttctggggttagacgctgcccctgccatggaatcaggcaataccaaatttgatgcatcacagtatgctttcttcggcaacaatgctgtggaggagattgagctangtggattggatgatgatgatggtggtgatgctgcatttattgagcccaaagatgaag

SEQ ID NO: 22496 - DNA, 470 bp, Sorghum bicolor
  Clone ID: 14365468
gcacgaggaagaagcaaagcaagcagcaagcagggtgcgggttgtcggacaatacgccgccggcgatggtggagctgacaccgcgtggcaatggttgttgcccgcgtgtgctctcggtttctctgctcctcctcctccttgctgccctgctgccgtcgacgcacgtctcgtcggcggcggcggcggcggcgattaccaggggtgatttcccggagggcttcgtcttcggcgccggcgcatcggcttaccaggttgaaggcgcatgggcagaggacgggaagaagcccagcatctgggacacatacacgcacagtggctattcgattgaccatgcgactggagatgtggctgcggatcagtatcaccattacaaggaagatgtgaagctaatgcatgacatggggttggacgcgtacaggttctcaattgcctggtcaaggcttattccagatgggcgtggagctgtgaac

SEQ ID NO: 22497 - DNA, 485 bp, Sorghum bicolor
  Clone ID: 14365469
cggcacgagggtcgaaacaagtcgagagagatagacatcttgtcacgctggtgatcggcgatcgtcgtccgtcctcgctccgtcgctagctgacatggccgacgagccaagaacgacggcggcggcgacgccgagcagcaggatgccggacttcaagcagtcggtgaagctcaagtacgtgaagcttgggtaccaccacctgatcagccacggcgcgtacctgctgctggcgccgctgccggggctggtggcggcgcacctgtccaccttcacgctgcgtgacctggcggacctgtggcagagcctgcagtacaacctggtgtccgtgctcgtctgcaccacggtggctggtggtggtggccacggcctacgcgctgacgcggccgcggcccgtgtacctggtggacttcgcgtgctacaagcccgacgacgagcgcaagtgcagccgcgcgcggttcatgaactgcaccgagtcgctgggcacc

SEQ ID NO: 22498 - DNA, 433 bp, Sorghum bicolor
  Clone ID: 14365470
gcacgaggagcatatgttgtgcatgtgaagagagagagagggacgaggccgcgtgtgagagaaagctatctagactgaaaggttgacaagacacaaagctagaacctcatatcatcattcgtaagccagcacttacggacatttcgcgaagcagtatggctctggctcgcatcctcttgttgctgctggtcaccgtcgcgagcctcctgccgccgatcgcgagccagcaggcagcagcgacgaagtgcgagtacagaaagcactcgggccaccggtacaggcacccggtgggcgtgcggaagatcgtggtagacgcgagcggcgccggcgacttcgtctccatccaacaggccgtcgactcggtgccggagggcaacaccatgcgcgtcatcatgcagatcaacgccggcacgtacatagagaaggtggtggt

SEQ ID NO: 22499 - DNA, 571 bp, Sorghum bicolor
  Clone ID: 14365480
gcacgaggcttcctttggcccttacgtgggtccctacatcaaacagcatcactaatggtttttgtgttcaaaagaatattggggttgattcgcaaccaggaaaagcagtacttcgtatccatgaaacggcttgttatgttaacgatgcaaagatgcaggggtttcttcatgcatgtgctgaacgtcatcttgagaaagggcagggtattgcaggccgagcccttaaatccaatcttccattcttttcgcctgatataagagagtacagtatcgaagactacccgcttgcacaccatgctcgtaaatttggtctgcatgctgctgtagccatccggctgaggagtacgtacaccggtaacgatgactacatactagaattttttctcccagtcaactgcaagggctgtggagagcagcagatgttattaaacaacctttccagcacaatgcaaagaatatgcaaaagcttgcgaacagtttctgaaacagagattgaaaatgttagagctactgcaccaatgtgtgagaagactaatggaagttgtttaccaactggtaactctgagagttc

SEQ ID NO: 22500 - DNA, 540 bp, Sorghum bicolor
  Clone ID: 14365484
tcgcgccgtatctacttcagcaagaaagatggggacgacggcggctccgacacgagcgaggccggtgagagcgctgctgtggcggcgccgaagtggccgtactacgcgcggagggtgtcgcacgatgagggcttcctgctcgggctaatgcgggagggcggggtggactaccgatcggcgccgcggcctgctgggaggctgctcgtcgacatgctgagcacgctgctcacgctctgggtctcgctggtgcccatgatgtggttcatacagcggcagatgtctggtggtggcagtgctgacaagcgacgcaaaccgaggaagcagatggtgggctttgacgatgttcagggtgtagatgaagcgaaggaggagcttgttgagatagtgagctgtctgcatggttcactaaactacaagaagcttggagcaaaattgcccaggggtgttctgcttgttggccctcctggaactgggaagactctgttagcaagggcagttgcaggagaggctggaattccatttttctctgtttctgctagt

SEQ ID NO: 22501 - DNA, 418 bp, Sorghum bicolor
  unsure (1)..(418): unsure at all n locations
  Clone ID: 14365490
gcacgagggctccttccaactgcccctcttcttctttccctctccctccctccctcccctgcttcccctcctccaaagccctaaaccccaccccagcgcagctcggtgtgccaacccactcgcccgcccggtcggcgccgcacccctcgcccggattctaccctaaaggcatgaccttggccttcccatctggaaattgagtagcaatcaagtatggcttcaagagcaatcacgaggagaaggaaatatcttttcgatcatgttaaaacacttaacctctcatcttcatcctctaccttccaacatggaagaattggttctgaggctgagccaagaatagcactacggtttctggagcaaagctccggagactcaagatctgagaaggagcaatacagtgtgaatttgactaanagga

SEQ ID NO: 22502 - DNA, 432 bp, Sorghum bicolor
  Clone ID: 14365517
acaccaacgtcgaggcgcgccgcgggacgctgcagtccgaccaggagctgctgtcgacgcccggcgcgcccacggcgccgtatcgtcggccggttcgccggcagccagaaggagttcttcaagagcttcaccaggtccatgatcaacatggggaacatccaggtgctgacggggagccagggtgagatcaggaacaactgcagagtggtcaacggaagctagacccccgtcgagcaaaggtcgttgcaaggagtagtagctcttgtaaatgtggcgtgcctataagttactggtgaaagcagtgctgctgtatgtaggatgctgcaaacatgtacgtatagttttgagggcattatagcatgatgcaccgatcgatttgtttatgtcatggagattcaatataaacaataaagtggtgtctgcagttttttc

SEQ ID NO: 22503 - DNA, 455 bp, Sorghum bicolor
  Clone ID: 14365536
ctgcaagcttgtcgatcagcatctccatcgtctcgatgtacctcggcatgtaatggtctctgatcatggttcttgccagccggatcttgccatacatgctgcgaggggtctcatagatggcaactacctcattctggtggcattgctcaccggtgctcagctcttccggttctggcagctcaaccatgtgcatgattctgcccggagggtacagctggtgtggctcctgagaggccattcgcgatgatcgaaaggccttcagaagctgatccatgtgttcttgacatcaatgctggaatgccctgagtggggttcaccagagacttcagaatttgcgtattaacagcgacagaagaccagcaggacagtgcagagtgcttctgtacagcggcacacacattttctgaaaggttcaactcatcctgggatgccatgaggaatcaattcagtgaatt

SEQ ID NO: 22504 - DNA, 531 bp, Sorghum bicolor
  Clone ID: 14365553
tccaatatttgagcacccacaaacctatccttacgggggaatttcatgccctcctttggttaaaattcaaaatgaaaccactcaacatcgcagactaatgcgtgtatcgtccaagacgatttctccacaattgtcaacacagtttcacaggaagtacaaatctgagggcaagaaaaacagtattgcagtggcagcaacaacattcactgcaccagcacccaacccaaagtgaatgccttggtctctaggtgcctcaaagtttccaaaaccctgcaaggcgtgtttatctagtgtgacccgttgatgtgtctagttacaccaaggtgcgtatgaagtagctgtgtgtgcctaggctaaagttgtaagaaatctcagtcaagtgtaagtagaaaatgggaagttagtagccagaaagctggataactcccgactccatgtataatagtatggcaacagctaaagaaatggctggccatctgttaattatgatgattttcccaaaaaaaaaaaaaaaaactcgagggggggccc

SEQ ID NO: 22505 - DNA, 591 bp, Sorghum bicolor
  unsure (1)..(591): unsure at all n locations
  Clone ID: 14365560
aagctggtccagttactacggtaaggtgaaagaagtaattcctgggaaatgaatgcagaagattaataaagagaagaaaaagnctnctagaggccttggtggccgagagcaagatgggtggacatggagtactggaaaaagcaagacaagctggttactattgcttttcggatcgttttcagatcattggacgaatctgggcaagactacatgcgtaatgttgctcaatacacaggtgcgtaacgttaggtgttgaaggattgattttatgtgcagagtttcagtttgatagaacacgttgcagtattcctttcagtatatatgaagtgaagctgaaagccgcaattcattgccgtccagaagtctgtacgtacactgtaaatagttattgttttcatcgcaatggagcgtgcaacggagtgtgactgcgtgagtaatgcagttgaaccgttttagctatagcagagcagccaagtatatctgtacgtactgtacattgtgatgttttggagcaagctttgcgttgcgtacaattgctgacatgacatttagagccngacgacgnacagctgattttttctttctttctgg

SEQ ID NO: 22506 - DNA, 470 bp, Sorghum bicolor
  Clone ID: 14365569
cgtttgcgaccggccggagcaggaccagccgtgccgcgtgccgctctgcagccatttcacggcgaaaatgcagactgagaaggcggacaagacatggcggctcctggtgaagaaggtgacgagggctagagcgatggccggcttggccaacaggcaggtgccggaggtcgtggccatgtcatgggcgaagtacagcaccagcagcaaatgggcgcgaaactgagatgaacagacacgcctgtgggatgtgcatggttttgctgtagtctgtaatccttctgcaattttttttcgctgttggactgcggcaaaattcaatctcgcatcgatggagtctgtctgagataaaataggcggagtcgatctataccggatagatttagtgtttatttttagagagatataaagagaatatatatatagtgctatgtataatatgttcgtttaataaattgtagcagtacaaattc

SEQ ID NO: 22507 - DNA, 477 bp, Sorghum bicolor
  Clone ID: 14365570
ctattggactagttcggaaaattatgcagtccattggtttcatggggccttgtgtgtcattactatgtttaagatttgcccaaactccatcagttgctgcagttctcatgaccactgccctgagcttgagttctttttgccaagccggatacttttgcaatatacaggacattgctccaaaatatgctggatccttgcacgggttgacgaacggcatagggacggtggccgccatagttagcaccatcgggaccggctacttcgtccagtggctagggtccttccaggccttcctcaccctcacggcggcgctctacttcagcgccaccgtcttctacaacatctacgcaaccggcgacctgatttttgactgagacgaacttgctaaatgccagtaatgattcttttgtgcagacgcagaatcccaaagtgtaccaatgttaattgtatctccccaaggatggaataagatggagg

SEQ ID NO: 22508 - DNA, 573 bp, Sorghum bicolor
  Clone ID: 14365575
ggcttttgcaccgacgaggtacccatgatgcacccggacgagatcatggtgccagtactgggcgaccagcggctgcacacgccgccattgccgacgttctcaccggccaccgccgccgctgctgccgccgccgtctcgacgacgcccacgacgacgacgtccagctctgcagcagcctcggcagcgtcgtcgtcgtccttgatcagccgcgatgaggacgcggcgctgttcccgctcatcgacatggacttccccgagatcgtgttccggatggggctagacgacatggtcgcgtcgtgggacgactccttggcgcagccgccgctgtcgccatcgctgccggtctacgaggactctgcgtaccagctgcagaggagcggcgttgcgtttgaccaggagccagggaacaagattcagctcttctctagctattagtcacttaacccctctaataaataagatttgcaacttctcactgcactaaactactagtagcaaattagacaggacggttgttctgttgttcattctgttaactgcgactgctttctggttattatatcctgttctccc

SEQ ID NO: 22509 - DNA, 479 bp, Sorghum bicolor
  Clone ID: 14365594
gaaaaaaaaaaatcggagcgcacgaacccacgaacaaaagagaaggggagggagggcagagacaggagggagcgcgagggggagggggcatggtctctctcgtcccagcagtccccgtctcaagcaaaggctccccctcttcttccgccgcccaggtcattgagttagcgaaagggaagcagggagtatcatgggtatctcatccaagtggattaaatctttggttggcataaggaagcaagaaaaagggcagaatgcataaaagcaagaaaaaggacgaaatgctgagagcagtgaaactaaacattctttggttcctggaggtgcacttgcagtcgaagaaattgcagtacaaagtggagcattgactgatgacaaaagcacacagatgatttcaaattcaatttgttcagacaatacatcacttgatgtgcaaatttctcaggctgaacatcatagtaaagaagatttggccgcaa

SEQ ID NO: 22510 - DNA, 625 bp, Sorghum bicolor
  Clone ID: 14365599
gcacgagggttactggaggagttgttccgggcgatagagctctggcttcggattgcaaaggagcaggtgcccttggtcgatcccacccttgacccagtgttacttgttcctggtattgctggctccatccttgaagctgtcgatgaggaaggaaacaaggagagagtttgggtgcgcatccttgctgctgagcatgagttcagagagaagctctggtccaaattcgatgcctccactggtaaaactgtttctgttaacgagaaaacaagaattactgtccctgaggacagatatggtttgtacgccattgacacattagacccagacctgatcattggtgatgacactgtgtactactatcatgacatgatagtggaaatgattaagtggggatatcaagaaggaaaaactctctttggatttggttacgatttccgtcaaagcaataggctctcagagacacttgacagattttccaaaaagctggagtcagtgtacacatcttctggtggaaaaaagatcaatctcattacccattccatggggggattacttgtgaaatgtttcatctctctgcacagtgatgtatttgaaaaatatgtgaagaggtggatcgcaattgctg

SEQ ID NO: 22511 - DNA, 373 bp, Sorghum bicolor
  Clone ID: 14365613
gcacgaggccaccccaccaaacccacctccccaagctcgtcactgttagagctggttgcttgggggcatttagctcagcaagcacactcgcattgtcacacacatctattcctttcggttccctctccattggtaccatctccatgagcagcaaccacacgcgttgcccattgccgccttcctcgtagctagctcgctagatctccccatctagctcttgattcttggcaagaacgtacaagagagcaggcggagcaacaagtgcgtgcttgcggccggcgggtggcgcggcgatggagctgatgacgttgctgacgctgccgctgctggcgtgcttggcggcgatgctagcgcggctgctggtggcgcgcgc

SEQ ID NO: 22512 - DNA, 122 bp, Sorghum bicolor
  Clone ID: 14365622
aaatcatggatacaaatggtgttgtccaccaaactgtgtcacatgaccttgaaagtgtttctgctatcctgaaatggctcaattatgttcctccatatgatggtggtcctcttcccattatg

SEQ ID NO: 22513 - DNA, 549 bp, Sorghum bicolor
  Clone ID: 14365628
gcacgaggcactcaggaattggcttgaagatattatggcttgatttacttgatgaatctagttgctttccttatatcgacggatggctcaaggttgctgttacaccagggattgaagagctcaaccttaggctgcctgaaaaacacaacttcccatgctcagttttatctgctggggttggaaactcaattcggtctcttctacttgcctcttgtgccttccgtcctacggctgaacttggacctttcagaagcttaacaattttgcgtctgtgttctgtctgtatcacgggggatgaattggagtgccttctttccaactcccttgctctgaaacatttgcatctcactgagtgcaatgagataatttccctcaagataccttctgtgctgcagcagctcagcctccttttggttgatggatgttttcctatgcaaattatagagaacaaagctccaagtatctctagctttaccctttccagagttttaccaaaactcgagcttggaaaagcgttgcaaatgatgaagtacttgcagttgaattttg

SEQ ID NO: 22514 - DNA, 519 bp, Sorghum bicolor
  Clone ID: 14365629
gcacgaggtccttggtggcagccaacacccatatccccgtcgctgcagaactggtcggcacccaacagaaaaagacccaaattcagagagcaggcttttcctgttgaacctgaacatctatgtcccgcgtgatgaacgctttgggcatctcaagatgtcagacttccttgggtactcactgaaggcaatcgttgaggctgttcttccaacattagggacttttgtcgatgatacaccaaaggagtttgattcattcgaagatatcctcggactctatgaactgggtccagaagcacccaacaatccactagtagcagaggtcaggaagagaatccccagtgagttccttagaagtattctgccaaatggtagtcatgaccaccccctaaagatgccccttccaaatatcatcaaatcagatgtattgaaaaaggctccagagttcaagtttggctggaggactgatgaagagtttgcgagagagacacttgcaggcgtgaacccagtaatcatcaaacg

SEQ ID NO: 22515 - DNA, 549 bp, Sorghum bicolor
  unsure (1)..(549): unsure at all n locations
  Clone ID: 14365647
gcacgaggatcagcctttattaaacaaatgcttgtgttacctagtgttttctcaaacttgatgtcttactgtggctttatgaagagcggcgaggaaagtctgtcaaatttcatggattactgatgctttttttaagagctatgcacgtcaattaatgatcccagaagtaaattcaaattctctgaaatctatttatgctgccctggaatatggatatgacactatttcttgttatattacctcctgcagacctgaaaggctgagcttatcatatttcatttaagttgcatgtaccattcgcatttgacacatgctttaatttgtgtagtgtacttagtactagattctgtttcaataaaacataagagttccaacccccactgcacccaccccccanaaaaaaagaaaacaataacatgctgatgctgctgatacacatatttgcaggctggtgcgcgatcagggtgctcaatcagtgcatcacgcanatgcaagcctccctggtggaaaggcttatttgtagctgccccgactgactatnaagaaaga

SEQ ID NO: 22516 - DNA, 591 bp, Sorghum bicolor
  Clone ID: 14365655
gcacgagggctcgccgcgctgctcggggtctccgtgctctacgacagcgcccacatcgccgccacgctgcggaggcacggcggcggcccgacgacgtacgccaagctctcgtcctccgacgacggcgccaccgccgtctccggcgtcgcgagggaggaggcggcggcggcggccgtagaggcgctcgcgccgccggcgcgggcagcggagtcggcgccggttgacggcgcggattgggccgacccacccccgcacgagcggcaggaggaggtcgcagcgaagcctggagcgacggccgggagctccctgcaggacgcgccgctgatcgaggaggtggtgcaaggaggaggcggaggccacggcgacggcgccgcgcaggagcagtcccccgggacctgcgacctgtacaagggccgctgggtgtacgacgagtcccgcgcgccggtgtacaaggagtccgactgcagcttcctcacggagcaggtcacctgcacgcgcaacggccgccgcgacgacgactaccagaagtggcgctggcagcccgacggctgcgacctccccagatttgatgctaagttgcttctggagaag

SEQ ID NO: 22517 - DNA, 454 bp, Sorghum bicolor
  Clone ID: 14365656
gcacgaggcaccatcgccgtcctcggcgtcccctccgacgccgtcctcgccttcctccacctcctctactcctccgacgccgccgccctcgcccgcagccgaaggttggtggcgcccggagcggaggatctggtggccgcgcacggcccgcagctgctggcgctggcgcacgcgtaccgcgtcgggtggctgaagcgcgccgccgaggcggccgtgtcggcgcggtggctcaccgcggaccgcgccgtggacatgctcaagctggcgaggctctgcgacgcgccgcgcctgtacgcgcggtgcgcgcgcctggccgccaaggacttcgccgccgtcgaggcgtccgacggctggcgcttcgcgcggcgccacgacccggcgctggagctggagctcctccagctgctggaggacgcggacacccggcgcgcgcggtgggcgcgggcgcgggcgt

SEQ ID NO: 22518 - DNA, 454 bp, Sorghum bicolor
  Clone ID: 14365657
gcacgagggctgcgcgtacggtccccgtccctggcgctcggcggcgacggtggctgcgccagcgccagcagcagcgggaggggtagcgtcgtcgtcagtggcggcggtctcggcgtgctcggcggcgatggaccgaggatcatccggcggggcggcgggcgggaggtcctcgccatgtgcagcgcgagcttcgacggggtccgtcccgccgccggcgccggcgctgccgtggccagcgccgtgcagcccgtgccggcggcgttccccgagcgcgtcaaggtggtggcgctggtggcggccatcatgctgctctgcaacgccgaccgggtcgtcatgtccgtcgccgtcgtgccgctcgccgcgcagtacgggtggtccagctccttcgtcggcatcgtccagtcgtcgtatttatggggatatgttttctcatccatggttggaggagctttgg

SEQ ID NO: 22519 - DNA, 354 bp, Sorghum bicolor
  unsure (1)..(354): unsure at all n locations
  Clone ID: 14365662
gcacgaggggacggcggaggaggaccagaagctcgtcagcttcatcctcggcaacggccagtgctgctggcgcgccgtgcccaagctcgccgggctgctgaggtgcgggaagagctgccggctccggtggaccaactacctgcggccggagccntcaagaggggcctgctctccgacgccgaggagaagctcgtcatcgacctgcatgctcagctcggcaacaggtggtccaagattgcgtcgcacttgccagggcgaacggacaacgagatcaagaaccactgggaacacccacatcaagaagaagctcaagaagatggggatcgacccgctcacccacaagcccctctgccc

SEQ ID NO: 22520 - DNA, 624 bp, Sorghum bicolor
  Clone ID: 14365664
gcacgaggcacattcgtgctgctgttgctcttcatcgtccacaaacttgggatactgcttgtgtgctttcccaattgcaggaggatttgacgtcatcgagcaagtcggctgtgcgtaaatgggatgttaccgcgggggccaagccgttcactcgagcggcttatcctattccgccacctccacctcgtgttgacaagcttcctgcaccgcctgagttaaagcctcagcctggccgtgtcctgacggctgatgatcgttgggccgctctacgtgctactcgcaaggctcaaggcttatgctataaatgtggtgctaagtggtctcgggatcacaaatgccccgcggctgttcagcttcatgtattggaagagatgttggagttattttcagtggaggactcttcttcacctacggattggacacctgatgatgagccggctcagttggctatgttgttgtctgcagcagccgtttctggtgttaccgctcctcgtactatgagttttgagggtatgctgggtgacacacctctccgcatcttgttggattcaggcagcacacataccttcctcagtgcttctgttgctgctcaatctcctgcgttgtctcctctgccagtccccc

SEQ ID NO: 22521 - DNA, 490 bp, Sorghum bicolor
  Clone ID: 14365741
tccgccgtcgtcggcgacctcctggccaacccgctgggtttcggcgcgcgtcggctccgcgcggcgacggggcacggggacgagtacgcgcggtcgctgctggactacctggagacggccgacctggcggcgctgccgcgcggtggactcgccggcacggacctgcgcgtgatcagctggctggggatgccgtcctacgacgcggacttcgggtggggagagccggcgctgctggcgccggcgctcatgtactacccggggttcgtgtacctgttgaactgccccggcaacggcaagggcggcggtgtcgcggtggccgtcgcgctggagcccgaacgcatggagcggttcaaggagctcttcttcgaggagctggccgcgctggagtgagcttgagcgtgaggcaatagattcatgtgtacgcttaacttgcactttatgcaccgcgttaatatgtctatatctatcgcatatatttatctttgtatct

SEQ ID NO: 22522 - DNA, 189 bp, Sorghum bicolor
  Clone ID: 14365789
ccgtcgattcgctcacaggccatggccatttccccgccgccgaggacgtcggcaagcatggatagcctcttgatttgaaaagtttccccccatcgctggtggaaagcttttgattccaaatagcctgctttgaaaagtctgtcttggactgtttgactgcaaaaggtcatttaacccctagaaaatttt

SEQ ID NO: 22523 - DNA, 409 bp, Sorghum bicolor
  Clone ID: 14365844
ccaccccaggaatcaacctacgatggttccttgatgttgctggaaagaaaaattccaaagcttacattgtcaacggagttgcaatgttcattacttggctgatggtcaggatagttctgttcatctacttgttttatcacatccttacaaattatgatcaggttaagcagatggacacttttgcttgggttttgatatctgttgccccccccatactattcactatgaatgtaatatggttttccaagatcgtaaaaggtctcaagaagacacttgccaaaaggcatgctgaataggggaatgtgcatacatgtccatccacgaccatttattccatctgtacattcacttacagctatgtacaaatttagtcacaaatgcagatatgctggtaattcagctttttcgt

SEQ ID NO: 22524 - DNA, 380 bp, Sorghum bicolor
  Clone ID: 14365888
gaaccacccagaggatcattgtcctgaaacagatgcacttgcaattttgccttgtctgcagtgttagcctcaaatggttggcgtcacatctatctggattcaaagctgcaatgagctccaatgctcagaccatggggacttggttcagaatgagcgagctggtcctccagaatttagtgcctgatattagtggttaaaaacatataaaaaaagaaatctgcattgtaaatggcatctgcatttttgccctttgcttaggtccgacaattagatggtacaaagctcgagagaattgctggtgtttgatcgctattgatgactgttggtcgtttttgttcctttgtttctctaagccatgaattttctgtaaaatttgccct

SEQ ID NO: 22525 - DNA, 119 bp, Sorghum bicolor
  Clone ID: 14365891
aagtagcatgcagtaaaccctcaagaagtggtttagcgctagcttttgtataggaagttagaacccgggttatattaaggccctgtttagttacacacccaaaaatttttcatccattt

SEQ ID NO: 22526 - DNA, 585 bp, Sorghum bicolor
  Clone ID: 14365902
tgtgaaggagatgcgagcgatgcgtttggtcaagaggctgatgactctgagtgggaaacagctagcgaaagtgatgctgaaaatgatgccacaggagaagcagatgatgaaactgaatggaagaatgatggccaccaggaagatttctgtgagaaaagctgaggaacagggcgagctggatttgtattcagagggagtcaaactgagcaggtacagaagcagcttctggacgttctgcaatctgcaccacgaagcatcaaatctttctaatggaacgatctggtgacatttttattgtcattattaccaaagcaaggcccaattaaattaatttcccacgtcttcttgctgggtcagttgagttgtgcctgtgaccattcagtatttcctcgtagatgttggtccttgtttggtgtttgtaacatgtttttcaccagtttgtcaactctttgaatcaagaaaactgtgcattgtttgttttcttttcttttttttttatcctgaagtttggtgaagacgccataattctggctttcttccctttccactggacctatctggaatgtgaaggccacgtttcctttc

SEQ ID NO: 22527 - DNA, 287 bp, Sorghum bicolor
  Clone ID: 14365916
gttccgaggagttgctactgctacctagaaaaattatcaataactagcttcatcacacactgttgtttttgtttctgatgatccagccaacttaggtggacctgggttatccacccttgttggcgtccttgctttactgacctcacctgcagcattgtaatctgtatgtatagaaagaaaattcacctgctgcctactgcttgtattcaatcaaaggaatgtaacaaaaaaatagaactagagtgttacagagagaatgttttgagaaagcaaatggatgaatcgat

SEQ ID NO: 22528 - DNA, 518 bp, Sorghum bicolor
  unsure (1)..(518): unsure at all n locations
  Clone ID: 14365924
cagtaaacagcaaagacccgaaagcagacaaagcaaaacatgcagctgaagctggagatgatccgaagaagcgggcatctgatcaagctggtaaaaatacaccagatgcctcaaactctacatataagaaggttgaaatgtttgtgaaagagcagatcaggccactttgcaagagcggtgtgatcacggttgatcaatataagtgggccgtcgtgaaaacaaccgacaaggtaatgagcttccaccgcgatgccaaaaatgccaactttttgatcaaggagggtgacaaggtgaagaagcttgcgctgcagtacgttgaggcatctcagcagaagatcagttgactcttacgggattttgtaaaatgtgatcgcaatgcataggtattgttttctcgtgctggagcaagcaatctatgaaaatgacttatgtggatatggttaatcgtgtacaggcgggaaacaagttccncgtaaataatttttacatatgcgttttgcacctgaggaaacaagttc

SEQ ID NO: 22529 - DNA, 497 bp, Sorghum bicolor
  Clone ID: 14365925
caccacaggcggtggtggtccagatagttccatgggggaagatggactggatggccaccaacttctacgggcagccagcgcgtggcatgaacctgaggtacctggagtactacgtctctgaaaaagagagtagccttgctcagaggtacccaagagaccacttggtgttcaaggaccccatggcaatccatggtcagggatggaatgcgttggcagacatttttatggcacaggatgtgaaactaaatatcaggagattcaggcctacacttttacaggttctggaccttcttcaggtctagcatgatagagacataacagttttgttttcttccttgtatcatataatgttcattctttgtcagttaattcttttttctgacacaaaattaatatagttgtaaccatttgtttgttttagcttgttgctttcagtagtcgtcattgtatacgaccctcttgctcttggatcccgtcgctcaagttgttcactttgt

SEQ ID NO: 22530 - DNA, 463 bp, Sorghum bicolor
  Clone ID: 14365936
ggttattggcgttattctttacagtgaatccaaaaagcgcagcaacaagccatgaacaccctagaagacagtaaatatggcaatcatttctttgtcctgtcagtgcctagagctaatatatgatgagaaattcttcggtggcgatcacaacaaatcctaagccatactgcctcagcaattggacatcgaggatagaagtccaatactacctgtagtatcaccttggcatgtgggaggcattttgtttaatggcgttgatggatagaatataattttttgtgttatagaactgtggctcacactgccagcattggttaatacgtttagctcttggaaattgtctctgctattcatctgctattgtaacttccattttctcttcttctgatgaagaccacctgtaccagactatgatccaggttccaggacctaattaatatattgtgacactgaatttaagctc

SEQ ID NO: 22531 - DNA, 252 bp, Sorghum bicolor
  Clone ID: 14365937
ctgatgacgcatgtaaatttcccccggccccctttaactttcactttttttttcatctttattaattttccatctttctcttttccttattagctatagcttgttcattgtaatttgccccgagatccatccacagcactgcgcaattgtactgaaaagctagctaggaaacaaaaaggggtcatgaggacgctgcatgcgccatgtatgtctgttggcagcaataaagcttgcatatagtagagtgccatg

SEQ ID NO: 22532 - DNA, 563 bp, Sorghum bicolor
  Clone ID: 14365939
ctcgacgaaagctatcagtgtgcttcattgtggacacacgattcacctggaatgcctgtacgagatgagagcgcatcagcagttctcatgcccggtttgcctgaggtctgcctgcaacatgtccgacatatggcaaaagctggatcaagaggttgcagcgtccccgatgccggcgatctatcagaagaagatgatatggatcctgtgcaacgactgtggcatgacggcgaacgtgcagttccacatattggcgcacaagtgccctggatgcagctcttacaacacccggcagacgaggggcgatccagctgcatgctccagagtttaagaacaagtcacgaaaagcaaagaaacgagactgcagtgcgcagaggcgctcgtgtgtgatcgatcaataagctctaggcccgtagtagctgtaggaagggaagaaggccctgcacatgaacacgatcggtgccggtcatttatattgttagctgatatgtatatgctccgagcaaataagcatttgccgcatcggacacaatacaaatttctttagttttttttatttgagatgg

SEQ ID NO: 22533 - DNA, 527 bp, Sorghum bicolor
  Clone ID: 14365947
cagcaatattgcttcaagagtatggtgatgatgaattaatggcaaataaagacaagtggtttatgtttactgaagacgaagagaaagtaattgaagaacatgtagccacagggtccagacataagatgaggaagcgtattagagtatagtgttctactcatttgagtctctggattcttgaactcagtgaaggtggattggctatgccttaggttgccttagttgaagcttgaaggttgccttaggtggataggctttttgctacagaaaaaaggttgtacaaatagacaggagccaagcatttgaaaacttgccatattttggctgcatgagaacacaggcaaggttatgtatgcagtttcgcagtaccgattaaggcagaagtttgccgtgagctgctttacgttaaaaagtagcgttgtatttgaatttgtcatgttgcagttacaactgttgtaatcggtatttctttggtaatctgtagcaacaactaaatatcgatatggcttttgcatttttgttagctc

SEQ ID NO: 22534 - DNA, 511 bp, Sorghum bicolor
  Clone ID: 14365971
gcacgagggctacgcttgagatatcctggtgatagctcacatcccacatggcaatctgtgggacatgtgattaagctcactgcacaagaggaggtggcacttgagcttcgtgctagtcagggggtgcctactgagctaaacgttggattcagtgtggattttgtttggaagagtaccagttttgataggatgcaaggagcgatgaaaacttttgctgtggacgagacaagtgtcagtggatacatataccatcaccttttgggacatgaagttgagcaccaaataatacgtaataccctgccaagacgctttggtgcacctggacttccagaactaaatgcttcccaggttttagcagttaaaagtgtcctgcagaagcctgttagcttgattcaaggtccacctggcactggaaaaactgtcacatctgctgcaattgtgtatcacatggcaaaacaaggtcaaggacaggttcttgtatgtgccccaagtaatgttgctgttgatcagc

SEQ ID NO: 22535 - DNA, 412 bp, Sorghum bicolor
  Clone ID: 14365977
gcacgaggcggcaatcttcgtcaagccaaataaaaaggatgtcactgcaatcgccgatattctcaccaagtttggtgaagtaacaggtctcaaaacaaattttgggaagtcgtctgtcatccccataagatgtcagggtgttgatcttgatgaggtgctatgtgctttccctgctagacgagcgcacttcccaactaaatacctaggtctacccttatcaaacaccagactacggaggatcgattttcagcctcttgttgataaagctgtgagtaagctcactgtgtggaatggcaaaaatattaattatgcaggaaggtccaccttggtcaaagcggtactcacctcacaatcggagtattgcctcacatcactaagagctcctaaatccactctggaagaaattgacaac

SEQ ID NO: 22536 - DNA, 494 bp, Sorghum bicolor
  unsure (1)..(494): unsure at all n locations
  Clone ID: 14366063
gcacgagggcttgatgttattgcctctgcactttctaatttcattgagatgggcaaggatgtactagcaaaggagctcgctgagatgttcacacctgaagagatgcctctgtttggttcgaattcagcacttgactgggccaacttcaatgcacaagcattttctgatgaatccctttcttttgatgaggaatgttcaagaacctcttcagtagattgtggcttgcacgagtcaccaatcaccaacactgctagctccatctcaaagattactctaccacagtcggttccacatgttttaggtgtcggtcaattgttggaatcagcgctacatgtggctggccaggttgcgggtgcatctgtttcaacctcacctcttccatatggtacaatgactagtcaatgtgaagcccttggattgngcaccaggaagaagctatcaagctggcttgtcaatggacacgaatcaaccccggacaatcctatgccaagtct

SEQ ID NO: 22537 - DNA, 481 bp, Sorghum bicolor
  Clone ID: 14366076
gcacgaggcgattccgtcgcgccgcccgcctcgtgcggtctcccacaaaggccgaatgccccctgccggatttggggcttgtgccgccgctgggtggctggcccaacgagcatcgcgcaatggcgacggctggtgagccacctcccagatctacatcaaggagtaggcggtggtggcagtcgtattcgcaaccagaccctggtagcagcattcgcggagctaggaggaggtggcggctccattgctggttgaccgtgcagcccagcagagtgttgaaatcgagcccagctacgcacagtcctatgctgagagctccacacttgctgagctctaaggatccagctgccaaggccctgcacacgtgcagaccgaagctcgctctgttgctcatatggaaaaaagcaggtacttccctctaagtctctaatcgtgtgtgacggctcactctgttgcccaatggaaaaaggaagtaaagatgcaa

SEQ ID NO: 22538 - DNA, 499 bp, Sorghum bicolor
  unsure (1)..(499): unsure at all n locations
  Clone ID: 14366091
gcacgaggcccacctcccgaggagctgctccacacgcaggccacgggtctcgtcgctgcctcgcaggccaacttcatgcgcgtcatcgtggacgccgcggccccggggctggaccaccaccgcggctccgacctgctctgcgtcgtccgcgcgctgctcaagaagatccgccgccgcgtgctcgtcggtgaccgcgntcctcgtcggggcggtcgactggaccgaccgccgcgggatgatcgaggatgtcttcgagcggaggtccgaggtggccgacccgcccgtcgccaacgtcgaccgcctcgtcgtgctcttctcgctcgaccagcccaagcccgagccggccacgctcacccggttcctcgtcgaggccgagtccacagggatcccgtttgtgctcgttttcaacaaggtcgagctcgtcggcgaacagacaatagcatactggagagatagattgaagagttggggctatgatccactgtttctaagtgttgat

SEQ ID NO: 22539 - DNA, 505 bp, Sorghum bicolor
  Clone ID: 14366176
gaactagtctcaagaaagaaaaggcagaaaagctcataagggaaattgaaaacaaatgcaacgaaaagatatcacagaacaagcatgattctgagaggtatttgatttgccttaaggaggaacatggcacaatggtggcaagaattcagcaggacaatgagcaaaaagagtcaactctccgggcttatcacaaagaagaactgcagcgcattcagtctcaggctgagaatgaattgagggagagtctgtcattgctcaggaaagagcatgaacttcaaataaaagcactaaggatgcatcatgaggaagaatgccaaaggatgcagggggaactggagcttcagaagtccaaggaggagaagcaaagagcattgttacaactacagtggaaagtaatgggagaaagtcaacaagttgatcaagaagtgaactctaagaaggaatactctgtttcgtcgattaagaggagagatccatatggaagaaaagaacatgatgtccagtt

SEQ ID NO: 22540 - DNA, 500 bp, Sorghum bicolor
  Clone ID: 14366179
gcacgagggctggatgtagttaagaaattcccttctaaagtccagcttgaggaagttcctcggcagaattcatggccgacacaatttcaggaaaatggtccaacttatgacaacataggtctttttttctttgctagggatgttcagagctatgaaaatcactacagtaaattagttgaaaatatgctgaagaatgatttagttctcagaggaagtgttggtactgttgagttgctcatattcccttccaatatcctgtcaaagaacttccaaaggtggaatatgttctactttctatggggtctattcagagttagcaaaaaagattcctctaacctcggccccaatttggtaaagtcaactaattttgcaccgagcttggaagccagtcatgaggtgtgtttggatggggagatatctttgaatcaacctctatgcagaagagctctagatgatcacctagattcagatacaaaagcaagttcaacaattagcaatgg

SEQ ID NO: 22541 - DNA, 116 bp, Sorghum bicolor
  Clone ID: 14366182
gcacgaggcaccactgcgacaaaatgatacaactgcaagtgctttatcttcaaagatatatgaggataggatgaaaattactgttcagagggacgtttcagaagaggctctaatga

SEQ ID NO: 22542 - DNA, 567 bp, Sorghum bicolor
  Clone ID: 14366189
gcacgagggatcgccggcctgtacgaggcgtggaagcaccacggcaagctcccatggaggcgcctcgtcctgccggccgcgcggctcgccctggcgttcaggatctcgccgtacctgcggatgcagatggaggcgaccagggacggcatcctgggcaacaacgggacgcgggccgtgtacgcgccgggcggcgacatcctcagggccggggacatgtgccgcaaccggaggctcgcccagaccctgcgggccgtcgcggagcacgggcccggcgtgttctacggcggcgccgtgggggcgcggctcgtgagggacgtccgggaggccggagggatcctgacggtggaggacctgaagaggtaccaggtgaaggtgcggcagccgctgacggagaacgtgatggggctcgaggtggtgaccatgcccccgccttccgccggcggtgccgggatgatgcttgtcctgaacatccttgatcagtttggcattcctgctggtttcgctggatctcttgggattcaccgtctcatcgagtccttgagacattacatggcggtaaagatgaac

SEQ ID NO: 22543 - DNA, 619 bp, Sorghum bicolor
  Clone ID: 14366194
gcacgagggttccccaaaccgcacgcgcgcgcgcgactccccccggccgctgtcatcgtcgtcgtcgtgttcggggaggagatccgccgggctcgcccatttccctcctccaagctctcctcccccgctcccgcggccagctgctgccactccgcgcgcgccctcgccaaaccctagcttggccgccgccgccgccgcccccgcccccgcactgccccggcgccccaccgagcgcgtgcgccgcccgggccagcggcgccgaccgccaccattgccgtacggaggcgtcccgccacgttggaatgcgctgtttgaagtgtgatcattgaggttgtcattgaagaagtgtctagaatcgattggctgcccttcccataatggacaagatacaatctgattgcccttatcctggatgtttcttttgtgtcatgaaggaggcaaacccaagtaaacgaagagcaagtgtgctaaagttctttagggaacttccttcccaagatgatgatggtcaagttctccctattagtggtctctggaacacagcaatggctcacccaaatgatcccgagttcatcaacttgggcatatttgaatgcatggcagctcttatatggaaagg

SEQ ID NO: 22544 - DNA, 495 bp, Sorghum bicolor
  Clone ID: 14366199
gcacgaggcttttcagcattttgtacaacaaaaggttcaatgtatttcacttcccggtatcagaagaggaggtgcctgactatcgatcaataatccacaagcccatggatatggctactgttttgcagcgggtggactctggacagtaccttaccagggcagcatttatgaaggatattgatcttattgtctcaaatgcaaagacttacaatggggatgactacaatggatctaggatcgtcagtagagcatgtgaactcagagatgtggtccaaggtatgttgtcacagatggacccatgtttggtgtccttttgtgataaaattgctttacagggggggccacagcaggttgtggatgatgaagatagctctattcttcaagcagcgcctgttgctcagctggtttctggtactagaataagtgcaaggcttcgcaatgtactgcccgaagtaaacctgtcacaaagttatgaagtgctaaagcggcaaaaga

SEQ ID NO: 22545 - DNA, 568 bp, Sorghum bicolor
  Clone ID: 14366202
gcacgagggctactcgggcgccggagcacggcagcagcagcagacggaggcggtggccgaccgcgtgcaccggtaccgtcgggtgctgatggtgttgctctcgccggtactcctcatctcgttcgtgctccttctcatgccgcgcgcgccggcctccgcctcagggggtgggctcctcgccgttggtggtcggaggtgggggccccgggccgttgaggacggattgaacaagtatgccgttatatttgacgccggcagctccgggagccgcgtgcacgtgtattgcttcgacgaaaacctggatctagtgcctatagggaaggagattgagctgttcaaacagaaaaaaccaggcctgagtgctgcaaagggtccacaggaggctgctgaatcactcatttctcttttagaggaagctgagaaagtagttccagcagagctgcgtggacaaacacctgtcagggttggggccactgcaggtctcagagcattagggactgaaaggtctgaagaaattttgcaagcggttagggaacttctccgtgacaagagttctttcaaatcccag

SEQ ID NO: 22546 - DNA, 496 bp, Sorghum bicolor
  Clone ID: 14366208
gcacgaggctggatatcaaattttctccgtatgaatcagttgaaagatgagatatgttcatcttggtttgctcctgttggatctgcaagtgactatcctattctggcaaaatgggttatttacggggagttagtttgcagtggatcctgtgctggcccatcagatgaaatatctcctttgtactcattgtgggctacatttgttggcctttatatcgctaactttgttgtggagagatcgactggatgggctcttacccacccgtcaacagatttggaggatgagaagctgaagaggcatatgaaaccagatttcctggacatggtaccttggtattcagggacatcagctgatttattcaagacagcatttgatcttatggtctctgtgactctttttgtcgggcgatttgacatgcgcatgatgcaggctgcaatgaaaggaccaacagacaatacttcaaatgatgacctattgtatgactacttcaatgaaa

SEQ ID NO: 22547 - DNA, 630 bp, Sorghum bicolor
  Clone ID: 14366216
gcacgaggattcatggctctgcccaagatgcaagtttaatgaagtggaacatgaggcagatgtaatcttgaagcaaaacttcagtgaggagtgtatgattggttctgataggacagctaccaatgcatcattttctggaagggtgtcagtatctgttgctgatgagggagaaactgcccttgttgtatcaatggtgggtgtgcattctgaaactaggagtggtatatcagaaacttcactaggacttaagacagcacatgaaacatttaactgcagttcatatccaagtcattccaaagatgcccttgttgcagatgctagttccctgcggaacacagatattttcagtacatcccagaataaaccttctgaaacaaatgttgttcaccctctttatcctgagccaacagaaacatcattacaattttcaccaatacgtgagccagcaacaaccatatttagctcagagcagggtaacatgtcaactgaacggttagaagtaccaaagcttgtgtcatcttgtccagtagtagataacggcaaggaggctaaaagtactggagaggagaattcagtggagcaaagcaataatgaattatctcctgtaacgaatctccacaacctttcttg

SEQ ID NO: 22548 - DNA, 536 bp, Sorghum bicolor
  unsure (1)..(536): unsure at all n locations
  Clone ID: 14366218
gcacgaggctcttttactccgatgctccctcccgaaaacccgcaggcgcagctgatgattagctgagcgcctgagccatggcgttcctggtgcagcacggcaagagcagagccgtcggcgcgaggaagccgaggcacgtcgccaggatcccgaccaagctggagctcaggcacaggcagctcgccgccaggcttctcccggcgtgcctgctcgccccggtgctctgcatctgcgcggccaggctcttctccgtcgtcctgccgtcgcaactctcgcctggcaatggagtttaccttgcagagggaaaccatgttatctctgacgatgctgaagcggctggagctctgagctccttgcagcagggctctgtggacgacagacatcgacttcaagaacctagtgctcaggttcctgcaagattgngtgctgatcctgtcaggggttcaccaaaattagatattgaagttgaaagcagcaactccaagcatataacagatttggataataaatcaggaatgaaggggctggctatatct

SEQ ID NO: 22549 - DNA, 618 bp, Sorghum bicolor
  Clone ID: 14366225
gcacgaggcagacgagtgcggagcttcttgatccgctccggctgttcccgtggaccgtcgaccggacttggggttgcgggaggccctctgtctccatggatgaggcaccagggctgctgttgcaagaagagggtggaggtagggaccacgaaccgctcctccttccacttccacaggatgctggcctttacacaggtgatggatctgttgatgtcaaagggtgtcctgcattaaagggcactacaggcaattggaaagcatgttttttcatcctagggaatgagtgttgtgaaaggctggcctactacggaattgcaaaaaacctagttacttatttgaaagtgaagcttcatctaggcaaccttgaggctgcaagacatgttaccacttggcaagggacatgctatcttactccccttgttggagccatcttagcagattctcattgggggaaatactggacaattgctgttttctcatcagtttactttattggcctggctattttgacgctgtcagcatcagtcccagcattgcagccaccttcatgtttaagaacagtttgtccagaagcaagcttacttcagtatggcgtattttttgttggtctctatatga

SEQ ID NO: 22550 - DNA, 644 bp, Sorghum bicolor
  Clone ID: 14366230
gcacgagggtcgtcactggagtcatcatcgccagcggcggcgagcctagctttcatctgtttggattcatcatgtgcataggagcaactgcagcaagggcgttgaagacagtattgcaaggaattcttctgtcttctgagggggagaagcttaattctatgaatctgttattgtacatggctccaattgctgttattttcttgcttcctgcaactatctttatggaggataatgttgtcggcattacaattcagcttgcaaagaaggatttcactattgtttggttgctattgttcaattcttgtttggcatattttgtcaatttgaccaatttcttggtgacaaagcatactagcgcactgactctacaggttctcggaaatgcaaagggtgctgtggcagttgttgtctcgatcatgatattcaggaatcctgtgtccataacaggaatgctcggttacactctcacggttattggcgttattctttacagtgaatccaaaaagcgcagcaacaagccatgaacaccctagaagacagtaaatatggcaatcatttctttgtcctgtcagtgcctagagctaatatatgatgagagatacttcggtggcgatcacaacaaatcctaagccatactgcctcag

SEQ ID NO: 22551 - DNA, 626 bp, Sorghum bicolor
  Clone ID: 14366231
gcacgaggattgcattaatagagagagatggccagagaaatggagaagccaaggaaggctacttcttcccctaataagagctcaacgaatcataccggtcccaagagcccggtgaggaatggaggagggtctccgcctcataagaagaacactactgagccacgtggacgaaaaaatgagcagcaaaacgttcgaaaaggaggtcatcaagactcgttgtctcatgatgagagcaaacgccgttcttcatcaactgcacaaacctcacccaagtctcagagatcaccgagacacgaacaacccctgagctacaacaggcttcacactgaggagagagcaataaggcgggctggctacaattatcaggttgcaagcaagataaatacccaggaaatcattcgcagatttgaagagaagcttgcacagttgatggaggagcgcgagataaagctgatgaggaaggagatggttcccaaggctcaacttatgccagtatttgacaagccattccacccacaaaggtcgacgaggcctctgacggtgccaaaggagccaagtttcctgaggctgagatgctgcatcggtggagagttccatcgccatttttgctacaatggagccaataa

SEQ ID NO: 22552 - DNA, 462 bp, Sorghum bicolor
  Clone ID: 14366233
gcacgaggggcattattcggcagcacgtccctgcctgctcagctgcacacacacggcgcggcacgggaagcgagcgagcagccgccgtccggcgggccgggcgcgcgcggcgctgccccccctgcttcgccggtgcgctcacgcaggtacgcccccgtacgggtcggcaagagctcgtcgtagtcgtagcacggagacggctttattttcttgttgccgtcgtgttcctctccctcgccggcttttcgagcggtggacggccgctctgctatctttctctgctcctcgcctcctcccggtcggcgtctatcctcctcctgtcatctctctatcttttctctgctcgcgtcttccgtgtccttccgtcggtgcgacggtgtctcacgtctggtcggcggcgacgcccggcgaggtcctgaagctgacgcatagaaggtgcatgcacagcacaacaacgaaggg

SEQ ID NO: 22553 - DNA, 500 bp, Sorghum bicolor
  Clone ID: 14366240
gcacgaggaaaaggatttcctctcaactatatcaatcaggggatatcaggatataaaaacttgagcccttcttgtaagctgcgtgttctgaattttctttgtgatgagaccctctctactgacaagctgaggaactggattgacatgcaaaatgacatagctgctgaaccaatgaatgctgctagagaaaaagctcgtgctgcaaaagaaatggaaaaggagctaaaggaaaggctaaaggacaacgtggataaaacaatgctttcaccaaatgaagcagcagcctttagcagtgaagaaaataagtatcttctttcccaaataaaggaggcacaggaagccaagcgtgcagccataaatggtatggcaactatggagaagcaaggaggtctttggaccaagcctctgatggtagagaaaggagtagcatattggaagctagatggttactgtgaaaactcagcaatattgcttcaagagtatggtgatgatgaattaat

SEQ ID NO: 22554 - DNA, 536 bp, Sorghum bicolor
  Clone ID: 14366264
gtgtcgagggatagtcgagaggtgaagctttggcgcctcacgaactcaaatggagacctgaaggtgaagcaggagaaggatctaaccagtgctgcagggaagcttgcagagtgccagaagaccatagctaacctcggtcgccagctgaaatctctaacagaccttgatggtgtggcacctgatcctgaaaagctggaatccagggacacacacctggacttcagagatggcggcgacgacctgctctctgcagacgtggctgacggactgtatgaagttggtcttcctaagaggaacggtagctgcctctcgccccttcggtcgaatcagtcgtcgggtggtttgccgtcccttagtagctacttgagcaaaacaaaaaggtgaaaaatctgatgagaccagaccattgtgcataaattatttgacagtctatggatgatgatgtcatttgttacctggtggtagatctgtgtacatttacagaacttgatggttgcttacatgtgtccatctactttctcctttgctatgctccc

SEQ ID NO: 22555 - DNA, 350 bp, Sorghum bicolor
  Clone ID: 14366267
caatgagcctttggttgacgtggctgacctgacaaacccttcggtgaatgagccttcggctgatgtggttgatctgctacatacttcaaacgagccgttcgacagtttgaatgatatgccaaaccctccagagatgtcttttggtgggagcagtggagaacatgctgacagttttatataaggatagggctatgcgatactgatagttcagagatgaacgaaacatactgctgcactagttggtgtgtcctgtacagtgatgaacgcttttttccaagttatgcagaagtttttgtacataaataagtctttatgtcggcatcaatttatactaaatactatgaaagctg

SEQ ID NO: 22556 - DNA, 670 bp, Sorghum bicolor
  Clone ID: 14366276
cttccaagtatgagcacaaagaggggatgccatgccctaactgtcctgggagaaagcctatacgcaatgggaggatacaatggggacaagatggtttctagcgttgagatcttcgaccctcgcctcaatgcctggaggatgggagatcccatgagcaccccaagaggatacgctgctgcagttactctggatggaagcgcgtatttaatcggtggcctgaagtccaatgtgcagatcctggataccgtggaggtttataacgcgagctccggctggtcagctctcggtttcagttcactcgggaagaggacctttgcatctgccgtggccatgtagttactgatcagatcaggaggttaactagtgttaataacatcaggtttaacatagttgctgcctttcgcaaggaatagtagttagggtaaagtgggtgccgatgtgtattgtgtttggatcttcatcagggtaaatcatccgaatggtatgggagactgggtacgtggcccgtggattgaccgttgaaccctcgctgactgtcagtcttgagaacccatgcatgcattcgctgttgtatgcgtgccactgccacgccgttgaacttagctgtactatcagatagatagtgatacccaaactcacggagtttaatggaacaggatagaatgctggc

SEQ ID NO: 22557 - DNA, 623 bp, Sorghum bicolor
  Clone ID: 14366281
ctgggaacggtgcgaaacagttcctgactagttcaaaattgcgaactctgtggctgggaatcattcccgtaaaaccgaacgaggcctaaatctgcccatgatttttaatggtacaggacaaggtatgtcaatgataaggcccttttggcaatatacatagccggtacctctactggctactcagatctgcagtactttgaggaactatagcagtgatatacgaccgaaaagggtggacatctctgcgatccaaacgctggatgtgttttcaaggcatcgagagtgtccacattgacattcgctgtcagccactttttacaagccctgaaatgtgatgactggtttgatgcagttcagtagttcattgctgaagaacaactgaggttggtttccatttcaaagtattccatggatgagcttgtgcatatttccaagggaacaaacaacatagggcagtttctcctgtgcggctgtgccaagcacccaggcctctagtctcttcgtgcaaatatactgatgtatatgtatgcatttgaagttgatcagctgcttagttgcttgtgttgttcattctgtaattctaacccattgacctggtcgagcaaaggtggtgtgcgtccttc

SEQ ID NO: 22558 - DNA, 533 bp, Sorghum bicolor
  Clone ID: 14366289
actcgggatgacagttttggcatgggggaactctgtgggagaccttgttgcagatgtagcgctggccaaggctgggcaacctacaattgccatcgctggctgctttgctggtccgatgttcaatatgctggttggattgggaactgcccttgtagtacaaacagcaagagtgtatcccagggcttttgtacttgaattccatgttggaattgtcgttgcatttgtgtttcttcttctgagcttgatgggcaccctgttggtggtcacctgggctaggtttcgggtacccagattttggggctactgccttatgggtatatacatcttgtttaccatagtcagtattgccattgcaagttcttcaggatgatatatgtgatctcttttgtgaagatagctgctcctaggttgttgtatgtatttagcatttgcattttgtcaggttgatgcattcggtgaaaactattcatgagatatcatctgcctggccatgttgtctaatcttaatgtatagaattgagatatttcattgc

SEQ ID NO: 22559 - DNA, 553 bp, Sorghum bicolor
  Clone ID: 14366291
aacaactgggacaattccaagcaatcatctatggttggcaactcatttgagaggaagctggccgtcctgaaaggagtctctccaaaactagagacaccggacagaagcatgcgcaggccgccatcgaggaggcccggggtatcgtcggagccgaccacgccggagcaccaacaccagcagccgacggcgaggagggcctttggctccgcgtctgccgggaggtttggcagggagcgctcaccagctgccgcaccgccaatgtcatcgccatctcccaaaagccgctcgacgtcgtccacgcccaccgcggtggcacggcggctcttccctgcctcggtgcacgcatcggaggccgtgcacgtcgtctccacggggacgacagctcgacgacggtgagagaggagagctgcacggaatgacggaagacgacgtgtatgcatgtgtaaccgtgctcgattgaaaccatgtaatgtagagacagtagagttgtactaatcaccggtgtgcgtacgtattttgtttaaggaatttacctgtcaggctgtgatacccc

SEQ ID NO: 22560 - DNA, 484 bp, Sorghum bicolor
  Clone ID: 14366315
gtgtccgccgccgcctcagcgttcctactggcgctgctcctggtggcatgaccgatcagggcctccatttcttcttcctttaatttgtttcccttccacctctcatccgtcgccgtcttcatcaatcccattcccgtgggcaggcagggggcagcagagcagagtaggcagggcatattggttgccaagacttcaacacttgggttttgcttcgcttaattgcttcgtcagagggaaactgtcatgtactgtatgtaatgtaacttcccagttgcaggtcgtcagatggcaagacaatcaggctggcagactttttgggtctgcaactactattagagagcctgcctgagcgagagagagaaaaaaaagcagacatatagagcacacatgatttctgtgatttcgtactgtatacataatccagatactctgttcgaatgatatatgaatcaacatactgaacatcaggatgcttttctgaacc

SEQ ID NO: 22561 - DNA, 528 bp, Sorghum bicolor
  Clone ID: 14366316
cgcagggagtatagtgtagttcagcaagatacatggttgtttgtcactcaggtgatgtatatagccaagaatggccggccaaagcaaataatattttgcttataaaccactttgtaaatgagaggcgtttatgagagtcatctgatgcgagatgaatgctggtcagttatcctcttcttcctgcgcagtgcgtgtgccccatgaagctgtccgctggacccatgaaactttgcaccaatggttgtggatagcaaatgcgcttctgcgaattcagagcaccagcgtcctttcgtgcttcccagtattcaagaacgccgtggggggagccttggcattcgctggagactagctgtgggcattttttttattttatgtattctattctccagaactttattagcatcagatggactggtaacctggctgccgcgccaatttcttgtagtcgatggaatatatttatgtgcatgtaacacgaccatttatgtctcgccaactaacatgttttggaaccatttgtgtcccccc

SEQ ID NO: 22562 - DNA, 549 bp, Sorghum bicolor
  Clone ID: 14366349
ctgaatcagaagatacatgtccttgagtccaagatagcattccttttaaatgagacatcatatcctctaagtgctctggttggataccctgcatacttgtcgttcactatagagagaaccaaagctaggtttctaatgtacaattggctgcgagaaaaagggctggttcctcctaatcttgctctatccaccttattagcttgttcagagaagcggtttcttaaatatctggtcctaaaacatgaaaagggtccagaagtctgggagaagttgaagaaagaggtagttgcagacaaaaacatgcactgtactgcagatgattagcacgatattatttgttgagagatttttttttgaggaaaaggcaatggagtgcctttttcatgttaattatgtaatgaagaatgtgcatggatggtagtaactgatattttaacttagttccatgaatattgtttttgttttgttttgtcttatcgctggtctagagtggacagacctcgattctgactatggcacacccaaacttcgcaaatgttattcagcatc

SEQ ID NO: 22563 - DNA, 607 bp, Sorghum bicolor
  Clone ID: 14366366
ttccactctgatggtccaaatgcaggagatcaagaaccattccctgtgggatcgaatgtccgttccaggcctggaaggtccaggattttgagctgggaacaaaaccaccaggacattgcatcggatcataccaaaggtggaactcctccgagcaggggtggtggcactctaggttacatcgccacagacactgatcatatggctgtcgcttgaagaacttaccacatcacccaaccttttgacaattgcaatccagttttttttttgaaattgcatcctcacccacccctttgctccttttgttatgttgtatctatatctacttccgcgtgatattttgggcaccggaggctctctagacggctgcagatttggtcgctgacaaagtaacgaggagatggacgttgtgccgctcagtttctcctaaggcctgatcgaagcattgtcgttaacttttaactgagagttgttgctttggaaggcgaaaggcgcacggactgcttcgagattttgggtagtgctgtaagatgtaacccagtgttgtacaggtgctgtaagaatggttcactagagggaacaagacacaagaatgtccacttttttgggg

SEQ ID NO: 22564 - DNA, 517 bp, Sorghum bicolor
  Clone ID: 14366394
ctcgagaaggggaagcagaaactgtattccagctcacttaagttgctccttgaggaggatgtgaggcacctaatcgaggccgttacagctgaagagaagaagcagcagaagaagaagaggagagaaaaggcacctccatctgttctgcttgacccacctttttctcccattggaagagtatagcaaggcagggcgcggctgaagctttaggacccattgtgtgtaacattgtttactatcggtcaagatttgtcctcatgttcatattttccttttactgaaggggcaaattcatgttgttcataaggatgggggggttgcatacttgcatgtagtgttagattttagcaggcagtaaggtcataatgtactgttgagatgttgaatagaaaaaaaattaggaggcagttgcatgttccagttggaagaagataagtgaatggagaaaagctggctgtcgcctctgtatgtaaacatcagctgaaacaaaatgtagcatgaagtaggttcagttttc

SEQ ID NO: 22565 - DNA, 599 bp, Sorghum bicolor
  Clone ID: 14366420
ggggcgtccccaagcagtagctaatgaccggggctctctcgcctggatatagtagattcaccacacattggttggtatgatccatatgaagcctgagtgatcaggatcttgttattttcatttgtgttcgggagaggggctggtccacagccataccgaaacgaaagattgatgtacagggagcagagggggctataaagtcggtagaagggagcttgatctaggacagtgctctccaattcgtttcattgaacacaagtagcagtgcaaatagaactcatccaaagatccgtggaggcttcacttgtatatactcagctgggtggatagggggggtgggtgtatggtgtgtgtttttggtatccaattggaatggcaaaggtaatagtgttattgtactaggtattctttcctttttctctttctcggggcctagaagtttctcatgttgcaaagtgtttttgagctgccacagggatttgtcaggagggctcgcggtccagttgttttgtataatagtgctctcaacctcaatgtaatttcagacagatgctgatgtgtacaatttgtgttctaaggtttgagaatttttggggtgg

SEQ ID NO: 22566 - DNA, 592 bp, Sorghum bicolor
  Clone ID: 14366428
cggcgccgagcgcgtcgaggacgtcatgctgccgcgctccccggagcagatgcggcgactgctgcagctcgcctatcaccgcccgcgtcgcttcacgccgggcttcgtcctccgcgacttcgtccagtatctgtacagcgacaaagttgaagagaagaaggagctaatcaaggggataacactgggtaacaaagacaaattccagcttacacctctcccccaggacgaagttcttgtgttatggggagagcatgatcaaatattccctgtcgagaaggcatttgaagtcgcaaggaaacttggagcaaatgctaggttggaggtcctcaaggacaccggccacatgcctcaggaagaggatccaaagcggttcaatgaggcaatcctgaacttcttgcttccagctccaaagtcctctttgcaatcgtaacgcgatgtgaatagttattcaggcccaaggatcactgggacagttcataatttaagataagatgcattctgcctgattaatgcaattatttgttggtttgagacttccaaggttgatgaaatcggaaattaaatatgctatggtgattgctatttatccgtc

SEQ ID NO: 22567 - DNA, 486 bp, Sorghum bicolor
  Clone ID: 14366433
aaaggaaaacagaaaaagatttgccaccaagatcctgtggaacctgatgatgaagcgtgttcgcgaaaaaaagaacctgatgtttgcccaaacattagttgtgtgcaagactactgttgtatggaggattactattattgttgatgagcgattttcgggtatgtttaattgcgaattcaaaatgtaaaagagccatgcatgagcatgagtggtgtcgtagctagctagacacaaagtgacatggccgggcatgcattccaggctgctatttttttgtttcttttttggttgagggcaatggcaggtgatctgccatttcactaaagaataaagagtagcaattcttgtcaaatgtggtgcttgagcgggtgccagcccagttcagcatctgtgaagtggtcctatatatgtatgccatccattgagcatgagcaggattagggacatgctcgcgcccttactgagtgaataaacgagccatcatcc

SEQ ID NO: 22568 - DNA, 322 bp, Sorghum bicolor
  unsure (1)..(322): unsure at all n locations
  Clone ID: 14366442
ctcgctcgaggagatcctcgtcagatcgtagcagctcccggaccatttcctcggagcaacaatggcgtaggctgcggctggaagcgtagcgagaaacagagcaacgggaggaggaggagggaggcgaagcagagtgctgcttgctctgcttcgtttgcatgcttggaagcagagcatggcggggatttcttccatttttggatatagcacagaaagattttaaaattaggtggaaatatttttatttctcttgattgatctcaaattaattttggatgttcttgatttataatagtatgtttttgctaaatcatgaaanctt

SEQ ID NO: 22569 - DNA, 631 bp, Sorghum bicolor
  Clone ID: 14366454
tcatcaaaacagatgattaaagatcttgagagttcagggccgttttcaggcccatcacatggttgggaacctggcattggtctacctgaggatctcgcagatttatttgaagcaatagctggtgcaatttacgtcgacagcgggaatgacaaggaggctgtctggagagccatgaggcggctactggtacctcttgccaccccggagaccattttgcttgacccagtgtcggagctcaaagaactatgcgagcacaaaaactaccctgagccatggtactctccaactcgtgacgatgcagctggagtgacaagggtggttgcaaaggtgaaggctgcggggagagaatactctgacactggagaaggccccaaccaggatgtggcggaagttttcgctgcaaaggctctgctcaagaaactgaaggccgcagcaagaggatgaagcttggacctggagcacagggcgttagaatgttttacgcacttgatagctgttttcgcggaggatcaagtcggtcgcttggttaccagcttgtatgtaagactggttaaaggtttgagcgctgcctctggtttcacagttgtgagaaacttttactggtgttgactgctgagtctatgtttatgct

SEQ ID NO: 22570 - DNA, 557 bp, Sorghum bicolor
  Clone ID: 14366488
ggtagagggcgaggacgtcgacagaggaaagactttcagaaggacatcctgccaggccttgcgtcattgccaaagcatgaggtgtcagaggatcttcgtgcacttggaaggtccaagccaaccacgccggcaaaacgtggccggaacaagcagcaaccgagagggaggcgccgggcaagaagtgtggctgttgccatggaggtagaggaagccaaggtcagcccaccaccacaggcatcaccatctcttctccctgctgacttggacgctgatgcactgggcataacaaggtggggaaggaccaccagacgttgtcgaaggcccaggtgcccgccagtgaacaatgcatcgttgcgtgtagcttgagagagttttaggtaccttagctgatgagaattggtcagaatttagaaactcctttttttttccctgacgagttggagggaaattggcaaactagtaggttaaaagtaatcagtcaaattgtacatgcttctcagcactaatttggtctactgagacctggatcggatcaaaacattttgtacatctctttg

SEQ ID NO: 22571 - DNA, 580 bp, Sorghum bicolor
  Clone ID: 14366492
ctactctcctgtttttcagcatcatcctgtgctgttggatgctttcttgaagacatgcaagcttgttgcaggtataagaagcagacaaaaagaggacttacaagatacaacataagttggagcagcaagtttagagtggcttaagggacatgagagatattaatttcatggtggaggaacagcataccattgcaaggctatgaaattgatccatggccaaattgacactgcaaatctgcagctagaaggaagctgaggtagtccattcgactgaattttgaaacctaggttatactgtcggcactcactccgcagatgattggattcacatcctctatgatgtatgtagaagtgaatacacctgtacaaattatgatagttcaaattctgtgtgggtgatcacagttttgtcagcagcctatatagaaataacttagctgttatacaagctctagtcatattgtaagcatagtaacttataaattttggagtcctggcttgtactaatggtcttgtaaacctgtacagatcttatgtacaacatttgtcaattttcgaggaaagcaaacctttttagggc

SEQ ID NO: 22572 - DNA, 628 bp, Sorghum bicolor
  Clone ID: 14366495
taaatactatattgtggtacccatatgattcacatgagtttgcaaataactgtatttatttaagtgataggaaacaatcatttttaacgaagttgatcaactatgaacttagctgtatcacaaaaatgtctatatagtagagttggtgagcctatgatgccaaactcttcatagttgtgttaattttatgaactttgctttttgattaaatgccattttaatattggtatttaattttagagtattgttttcttatcatgcgatccatgtgtttttagattcgtggaactgatgtatagattattcaaaatgaaatagtgcattgtccatatatatcttatataaaccatttatgccgaatctgtgtttttgtagcttggagtcttattcgaactgtaagaagaaggctaggatttcttggggttactagatcaagaacaccttgtactatcaacttgccatcccaaacatgctcgcaaggctgcagtcctatcatttgatctgtgccgctctgcacagccgatcttggtacattttttgttgggaaatagttatgtttggtcctcgtgcatgtagatgtatagtctgtgacctaattttttatccaatttccattttgatgtgctgt

SEQ ID NO: 22573 - DNA, 604 bp, Sorghum bicolor
  Clone ID: 14366539
cattggaaccgccaatgtatacgtgttttcccttttactttttgtatgtcgtcgtggtgacgagatgcacgcctggtcagcggggaataagttcactatatgaacagactccggcgagcgagacacgctgtcggcctcgggagagggaactagctccaggcacttaaatcctgaagtgttagaactaagcgtttgatcctcctccgggggaaagagaacgccagttctttaagccataactatagtgagttggatcatattcatccttcttaggattaaggatttctgaagtctatcatgaaaagtagatagaaagcaacacgtcaataacgtggaaccttttccgaggaagtagggtgcttgttcgaaaatcatggtagattcggaaacaatttgcttagagtgtgtcttttcgacgttggtagttcaaccgttagggctaggcacacttctccacgggtttgtgctgcagtattaaatatcattaaggtactgtgctatagcggaaagattataagacgttgaacacattgtcgatggggcccaatgcgcacccggatgtgttacgctcttctttctgtgtcactatagataaaagtggggt

SEQ ID NO: 22574 - DNA, 630 bp, Sorghum bicolor
  Clone ID: 14366543
caacaccagtgaagtcatcacatgtgaaggttggggcaaagaagcgagggcggcctaaaggcagcaagaacaagaaagtggtgattgagataaattagggctatggaatggcgcatgtgaaggttggggcaaagaagcgagggcggcctgttggcagcaagaacaagaaagtggtgataagatcgattagggctatggcatgccgatcgctgcaccatttgacatctgcatctgttgtaaactacattgtgtatgtgttgggaagttttcttgcttgcagatgacatgagccttgtaagatggttgagcgttggtgcttcacctcgataagttggtcgagaatcagagcttcaccattcatgaaattttggtgactaggttttcctccttactttcattgcaaagtttaccgtaatggtcagttcaggtgatcagttttagcttttgttcgtatcatcccattagatgggtgagatgtttcatgctgtagggtggcagctgctcaggtgtccgttatgctatctgcaactttttaagattaggagatggataataagctctgtgaatgtacattaattagaaacactacagtatgaaactgttgaaattggcaactttgcttcggcaatt

SEQ ID NO: 22575 - DNA, 563 bp, Sorghum bicolor
  Clone ID: 14366563
tctcagaggacgccgtggtcttcgagctgcgagatggccggctggcggagctgcggcggccgccctccgtggaggggtgcggcgggtgggagtgggcgcggatcatcggcacgccggccagcgcctgtatgaccagctactggacggccgtcgccacgtagccgccgccggccgccggggcgcgactcacgaggccggcaggccgcgctgggctgattggctcatcaaaggaaggaatggactgccagcccatggccaactcggaagttggaaatgatccaccacggtcacgtccacatgggtctaggccgtatcctggcaggaattgggcctcccaagcaaaggcagaaaggaactctcccagaaaaaaaaggaaaacgactaacgtagtacttgtctcaaagaaagaaacttaaatacaactagtgagtaatagtgtattaataacatttgtaaattaaagtataatattcagagaaatcaggcttatgattttggctgaaattagtgggtattagctttaacattgtactataatctaaaatttctctcttcttttcttg

SEQ ID NO: 22576 - DNA, 477 bp, Sorghum bicolor
  Clone ID: 14366576
gcacgaggggttgggaacaagctgaagctgaagttgcttccctgaagcaactacttgaaactgcatcccagaaaaatacctctctggagggtcaggtcagccacctagatgatgcccttaaagaatgtgtaaggcagcttcgccaagcacgcgaagaacaagagaagaaaatccgtgacatagttgctaagaagtctaaagaattggagtctgagaagtctgagctccagcaccacattgctgaactcagtaagcagttggaagccacaaaactagaagctactactgtgcgtgtccagcgcgatctgcaggagaagcttcagatagtggagaaagaaaacaaagacctcaaggttgaattacttgcactgtccaaggacctgaagatacttgcacgggaacgagacctaagcaaccaagcagcagaaacagcaagcaaacttcatctagaaagtgtgaaaaagataacaaggagtt

SEQ ID NO: 22577 - DNA, 496 bp, Sorghum bicolor
  Clone ID: 14366579
gcacgaggggaagcattactcacttccaccaaaggaacatcatctttgaaacctgctgtttgcactagcagtaatttaggtgctgaaaacattaacgattccttcagttgttccctttctcctggaaaaactggcaagatgcccactaaagatggttcagctgaccaatttctgggtacatctggtgatgctaatttggttggtgccatcatgtcttctcaagatattgatacaactcctagcaattctctctcaaatgaaatgttggatagcaaggttgagataaatgaacagaacgatgatctcagtacagaaaaggtggcatttgttgcgatcacagaaccattggatgttccctcacgcactgatacaattgaggaatctattgatgatgcaagttgcgtgaatagacaaagcaatggtcctaatctagatacaatgaactgtggacctttggatcctcctaagcctcctacattgtttgaacctgttgata

SEQ ID NO: 22578 - DNA, 628 bp, Sorghum bicolor
  Clone ID: 14366588
gcacgaggctgatttatccaggagggctgaagcattggagaaaaagcagaaagggtcagatcaagatatactatttttgagggaagttgttaaagattcaggaagaaaagtacagcagctggaatatcttgtagatgagttacaattccgatttgactcttcattgcctcttcttggaagcacgcgcaagccatcgatattcctgataggtggttacaatggcgtgacctggttaccatctcttgattccttttctcctgagaaagacacactgatgggtcttgcaccaatgagtgtcgcccgctcatatgcatctgctgctgcattggatggtcacatatttgctttcggtggtggaggtggcaactcatcatggtataacacagtggaatgctatagttcaaggaataacgagtggatagaatgcccctcattgaaccaaaagaaaggaagtcttgctggtatcagtcttaatagcaaaatatatgctattggtggaggagatggaaatgaaactttttcagaagttgagatgtttgatccatatctcgggaaatggatatgtggtccatctatgctgatttctcgatttgctcttgccgtagctgaattgaatggcaccatctac

SEQ ID NO: 22579 - DNA, 626 bp, Sorghum bicolor
  Clone ID: 14366592
gcacgaggagaaagcgggggcgagcaacagcaggccaggcaggcgcaagaaacttccccccacctccaccacctccttctcctcctcgccttccgcctttatttcttgtctccttcctcggtcctatctcctctcctgctccgccttttcctcatcggttcctcctcccctatcctctcgtcctcgctccctgcgctccgtttcttgggtgcttgaggtgaggtgatcccggccatggcggccatcaagaagaccaaggtcgtcttggcgcagccggcggtgggggctccggcgtcgcggccgcccttcttttctcgcgcgccgggcccggtccgaggcgccggcgacgaggcggcgtacagggccagcctcaggtaccgcgccctcctccaggactaccaggagctcatcaaggaaacccaagcaaagaagaagaggctgcacatggagaggctcaggaagcagaggcttttggctgaagtcaaattcttgcggaagagatacaaatccatgtctgaaaacccatctcagacaattgtttgtagactgaggaatccagcaatgtcgtctgcatcctggacagcagcttcggcaggtgatgcccagcaccagtcagttcatgggcg

SEQ ID NO: 22580 - DNA, 605 bp, Sorghum bicolor
  Clone ID: 14366593
gcacgagggctgcccgtccccagccgtcgcccgctccgcccacgctttcctcgagaagctcggtctcagggaccacgaccacaccgtccactccctcatcactatgtactcctgcctcggtgatcacctcaccgctcgcagggtgttcgacggaattccccaccgggatgtcgtctcttggaactctataatgaaagcatacgagcgggcagcttgcagggacgctggcaatttggtgcttgggaagtgggtggaggagtgggtgaggtctgccgggatggaggtggactcgctcattgggtcagcacttgtggggatgtatgagaagtgtggagagatggaagaggcacggcgtgtgtttgatggcatcagcaacaaggatgttgtggcatggaatgccatgatcactgggtatgcgcaaaatggcatgtcaaatgaagcaatagccttgtttcacagcatgagggaagctgggctgcgtccggacaagataaccttggtcggtgtcctctcatcctgcgctgcagttggtgcactggagcttggagttgaactggatgggtatgccttgcacagaagcctctacagcaatgtctatgtgggaa

SEQ ID NO: 22581 - DNA, 448 bp, Sorghum bicolor
  Clone ID: 14366601
ccgcggcctcggcgcgcttcaccccggcggtgtcccgcctcgccgcgcgcctgcggctctccccgtccatggccgccgtcacgctgctcgcgctcggcaacggcgcgcccgacgcgttcgcctccgccgccgcgctcggcgggccacgagggatgcccagggccgggctcgccgccatcctctccgcgggcgccttcgtctccgccttcgtcgtcggggctgttgcgctcatcgccgcgcccttcgctgtcccgccggcgtcgttcgcgcgtgacgtcttcttctacctcgtcgctgcgtcggggctgttctatgtctacctcagcgctgagatcttcctctggcaggctgttgggctcgtgctcttctatgctttcttcgtggggctagtgttctacatggatttgggtagcgcgggagggaaagcggtcagcgccgcggcagctga

SEQ ID NO: 22582 - DNA, 619 bp, Sorghum bicolor
  unsure (1)..(619): unsure at all n locations
  Clone ID: 14366603
gcacgaggcttcagcagcgagtgagaactcccacttccattgcctgcttgcttctgcttccctgcatctgcgagcgttccggcggcggcggccgccggcccggccgactcagcggcgaccgcgaccatgaagggcgtcgacgatgcgttcctcggcgtcggcgacaagccagggctggacatttggtgcattgttgggagcagtctggtcccggttgcaaaaccccagcacggcaagttctacaccggcagcacctacatcatactgaatacaaccgagctgaaatccggggctcgtcgacacaatgtgcattactgggttggggaggaggccaaagaggacgattgcctcatggcctcagacaaggctgttgagttggacgcggcactgggctccagcacggtccagtacagggaaacacagggtgaagaatctgacaagttcttgtcatacttcaaaccgtgtgtcatcccagtacaaggctgcttcttttcacacctganaggatctggtgatagatccaacgcgaccacgatgtttagatgccaaggagagcacattgctcgcgtcacacaaattccatttacgcggtcctctctggatcacaaatcggttttta

SEQ ID NO: 22583 - DNA, 416 bp, Sorghum bicolor
  Clone ID: 14366618
gcacgagggcgctcaccgatcccatttcacccacgccgccgtcgcctccaaccagggttccgctccttccgccggcgggtgtgatccatggagaacgagaacggcagcgtcgggcggccggaggatcgggcgggcgagaacggcggagtcgccgaggaggaggaatccgccgtgaaggcagccactgcggcggatgagggcgattgtgatgtggtggtggagggcgtggatgagggggacgtgccgcccggcgcggtggcggcgcaggatggtggcggggatgaggttggggaagaaaaccgggcctcgggagaaggtgcgttggagtctgcgggggtgtctggtgatcaccagccagtggtgacgccgaacaccagagtggtgctggaaaccggacagcttgcggcagataagtg

SEQ ID NO: 22584 - DNA, 472 bp, Sorghum bicolor
  Clone ID: 14366627
gcacgaggggatcttggtgcttcccaagctagttagcaagcagcagccgtgctagctggtgttactgctacgttcttgcagaggccgccgccggccggccggctcctcgctcatccaccgacgatggggctccgcgactcctccgtgctgctggccgctctgtccctcgcgctcgcctactgctccgtttcagtggtggcctacgatcccctggaccctcggggcaacatcacgataaagtgggacgtgatctcatggacgcccgacgggtacgtggcgatggtgacgatgagcaactaccagatgtaccggcacatcatgtccccgggctggacggtgggctggtcgtgggcgaagaaggaggtgatctggtccatcgtcggcgcgcaggccacggagcagggcgactgctccaagttcaaaggcggcatccctcactgctgcaagcgcacccccgccgtggtcgacctcc

SEQ ID NO: 22585 - DNA, 445 bp, Sorghum bicolor
  Clone ID: 14366628
gcacgaggcctcgccgccctcgcccgcgccgccggctggactgtgcaacccgacggcaccaccttccgctcctccaaccaaccactcttgccgccgcctcctccccagctgcatggagtgtttcaggttgcatctgtggaaaccccagctttgatcaatactctgagcagttatgtcattggaacaccattagattctcaggcatctgccctacaaacagatgacagtctgtcaccatcatcactggactcagttgtggcagaccgaagcataaagactgagaactatgggaattccagttcagtcagttctctcaactgtatggacaatgatcagttaatgagatcagcagtattattccccggtgattacaccaaaactccatatataccagtttatgcttctctgcctatgggcattattaatagtcactgccaattagttg

SEQ ID NO: 22586 - DNA, 545 bp, Sorghum bicolor
  Clone ID: 14366641
gccgatacagcacacacagccgcgcgccgacgacatggggatgggagctgtggctgcgacgacccgggaggatgaggaggcgaagaagatggaggccggcgaggacaccgtcggccagaagctcgacgccggcgcgctcttcgtgctccagtccaaaggttcgtggctgcactgcgggtaccacctgacgacgtcgatcgtggccccggcgctgctgagcctgccgttcgcgttcgcgtcgctggggtgggcggcggggatcatctgcctcgtcatcggcgcggtcgtcaccttctactcgtacaacctcatctccctcgtcctggagcaccacgcgcggcagggccgccgacagctccgcttcagggacatggccacggacatactaggtcctggatggggaaaatactacattgggccgatccagttcatggtgtgtttcggagcagtcatcgggtgcactctcctggccggacagagcatgaaggcaatctacctgcttgccaccccggcggcacgatcaagctgtacgtgttcgtggccat

SEQ ID NO: 22587 - DNA, 526 bp, Sorghum bicolor
  Clone ID: 14366660
gcacgaggcgaagtctgtgccctctttgccgcagcttcatctgctctgccccactccaccaaggagctcgggcaccggctgccactgcacggtcctgcgccggcgaccgtttgacgccgcccgcttcagcggtagtagcagcgtgctacttcacttgactgggcgctgagggtgcagaagctggagccgccgtcgatggcggccgtggagtagcaccccaaagctgtcgcctttcttgccgtcctgccagcgcttccagctcggtttctccatgatcctccgcagcgcactaagggccggtcgcggcctcaggcgggttcccctggttcatctcattgtggagcacggtgagccgtcccgagcaccaccccggtgtgctactgatacccgggatgttgaagaaccatcagctgtgttgaattggtggggggtcagtccaattggtcatcggtatcagttgcgggcttactcggctgcagctgcacacgttaggggtgagaaaccgttggattgtgctaatgaggtg

SEQ ID NO: 22588 - DNA, 565 bp, Sorghum bicolor
  Clone ID: 14366664
gcacgagggttgcctagtggtccatcagcagacccacttatgcttaattcatgtaaaactatggagggtcgatgccagtttagctctgaagataatatttcatctggtcggtgtcagctagtaaaggaggatttgatcaatgcaacggttgatgcgagtgacatctctgagtcatttgatagttgcccatattatctaagtgagcataccaaatgtgctctcatgtcatcagcatatgtacatttacactgcaagaactacttcaagtttacaaaagatatatcttctcttagtcaacgagtgctgctatctggcccaacaggaactgatatctatcaagaatatctggtgaaggcacttgcaaagtattttggtgctagattgctcactgtagattcttccatgctgtttggtgggcaaacttccaaggagtcagagtcctacaaaaagggtgatagagtgaggtatattggttcattacagtcgacaggcattatccttgatggacagagccctccagattttggttcacagggtgaaatatttcttccttttgaagaaaata

SEQ ID NO: 22589 - DNA, 471 bp, Sorghum bicolor
  Clone ID: 14366671
ggcccgaggctcctttccgtgcgccatggcctcctgctagctcccctcgcaacgcctcccagatcccggacgcagcgcgccaccccccgcgacggccggcgcgcgacatgggagggtgccacgcgaagccgctcacacacgacgcggacggctcgccgccgcacgcggcgccggcgaccccgccaccgggcaacgccacgcccgccacccccgccaccgggaagaaacactgggcggtgtccccgttcttcccgttctccacaccgagcccgagccccgcgcaccacctcttcggcggcaccgcggcgtcgccgcgcaagtcccccgctcccgcgggctccgcgcccaccaccccggccaggcggctcctcaggctgcccttcccgccgccctcgcccgccaagcacatcagggcggcgctcgcgaggcggcacggcccgtcgcggccgtccatccccgaggaaggcggcg

SEQ ID NO: 22590 - DNA, 448 bp, Sorghum bicolor
  Clone ID: 14366681
gcacgagggctgagtctgctcttgctcccgttgaagttctcgaagcaggaccgggcaagcagggacagggagtagaagttattggagttgcgcaagtgcttcccttggaaacagaagctgttgaagtgaaacagcagcatctggttgccgaagttgctccttctgaagatgttcttgacgtgggattggtggacaggagtgtacaagctatcgaagtgacgcctgatgaattggattctgagactgctcttgaagagattcttgatgtcgtattggagaagaaggaagaacaagtagttgaagtgaaggagcatgaattgcctgcaggggctgctccacaaccaccagttcttgatgtgccatcggcaaagaaggaagagcttagacatcatcagcccattgaagaagctgctgaggtacatgaggaagtgcagtgcaaggaggaagc

SEQ ID NO: 22591 - DNA, 485 bp, Sorghum bicolor
  Clone ID: 14366682
gcacgagggcgttcccgtggcggttccgcgctactcctcgtcaccacggccgcggtgctggagctcgccgcgctaccaatctgcccgcgcccggcagccaaggagttggagtgctcgcctccgagaggaggccagatgatggggacactactactgtgatgaagaatgcagaggcgcctagcacttcaacggccactgcaaattccttgcgctttcccacacagggaaacttcaacgtggctgccattgttagcatagcattctgctttctacacagaattatttctggtcggatgcagtcgctgatgaatttgttcccgtcgatgtcaagtggcattacaagtttgccatttgcttgcatatctgatcctaccaaaagacccatgcctcttaagctagatttgactcttccaccactgcctaatttcggatggagtttttcgcgattgtactatctgttcaactctcagcttgatcgggacatt

SEQ ID NO: 22592 - DNA, 501 bp, Sorghum bicolor
  Clone ID: 14366693
gcacgaggaccaccgtggccggcatcctcgagtacgaggaccccacgtcccctcccccgcacgcggccttcaacaagaacctcccggcgctgaagccgacgctgccgcagatcaacgacacgagcttcgtcgccaactacacggccaagctccgcagcctcgccaccgcggagtaccccgccgccgtgccgcaggaggtggaccggcggttcttcttcacggtcgggctgggcacgcacccgtgcgccgtgaacgggacgtgccagggccccaccaacagcagccggttcgcggcgtccgtgaacaacgtctccttcgtgctcccgacgacggcgctgctgcagtcgcacttcgccggaaagtccaagggggtgtactcgtccaacttccccgccgcgccgctcgtcccgttcaactacacggggacgccgcccaacaacaccaacgtggccaacggcaccaagctggtggtgctgccgtacggcgccagcgtggagctgg

SEQ ID NO: 22593 - DNA, 492 bp, Sorghum bicolor
  Clone ID: 14366704
gcacgagggacaggtagcaagaaaaattccatgtctcgaaaatcactgttgggtgatttttcaagaactgaacaagcatctaattgccagcctaatggacaagcacagcgtgtcaaatctgctttgtcacctgctcatcttcaagcggttcttagattggattccaagaatggtgtacaggtttttgaattctgtgttgagggcccagaagaatccatttctgccaggaattggaaaactggagatgagttgaactctatatacaccttccatagtggtgggaaacgatccagtgctgctggaaggatctccaaagatggaggcttgaatttaccgccaattgtaggccaggtgcaggtttcatcttatttatgctctgaagttggaaaagatggtacggtgaataactctgtcgtcactgagtttgtttcatacgatattgctcatgcaaggcggattgttgaggaaaagactcaatgtacagagacccct

SEQ ID NO: 22594 - DNA, 435 bp, Sorghum bicolor
  Clone ID: 14366711
gcacgaggctttgttaatgatgttgaagttggtgacatgctccttgtagacggaggaatgatgtcattcttggtcaaatcaaaaactgaagattctgtgaaatgtgaagttattgatggtggtgaattgaaatctaggcgccatctgaatgttcgtggaaagagtgcaaccttgccatcaataactgacaaggattgggacgacattaagtttggtgtggataatcaagttgattactatgctgtttcttttgtgaaagatgctcaagttgtccatgaactcaaggattatctaagaagttgcaatgccgacatacatgtaattgtaaaaatcgaaagtgcggactccatcccaaacctacattcaatcatcacagcatctgatggggctatggttgccaggggtgaccttggagctgaactgcccatcgacgag

SEQ ID NO: 22595 - DNA, 479 bp, Sorghum bicolor
  Clone ID: 14366713
gcacgaggctggagttgtggtcacttctctaggccacttttaaccgtctctgatgataatgaagaaaccaatgctagaagagaagagaaagaacgaattgcactagattacatcactaagtgccagcgctcctcttgcaagatgacaagccaaattgctagttgggatacaaggtttgagttgggaacaaaagcagctttattgttgccattttctccaatcgttgtcgcagctgatgaaagtgaacaaataagagtgtggaactacgatgatgcactaccagtgaactcttttcaaaaccataagttatccgacagagggctatctaaacttttgcttatcaatgagcttgatgagagcttgcttttggccgcctcaagtgatggaaatgtacgtatatggaaaaattttgctcaaaagggaggacagaaacttgtaactgctttctcatcaattcagggacacccgagctgctggac

SEQ ID NO: 22596 - DNA, 502 bp, Sorghum bicolor
  Clone ID: 14366715
gcacgaggctggtaagcgttgcagtgcagtgcaggcggtctcaactgtcgaccgcgccacctttccttgtccaagcagatcatcgcctatggctcctcggtttcccctcgtcctcgtcggggcgctcctcgccgtcgcgctcggcgcggtgccctgcgagagcgccgcggccgcgccccgcctccgcggctccgtcgcctgcctcgactgcgccgcgggacacgacctctccggtgtggtggtggcggtgaaatgcgccggcaacggcgacggcggcggcgcgggtatgcacgcggcgcagaccgacggtggcggcaacttcgacgtggccgtgccaggagcgtcagcctcttcggcctcgcagccgtgcgcggcgagggtcctcggcgccacggagcagctctgcgcgccacagcggctcacggtcgcgcgcgtcgtcccggcacgggcgcgggcgcctggctccgccgccgccgcctcgtatgtcttgggctcccgcctc

SEQ ID NO: 22597 - DNA, 480 bp, Sorghum bicolor
  Clone ID: 14366723
gcacgagggagatgtcctcgatcaaggtggatgatgtttcttcgaaaatagcaaagaatgttggatctgctgttgaggccacaaataaattgccaagttctggcagaaatgttgaatttcgttacaacaggaagaatccaaagcgaaggcggttcctggaagcctcacaggaaaagctcacaatatgttcctcactagatagcacatgtgggccagactctgcttcaacttccaattctacctatattgatgatcatcaggaaagaggaaggccaatctctggagaaaccataatgtctgttgatattgatgaaaggcttgcatctttatcaaacatggtagcagtgctttgtgaacaacaactgtttctaccattacttagagcttttgaaatgtttttgccttcctgctcgcttctttccttcatccgttctctccaggcattttctcaaatgcgtctgtccgaggcttctgcacatt

SEQ ID NO: 22598 - DNA, 522 bp, Sorghum bicolor
  Clone ID: 14366726
gcacgaggcttcctcgtcagaaagggcccacaagtagccatgttaatggaagccgaggtgaattgcattctgctgaatggggaacaaatcctggtcacatagaatcttctggctttatgccaagcactggagacagacagaacgatatatcacatcaactgtcaagttcattcatacatactccagatggaattgtggataatggctcaaaaaagtcacccatcttgtatgaatgtgaagagcaaatggaaattgattcacttctaaattcatttggtgtatcaactgattccttttcgcaaacatgtggaatgtttgagcaaagcgacaatttggttgagtttggtatgaagatcgagttagatgaaagtggttctgctgcatgctttagtaatactaccccatatatgcaaactggaccaccagagtcagctatatctgatggatcttcttatcctgaacagtatcaatctacttctcagacatgtggcttttatgcttcagcatctcagtggcaaaatg

SEQ ID NO: 22599 - DNA, 533 bp, Sorghum bicolor
  Clone ID: 14366731
gcacgaggggcaatcagtgctacattagctgctgtgaaggccaggcaggttaatggtgagatggagcagttgtcggacaaggagcagtctccagactccacatcgaccaccaaacattcaagcctcataaaaccagacagtactctttctaacaacatggcagttgcacctggggttcggttgcaccatagagccgttgtggtggctgctgaaactggaggtgccctaggtggcatggtcaggcagctatcaattgaccaatttgaaaatgaaggcagaagagtcagctatggcaccccagagaacgcaactgcagcaaggaagttactagatagacaaatgtctattaatagtgttcctaaaaaggtaattgcatctctgttgaaacctcgtggctggaagccccctgtccggaggcagttcttcttggactgcaatgaaattgcagatctgtgcgacagtgctgagagaatattttcaagcgaaccaagtgttttgcggcttagagctcctgttaagatatttggagattt

SEQ ID NO: 22600 - DNA, 134 bp, Sorghum bicolor
  Clone ID: 14366736
gtaatttaatataaccagctttcacaatataaacggctgggtctgtatatatctgagtcactggttcctgcttgtactagcaacctaatttaactatcttgagagttgccagcttttaaaaattgaaggtatac

SEQ ID NO: 22601 - DNA, 447 bp, Sorghum bicolor
  Clone ID: 14366741
gcacgaggcccacctctcgatccaggtccagggacgcccctacccgccgccctccctgcacccacgccacgccacgccatgccgacgctgggcatcgcgccgctgctggacgcctacttccggcgccgcttcgccgcggcggggctcgtcgaggccaccgtcccgctggacggcggcgccaccacggtccactgctggcgcttcccgccggggccgggcgccgccgccgacggcgagggcgacgcgcgccccgtcctggtgctcctgcacggcttcggccccccggcgacgtggcagtggcggcgccaggtgggcccgctctcgcgccgggtccgactcatcgtgccagacctcctcttcttcggcggctcgtccaccacgtcgtcggtcgcgcccggcgccgggcgggtctccgaggcgcagcaggcggaggcggtggcgaagctc

SEQ ID NO: 22602 - DNA, 397 bp, Sorghum bicolor
  Clone ID: 14366745
gcacgaggcctaagccagctcggaagcaagcacgagcaggcagagatgccaaccgcaatgctctgtcatctctgctcatgagcaaatcgtgggagcaggagaagccccatcgaggtcaaggtcgcccatggatggagatcatatgaggcaagccaccgccgccgccgccgccgtggtcaccgtcacacaggcggcgcgcgcgcaggacagccccgcgcggcgcctgatcgcctggctgcggcttctcttccgggcgttcgtccataggtacgccaagctcgcgagctgggacgcggcggggcgccccgtgttcgtcatcctcgccgtcttcttcctccacaggagcctccgccgccggtacctgtcatggaaggagtcgtcggggctgcggctgatg

SEQ ID NO: 22603 - DNA, 322 bp, Sorghum bicolor
  Clone ID: 14366746
gcacgaggctcatcggcagctcgcttgttattggggcttgcatcgccatttcgtcatcagcttgataatggaggaactctcactcgtttggaaaatcattgattggttcgatgattgggcgcttcggctggcgactcttgccagcttgttcttgacatcaatcctcatgctctccgccgagactcgccggcacaacaagtatccctttgctatgttgttgctgtgggcggtgtaccaggtccaaccaaaagtcacggagtacgccctcacccatctcagcatcaacagcagcacctgctgcacgtcgacctcagcacacgag

SEQ ID NO: 22604 - DNA, 455 bp, Sorghum bicolor
  Clone ID: 14366747
gcacgaggatcatctctagctcgtcttgttcgtcctccttggaaggaagcagcaatttgttgctcacctccacacggcctgcttattatttttagcaaaaagcaggcacaggcaggagaagagaggagagggggcgacgagggcaacgcatcaaatcgatagatcaatcactgctgctcctgctcgtcgtggtcagccgccagcgacgaacgaacgagcaaaaggccggctgatttgctctctctctctctctctctctctctctctctctgctctgctagtggcgccgaatcaatcaatcaatttcaatcacaaagttaagttggaattttgattgctccatatataaactcaattcgtcgtccacacgacattaattggatcggaatcggaatcggaccacccaccatcagaaagcaaagcagaggaaggcagtccattcaagattggaaggc

SEQ ID NO: 22605 - DNA, 491 bp, Sorghum bicolor
  Clone ID: 14366748
gcacgaggcacttgcgcactggagcaggctcgggtgctgagggagctgctgttcggtgtggcggcgagccatggcttggtcggaggccacatggatgcagccaccggggagattcgatttgttctatccgagagcggagggacggactcggtggaagggtctgtggttacatgggaggatgagccggggaggttgttgtgggagaagggatgcctcctgcgctgccaactgcccctgaagcttccactctatcttaggcctgatgtgaattctggcatcgaagaacggttttcttcacttattgaatctacaattgctaaactcagagatcctcatgtatcgtatttagttgaggggccaattacatctagtgaatcacatcattctattatcttgcgtggtgatgatttaagctttgattcacatacacatggaaactcaagaaagaacaattgtaccacaagtattgtatcttgttcagaattcttcac

SEQ ID NO: 22606 - DNA, 500 bp, Sorghum bicolor
  Clone ID: 14366755
gcacgagggtagtattagctagcttggtactaattatgtagtcgtacgtgtgattagtcgatggatcttttaagtatcttggccacaaatgagaaactgtgacaggagaagatgatggaagcatcgaagattttgcaggagaccgagctgttgagttccaagcacaaggagacaggaaggcacaagaacgttcccatcaatggcatccgacggcaagacaacaagagctgagagatctcctcgtaaccatcgccgccgaggcttggccgcttgcgatcccggcctctcaaatctaccgaccataacgccatgccgccgcggggcctctacctctagtagcttagatccaccgccaccgccgccgacacaccatgtcgctgtcgtggctgacgagcagcaacgcgtacaagtcgccggcgttcatcgcgctggtgagcgcgctgtgcgtggccgtggtgctgctgctgcaccaatgcgtcctcgtcaactgctgccacggg

SEQ ID NO: 22607 - DNA, 482 bp, Sorghum bicolor
  Clone ID: 14366756
gcacgaggatgctgttctctcaattatgcctgagaattccatccacaaatgcgatgcatgttaggggccttcagtcccttggtcaactttttggttatacatccaagaacattgatagtcacttggaaacccttgcatctcaccaaagtgttggaaacaagaatctttgccggagtgagacattgcaagacattggcatggatcaatctggccaatccacttctttctgtgaagcatcaatggcagcactacttctgagagggcttgctatagctcccatgcagcttgtagcccgtgtaccaacttctttgtttttctggccattgatacagcttgaaggggcagccagtgatgacattgcattgggtattgctgttggtagcacaggaagaggcaaccttcctggtgctacatcagatatccgagcagcacttcttttacttttgattggtaaatgcacagctgatcaggaggcactgaag

SEQ ID NO: 22608 - DNA, 632 bp, Sorghum bicolor
  Clone ID: 14366767
gcacgaggcctcttcatccctcccaatcgctccgccgaaacctcaccagcgaccagtccccaccaccatggatggctccgcctccccctccgccgccgcggtcgagactgatacgcagggaggagaagctccgtccaaagccaagcgaggcaacgccgaggagaaatatcaacatggacagccggtttactttccagaggaactagtggacaattgggtttctttttctcgtcatggcttgtattattgctacagcatcaacatctcgttgcaagggtcttgcaacacagctgctgatccgaccaacataattttagctgtcaaatgtgacatgggacctgactttttttggcactcttttaactcgggtggtattggaattaccattaagtacttgtgcaagatccatctgaatcaagaacaggtaatttttgctagaagattccagacaacggttctttctttgctcattaacagtgaccatttggaggtcagtgatgccataaaatacttccatgaactgcaagtagatgtgggggttgtctatctacttctgcccacagtgtatggcaaaatcgattggtgcggtatcaagttctcaacttcatcagtatatgatgatgtgactgata

SEQ ID NO: 22609 - DNA, 638 bp, Sorghum bicolor
  Clone ID: 14366782
caaaccgcataacgatggttggagtactctttgcctgcagccatgctggtctagtggaagatggctggtactactttaggtccatgaagaagctctttggcattcaacctgagagagaacaccacaactgcatggttgatctccttggtcgagccgggaagctcgatgaggctgtggaattcatccgtgatatgaaccttgagccagatgcagtcatttggagaactctcctaggtgcttgcaggatgcataaaagtggcaatctcgcagcatatgcagccagagaaatacttaaactggagcctgacgaccaaggtgctcgtgtactgttgtcaaacacatatgcggatctgaggcaatggacagatgctgagaagtcatggaaagcgatgagggaccgaggtatgaagaaagaaccagggcgaagctggattgagctggaaaaacatgtccatgtgttcattgctggggacttatcacacccatgctctgacaccatagttcaggagctgaaccggttgatcggaaggatcagcgctcttggttatgttccacagacagaatttgtgctgcaggacctcgcaatcgagcagaaggaagatctgctgaaatatcacagtgagaagatggcaatcgca

SEQ ID NO: 22610 - DNA, 518 bp, Sorghum bicolor
  unsure (1)..(518): unsure at all n locations
  Clone ID: 14366802
gcacgaggggactcttcatctgcttatgataaaactgataagctggcattcatagctcagtttcttgggagatacacatacagaggcttcagtctcggcttgcagaatccctcagccaccgtcgttagctcggctcgcagaatccctcgccaccgtcgttttgcatcgcagaacttggtcacttccaggtgcattttcctgtgctgcaaaaggtgctgaataaaccggctgaacaagccagtggtccttcaactacagaggcctgatctgcagattcttccattgggtactgtttcatatttggccactttatatggtaataaaagctgagggcgggcagaatactttgacatggaacattctagtgtaaattctaatggcaatgtgttgccgtatcacaaggagaacaaaccaagtgtgtatcttgctgagaagttcacaataatagcttcaaatggatctgtacattacgacnaggaaatgataaagcggacaatgcttgtgcatgaagctacatt

SEQ ID NO: 22611 - DNA, 574 bp, Sorghum bicolor
  unsure (1)..(574): unsure at all n locations
  Clone ID: 14366806
gcacgaggggtgaggtgactcgttctccgcttcgcttctcctctctgttcgtttggccgcaagtgagcgcagcggagcggcagcgtcgtcgtcttcctcgtcgcgatcaccggtcaaatcccaagccaatttgttactgccagggctccgattcaccaccaacaccaccctctcctcttctactgccgccgttatccccaacccggcacgcacgcgctaggcggggagcagctgaaccccaccacagccgtccgcgacggctccgacagtccgacggggcgctgaagcggcctctcaggctccttccaatggcgcggatccagcctgtggtggatgaaagaatggacccctttcttggtagattgactagaccaaccaccattgaccaatcctggtgtactgctccgagtggcctgtccttgttcaacgggccttttaacgagttcaaggatgcaattgtgccgtcgtcaggcttgttgtcccacaattgctgctctgatgtcgcaaacaacttcgaagaatttgcaactgcagtttcaaggttacatcaacacctggatgcaaatgtanaagt

SEQ ID NO: 22612 - DNA, 563 bp, Sorghum bicolor
  Clone ID: 14366809
ttcggcacgaggctctcttcccccagccccttcgttcttctccctagcgacatctcccccaatcacgccgtcgcagatcgcaccctcttccttcccccagccccttcgttcttctcccctgcgaccatctccaccgcgaccatctcccccgtgtccctggcagatcgcgcgtctctccctgcgtttgctgtaggtgcgcttccccgtcacacctcacgcctcggcacaacaaggccaggaaggccgccgcctcctttgtcgtggccttcgccaccactggcaccagcgactcgtgttgcttccacagcatcaccgtcatcctcgaagtcgcgcgcccgtgccatcaacgtcgcacacactgcgaccgccctcgcccgtggcatatgatagaagcaacgtagaggcaagacaagcaatggacgcacacaaggtgcaaaataagagttcatgagaattgatcaatctctgcatcaagagagaagagagagggttgagggccatggcaaaggcgtccccaacgttgcagtgcagtatccccttcaccgctcctctcagtctcagtt

SEQ ID NO: 22613 - DNA, 606 bp, Sorghum bicolor
  Clone ID: 14366829
cttcgggtggtccaacacctacgtcttcaccaaggccatgggggaggtggtcctgggccagcagctccgcgccggcgtcggcgccggcgccggcgacggaggccgcgacatccctgtggtggtgatgcggcccagcatcatcaccagcgtgcgggacgacccggtgcccgggtggatgcaggggacgcgcaccatcgacagcatcatcatcgggtacgccaagcagaacctgtcgtgcttcctcgccgacctggggctcgtcatggacgtcatcccgggggacatggtggtcaacgccatgatggccgccgtggtggcgcactccggcgagcgcggcgcgccgcaggtggtgtaccatgtcacctcgtcgctgcgcaacccggccacctacgacgtgctctatcagtctggacgccgccatttctacgagaacccgcgcgtcggcaaggatggcagggtcatccctaccagggagatgtacttcttcaacaccatcgctaggtttcacctctacatgatcctcacctacaagataccactagagattctgcacttggtgaatctgctgctgtgtgggcttttctcaaggctttacaatgaccctca

SEQ ID NO: 22614 - DNA, 510 bp, Sorghum bicolor
  Clone ID: 14366838
gcacgaggctcctttcctcgaagcacgggataggctcgaggcgacggttcctactgcgggcggctccctcccttcccccgacccccggccctgcggcgcgggtggcactgccggcggccgcggccgctccacccttccgcgcgatctcgtgcagatggtcggcgcttctctgctcttcctcgatctgtccactctatcctctctctctgctccgcgtatgcgggcgccggcggcggccacgggccactccactcctccgcgcgagcttgtgcagatggtcggcgcggctttgctctccatcgatctgtccgctctgccctctccccctgctccgcgtatgttcgtgtgctacaggtaaccctacctgcttgggctacaaggtcacgaccgcccggcaccgcccccacccacggcaacggtgtcctactcccagtgaggcgctcgccggtgatagtagcggcgcccaccaggccgctgtccctccggtgactgcgtggacgacaagcagga

SEQ ID NO: 22615 - DNA, 365 bp, Sorghum bicolor
  Clone ID: 14366851
gcacgagggttgttcatcgcattgaggggaggggtggtgctactgctttccagtacctgcctacctgcacttccatctgctgcttgcctcccggctgctgacggctggcctgcgaatccacctgcatttgctgaggctcagcgccgcgtgtactcctcctcctctgtgaggggattcaggaaatgctcggagttccattccgcggctgaaacttctggaagggtttaagagagtagggagaacttggcctcagcggtagagaaggatatggcagccactgaagcggccatggacacaggcagttcaaggaggtcacaagatgacaccgcaacattaatcccccacagtggcaatttgggagaatc

SEQ ID NO: 22616 - DNA, 569 bp, Sorghum bicolor
  Clone ID: 14366854
gcacgagggcccgcttcggcacggtagaagcactttctccctcgagaaatgcagtgaataatagccagggcagttcacctaagatatctgttcatcttttcctccattctagcgggatgatcgctgcaagattcccatacaaccagttacttgttgatgcatttcggaggacaccaaaagccagttggaatgctaaagaaagggtatggatgtttcctccctcgtctttagcaatagtagaggattttcctcgttcagtatctggattagctgtggaggttcacaagttggatcccctagttcagcgtgctttagatgctgctttacgatccaaagatcttcgaggtttgtatgacagaatcccccctaatctggagtcacagcttatgccatttcagcgtgaaggcatcgggtttgttttacagcatggcggcagagccctgattgcagatgaaatgggtcttggaaagacagtacaggcaattgctgttgcttcttgccttcgtgatgcctggccagtccttgtaatctctccatcttctttgcgattacattgggcaactgcgatt

SEQ ID NO: 22617 - DNA, 616 bp, Sorghum bicolor
  Clone ID: 14366859
gcacgagggacacgccgagcatacatgaacgtggtacgtcttataggcactatagttgtttgcccagcccactacttggaagctttagaggaaggagatgagctgtatttcatttgcttctcattggttatcaagctcacttttgacccaagtagagtgactctcgtgaatagccagcaggatttgatggtttgggatcttgggaacatggtaccaccctcaattgatactctcaaaatgatacctacgcttgaagactgggatcactttcaggatggaccaggagcctttgctgttacgaaatataactcgaaattcccaaccaattatatcaacacactgactatgattgagaggattagggcaaatactcagaatcccacgggttgttattccatgatgggctcccaacatacgatcaccacaggattgcgatatcaaatgttctctcttgatggattctgcggtgggttaatcctgagagccagcacaaacatggtgagaaaggtcgtcgggatccacgttgctggaaggcagaatcacgctatgggatatgcggagtgccttattgccgaagatctacgggctgcagtggcgagattggcgctagatccta

SEQ ID NO: 22618 - DNA, 549 bp, Sorghum bicolor
  Clone ID: 14366862
gcacgaggctacgccgtccttggcctcgactccgccgtgccggcctcccgcgagcccgacgtcgtccattcccaataccgccgcctctccttcctgctcaaccgctcccaccccgaccgtccctgctcgctcgccttcgccgacgccgcccgcctcgtcgccgacgcgtgggccttcctgtcggatcccctccgcaaagcctccctcgactccgacctcgacgctgccgccgctgcaactaacgcagctgcagccgccaaagccgctgccgccgccgcagctcgtgtgcccaccgctccccatccagagaagcagcatcagcagcagctgtcgccgccgccgccgcctgctctgcagccaccgcagactgtgtcgggcacgccaccaaagcgagggcgaccgctgcgggctgccaaaacgccggcgacgccgcctgttccgcagccaccgcagaccgtgtcggccacgccgccagctcaacaaccaccgcagaccatgtcgagcacgcagccaccaaagcgtggccggccaccgcgggctgctcaaacg

SEQ ID NO: 22619 - DNA, 579 bp, Sorghum bicolor
  Clone ID: 14366864
gcacgaggccgctcttgaacagggttttcagttggaatggaacataagccggaggtccgagcggtgcacccagtgcgagagatccaatggaagatgtgcctacagcagagatggggaattcgtagcttgcttgtgcaccaacgggcgagtgagcgaccatgaatgcaccaaaggtaagccctttcggtcttgtactaccctttctcccttttttggttgaaaccaagccttttctccttccttggtgtcaaattgttaaggggatccatttagtttgcagcttcatgaactgtaagtaggcaggtatctgctagttgtttttccttcagattttaccttgaaatcaaatctttgcttggcctggtcaaagaacttcggtcgatttctgaaaaatagaatgtgtagaaatggatctaaattaaaggatgaaaaatctgtagaactcaatcaaccatgtaccaatttcagccctgcccttaacaggaccaccagcagcagcagaaagcttgctgccaccagcttgccatattttgggccctcttcatcttcttcctcctggtcctgggccttccatgtcag

SEQ ID NO: 22620 - DNA, 470 bp, Sorghum bicolor
  Clone ID: 14366868
gcacgagggttgtttcgagatgcctgccaacactgatggttctgaagatttactccaaagccatgaagaaatgtttgagaatgcagatctttggtcaaactactcccatgtggacacttcagagtgccatatggagctcagcggaggagaacaaatgattgatcacacagaggctagcccttatgaattttttagcaacgatctgcagaaccaatcaagaacttccaacttggacaatgaacattttccaagggatgcatcaaaccatgctaatgttgaagaagttgctggacctccatatgaagatctctcaaatggtttgtaccttcgacagcaaactctatactctggccaaacacaattccaagtggagaacaacacagaaggcatggagacacaaatgaacacttatttctcaggtggtatatccacagagcactcagatttgatgcttggtagtactggtcagg

SEQ ID NO: 22621 - DNA, 426 bp, Sorghum bicolor
  Clone ID: 14366872
gcacgaggcaggaaacagctcttaaccatgtgaagacagctggccttcttggagatggttttggcgccacgccagagatgagcaagcgaaacctgatttgggttgtcagcaaaattcagcttcttgttgagcaatatccctcgtggggagatatggttcaagtggacacatgggtagctgctgctggaaaaaatggcatgcgtcgagactggcatgttcgtgactataactctggacgtacaatcttgagagctacaagtgtttgggtgatgatgaataagaacactagaaggctttcaaaaatgccagatgaagttagggctgagataggcccgtatttcaatggccgctcagccataacagatgagcaaagtgagaagttggctaagccagggagcacttctgatggtgatactatgagacagt

SEQ ID NO: 22622 - DNA, 511 bp, Sorghum bicolor
  Clone ID: 14366883
gcacgaggtgattttggtccgagtccccaaaataccataagaagaaaactatcaaacaagtacgagtggtccatcctagatgcaccagaaacagaaggttggaatgcagaatattgcagtgaagagcatggtccgacaaattgtattactggagcaaagaatatagttacagacactgaatcaaatgacttgagcaataccccaccttccaggaggcgtaaagtagaagataagcagcactacctaaatgttaacagctaccagcagagtgatgaaactgaatcatacaacttcctatcaaggaccattgatcttaacttccacatgcgggtgatgcatgcagatagatcgcttttccttatagcagacaatggattgacttttgaatatttaaacagcaatggtatttggttgtggttaagacatgaacatgttacagccatgaaaggaacactaggaagctacaatggcagtttgtatcttgtcgacgtgcatgggaacttacacatta

SEQ ID NO: 22623 - DNA, 565 bp, Sorghum bicolor
  Clone ID: 14366886
gcacgaggccgacaagcaggacaagccagcaccaagtgttctcagctccagtccggctgttacatcaacgcctcaactgtcgtttcctgccttttcgaccccatcctatcagccttcaccactaggcatcactcctcctcagcctgctactacttcacctcccaaaccaacaatccagacaccacaaccgccaactcttccgccagtccctccagctccaccacaaccgcctcgtgatctcatcggagacttcacgaagtggtacgtgcttggcgatgaaggcatgcttggagacttccaagcctttatgctggacaacatcctgcagggcgtataccggaagtttgttaaggacaaagaaaggaaacgacagaaggaagaagaagaacaggcacttgccaaagcaaccgagttccgcagatacaccctttcagtcagatacttctaccgctggagggacacggcacgcgagctacgacttagccagcttcgtcgaagcggtcgagagcaaatgagagtgtactacgaagctcagcgagcagcacaagtcaaggctcaaaaggct

SEQ ID NO: 22624 - DNA, 504 bp, Sorghum bicolor
  Clone ID: 14366887
tcaacatggttttcatcctggcattgtgcctactgtctcaaatagttgtggcccttcagcctctcccaccgatcgcatcggcaaatgatagtagcaacaacggcctcggcttttcggtcagcaaacacggaacaaagatatacattgagcacgcctttgctgagaaaaaagacttcgaaggccttactctgattccacctaatgctggagaatttgccgaaacattccgtgcggatttatcaacgttactaggcacacaatggacattggaacgcgtcgaccaacttccctctaccggggttgtccttggaccgttccggggcaatgcagaccatttaacttatgaaaacggcatcgcaacggaagaaggatacgaacttgatgttaccaacggcagcgtctacattggcgggactggtgcgcggggcatgtattggggtactcggactgtattgcaggaactgctgattaacaatggatctttaccatatggaagcattggtg

SEQ ID NO: 22625 - DNA, 518 bp, Sorghum bicolor
  Clone ID: 14366891
gcacgagggtggcatcttcctcccgggatcccggttcctccctccctatctccctcgatccagctcagctcagctctcttcctcccgcccccccgtacgaccttactcttcttgatccgttcattcatacatacttgttgagaggaagaggatcggtctgctgctactagctgcggatagttgtggttctagtagcaggtaaaagaaggcaagggaagggaagggaatccatgaagaaatggggcaacagcgggcaagccgccgattccttctaccaggtccgccccgattgcagccaaaacgtccccaacaccaagttcaagatcaaggcggggaagacactgagcgttcggaaatggcatgctgccttcacgcgtgacggatgcctggatatcgcctctgttctcagccgcatacagagagggggtgtgcaccccgcaatcaggggagaggtttgggagttcttgctcggctgctttgaccctggcagcaccttcgatgagagggaccagattagg

SEQ ID NO: 22626 - DNA, 548 bp, Sorghum bicolor
  unsure (1)..(548): unsure at all n locations
  Clone ID: 14366894
gcacgaggctggcatctgggtttagttttggatcagcaaagactatgcctgaagcagcaggagctgttgcagctgcagctgtagctgatcgattgcatgggtcaaaggaggaccggaagctggccattgttttggttggcctaccagctcgtggtaaaaccttcactgcggttaagcttacaaggtaccttcgttggttgggtcatgaaactagacatttcaatgttgggaagtatcgccgtctgaagcatggagcaaatcagcctgcagactttttccgtgatgataaccctgaaggtattgaggcacgtaatgaggtggctgctttagcgatggaggacatgatagattggatgaatggtggaggtcaggttggtatatttgacgcaacaaacagcacaagaaagcgaagatatatgctaatgaaaatggctgaaggtaactgtaagattatatttctggagacaatatgtaatgatccaaatataatcgaaagaaatatacggctgaagatccaacanagtccagactatgctgatcagccagat

SEQ ID NO: 22627 - DNA, 614 bp, Sorghum bicolor
  Clone ID: 14366897
gcacgaggccgtttcgacctctggacatgctcgtactcctagcaaccccaagcttttgatctctgcaaagcaaaggagaaacccgatcatggaagcctctatacagactctcaaggcccaggaagtccccatcctcgaacgtggacagcccgaatatgacaaggctatagccacgtccaacctcttgttccgcttttcacgaccggaatttgtggctcgtcctgagactcctgcccacgtccaagctgtcatcagagaagcgaaggcaaagaagctcaaggtcacgatcaagtgcaatggccactcgtatgcgggccattccactgcccaggaaggtatctccttggaccttcggagcatgaagaaggtagcccttgacatgaacacgaagactgtcactttcgacgccggctgtcagtggggccatgtctacgggacccttatcgacggcggacacgatggcttcatcgttaatggcggccgatgtccgaccgttggtgtaggcggcttcatcctcgggagcggacttagcccattcactcggtccttcggaatggggtccgatactcttgtcgaggcaacactggtgacggccgacggtgacctcgtgacgg

SEQ ID NO: 22628 - DNA, 416 bp, Sorghum bicolor
  Clone ID: 14366899
gcacgagggtgcgaaccgcatagttaactacatactacgtaccaagtaacggcgtccatccgcaactgcccgctacaaggcagcaaccacaacccacccttcacccctcccgtccctgccagcacctttacaatggcgacacggaatgtaaatgtcagcaagcaggagagtgatctccaaatcaacatccgcaaagccacgagcatcgaggagacggcgccgaaacggaaacatgtccgcgccgccatcgtctacacatgggatcacaagagctctgcctccttctggcagggcatgaaggtccagccaattatggccgacgagatccagactttcaaggccctcatcacagtgcacaaagtcctccaggagggccaccccacagttataaaagaggcgcaaaacaacataaattg

SEQ ID NO: 22629 - DNA, 536 bp, Sorghum bicolor
  Clone ID: 14366903
gcacgaggaataggtatgccacactgctgagtcaattcaataattccatcaaaaagggatctactaaggaggtttttctggcatctcatgccattgggttattggctattacactcggtgctgggagcagttcacgtgaaataatggaggagtcgcatccccaactctgtaggatacttcaagcttggtctgatgcatcaaagatgatatctgcacttgattgtttggctatcatcacatttgttggcgcaactgatctggctgaaacagagttatctttgaaagccatgtgggatgtgattcatccaaagtctggttcaaatgtgggaactgttcggaaacctaagcctcctgtgttagcagctgctctatctgcatggacatttctcctgactactattggttcatggagaataaatactgatagctggaaagagcccattgcatttctctccactcttttggaagcagatgatcgtgctgttcgaatggctgctggtgaagcattggctttgtgctttgagttaaatctgctt

SEQ ID NO: 22630 - DNA, 562 bp, Sorghum bicolor
  Clone ID: 14366908
cccgacggaaacggcaactacgaattcagcgctgctcgacagggaacaatcactggtcttctctctattggatgtttgattggtgctctgattgccggtaacctttgcgacaccatcggtcgtcgcatgaccatctctgcttccgccttctggacctgtgtcggtactgtcatcgaagtcgcttctcaacacgcttggtaccaacatgctatcggtcgtctcgtcactggtgtcggtatcggatctctgtccgtcgctgtccccatgtaccagtccgagtctgctcctgccatcatccgaggtatcatcgtttcttgctaccagctcatggtcaccctcggtatttggtgcgctgagatggtcaactggggtaccaaccactacgacggcagcgcctcttggagaattcccaacggcctcaacttcctctgggcccttcttctcggtgttggcattctcttcctccccgagtctcctcgattcgcctaccgaaagggtaaggaggatgaagctcgcaacaacatcgctcgccttgctggtctcgagcccaactcccccagtg

SEQ ID NO: 22631 - DNA, 512 bp, Sorghum bicolor
  Clone ID: 14366910
gcacgaggatgaattctctattgatcgtccttgtggccttatgccttcattgcatcaatgcagcaacctatcgtgttgtcgttggttggcagacagctaacgacgcaatgggaccacaatggtactcattatggttctatccaccttcattgacgattgcatatggtgattcagtcacttgggtctcaccaacattggaattgcataatgtggtatttacaaatggtactcgtcaaagtgagactatgccgaatggtgtgaatctgacagcaattgcaggcgtggttggtaatacaactcactttgtgtcgtatgctgacacatattcatcaggctttcgggcaaacaatgcaccagcttacacgctcacattcatcccgaatactggatctggtaccttccaatactattgctccattcatcctggtatggacggtacaatcactgtgttgccacaaggtcaagcagctccattgacgccagcagctgtcaatcaagctgtcgacaaccag

SEQ ID NO: 22632 - DNA, 544 bp, Sorghum bicolor
  Clone ID: 14366918
gcacgaggaacaagtttcgtcagtgcggtttcgctgtgacaccgccatcatgaagctttcaaatccgggaaccgttcccgtatacacaatttcgggcgcatctagtgcccgacctctgcccgactggcttgcgcgacgcagaaagcgaagtttgaaggacgatgccgaataccagaatcgtgtcgagcttctgcaagatttcgagttcgaagaagccagtaactgtatccgagtcagtgaggatggtgactggatcatgagtacaggcacatacaagccgcagattcatgttcataacctacctcagttgtcgctgtctttcgctcgtcataccaactccctcaaccactcatttgagctcctgtcaaccgattactccaaatcccttcaccttcagaccgatcgccgcctcgaattccacactcccatgggctgccattatgaagtccgtcttcccagatatggtcgagctcttgtctacgaccggcaatctactgaggctcttgtgccagccgtgggcttggatagcgatggtaagggcgag

SEQ ID NO: 22633 - DNA, 546 bp, Sorghum bicolor
  Clone ID: 14366919
gcacgaggcaacaagcaagactaggaagagcgctctccgacacgtcctcctcctctgcctcctccttccatgtatctcccaaccactcccggctccttccccatctccaacggcggcggcgcctccggcggcgacgcttcacctctcgccgttcaacgaccgcctcgacgcggcgtacgtcgcgctgcaggcgtggaagcacgccatcatcgaggaccccaagaacctgaccgccgactggtgcgggcccttcgtgtgcaactacaccggcgtcttctgcacggcggcgctggacgacccgcacatcctcaccgtcgccggcatcgacctcaaccacggccgcatcgccggtttcctcccggaccacatcggcctcctcgccgacgtcgcgctcatccacctcaactccaaccgcttccacggcacgctgccgccgtccatgcagcacatgcgcctcctctacgagctggacatcagcaacaacctcttctccggcgggttcccgtcgttcctcacctcgctgccgtcgctcaagtacctggacct

SEQ ID NO: 22634 - DNA, 604 bp, Sorghum bicolor
  Clone ID: 14366927
gcacgaggctgtatttcttcccttctagctacacccaccaagtctcgtcaccatggcagaccacgcaaagccagacgaccacgtcgcctcggccaagctcagcgtcgagtcgcaccccgaatcccgcgccgcagccgccttcgcaatggactcgcagcaccgccaggccgtcgagaagagcatgaagcgcaagctcgacacgcgctgcgcgctcttcgtgctcatctacatcatgaactacctcgaccgcaacaacatggccgccgcgcgcctcaagggcctgcaggaggacctgaacctcagctacaaccagtacgcgacgtgcttgtccatcttgtacgtcgggtacatcctcatgcaggtgccctccaacatgttcatcaatcgcatccagcgcccgtcgctgtatatttcggcggccatgttgctctggggtctcatctcgacgctgtcgggtagtgtgcacaacttcgctggcatggtctgcattcggttcttcctcggtttcgtggaagctgcgtttttgcctggtgctcttctgattctgtcgaagtggtacacgcgacgtgaattgaccaagcgcaacgccattttgttctgcggc

SEQ ID NO: 22635 - DNA, 580 bp, Sorghum bicolor
  Clone ID: 14366929
gcacgagggttttttcgtttttgtggccggccggccgtcgcatcgaaaactcgcaaagcagaggggcgaaaaggggaaaacgccccacactcggagcagtcacaccaccaccaccaccaccaccacccttcttcctccgcccgcgacaactcaagacaagatcgaggcaccaggcaggcggcctccatctccatctccgtctccattgtgttgttgtctgtacccggagcgcaggagcgcgggcagccgaatcgacggggaggtccgcgttccgcggtccaagtcaggccaaagcttggattcctgaatctgatggcagcagtctcttcgagattgtaattcagcgagcattgttcagctgaaaccatgaaatcagacatgagttctctgaagaaatccgacaagaaagctgcgctggatttcgcggcgtggagtttcaatgtcactacatctgttggaatcatcatggtcaacaaagctttgatggctacacatgggttcagttttgcaacaacattaaccgggcttcattttgcgactaccaccttgatgaccatcgtatttcggtggttaggcctga

SEQ ID NO: 22636 - DNA, 593 bp, Sorghum bicolor
  unsure (1)..(593): unsure at all n locations
  Clone ID: 14366931
gcacgaggtacactgacatcgccaaggaggtcttcgaccgtctcctggagaagggaaacccggaggtcgtcgcggacccgccggccttcctcgaactgctctaccgccacttcgagcgcctgccgctgagctacgccatcgatgtgaacgtcgagaaggccgaggacgtgctgctgcaccggacaattctcaacgagtgcgccgaccctgaaaagcgccccatcttccatgtccgcttcttgcactgtgcctcgacctcggcggattcacatgataacacggagggcctccctacgagtgaaaacggtaattgtgggggttctcaggcttccactttgagagaatctgagcctagagaatttgagccatgcgaagggatggaggacctcagtttaactagaaaaaaagttgtggaggatgactttgaggccagttctgagaggaaaggcgtagaaatcctccatatccatgaaattattttttctaccattgacaagccaaagctcctcgctcagctatctgctntgctgtctgaagttggactgaacatncgtgaagctcatgtcttctcacaactgatggctnttgtttgg

SEQ ID NO: 22637 - DNA, 486 bp, Sorghum bicolor
  Clone ID: 14366933
gcacgaggctcctattttatatacatctcggtttctgttctctctttcacttacgtctttacacatcacatcacatcttcttcgccaacatgcagtactcgaccgccattctcgttgccgctttcgctgccaccaatgtcctggcccacggtgtcgtcaccgaggtacagggcgccaacggcatgaacctgcctggtctttcgctcattgacggtacgcctcgcgactgtgccacccctcggtgcggttctgaggccgacactgccatcatccgtgaacgcgagctcggcaccagcaaggcttcggcacttggccgcacccagggcggcggtcccattgatgccgccaagatgatggccatcttcaccgacggcgccaacgccaacagcaccgctgccaaggaggcgcgcgagatccacgaggccaacatggccgcccgcgccctggttacgcgtcagaacggtggcggctccaagacgcccaagg

SEQ ID NO: 22638 - DNA, 502 bp, Sorghum bicolor
  Clone ID: 14366935
gcacgagggtggacccctctcccttctcctctcctccgacgcgatactacagtttgtgaacatgtttaaacttcttcgccgggtctcttcaggcatctggagccgcaacagaccagccccagacagtgagccatccacagacgccccgctcgtgggtagcaagcgccgacgtgacgcggatgacgacgcaaatacggtcatgcaagtcgacgacctcgggcagcgcaagagggcgcgttcgaaggagcccgactccgacgttccagatacccccacgggttctcaatttatcactcccagttatgtcgtttcagatgctgctgacgctgcgagggatgcgtcaccgttccctatatcgaggagtcaatcggctacggactctgtgcgggagcagactgaggcggtcaagaacgtgactttgaccgataaagaagccgtcgttgaggagcccaccgcaaccaaagaggaggcgattcctgcacccgaagagactactcctagt

SEQ ID NO: 22639 - DNA, 502 bp, Sorghum bicolor
  Clone ID: 14366936
gcacgaggcaagagtatcaagctcaaggcgacagccgcctgccgcactggcaccaccacggatcgtcttcccacttgcccacctcgagagaacaggacgaagacaacctcgatccatacctccagcaggaagagactccccaggtgccccccaaagatagccaatatcagccaaacctgccacggccgaaacaatttgttgctcagccgcatcaggaaccctacgttcggcccccacttggcagggtgagcacggagggcagctattcgacccaaggcggggtagatcattacagcccagagcaacagcaacaccaaagtcagggtctccaacagtcacagtcacaacaagtgaatcacgggcaccagcaatcattccaaagctatcagcctgctcctccgcactcgcaggcccaaggcaacttctctgggttcaatacacaaaactcgtcgagctctctgctgcagggcattcagctgcatgggcacaacgcttcggtcca

SEQ ID NO: 22640 - DNA, 527 bp, Sorghum bicolor
  Clone ID: 14366941
ttgttgtcttcgtcgctgcgactccagatccccctcgtcttcttcgtcgctgcgactctctctggtcagatatgtggcgattgtgtttgaggtttcgctggatccgaatttcgctgggccgccatcgattttgctaccggtgagtcatgctcccgtgtccgttgcgccgctgccgccgccgaccaccgcggtgaggtgctgcagccagcccacccgctcaagtccccgctgctcgcctctgcctcccagtttcctgtacccccatcccctccacggcttcaatctgctgtgtacgcctgctcagatttgtccatggcggcatcgcggcaagtgaatggagttctgggaggaatcgataccgatgagtacgagtggagcaggcagcctgccactaatcatcatctcattcttgggtgcagagatccaaggcttggaggagggtacctactgagggttgtcagcaaggaaaagcaccatctcatcatgttaaaggtgcagagaggaaggatgctatgcttgtgctatta

SEQ ID NO: 22641 - DNA, 457 bp, Sorghum bicolor
  Clone ID: 14366947
gcacgaggaagacgtcaaagtctaagaagagctcagaaaagaagaagtcacacagacacgcagacagttctgtaccagtatttaatcttgaagatatagaggaagggattgaaggttctcaatttgatgatgagaaatcgctgattatgtctcaaatgagcctggagaagagatttggccagtccagtgtttttgtagcctccacccttatggaatatggcggtgttccacaatctgcaactccagagtctcttctgaaagaagctattcatgtcatcagctgtggctatgaggacaaaactgactggggaactgagatcggatggatctatggttctgttacagaagatattctcactggattcaagatgcatgctcgaggctggcgatcaatctactgcatgcctaagcgaccagctgtcaagggatctgctcctatcaacctttcggatcggtt

SEQ ID NO: 22642 - DNA, 231 bp, Sorghum bicolor
  Clone ID: 14366951
ccacgagggcaagatgatggccacgggcgcggccacgagggggaataaggtcagggtgcgggtgcggccggaggaggtcgtcgaggccgcgaacctcgccgtgagcgggcagccgttcgaggtggtctactacccgagggcgagcacgccggagttctgcgtcaaggctggcgcggtccgcgccgccatgcgcacccagtggtgcgccgggatgcggatcaagatggcctt

SEQ ID NO: 22643 - DNA, 592 bp, Sorghum bicolor
  Clone ID: 14366956
gcacgaggccataatctcgctctcaatgttcactcatacgctcgtttggctatgctacctttctcttcttgcgacacctcttccagcactcggtcattccatgtataacaagcacgagcgaagagctcatgtgaggaaatcagactctgctcgtgctgataaaacatccagtcatataattcctatatccacctccccacacaaagcaaccacgacccactcttcctccgcatcgaagcatcactctgtcccagcgacatcgatagcatcttcatctgcgaacccttcttctccttcttcttcttcatttatttcatcttcagttacgtcatcaagtccatcatctaacacatccacatccagtccctctctgtcttctgcttcctctactgcaacatctgctgtatcagtaccttcatcgacagaatcatcggaagaactacaaacactgctcgaaagacgcaacgagttcacaatctctgcagtccctgatctcaacagtatcaccaagtggcttagcacgctctcgtcggccggaacatggcctgacgtcaactatgctactggatgcgatgctcaacgtgctaactgg

SEQ ID NO: 22644 - DNA, 484 bp, Sorghum bicolor
  unsure (1)..(484): unsure at all n locations
  Clone ID: 14366959
gcacgagggcagngaaaaaaagcccaaaacaatccgcggcttggagaaccctagaatcaagcgcggaaccgtcctcatccaccatgctgcgtgcggcggcggctgccgccgccatcctcccggtgcggttcgccgccgcgccgaccgtggcggcggcggaggagctcaggtctccgctgctcagggtcattgggacgctgaggggcggccgcggctcggtgctgctgggaaggagggtgcgtttctgctccaactcctctgcgagcgactccgaggcggcggcggcggaggcgaaggccgaggatgcgaccgctgctgagggggaggcggacagcaaggcgtcttccgccatcgtgtcgaccaacaccaatctcgacgactgcctctcggttatagcgttacctcttccacatcggccactctttcctggattttacatgccgatgtatgtaaaggaccaaaagctgttgcaagccctaataga

SEQ ID NO: 22645 - DNA, 495 bp, Sorghum bicolor
  Clone ID: 14366966
gcacgaggtattcatcgcaggcctcaactatccttctctgctaggagaggcctcccccagcgactagtagacttgtgtgagcgaggaagccctttgaataggtattcctgacatccttacttcatgttcggagacttcttgctcttcgtgggcttgtcatacactctttacatacaacattcctcgacacacgttagcatgataggaccatttgcgttcctccagaccatctcccacgcccaaagtatggagaccctcaacacaactggcgaggccgctggtctcccaagtgcgcctgcttcacagtttgccatcttggactttctattccctggcttttccaccttttcaagtatcgtccatgcctatctcggtatcgatcttaacctctacatccccctcctcctggttatctccggtatcatgtttgcctggaactatatcaccgagtattcatggagcatcatcgggcagcatctcatgtctgccggacgt

SEQ ID NO: 22646 - DNA, 489 bp, Sorghum bicolor
  Clone ID: 14366974
gcacgaggctcacttgaggcaaagggtctgaagcacgtttactaccccgacagtaacggctacaagacccgcactgagtcgtacttttccgtgtcgtcgcagctggagccttactgcatcgttcagcccgagagtgccaaggatgtatctacgattatcaagaccttgacatctgatacaaagtgtaatttcgcgattcgaagcggtggacacaccgtttgggcggcgaataacattaacgatggtgtcactattgacatgggattgatgaacaagactacgtatgtcaagaatacgaaggtcgctcagatccaggcgggttctatttggcgagatgtctacggcgctcttgaaccatacggtgctactgctgcaggcggtcgtacttcgactgtcggtgtcgctggcttcttgactggtggtggcaataccttttatactgcccgtcggggttttggctgcgaccaggttgtcaactttgaggttgtc

SEQ ID NO: 22647 - DNA, 536 bp, Sorghum bicolor
  Clone ID: 14366980
gcacgaggccatctcccaagctcaagctcaagctcgcatttcacgccagcaatcttcgtccatttctctcaattttttaaccaaaaaccacatctaatcaataaccatggctgagatccgccgaaagctcgtcattgtcggcgacggtgcttgtggtaaaacctgtttgttgattgttttctccaagggcactttccccgaggtctacgtccccaccgttttcgagaactacgtcgccgatgtcgaggtcgatggcaagcacgtcgagctcgccctatgggatactgctggtcaggaggattacgaccgtcttcgacccctgtcctaccccgactcccatgttatcctgatctgcttcgctgttgactctcccgactctcttgacaacgtccaggagaagtggatctctgaggttctgcacttctgccaaggtctccctatcattctcgtcggctgcaagaaggacttgcgatacgaccagaagaccatcgaggagctccgaaagaccagccagaagcctgtctctcccgaggagg

SEQ ID NO: 22648 - DNA, 599 bp, Sorghum bicolor
  unsure (1)..(599): unsure at all n locations
  Clone ID: 14366986
ttgtccaccttctttctctccacccccacactctttgctttccagcaaccccccagagatccagcatctcgcccactgtccttcacacttcacagctccagtcgtcgcagactcgactcacatcgcacatcccgtgcaccatccaggactctttttttgaattgctagccaattcacacactctctgtggacacttgcccagtacaatccttctctaggaccaactgcttactcacaaacaacacaaaccaccatctttctctcaaaatgaagtctgctgctatcgcttccaccctcttcgcctctctggcccttgctgcgcctctcgacaagcgcgtctacgccacaaagaccaacatcgtcctccagaccgtctacgttaccaccaccatctgggacaacggtgctcctgctgctccctcgtcgtcggctgccggtcttttcttcgagaaccagtctgccagctccgcctcgaccccggccgctgccccggttgcttcctcgaccagcgccgccgtcgagattccggcccagactcctactccggcctcttccacgcctgagccctcatcctcgagcgcggttcctcctcctccttn

SEQ ID NO: 22649 - DNA, 521 bp, Sorghum bicolor
  Clone ID: 14366987
gtggccctgggacccgccgctcgacgacgccggactcctccgcgcctggaccgtcgggaagtgcatcagggccgccgccgccaagcagggatgggccctccaccgggtcctcgtctccccgttcctgcgatgccgacagaccgccgcgcgggcggtcgccgcgctatgcgccgtccccgacgacgacgcgctgctcgcggtcggcgacccggacaatgtgcccctcgacacctcacgcatcaaggtgtctatcgagtatggattgtctgagatgatgaacactcaagcaatgggtgttattgttagcaagctagcttccagcatcaacaagtggttccctgacttaccagagctcgaagccgacttcccggctggaaccatcgaccattctgcagaaccaatctacccggaggtaccgaagtgggaggaatctgtcatggaggcaagaagcagatatgcaagcatcatcaaggctcttgctgacaaatatcctcatgaaaacctgctcttagtaacacacg

SEQ ID NO: 22650 - DNA, 488 bp, Sorghum bicolor
  Clone ID: 14366988
gcacgaggctcctccccacccaccggccaccggaataggaacaatcaagccagattcagctcgtgattgcaagtatgcgatgacgacgccgtgcccgggcgccgcggccgtgcgcgtccagtggacggcgcgctccctggcgggggcgtttctcgacctcacgctcgcctgggcctgcctctgcctcgccgcgctcgccgccgccgcggcccgcttcctcgcgttgcttggcctcccgctcccctgcacctgcgcacgccctcacctgccttgtatcctcgcctttctggcgtgctacccgtcccgcgccgtcgggtccctccacgccgccctccgcgcccgcttccccttcgccggccccaccgacgacgaggaccgccgtcaggagggggcggaggaagatggggaggagcaggccgtcgacgcgcgggaggaggaagcggatcttcgtcgccgcgaggaggcgcgcgccgagctgcagcgggagc

SEQ ID NO: 22651 - DNA, 432 bp, Sorghum bicolor
  Clone ID: 14366989
gcacgaggccagctttcagttgccaaaagacctcatgaaattggacattcggtgctaccccaagggggagctaaaacttgaaaggcatgagaagctcgagaagctctacttgagaggtggagacatgcaaaggttttccgcaaacaagtcagcctccatcaagacattacgtctgaggtatctcaagaagttcacaatggaatggcaggatatctgctcagaattgaagaatattgaatatgtggaaattgtgcttaataatcaggatgcaatgcgaggaaaggataagagtgagcttgttacgaaggatgcagaggataaagaggtcaagcgtatttataaggatgtgatgaagataccggattttacattggatggacatggggtatggactaaggatcagaaggaagaggataacaaacaaaagtggct

SEQ ID NO: 22652 - DNA, 494 bp, Sorghum bicolor
  Clone ID: 14366991
gcacgagggcgagtcgaaattcccgttacgagtccgttctttatttaccgatttcctcccataactaccgtagccatgttcaaacgctcgtttaggtcgcaagaccccaaccgcgtcgacaagactgcgagactcaagagatcgggctcccaccgggatcacacgaaaatgtcgaagctgcaaagatcgctcaacgagcaggacgccatcccccagaagcctgctccagcacccgccgcgcctgcaccttcgcccatcgtcactctgactgttggtcaagatggccggctctttgcagcacatgaggatgtactccgccagtcgcctttctttgaggccgccctgcgcggaagttgcttcgaggcacagagcaagaggatctccatccccgacgaagaacccgaggtgttctccgccgtcctcgaatatctctacaagggtgactactacccacgtctgctccataacaagcagcgcaactcttgggagctcga

SEQ ID NO: 22653 - DNA, 539 bp, Sorghum bicolor
  Clone ID: 14366993
gcacgagggtagaggcaagcttatttgtttggctcagcactagcttggtattctgatgatgcttgaaataacaatggaacagttgcgagcaagggagccgatggtatgatctcacaacatggtttctgataaatgaaaggtgtttgttgcgcatgggccgaaactgaaatattttttagacacgcggaatgttactctgacatggacatttgccaattggggtctcatattcagaatatttctgatggcaaaatatgttagtgtagaattggtaatttaataaattttggaataattgcaaaataagagcccctttttatatctttgctcttaagcatagatcaaagattcttatactaattagctagagtgggagcttatgcatttccattcaagcttaaaatgtcactaattttgattttatgttggtcttggttggctgagtacaaatttgactattgtgttctattgtatctcagcatgtgcaaagagatttaaatttcaaaattcataaattctcgtacaatctcctttccaat

SEQ ID NO: 22654 - DNA, 528 bp, Sorghum bicolor
  Clone ID: 14366996
gcacgagggcacctccttcactcaggacgaacttgccaagctctgggtcctccgcggccaggtctacgacttcactgactttgtcaagcaccacccggctggcagcaaggccatcttgctcggacgcggccgcgactgcaccgtcctctttgagtcctatcacaccatcctcccgtccgatgccctcctcgagaagtaccgcgtttccgcccccaacgccaagctcgagcccagccgctcggccaagctgttctcctttgaagacggtggcttctaccacaccctcaagcagcgaacacgggagtatttcaagaagaacaacctgagcaccaaggccacgacgctcgacgtcctcttcttcgtggtgaccatcctcagcatctactattgcacatgggctgccttcgtgcagggctccctcatcgccgccgtccttcacggaatcggccgtgcgctgtgtatcatacaaccgacccacgcgacgtcgcactacgccatgttcaagtcggtctggctcaaccagtgggg

SEQ ID NO: 22655 - DNA, 270 bp, Sorghum bicolor
  Clone ID: 14366997
gcacgaggcaacacttacacacactcttttgtgtaacagtctttccctcactttcatctgctgtgcggacgttgctttcactctttaaagcatctaccacggctcttgtacttggacatcgctagctcgattccatcgccgctcgtcagcgtacagtcacccacaacacacaactcagtcaacgagactgcatcatctctgcaaaacaccaacacaaatgacgaaagagtcaaatctttactttcgcacatattcaaaatgggtttcacc

SEQ ID NO: 22656 - DNA, 376 bp, Sorghum bicolor
  Clone ID: 14367001
gcacgaggcaacaatcaactcagatcctaaatcaactcttcaacactctctttcgagacaatcacttcttaccaaccttcaacatgaagttcaccgcctccattcttactgtccttgcccttgctactggcgctctcgccactcctcccgctcctcgcccccctgcccctcccgctcctcctgcccccaagaacaacaacaacaacaaccagcagaaccactgcggtaacggccagtctctctactgctgcacctgcgctggcaacaatgccgatgttgagtgtgtttctttcaccaacggtggtcttggaggtgtctgcaacggtatccagatgtgctgcaacaacaacaacggcaaccagggctgcaacttgaa

SEQ ID NO: 22657 - DNA, 427 bp, Sorghum bicolor
  Clone ID: 14367006
gcacgaggcgcgttaaaagctccactcttcttcgccttgtgtcccacactcctatccttctcacagagcgcccagcgccccgcgaagcttctagaacacgcggctggagtgagcgagcgagctggcggtggcgggtgggcgaggcgaagctaaggaggcgcgaggggcggcgatgcggggcaggtgacgccgtgacggtgcggcgcggcgcggcgtgggaggaggcggggcagggcgggggatggtggcggcggcggaggaaggtgggcccgtcgaggagggcgtcggggagagctcgtccccgccgcgcgaggacgtcgccgccccagcgcccgccggctccggaggcgggagcgggggcgggagcggcggaggcgcccgtgacatctgcgcccaggtgctcgagcgcctcgtcgccgacggccac

SEQ ID NO: 22658 - DNA, 492 bp, Sorghum bicolor
  Clone ID: 14367007
gcacgaggctgcagcctgctagctaagccaccgagcatattgagtccagttgctacacactactgcaccctctgctagctgcgtcggcgatgtgtctgccgttctcctgcggcggcggcgacaaaggcgacgattggtcacatgactctagcagcgtccaccaccattttcggcagccgccacaaccacaacctcctccgccaccaagggaagacgaaaagcaaacttattataagcctccccctgagaaagaagcatatggccaccatgggaccaacatgcctgccggcggcggcgatggcatgaataatggaggagctcgtgcggcggaagtgaacaagaacggaggagggcacacgacggacttcggctactcagatggcaacgtccatgcttctgtcggcgttttccgaggtcgagagagtcagagcgctgccgggaagaagatcgtggcgtccaccgctccagcgatgcaagccttcaatacaagca

SEQ ID NO: 22659 - DNA, 445 bp, Sorghum bicolor
  Clone ID: 14367010
gcacgaggctgccgcctccattcctccaccagtccaccatcgccagctacgcccaaccaaaccaaactccacctctacctataaacgcaacccgccaccgctgtcgcggcctctgcgctccgaagatcccaaacccccgatcctcccaatggcaaccgcattctcgctgcgcgctgcggccccggccaccgccccctgcgccggcctccgatccacctccgcggtgagggtcgtgtccgtggcggcggcgccggcgggacgtggaaggctggtggcgcgtgcagcggttgcagcaaaggcggatgcgccatcgagcgccgtggccggcaagtccgacggtcatgagctcttgctatttgaagctcttcgtgaggccttgatagaagagatgaaattagatcccacagtgtgtgtatttggtgaagatgttggtcattacggtggt

SEQ ID NO: 22660 - DNA, 505 bp, Sorghum bicolor
  Clone ID: 14367011
gcacgagggtagcgaggagcatggacccagggaacaagagggcaggaaatggagattatccagttccatctggtgtaactcctaacccagtgatgaatggggctgtggtgtatcactccaatgagccgttaccggcattcaaagatgtgccagcgtcagagaagcagaatttgtttgtcaagaaggtcaacctgtgctgcgctgtgtatgactttgcggatccaactaagaacctcaaggagaaggaggtgaagcgccagacacttatggagcttgttgattacgtcacttctgcaaatggcaagttttcagaggttgtcatgctggagatcacaaagatggtgtcgattaatttgttccggacctccagccccacacctcgtgagaacaaggccattgaaggggttgatctggaggaggacgagcctctcatggatcctgcatggtcacacctgcagatcgtgtatgaggttttcttgagatttgtagcgtcacaggagacaga

SEQ ID NO: 22661 - DNA, 585 bp, Sorghum bicolor
  Clone ID: 14367012
gtttttcgcaatcaagctttcctgagtggaatggtgttgctgaaaagttctagcactgcgttccttccagttctcccatgccaccgggattgccaacaaccaaatgactttaacaagcccagcccaaagggtgagggaactgtcccttggtccaagtcctcaatgcagaccaaacttgttgcctgtattgacaatgtgcaagcaagcgtaccactgattcatctctaactcagtgtatcgatccatgaagttacaccatgtaagctgattttgtcgaatattcaccattggtgttgagcgccctctagatatgatcagctgcgctcacattgaggtgtacatgctgaagacaatcccaaagggcgacgaattgtgacaactgttgaggcattttgcttgctagaatgtttatgtactgcacccataaattgtcctgcagtgcctgttgtatcgttttgttccttttgcgtgctgaaaaaaaaaatggccggagctcccttttggtgatgcgcacctgctggaatgccaaaaaagagccttggcgccatccccaagtctgttctttgttgctgcattttagagttg

SEQ ID NO: 22662 - DNA, 521 bp, Sorghum bicolor
  Clone ID: 14367014
gcacgaggcacccgtcttgtcacgtcacttcgcaggcaccctctattcttcattgcacccgccttccaaactacagacttgggctgaaagccaagagagacggctctgagcatcacgctcctcgtggaacggaccggaccccctgagagaaagacacacacgtacacaaagacctaaagagccttcgcccatctgggtacacaacaccaccatgtccgagtacagctatgcaccaccccggcaccgcaaccgggagccagagtatgtgactgagacgacctacatcgaacgcggcggccgtggaggcgcagtgcgtgatctcgtctaccgccccgcagcccgagaggacagcatcgaagagatcccccgcgacttccctcctggcaccgaattcaggcagaccaagtaccgtgaggagtatgcaccccctcgtcgcacgcgttccatgaaccgcagctatgacgacgactactatgaccgtcctcgtcatgaccgtcgccgcgaccgcgactacgacgact

SEQ ID NO: 22663 - DNA, 402 bp, Sorghum bicolor
  Clone ID: 14367017
gcacgaggacacggattacaccccctgccaagaccagaacagggcgatgaagttccctcgggacaacatgaactacagagagcggcactgcccggcgcagaaggagaagctgcactgtcttatcccacccccaaagggttatgtggctccgttcccgtggcccaagagcagggactatgtcccttttgcgaattgcccgtataagagcttgacggtcgagaaagccatccagaactgggtgcagtatgagggtaacgtgttcagattccctggtggagggacacaattgccacaaggagcagataagtatattgatcagcttgcatcagtcattccgatcgccaatggaactgacaggactgcgcttgacactggttgcggggtggctagctggggagctta

SEQ ID NO: 22664 - DNA, 488 bp, Sorghum bicolor
  Clone ID: 14367023
gcacgagggaaaagtcctttgtcttccgacactgttattggtcaaggaaacactagcgcttggaagatgtgcggccttgacaggaagacatcactttgcttggtatatgatattgcaaaaaaggatggcccagattcaattggtcaatcaacaagcaatcagttctactttcagttcttaacctactatcagcacaatgagggtcagatgagattaagatcgaccacaatctccaggagatgggtctctggtgataacaatgtggaggagctagtagccggctttgatcaagaagctgcagctgcagtcatggcacgcttggtgtcatttaagatggaaactgaggttgattttgacccagtaagatggcttgatcgggctttgatacgtatatgctcaaaatttggagactatcagaaggagacaccctcatccttcagtttatccccacggctgtcaatatttccccagtttatatttaattttga

SEQ ID NO: 22665 - DNA, 503 bp, Sorghum bicolor
  Clone ID: 14367031
gcacgaggccgccacagcggggattgaggacactgggtgacttgcaggcatctgcggccggcggctcccacggacactctcatgctggagacgacgacgacgacgacccggactaccaagacgacgagaaccaggacttgtttgcgggaggcgagaagtccggtttggcggtgcagaaccccaaccagtccaacccgcaagattacatcaacaacatcctgcggcgtgcgcgacagaatgcccctcgaccgggtggtgatgacgaacgacccacctcacgtttccagggaacaggcatgacgctgggcggcgacgatgcaccatctcgtgccattcccgaccccaacgctcacgtaccccaaccggccccccgcgtacgccgcgaacttcacctctggcgcgatggcttctcggtggatgacggggctctctacagctacaacgatcctgccaatgctcgcacgctggaaatgatcaacacgggtcacgccccgctgcatatc

SEQ ID NO: 22666 - DNA, 530 bp, Sorghum bicolor
  unsure (1)..(530): unsure at all n locations
  Clone ID: 14512903
aggtgtgttgatcctgactctgaaaagagacctaagatgggccaggttgttaggatgcttgagtcagaagaagttccatgccgggaggatcggagaaatcgtagaagtcgcactggaagcatggatattgagtccattgcagagggttcaaactccgcggagtttggaaagaaggtagaaaggactggaagctcaacatctgaccgatctcaaccatgaggcctggaaatctaagctataccaggaactgtctcagaaacgatgttaatcaccaaggtgattgctgtcctgatattggatgctggtaggtaactgaggcgaggcaagcccaggtattgctgcctaagtattagacctagttttcaggtggagtagaagcattcttggttgaggaacctcctggtctcctgttattcgtataggttatatgttagcgcctgaggaattcctcttgggttggttgggtgtttaacaattgttcggttcttttatttcttgcgttgttgccttcttaaatcagtttcacttnt

SEQ ID NO: 22667 - DNA, 628 bp, Sorghum bicolor
  unsure (1)..(628): unsure at all n locations
  Clone ID: 14512905
actggcagatgggttcttagtgaaatcaagtgcagtgacagagactacatcaaatacactggctatatgacctatttcaaaggcttcntgcatttttgcataggcaatggagtcgcgtcggtggacacagagggccagacattgaggatctcccaagtgaggcaaagtgggggttggagccgttttacttctgtctgtcattctcaaggacgcttactttatgttgatacccttggcacatcaagttccatgtcaatttattttcttgaggatcttgacagcgaggagtggatatggatcttcaagcaaagcatcgaaaaggcagatctatttggaccactaaatttaggaaggatatgctgggactactacacggctgcatttcatccagactgcaatttgattttcttctatcattggactcagaaaaatctgattttttatgatatgaaacacagggatgtgcatgttatctgtactctagaagtgccctattttgagtttcaagaaacagacgatgtgcatcgtaaattttttccatatgttccattgtactcaagggcattaccatcatctagtctcaactagaagcacttcacaactttcaatacaaggctcaaattggcgt

SEQ ID NO: 22668 - DNA, 464 bp, Sorghum bicolor
  Clone ID: 14512907
ttcaagatcctgccgttcagcgccgggaagcgcaagtgccccggcgcaccgctgggcgtggcgctggtgctcatggcgctcgccaggctcttccactgcttcgactggtccccgcccgacggcctccgccccgaggacgtcgacacccaggaggtgtacgggatgaccatgcccaaggccacgccgctcgtcgcagtcgccacgccacgcctgccgccgcacttgtacggcggcggctcggcttcttaattattagtttgacgcacgctgccctgccagtcccagtcgtggcggcaagcaaattaaatccatggtgatcggtgcatctttggtcgtcgcgcgccatggttaaggctaactggcggcgacagagaaagaagcagcgagacgatcctgtagctattactacacgcatgatgttccatatcaaccgatgaatgaaattaatgagcttctctggtttg

SEQ ID NO: 22669 - DNA, 484 bp, Sorghum bicolor
  Clone ID: 14512909
gctgcggcatcgggaggaacagggggatgatcacctgcctgccgttcctgcggccgtgcctcaaccggcaggcctacatcttttgggacgccttccacccgacggagcgggtgaacgtgctgctcggcagggccgccttcagcggcggaaacgacgttgtgtaccccatgaacatccagcagctcgcagcatggcagccgtagtagacacggttttacggcctgatgtcaagctgtcgatcgatgcgtggttttgcagcggtagtgtgttgtgtgtgcatgtgtgggtgaggtgtacaagatgtatggtcatgagtaggagggagctgagcggagttatggtacggttcgtgtgcgtccagtgtcctgttgtttgtggtcaaaatcgtgtctctctgttgtttttttggaccatcagccatcagtgtttgttcgtttggttcctgtactgcatatcacggagatcagtatgtagagttagttcc

SEQ ID NO: 22670 - DNA, 441 bp, Sorghum bicolor
  Clone ID: 14512929
atgacgatgaagctcagcgagtagagaatgtcgagttaacctccctccctgcaaacagagatttttgcaatgataaatttctccatgactgtgagaaccgcgaggcccttgacggagaacgagacgccgacgaagtttcactttttgccaccaggagttgatccaggatgcatatggagattttttttttgtacccgagcaaataaataaaatttggaaaaatctttgacatttgtttactatagaagttcatttagatgtccacgttgttaaattcattgattttacagcagggtagcgaaggcttgagagacccatactggggatgctttgagattgttttccatttttttgaacttccccatataccaaagttatcatgaatcaaactttattaagtgcaaatcttgactttttttaatggggtttacacttggggtt

SEQ ID NO: 22671 - DNA, 584 bp, Sorghum bicolor
  Clone ID: 14512932
ccagcagtttgtccctcagcctggaggtgtaatgatgggcatgccttacaacatgagcaccatggccccgccacctccgcctccaccaccccagatgatgaacctaggaaggccctcaccttcagctccacagcctcaaatggctgtcatgccgcagagccagccaccaactccaccgatgcttcagcagcagatgccaatgaacctagcgcctcagatgcagtttgcccttcagccgcctggtattccacctttcaggcccttgcagccacctcctgggatgcaatacttccatccccaatctcagtgacagttttggtagcccagccctgttaaactttttgacaggttttcgatttagcgttgactggtaggcaggatctgacttgctgtagagtatactgtttgtgctgttcatttcaccatgttgtactgtacatgtaatgcgaggagagttaaagagcgaggagagtaaaaggaagattaaagattcacataggcctgtttcgttctcgtacagctgcaccgtatatgatttaatgggggaaccgaattttagaaaatggaggttgttggtagattgt

SEQ ID NO: 22672 - DNA, 591 bp, Sorghum bicolor
  Clone ID: 14512933
ggcgagaggctgcacgagggctgcgacaaggcttacatgctgaggttcgacggctcgtcggagatgcagcccgagggcacacaggaggtgatcgtcaccgggaaggaatgctgcagggagttcatcaagagattcttggccgccatcccgctcagggaggagctggagatggagaaaaggggcgccggcagcatcgacggtggtggcgcgccgcaccggcggctgcagatcgagttccacttcacagtcctacgagacgacgataggtgatacgacagcagttgggggatgttccttcctccctgattgcagcattgtactaacataatgtaaattcatctgtatatctgtatacagtttaaaagggaaaaaaaatacagggtaggattgttggttctggttttataattttagataggaaacaaaacatgaagaggattacagaatacagagtgctggtcgagtacttgtgtgtgtgtgtgtgttttggctagggtttgggcttgaacctatctcaggatcatccctgcaataccattttgtaagctcaggccttgtttagttctaaaaaactttgcaaaagttttcccc

SEQ ID NO: 22673 - DNA, 554 bp, Sorghum bicolor
  Clone ID: 14512943
tttcttcccaccagcaatgattttgctgcaaatacttgtgtgctgtcaattttgatgctgcaggctagagattatggaccgtgtcaacagaagcgggaaatttgagacacagtttcagggcttcactgggactgatggtccgctggggaagaggatggagaactccaaaactcgggcagagctcggatggcagcccaagtatccgagctttacagagttccttggtctcagcaatctctaactttcatgcgttgtcgctaaatacttgtgattaaagatgaatatactggtacatgaaagaaacaatgacaaatttgaagtggaatgttggttcctcatactacagggtttggctatcttttgttttattctgttagatcatgtaaagcattgcatcatggggtggcatgtacctaacagccttcaattctcttttgttaactcatgagagcattgtacgagcatctccaacagttatgcaattgaaatttgccatttgttggagtttgccaaatccctaaacattttgccaaaggaaaaataagtttatctcc

SEQ ID NO: 22674 - DNA, 522 bp, Sorghum bicolor
  Clone ID: 14512953
gaaatactggtgactcaagtattttcgttttgttgacctgactcaagtgagacttatgtgtcacaaggtacttgtgactatttatgctgctgatttttgtgttagagtatttactgttcagtagaacccctcaaactgagatgcattagacaacgctcctgttcaataaaacctccactctatacgctttatcagtattttctgttgtgctggtgtcacctgaggcttccatcttgttccatgcttttccattgaaaacaataaccatagtaaattagtaatcataataaagctgaagcgttctagatcagaaatgccgaggcctatgtaaggcgtgaacctagctcttggaaatggattttgattccgtttctcgtgggcctggctcatgtgggcgtgatagagcaagacaaccaaagaaacatgcttgcatggccacagcctggctattgttagcttgactctctagatgtaatgcaggctagctgagaagtgaatcaaatgaaccgaaaattttccttc

SEQ ID NO: 22675 - DNA, 126 bp, Sorghum bicolor
  Clone ID: 14512960
ttgggatcttgctcatcaagggagagtttggtatgcatacatcccagaggggagcttccatttggggggcttatgttataacattgggggttacaacttaacttggcaggtttcatgggcatggtt

SEQ ID NO: 22676 - DNA, 549 bp, Sorghum bicolor
  Clone ID: 14512963
gatggcacaagtccaaagaaatcagcaaaccaactctccattgattctccaaataaagttctgcgcttggacgtgttcaaaggaacaaaaggaggtcatcagtctgaggacgagggtattgtgaaagatggtcatcctttcagaaggacaacagatgaaatatctctaaaacccatagaagtaaggaagaaatctcttcctggccattcttgctcagatgcagaaatcgagtacagaaggacaaggagtttgagggatgccaatggtgttttatcgcggcggagtgcattggcaagacaattgcattaataagtcactagtatgcagggtaatttcatagttcatgtagcctaatgtgcattgaattcgagctgtcattagagtgatctgtagccgaagagtagcctttatcgtatatgaggattatattaccagtttgtgttctagatatgtgatgatgagcttgtactctgtttgaactccaagatcctctttgtagacactccaattgttcgcaggagcagtgaaatgaaatatcgttggtacatt

SEQ ID NO: 22677 - DNA, 552 bp, Sorghum bicolor
  Clone ID: 14512968
cggaagcctctttcagaataagttcttgagaacgtttcagacagagcaatgaggcattttgaagaagccaggggtgtggggagttggggcctccaatcaagaaaatcctgttctttgttgtatgaagaaaattaggaaaaagtgctgaatgttaagcttttcgattgttcagttgtttggttgtgtgaggttgtcgtccagcattcggtcctagaggggttgactgtgctgtttactagtgcggcccaacccctctccgtcgtaagcacaggccgctcaagccctcacagttcatgggaagctgctttggcgggccagcgtacgatgctttgtgggcctgggtctaattctttcctctcctggtagttgcctataagctagatcattgttcttttcttcatgttctcatgtaagcagcactttttttctcatctagattttatgatttattttcaattgtgtaatggtcttgtggtgatgctattaaattatcctattccaaattttgaattgttttgtaatatctttttgtttaattttggtccaagagcc

SEQ ID NO: 22678 - DNA, 133 bp, Sorghum bicolor
  Clone ID: 14512969
atgaaaaaataaaagggtggtgtatagggttgacccatgtaactcaaggtgtttgatactgaggtgtttgccccgttccataatttttgattttgttccccggagggacgaacgatggacagtttggcccttt

SEQ ID NO: 22679 - DNA, 624 bp, Sorghum bicolor
  Clone ID: 14512982
ggctctttgtgcagttcccgaactatagatatgcgcccatggaaggttctattgatcaggtgtgggaagaaccaccggaagttggcttggacaaccttgtcatggtaaaggtcatgaacttcaactggaaccctgccgaggtgcagctagtgagttttctgttgaggaaagctaagtctctgcacaaactgttaatagtttctcacaatgtcaccccagtggatctgcctgatacaccagaagcagacctttcacctctcaaagaagctttggtcaatggaaagataatgtttaccaagtccgacaatgcagcgactcaaccatatcatgatgcctttatcaaggtatagtttagttaccagtcgagtcagagccctatggatagtaatatcagcttatctaggcattatcctttggttgtagttcttattgataaaacgataagatatgaagaaccaatgttgtctccttaatttgtttcttgaatattactactagcaaaatatttaaaatgcatgatgttccagtgtgctcatgctttgctatcctggcaccacttggatgatgtatttgacatattgtccttatgatgatgaatcagagctctgccgcttcatattatct

SEQ ID NO: 22680 - DNA, 492 bp, Sorghum bicolor
  Clone ID: 14512988
ttcttgttagccatcatgagtgtaaaactgccatatccaaggcccatgctatacccttgttgatagatttgctacggtcaggccaggcccgtaacaaggagaacgctgctgctattctacttgcactttgcaagaaagacactgagaacctcgcctgcatagggaggctgggtgctcagataccactgactgagctggcgaagaccggcacagaccgagctaagcgcaaggcaacttcactcctggagcatctcagtaagttgcaggtgctctaatcccactgtccaccgctcaccattttgtgcgtgcgcgcgtgtgttttcaacttttcacgtgtatgtatacatacgggagaattataacatcatctgtcattgagtgtgaaatttagtgggttggtgattagtttgtttcagtcaggaccaaacgcttgttcatcgaatcacgccattaattggttggtgcccctgaatctgagattttctgttgctc

SEQ ID NO: 22681 - DNA, 170 bp, Sorghum bicolor
  Clone ID: 14512994
aatatcagtttaagtaacagaagctgcttgtccccccatctgtttcaatctcaataacatctggctactgcttgagtaactgagtgtgtatgatgtataacatctggctactgtgttggttaactgagtgtgtatgatgtatgaacgattcaaatttataggaagaaaat

SEQ ID NO: 22682 - DNA, 639 bp, Sorghum bicolor
  unsure (1)..(639): unsure at all n locations
  Clone ID: 14513021
tggggtaccctttcaacagcttgtgccttaaaatttgctctatttggactggcttagttccaccttcagttactccacacattcagttacgtattggtcacttccctggctgcgctactngtagtcactagtgtgtgtgtgtttgctattttctgcaggtgtctagttgcaggctactctccaacatgtatgcttccctgctctccctagttacagtttcagtgtcgttgtcaaggttcagatcagtgtcttggctgtgtgatacttctgtgggtgttgaatttttctgtgtgtttttctcagtacacacagaacaattagcaataatagtgtgagtttcaaaaataccgccagaaaaatccaattactcacagaaaaatagagtactttttctgtgcgtgtgaatacacacagaaaatttaatattattctgtcggtttttgctaacctcacagaaaaaactatatgcacgcacagaaaaattataattattctgtcgggttgtttcttacacacagattaaatttactaactcacggaaaaaattaagtcccgcgcatagattttcctttcccgctctgcttttggcattggcgcctagcttttggtattggcgcggtgtcgaatagataagatggt

SEQ ID NO: 22683 - DNA, 260 bp, Sorghum bicolor
  Clone ID: 14513041
actcgggagtcaaacagatgaagcttataggtggcttggcttgatggcagattgttttcttttgttctgtacatgatgatattggtcggtgttgtagtaacttggtgatcgggggctgtcttaacttgtaggggttgctcttgctcccccctgtttgcagcttttttttgtggctgcctggcgagtccatgcgtattgcatagggaattgagtttatgttaattaataagggagttgaggtgaaggtttataggaaagtc

SEQ ID NO: 22684 - DNA, 182 bp, Sorghum bicolor
  Clone ID: 14513045
caagcctccaagtttagtttttgcgagaggggagagagggcaaagaggaagagaatgcgaggggatttgtgacgtgttttgttttgtgggggggcatgtttgggtttcccattgagattatgtacaatttacaaccagtcaggggtaccttttttttagttaaatatcagaagggccagggg

SEQ ID NO: 22685 - DNA, 550 bp, Sorghum bicolor
  Clone ID: 14513058
caaaaggaagcaatcgacctgaaggaactcaaacgaattgatcatatcctgtcatccttgaaacggaagataggggctgctcctccacctccaccttatcccgagggctatgtcccaccatcagcagaacaagagaaagcaccggatgatgtggcagcatcagaggcaccgcctcaacttgaccctatcattgatcaaggtccttctaaaagaccaagattccaatgaaagatttgtagcttaaatctgctgactcacaattgcctgtatgttttaaagttgcagacgtggactttataagctcattcttgctggttatttacgggccaaagatagaactaaccttgtggcatgatgtttctgtctctgagtttctagcttgaatcttgtagattgaccagtgtcatttgctctgggcttgcaatcttgtagattggccaatgtcatttgatccggtgttatccactgttgctgttgacctgtttccactgagcttgtatgacttatgaggtggctatagttttacctttgtgcaaatctgcaaggctgg

SEQ ID NO: 22686 - DNA, 546 bp, Sorghum bicolor
  Clone ID: 14513061
gtgatgaacagttagagggtgtcacagatgaggcgacgtcagctcttcagacgacttttcaggaagaagaaactggaactcagtctgatgcaagtaaagtttttggcaatcaaccatttgcgcaatcagtgcagccaaggaggccgccaaagaagtatagaaggcattcgaagaagaaaccagaaaagaagcatgagaagaaggaagatgagcctgagggtgacaagagtcaatagttagtacgccccattgtgagattcgattgacagacttcatcgtgcccgcttactctgtgacggaactgtaagtacgtatgtccccgacgtccgacgatcacctcgagtttttcattctgggtatattgtgaaatggaagcggacaagtggtggtagctttactgtcagcttagacttgatattcccaaaaattgctcaaaagggatattgtgttgtgaatctgactgtttgttgagacttgagagagtaagagtttcagtatacccaatgatggagaggagaggagaggagaatggtactctctgtttgc

SEQ ID NO: 22687 - DNA, 680 bp, Sorghum bicolor
  Clone ID: 14513074
gatcttgcaaggtcaagtatctatttatatataggagtacaaaagtgactccctagctgaagtgatcatggatagacaaagacaatatgtttgagtttagtatcattgatgaatcgattacaaattctaattatggccttgttgtaactgaacatctgttaagtttctagtatcatatgctaattcagatatccatttgcttgatttgcatttgtgattctattactcactcgaaacatttggaactagctagtatctcttcagagctctgaactatatgtagggtagtcagtaactgttcacccattttttttcagcttgttgttctgaacttttgaattgcgatgacactgcaaggttccaagtgcctcgtatttatattttccttgccttattctatcactcaaacatttggaactatcccttagaatcatgcagggatttcctttttagctcaagactgagagcttgtactgcagtcagcagcgcctcaatttttttttctcgtttcaacttcgtgttcagaacttgtaattttagactgaaaaaagagtattctgctatgtgcactggaacgtggtgggacatacagatgcaatgagccagtgaggacgtgagatagtctgaaactgtgtttgaaacaacatttttcaagagcagatagttattgattagtctct

SEQ ID NO: 22688 - DNA, 679 bp, Sorghum bicolor
  Clone ID: 14513089
tccttggactgcacccagaatggcaggatcgagtacgagcagaggtgcatgaagtctgcggaggccagccagtagactcacggtcacttcagaagatgaaaaatttgacaatggtgatccaggaaacattgaggttgtacccagcaggtgcctttgtatcaaggcaggccctccaggaactgaagctcggtggcgtacatataccaaaaggtgtcaacatctacatccctgtctccacaatgcatcttgaccctgagctatggggccctgatgtgaaagagttcaacccggagcgcttctctgatgttcgaccccagctacattcatacttgccatttggtgctggggcccgaacctgcctagggcaaggatttgctatggctgagctcaagatcctcatctctcttattgtctccaagtttgttttgaaactctcaccacactaccagcattctccaacactgaaactcattgtggagccagagcttggtgtggacctcaccttaacaaaagtgcagagtttctacactaagaggggcactgcaattcaagcacgttaatattagtcatcatacaatgtgatggaaagaaacctgtgctatggtggatgcagcttcccctgaggagaggggacaatttgtacagagacaactcatactatctacacatgatattttcc

SEQ ID NO: 22689 - DNA, 588 bp, Sorghum bicolor
  Clone ID: 14513091
gccacggcggcggcatcaaagggctcatgggcctcaacaattccatcggccttgtcaacgccaccatgccgctggctcacggcttgtactacacgcccgcgggtgagtcttggacgaccaatggcaataatgccgccgtccatgatcatcaggtgagccaccacggcacttcgcctcagacgacggtggctcaccactcgccgttctcatctctgctgtctcttgctgctccggggcctcagctcgtcttctactcgccggaaggcggcggcttcgccatgaaagaagccgccgatcatcagttccctgtagatagcctcgaacattctcaaggccagctctcactgagctcagcaagaagcttccttcaccccggcaaccagggatgattaggtcactgatctctactgctccaagaaggacatgcaaggcaattcgttgcttcttttttatacaaggaagtaaccggtcatatggggtgtgatgtggtgtgtgtgtgtgtgtgtgttggtaatgtaataacaatttataattcgctcttgaatttctgcttacctagattgtgttccttttgtggacattgccttc

SEQ ID NO: 22690 - DNA, 552 bp, Sorghum bicolor
  Clone ID: 14513092
cttctccatggccgattgcaacatagaagggtacacgataccatcaggaacacgtaccattgtcaatagttgggcccttgcgagggatcctagctattgggagaaagcagaggagttcatgcctgagcggttcatgaaaggaggtagtgccacagctatagacaataagggaaatgatttccaatacttgccatttggggcagggcgaaggatgtgcccaggtggaaactttgcaattgccaatatcgaagtcatgcttgcaaaccttgtgtaccacttcaattgggagctacctttggaattagcaaggacaggcatcgatatgactgaatcgtttggggtcatagtgcatcgtacaaagaaactcctccttgtccctatagttccacaagattaacacatttgtttatagagtcctttatgtacacaatagatctaggactcgaccgtgcactacgtaactatcacaattgcatcatacttgtgggttttggacttgttgttaagtatatgcatactaaataaagaaagcatgcattgcattgcattctt

SEQ ID NO: 22691 - DNA, 653 bp, Sorghum bicolor
  Clone ID: 14513100
ctatacactactgatggatttaatggctgagccgctgtctcccatgtctattttatttgctgatcacaaagtaatataaatattttgataatattccaataaatcctttcctaatgtccttgtatatttgatagttatattatacgtggtttcccattataagccgccacacctagaaaatattcctacctccgccactgttactgagcattaagttgtccatgaaactggctttgtatttactgcatctttacaatattcagttgaagattttttgtactaaggttgagtccactggaaaaccacctcattctttttgaaaagaatactacatgcattagaatggtttcttgtgtaaaaaaaaaactgttttcccccttctctacttggacatctctttgacattctctggaatgcacaataacttgatagtttgtgtcataaatggaaacaaaataaggtcaaggatttacttgtattacaaagttcattaactatttcaacaggtgtattgttcatttatctcgttctgcaatatatttgtgttcaaattgcaacttcttttttgggccaccaatcaaaggaagaattgaaatttcttaggggcccatgatttccaaatcaacttccatggctccaggtttatggatcct

SEQ ID NO: 22692 - DNA, 513 bp, Sorghum bicolor
  Clone ID: 14513102
cgatgctgatgcagggaaagagagatgccaccagccgtcctgtcctgcccgtccagccttccccttttgtgattgtgactgccactatagccacagtggatcgtaattattggcgaaatatcagttcttaaccgaaactctcaatccaatttcataacaaagagcacatgtttagtatgaatgtgatgtttatttatttctgatactgcaggatatgcaaggttatcatggaaaggagatctggaggcataaatgaagcggcacaagtctaacgtccagaaagtggcagctgagcttgttgagttcaatcaagagattaggagggaccattcttcggatcccccctttggtgaagaaaggcaggcaggcaggaaggcaggtgatgggaggacgggatggggttgtgggtgtcaacattgaggcaagtgaagatgtgctccatgatgttgcttgtgcccatccatccatacatacatacatacatcgctggatattccagaataagaatagtcc

SEQ ID NO: 22693 - DNA, 537 bp, Sorghum bicolor
  Clone ID: 14513111
tgtgacaaattattggaccggaaggaggaggctgctaagtcaagggagcgaaggtcgaaccaaaagcttctttttgattatgtgaatatggcattagttgagattggccatgacaccttactatctgcctacccctggaggcaagcgcactcaatggcctggaaggagacccttcctcaagctttggtggaagaagtaccacagcatatgagggactggctctatggactaggaaagtttgcggtaaatgagaacgacgacgctggatcaatactggaaagaatcatgcagcaggaggtggaaggaagaggttgggtgaagtccatgagatgggaattggatgaaatcatggagcagattgcagggaaggtgctggaggaactagtagaagaagccacggaggatctcggaatttgttctctgtggccagaaacgccattgacgataccgaatctgtaggtagcaattgctctatgtatgagaaatgagaactgctcttaaaattattttgtgctgaaaaaagtctcgggtatcttc

SEQ ID NO: 22694 - DNA, 150 bp, Sorghum bicolor
  Clone ID: 14513146
aaatgggccctaaattttttgtttttggatgggctccctttggaaacttgaccagggcgttgtgtatttttttgcttaggccaatggatgaatatacccaaatacaggcattccccaaacagggggaggaagtgtagtttgttttagtaa

SEQ ID NO: 22695 - DNA, 532 bp, Sorghum bicolor
  Clone ID: 14513147
ggctactttgttgagtcacgcgacgattcatctgaagattcatattgcacagtaccggtaacaccagattatgatccatttgagttacccttgagcctagtaccaagttttagccaaatcaccgaagtgccagagacacaagaagacaatgtcgactaaatccaaagttatggagacatgaggagcttcaagcactcaagaaatctgtgcctgatcggacgactgctgaaagaagtgcttagaatgaggcgatttcagctctatactgtagtttcttccacatagaatctgtgcctttgtttgggattatgaaagagcggagagcactccccagttcccacacccttccagacatccttgatcttacatatttacctttaagaccccctttggactgctgtttgttttccttgttttctgtatttttccgtgaagattactgtgaagactcctgttaaacttgtgtacgattactgtgaagttcctgcgttccaaagggaccctaaatgtataatcaaacttgaactggagg

SEQ ID NO: 22696 - DNA, 604 bp, Sorghum bicolor
  Clone ID: 14513173
caaaggaaattcagagatctcttagtttctgttagtagatatcaactcaggttgatgttgcgatgatctttttccttcatgtgttgatgctgcctagaatattatctttgtgatagcttttttggtaacttgtcaatcgtgcacaattttcttgtgtagatattttccttcctttgttattatctatgctttctttgctttgcccagttgatgtggacaccagtttattttcctacatcgcctcccgtagttctaacttctgatagaagaaaattgttacctgctcaacgtctctcatccccaggcatcacgccgactagcatgacagaggtatatcctcagggttcaagatgtattcttgccaacaattcaaagtgtgaagctaaaaagaaggggatgggaaagacactctgagaacgtcttcctaaagcataagaggaaatcatatcctgggctacccatgatgagttgggcaccatcacggcggcatggcttgatcctagaggattgtatgttgtctttatgcttatcattacatgtaattggccacatacaaagcatatatttgtcgtgcatggtaggattatatgaagatagatttgtg

SEQ ID NO: 22697 - DNA, 505 bp, Sorghum bicolor
  Clone ID: 14513179
tgacgtcgcctgccaagttcgggtttgatgaagacgtgctgacgctttgctgcggaggacccgggcggttcaactacaacaggcacgttttctgcggcgaacctggcgccaacgagtgcaaggacccgtcggctcgtctgttctgggacggcgtgcacctgacggaggcggcctaccggtacgtcgccgccggctggcttagcgccataacgtcgccgccgccgggacggagtggcggcggtggtggtggtgccacactgccaaccggaaccggacggcggaggctgcaactgtgagcaaggattccccgtgctataacactgaccggtgaaagccaccggaaccatgcataaaagtttgttgacgctccttgttggtttggtgttgtcgctagtacttcttggctgcctactgtacttggtagtagacactagacagcaatgcaagataacaagatttgtcgatgttgtcgataccagaaccaagatgacgtacttcgacggcc

SEQ ID NO: 22698 - DNA, 524 bp, Sorghum bicolor
  Clone ID: 14513180
actccttgacaacacacttgatgtaagagatgcagctagggaccgaggaatgccatggtgggcgcgtttcaggacattccgtggcgacagcaggaatgaagagttctacactctgcctttcaacctcaaccgattctttcccccaacataagtctaattgccattgagaagatgctgcatgttaagtggtccactgaagcaagtattacctaacaatgaggtttgcttttgacagagtagaacaacaaaaggttggacaaaggaagaatcagaatgtcagattgtacataaaaccaaatcgtttaggtttgaccaccagtgccaaatcagaatgtcagattttgatgtaatgcgagtttagagatcttatgaacaattcgtttcaagccttatatgcaagctagcttttaaacaatgttttcatggcttagtggcatggtctggtgtctggtcccaaatgctatagaagatgtccagctattgtaagaattattcttcatctcgcattttagtatctatatatt

SEQ ID NO: 22699 - DNA, 588 bp, Sorghum bicolor
  Clone ID: 14513193
cagagcttggtgaatcagcttcatgcaacccaaggtgttgaagctctgtcggaaaaagagaagacagagcaagatctagctatggaattcaacggatatgtgaatggtagtaggtttctgatcgtgcttaataacctttccaccattgaagagtgggaccagattaagaaatgcttcccaaacaacaagaaaggaagccggatcatagtgtcaagcacacaagttgaagttgcaagcttatgcgcaggacaagaaagccaagcctcagagctaaagcaactgtctgttgagcagacactttacgcattgttcgataagggttccccaaatggagaggattcagtgaagcgagtgtctatcttggatgtggcaaccacaagtatagacgatcaaatagcacctcatggtgagattacagatgatcaatatatggatgctgatgagaagaaggtggctagaaagagtcttagtcgtaccaggacgtgtttgggtgctttggaggaattgcaacttatcggacgaaatagagaaatatctgaaattatagacttagtttcaaataatgataatagccaacaggttcaagtg

SEQ ID NO: 22700 - DNA, 534 bp, Sorghum bicolor
  Clone ID: 14513201
aataccattcaatccaattgggtcattaagcaatttcaagacaagcagtgaccaaaatgtgaagaagttccaaaaggttctaaaaggcatctaccacatcagaaccactgttcgccagcagatgggtcaagacatagctggtgcttgtggccagttggtggttagcctcccagatgaaagatcagctggtggagcaaccctgttgtcagacatcgaagaccttcggatctgacctctcccaattgttacttctatcttctcaaaaccagatcgtcttactaattagccttacatgatatggtaactagtgctatagtttcagtcaagctttaaaacatggagatgtttagtttgaccattgttgtgtttcccttttgttctgggatgcacaattttgctgtaaacacaatggtgaagactcctgctcgtgtggataggtggccactgaaacggttggtaacttggtattgtaaatgggacaatgttatcgcaacaatgccatggtcagctataatgatatggtatcttctgtct

SEQ ID NO: 22701 - DNA, 626 bp, Sorghum bicolor
  Clone ID: 14513206
ttgctatgaatgtcattgcctgtgagggctccgatagggttgagcgccacgagacatataagcaatggcaagtgcggaaccaccgggcaggactaaaacagctgcctttggatccagatattgttaaggtcgtgaggaataaggtcaaggacagctatcataaggactttgtcatcgatatggatcaccaatggctcttggaagggtggaaggggcgcataatctgtgccatgtcgacgtgggtcgcagatgatgctttctcggaacattagttgcttttcatcattgattctgagagtgagcatccttggactctagaaacgaaattaatagcctaagtttaaatgtagatattgtcctgtaatgtataattgttacgttcagttaggtgacatagttgcagcttaaagaaatgtaagatctcaccatatctctgcatgggttattgcatagatcgtgttgatgtacaacaagcagaagaatcctggtgttttttttctagtacatagctgtatgagtgtttgttattctgtagctaacaatcagtttcttttaagttcactctctgttgtaccatcagatatttggcatttaccttgtgtctggagagagtaaagaggtgcttg

SEQ ID NO: 22702 - DNA, 375 bp, Sorghum bicolor
  Clone ID: 14513220
gcacgaggcatggatccatttgttctctccatcctcatatgctcatggatctttgttgtagtgtactggagaacgctgaataacatgaggctaaggcttccacctggacctccaacatggccaatctttggcaatcttctccagttgagcccgcttccccacaaagactttgcccgattttgcaccaaatatggccctcttgtctatcttcgcctaggaaccatcgatgccatcaccactgatgatcctgaagtcatccgtgaaatactcatccggcaagatgaggtctttgcttcacggcctcggacactggctgctgtccatcttgcctatgggtgtggcgatgtggctctacctccgctggggcctaactgg

SEQ ID NO: 22703 - DNA, 538 bp, Sorghum bicolor
  unsure (1)..(538): unsure at all n locations
  Clone ID: 14513222
gcacgaggccccctcatccctcaccttttcttcatccagcgcacatccggctccggtgccggttgattgggctctccagcaaggagagtctgcggcggcggggcgattcctcttcaacgccgcacaagaggttccgcagcgcctcgctcgtcgggatggaggaagggagctgccgggcggcggcggcggcggcggctgtcctcccggacgagctcatcgtcgagatcctcgcgcggctgccggccaagtcgctctgccgcttcaagtgcgtctcgcgtgcctggcgctccctcatctccgacccggccaaccgccgcaggttcgcgcacacgctgtcgggcctcttcttcccccgcccctacggcagccgcccggcctgngacttcatcggcctgtccatgtcttcggtctcgcctccgcctcccggggtcgatacggcactctccttccttccccctacctgtggggagatggagctgctcgactcctgcaatgggctcctccttttgtgctgcactggcaacatccatgaatctcc

SEQ ID NO: 22704 - DNA, 535 bp, Sorghum bicolor
  Clone ID: 14513232
gcacgagggaagaactgaagactttacactagcacagtctgctcatcaagagccttggcagaatgaggtggcttggtctttccgttgatgtgttccgcagggggatctccttgaacctttactgccgtgtgattctgtaaatcgtctccccggctaccggagaccttccttccttcgcacgcctcctgatttataggcttgtgaaggcaccccccacccggttgttggcgttgctgttaggccgttgtggttgtttggccaaagcttttgaggagaacggagtggagtactaatggtgtggaaagcagctgctcagccgagattccgcgtgtttaagcatgagaacggaatcacagtgagagtaattgcttgcttccagctgctgcaaaattgccaggccgagtacttccgtcatctcctcaagcctgtgacgtagcttctctctctgctctccatctgctgctgaataagcttgctgctttaggttcttctccattacaattgaagtgggagaacttcccattcatctgaaaat

SEQ ID NO: 22705 - DNA, 566 bp, Sorghum bicolor
  Clone ID: 14513236
gcacgaggcaagggttggcagttataacagttatgattgtcacaacttgctttatgtcactcgtcattgtcctttgctggaacaagaatgttgtgtttgctcttgccttccttcttttctttggtgcaatcgaagctgtctacttctcagcttccctcgtgaagttccatgaaggggcttgggtacctataattctttccttcactttcttgattgtgatgtgtgtttggcactatggcacaacaaagaagtacgagtttgatgtggagaacaaagtctcaataagctggcttttgaatttaggcccttcgttgggtattgttcgagtcagaggcataggtctcatacacacagaacttgtgtctgggattcctgccattttctcccactttgtcaccaacctccctgcatttcatcaggttctggtcttcctatgcattaaatccgtttctgtaccacatgtccaatctgaagagcgatttttggtcggacgcattggcctgaaacaatacaggctatacagggtagttgtccgatacgggtaccgggatgttcagcaggacagc

SEQ ID NO: 22706 - DNA, 569 bp, Sorghum bicolor
  Clone ID: 14513244
gcacgaggcacaagcgaagcgactctcggaaatgtcgccgcagccggcccccgacgacctcgccgaggacaaggagagggagaccaatgtcctcatcgaggcggcggccccggggccaccagcgaaggcggccgaggacggcgacggccacggcaggcccgcgccgtcgccggtggcgtggttccggatgctggccagggagctgcactggagcttcgtcttcggcgtggtggccacgtacggcatcagccagggcctcggcggcggcatcacgcgcgtcgcgtccgactactactggaaggacgtgcagcgggtgcagccgtccgtggcgcaggtgtaccagggcgtcacctccatcccctggatggtcaagccgctctggggcctgctcaccgacgtgctccccgtcgccggataccgccgccggccctactttattcttgcaggcttcatcggagtgattgcaatgcttatactcgctctccacagcaagcttcatgcattgttcgctctgttggcattgatgactggaagtgctagtgtggcgatagctgatgttactatagatg

SEQ ID NO: 22707 - DNA, 633 bp, Sorghum bicolor
  Clone ID: 14513247
gcacgaggcttacctctccaaaccctagcctccctgatccatccgctcctcgaaatttcggcggctgatgcctccgccatcggcgccgtggtcgcctagcagctcttctatctaggtttcgtcggtccctcttcctcaccccgcccccaagatctgcgcgacgttttgagctctccgtgctgttcgggcggccatgaacagcgcgttcagcgaggacatactcgctgacaagctcgccaagctcaacaacacgcagcaatgcatcgagacactgtcgcattggtgcatttaccatagaaagaatgcagagcaaattgttcagacttgggacaagcagttccacagctctggcaaggagcagatggtccctttcctttatcttgctaatgacatcttacagaacagcaagcgcaacgggacagagtttgtagaagaattttggaaagttctccctggggcgcttaaaaatgtaagcgagaatggtgacgaccgtgggaagaaggtggcatctaggctggttgacatatggcaagaaaggagagttttcggttcacgtgctgggggcatcaaggatgtgatgcttggggcagctccccttcctgatttagatatgaccaaaaagcgctctcacag

SEQ ID NO: 22708 - DNA, 549 bp, Sorghum bicolor
  Clone ID: 14513248
gcacgaggccaagaacaaggccggggcaaggagctggtgaggctggaggagatcgggacagccatgataagcctggaggagtgctgctgggagatgcaactgcagcagcaacgccagcagctggtggttgtccccatcagggtcaggaaggacggatgggcaagtgatgccatgctttatgtgaacgtggagctcgtggatgcgaacacgcgctctgacatcgaaagggcagtctcgtttagggagaagccgagaacgaacatggcgccacggccaacaatgcgagatagccggaagagcttggaagcagcggcctacgatgttcttgacctgaagcagctgcttgatctggctgagaaggaaggccgggtggccgtgtatgggaacaaaaggaactctgacaccagcagcgtgagcagcatcagtagtagtagtagcagcagcagcagcagcagcacgatcagtatcagcagtgctagcaccagcggcggcgcgagcccagagccggcatcgacgtcgaaacgccggttcctgccatggatgaggagg

SEQ ID NO: 22709 - DNA, 538 bp, Sorghum bicolor
  Clone ID: 14513252
gcacgaggcaaggtggtccgccgcgggtgtgaggctctcgggctgtgcgccgacgccgtgccgcgcaactcgtcggatggccacttctgcgggagctgcaacttcggttgcccgactggagacaagcgcggcaccgacacgacgtggctcgtggacgccgtcgcccgcggcgcggtcatcctgaccggctgcaaggctgagcacttcgtcttcgagaagaaccgcagcggtgtgagcgggcggggcaagaagtgcgtgggcctggtggcgacgtgcgcgagcaacggcgtcaccaagaagctgcgcatcgaggccaaggtctcgatcgcggcgtgcggggcgctgatgacgccgccgctgctgcgcaacagcgggctcaagaaccggcacatcggcagcaacctccacctccacccggtgtccatggcgtggggttacttcccggagaacaagcaggatcccccgctccctggcaagtgcttcgagggcggcatcatcaccagcatgcaccgcgtcacggagcgcaccatcatcgaga

SEQ ID NO: 22710 - DNA, 474 bp, Sorghum bicolor
  Clone ID: 14513256
gcacgagggctaacagcatagaggtcaacgcccggaaaccgcgacacaactgctttgttggttatccaaagcacacacacgaacgctgcgggctgctcagctccatcaggcagcagctttggtccgctcgctagctccagcttgcagcagatcgtgtgtccgtgccattagcattgctacttccatggcccaccacaagcaggggcaaaggcagagagagatgcccagcacctgttcaatagaatgctgcaaagagggtaatcttaccaggctcaaaatgtggtgatcctatacaaaccaaagcaagcagccaaacaaactctcatagaaacgagaccaaggatagaagtccaaccaatcacacatgttggcctactaaagacaggcctaacttgaccaggctccgatcgtaggcaggctccaattaagccaagaaaccaaacagaccctatatgtttcagtggctttggcttc

SEQ ID NO: 22711 - DNA, 516 bp, Sorghum bicolor
  Clone ID: 14513259
gcacgagggcctccacgacgtctttcacgtagggctgctcaagccctacacttttcctaccggcgtccctccttctgggccggctatgctgcctcctgtgcaggatggtcgcctgctgcccgccccggagaaggtcctccgtgctcagctacgtcggggtgagtggaaactcctggtgcagtggcacgggctggctgcggatgaggcgacttgggagcccatggaggacttcaagactctaccctgatgtgcagctcgaggacgagctgtttgccgagggagggagagatgttatgaccggtattacgtacaagcggcggataagtggctaggggccacaggccgatcggcctaggggggataggaccccaatttccattgtcaattgctattatttaggaatattattatttgagggagtattttataaattattagaggagaggaggatatatatatttgtaaagactctattctggattcaagcagacacaatattgttaaagggagctggga

SEQ ID NO: 22712 - DNA, 568 bp, Sorghum bicolor
  Clone ID: 14513267
gcacgagggcctgtcctgtcttcgtctccctcctcctcgtcgccctccgccatagtggcgagcacgacacccgccacgccttgccttcgcctccaatcattcgcctccccaacgcccaacccaacctctctccgctccgtcccgtttagccgggtgggtgattaacggattattagttaatccggaagcagcttcacctcgttcgttcgcccccgcaaaaggctaacgccagcccgggcgcgcgctaacggcagcagcgacagcaacccgcccgctggctagctagtcctccccacgattcgactccgccaccgccccccggcccagcacacattttcttctctcgtgaagcaaaaaccaccaaagactagtccaacaaaatctaggggtcctatggctgtttcaatgagggaagtggatcctgtttttcaaggtgcaggtcaaaaagatggattggaaatatggcgaattgaaaagttacaggctgttcctgttcccaaggaatcatatgggaaatttttcacaggagactcctatatagtactgaagacaactgcccttaagaatg

SEQ ID NO: 22713 - DNA, 548 bp, Sorghum bicolor
  unsure (1)..(548): unsure at all n locations
  Clone ID: 14513275
ctgaatcaaatcagcaaaggaagcatgagttaactgactcatttgagaaagttcctaacattgagcccgttgagtcttctgctgagaaatttgttggtacagatgatgatgtgcttcaacttggtaaaggtggttgccactcagagatatctgatgatagcaaagctcagcagcaacctgactctacctctggaatggcagatcatctggcaatctccaaaggggcagacaatgttgaaggacagcattatcctacaacagatgaaagcatcggagcaatatcaagtacatctggacttgctgttgatgccaaatttatatctgttgatgccactgctaaccttacggaggatgtttcttcgtctggcataacaatagatgacagcatgcaggaaaatgtgacaagtggtactatcataccatctcaagccgatctactgaatttcagtccttccgctacagcacatgagatcaacatggtcgatagtataaatgatgttgaagaanagagtcagaatgaaaaaagcagtacagatcttgcttcatat

SEQ ID NO: 22714 - DNA, 482 bp, Sorghum bicolor
  Clone ID: 14513277
gcacgagggctaggctcttccatcgctctccttgcgttctccggtctcagcggatcgctcatcgttcggtattgggggttcttcgggactcagtaaggtctaaactctgaaggcgagcaaaggatgggattctccttcttcacctaccgagccggtgctcgattgctggacgggatcgcgcgccccggcgtctccaccgcagcacttctgttcgcggcggccagtggcggcggccttgtggcttacgcggattccgctgcagagagtgctccggagccatctcagggtgctcccaagaagaagctgctggttcttgggactggctgggctgggacgtcattcctgaagaacctcgactgctcccagtatgaagtgaaggtcatctcgccccggaactacttcgcattcacgcctctgcttccgagtgtcacgtgtgggactgtcgagccgcgcagcattattgaacctgtgcggaggatgtt

SEQ ID NO: 22715 - DNA, 550 bp, Sorghum bicolor
  Clone ID: 14513279
gcacgagggtcttctcaacttacacaactgagccatccacagcaccattgaccccaccacctgaactagctcatgcaacaacgccttcttctccagatgttccatatgctcgatttctttcttcttctatggatatctaaactgccagcaaggagcataacatgcctttcttatcaacagcctattctggtggttcaggactccaggcatcctacccactttaccctgaaagcccttgtagcagcctcatctcaccagcttcagtaactccgaggactggtctatcctcacctatacctgagcaagaggttcctcctgcccattggaagacctctaggtccgcctgcgacacgccatacttcagggcttcaccaattcctgagcaagagaccactgcacaatggaagacctctagatctgcttgtgacacaccgtatgccaggaactcaccaaccaatatttttggtctggattcatctaccccgagaaactatatgctagatagcaatttctttcggccagcggcatctgctcaattctacctggacca

SEQ ID NO: 22716 - DNA, 515 bp, Sorghum bicolor
  Clone ID: 14513285
gcacgaggcctgatttgatccattgcggcggcggagtccacgatgtcgaaggcgggagccctggatcttgcatctggcctcggagggaagatcaacaaggaggaagtcaaatcggcagtcgatgagtatgagaaatatcatggatattatggagggaaggaggaagcaagaaagtccaactacactgatatggttaacaaatattatgatcttgccactagcttctatgagtatggttggggtgaatccttccactttgctcacagatggaatggagaatccttgcgtgaaagcatcaagcgtcatgagcattttcttgccctgcagcttggcttgaaaccaggaatgaaggttttggatgtgggctgcggaataggtggaccgctgagagagattgcaagatttagctcaacttcagttactggattgaataacaatgaataccagataaccaggggaaaggagctcaatcggttggcaggagttagtggaacctgtgattttgtcaaggcaga

SEQ ID NO: 22717 - DNA, 622 bp, Sorghum bicolor
  unsure (1)..(622): unsure at all n locations
  Clone ID: 14513298
gcacgaggagaagggtcttcccaaattggggacgagcaggaaatggcgatcgactccggcggcggtggcggctgcagcggcagcggcagcggagcgaagaagcaaaggctggttgagctggatgaccgatgtgaggcggtggaatcggatgcgatccgggcagaccgcatctcggcgctccctgaagagctgcggctgcacgtcctgacggacctccccctcaaggacgccatccgcacgggggcgctcgctcgcgggtggcgcgacctgtggaagcgccggtgggcgcaccgcgcctccctcaaggtgcacctctgctcccgcgacgacccgcggagagagctggacgccctggcgcgcgagccgcgcccgcgccgccgcctcgagcgcttctccctgatcgtcgacacctcgtacctcaagtcctcggagttccagcgctttctcgactacgctaccgagtgcggcgtcgaggacctccacgtggagacgcagtcgcgcagcaccacggccgcggccaagctaaaattccacctgccactgtcgagcccggcgctcgcgcgcctctcgctccgcgacatccccgtctccatgttctacaagggcgcccagcagccctntc

SEQ ID NO: 22718 - DNA, 636 bp, Sorghum bicolor
  Clone ID: 14513305
gcacgaggggtggtgtaaccccaatggcccgccagaactctggccctctgcctcctattcttcctacaactgggctaatcacatcaggtcctatcacctctggtcagttgaattcatctggtgctcaacggaaagtatcaggccctcttgattctagtgtatcaatgaagatgcgtgccacctcttttgcacacaacccagctgtcacaaatctcaatgttggaggtggttactcgattaagggcagcattccaaccacaataatctggctggtcgggttgctctttttggttgggttcgtagctggtggcttcattctcgctgctattcataatccaatcctgcttatagtcgtggtggtgatatttggttttgttgctgcactggtgacctggaacatctgctggggaacaaaaggtgtgattgggtttatcagtcgctatcctgatgcagaccttagaaccgcaaaagatggggagtatgtgaaggttactggggttgtcacttgtggaaatttgccccttgagtcctcattccaacgggtgccgcgatgtgtttacacttctacttgcttgtatgagtataggggttgggattcgaaagctgctaacactacgcatcgccgatttacttggg

SEQ ID NO: 22719 - DNA, 612 bp, Sorghum bicolor
  Clone ID: 14513312
gcacgaggggtgatgctacaggggattatccatttagtcaccacaaacttacagttcaattttcagaggcgtctgctgcccaagatagaaaattggagggattagttcataaggccattcgggagctttggaggccgaatcccagtcaattaactctcctacaaacaaagggaattggtgctttacataaagagcttccaaaagcctgtactttgactggcagcagtgatccgtgctacatcgaagcatatcatttggcagatccaactgatggcagaatcactctacatctaaagattttaaatttgaccgagctggaactcaacagggtggacatccgtgttggcctctctggagcactgtattatatggatggtttctctcgcactgttcgtcaccttcggaatcttgtttcccaggatccggtccaaagtagtgtgactgttggggtttcacattttgagagatgctcactctgggttcaagttttgtattatccgttttatggaactggtggatctgcagactatgaaggagattatgcagaagaggattcacagatgatgaggcagaagcgctcacttcggcctgagcttggggaacagttgtttt

SEQ ID NO: 22720 - DNA, 530 bp, Sorghum bicolor
  Clone ID: 14513316
gcacgaggcccatggcgacgattacagcccctccatatgcacgctgcaaccatacgcatgcggcaaagtgaatatcagatacccgttctatctttccgatgagacggcagatgtgctgggcaacaactcctcctgcggctaccctgggctggtcatcgactgtgtggacgacaagtatcccatcatgcaactcggcagcagcagcagcaacacaggctactactacaactacaacgtgacggacatcgactacaacaacttcaccatctccctcgcctaccccgatgtccttgatgatgagagctgcccatgggtcgaccacaacgtcaccgtttcgccaaccttgtggctgaacctgtcggagtacaccgttggttacctcctcttcttcgccaactgctccaccaacactgtccctggtcagcctaacatcgacccgatcccatgcgcaagcagttctgacgacggcgtagattactattcttttgtgattccttcgtcggaggtgctccaccaacctctgtcgcagg

SEQ ID NO: 22721 - DNA, 643 bp, Sorghum bicolor
  Clone ID: 14513317
gcacgagggaactcgccgcctagggttccgccgccgcctactcttccgccgatcaagaagcgggaatcattgcgcgatgccgcagtcggtgctggtggagcgcgcgacgagcgagtcgctcatcggccccgactggtctctcaaccttgagatctgcgacatcctcaaccacgacccctcgcaagccaaagatgtagtgaagactatcaagaaacggattgggcacaagaactcgaaggtccagcttcttgcattaacgttgctggagaccttgattaaaaactgtggtgattttgttcatatgcaagttgctgagaaggatatacttcatgaaatggtgaagatagctaagaagaagcctgactatcacgtcaaagagaagatactaattctgatagacacttggcaagaagcttttggtggtgcccgtgcaagatatccccagtattacgcagcatatcaagagatgctgcgtgctggtgctgtatttcctcaaaggccggagagtaccgtgccaatctatactcctccacagacacagcctctaaggaactatccgccttctgcattgcgtaacactgattatcgacaagatgtgcctgaatcctcttctgcaccagaagtgcctgcattaagcttgaca

SEQ ID NO: 22722 - DNA, 521 bp, Sorghum bicolor
  Clone ID: 14513327
gcacgaggcttctctccatgtcttcaacggctgtggttttgaagtttctgatggaaagaaatagtatcaatgctcttcatggccaagttacagtcgggacgcttatattgcaggattgtgctgttggcttgctgtttgcacttcttccaattttgagtggtacatctggccttcttcacggagttgcatcaatgacgaagtcgctggtggtattgatatcattcctgaccattctctctatcctctcccgcaccggtgttccttggtttcttaaactgatgataagtctttcatcacagacaaatgaactataccagctggcatcagttgcattctgcttgttatttgcttggtgtagtgataagttgggcctaagtctcgagttgggttcatttgcagctggagtaatgatatcaacaacagatcttgcacaacatactcttgaacaaatcgaacctatccgcaactttttcgctgctcttttccttgccagcattgggatgctaattaatgtacatttt

SEQ ID NO: 22723 - DNA, 508 bp, Sorghum bicolor
  Clone ID: 14513352
gcacgaggcttgaaaggagcttgtccagaaagaatgtaatccgtgtggttcggggctataaggatccaggttgcttgtctgggaaggtttatatttatgatggcctctacaggattcacgagtcatggaaggagaaaacgaagagtggaatattttgtttcaagtacaagctgctgcgggagccaggacaacctgatggggttgcaatctggaagatgtcccagaaatgggtagagaatccaataactagaggcagtgttttacattctgatctatcatctggtgcagaaaatctcccggtgtttcttgttaatgacattgacagtgataaagggccacaccatttcacctataccactcgggtcaaacacttgaaaccactcagttctgtgaaacctttagaggcttgcagatgccttagtgtttgtctgcctggtgatgccaactgctgttgtgcacagcgtaatggaggcagcttaccttacagctcatcaggattgcttgtatg

SEQ ID NO: 22724 - DNA, 644 bp, Sorghum bicolor
  Clone ID: 14513356
gcacgaggcccccttcctagattttctgcattctcttctggaatttcagctcaggaagtgtctaagccccctactagactgccttctccattttcttctggtttttcatctcaggatggacctaacacctcttctaggttcccttctgcattttcttctggacttccatcacatgatggccctaatcccccttctagatttccttctgcattttcttctggattttcatcacaggatgggtctaatcagtcatatggctcaacataccaagacaatcttctccaggatactgttttgggtggcaacagtaatcattaccaatctcagtttggaaggcacgcaagtgatatggagtttgatgatcctgctatattggctgtgggcaaagggctgatgcctggaattggcgattcagggctggagatgaaaaattctcctgcttttcaagcacagttgcaaccagaaagaagcgatccaaggtttcagttacatgtacagccaaatgtgcagtctcatcaaaacctgagattcacagaccctatgcaggatggcttgaaccatatgaatgataattatctggcatccagatttttagctcagaaccatgatcctatatccccttatgcgcagattccgcaacaacc

SEQ ID NO: 22725 - DNA, 510 bp, Sorghum bicolor
  Clone ID: 14513359
gcacgaggcatccatccatccatccgccgttccgttcctcagctggccggccggttccatccatcccagagagcccagctcggtcggcagctgcagcaatccggcgagacagagagagagagagagaggcgatccgagaaccactctcggcaacccaatccggcgcgcgtgcgtttgtgaatggtgaacggcgagccggcgggggcggagtgcacgcgggcgtcgctgctggggaggtatgagatcgggcggaccctcggggaaggcaacttcggcaaggtgaagtacgcgcgccacatcggcaccggcggccacttcgccatcaagatcctcgaccgcagcaagatcctctccctccgcatcgacgaccagattaggagggagatcgggacgctcaagctgctcaagcacccaaatgtcgtccgcttgcacgaggttgctgctagtaaaacaaagatttacatggtgcttgagtttgttaatggaggcgagctcttcgacaagattgct

SEQ ID NO: 22726 - DNA, 561 bp, Sorghum bicolor
  unsure (1)..(561): unsure at all n locations
  Clone ID: 14513365
gcacgagggccgccgccgccaccgctgcgcatgaattcctcgctatcgacgctcggttccccaccgacgacgatctccgccgcgatctgcttgacatcaaacgtcgcctcgaggggctcgcgcgtcggaggctagcggcggtcatcgacgcacaggaccaccctgctgtgctccgcctcgtccgcctattcccactgctcggacttgccgatgaaggactccaggtctacgtcgcctacctgaagaaggtcgtcgctctgcgtgcccgggcagactttgagcacctcgctgagctgacctctgcgacccaaccgacctctgagcggctggattttgttggctgcctcactcgtctctttaaggacattgtactcgctgtcgaggagaatgatgctgtgcttcgggagctcagaggcgatgatggtgttgcttatgccatcattgagctgcaggaggagtgtgattcacggggcacccagatcctacgccgttatgctgattacaggaagcttgcacgccttgcatcggatataaactcctatacnaagaacctcctttcgg

SEQ ID NO: 22727 - DNA, 515 bp, Sorghum bicolor
  Clone ID: 14513374
gcacgagggggtgtagcaacattcgctccttattgttatatatttgtgtaacagttcctgatgtcctggggataaaatcaatgatctcgacctttttttcatgataaaattcatatatttttaaaccctgtattatgccctcactgttagcagtggttaccgtttgtaattccatggattaagagaataagaacaagctctaacaatcacgctttggttgtttcatataatatcttctacattaattttgatgtttttgaaggcttttgtttgtctattcaccatttctggacgggctgcaaggttataaaaatgaatattgctcctacagggcactttcatgtaacatgatttgccagctcaacgcctactgtacaggcccggcatgcatgttccttctgttatcattcctttgtgacgtggagttccacctgtgctttcgagaccacagcctgaagcagcctgtgcatgtgaccacacctccgccacagcgaagtgatcgttgttccaatggc

SEQ ID NO: 22728 - DNA, 511 bp, Sorghum bicolor
  Clone ID: 14513377
gcacgaggcaagggcgtcagcgtgctcgtcacgctaaccaacgacttcagcaaggtcctatcaagcataaacgggctgcaaattggtggtgaagcaaacttgattgctgctatccgggtcgctcagcttgcactcaagaatcggaagaacaagcagctgcagcagagaataattgtttttgttggcagcccagtaaaagatgagaagagctcgctagaagtgctagggaaaactctgaagaagaacaatgttgctcttgatgttgttgacttcggtgaatctgatgatgaaaagcctgagaaactagaagctcttgttgctgcagtcaatagtggaggcaacagtcatataattcatatccctgcaggaggtgtcctttctgatgaaatcttcagttcaccaatattatcagaagacccaggaagtgattctgctgctgctgctagtggagcatcaagttttaaatttggtgtggaccgagagctggcgctagcactccagatctctatgg

SEQ ID NO: 22729 - DNA, 476 bp, Sorghum bicolor
  Clone ID: 14513379
gcacgagggtcactcgcatctcgcgggatcagaccccagcgccgccgtcctcattcttcgccccgcacgccgccacacgaaccacctcagcttcccgcgccactaccctcgctcctcggcctgccgccgcacgcctcccgcactgtcgccctaagccctcggccccgcgcaccgccgtcctcggctctccgctccccgcgacgccgcccttggctctctgcccccccgcgacgccgcagggacctgcgatccatccccgcacgaagcagcgctcgtccaaggtgggacgagctagtccgtgaaaattttgggggcagggtgaacccggacctgaggtatattcgctggtttcggcgtttcggcagcgccgcctgcgcccactcttccgttcgatttggtgggccgacgtctagtacagcgcttcccgcacggcgatgtcggcgacgccgctgcccccgccgggccccgacggcgcg

SEQ ID NO: 22730 - DNA, 644 bp, Sorghum bicolor
  Clone ID: 14513390
gcacgaggcactccattcatcaaatggcgctgctgctgctgatgatgacggcagtgctgctgcttcagcagcaggcactggccaccggcggcggcgaccctagcttcgatgaactccggtacaggcggcatcgcgggttccggcaccgcaacgcgccgccgcagactcccactgcgccggcgcagcccgtgcacccgcctcctccaccaccgacgacgaggcactgcaacgacacgctcgcccccgaagagtctctcacggcgagcggcgatgtctgcgtgccggtgccagcgccgtctccgccggtgccgcctccccgccgaggcctgcggtgcccgccgtgcacctgcccgaggccaccgcagccgccacgcccgttcccgggctggccggtgccacggccactgccggtgccggtgccggttccggttccgggcagcaaagccggcggcgatgccggctacgactgcgtgacgcctctggcgccgctgacgacgtgcggggaattcatcacgggtaacgacaccgagacgcctgctcccaccggcgcgtgctgctccgcgctcgcggcgttcctgcgcgcgtccagcgccccggcggcggccggaggagggaccacatgctgcgctgcctgtgcccggtca

SEQ ID NO: 22731 - DNA, 473 bp, Sorghum bicolor
  Clone ID: 14513392
gcacgagggcagctcccattaatggactgcgcaacagcttaaactacgccgcccatttcaaaaggaaccgaaccggccgcagcagcgcagcgggcacgcgccttgggggtggagggaatggcggaggcggcggcgatcctctcgctctccgcggccgccgtggtggaagacgtcctgcggcagcacgggtgccgcctcagcgaccgcgacctcgcgtcccgcagggccgaggaagccgcggcgaggaggaacgaggcggcggggtggctgcgccgcacggtgggggcggttgccgcgcgcgatcttccggaggagccgtccgaggaggagttccgcctcggcctccgcaacggccagatcctctgcggcgcgcttaaccgggtccacccgggcgccgtcccgaaggtggtcgtgaacacggcggcggactccgtgctgcaggccgacggcgcggcgctgtcggcgttccagta

SEQ ID NO: 22732 - DNA, 259 bp, Sorghum bicolor
  Clone ID: 14513396
gcacgaggcacggactccgacgcgctgcccgctcgcctggtcgcctgccaaagcccctcccccacccccctcgccggcgatgctgccgcgtcgccgtagcaaccacccgggttcgtcttcccccctcccgttcctcctcgtctgcggcctgctcctcgctgcggccgtcgcattctcccccgacgctgccgccgaggccgctggccgcggcggcggcggcgctgggcacgagggccgcgcggggaagccggaggtccag

SEQ ID NO: 22733 - DNA, 574 bp, Sorghum bicolor
  Clone ID: 14513405
gcacgagggagaaacagaggggagctagcgaggatcacatatctcgtagcgtgtgggggctccggcagggagagtgaagcgaagcgaagataatggaggtggccatgactgtgactgtgacgaaggtggtgctgagcctgtgctgcgtgggggcgtgcggcctcgccgtgtacctctaccacatcctctggctcgtgccgcagagggtcctcgccaagttcaaggatcagaggatcggcgggccgcgcccgtcgttcccttacggcaacctcgccgacatgagggcggcggctgctgctgcgaaggctgcgcgcgcgtcggcatgccggagcggcggcggcggcggcggcggcatcgtgcacgactaccggccggccgtgctgccctactacgagaaatggaggaaagagtacggtcccatattcacttactccatggggaacgtcgtattccttcacgtgagccggcccgacgtggtccgggacatcaacctctgcgtgtcgctggaccttggcaagagctcctacctcaaggcaacgcacgagcccctcttcggcgggggcatcctcaagtc

SEQ ID NO: 22734 - DNA, 636 bp, Sorghum bicolor
  unsure (1)..(636): unsure at all n locations
  Clone ID: 14513416
gcacgagggtatgttgagagctatttccttgatgatttcacagcatgtaggaccatgggcactgtaaaaaaagttgctgttgcaccatatgttcatttgagaatatcagtgtttagtgttgaaaatgtactttgaaatagtaaaacttgtatgagtcagtgagaatttcctactcaatggaaggttaaatggggattggagagcccctgctctatgttggaaatgtagtgggaagtagttatgtaggctcaatatactgatttaactatcgtattttttcaaatactcatgccatgctaaacaaagctgatatattcattagatagctgatccaggcatatttagcgaaaaaagcaaataattggaaatcatatattagcttgaattatgtgggatctttgattcatgaaaacatgtagttctgtcaggagtagtttaaaaggcttaagaacagaatgctgatatgttaccttgattccttgagtaagtaggatctttcattattggtaacatgtggttttgttacttaaaagactggtccatatacctatcatgtcagnttggggggattttgtgattcttctctagataagcggcgaacatgatgcaaactattgtttcgtcgctcttctaaaa

SEQ ID NO: 22735 - DNA, 590 bp, Sorghum bicolor
  Clone ID: 14513418
gcacgaggcttttgggttactatgagtaggctttggtgaatggacgccttactgtacaggtacaggtgcaggtgcatctgttgataggcccatttatgttatgtttttatatgtaccatcaccaactaatttgaaatgtaggaaggtactcaataactctaagataatacctaatggcttattatccaccatctttgctgaatgtttgtcgaatgtttacttttgacatcaatacagactactagttcagcatgtgtttaattttgatttgacatgaatacagagttatagactactggttattttcccgctgtgctgcacatgtactgattcttctatattgcttcaggttctaaggaaattcatataccaaatatatgtcatgcattttagttccaaggcaaccaactgctggaaatagaagtggcttatagcaacaaaggaggaccagaggacttccccttttcatggcatgataaaacactactaattcttgatttgatttatgtttccatcttatctgtacttgtagactataatatgcatttattgaaaacatctttatcttcttgtgatgcgtgcatgaagtt

SEQ ID NO: 22736 - DNA, 520 bp, Sorghum bicolor
  unsure (1)..(520): unsure at all n locations
  Clone ID: 14513428
gcacgaggggaacagttcacaagaggagctgggctgagatcgatcaatccatccatccccttccttccacaccaacctcccaccgcgtcgcttagcgctcgctcaccactgctctgctccgtcccgcgtcgcgccccgcgccggcgaatgctccggccctcctcgccgcaggagtatgtataaatgttgccatgcttggaggtcgcgtttatgatcagaagaaggcaatgatcaacttattcgacctcagtgcagggatgtctagcacgaacgtgctcacagatcgagctcgtacagatggttctccagcatgtagaaacaagcaagctgtcaagagaacagttgattctgctaaagtctatgccgatgataaagtaggagctagtaactggagctcatcaagaaataaatcanatgcatctccattgaatgtggcattagaaaaggagatgtccaaggaattggaggcaaagaagtcaccaagtgtggttgccagattaatgggacttgaagaagatct

SEQ ID NO: 22737 - DNA, 540 bp, Sorghum bicolor
  unsure (1)..(540): unsure at all n locations
  Clone ID: 14513432
gcacgaggggctggcgggcggtggactggtggctgctacatcaatggagagagaatcatggtgaggcttctcgggtgtcgccccctctctttctctttctgctgcgccattgcgccagtgcggcggcgacctctagaatccaaagcaaactgtagcgagcagccccttatctactctccgcggtccacaccgcgcgcccccgcagcaagacgagagctccaccgcgttgttcacttcttctgacgaaggatggcggaggaagtggatgagattaaggagccatcgttggtggcggccggcggcgagctagatcgaacagcggcgaccacggaatcccttccgcaaatttcgaatcttgagtggggaaaggcagcgtgcaccgaggatgccatccagaagtgtgtggcggccggcgccttccatcccggcgagctgatcgaatggcgagcccccatcanagatgagacgccgaggctatccatcttggaggatcagtttgttatcctgtctctgacgcacataatttgcggtctgaggttg

SEQ ID NO: 22738 - DNA, 587 bp, Sorghum bicolor
  Clone ID: 14513444
gcacgaggctcatacattcgacattcccctcccccctctccctcccctcgtcccgtcccgctcccgccgctgtagccgcgattccaatctgccctcccctccgccgctcaccgccgcgttcaggccgcaagcgtctcgactcgggatccccagccccacctcgcctcgctcgagccacgctcccgccgcccaggcgtccgccggggaggcgtcggtggcccaactgagcagcctctcctcgtcggggcttgttgcttcagagggagaggcttcctggtcggcgcgccgtgagaagagcagcagccatgtcgcagacgaactgggaggcggacaagatgctggatgtttacatatatgactattttatgaagagaaatttgcaggcaactgcaaaggccttccaagcagaaggaaaggtctcttcggacccagttgcaattgatgcacctggtggctttcttttcgagtggtggtcggttttttgggatatattcatagcaagaactaatgagaagcattcagatgttgcagcctcatatattgagactcagctcatgagagccagggagcaacagcagcaacagaca

SEQ ID NO: 22739 - DNA, 259 bp, Sorghum bicolor
  Clone ID: 14513458
gcacgagggaaaagccgaaacgaagcattcttccaccgccgccttcaatcctctccccggcgcgcgccgaaggccgaaccaacgagcctcgcacgccggcggtctcgattcgggggtggggaggaggagggggaggatctgagtggccccctgatctgggtaccgggcgaaatgaggctcctgcgggttgccacttgcaacctcaaccactgtgcgatggacttctacaccaacctccgcaacgtcaaggagtccatct

SEQ ID NO: 22740 - DNA, 552 bp, Sorghum bicolor
  Clone ID: 14513462
gcacgaggggagctagttgtgattgctacgacttataaggtaacgtaggttttttgctaccgtaaagtatctgcagtggagcagattaaggcatctttacgaagaaagaactacaaggaagctatttctttattagaagagtttgagtcagatggtgaaatttcaaaggaaatgatctcctttgtccaggcacaacttggatttttgttgttttttgacttgcgtttcgaggatgctgtaaatcatttcttgttatcggagactatgcagccatcagaagtatttccattcattatgcgggatcccaaccgttggtcagatctggtgccaagaaagcggtattggggtttgcatccaccccctaagccccttgaagaagttattgatgatggtctggtagctgttcaacaggcattgtttctgaaaaaggcaggtgtggatacagttgtggatgaagatttcctttcaaatccaccaagtagagctgatcttttggaactagcaatcagaaatattatcaggtacctttgtgcatcgcggatgaagaattta

SEQ ID NO: 22741 - DNA, 633 bp, Sorghum bicolor
  unsure (1)..(633): unsure at all n locations
  Clone ID: 14513464
gcacgagggctatctctcacttcattcaccaccaccgcttcaccccagctcttctgatttctacctgctgggcggcgccggtgatccccaccggccggtcgagcacaccctccttcgccaccagattccgtcaccacgagttgtgacttttgttgagttcagggtcaaagcatctgcatctccatctgcgttcaaaaccattctcgttcccgagctagcaccacagttggctctgctggatttctgccttctccgccgacggtcattcatcactggccagccggtgagcgaaggttcttgaactcatctagtctctaagatgagcaaaagtaggaagaagcctccggacagcgaacaaccatgctactcccgaatgtgatgtgaaacttattcgaattggatggtataggaaaataagagtcattacattggactggtcattatgtgacgtcaagttctgtatgaagctttcaacttgggcagacaatcttgcaaagctggaagaagatactgaagcaactacnaatggagtttcagcaggttccttcagctgttaaaaaangttaaaacaaattaaaacatgacataatggtataacaccaaaaaaaactatgagccactaaatcatacagt

SEQ ID NO: 22742 - DNA, 510 bp, Sorghum bicolor
  unsure (1)..(510): unsure at all n locations
  Clone ID: 14513483
gcacgaggcaccgctgtttctgcgcgtatcgctaccatcggtcctctgtcgcctccagcagcgcatcggcgacggcgacgtcgagctgttgcggcatctaccgagcccactcacggagtaactcctcatgatgcccactgagcgaatccggtcagctccatcctcgatggcagcagatctgggctcgagggcagcggatccgattggcctacaccggctgctctgcgacgaggcctcccaagatacgcgcgtgccgctgttgatgtggttggaccggtggctgcgtgttccacgccctcatccctctcatgtgcctccatgctcaccctgccatgcgctcctatgacaacactctccatttcggtagtccgcanagaggtcaaagccctatttcaacctgccactcttcattgcctccatgccaacatggacgcccctctggtagaggtccttcccctgtctttcatcttgtgtttcagatttttttggcagaggacttcttgattttgc

SEQ ID NO: 22743 - DNA, 555 bp, Sorghum bicolor
  Clone ID: 14513489
gcacgaggctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccctcgcaccgtacgcgtcggctaccgaagctgctccgccgccccgacgccgctcggcgggccaccgccccgatgcgccgccgcaggatctaccgccacatccgtcgcctccccacgacagaacgcgttgctgcctccgctccacgtcatcttgcacgctagagatctcaccctgtcgtccatggagggaagccacgccattgagcaggggctaggtgaaggacccgatgaacacgacgcctgctggagaagccgttggtgtcttgttgccgattggaccccacctcttgttcgtggtgcagatccgggtcacaagttcaaaaaatagagtgtaaccaaggagcatatttaacctttccaaagaatacaaggctgagttactattaattgttttcatt

SEQ ID NO: 22744 - DNA, 547 bp, Sorghum bicolor
  Clone ID: 14513495
gcacgaggtgagcaacgacgacgacgcacacgacggcccggaaggaggccgggagcgagagagcaagatgaggtgcaagcagctcttgccgccgtgcgccgtctggcagctgctcgtcgtcctagtcttgtcgtcgtcgtcggcggcggcggcggcggcgccagttcccgcctcatccaccactctccgcgtgcagcagcgctacgattccatcttcagcctgggcgactcgtacgcggacaccggcaacggccccgtcgtcttcggctggcacgccatcgccagccccgtgatgcgcccgccctatggctccaccttcttcggccaccccaccggacgcaactgcgacggccgcctcgtcatcgacttcctcgctgagagcctgggcctgccgctcgtcccgcctttccttcgtcacggggcgacgagcttccgccgcggcgccaacttcgccgtcgggggcgccaccgccctcgacgccagcttcttccaccgctgggatccccccggcggcggcagcgtgttcccactcaacgtcagcctcgcc

SEQ ID NO: 22745 - DNA, 547 bp, Sorghum bicolor
  unsure (1)..(547): unsure at all n locations
  Clone ID: 14513496
gcacgaggcgctttactgttagcagtcagtcgccaccatcctcctcgtcgtcgtcttcctcgccgacctctgaccgccgccgctgcgcccgctgacatttgtctccccatccagcggccgcagaggagaacgttaccttgctggactggattcgcgtttatctacccccattgctcctggaccctgcttgggtttcgcagcgacgttggctgttgctactccctatccttctctcctttgcctctgctctgctctgctctcagggtcgctttgctctgctgccaagattgctctcaagcttcagatcgtggacccttccggccggttattcagagtttcagtcccaactcccaatacataaaacgcacttgctctaacaaattcagaaatggccgaggtgaagcctgaggacatggtgcatcatcagcccatggaccagctccagggcttcgagtactgcatcgactccnatccttcctggggcgaagggattgcgttgggcttccaacactacatactgtccctgggcactgctgtcatgatcccc

SEQ ID NO: 22746 - DNA, 522 bp, Sorghum bicolor
  Clone ID: 14513497
gcacgagggccccgcggacggagacagattcagccgaggagaggagccccgaaaagcagcagcagcagcgagccgcgcgccgcggcgcagcgaggcgtctcgtcagcgtcgtctctatcctcgaggaggaaggaagtggaggcgagggaggaaagcgaagcaagcaacggacgcccgccgaaagaaagaaagaaaaaaaaactgacctttttctccctctttctcctcgcattaaaatccccccccccccctccccgtgctccctctcccaaatcccgagctctccccctcttccgtcccctgccctacctcgccgccggcggcgcgcagatcgcggcccctcgcccgtaccgatcgcctccgcgcaccttcccgtccgttcctgctcgggcgacggcggcgattcctgcgtcgcatcgccgcctcctccttctcttcctccagtggctgcttgggctacggcggttcctgcggtcgcctccttcctccatcggctgcttggcggcgcctcctccttctcct

SEQ ID NO: 22747 - DNA, 358 bp, Sorghum bicolor
  Clone ID: 14513511
gcacgaggcggcggaccggtgtcaggcgaggcgagccaggccgcgtggtggctcgtcggcgagcggctgctgcaaagctgcgcatccgccgtaggtgaggcttcaagctaaacttgccggcggctcttcgcctgccgaagcacatttgccttcgtcgtccaagttcatacatacgaaggttgctgccagagtgccagtagcctgtaatttgacgcattcctgtcagtttcctctctttcaccttaaattactcgatgccttatttaaactggggacagtttgtgttgcttcttgtgtggtattataaacttgccatcagccgtgtgagcacaacctctgccacatatgtttcagggat

SEQ ID NO: 22748 - DNA, 644 bp, Sorghum bicolor
  Clone ID: 14513515
gcacgagggtagttcttctgcattgaagcactcagaaaggtgtatcattgtatataggtatttgcactactatatgagtgctgtgcttttgccacatctttgctgtggtttttgtcgagtttcaactcaacaccaactttgcttgggactaaattgttttgttgttttgctctggcgtcagatctcagatctgcaatgtcacttataataatagatcttacacataacagttatacaacttcacagttttttcttgaacgacagcttcataggtttatgtgttttgattttgataggcaaaaacccctgaacagattggcagaaactcacacacacaagaatacagacaaacgcagtaggtttggtggctggaatgacttagccttttctgattttctctcctctatatataggcagtgatgacctacattttaggctgtgataggctcctaataaatgcagaatattacacacttaatcaacctattactgctattacttcatgctgaaattaaggttataagctaaagataatgatatgaacctagacactagcatgcatctagacatatataactgtggttgcatggaacggatcgaccaatggtcaatggttttgatggctcatgtagtaattgtggcta

SEQ ID NO: 22749 - DNA, 527 bp, Sorghum bicolor
  Clone ID: 14513519
gcacgaggatcccaatttggtccctttccatcgtctccatgttttctccactgcaaacctaccataatcgtcatcatcaaccggataaagcttcgatttttaccgacagtcaggcatggccggcacgccggaggagttcccggtgcaggggggccccgagcctgagccgttctccccctccgtcttcctcgaccttcctccgacgccaagcgaagaggacccgccggcctccacggacgacctcgcgctaaccttcatctcgcgcatcctcatggaggaggacatcgacgaaaagttcttgtaccactaccccgaccacccagagctcctccaggcccagcagccattcgcgcagatcctctccgatgcaggcgcctcctccgattttttcgccaccaacaacgatggaagcggcgcctgcacccttccgccatcctcggacgtcccggcgttggccaacaccacctggcccttcgatccagtcgagttcccccagctgttcctgtcctcgccatgcccagacatgg

SEQ ID NO: 22750 - DNA, 538 bp, Sorghum bicolor
  Clone ID: 14513522
gcacgagggcttcgtcggcgccgcactctgcctcgagctgctccgccgcggcgcgcgcgaggtccgctccttcgacctccgcgccgtctccgcctggtccccgcagctgctcgacgccggcgtccgcctcatccaaggggatgttagaaacaaggatgaagtggggagggctttccgcggagtggactgtgtcttccaccttgcttcttatggcatgtcagggaaggagatggtgcaggctgggagatgcgatcagatcaacataagcgggacctgcaatgtgctcgatgcttgccatgaacatggtgttagaaggcttgtttatgtgagcacgtacaatgtggtgtttggagggaagccgatcgccaacggaaatgaggcgctgccttatttccctatcgaagaccatgtcgatgcttatgggcgcagcaaatcagttgctgaacagttggtactgaagagtaatgggcggccggctaaaagtgataaaagtacatgtctttatacatgtgctattcgccctgcagctatatatggc

SEQ ID NO: 22751 - DNA, 483 bp, Sorghum bicolor
  Clone ID: 14513523
gcacgagggctgcggcaggtagttcacacggttcgcgccgcaccccctccgtacagccatgttttttatggcgtgtcatctctggtgttaccctagggttctctgctcgaggggtatgccgggctccgcgcggcgccggcgccgcggtcgacgatccctggtggcgatgaacgtggcttggggtttgcgcgcagctacttgacgtcagcactagggagccgggcggccgcgcccaccggggcgggaaaggtcggagattggaggttcctgctcgccagctcgcagttccggcggttattctctgatgggtccaacaaggattatgagaagtaccatccaaaggagaaggagcagaagcccgagggggacgggagtgacaagtctgactccaaaaaggattcaaattcaaacaatcaatggaatttccaggaggatgtcatgaaaaaattccaggaattccttgctcctatacttcttcttggg

SEQ ID NO: 22752 - DNA, 647 bp, Sorghum bicolor
  Clone ID: 14513532
cattcgtgggaataatttgaaacagacaatggggggtacaaatgcattttgttgcctgcaaataggaaatggtcctccaaggcaaactaaggtggtaaaccacagcatctgcccagcttggaacgagggtttcacctggttatttgatgtcgctcctaaagggcagaagctctacatcatatgcaaaagcaaaaatacatttggaaagtcaacccttggaagagtgaccatccagattgacaaggttgtcaccgagggtgtatacagcgggttcttcagcctcagccacgacggtggcaaggatggctcaagaacccttgagatagaaattgtatggtcgaataggccatccaacgacagtatgtagcatatggatgatttacctgacggctgacgccaaccttatactcctggcttccatgtaaatcagccccccataatcatccaaatttcatttatttatatgtagaaagttaaaagacgcttagataacccatgccatcattcgattattgagtaactctcgggagtgttagccttgctgctgtaacagattttggacctgagtaatttttttgtacagttgaatttatttaatgtaattatatattagtgttagattggtgtaagtgcggacaaacattgcg

SEQ ID NO: 22753 - DNA, 574 bp, Sorghum bicolor
  Clone ID: 14513547
tgagaaaataactcagatggaagagcagctggaacttcttagaattgccatggatgacaagatcagattttcgcaaaggcctggttctggagcaggcagggttatagcatcaccgccaactaattctgtagatgaaccccaaataaaagagtccatggaaaggccacgttcccgcagcggcacagagcaatatccaaaaccaactgaagaaaggtgggggtttcaggggagcagagatagaggctcttttggtggcaacagaatttcagagaggtcgtcgggaggacagaggtggtgagactctaggggtcagattttttgaaactgcggaaaaataagttatgttcctcttggtacttgactctcattttgtttggcttggaagagcggagaggatcgtgggcaatacagattacgttgcaccaagctgttaattaccacctttatggtgtttcttccatttcccttttttttgtgtgtaatttttcttttgccctcctcttccatgtcgaaacaggtgctttgaacctttcataggctaactattgtcgttgattcctgcataactatatgc

SEQ ID NO: 22754 - DNA, 559 bp, Sorghum bicolor
  Clone ID: 14513553
agagcaagactacaagagagggaagcaacagtatcaagtaattctacaaaagcgtttgggcagaaggatcaacacgagcctttaccatcaaggaaacggaattatgcatacgcacccaagcgttattcgaatcctattgtgctgactggaaggcgaccccaagctttattggacagtaaaggaagaagcagctctaagggaagcaatgaaaaaattcaccccacgggacaacgggcctattccgtgggttcagatactggaacacggcagaaacgtgtttcacaggacacgcctcccatgtgacctgagggtcaagtggaggaacatggaaaatagaggagacgcgtgacgctgacagtttcaccccctgatctagccaacaatccacgtctaatccttccctgacctcattgaatatcctcatgtaagaatgtaaatgcattgtgctatattctcgccaagtagggaccagaaagttttcgtcgtccagcagttgatgttcatggatgctagttaattttggatcattaagaaactaggagaattgtttttctgtggg

SEQ ID NO: 22755 - DNA, 442 bp, Sorghum bicolor
  Clone ID: 14513555
tcttcagtctcacagttggagagatgtgcaacaggaatccaagaacaataactgcggaggcaatggcagttgaagccatggagaagatggagtcacctccttcacctgtacagttcttgcctgttatcaacgataacaacatcgtgtgtgggatcatcacattgcatggattggtctctgccggattgtagacttttgtgcatcatcgacttctgctggattgtaagcttatgtgccagcttaccgggttctaaacttctagttgcagttgcagatatccttgctgcccaggaggcattttattgctagagtatttatgtgaagcctagactctttagtgtacccttatgtatagtggtggataagaggaatatggtacactgctgttttgcagttggctgttaaataatgcttgtgttttgtacataacttatttaaaatg

SEQ ID NO: 22756 - DNA, 522 bp, Sorghum bicolor
  Clone ID: 14513560
ctcaaccttcccaatatactgctgaacgataacatggtcccaaaaatttatgattttggtctctcaaggtggttcaaagaaatacaaggtggaactgtgacgtcaacactagttggatccatcgtgtgacgatgaggcgatgacagcgtggccggcaaaaagaaaggtttgacgaccgcacgtcactgctacttcctactgacggtgacgtgtccgcgggtgatccgttttactccgaggagcagcaggaccagcagcaattccccttcaccgaagatgaaagttactatgaagaattccctgaggacttctaggttggcgatccaccagtcggtcgtccctgtgattggagctgccaagcttagctagatatgtgttttattccgctcgttgcagactttgatatttgtgttgtaataacgttatgtaagacacttgtgatgatacatttgtaatttgtcgacttgtgtgcgcgactattcctggggcgcacatgaggtttattgtactcaaattatcctt

SEQ ID NO: 22757 - DNA, 307 bp, Sorghum bicolor
  Clone ID: 14513561
ctcagatgcaatttcccatttgagataaatgaaacatggacatgattggattgctgattcagtaaggcttgtccaagtgggttcaaaaatcaaaacccccagataacttatgaagttgagcatgggttattgttccttgcttgcattgccttccatggtgtttgtttgagtgccaatttgaggtgccactacatgtcgagctgtgttggctcagtttttgggtttgtggaggagggctatgtatttccgtggctgtacaaagaagtaaaatgaagccctgcccccccccccccccccttttttttct

SEQ ID NO: 22758 - DNA, 537 bp, Sorghum bicolor
  Clone ID: 14513572
cccactctcagttcaagctggatttacaccatctatacagtggtcatggaattgcatggtggtggcgccagctctaattctcggatccaccgaagagagcaacttgccaagagactactcaatcaccagcctaagttggacaaatttggcataaaatctcgtgtaagatttgggatcagtctagcggaaaaactgctcacgagggagggcaaaaagaaggattcattgcgaatagtcttagatgtgtggacagatattctagtctacgtggccaaccgatgcagcagagagtcgcatgctaaacagcttagcataggtggcgagtttacaactctcatatggcttatgacagagcactgtcatcaagccagttacaggccaacctcttagttagggatggcaatggccccgtccactgtttcatggctgatcttattaatcctcatacttgggatgtggttaaatatgacattggatctgtgcatattttatatcatataaaaacattatatgaaatgtcgagccacatttgattct

SEQ ID NO: 22759 - DNA, 613 bp, Sorghum bicolor
  Clone ID: 14513590
taagccttcttgcagttgctgttgtattttacatccaggataatatttcaaatgactctgacttgtataacatcttaagtatggtgtccttggttggtgtcgtggcttgtgccattgcctactgcttcggtatggctgccattccatggatcattatgtctgagatccttccggttagcatcaagagtgtggctgggagcttcgcgactcttgccaactggttgacatcctttggagtaacaatgacagcaaatttgcttctgagctggagtgctgcaggtacatttgcctcctacatgattgtgagtgctttcactgtcatgttcgtcatcctttgcgtgccagagacaaagggaagaaccctcgaggagatacaatggtccttccagtgagctccagcatttcatcagtatatgcaattagcgaggtctggtttgagccgtatgtggtgtggtggctcagatttgtttttctttccttcttgtctcctctctctttgttttctgtgttgctaggcacttcacatgcaggtctgttcctatttgtttgtactatactttcgtgggttgtttcccttttctcttaatgaaacacgcgcataacacgttctttt

SEQ ID NO: 22760 - DNA, 613 bp, Sorghum bicolor
  Clone ID: 14513592
tttgttgtgtacataaaataaaaataattgatcaggatcttcgattatcctgatcaagggtgcgatatttgtgatgtgagctgtattgtctgcttttacttgaaatatttgttttctcattgaattgtgacctgggaatcaccctattttgatccattcactccaggtactggatagaataatttcaggcgtggaagaatttggattctgcaataagggttggatcgaatctcctataaagggtgcagaagggaataaggagttccttgcttgctttcacaggatcccaatatcagaatcacagccagatgtagaggcaaaggaacctgtaacataggatgttatcagaaattactcaaataagcatggttatcaatcagaacagcaagtgatgtcgatacagttctgatatttttagttgtgagataaaatttgtccagcttagtccagttctgatactagagatacaaaattttgaaacacatcctgaagtttcagaggtacgcttgttgttccccaggagagcaagaacaaacacacaaaatagtcagccttttgttcatcgtagagtactgtaaccagattgtgacataaatttactgctccgttgcct

SEQ ID NO: 22761 - DNA, 550 bp, Sorghum bicolor
  Clone ID: 14513602
tgcgaagaccttaatgtttgtgaacgtttcaccagcagagtctaacttggaggagacttacaactcactgatgtatgcttcacgggttcgttgcattgttaatgatacgagcaagcatgttgccccaaaagaaatcatgaggttgaagaagttgatcgcctactggaaggagcaagcaggcaagcggagtgatggagacgaactagaagagatacaggaagagaggatctcaaaagagagggcagacaatcgcttgactggctgacaatgtgacgccaccactgaatgctcctggtttcattcttgcattacctggagaagaggtgattgatgctgatgagcatctgcgactgccacgagttctgctatcgctctctaacagaatgctccgatgtcatctgacggtcctgtacactaactgtatagtagctacgtattatactatggcagcgatgcccgtttgtacaaagaagaatgtagcacatattgatagaaggggaaaaagttgagggctaactttttttggaggcttgatgcgccctaagcccct

SEQ ID NO: 22762 - DNA, 478 bp, Sorghum bicolor
  Clone ID: 14513630
gacctgtagggttggcaatgttgccacctgtatggtggttctggacgagggcatttagttcaaacctgaaatgattcctagagatttggatctgtattgaggccctggatgttgcaagcatttctgctctgccgaggcccgaggggtacaaggttgagagccacaaaaggggttgggtgccccactgcaggacaattcacaggtatgcagaattttgctttcattgcattgcattgcagatttgatgattaaagtcaatcaagcaaaaaaaacacctctaatatatacactcgtatggctccgttgtaattccctccattttgttttgagtggacaatgaatatcaagcaagcagccagcgtgcgtgcgtgcgtgcattgttgttcagttgatgctactagaggagtatatttctgtattcacaggagccatttggatttcaaggcacatgcacggatgcacccccgtgctcggtttc

SEQ ID NO: 22763 - DNA, 526 bp, Sorghum bicolor
  Clone ID: 14513637
gttctagtagttagcaacgaccatttcaccattgtcaagcctgttgattcaggcctcgcatcacaagaaggttcagacagcaacgtggcatcggacactcaacaatcgcccccgccaacaggcgaaggagaagaagaagctccgaaccagaacggccctgaaaaggataagcagaaagaaccagtttcagcgggctgttcgtcgcgccagctcttccctcctgggaggatcatccacatggttgcgctgcccccgccgctggacccaaaccccggcgacggcacgagcagctgtgagatcattgggatatacgagacgccgagggatttgtacgggaagatacgtctcgcgcccaacatgattaaagaacattacatgcctagctatataagtacgatggaatcgttgttggaacagcttcagaaggaggatgatgatgataccagtgtatgtaccgcatcaaatgacctgtgaattattgtagagaactccgttgtgaatattagtaatccaattctttctcgtc

SEQ ID NO: 22764 - DNA, 642 bp, Sorghum bicolor
  Clone ID: 14513655
tctctctgaatttgatgaatctcgagagataatagagagcctagttgatgaatacaaggcctgtgagtcgccagactacattaaatggggaatggaggaccctggagaggcaaacgttgcggcagcacttgactctaagttggtagtgtaaatgtaaaggtcctgttggtcatccaaagatgctactggcactatcttgtagtcatcagttcgacgccgcctgcctatctagatcctatcggagtgcagccaaagcgggttatgaagttatttcgacctcaaagtttgtctttctttagtctgtgctatgtatattttgaaacccacttgccctggcctgtgtgcattttccctttaaggtcttgtgactgcgctctttggtggtgatggtgatggtgatgttttcggtgtcctttaaggcttcgatgctgatagttccaattgtgccgagtgttccttgctgatgacttagaaagagttttagttgatctaatttgtgggcctggtccccatcctgtgatgctgtgcaatcgtctctggcaatgtttttttagcttgttgggtatgtaaacatgattttttttctctgaagagagcatttactgtcttaaaaaataaaaaaaaaactcgagggggggcccc

SEQ ID NO: 22765 - DNA, 333 bp, Sorghum bicolor
  Clone ID: 14513676
gctgagaaggaaaccgacagagttttgggggtgcacatcatggcccttaatgctggggagatcatccatgaggccgtgtttgcacttcagtatggagcatcaagggaggatttcgcccgcacatgccatgttcatccgagggttagtgaggccctgaaggaagcctcccttgacccctacacaaagccaatccatatgtgattgtagatatgatttgaactgtgagctcaaagcacttcccaagattttggaataattttgtagggagggggtcttgaaacatttagctttgtcatttgttttttgggggaaatagttccattgttaaattcc

SEQ ID NO: 22766 - DNA, 363 bp, Sorghum bicolor
  Clone ID: 14513680
tgcttcggctgggagatggagagatgctgcaaagattaggactgaaatgaggagagttgaattgagaaaggagactgggtggagttttgtagatgttggaggggttgagagttttaagtttgtgtcagccgatacaaggcatcatgatgctgaagaaatatattcagtatggcacagtatgaacaggcacatggcagatctagctgctgatgtgcacaaacttagtccaattagtgcagtttagtcgatgcacgagatgtttaatagatctagctgctgatgttttggtcaggtcacagtgatgaaatagaccttttgtagtcatgagcttagacataaaattactcctactgaaaaattttt

SEQ ID NO: 22767 - DNA, 376 bp, Sorghum bicolor
  Clone ID: 14513682
tcccgactacaaacccgttcttcttcccctagaccgcttttgacagctttttgttccggctgaactatcggcgtctggaatggcagctggtcttgtgtgtggcgtctagcagctttgcttgtcggtgaccgttgttaattaagtagtaataatgggagaaagtatgtgtgtgtgcgtgtgtgtgtgtgtgtgtgagagagagagagagagagagagagagagagagcgcgagccataagaagcaacatggctagtctccctctggtatgtggctgttgagatatgggctgttgccattgccgtggatctgccatggttgagatttgtacttgtaccccatgcatgaattggttctgaaatggtagtattttgttct

SEQ ID NO: 22768 - DNA, 406 bp, Sorghum bicolor
  Clone ID: 14513683
agcaaaagatgaataaggtgctcatggtggaggagatcgggatcggtgtggaacttgccgggtggcagcatgggctggtcaaggccgacgagctggaggccaaggtgaggctagtgatgatggagtctgaggaaggggagcagcttagagctcgtgtgacagcgcacaaagaggccgcaggcatggcctggaaggatggtggatcgtcgcgcatggcgtttggccagttcttgtcagacgcggccaaggttggacaggatcgtctgacacttggttgatggttgatgctttggattgtgagtcaaaatatgtgctccctagaaatattgtgttgttctaaaagatattgtgttgtgtcaaatgatcaatctcacaatacctgaaatgctattggaaccacattccc

SEQ ID NO: 22769 - DNA, 396 bp, Sorghum bicolor
  unsure (1)..(396): unsure at all n locations
  Clone ID: 14513694
tccacctcgccggtttagagtctttgcatgccaggtgtagcgcgcagcagtaatgtaatactaatatcgttcattagagattagtaccaagtttgttctagttgatgctgcttgcgcttaccaactatgcccttagtggtagtggggctcgaaatgtttgtgatagcttcggcgatgcttagctcgccgccggtttctggacattttttattgctttattcttggggcctttttgaatatgcaactgatgggctctttggtttggtttcttttggacgctgacggtgcctgattaccaggcctaattcagctatctcgaagcggactctgtctcattcgattcatgctgggggcatgcagttccgcccaggtcganagtgcatatatttttgcttc

SEQ ID NO: 22770 - DNA, 407 bp, Sorghum bicolor
  Clone ID: 14513702
cagtgtccggagggtcgatgaacccgatcaggacgctgggtccggccatcgtgctcggcaggtacacctccgtctggatctacctcgtcgcgcccgtcgccggcatgctcatcggcgcgctctgcaaccgcgtcgtcaggggctccgacgccatcctcgccttcctctgcggcaccaagccgacgagagcggtggcgcccagagccacgccgcgcgccgttggatcacttgcgtcgtcgccgcactactagccggccggccgccgccatcgtggtggtgggctactgacaggtggcccctctcgcttgctgtaacagtgaatgagtcaaaccaatcaacaaaacggcgcgacacaagtacacaactgatgtatactctccgttgtgctatatacccaacgtgtattc

SEQ ID NO: 22771 - DNA, 227 bp, Sorghum bicolor
  Clone ID: 14513714
cccatatagggccaccaagagaaatgcgattgttgcatgaatcactgttctgaaatgataaggtttatgatgaaaggcgaggattgttactaagggaggactgttactaaggtattcaattggtttgttcaggtgagggtaacgggaatagtggtgtttacctatttagaaatatatgaaatcttgaagattgatgattgttgtaaagtttcaaatgctattggttt

SEQ ID NO: 22772 - DNA, 363 bp, Sorghum bicolor
  Clone ID: 14513730
ttccaaccatgggtcataagctatgtcatgctgagtgaggctccaaaacaagggcctccgtggagcaaggtgtggagatcttgaagaccaacgctttccattcccattagcaagcgcaagcaagcaaggagcagccagtgatctaggacaggccctttgttcaagctgggttccgtagggcctgagaataggctgagtgctgtaatctgctttgcttttgtagtgcccttgttaatgctggtactatgtaggctgaatggtatgttggctattttggtcgccttgctcttgacccctaggtgatcggagtaatggctgtgaactctttaatttcgttgcttctaaagtaatgaaatcaaaggt

SEQ ID NO: 22773 - DNA, 419 bp, Sorghum bicolor
  Clone ID: 14513733
tggtgcacttccattttcacctgaggatgttgtattattagcagaaagcggttgtttcggtggcagacgcgagaaggttgtagagcaagcaccaggcagtacataagttaataaactggtgctgatgttgagcggcagcatttctttccccctcaatttgattagaaggcaataggacgatgggttggccgagccatttttgtagttgcagtccgtgatcccggagcccggtgctggagtcggaaccggaacgggtgcagttgatcgttccatggtatcatcgccttgtatggtgtaatgcatgttgtcagtgttgtcatgctaatttacatttatcccatgggaacatggggtatttgagctggtgattctaaccaatatataaattgcacacaggccccacatgtcatgataagtct

SEQ ID NO: 22774 - DNA, 616 bp, Sorghum bicolor
  Clone ID: 14513771
cgcatttgatacatggggatagaagggttgatatgaacatggcatcccctcccctgatgcagggcgacgccagagtggatatgaatatggtatcaacttttcagaatgggatgcacacttttgatttggtgaatataaacctggagagtggttctttgccgatggccgcaacagattttatgcaaatgcacccacacccagcagtttaccatcccaaacaattttttgatatgagagatcaggtgatggatgcaaataagagaccaaatatggaaactaacccttattttatgggaggcggtatgcatgtggggtagtttgattgtctacttctgtaatcctttatgttcagaattcagagagggcatcctttttttacatcaacatgtaatcatgtatgtttttagagctggcagtacaactaaacagttaggctttagtattgcagataagacttgactgttgatagctttattgtaacctgttacctttttagcagttgtagcaagccggatgcccattattttgtgcataatgaataagccgtggtatcatcttgttagcaatttggaagtgagacccctttagttgcaagattctgctgacatttcttgtt

SEQ ID NO: 22775 - DNA, 503 bp, Sorghum bicolor
  Clone ID: 14513793
tacattgatttcatactcctcccccgatgtagaagcagaagtccatcaatcactaagccggactgtgttcaccagtgagaggccgattatttcttcttgatgcatacaaagaccttctggtgtattactcacctacagctagtagcgaaatcccttttcctcctccacgtgactgtttactgagatcaacagtcgatagactaaaacaagaaaggaatataacacccaaactggttttcattcaaggagcacatgatgacacttcagaattcgagaaataccttgttgaggatcagaccttggatggctccctgttacctagctccacaggtttcagctcattccttgatgaggttagaagtaaagtggctgagcatagcatttgagtaccaatgtcacctttctcgattgttgaactgtgatgttttacgggtgatgaccacccatgcaacccagaagtactgtcatgagtcaaagagtgatgttatagtgctttgcttgtt

SEQ ID NO: 22776 - DNA, 481 bp, Sorghum bicolor
  Clone ID: 14513796
acaagtacaagtctgcacacaacaagatatcatctccagttatccctgtcctggtaacatgggccctcggctatatagtcgcgaagcttttctttgcggtggttgagatgtcgatcgacaccataatcctctcgttctgccaggacgccgaagagcaccaggggaatgcacagtatgcgccccctgctttgatggaaactctggatgaacagggcgaactgcagagactaactcaagggccttgactgttgtttcctcctgggcatcccttcttggtatggtagcatggaaacttagcagcaggctaatcttttgttaccccgttcccttggcgtgtgaagaggtttgccattttgcttgctaccctaccaaagtttcttctacaagtctgaatctgacatgttttcctggcccaattggcatgtgtaggcagcttatctaatatatatatatatgtgtgtgctattgctgatacagcgtt

SEQ ID NO: 22777 - DNA, 674 bp, Sorghum bicolor
  Clone ID: 14513806
catcagggacaaggtgagaaagatggtgtacagaaaccgtgatgaattcaggcacgatgtagcacagatacaactgaacgcacatctatacaatgatggtcgccatcctcacatccctccgcttgctgacgagctcatggaggtctgtgatcatctgcttgacgaaagcgcagatctgctcaccgaggcggaagatgctattgaatagcaatataataattagatttagcatgtggatcttgctatatcctaacatagatgatgtatttgctgatctgtaggagggaaaaggttgtatattttttgggtcctagcagtgcaatcccaaaatccagctgtttttacctactgttggtatagggttgggagttagtggaagtacaaaagatctaggttagtcactcagagtccgctgtaaccaataggcctcatgttgtaaaaatgtagaatgtaatctgtccatatacatggcttatatcggtccaataatctgattgtcttgcagtatttgatgtaatatgaatggcgaccaagtgctgcatgaatcaatagagtgcagcacgtgcctgtgtgcacgctttcgaacttttctaggtcttatttcaaccttacttcttatctggaggtgtacgcattgaaccctgaactacaaagctgatgggcaagtttcagtc

SEQ ID NO: 22778 - DNA, 620 bp, Sorghum bicolor
  Clone ID: 14513814
tcgcaacgacatgcctcctcgtcgtgctcaactgcctcagcagcttccagatctactccatgccagtgttcgacagcttcgaggcctactacaccggccgcaccaaccgcccgtgctcggcatgggtgcggtcagggttcagggtcttctacgggttcctctcgctgttcatcagcgtggccctgccattcctctccagcctcgcggggctgctgggcgggctcaccttgcctgtgacctttgcctacccgtgcttcatgtggatccgcgtcaagaagcccgagaggttcagcttcagctggtacctcaactggggccttgggctgctcggcacagcgttcagcctggccttctcgctgggtggcatctggagcatcgtcaacaatgggatgaagctcaagttcttcaagcctactaactaggtatatatagattgcttgcttgctccaatctgcaagatattagaagaaaatagttgtggaactgaattgttacatactattactactgctacatggttatgctgcataactgcataactacgttgccttcgtaggaacaatggcatgtatgtaatgtaagtgatgcctgggaaattcgaaatctaaggggctttgcgt

SEQ ID NO: 22779 - DNA, 688 bp, Sorghum bicolor
  Clone ID: 14513818
agaaggaagcaaggccagtgatgtaaaggttgagtcagttcagtgtggaagcgaacttagagagtgcggtgctctattttctgaatgttcagacaatgggcatgagttggaaaagggaggttctgcagatatggaatgtttctccatggaatgtgatgttagagaaccaaatgaatatgctactttggggaattcagaaaatgatgctaatgcgggttgctgctgccaaatagactcatgtcaaggtggaaacaattctttcagcagatctcccaaggtcaatgatattccagctggaggggttctgcggtatgctttgcacttacgttttctgagtcccttctccaagaactcatcaaaatcaaggcagcctggcaaattggatctgtcatcagaaccgcacactcgcagtaggactgagaaagagagaagattttatctttacaatgatattagagttgtcttccctcaaaggcactcagactctgacgaaggcgagctgcgggttgagcatgacttcccagcaaatcccaagtattttaacataagcaactaagaactccttgcacactcgtgaagctgcagatactttgtacataccatttggtcactaacttatcaatatgtactgcttattgccattgatgtacagactaaccttccaatgaaattatttatttcatctaaa

SEQ ID NO: 22780 - DNA, 580 bp, Sorghum bicolor
  Clone ID: 14513828
gcacgaggatcgcgactggtccatgagcaagaagtcgttcgcgccctctcccgccgactccgcctcgcggagccggtacggtggcctcgggggtggcgcgcccgcgtccgtcggccgcgccgacgacgatggcgactggtcgcgcgggaagaagccaccaccgccgtcaggcccgtcgcgctacccgagtctcggctccggcggcggcggcggcttccgcgactcgcccgtctcggccgactcctctgaccgctggtcccgtgccgcgccgagcaatggcgagcgtgagaggcctcgcatcgtgctcgatccgcccaaacgtgacgcctcggccactcctactccacctgttgaggcggggcgcagccgcgcgagcccatttggagccgcgaggccacgggaggacgtgctggccgataaggggctggactggaagaagatggaaactgagattgatcagaagaggactagccgccccaccagtccacactcgagcaggccagagagtgctcaatcgtcacgacctgggagccccgggtcacagatttcagccactgctactgaagccgcacccagggca

SEQ ID NO: 22781 - DNA, 546 bp, Sorghum bicolor
  Clone ID: 14513835
gcacgaggggaagggatggaggcgctgaggaagcaggcgagcaagttcaaggagcaggtcgccaagcagcagcaggctgttataaagcagttcagtactactggttatgagcggtcagattccgttgtaattgatgaggttgaactacagagacatcaacagcttgagaaattgtatacttctactcgttctggaagggatttccagaaggacatagttagagcagctgaaggtttggtgtctattggaaacaaacatattgaagtgggaacaaaattttctgaggactgctatagatatggaggtgaaaatactgcaagcgacgaagcccttggaaaagcagcatcactatatggaggtgctttgagaaatattgagaaagagtatgaggatttcaacagaattttatcttctcagactatagacccattgaggtcaatggctatgggtgcacccctggaagatgctcgtggtcttgcacagcgctatagccggatgagacatgaagctgagatcctttcggctgaaattgctagaagaaaggca

SEQ ID NO: 22782 - DNA, 458 bp, Sorghum bicolor
  Clone ID: 14513836
gcacgaggagatggttcgccgcatcacgcgcttctgtgactctcaacagttcttccgatccgaggatccccggtgatgaacggcatgccgatctctgcgtcctctgcggcaggcgtcgacggcggcgcggtggcggccggcacgcccatgaagaatgcgacagcggcggctgctgtcgccgagatggcgaggcatctcaccgtcgacacggaagacgccttcgcaggcctgctggagttcgccgctgacgacaacgcggaggggctgcgccgcgcgctggagcgcgcgccgcctgccgccgcggacgaggccggcctctggtacggccgccggaaggtcctggagcaccgcaccccgctaatggtcgccgccacctatgggagccttgctgcgctccgactgctggtgtccctcccgtctggtgacgtcaaccgccgctcgggcacggacgggaccac

SEQ ID NO: 22783 - DNA, 639 bp, Sorghum bicolor
  Clone ID: 14513840
gcacgagggaccgtccaaactgcaagcttgacatggttaaagctggtatcattgagcatgcgcttgatatgattcttgatgttcctgtatctgttagttcatccattgctgaattgcttcgcattttgacaaacaacagtggcattgctaaaagttctgctgctgcaaaaatggtggagccacttttcttgcttttacgtcgccctgatgttactatgtgggaccagcacagtgccttgcaagcacttgtaaatattctggagaaacctcagagtctagcagcattgaagttgactcccagtcaaataattgagcctttaatatcatttcttgagtctccctctcaagcaattcagcaacttggcactgaggtgctctcacatcttctagaacaggaacattttcaacaagatatcaccaccaaaaatgcagttgttcctctggtgcagcttgctggtattggaatcctgagcttacaacaaactgcagttaaagcacttgaaaacatctcacagagttggcccaaggcagtagctgatgcaggtggaatttttgaactttcaaaggtaattgtccaggatgatcctcagccaagtcaagcattatgggaatctgcagcacttgtgttatgcaatgttt

SEQ ID NO: 22784 - DNA, 484 bp, Sorghum bicolor
  Clone ID: 14513843
gcacgagggcttcttctacttcccctccaccggcctgcagcgcgccgccggcggcttcggcggcatcgtcgtcaacaaccgcgacgtcatcgccgtgcccttcggccgccctgacggcgacatcaccatcttcatcggcgactggtacaacaagaaccacacggatctgaggaagatgctggacaaggggaatgacctcgggatgcccgacggcgtgctgataaacggcaagggtccgtaccggtacaaccacagccttgtgccggccggcatcgagtacgagaccttcaatgtgcatccgggcaggacgtaccgcatccgggtacacaacgtgggcacgtcgacgagcctcaacttccggatccaggggcacaacatggtgctggtggagacggagggctcctacacctcgcagcagaactacacgaacctggacgtccacgtcggccagtcctactccttcctcgtcaccacggaccagaac

SEQ ID NO: 22785 - DNA, 491 bp, Sorghum bicolor
  Clone ID: 14513849
gcacgagggaagcgtctccatcacgagcgtacacattgcaattcacccccaaagttcgccggtgttcgggatgccgtccccctcctccgcggaatgcctcgccgccctctgggtcgctgataccctcgctgccggtcaggccttcgatttcgccgtaataaaggcgctggtgggcgcctcgcctgagcacttcatcggcgccccagattcctcgcgggagcgggtggcgctccggtgcctcgaggagcatgcaaccttcgccgatgccgacgaaggtggtgctgcggtggcgccaccaccttccaagattcttagggttgacgccgtccgctcttgcgaggacttgctggctgagctcaccgggcaggttggaagctctggaattctagataaggatataattctgccttttagacaagatattcaaaactttatttgtatcaagaaacctacactaccagaatcttctttggaattgcttggagaagtgg

SEQ ID NO: 22786 - DNA, 491 bp, Sorghum bicolor
  unsure (1)..(491): unsure at all n locations
  Clone ID: 14513851
gcacgaggcggcatttcctcgaacgccccgcgcgtgccgcgcccctcgccgcccatgggctccctcccggtgccagcctcggcggaatgcgccccgcaggggcgcgccacggtgtcggcgtcggacctggcgccgctcttctccgcgcagcgccggcacctggaccacttcttcgacagcctcgacatgtcgcaggcggcggcgttcgcgcaggcgctgatcgacgcgccgggcgccgtcttcttcacgggcgtcggcaagtcgggcatcgtggcgtgcaagatcgcgcagacgctggcgtcgctgggcttcgcgagggcggggttcctggcccccgtcgacgcgctccacggcgacatcggcgcgctcttccccggggacgtcctcgtgctcatctccaagtccggagcctccgacgagctgctcgcgctcgcgccctgcgcgcgcgccaagggcgcctacctcatctcgctcacctccgcggnctcggg

SEQ ID NO: 22787 - DNA, 471 bp, Sorghum bicolor
  Clone ID: 14513856
gcacgaggaggcatttggtcgaagcgtggccattcgtgcctccgcagctcagtactggctgctgagtaagtgagcagagtagcagaccatccatcatatgtagtccaatcagaaataatctgttagagcttagaggattagtgtctgctcaatacgccttgagaaagaatctattccactctcattaatccatttctgctaataatttccttctttgtttgttgttttaagttataagtttctcttcactgattacatgcatattcactgagccattcggctatagatggattctgaagataatatacacgatcacatggagatcacgtctaaatgagaccatgacgtgcttcttaaaaatgaagaacaaatcaagccgatagacctgccaatgtcacttctaaacgcgatcacaaaaaacttctctgatggtctacaaattggcagtggcgggttcatggtggtttacag

SEQ ID NO: 22788 - DNA, 435 bp, Sorghum bicolor
  Clone ID: 14513857
gcacgagggcacccgctgccaacggcgccgccgccgtgcttcctgcggccgcggggcctcctcccttaggggtgattgtggtggagagacaccaccacctccgcagggagctcatcgctgccattatcctctcatccgtcgccatcgtcgtgatcaccatcgccgcactgtatgccttcttgctgtggcgacgatcacggcgagccctggtggattccaaggacacccagagcatagataccgcaaggattgcatttgtgccaatgttgaatagcttcaactcatacaagactaccaagaagagtgctgccgcgatgatggattacacatctttggaggcagcaactgaaaaattcagtgagagcaatgtccttggagttggtgggtttgggtctgtgtacaaagccaattttgatgggaggtttgctgctgcgg

SEQ ID NO: 22789 - DNA, 228 bp, Sorghum bicolor
  Clone ID: 14513865
gcacgaggcggagggcccgaggagcgggtgctgatcagcgaggtcgcggtgcgggggaaggacggggagccgctggagcgggccgagctggaggcggcggccgccgcggcgctgcgcgcgtgccgccccaacgccgcgctcaccgtgcgggaggtgcaggaggacgtgcaccgcatcgtcgagagcggacttttccggtcgtgcatgcccgtcgctgacgacacccgc

SEQ ID NO: 22790 - DNA, 504 bp, Sorghum bicolor
  Clone ID: 14513869
gcacgagggaatggcatccactgattgattgaagctttagaattgctcaggtaccaatcactgctgcctgacatctcctcttggctgggtacttgacgaattttggtcaccagttactaggagctactgcacccgaatgcaggaggcaggattaacattggtatggctgctggacctttggaatagatgggcgacccagttccttgtggtctttagcctcatgcagcagcttgtcctgctcttctttgctggcgtccggcggcataaagacggtggtgtaaagatgggctttctctggctggcataccagctggttgactacaccacaacatacgctctgggaaaccttgccatcagcagtgctccgcatgagcaccaactggtggcgttctgggcgcctttcctcctcctgcacctcggtggcccagacaacatcactgcctactccctggaggacaacaagctctgggagcgccacttcctaactcttgttgcacaggtgct

SEQ ID NO: 22791 - DNA, 609 bp, Sorghum bicolor
  Clone ID: 14513877
gcacgaggcggcgttcgagcggccgctcacgagcggggtcgcgtatggggtcaaggtcacgcacgccgagcgggagcagttcgagcgccagcagggatggagcatcaagaagatgtactcctccaaaaccaagaagcagtcgcagggacaagggaacggcgaggacgccgaggtgcgggagccggcggaggagtatgctcccgtaatcttcgcgcaggacgcctacaagcacgtcatctccttcgacttgctatccggcgccgatgaccgcgacaacgtgctccgagctagagaatctgggaagggtgttcttactgctcctttcaagttgctcaataatcgcctcggagtgatctccacctacgctgtgtacaagtatgagcttcccccaaatgccacgccacaggatcgcattcaggctgctataggctatttaggtggcatatttgacattgaagcgcttgttgataagtcgcttcaccagctcgcgggcaagcaatccatcatggtgaacgtgtatgatactactaatgagaaaccgatcagtatgtatggttcaaatgatacaggaagtggcatgtgccaggtcagcacactgaactttggtga

SEQ ID NO: 22792 - DNA, 137 bp, Sorghum bicolor
  Clone ID: 14513886
gcacgaggctcgggctgcgcctgctcacggtacgggcgagcgcgcggtgtggcctcggccagctgcagagtggctcgcgaccaggaggccccggctgctgtgcgacaccgtctgctcgcgaccagttaccatcccct

SEQ ID NO: 22793 - DNA, 614 bp, Sorghum bicolor
  Clone ID: 14513896
gcacgaggcgcccccacaaaatcccaaatcctagacgaagcagcccagccgcccctccacctctcttggcgaggcagcaatgatgcagatgctaggcctccgcggctcgtctaaggaccgtggccgcgggggcgacccgtccccgtcctcgtcctccgctgcggcggggggcacagggaccccgcgctcgcctttcgcggcggaggcgggcggcgagggcgggggcggccggccgctgcggctggtgtactgcgacgagcgcggcctgttccggatggacccagaggccgtggccgctctgcagctcgtcaagggacccgtcggggtcgtctccgtctgtggccgcgcgcgccaggggaagagcttcatccttaaccagcttctaggaagaagtagcgggtttcaagtggcaagtactcatcgtccctgcaccaagggcctttggatgtggagtgccccaataaagagaactgcccttgacggaactgaatatagtcttttgctacttgacagcgagggcattgatgcctatgatcagacgggcacttatagcattcagatattctcattggcagtcctactatcaagcatgttcatatataatcagatgggtg

SEQ ID NO: 22794 - DNA, 540 bp, Sorghum bicolor
  unsure (1)..(540): unsure at all n locations
  Clone ID: 14513901
gcacgagggcagggtgaggaaatatgtgtagcacttcaaacgcatataaacgacgtcatgctccgcagatattcaaaagcacgctctgctaatagtgtgacatcacaaaatgatgttaaccaagcatataagccaccaaatatcgaaatgtatgagaagcgtgtccaagaactgacaaaaacagttgaggaatctcagaagaaagcagatcggttacaagaagatctacagttgaagacaaaacaagaatcggagatgcaagaagagttggaagggctaagagataccttgcaatctgaacgacaaagttccaaagaagtaaaaaatgagcttgataagctaaaatctctatgtgatgagaaagaatctgctttgcaggctgccctgatggaaaaaagtagacttgaaaccagattaacaagtgggcagggccgtgagagagatactgtgacaactgttggcagcgtcaatagtgacattgagatgcttaccaagcttaaggaggagttaaaatcataccanaaagagcttgatgcatca

SEQ ID NO: 22795 - DNA, 653 bp, Sorghum bicolor
  Clone ID: 14513912
gcacgaggattctatgtgcctctatttttatttttatgcgctccggccatggcactcatgaggcggtccagtgtatgacacaatccaccagctacacatgcgaggtgataatattttcttgttgttgtttgatgaactgatatgtgctgcttacttgtttctaggtaagttcctgcgttcttctctgtagatcccaatttcaaaccaatttccattccttttctattctgaccattccactctaggagaattaattaatcattgcttgaactggagcagcaagaataagaggaagaagagagacacctagatgcatagaaattaaaatcttattttaggatgcataaaaattaaaatgttaattttttatgcatagaaatagacttctttttcatgtaagcttgaggctttcttctatgcttaaccttgatacagtatgaacaaaattggaaaattattttttgggtgcatagaaattgaattctaattacttggatgcatagaaacttttcggatgtatttaaaatgttccgatctagtctgactctatgaaatttgattgcttgtatttttttagacttggaacacagggcttggcccacctcattggctccgacatgatgcctctcctatggtgatgacttctgtgacta

SEQ ID NO: 22796 - DNA, 547 bp, Sorghum bicolor
  unsure (1)..(547): unsure at all n locations
  Clone ID: 14513928
gcacgaggcctcctcgcatcgcccccctcgacgatggccgccgccgccgccgccatcgccacggcgtcggcgtcgtggcttctcaagaggtctatatcctccgctttccttgcgaggcgcgcgggccctagcatcctgcgtacagcccttagctattcctcctccgcatccgcctgccccaaaccagcgccgtccctgtctccgcctgacacatccgccaatgatggaggcggcgggatgaggtgggagtctgcgcgcaagaagagagtggtgctccgcatcggctacataggcaccgaataccgagggcttcaaaagcagcgagagcttggcgtggattcgaccattgagtcagtcttggaatctgccatcttcaagtcaggtggaattcttgagagtaattatggaaaactgcaaaaggttgggtgggagaggagtagccgaactgataaaggggtacactcactggctacnatgatttcccttaggatggaaatccctgatagagcgtgggaggatgatcctgatggcattgctcttgccagtt

SEQ ID NO: 22797 - DNA, 656 bp, Sorghum bicolor
  unsure (1)..(656): unsure at all n locations
  Clone ID: 14513929
gcacgaggcttctgattgctatgctcttcatgcagcaggctatcaagggacttgtcgacgagttccgcattcctgagagggaaaaccgaaaggcactggagtttgtcccatcatggcggtttgccaatggaatgtttgcaattgtgctgtcgtttggccttttactcactgctctgaggagcaggaaggcacggtcatggcgctacggaacaggttggctgcgcggcttcatcgctgactatggtgttccactgatggtgctagtttggactggagtgtcttacataccttatggaaatgtaccaaaaggaattccacgacgccttttcagccctaatccatggtcccctggtgcatatgacaattggacagtcatcaaggatatgacacaagttccactcctctatatccttggtgccttcataccagcaacgatgattgctgttctctactacttcgatcatagtgttgcatctcagcttgcgcagcagaaagagttcaatttgaggaaacctccatccttccactacgatttgcttctcttaggcttcctgacattaatgtgtggccttattggtatccctccatcaaatggtgtcattccacaatcacccatgcatacnaagagtttggctactctcaagcaccagctgctt

SEQ ID NO: 22798 - DNA, 500 bp, Sorghum bicolor
  Clone ID: 14513938
gcacgaggaggaggaggagccgtggccggacagggcgcccttgacctgctgcgaggcgaccgcggtggcagcgcgcacggcgcggcgcacgtgggagctcaccgtcgggcggtggggcctccacgggctcgccttcgggatcaagcgccacatgaagcgccagggtaatttgcagcatgagtatagtggaaatgattgtctccaacttaaaggacatcagacatatactgaagtatcttctcttcttgagtacttgaagctttgcatgttcttctcaaagaaatctttttcagcatttctgaagtttggtgggtacaaacaagacgacattcttattcacaaggctagggcgaggctcatgcagccttctttcgcattggtgtgtgaccaaagaaccaagtgcttgctgcttttcattcggggtgctatcagcactaaagagcgcctgactgcagcaactgctgctgaagttccttttcaccatataattctaagtgaag

SEQ ID NO: 22799 - DNA, 438 bp, Sorghum bicolor
  Clone ID: 14513939
gcacgaggccttcggccttcgcagcgcagcccccttcttcctcctctcgcctcctcgcgtctctattccccacggcgcactgccataaaccctgggaccgtacgcctccctcgtcatgctgcgccgcctccgcctgcgctcgccgggtagggcggcgtcggctgtcgccggcgcggccgctgcaatggcgtcgctcaccaacgtcgcctacgccgacgggctcttccgccgccagtccccaccgtcgaatccaggcgacgaggacaatttgggagcctccgcgttcggccgcgacccggagaccctggagcgcatggcccgagcgctgcggcagatcaacaactcaccgctcgccaagcaggtgtttgagctgatgcggaagcaggaggagacgcgcctcactgagctggaggccgagaaggtcctacacgctgtcca

SEQ ID NO: 22800 - DNA, 649 bp, Sorghum bicolor
  unsure (1)..(649): unsure at all n locations
  Clone ID: 14513956
gcacgaggctggaagcagctatgcctcgagcatggcatcggcaaggacggcctcctcgaggacttcgccactcaggggggcgacaggaaggatgtcttcttttaccaggctgatgatcagcacttcatacccaggtctctgcttattgacctggagccgagagtgatcaatggaattcagaacagcgagtacaggaacctgtacaaccatgagaatatatttgtcgctgagcacggtggtggtgccgggaacaactgggccagtgggtatcatcagggtgaacaagttgttgatgatatcatggacatggttgacagagaagcagatggaagtgatagccttgagggttttgtcctttgtcactctattgctggtggaactggttcaggtatgggttcttatctattggagacactgaatgatcgatacagtaaaaagcttgtgcagacatatagtgttttcccaaatcagatggaaacaagtgatgttgtcgtccaaccttacaactcacttttaactctgaagcggctgacactgaacgctgactgtgtggttgttcttgacaatacggctcttaataggattgctgttgagcgccttcatctatcanatcctacttttgcacaaacaaactctttggtctctactg

SEQ ID NO: 22801 - DNA, 336 bp, Sorghum bicolor
  Clone ID: 14513965
gcacgaggcttgcctcctagcctaccgcctcctcctcctgctgctgctgctttggctggagccggcgatggaccgggcggcgctcaccgtggggccggggatggacatgcccataatgcacgacggcgaccgctacgagctcgtacgcgacatcggctccggcaacttcggcgtcgcgcgcctcatgcgcaaccgcgccgacggacagctcgtcgccgtcaagtacatcgagcgaggcgagaagatcgacgagaacgtgcagcgggagatcatcaaccaccgctccctgcgccaccccaacatcatccgcttcaaggaggtcatcctcaccccgac

SEQ ID NO: 22802 - DNA, 555 bp, Sorghum bicolor
  Clone ID: 14513973
gcacgaggatttcattgactattgcttatttctggcaactgtacacactctggatcctagtgaagcttcatgaggctgtgccaggcaggaggtacaacagatatgtggagcttgcacaggctgcatttggagaaaaactgggaatgtggctgtctcttttcccaactatttatctctcggcaggcactgccactgcgttgatccttgttggaggggagaccatgaagctgttcttccaaatagtatgtggcccactctgctcgccaaatcccattacgacggtcgagtggtacttggtgttcacatccttggcagtaattctttcccaacttccaaatctcaattcaatcgctggtctttcactcatcggtggcgcgactgcgataatgtactgtaccatgtcatgggttctctccgtcagccaaccgcgaccaccaacagtatcttatgacccagtgacatccaattctttcggtatatccctattctcaaccttgaacgcccttgggataatagcgtttgccttcagaggacacaatcttgctctggaataca

SEQ ID NO: 22803 - DNA, 376 bp, Sorghum bicolor
  Clone ID: 14513988
gcacgaggcttttctctctcctccccctccctctcgtcctctctctctcgtccgatctgcatctgcttttcttccttccccccttgtctcctgtcccttctggcgtgcgcaaagatttgatttttctttttcttttttttttcctctcggggaggaggcggagtcgaagcaggagtcggggaaggagtggtgggaggcgggaggaaggaggagatcctgatctgttcttggagtggtgggaggagaggtcgagaggaggaagatggcggcgcaggagcaggagcacgagaagcagcaggcgaagacaagcaccacgagctcgctcccctccagcagcgagcgctcctccagctccgcccccaacaacctcagggaa

SEQ ID NO: 22804 - DNA, 650 bp, Sorghum bicolor
  Clone ID: 14513990
gcacgagggggaaaatgatatcatttggaacaattcaccagcaactgatcagcagccttatgcaaaaatctgtgaatctgaagagagtgtggacacccatggtgaagaccagggtaaggattatggtcaggtctccaggtgttgggatgtacggagtaaaagcaatgggtccccagtaattgaagagacttttggttgtacagaaatgcctgctccagctaactactgttcccctgggaaaagtttccctccactgacaaatgaagataacttagatcacataacgccaaataacttagatgatgcagttaaaattgacaccacgatgcgtttaaataaccttagtttactgaatagggaattattagaaggatcatggttggacaacataatttgggatcctaatgaggttaccccaaagcctaaactgatctttgaccttaaagatgatcatatgctttttgagatcctagatgaaaagaatgtgggtcatatcaggtctcatgctcgtgctatgattgttagtcagtcaaccaagacttcaacaccaacagttgataattttgacaatcaagcaaagacattgagtggaagattcaacatctccaatgacaagttttattcaaataggaagactccacagcaagcta

SEQ ID NO: 22805 - DNA, 476 bp, Sorghum bicolor
  Clone ID: 14513991
gcacgagggccagaccgagaagatgttctccgactccgttatacggttctacgcggcggagctggtgctggcgctcgagtacctgcacagcctcggcatcgtgtaccgggacctcaagccggagaacgtcctcatccaggacagcggtcacatcatgctcgtcgatttcgacctctccacgcggctcccggcgccgccgcaggagccagacgcgccggccaccagtcccaagccggtggctccggtcgccgcaccgttgccgagccgcgggagagcgaggaagccggcgggcgctgccctgtgcttcccattccgcaccggtagcgccgcgaggcctgccgcgaagccggccgcggactcgccgtcgccgctgtccacctcgcggacggcttcctcctcctcgtcgtcatcgacggcgaccacggcctcctcctccgcgggctcgcccggcgcgcggacgcccgcgaagtcgaact

SEQ ID NO: 22806 - DNA, 518 bp, Sorghum bicolor
  unsure (1)..(518): unsure at all n locations
  Clone ID: 14513993
gcacgaggatgattgtcaactccagcttcggcttcaaccagggcaacccgctcaggctgacttatgaactggactacaaagggaacatctgtggcgacaagcatggcagcccaaatttgcaggagctggatgttagatactggatgaatccgaaccaagtctaccaaagtggactcaaggacagcaaggttaacctggctgatgccaaagccatctgcctgatggagtgcccaaatccagctgtagatggattgaactttatttgtgattatccagaaggggacatccacctctctgttgatgactggatcaatagggactatgactattttgagtttctcacaccagacatgaggaatagctcacttcaactccagggtccatgctaccctatcatattcccaactgttaatgtctattggagctgccaatttattgcacgagcatccaatgtctctttgaagcactggcatgagatgggtggtgtcagcattgatgagnatatcctcattgataaa

SEQ ID NO: 22807 - DNA, 474 bp, Sorghum bicolor
  Clone ID: 14514005
gcacgaggcttccctgagatctctcgtcacgtcgccagatccgaagccccaaatccgcgcggcggcaatggcggtgcgcgcgagcctcgcctgcttcccctccgaccccgcgctccacgaggcctgcggcatcccgtggggcgtcgccgtcactccgttctctgccacagatgagcgcggctccacgccggccaccggcgccgagggccacctcctcccccgctgccagtcctgcttcgcctacttcagcttgctctgcccgctcgaccgctggtcctggaactgcgccgtctgcggcgccgagaatgacctccccgccgacgccgccgcgcgctacgcccgcgacggtggccacgacccgcccgagatgcgctccgcgttcgtcgacctcctcctcccccccagggaggagggcgaggcggcagcggcagcggctcccacgcccgtgtacgtcgcagcgatcgacttgtcctc

SEQ ID NO: 22808 - DNA, 447 bp, Sorghum bicolor
  Clone ID: 14514007
gcacgaggacggcaccaagttcgactccagcagggatcgcgactccccgttcaagttcaagctgggtcaagggcaagttataaagggatgggatttgggcatcaagaccatgaagaaaggcgaaaatgctgttttcaccatcccaccagagcttgcatatggtgaagatggctcaccaccagtcatccctccaaatgccacgctgcagtttgacgttgagcttctgtcatgggtgtgtatcaaggacatttgcaaggatggaggcatcttgaaaaaggtactagccgaaggcgataagtgggagaaccccagagatcctgatgaagtttttgttaagtatgaagcaagacttgaggatggaacagttgtatcgaaatctgatggtgttgagttcactgtgagagatggcgtattctgccctgccatatcaaaggctgtcaagaccat

SEQ ID NO: 22809 - DNA, 503 bp, Sorghum bicolor
  Clone ID: 14514008
gcacgagggcacggcaagatcgtggtgtgcgaccgcggcgtgaactcgcgcgccgccaagggcgacgtggtccaccgcgcgggtggcatcggaatggtgctagccaacggggcgttcgacggcgagggccttgtcgccgactgccacgtccttccggcgaccgccgtcggcgcggctgcgggcgacaggctccgcaagtacatcgcgtcgtccaccaagcagaggcccgccacgggtaccatcctgttcgagggcacccacctgggcgtgcacccggcgccggtggtggcggcgttctcggcgcgcggcccgaacccgcaatccccggagatcctgaagccggacctgatagctcccggcctcaacatcctggcggcgtggcccagcggcgtcggcccggccggcattccctcggacatccgccgcaccgagttcaacatcctgtcaggcacgtccatggcctgcccgcacgtgtccgggctcgccgcgctgctcaggcggcg

SEQ ID NO: 22810 - DNA, 620 bp, Sorghum bicolor
  Clone ID: 14514016
gcacgaggcttgtactcctgatatggtgaggttcctaaaggcgtacagggagatgcctgagtcagcaaagaagaaggccaagattaccgatgagatggatgagatggtggagaagtcgctgagcgagattgctgagacaaggaagttcccgacacgacccaagaggggtgctagtgttggggctgctgttggtagccagaggtttagcaggctcgagagttttatgcagcgtttcggggaggatgacctcaattcactcaagaagttcattgagaagatgcaacacaggaaaccaaactttatccacagctgggatcttgatcgggaaagtcatgtgaagaatttcttttggactgattctagggcccaggcacaataccgctattttggtgacgtcattacacttgacgtgatgtatttacagcactcacgcgccagcctcccattagccacactccttggggtgaataaccatggccaccttgtgcttcttggctgtggtctcctgtccggtgacagcaaggagaactatgtttggttgttgaagaggtggttgagctgtatgaatggcaaatcgccagaagcaatcacgactggctattccgatgttatttcagagg

SEQ ID NO: 22811 - DNA, 348 bp, Sorghum bicolor
  Clone ID: 14514019
gcacgaggctgactgcaagatacggagatagtgaagagtctggattagcacctgtagatttctttgtcagtacagtggatccattaaaagagcctccactaatcactgcaaacactgtgctgtctattcttgctgtggactatcctgtcgagaagatctcatgctacgtatctgatgatggttctgctatgctcacatttgaatcgcttgcagagactgcagaatttgctagaaaatgggtgccattttgcaagaagtacaccattgagccacgagctcctgagttctacttctcgcagaaaattgactaccttgaaggacaagatacacccgtcttttgtcaaggag

SEQ ID NO: 22812 - DNA, 644 bp, Sorghum bicolor
  Clone ID: 14514030
gcacgaggcggtgccgcgctctgcaggcggaggagacagaccaacgacgggcggacgtgcttcatgaggagggtgccgtgaccgtgaggaaacaactctgtgaggcgagaacagctggtgagacaaagtgtgaaggaagcgagaggcgaccaaatggcaaatgattcctcagctctgcaggcttcctctgaatcgattgcgcaaaagatggggttcttcagagtccctgaccttcttgtcaaactgagtgccaaatgtttgagtgaactggatgtggttcgcagtccaacatcacccctagacctcaagtttttcactggacttggcaacaaatcacccagatcatcctcccttgatgccagccagaaccagaagatcttgcttggtgacagggttgggcttggacttgtggacgccctcactgatgagaaccccgtacccctgggtggtagaaaggttcttcttggatctgagatgaggattactgataacatgtctcgcaagaacagctccactgctcctggtcaagctggggaagttgagcagaaggatgataacatgtctgatggtctgatgggtagtgtcatgtcccttgatgatatcgtcaattcagaggattacacttgtgttgtctcccgtggccc

SEQ ID NO: 22813 - DNA, 110 bp, Sorghum bicolor
  Clone ID: 14514046
gcacgaggatcatatcagggtgcgtgctcaatggtatgctcgaagagggcctcgaggtgttcgtcatgatgctggaagatggcgtcctccctaacaatgtcacgatgctg

SEQ ID NO: 22814 - DNA, 525 bp, Sorghum bicolor
  Clone ID: 14514049
gcacgaggcaggcgggggcatgggcgtcggcactcagggcgtacgcgacgatcgaggacaccgacgtggtggtggtcggcggcgggcccggcgggtacgtggcggcgatcaaggcggcgcagctggggctcaggaccacctgcatcgagaagaggggcaccttgggcggcacctgcctcaacgtcggctgcatcccgtccaaggctcttcttcattcgtcacacatgtaccatgaggcaaagagttcttttgcacaccatggtgtgaagttttccaatctagaaatagatctgcctgccatgatgtcgcagaaagacaaggctgttgctggtcttacaaaaggtattgaaggcctgttcatgaagaacaaggttgaatacgtgagaggaattgggaggcttgtctccccttctgaagtagccgtggacttgcttgatggtgggtgcactaccgtcaaaggaaagaacataatcattgctactggttcagatgtgaaatcactccctggagttcatatagacgaga

SEQ ID NO: 22815 - DNA, 469 bp, Sorghum bicolor
  Clone ID: 14514051
gcacgaggttttgttttctttaggcagtggtaagccgaggtaaatatggtgtgcctggacctggtgataattgctggcctcaaatggctggtatgatccctcttccgcatagtacgtttaactggcaaggcgacctacccctgaagtatcatcagaaggaccttgtcatctatgaaatgcatttgcgtgggttcaccaagcatgattcaagcaacgcaaaacacccaggaacttacattggtgctgtgtcaaagcttgaccatctaaaggaacttggagtcaattgtatagagttaatgccctgccatgagttcaacgagctagagtacttcagctcctcttccaagatgaacttctgggggtattccacaataaattttttctcaccaatggcaagatattcgtcaagtggcataagagactctggacgcggtgccataaatgaatttaaaacttttgtaagggaggc

SEQ ID NO: 22816 - DNA, 163 bp, Sorghum bicolor
  Clone ID: 14514052
ccttcggtgccacgactaccccagcatttggttcaccatcaacatctttattcggagcttctagcaccccaacgattggttctacagcctttggaacatctgctactggatttggaacttcagggaccacaacatttggtgagagtagcactactccgggctt

SEQ ID NO: 22817 - DNA, 637 bp, Sorghum bicolor
  Clone ID: 14514065
gcacgagggtttgttgctaagcattttttctctcaaagtgtggttgatttatcttggagccctgatggttattcactttttgcatgttccttggatggatctgttgccaactttcactttgaagcaaaggagcttggatacaagttaagtgattctgaactggatgaattgaagaggagtagatatggtgatgtcagaggacgacaatcaaatctggctgaaagccctgcacagttactgctagaagaagcatcagcaaagcaatcagctagcaaaaaggggacttccattgtccagcaatttcaagcacccccaaaagtttcttcagatgtgcctaacccagctcctgttgtgcaaagtaagaaacctgctttgcctgaagctgagaagaaaacatcaggtcctactgctgaagatatgaataaagttactcggttatctagtccagtgaagcagagggaataccggcgtcctgatggccggaaaagaataatcccagaggctgttggatttccttccaaccaggataacatacccagccgttctcagaacccaggtgtggatttttcatccctagatcagcgaatgaatgggataggaccatcttatggtagtaacagtaacagtaacaactctg

SEQ ID NO: 22818 - DNA, 597 bp, Sorghum bicolor
  Clone ID: 14514075
gttacgacacatggatggactgggcaggatgatctttggcgatcgaagcttgctagcaatttccacagatgcagcaactctagcaataaatttcttgattctggtgttaccactcaaccagatcgatacttgattgttgttacaagtggaggtcttaatcagcagagaacggggatagtcgatgctgtagttgctgcacgtattttgaacgctacacttgttgttcccagactggatcaaacatctttctggaaagattcaagtaatttttcagaaatctttgatatggactggttcatctcatatcttgaaaaggatgtcagaattatcaaagagcctccagaaaaaggaggtaaagcaatgaaaccttataaaatgcgtgtcccccgaaaatgtactccacggtgttacttgaaccgcgtcttaccagcacttttgaaaaaacatgttattcgaatgactaaatatgattataggctctcaaataagttggacactgacctgcaaaaactacgttgcagagtcaactatcatgctttgagatttactgacccgatacaagaattggctgaaaagctaatacagcgaatgcgagaa

SEQ ID NO: 22819 - DNA, 594 bp, Sorghum bicolor
  unsure (1)..(594): unsure at all n locations
  Clone ID: 14514081
gcacgaggaggtcacctgctcaggtgaggcaaattaaagacatggccagaattagcagcttccatttggccaccgtactgcatgacatccaccagagacagcgagccgatggccccgcggcgatactgggcctcggcacggcaaacccgacgaactgcgtgctacaagaccacttcgctgactggtactttcacgtcaccaagagcgaccgcctcgcagagctcaaggccaagaccaagaagatttgtgacagatcaggaatcaagaagcgttatttttaccacaccgaggagatcatcggcggccacccggagttgatcgaccgcaccctgccgtcgctcaagacgaggttaagcatcatcgcggacgctgcgcccaacctcgcagcggaagcagcctcaagggcgatcgtggactggggccgtccggcggccgacatcaccgatcaaatcgtcgtcaccaactccggcgccaacgaacctggcgctgacctgcgccttgcagggttgcttggcctccgtccgaccgtgcgccgcaccctcctgtacctccacggatgctctgctggtcttaccgcgctccgcatcgctnagg

SEQ ID NO: 22820 - DNA, 527 bp, Sorghum bicolor
  Clone ID: 14514085
gcacgaggccactgtccagccatccttccgatccaactaaaccaaaccctagccgccgccgccgatggagaaggaggcgaaggtggactccggcgacatctccgcctcgcagacggacctcctcgcccgcgcccgcttcattggcagcggcggcggcggagccgttgaggaggggtccgaggtgttcagcacgccgcctctcgcagaccaggacccgcagaggcagggccaaagccagcgaggccaggcgggagaagggggaggacggcatcgccatgtgctccgtgcccttcacccagacccagccttccgcttccccctctttctcccctccctcggatactccgacgccgactccgactccgacgccgacgccgacccccagccccgaactcgaccctctcgccaggctgattctcatggtccccagccgtcaacttccaaccaccggtatgagcatcctcgagcttgctcgcagccgcggtatcttcgacggcatgaagccccagcccccaactcgaccctct

SEQ ID NO: 22821 - DNA, 323 bp, Sorghum bicolor
  Clone ID: 14514097
gcacgagggtgctgcagcgatcccttgagatccctgtaattgaggaaggtcaggaacatgctcttgcgaagttttctggttgcatgcagttgggggacacctatggcatgctaggtcaaactgcactctcactgcaatggtatgcttctgggcttgaaatccaaaagcaaacattgggagagcaagacccaagggttggagagacttgtcggtacttagctgaggcccatgtgcaggcactacaactcgatgaagcacaaagattgtgtcagatagcccttgacatccacagggagcatggcgagacggcctcactagaagaa

SEQ ID NO: 22822 - DNA, 450 bp, Sorghum bicolor
  Clone ID: 14514111
gcacgaggcacgaacgaagaacactagcggcgaaatggcggagaaagacttcgccgacggcgttggcgccgtggacgagcaggacttggagcggtcttgccgtgaccaggatgatccagccgccgctgcagatggtgtcagcagaggcctagccatcggtcatttcgtacgggagttgatggtggagtgcgtggcgtcgttcctgctggtgttctggtccgcggtggcggcgctgatgcaggagatgcacggcacgctgacgttccccatggtgtgcctcgtcgtcgctctcaccgtcggcttcgtgctctgctggctcggccccgcgcacttcaaccccgccgtcaccctcaccttcaccgtcttcggctacctcccgtggcccaagctgccgttgaacgtggtggcgcagctggccggctcgctgctcgcgtgcgtggcggcgaacgg

SEQ ID NO: 22823 - DNA, 286 bp, Sorghum bicolor
  Clone ID: 14514124
gcacgagggtcttcccggccgcggccattgccaattgcccacatccgcatcccgcatccagtcgggtcaactgcgagggcgagccatttgaaaggggaggagtagcagactccggaggcggagatgacgctgttatgcgtgccgctggtggggcggacggtggaggagatgattgccgacgcggcggccgccgcagccaccggcggcgacatggtcgagatccggctcgacttcatccaggggttccgcccgcgcgagcacctaccgccccctgttccgcagctgc

SEQ ID NO: 22824 - DNA, 567 bp, Sorghum bicolor
  Clone ID: 14514137
ctattgcggattcgctttcgctgaccttgccttgccacggtgggggctttcccctgccatggtgggctatccagtggtcctacctaatcttctacctctgtttccattattctattggctctgttcttgaggtctttgtgctcatagaatacattatgtttgtttcaggtttgtttccttcatctccgtctaacgaatctagacagcctccgcgtgtttgcactggtggcgctgccagggatcgacggtgtcgtcggcttgcggcgcggcggtgcccattctcggctgcaatgcgaggtgggaggaggcgacgcgaggtgggaggaacgccagtggcgatcagcaaggcacgctcacgcggcactgtggtgaacagtagggaattcttttttgatgacaacctatccctactgtctgtggaaccattttttcccctgatgcttggtgcaactgatagaaattttcctttgttggataggttgtcatcaaaaaagaattcttatataagttggggacataggatggttatcttgaaaggaaaatatttttttgcctatgtggctcacg

SEQ ID NO: 22825 - DNA, 507 bp, Sorghum bicolor
  Clone ID: 14514162
tggcagctctacattacaataagggtgataaagatgtatcgcccaatggaagaacaaggatgggaacacagactgtacattctcagctgtgaaggatcatcccgctgtgaatgatcaatccctatttatggttgcacatgcaaagtcaagtaaggtgctctctgcaaaatgtaaggatcgacaccaaatgtatccatcaacaagtgacctatctgcttccttctctcgactttattcctcattggacatctccgacgacgacgaacattgctgggaacttgactgtagctgcaacttctgatcatccttgcatccatgtggaagccgaacagagaccgcacacacattgcttcctaaccttgtatataatatttctactcaacgctctgttatgcttttggatactacatctgacagagcatacaatggacatcatactaatcttgtataatatcaacacgcaccactctaatgttttttatatgcgcagctcaaatctgccatccg

SEQ ID NO: 22826 - DNA, 538 bp, Sorghum bicolor
  Clone ID: 14514207
cgaggtgggcagtggcggcaacaagggcagaggcgggaagcgcagtggcagcaaagtgaaaggcagccccagcaaggtggacgatgctgttgagtaaggcgaggaagaggaggaagacgccgacgacgacgaggaaggttcagtgaggcagttatgctgcctgcaggccctcaagttctccaccaggaagatgaactttggaggcggcaagcctagcctgtccaagatcgccaaggtcctaaagaggatgaccgcgctgtcgaggatgggaccgcggcgcaaacagtttgaatgaaggtcagctcagctgttgtgaactggtgtgaagtgaacaatggatggaacttcttctcgaatgtagaaccgctttactgtcacggtttgttgtgctgtttttcaattgtatttctttttccactttgtgtatatatgtgatatacccaatggtttcagtgattggggtaattacagggctgtcacttgatctgcagaatgtaataacccttaatcgcggtgtgtaattttcgtgcattcagtc

SEQ ID NO: 22827 - DNA, 613 bp, Sorghum bicolor
  Clone ID: 14514209
agaactactgtacattcactgcacaaactctttatcctatgatggaatttcaagtttatgctattagcaatgaaatcatttgagtttaagttgaaggacatcatttcatttcttattacagttcctctggtttggtttctgcaggcggttatctttacagctgcaactattataaccctttctgttctgctgatatgttgtgtcaacaaacggttcttgaatagctgcgcagtttgacctgaatgatagcagcaagatatctattgcaaaacatcagcgatgaacttctaactgaaatattctttagattctttggtcagtacatttattgttggactgcaaaagggcaatcaacggattctgaagatacattatcacctgtgtcaagtactcaagtattacctgtgactgtgagtgtacattacagattactgaaattgtggaaatcttactatatgcagcaattccttctctcccctgaaactattgaacaattttgtaccgataatttgcctgatgagaacaatcaaagttcagaacttgtatccaaacctgtctgaaattacatgagcagattaatctggaatggaacttgtgctgcatttttattctt

SEQ ID NO: 22828 - DNA, 144 bp, Sorghum bicolor
  Clone ID: 14514210
ggtatgcaaggagaccatttcagagcagcagctctgacctcccccattctgtcgtcagactcacatccaccctgatgcaacaccctgaactaacattgtgctccgaacagaagcatttagatcaggagatatctttctgtttat

SEQ ID NO: 22829 - DNA, 456 bp, Sorghum bicolor
  Clone ID: 14514224
aggtcgacaaggtgctgctgccgcagaagctcttcggcgcggcggaagcgcccgcgcccgcgccgctcgcgccggccaagaagaagggcaagacgccggcggccgtcgcggactcgcccgaggcggaggcggaggcgtccccggacgcgacgaccgcgtcgctcgcgccggcgaggttgacgacgggaggtgccggcctcgccgcggctcttgcgctcgccggcgtgtggtggggactgtagggacggcgatgaggtttacggccgtgacatccatcatgcatgccatctttttgtatactttttttttgcaggtcttgttggtcttttcgtgcccatttttggatgaaattattcttccctgcccttgaaattgctaggagtatgtcttgtaatggttaatgtaatgtcgttgtctcatttttatgtatttccactaaataaatatgagttgcgt

SEQ ID NO: 22830 - DNA, 510 bp, Sorghum bicolor
  Clone ID: 14514227
atcctgctccgagatgcagagggacatgatcagcgcggaggcgataaagcaggagctgttcaataacgctggctatagcggacgctgcttgtagagggcatggcgtggctggaggaggaagaagaagaggaggagcaggaggcagcaataaattaaagcttaagcagcgctagtagcaaggagcagcagtttagtagtatgagttcaggtccagtagcggaaaaggcaggcaaggcagaggccggcaaagatttgggaggcctttttgcaatccatctccccatcataacccagaatccatctatccatgttagcagtgtgtgtcgtccgtccgtcctagcatcgtgcaggatgcaaaggttgccctgtgctgctgaatctttctcctatatttaattaacaagagcaaagctcgctgcctttcttctaatgattgatcagaatgcctttcgcgattccttgtctttctggatatactatatctatatctatatataatgttcttcattt

SEQ ID NO: 22831 - DNA, 546 bp, Sorghum bicolor
  unsure (1)..(546): unsure at all n locations
  Clone ID: 14514233
tgaagatgaataccctggggtcgctacttaaaatttgccatcagcttcctgataaaaacaacaaattatctgtatatcaagctaacagatttaattntaagactcctcttggaaaatcagttgcagaggttggatgtgagcctattctgcatatgcggcatttccaggaaacgaagaggttacctcacaagcttgttcaccaggttgtccatggtagtggcgacgaacccttgtaatagctgttcaacaatacttgtatttattttatcaaggtggtgtggaggatgaatatacattgaagaatgccatgtttagctggcataccgaatacaccttccggacagattatttgccctgtacggtagacatccggacttgccctgtacgttagacatctcgacatctggtgagcattaatgttcgataaatgggcttggtctaattgtgaaattttaattattctaaataaatcttaaatgactattcatgtatgtatatggtgaccggtggaatttcagggcctgtttggtagatctctttgatttt

SEQ ID NO: 22832 - DNA, 178 bp, Sorghum bicolor
  Clone ID: 14514234
gctgtatccgtatttctagtaccaatacctcatcattgccaagtgaagtatacttgctcaggtggaaaataataaatgactgtcaattcgttttctggttaggttcaaacagaaatgtctagtgtttttagtcgactattctggagacgactataatcattaggctcacttatgtgtt

SEQ ID NO: 22833 - DNA, 488 bp, Sorghum bicolor
  Clone ID: 14514257
tacctcctccttggggtgtcatgaaaaacatgcacaaaaaaatcccagatgttgcttacaagaagtttcaagtgtatgggcatctgtttgagcaaaataagaatagcacacttcaatcagttcctgatctaccagagtttgcgctgtcactgagaccggaaggatacgaattgccaaccactgattcaatctgggagaatgttaatggccaacctcagattcagagcctcaaggagcatctggacgatggcgaagatgaagtagatacaaaatgatagttctcacttccaaatgcttcctttcattgtaccaccaaaagtagcagaagttatactgtagacttcaaaatgcttaatccaaaatgttttggattcagcatatgccacaactgcatctgtataattgcaagcattaccatgtgatatagtaaagtcttgatgtgtaatagaatcataaataataggaaataatagttggtttcttactgt

SEQ ID NO: 22834 - DNA, 215 bp, Sorghum bicolor
  Clone ID: 14514263
taatcaatctactgaagaacacgtacgttattttcctggagattgctagtgctaattttcagcgttgaatcaaataatctcaatcacgacgaggagctgcttcgatgagtggaccaggattgtgactgcttgatgcattcggttcttgtgatcatgttttgtgcacccctgtgaactgtggtgtttctgacaaaaaaaaaaaatgccgtgcctgt

SEQ ID NO: 22835 - DNA, 446 bp, Sorghum bicolor
  Clone ID: 14514275
atgtaaatctcctaccacaacaacatattaatatttgtgataaaaataaaaatatttttgttattaaaccagatcaaatcagagaaatataacgcacactattttcataaagtacatatgaatactaaaaataattatggaatattgaaattatactatacatgcttccaaaaatatatcatacaacatacatgtataccacataaacatcacaaaaatacattggaatatcacatgtataccatgtgaatattaaaaaaaatatctagaacattgcataaatactatgtgaatatcacaaaatataacacagaacatcacatgtatactacgagaacataacatatatactacgcgaacattataaataattcatagaacatcatatgtataacacgtgaacacaaaaacatcacaaaacatcacatgtataaagtatggatatt

SEQ ID NO: 22836 - DNA, 430 bp, Sorghum bicolor
  unsure (1)..(430): unsure at all n locations
  Clone ID: 14514285
gggagggttcatcaggagccagcatgcaaacaggtggtgtacgcatgatgctgcatggcatgcatggcgtggatgtttgtgagtgtcaagtgtgagtgtgatgggaaggaagaggaagggagaggtgtagtaggccaggtttagtaatgggaaaccaagatatgtcctcatgagtgatcgtgtggattattactagcagattagtagtatgagattagcatacataatgcctgcagaaacacaaacactgcaggatggatatatatagcacacatacataggcaagattttttttttgtttgtgtttgtgtgactcgggcgggcggtcagtatttgtatatgtaccgtgccaaatcaatcatgaggccaaaacaaactttgttgcttgtaagctgtaataactgtacatatgtcattattatacgttncg

SEQ ID NO: 22837 - DNA, 383 bp, Sorghum bicolor
  unsure (1)..(383): unsure at all n locations
  Clone ID: 14514310
cttgtggcctcagtcactcggaagagcccaagattcatgccaaatcctgagaagtattggggtcctgggacaaaggctggtaggcatccgaaaacatttcagatgaataatcgtaactgacaagatctccgcgccagaagatggacaagggtgtttggagaagcataatacagacttttggctggcaaaccccttattaagttttggggtatattattaattgctgcgggtcctgaattttctttttgcttggagtgcatttaagttttggagtgcattttccttcccaccaatctcatcaagaccaagcgtagaaccaaggtaccnggggttggaagnagattagggtttggaatagcaaaaactaagngttgatctttttt

SEQ ID NO: 22838 - DNA, 196 bp, Sorghum bicolor
  Clone ID: 14514319
aatctactaggcaaaaagcaatctggtcatcttccggaatttccaatagctagattggagatcgatggcagtattttacaagaggcccatcttgccgctctgaaagtgctggtcgcaagcaatgacctagcattgtatccacggctgaaggtggagctcacgcatgaggcagcccattgtgcattcttggagaatt

SEQ ID NO: 22839 - DNA, 361 bp, Sorghum bicolor
  Clone ID: 14514324
agagccaaaaccccaaccagaaccatcgaaaccagagccaccgtctcttccaccacccattggcgcgggcctcatggaagggaactaagaggagcatagtggcacagatcaacgtgcataccacctacagctttaggctatgactagtactatgtgtaagagtgagttctctctttatatatagtaatatatagagagagtgtgtgtactactgtcgtactatgtatggacgatgtgtgtgccaaccttttcccgtgtgtttccatcagcatgcatccatgatccatcatccatgtatatgctttggtaagtttgtgtatcatcaatgaataaaagaaacaagccttatgtgtctgtttcc

SEQ ID NO: 22840 - DNA, 122 bp, Sorghum bicolor
  Clone ID: 14514333
gagccattagtattcattccgctggagaatgaagatgaagtattcccgtgtggtgttgtgtccagggcttgattgaccgtttgatctgctcttgtttgtgcgcgtccactcctgtggtgtgc

SEQ ID NO: 22841 - DNA, 358 bp, Sorghum bicolor
  Clone ID: 14514341
gaaaaccctcacgagaacaaagtaaaacctgccgaaagaagcagcagcagcagctgtacaatgtaaataaatagctgtcagttgggaagtttgcatcagattgcattttttttttgttaatgttgggtggagccagagttcttttgattctttagttgatgattttctgatttcacatatttggtgatgaggatattatgcattggtcttgcaattgttcaagttacaaaaacgcttttgcttctttctcaccagcaagagctgcaatgcatgtatagtcggttgtaatacactgtggtggtggttttgcttgcttccagattgatgagcttacaggtccaaactcctaacttttgtg

SEQ ID NO: 22842 - DNA, 459 bp, Sorghum bicolor
  Clone ID: 14514358
ctagaactcatgggggaacgtgatgaagagttggaggagctaagaaatgatattgttgacctaaaagagatgtacagggagcaggtcgatcttcttgttagccagctccaggcattgggtgctcgtgtatagtgctggtaaggatttgtcgtgccatctaattcttgtccagtggtcgggcaaggcaagacaggtctacgacttgagcaggttttctttgaagttttgtgaccatacaacggcactgaaaatattcctttgtatacatctaaagtctaaacaccttcgtggtcgggtttaggatgatacgttgttgtatactagatgtagtttcacagttttacgcgcattctttgtgatttgtttccattgaaatgtatgaaaatttgaatccacttgcaagtgtccctcagaggaatgcaatcaatcaataatatcgagagctctttttgtcccttc

SEQ ID NO: 22843 - DNA, 427 bp, Sorghum bicolor
  Clone ID: 14514361
cccaccgcaaggattcaaacaagatggcttgcatcataaataagtcaacatttgattacattgacagtaatgcatcacgctcactggcttatgagtatctcaggttttcacccagacacccattcatatctgacattcgggcatggatgtcattgcttttcctgtacaaaggagcaaacatcattgaggtatttggtattgagctagatttctgtgacgcagcaaggtcagagaatgaaatcttgtggcttctagatatgcttgattggaaatagaagtttttccccacattgggagttgacacatgtaaagcatgttcatggttgtcttatcctttcctgttggagcatgtatgctactgaactatataatctcctggaaaaactggaataaatatcacttgctactccaaaaaaaaaaaaaaaaa

SEQ ID NO: 22844 - DNA, 458 bp, Sorghum bicolor
  Clone ID: 14514379
tcaaataccggttaagaaaaatgaactggaaagggaagccaataggctaatttcagaaggagcgaaggtcttagcttctgtttttccttatgaggaggcagtgatattatgcggaggttctctgcctagttacatttcaaaggatagcactcctcgcattgtgaagttcggggataatcctggtggtccttgcggtggtactcatgttgctgacatttcaatcatcaatagccttaaggtaacaaacataagagtgaagaaaggcctcacgaaagtctcatacagcatcagcccatgatcttcttccagcagctgcaacagacaccaggaatttatcggagcgagaattattaattgaattagaaggctgtaattagttttgtggcatcacatgtatacgcaggggacaaataaatagtttcactgtagtaattttatgactgctacttccctgtccc

SEQ ID NO: 22845 - DNA, 459 bp, Sorghum bicolor
  Clone ID: 14514383
ggaaaggcgagctcatgtggtgagaacattgggctttcgtcgtatgcatacaatgtcatgggcgatgatggtggaccgcagagatggatgacagatatgtcggatacaagcctgcaaaggttaagttatggaacaaataacgtctcatgccactgactttgactcatagcacttgactgaacatgttgtatatgtgaggaagtccttgtccgatttcatttatatcgacaaaggaaacaagtatgtgcatctaatttgttgtgcctctgtgtttgaagctagaacccacatgccgcacttgtgaaagactggccaagagttttctgtcgatagatgtgctgaaaagcgttgacagcgttgggcagtctgtagtttgtaaagctgaatgctgtgtgatggctcgtttatctgggaccttttatttttatggtttcagaatcagatctatacattcatgtg

SEQ ID NO: 22846 - DNA, 482 bp, Sorghum bicolor
  Clone ID: 14514391
agtgtttgtgattgtcaagttaatttgcttatgaaattcttgatacagtgagagtgtttgtgtttgttaagatcttttcaaatttgaaccccattgctttgcaaacctacctgttgtcagtcttgcagaacctacatgctaccactaatgggagtaggaggctaagggcaattctgacattggagcatcgactggagccattaagccgagggcgggggaaaaaaggcaaatgatcattttttatcgtcagcctattgaacttcttgaccaataacaatttagacaccgtgtgtggtttttcatgattgaggtattaatgtatgatgatgggaactcttggcgatttatagacgtccataatattttgaaatagagagttgtgttttaaagataaatttgcgatgttttcccacaaactaaatgtttgtaatgatacaacacatgtatacttaaagtgtcattgtcttattattttccatcgt

SEQ ID NO: 22847 - DNA, 436 bp, Sorghum bicolor
  Clone ID: 14514392
cttcgatcggcttctacgatcaatttgaatgacgtgatcacagaatgggagatgagaactatggttgcaaaaagcaaccagtgtccagccatctacagaattatcgccaagcaatgcaggatgctgtagacgtctaggcttttatagctggcagagcactcctcagattagggtatgttttagatatatagagccattgcagagtcaaaacttcagacagagggttaggcaaagtctgaactacagacagagtaggcagatctgaagataaagtattttgatggagagtatttgtaattgtgtattgaactgctgctggggttgcttgaaacccatgtagcactatgagtctcagttcagaaaatactgaagcagatttaagaggttctactgattagtactatttgtgtaatgtgaatggcctttaggtgttctt

SEQ ID NO: 22848 - DNA, 472 bp, Sorghum bicolor
  Clone ID: 14514399
cagtcggtcagaccctcaaggagatgacgaggagaccaggagactacgcgcagagcgagcagcacgagctggcggatggactgctgagttgagtaagagaagagcgctggaggaggcgtttagcgccatatttatctaggactagatcaaaaggcgacacatggcctggaggaaagccagtatatttaaaatggccgtcaaacaactacacaaccttggatgacctataccgcgcttatcttcgggacatggcattctcagattgtagtgagtagcaccaagtgagcctgcggttgcaaaagcatcctttgtgtgcaagctagaaatgcacattgttgtgtaccttgttcatctcaggtcatcgtgacagtcaagatttgtgagtgttcttttgtataaggacatgatacgatgtacgagcctcgcctctcagacgtaaatataaattgtcccctgtgatatttattttgtc

SEQ ID NO: 22849 - DNA, 265 bp, Sorghum bicolor
  Clone ID: 14514408
agacagcaatggcccaagggagatcgtcggggaacaaatgggataaacagagggattgtccagagtgataagggagcaggtggaaacagcaagggcaccctgtttgactgttagggacgtacagcccctagcagattatgcagcttttgacggtaacttttgtttaggggtatggagtcttggggtattaattaaagtttgccggtaaccgttcaaacatttttttgctttgtttagcagcagatcagattaagtctgttccttt

SEQ ID NO: 22850 - DNA, 437 bp, Sorghum bicolor
  Clone ID: 14514410
gctggtggacagaaagactccagctcagacaattgctccaccaaagaaaccacggttgccatcgagaaggtcatcgtttcagacagtgaagacagcgcagacgaacgtgaaaggcccccaagatcaaggctgtcattgatgcggagacgattggctggaaagttttgaacttagtgtcaccgcagaactatttctatactgcgttgtaaatttttggaagacgagtattcaaatttgctcaagtaaattgtgcctgtgtttgtggtagatcatgccctatatatgttatatatgtgttagagaactctgtcgccctaggtgggggatgatgctctgttgtggtgtcattccttgtgttgttaaaaaaatttgaagactagatttttgcctatgcggttcagttttagcagctgtgcatgtaatctataatgcattcg

SEQ ID NO: 22851 - DNA, 495 bp, Sorghum bicolor
  Clone ID: 14514413
gatgcaataaggaaggaaggctgcaacgtccacggctactttgtatggtcactgctagataactgggagtggaactctgggtacacggtgcggtttggactctactacattgactacaacaacaacctgacaaggattcccaaggcgtcagtggaatggttcaagcaggtcttagcccaaaagacggctaatttggagtacagtggttcgacaatagccagtagttaagtgtatataatatctacagctaccatctctacatgctttgcgtacctttggattagattgtgattattctcaaatgtatatagcccaccatttggacgaccttcaaccgtccagttgaatgtgtcgttatgcttgtcatacatggccttgtttagttcaccccagaaaccaaaaacttttcaagattctccatcacatcaaatcttgtagcacatacatgaaacactaaatatagacgaaaataaaaactaattgcacagtttacct

SEQ ID NO: 22852 - DNA, 387 bp, Sorghum bicolor
  Clone ID: 14514418
gtcggcgaccagagcgagcaaagatggtggttcatcgacggcgcgcgtagcgtgctaatgaagaaggctgactccgtgtatcttcacacccttggtagaagccgaggacgagctacggtcagagttggaggttgtagcagcaaaagtggtgcatggcttcctgtatctcaaggcctgatgcttcaaaatgcggtaatcttcggccaagaaggcaggacacttctgaaatgagaatggccaagaaggccggactactttttgtattgacgccccaatttttgaaggggaaaaattgaattgttcataaattttgttcttagctttgataacgttcttgtttgcacatagaaccaaaaaaaaaatcacgaggccattacccagcctatt

SEQ ID NO: 22853 - DNA, 436 bp, Sorghum bicolor
  unsure (1)..(436): unsure at all n locations
  Clone ID: 14514421
atagaagcagaagtggggaggtagaggaaggcagacgaagcgataaatctgatggcgagcggcgccatagagatgatgcctacgagaagagcgaacaccaccggagagatgaaatcagccacaggaaaaggagcccagatagtagacatagaagagaagaccgagcacaccatgtgaaaaaacagcagtctgatgataggtcctacaaggagagaaggcacagagatggtagataagataggtttctgtatgacactcggttttgttgtctgcttttcactgatgtccctataagcttgtattcttagctcaactttttttgaagtcaatgtaaactgcctggaatgtgttgaattgttgtagtgtccagatctgcatcttttctgtgtgtttacagcttttgctggataatttgttgcaataaagaaaaaattgn

SEQ ID NO: 22854 - DNA, 503 bp, Sorghum bicolor
  Clone ID: 14514424
gcacgaggccacctacaggaatcattccacttggtacaggaaatgatcttgctagatcgtttggatggggtggctcttttccctttggctggcgctcagctgtaaagcgttatctcagcaaagcttccactgctcccatttgccgtcttgacagctggcaaactgtaattcagatgccagaaggagaaataaaagagttgccatatgcacttaagaaagtggaacctggagatccgttggagatcagccaggagaatggcacagagttatccgaaaaggcttctttctataaaggagtattctacaactaccttagcattgggatggatgctcaggttgcatatggcttccatcatcttcgtgatgaaaaaccgtatcttgcacaaggaccagttgcaaataagttgatttatgctggatatagctgcactcaggggtggttttgtacaccttgtacagcaagtcctcagctaagggggcttaagaacattttgcgactttcc

SEQ ID NO: 22855 - DNA, 513 bp, Sorghum bicolor
  Clone ID: 14514430
gcacgaggccgagttttattttatttccaggaactgggacataagtatgctatgtccactggttgcttgaaatggtcctgtctttgcttccttcatacgaaggaaaatctgtactggagcttggtgctggaataggccatttcactggagaactcgctaaaatagctgggaatgttcttgctcttgattttattgaaagtgcaattaaaaagaatgaaagcattaatggtcactacaataatgcatttatttatttaactcctagaatacccgttgagatcctccaaggaagcaccggccacgtctgctgaaatggcaccagccgtttgattgcccatcttgtggtgcatgaatgttggagctgattcaaataaatctgtcatcgattactttgctgtctgatttcttgtgtttgcctgcatttgtggactgctcatcgctgattttgattcttacagttccgctccgtactgttgctgagctaaatgtatcagcctcatttattgtgatccc

SEQ ID NO: 22856 - DNA, 623 bp, Sorghum bicolor
  Clone ID: 14514470
gacgaggtgaggatgaacctgcactgcagcagaagaaggccagtgctgatggtgtgtgccatgaggatgatgatgattgtgtagttctagatggtgaccctgataaggtggttacagttgctgatgcggggagcgcgggagatggcagttcggatgaattgcagatagtcgcggagaaaggcccgatagcatgcagggacttccctcattcgcgccatttatgctcaaacttgcctttcagcactactactcacgtgaagcattgtaccatgtgccactgttttgtatgtgacgctccagctccttgcaaatattggggtaacagtaactcagctgatgatcattgccatgctacagacaaggattcaaaatggagaaacatgaggcaaacattcaagaaaaaattgttgccagcatcttttccagaaaaacaccagaacggcgtttactcaacaatgtcaccacccagacagtgtcatgtttcagtcccacaatcgcctcccatatcacatgggagtcacccttctctttccatccaaagccctcttcttaatgaagggagccaaaaccgacagagacatccctcagtgagagtctcactgagtgtagaggcaacagtacgt

SEQ ID NO: 22857 - DNA, 194 bp, Sorghum bicolor
  Clone ID: 14514474
gcacgaggcgtgcctcgagagagccgaagaccggagccccaaaacccctggtgccgccggcgtacggcctccagtctccagtctccggtttctgtactgctggcggcgcttcggcaccacagccggcaaagatgccccccttccggaggccttccctcgtcctcgcgcttccgctcctactcctgctcctgcac

SEQ ID NO: 22858 - DNA, 545 bp, Sorghum bicolor
  Clone ID: 14514494
gcacgaggaagtgggccttgtcatagcagtgtagtcttgaaatggtttgataatgctattttggacgatctgatcagtaacttgtcaagtaatgcatacaaaaaggaacttcttcatcatgcaaaggtagctgcctgcctatgtatcatccatttaataacaaagttgtcaactggtgattctgggagcttgtctttctcattcatgaagaaaattcagatcatatcaacaaaattgtcacagcaccatgcattcttagctctcctgtcgcagtattcccgtaatggatatagtggtgaacaagaacttaataatttggttatcaatgatctttattatcatatatgtggagaactcgaaggtcggcagattagctctggccctttccaggagttgctcagttttcttctggagtttaaactttttgaacacaatcccttggagcaactacaaaatacatacctgatgccaaatgaaaaatttgtatttgatgtggagcacatacatgacgagcttggagttgatctctggactgattcagaccg

SEQ ID NO: 22859 - DNA, 509 bp, Sorghum bicolor
  Clone ID: 14514495
gcacgaggggaagttcttgattgagtccgctgttgctcatgttgacttcagcgggaacctgctcaccagtactacgcccaaagagctcaagtttctagcggatatttcggagacagttctgtatctgaacctgagcaacaacaagctcactggatcgttgatagatggtgttgagctctctacttttgggagactgaaggtgcttgatctgagcaacaatcagttatctggtgacctcccggggttcaattatgtttatgatcttgaagttttgcgactcgcaaacaatgcgttcactgggtttgtgcctagtgggcttctcaagggtgattctctggtcctaagcgagctggacttaagtgctaataacctgacagggcatatcaatatgatcacatcaactactttacaagtccttaacctgtcctcaaatgctctttttggggatcttccattgcttgctgggagctgcactgtgttagatctttcaacaacaagttcagaggaaa

SEQ ID NO: 22860 - DNA, 588 bp, Sorghum bicolor
  Clone ID: 14514503
gcacgaggggcagatcacaacacgccatgccggccgcctgctcccgcctccatccagcaccggagtacagcgcgggcgcgcagctagttagctagcgaacaaacccagcagcaggacacgccgccgcgcgccgacaacaaagcgatctagaagagcacaggacggagcaagctaggtgttcctgagggagtcgacaacagtacaacacaatggccacggagcagcaggcccagctgtgctgctacaccgacggcggcggcggcggcggagaaagcgccaacaagcgaaacgatgccatgccggtggcggtggccgtgtccctgtgcctcctccacgacgcgctcagcgtcgcgctgttcctcgcctcccacccgctccacaccgtatacctcctcttcttcgcgcgcggcctcctcgcgctggcggccttcttctggccgctcctcgtctccacgtcgctcctcctcgccgcgctcgccaccgtcgggccgtacgtcggcggcggcggcgccgagtggccaggggtcaggtctctcggcaggacctgcggcattgccgtcgccgcgctctgcgccgagctccggcccg

SEQ ID NO: 22861 - DNA, 653 bp, Sorghum bicolor
  Clone ID: 14514504
gcacgaggacataatatatatggccattccattgaattcccatctcttctctttagggactgagagcaaggtcgcctcccaccagtcaactaaggtgtcggcgtgggcttgaatggctggctgtaggtttccaaagttttcccaagatgccaccctgttccagatttcctgtgcaaaggggcacgattcagtttagcagcaccagaactgttagttcaggttgataatcagtctaagatcgcgagtgaagcataaatttgagagagatacagtcatacagatgactcatgttgtgcccgtactctcttagatttagttgagttagagtggcttctctgttttgttttcacatgtctgactatatagactgcatcatttcctcatgcataggctaatgcgtttggatactggtttaacctactaacttttcatatggtgatggtgaatccattatatattttccatcatgagaaagatggccctttcaaatctgaagggtaaggaaaaatctaaatgccccaactccactacagctaaagatcaccaaacctacagcaaacacttaacctgacaataaatagctaaaccacaattataacagcctccattcagaagtttacacaaaagatatccataatgtgtgctcacatgct

SEQ ID NO: 22862 - DNA, 555 bp, Sorghum bicolor
  Clone ID: 14514512
gcacgaggccacctcacaatgaccgcggcggcggagcgccgcaagctcagcggctacctacgcgccgtggtgtccgtacccggcgttgacgcctcggcggcgtcttcgatcccgcctctgtccccgtgcacgctctccgcgtgcggggccgtggccctagcgccgctccccgacgacgtggggacccagccgcggtggcccaggtggcgcgcgcccggcgtcgtgcgcctgctcaggacgctcgtggcgaaccgctgcgtcgaggtggagggcacgctgctgcgggtcgtgaccaggaaggccggggaaggggacggcgacggcgccgaggtggaggccagggccgtcctgctcctcgacgtctacctgcccgtcgctgcgtggtccgggtggcagttcccgcgctcgcgctccgctgccgccgccgtattcaaacatgtcagttgcaactgggatgctaggaaagctttgcttgattttgactggacttctcatgccaatacacactgtgatgaccgttccatttggagctgcaccgattgtcacgtgcttggt

SEQ ID NO: 22863 - DNA, 476 bp, Sorghum bicolor
  Clone ID: 14514523
gcacgaggccaatgcaggcgactacggcggcgagatggggttccttgacgtcgtcgagcccaaggcggcggcggcggacggcgtcggcgtcggcggcgccgccgcgggcctcgaggtctgcaaggtggagcccgtcctggcggagagcggcggcgcgttcggccccggccccggcctcggcgccgcgccgacgccagccccggcgtccaagaagaagagggtcgaggggatgccgtccaagaacctgatggccgagcgccgccgccgcaagcgcctcaacgaccgcctctccatgctgcgctccgtcgtgcccaagatcagcaagatggaccggacgtcgatcctgggcgacacgatcgactacatgaaggagctgctggagaggatcaagctgctgcaggaggagatcgaggagcagcagcaggaggcgccgggcatgctcagcgtctgccgggagctcaaccccatcgagatgg

SEQ ID NO: 22864 - DNA, 513 bp, Sorghum bicolor
  unsure (1)..(513): unsure at all n locations
  Clone ID: 14514528
gcacgagggtggtcagtcatcgccagaacaggaagagatctaagagtttcaaatatggaaattctggttgggttgggcttgggccttcatggatcggaaatttcagagaggacggagttgcctagttttgaagaagtcgctaataaacaatttgactgctggccaatgtaagctgcactgcaaattgcaagattttcaatctttgtgtgccatatataatgctacgtataagatacgaagagtgtcagctgagcgaataagttgacgtgcgccgcacacaccccacccctatggcctatgggctatggccttgtttagttgggaaaatttgttggttttgaatagtgtagcattttcgtttgtatttggttattattgttcaattatggactaattaggcttaaaagatttgtctcacaaacaaactgtgcaattagttattctttttatctatatttaatgcttcatgcatatgttcaaagatttgatctaaagatttgatgtgacgaanaa

SEQ ID NO: 22865 - DNA, 607 bp, Sorghum bicolor
  unsure (1)..(607): unsure at all n locations
  Clone ID: 14514530
gcacgagggctcgtcgcccgctgcaacgcggcaacgggctggcggatgcggttcgcggcggactccgactctgacctctcgcgtgggtactgcgcctgcctcgtcgccgcactggacggggccaagcctgaggacgtcctcgccgtcgaccccgccgatcccgacctcgccccgctcggggcggggataacggcggcccggtcgcgggccagcacgtggcacaacgtgcttgtcggcatgcagaagcgggcgcgcacggccatcgcggcgcgagagggtaggcaccccgggaagccgtttccgtcgctcgtcatcgctcgcgacggcgccgtccgcgcgcagggcagctacgccgaggcgcaggcgatgtttttatctccggacgagtccaagatttcaggccttgtgaataccctgaaagagaaaaaaattggggttgttgcacacttttatatggatcctgaggtgcaaggcatacttactgctgcaaagaagcagtggccccacatccaaatatctgattccttgattatggcagatagtgctgttanaatggctgaagcaggatgtgactatattacagttctaggtgttgacttcatgtcag

SEQ ID NO: 22866 - DNA, 214 bp, Sorghum bicolor
  Clone ID: 14514531
tgtactaggatgaaatattgcctacctaataacctaaagaatggcgtgtaagaagacaacaaggagtacagtttgacactccggttcctacctaataacctaaagaatggcgtgtaagaagacaacaaggagtacagtttgacactccggttcactttcattttagtttcgatattacatctgggttgattatccggctttatacttcaatcga

SEQ ID NO: 22867 - DNA, 488 bp, Sorghum bicolor
  Clone ID: 14514545
gcacgaggcaatcagacgcatgacgtaggtattacgcccttacggtgcccaaacttggataaaatccttgcctatgtcttgcctcaccatctagttcgtagcttgcgcacctgtgtgccgacaatctactaccgagggtatactccaaagtagactaccgaccagcttttatcgatagtggcgtgctaggtaggggtgtgcgtgccaggtaggggtgtgcgtactagataaacaagatggtcatcattcccgcttccgcatccgtggcaggaggcctcacgttcaccattggtcagatcacctggatgaccggttccgacggcttcaccgccacgatcatagaagaaacacagatctaatctgcgccagttttttcttcgaccacgtcggctgcgaccacgaccacgtcagccacgactaccacgactctgacaacgtctccaactgcgtcgacgacacgtcctccacttacccgatacaacgagaag

SEQ ID NO: 22868 - DNA, 564 bp, Sorghum bicolor
  Clone ID: 14514556
gcacgaggccaagatctccctctctgatctgaccagggccgggccaccgctgccatttgcgtctgctcctcgcaaacccctgtctcgctttgcacttcgtttcgccaactataaagccgggggtcctctggtgtgtgacctttttataccgatgtgcagtgcagcgtcaacttcgtcaggtttcttggctccaacaaccttcgttcctgggtcactctaaactgtaaagatggggtgtggtccatcaatccccgagaagtacagcatacgagggaagagtggcaagcgccggagcatcatacaggaggttgctgtgttcgtgcccaccatccgcataccgttggcttctgacatagctcatccgctcaggggaatagtttccaaggatctcgtcgatcgcctctccacactccgtgctcatgtcgtcgcgctggctgaagaaatctattctgcggacgtatcagctgttcaagaactgcaacatgcgttagaggagtacttgccagttgttcttggtttaacaatgaaagagagccgtcttgaatcgtcagtacaattcacctg

SEQ ID NO: 22869 - DNA, 621 bp, Sorghum bicolor
  Clone ID: 14514563
gcacgagggacaagccggctccccctggtcccaaccatcgcatcgcattctccttgcctgctccagaaaccagaatgttcccctccagctccgcctccgccacggccccgcgcttcctccgccccttcaccggcgccaccgcagtaccccgccgcgccatggcggcggcatccgcgggcggcccaagcgacccgtcgacgccgcagcagtcttctcccaccaccaaggcggtgcgcgtggtggtgaagggccgcgtgcagggcgtcttcttccgggactggaccgtggagacggcgcgctccctggggctcgccgggtgggtccgcaaccgccgcgacggcaccgtggaggcgctgctctccggggaccccgacaaggtcgacgagatggtgtcccggcggatccccgttggcccgcccgcggccgtcgtcaccgccgtcgtgccctcccccgccgaaccggtcgcccccgacgagggcttccaccgcaagcccaccgcctgactggtgggctggttcgtcagccatccatccatgcggcggcgcgtggtcattgacgaacggcgccactcgcctgcgtggtaatcaatctactgaagaacacgtacgttattttcctgga

SEQ ID NO: 22870 - DNA, 564 bp, Sorghum bicolor
  Clone ID: 14514574
gcacgaggcaggacagggccaagaagacccgtgtgtgcagcacaatgactccaaagtccggcgacaacctccacaacctgacagtcttaactactgaaaggttccttcttcaagatgtggttgatccccacctggctacttgtcttgactctctccatggtctcttattgctcaggtcatcatggtgtgctggtgtgaatggttgataaattttcacaggctaggattagaaggggtgctcttttgttcttgctgggtcctcctgttatactactgctactactactcttctccatccctcgctgcaggctgcggtagatatttacctcaacttcctagtcttggtcaaggttctgcagtttgcatagtgtgcttgcccagctgttactactggattggctggccttcttctagaagggtatggtaagtactcagttttataaaacaagtaccaacttggtggaatagtagcagcagtgaaaaatactactaccatgcaactagaagtgggagatattttgtgaagccatattgatctgggcctatattatatacatataatca

SEQ ID NO: 22871 - DNA, 555 bp, Sorghum bicolor
  Clone ID: 14514583
gcacgaggcaccttcttcctgctttgattttttttttttcttcggcgggagcgtcgtcaacgcgacgactcgagcgggtgctcggctggtggagctgttggatttcttggcgcgtcggcattggtgaccatgggcggcgtgtgttcggcggggatcgccggggacaaatcgccggcggagctctctttccgagcgatggggttcgtggtggagcaggatttcaggaccttctcagccgccggcaagaacaagaccgcgcccgtcgaggaggcggtggatcctaaccaggtgagcgatcagtcgtttcgtctgtctgatgagggctcgccgccgtccacgggcagtaaggttcgtcgctcggtgtccaaggagccgcatttgacgcatgctgaatcgaggaaggccaagggtgggaagcctaggagaagcgcctccggcaaggccggtccgagcaaggtttcagacataggcatagcccttggtagagagagtacctctggacttgggaaagcagtagaggttctagataatctgggcagcagcatgtcaagtttg

SEQ ID NO: 22872 - DNA, 537 bp, Sorghum bicolor
  Clone ID: 14514590
gcacgaggcccaaatccccttcgccaccgtctccctcgccgccgccgccgccaccgcctatccagaccccgacacctcgccacccgctgccacctcaccgtcggattcacgtcgcccagccgcaccaccaaccatcccgccttgctccgcgctccgcaggttagacagccggtacccccaaacaaaccctatagcacgcgggtcggttgtagaagagcactgggggcgtgagagagggagtcaccagccctcgagatccctccctcccgcttctaccactcccctgacgcttgcaaaaaatgggcatctcaaatcccacctcactcccttcgacctctgagatgttgatatgaagggagacctgtaacttgtgtatatattaggtcttagttttcttgtttccatatttgtttggagttagaacttagaagcaaggcttctcatggcatctccgcaagaatccaattccctgtgcttgaagcggaagcttgttgatgactgcctgtcaaaagactgcaaatctcgccgtatcaaatc

SEQ ID NO: 22873 - DNA, 593 bp, Sorghum bicolor
  Clone ID: 14514591
gcacgaggcttaaaactggcaatgaatcaagtgtggatcgcctcattaaacaaattaccaatttcatgtctgatatagcagatgaattcaagatagttgttgttgaagctatacggtctctgtgcttgaagttcccactaaaatatcgctcaatgttgaattttttgagcaacagcttgagggaagaagggggctttgagtataaaaaggccatagtggattcaatagttgctttgatcagtgaaataccagatgccaaagaaattggcctgcttcatctctgtgaattcattgaagactgtgaattcacatatctttctagtcagattttgcattttttgggaaatgaagggccaaggacatcagatccaagcagatacattcgctacatttacaaccgcgtgatattggaaaatgcgactgttcgtgctagtgctgtcagcacgttggcaaagtttggtgccctggttgatacgctcaagcctcagatctttgttctcttgcaacgatgcctgtttgatactgaagatgaggttcgtgatcgtgctacactctatctcaaactcttagtggtgaagttgccattggtaacg

SEQ ID NO: 22874 - DNA, 649 bp, Sorghum bicolor
  Clone ID: 14514592
gcacgaggcagaagcagctattagagcatttagagagaagtatcctcaagtctacactagtgacgacaagtttgtcattgatgttgattcggtcactgttgagaagtaccactttttggaagctatgtctacaataactcctgctgcgcacaggggatctattgtgcattcaaggccactttcaacggttatcgctccatgtctgaagaggcatcttgagaaaataatggaacaaatttctgatattttccctttcctttcatccatagattttagcaagttctccgctctttcctatggatcttccatcccccttgtttatagacctcgccttttgatatgtggtggtgaaagtgttggactggatcatgtgggaccagctgttttacatgagcttgagaagttctctgttcactctttgggattgccatctcttctctctgatccaagtgcaaagacacctgaagaagctcttgtgcatatttttggggaagccaagagaacaaccccatccattctatacttgcctcagttccatctttggtgggaaacggcgcatgaacaactcagggctgtgttattgactctgttgaatgagttgccctccaaccttccagttttattgcttggaacatcatcagtggctttc

SEQ ID NO: 22875 - DNA, 490 bp, Sorghum bicolor
  unsure (1)..(490): unsure at all n locations
  Clone ID: 14514608
gcacgaggcaaacactgaaatttcttagcttcaaaaaaaaaaaaaaaaccactgaaattcccctaaaaccagcacggaccaacttcaccggcggctctccgccgccgtaaaccgatgacccttgcattatgcttctcgcggtcagggcttctcaaccggcgcatcaaccatctggcgaatcaagtccttcgcctccacctcgcattctcctcctcggcctcgccgtccccgtccgacccctcctcctcctccgccgccgccgccgccaccggcccccagaccaccatcagggaagggaaagcggagatctttttggacgagtcgaactcggtcttctacaacaaggcccaggttaacaatagagatatttctattgctgtactgagatcatttattttgaaaagacatgaagaatatgccacccgatcaagaaaagcaggaacaaaagacactacattgagcgagcatgctaagtataaagaaccgaaan

SEQ ID NO: 22876 - DNA, 541 bp, Sorghum bicolor
  unsure (1)..(541): unsure at all n locations
  Clone ID: 14514611
gcacgaggctgaggggcttagggtggagcaaaccatcatttccaagatcatgacacggaatcctatttatgtgatgtctgacacgcctgccattgaggctttgcagaagatggttcaagggaaatttagacaccttcctgttgtagagaatggtgaggttattgctatgctggacattgcaaaatgcctttatgacgcaatatcaagactggaaaaggctgcagaacaaggaagtgcaatagcagctgctgttgaaggggtcgaatgtcaattaggaggcaacttttcagttccttctgctctcattgaaactctaagggagaggatgttcaaaccttctttgtcaaccatcgttacagagaatacaaaagtagcaattgtctcgcctacagatcctgtgtatgtagcagcacaaaaaatgcgagagtttcgggttaattcagtggttgttgctacaggaaacacattgcaggggatctttacctcanaagatatacttatgcgtgttgtgtcacaaaatatttcccctgacttgactcta

SEQ ID NO: 22877 - DNA, 645 bp, Sorghum bicolor
  Clone ID: 14514623
gcacgagggttgacacaacttactatggctgatgcttctgatgttcgtatagaagatcctcttagcatcttaaactcaagaactaatgagcatcatgccttagagttgaggaataaggagctccttgtgtcagagctgcagaataccctagatcaaaaatcaaagcagttgggtgaaactgaaattaaacttagtgctatgatggatgaggttaactccctgaataaagaacttgaacaaacccggggtcttcttgatgaatctcagatgaattgtgcacaccttgaaaactgtttacatgaagcaagagaagaggcccgaacaaacaaatgttcagctgacagaagggctgttgagtatgatgctctgcggtcgtctgctttgaggatacatggtttgttcgaaaggctaaataattgtgtcactgcacccggtgtgactggctttgcagagtcactgcgttctttggctatctccttggcaagctctgtaaagaaggatgaagctgataccactgttcagtttcaacaatgcatcaagatcctggccgacaaagtttatttattgacacgacagagtgctgatctgctagaacgctattcagctatgcaggcagtacatggaggtatcacaaaagagttggat

SEQ ID NO: 22878 - DNA, 103 bp, Sorghum bicolor
  Clone ID: 14514624
gaacaataggagcccggctccgcacgcgggagcgagaggatcgccagcgcaggatgtggtgcgcgtcgtgcttggcgtccgcctgcgcgggctgcacctgcaa

SEQ ID NO: 22879 - DNA, 173 bp, Sorghum bicolor
  Clone ID: 14514629
gcacgaggcacgccaacgccgacgccgacggcgagggcccctacgtcggtgttcttccaccaggaggcggtgcgcgtgggcaagaggttgtcgatccacttccgggtcgcggtgccagccgcgctgggtctcctgccgcgcggcgtcacggactccatcccgttcatgacggc

SEQ ID NO: 22880 - DNA, 532 bp, Sorghum bicolor
  Clone ID: 14514639
gcacgaggagttcatccacctcggcatcccgcttcccgagggcgagggcgaggacctgctcgcgcagaacgccgccgaggaggaagaggacctcctgctactcgagggcgaggacggctacgtcgatggcgatggtggcgggtactaccctgagctccgctgcaacgacggggagtactactacgaggacgggcaggaggaagaggatgcggttgccctcgatctggagcgccggatctgccgcctcgagcacgatcaggaaactcgcctgcttgagccaccccttgaggttgaggaagaggaagaggaaggtacccacctctacacagatgaggcattgccgaacttgtctgggcatgaacggagtggcctctatgctgatgtggtgttatctgaggaggatgtggaagtggaagcaaggagcaacctccacaatgatgatgaagagctgccggagtctcctactgctggaagtgctgatggggaggaagcaagcgaggctgatggtgttgacagtgtaagtggcagtggc

SEQ ID NO: 22881 - DNA, 224 bp, Sorghum bicolor
  Clone ID: 14514651
gcacgaggatcatcagttcccctgagcctaggggttaaccagaaaacgcggcgcttctcgaagcatgtcaccgccgtcgtcactcaagcacctgcccccggcaaccgccgacgcggcctctccacgcgcgggcgccactccgagagccaccgggattcgcgggctctgtgcactcccaacttggcgcctacggtgctcaacctcagccgacgtggccaccacca

SEQ ID NO: 22882 - DNA, 486 bp, Sorghum bicolor
  unsure (1)..(486): unsure at all n locations
  Clone ID: 14514652
gcacgaggcctactcttaagtgggggtgcttcactggggtctttccatgtaggtgtagtgaaaacattggttgagcataagcttctgcctcggattatggcaggatcaagcgttggttccattatatgttcgattgttgctacccggacatggcctgagattgagagcttcttcacagactcattacagaccttgcagttctttgataggatgggtggaatttttgcagtgatgaggcgagtcaccactcatggtgcactgcatgacattagccagatgcaaaggcttctgagggatctcacaagtaacttaacatttcaagaggcttatgacatgactggccgtgtccttgggatcaccgtttgctctcctagaaaaaatgagccaccccgctgcctcaactatctgacgtcgccgcacgttgttatttggagtgctgtaactgcctcttgtgcatttcctgngctctttgaagctcangaactg

SEQ ID NO: 22883 - DNA, 587 bp, Sorghum bicolor
  Clone ID: 14514658
gcacgagggcgaggtggaggagaggacccggaccggaggaggagaggagaggagagagcccaccacccgcgacctaacccggaccggagaggagacctcccctccctcccagccaggctctcccacccacctttcccctctctctctctccctccttcctccccgtcccgcgtcgcctcccacgccgccgcacccccacgcctccgcggcagcgctcctcctcgccgtgcggacgtcggggaggcctcgctcgcgcgggagggcttcgggtggcagtcggccgtagaggaggaggaggagcggcggaggagcttgatctggggcacctgaacccgggcgccgtcgagatgtacgtgccgccgctgcccaccggcggcgccggcgagcagcctagggtttaccaggtctggcggggaagcaacgaattcttcttgcagggaagattcatatttgggcctgatgtgagatctgtttttctcactatgttcctcatcattgcaccagtggttgtcttctgtgtgtttgtcgcaaggcatctcataaatgatttccccgatagctggggaatctcagtgatggtagtagcg

SEQ ID NO: 22884 - DNA, 624 bp, Sorghum bicolor
  Clone ID: 14514663
gcacgaggactaaacgacgatttggtagaaattaatgactgatggggtcaagatgtgtgaaactgtgaagagcttgagttcttcggcagggtctgtgcttcagagtaaatctgctgatcaaccatacacccaaaagggaaaataaagtgattttttgaagatttgatttatactctataaaagaacataattttgtgttactgagaatgattccccaacaatattaataacttcaagtttttccttgatgttgatcttctacctccatgcctccattgtgccagtggatattgatttggtgctctgtccctatcatcttgttgtggtgatggggttcaggcaattagttgaaccccctcagtcacccccacccaccacggttggaagactccattgtgattaaccataacttctggttgaccttacatctctaaattattgttttccatggaatgtggatgctattcttaactgggctgcaaataataaagccacaaccgcttttccatgcactgctgaagtgccattctatgtttttcctttttgtcatcttcgtggaattaatatgagtgtattacagtgaaagtgaagtactgaacataggggtattgttactttgttttt

SEQ ID NO: 22885 - DNA, 522 bp, Sorghum bicolor
  Clone ID: 14514683
gcacgaggcacacgttttttttttctttcttctccgctcggcccgcaatcccccacgcgcgacctctcctccgctcggcgatattggcctcctccgctgttgccggccgtcctctcccccgccgcctccgccgtgccgcggggcacggacccgcctccaccgtctagatctcgcgccgccctccgccccggtggctgttggtcacactccgcctctcccgctgccggacgagctcgccgtggaacggagaggtcgccgccggcgacaggaggagccacgcgatggccagcgaatcctgctcttcctcctcgccccatccgtgctaatttctactgctgcctcttgtatcgagcatgtactgaattgctcatggagaaatgtcaacaagtatgccgatattagtgcttgaaagatcccaacttgccaacactggtcggagttgatttgtgaagttatcaattgaagtgtgtttggttattggttccattaaattgcagcatagctttctcttcatctgagatt

SEQ ID NO: 22886 - DNA, 591 bp, Sorghum bicolor
  Clone ID: 14514699
gcacgaggctcggccctttggccttgcccttccgcttccgcctccacccctccactctccttttctccgcacggaacgccgcatcggcgattgctaccacgactgccggtcgacgccctgcagatccagcaagcacccgcgacttgttccacctccgacggatcctgcgatgccgagcagcctcgacggctttgactggcctgcgacccgtgggtctgtggcagcccgttgattcaactacctccagctctgcgacctgtgggtctgtggcagcccgttgattcaactacctccagctcgaccagccacttttgaagttgaggcatacacttcttccccttcctcttctcactccgaagtccgaaccctagccactactcacttcccagctcgaacccactgcggtgtgagtccagggagtgagggagctgatcctgtggtctaggcagcggtggtgagatggtgatggtgtcaggcggcggggggaacgcatgggcgaaggagatgaccatccgccgcaggatagccagcatattcaacaagacgcaggaacatttccctactctgaaggattacaacgattatctagaa

SEQ ID NO: 22887 - DNA, 489 bp, Sorghum bicolor
  Clone ID: 14514709
gcacgagggtaccatattcccatggctaccaccgagggatgtctcgtggccagcgtcaaccgcggctgcagagccatcgctgcgtccggaggcgccgtcagctcgctgttccgggatgcaatgtctcgtgcgcctgtcgtcaagttgccatcgatcaagagggcagcggagctcaaggagtttgccgaggcacttaccaattttgagactctagctgctgtcttcaataggtccagcagatttgggaagcttcagggtattaattgtgcattagcaggtaggaacgtttacataaggttcacttgtagtactggagatgctatgggaatgaatatggtgtcaaaaggtgttgagaatgtcttgggctacctgcagactgatttccccgacatggatatcatcagcctatctggtaactattgttcagacaagaagcctgcagccgtaaactggatagaaggttgtgggaaatctgttgcttgtgaggcc

SEQ ID NO: 22888 - DNA, 648 bp, Sorghum bicolor
  Clone ID: 14514711
gcacgagggtcatcccgtggcctttcttccggcctcccagtcccagccgctgggactaaggactggccgagcgccgacgccgtcctacgccaggtgcccaggtcttcgtcgggcccttcgccagggacgagcacccaaccagggtagaattttctgtaaaccacgaaatggctcaggccaaaaggctgaatctgagaatgcagaaagagattaagcttctactggatgatccaccccatggggtttctcttaatctctctgaagatgaaaatgtcttatcatcattatcaagtattgaagccagaattgagggtcctgaggggacggtttatgctaatggagttttcattctgaagatacaaattcctgaaaggtatccttttcaaccacccaatatgacttttgttactcccatttatcatcccaatattgataatggaggacgcatttgccttgatattctgaatttaccgcccaagggagcctggcaaccatcactcaatatttctactgttttgacaagtattggcttgctgctaagtgatccaaacccggatgatgggttgatggctgaaataagtcgagaatacaaatacaacaaacaagtttttgacataaatgctcggttatggacagagaagtatgcta

SEQ ID NO: 22889 - DNA, 547 bp, Sorghum bicolor
  Clone ID: 14514714
gcacgaggctatgaccttggcatccaggcacctgggaggtgttctattctgtctcatatattctgtagagagggcaaatcatcaactgaaccatatgttgtagctcacaacatactcttagcgcatgctggtgcttttcattcttataagcagcatttcaagaaagaccaaggaggtatcattggcattgcacttgattcaaagtggtatgaaccattgtcagatgttgatgaggacacagaggcagcagcacgagcaatggactttgagcttggatgaaacttgcaggcgataggctgcctaagttttcaactcaggcttcgaagttagtatcaggctcattagattttgtgggcataaaccactatactacattgtatgttaggaacgacagaatgcggatcaggaaacttgtaatgaatgatgcttcaactgatgctgcgatcatacctactggttagtcattttaaatgagtctaccccttattttcagttactgaattttcccttgtgtcctctctgacagcttatagacatggaaagaaaa

SEQ ID NO: 22890 - DNA, 534 bp, Sorghum bicolor
  Clone ID: 14514718
gcacgaggctctttcctgatattaatggaaataggaacaaagcatttttcttagggtacatggtgaaatgtctgctaatggcttttactgggaagcgtaaatgtgataataaggatgatttcaggaacaagaggctggacctacctggtgaattgcttggaagggaacttagggcgcaacttaggctgttagagaggcgcatggttaaggccattcaaagagatttaaataatgaccgcgagttacaagatcttgaacgttatatagatgcatcgattgttactaatggtctaaatcgtgccttttccactggttcttggtgccatccctacaaaagagctgaacggtgctcaggaattattgcgactctaagaagaactaatcctcttcaaatgatgtctgacttgaggaaaacccggcagcgggttgcttatgctgggaaagctggtgatgcaagatatccaaatccatcctattggggaaagctgtgttttctgtccactccggatggtgaaaactgtggacttgtaaaaa

SEQ ID NO: 22891 - DNA, 597 bp, Sorghum bicolor
  Clone ID: 14514720
gcacgaggaagcgagagatttccaagctcgtgccggagcaggcgaagcagcagggcgcgcagcagcagcagcaagcgtcgcgccgcccgccgcggcgcgcgctccccgcggcgcagccgtccctgtcgtcgcggctgcagcgcgtgggccgcatcgggcttactgaccgccagcacatcagggcgctgcacgcgctgggccaggccgtgcatatcattgcccccggcgggaagctcatttactggaaccggtatgctgaacaaatgtatggctattctacatcagaagcagttggtcatgatgcccttgaattattggttcatcctgatgatgctgaggcagcaaacaatattattgggaatatatttatggggaaatgttaggagagggaagtttcctgttaaaaagaagtcaggtgaacggttcttcattgtggccaataatactcctttgtatgatgatgatggcagcttggtgggtctcatttgtctctcagttgatacaaagacattagaggatataatgggcccttcaacttcagtgaggtcctatgcacatccagtgaagccccggtttcaagtcaacaatcggcctaag

SEQ ID NO: 22892 - DNA, 477 bp, Sorghum bicolor
  Clone ID: 14514757
gcacgaggctctcgcacacgcaccgcagtcgcgagcgacgacgaccccatgactatgatgacgccgccccctctcgagcagcagcaggaggacgacgagatgctggtgccgcaccaggagctccctgttgctggtccggaagccgccccacagccgatggaagttgtggcgcagacagagcccgccaacacagcggagagccagccgcccgaggacccgcagacgtcacgcttcacctggacgatcgagagcttcagccgtcttaacactaagaagcactactctgatgtgtttgtcgttggaggatacaaatggcgtgttctaattttccccaaggggaacaatgtggatcacttctcgatgtatttggatgttgcagattctgggaacctcccatacgggtggagccggtatgctcagttcagcttggctgttgtgaatcagatccaccccaagtatacaattcggaaagatacc

SEQ ID NO: 22893 - DNA, 676 bp, Sorghum bicolor
  Clone ID: 14514767
gcacgagggccaggtacttgctggaggggatgcagaatggcgataatgaggggctaagctttgatcccagggccatgaggtttgagtgcccgaggctggttgagggcctctcatggttaggcgcacagcttggggttctgtatggagaaagcaatgggaaactatttgcgcttgtatctgtgaaggaggcagtgctacagatggcgtattgcttggctgtttgtgtaggagatggtgctgcaggtgtaggagacgacaaggttggagctggtgagaaaggaagtgatgttggagatgtcgtggcaggccctgtttttctttcccaggttgctgcttccattgtggcattgtatgagaggttctacttggaggagaagaccaaggcgctgcaagctcaacgcttgtcaaattatcagctgtatgctttgttaaaatttcatgatgtacttatttctgcattgcatattagtatcatcgtaatttcttatgctagtaattatacaagaaaggttgacagagcatacatagttcctaacgctgagagaggaatttgtttacgagaggagggagttatcattaaacgtcaacttcgacaccaaagcaatttttggatcagagatgcaatatcactagttctgcttgtatttgcataccctctgtagttgaccgatgtttt

SEQ ID NO: 22894 - DNA, 552 bp, Sorghum bicolor
  Clone ID: 14514777
gcacgaggagaaaaaccaactggacagttggaaagagctctgagaaaaaggctactccggattttgaaagaaccaggacaagatcgtgaagtaaaaaatgtcaggggctttagatcttgctcggagcatgggagggtcgattgacaaggaccaagtcaaatcggccgttgaccaccgcacgcaagctgttcgacgaattgccggagccagctgaacatcaccggaggcgctccctggtcccgggaatccagcccggttcctcggtagaagctagccgcgtctacgcattggcatcgttttagtctaatctgcactgttactcaatactctacaccatgttttggaggcgggggcgggggctgtagcacctttccttcgaccttcgacccaccaggtcctctggtacttgaagtaccacgacctacacggaggtgaacaagaatcaaggaaatcaaattacactgatttggtgaataagtactatgatcttgccactggcttctacgaatatgtatggggtgactcaatccattttgctggcagatatccagg

SEQ ID NO: 22895 - DNA, 494 bp, Sorghum bicolor
  Clone ID: 14514779
gcacgagggccattccttccatcctactcgcgtttctcttcctcctctcgatctacggccgcgcccgcgctgcaaccggccggtggccgcgccatgcgcccccgccacgcgcccgctcctgctgcccgcgctgaacaagacgccggtggccgcgcccagcgccggttcccgctgccctgcccgcgcccatgcggactccggtgccgcacctcgccgcccgcgctgcgatccgctgatgcctggtggccgcgccgtgcgcccgctgccctgcccacgccgcgctcgtgcggactccggtggccgggcacgccccgctgcccgcgctgcgacccgtcggtggccgcgtcccgcgcccccgctgcgcgccggctgcccgagcgaccgcgccggtgaccgctgcggactccagtggccggccgcgctcgcgcggactctggtggccgagcgactgtgacccgctgcgacctgtcggtgcccgcgccccgctgcccgcg

SEQ ID NO: 22896 - DNA, 271 bp, Sorghum bicolor
  Clone ID: 14514793
gcacgaggccaccaccaccacctccttttccctcaccttccagagcccactgctctccggcggcggcggcggcagcggcagcggagatgagcgtgtggaactacgtcgtcacggcgcacaagcccaccagcgtcagccactcctgcgtcggcaactttaccagccccaaccagctcaatctcattatcgcgaaatgtacccggatcgagatccatttgctgacccctcagggccttcagccgatgcttgacgtacctatatatgtaagaat

SEQ ID NO: 22897 - DNA, 492 bp, Sorghum bicolor
  unsure (1)..(492): unsure at all n locations
  Clone ID: 14514824
gcacgagggccagggcaacgactcattggcctacgtcgacggccccttggaggccgccaaggactccggcgaggtcaccgacgaggaggccaccagctcggggtccgacgacgagaggggccccggccccgccgacgtcgaccgtctcagggagatgctgcaccggtccaggaacgagctggaggtggccaggctcaacagcaccatgttcgaggagaaggcgcagcggatatccgagtcggccatcgcgctcaaggaccgcgccgacggcgcccagagggacgtgtctgcggccgttgccactgtgcaggagattatcggcaaggaggcggacgccaaggaggccgttcaaaaggctaccatggcactgtcgatggccgaggcgaggctgcagctggcagcggaggcgctggaggcgaagcggggctcggtcgggccaatggaggttagcatcnaaggcgtggaggaggaggcccttgtgtctgcgcagga

SEQ ID NO: 22898 - DNA, 612 bp, Sorghum bicolor
  Clone ID: 14514854
gcacgaggctgcgatctccgctagcagtattgccttcctggacgcttcgccgcatccggccgctactcgttccctcgatcaggtccctgatcggcaagtcgatggctatgccaacggctacgaggcgcacgcggaggcggtggatgtggataccaattcaccgcgtgtagaggaggcggcaaaggatgaggacgatgatggtgaagaggatggagatactggagttgcagccttggggatcgtggagaggctggctctcctcagatcccaaatctccggcaagctcgacaccatccagcagagggctgctgccgtggctgccaagaggaggcttctggctggccggcggaggaaggtggcggaggaggcggcctcggtggcatccagtcacaaggatatggagagggagctggaggaggcctgtgaggctgaggactttgagaaggcagagaggatcagtgactccctcgctgcgctcgagaaggagaaggatcggctgttgacggtcctgcgtgatgctgagcttgactatgattcagtggattcggagctgcaggaggtgcttgagtctcgcattgctgcggaggaagaagctgcttcccttctgggagc

SEQ ID NO: 22899 - DNA, 504 bp, Sorghum bicolor
  unsure (1)..(504): unsure at all n locations
  Clone ID: 14514875
gcacgaggcttaattcaattgatatggaagtggatggtggcaatataacttgcaatgtggaaaaccccagaagcttcaaaagtgacaaatctgctgaggacaagattatggattgtgaaatgatttctttgaaaggcagtgaactaaaaaatggtgtcagagtaagggatgtaaatctcaattcatgtttggattcaatatcttctcctatttctggtggaaactatgaaacatctgatactcctgatgatgctattcgatcatccattattgcccaatgctttggtactacctctaacgatgacactgcttgtaaggatggaaactttgccaatcagaacaacacctgtaagggtgaaaattttgtcaaccagaaaaatgacatgatgtatcaatcaaatttgaccatggatcctatacctcgagctcaaataaatgtggattgtttcacttcttcatgttcaatgactcctganatcaaggactatggcaacagaggtgaag

SEQ ID NO: 22900 - DNA, 586 bp, Sorghum bicolor
  Clone ID: 14514882
gcacgaggattcccttgatattttgttagaaacatggaatgtgattctgggggacgtagatgccgacaaaagtccaatctcagttgatggagcacttgcagcttcaagtttgtttaagatcattgtggagtcacacttgaaggctgctgctgattctgcgttcgaggatactgatgatactgaatattttcatgtttctgtttcaaaacgtgatgagcagttagccttgtatgctctaatagcacgtgctgctgcagacactactattccatttcttgcacagttgttttcagaacgatttgcccggctaaatcagagaaatggtgaaagtgatcctactcaaacactggaagagctctattggctgttgttggttactagtcatgtcctaactgactcaggcgaaggagaaacactacttatccctgaagcattacaggctggattccctaatgtgattgaagcagcacagcatcctgttgttacactctcctggtctataataaatttttccaggcagtgtctagatccaggaattagggcaaaatacttcagtccacgactaatggaggctgtcatctggttc

SEQ ID NO: 22901 - DNA, 399 bp, Sorghum bicolor
  Clone ID: 14514891
caaccttcttcctctcagagaaggatgttgggcaaaaccgtgctcaagcttgtgttccaaagctacaacagcttaacaatgctgtcattatctctaccataactggtgatttgtccaaggagcagctttctaactttcaggctgtggtctttactgatatcagcatagaaaaagcagttgagtttgatgattactgtcatagccatcatccaccaattgctttcattaagtcagaagttcgtggtctttttggcagtgttttctgtgattttggtcctgagtttactgttttggatgttgatggtgaggaaccacatacaggaattgtggcatcaatcagcaatgacaacccagcacttgtttcttgtgtggatgatgagcgcttggagttccaagatg

SEQ ID NO: 22902 - DNA, 268 bp, Sorghum bicolor
  Clone ID: 14514904
gcacgaggggaagaagaggggagggtgagtgtctgcatccccccaaggaatgcactgctgctaatgcgctgccggtcagacccagttcgcatggctgctcttgccacccacttctgggggtctccatctgcagctaccgtggagcatgtggacaatgaggtgaccgggtgcctcaacgacaacggggaagaagaggaagaggaggctgaggctgagccagatggagtgcaaagacgaagctcgctgttcagctgtttctgtcaaagac

SEQ ID NO: 22903 - DNA, 539 bp, Sorghum bicolor
  Clone ID: 14514928
aattttaattcaacttctctatgcacagaattagtatgcacagtgtcctcgagtggtggattgcaagtgatgtcagttaagtttcaggtgccttccccattggtgccgaccagggaaagcatttcgtgaggtactgtaggtagaacgctgacggaacatgggccattgttgacatctagctggacagcctgcgccccagcttcgtcctcaagtgcaggcacctgccatcacgatgtctgatccagggaatgcctaatggctattcaaagctgtactatcaaaagcatggatgcaaaggaccttaatctgtcaaggaggtgaggagatgatgtaccatgtatcattagtggatggccacacaaaaaaaatagtattactatgtaatgactgaaatttcaatgatgtggcttgatgtgagagtatagaattaaccattaatgattgttagtctgtacaatctatataggtcatatagattttgtcattatgaaccacacttttaagatcgtttgttaatggtataacatatctcaaacttc

SEQ ID NO: 22904 - DNA, 608 bp, Sorghum bicolor
  unsure (1)..(608): unsure at all n locations
  Clone ID: 14514991
atctgttagctgttaaatttttctcttgctttacaaattcatttacagtgatccaggttcttgctgtgctgtcatnttaatcatttcactgctaatgttttggaaacactttcagctagtattcaagctttctttaaaaaataatttattctggatttttacccggtatgagcagaaaaagaaatttcagctgtctgtttgctttgagcacagagagttctattttccgcagaggttgaagcatagatattaggactggaccggactggttgttggacctgtgaaagacctaattagggcactcacaatgcaagactctatcacagagtccaagacaattaattacatattatttatggtattttactgatgtgacagcatatttattaaagaaagaggtagaaaaaataagactccaaagtcttatttagactctaagttcacattgttcgagttaataaataactttagactatggtagagtttgtattgtgatggcccttaaagactctgcttgcttgtatcacttttaaaagactgtttagggcattcccaatgcaagactctattatggagtccaagacaattaattacatattatttatggt

SEQ ID NO: 22905 - DNA, 491 bp, Sorghum bicolor
  Clone ID: 14569449
ctgcctcagcaaggagttgacagaatcgatttctgcaatatttttggagccctggaagagctgcttgaggctttcaactctaaccctgaccatgccatggctgacttcacagccttcaagtcagggttttgccagcgcgtcgtgtatgaggacgtgtgcgagagctttgagactttgcttgagatgtacaggacgactaggactcggtacatgaggggaatgctggcgttgcacggggcaggtgcacatgtgagctgagccgtggagaattcctcttgagagacggatttttttttaagacagacaagtttttctttttgtggtggttggcttgggcagtggggctagtcttttattcctagcgaggagaagctgatccgagcgctggacacttgtacggtttgtgccacactgtatcatttgatggcgcttagctgctggtcagatttaaagccattggcatcgattcttcgtcaatcgattttcaattc

SEQ ID NO: 22906 - DNA, 515 bp, Sorghum bicolor
  unsure (1)..(515): unsure at all n locations
  Clone ID: 14569465
gggccatctgcacaatgcccttgttgaagcgatccgccctcatgaggatgccatccggaccagcccctgttgtaagaggatctgcagggccctctccaggaggtgaaagttgtaccatctgtatacctttggtaccaggaggaaggtcgctggcctgtatttgattgttgtcaatttatgttcactagtttgtcacccataatgtactcctccacaacgacctacacgagccctgtcagttcagaaaggcaggtttttgttgcaggaacaacggtttaagttattgtcaggtactcaggttgtaaaataggataccgcccgtcgtgtcttccgtgtagttttttcgccgcacgcctgtcctgctggtgtgctgtagtgtagattgtagagttgtaaaaggaaccagtgtgctttcncccccttgggtctgttttgtatctgctgtattgctttccactttggattctacgaattgttgctgttggacaaggattattcaaaaaatattattgttg

SEQ ID NO: 22907 - DNA, 560 bp, Sorghum bicolor
  Clone ID: 14569469
tgcattgttgaccacagaatggctgccaggtcattatccacacctgaaagagatgctgttgacaatgagtgcaataaagctgagcagtggctaagggagggatcccaacttcaagaaaccttgcctaagaatgtggacccagtactttggtcctgtgaaatcaagagaaaggaagaagagctggatatgttctgtcgaaacatagcaaggtataagggctctccagcaaggacagatggcagcaggggttcagatcacatgcctacaccggatagagattagatatattcacgaggtttcttcactgtacggccacacttgtcttaatcattttgtagcaatatatgaatgaacgactttttgctaacaccgtcatataatcgactctgtaccacactaggcccgccattggctgaccgcttcttggttctccaaggtgtagttttcacttgagagcctactaatcatgattattgatacctgtgaattcttttgctgtactcggaccaaggctgtcgtctgcttgtgctgaatgaacaggaaaactaaaaggaaattgt

SEQ ID NO: 22908 - DNA, 545 bp, Sorghum bicolor
  Clone ID: 14569479
acataattctattgcaacttatcactgcaatttgttcagcccaaaaaaagttttagtacatggtctaactattactcacatgtactaaaacagaggggcacataacataaacaactcaaatgctcaggctaaacttcataagtctaatgaaactggcctcttgaaacatgtttttggtcaatgatagtgttgagacatgctttcagaattcgaaggtaattaacccagatcattgcctaccgtttctacccccatgtaagactccatttacgaccaatcttttgtaaacaattgttattgtaacctgcagagatcactacttaccaggaagattcagatgatttttataactttgtttaagtattcttgcttccactatgcactgatatgttaatctgtattttttatcgccaattccattatccttcagttatcaaggatggcatagaaactacaaaatactcaatcgtgtaaaaaacggatgtaatatatacctatgtacccccactatataactaaataaagaatatacatttttaacattt

SEQ ID NO: 22909 - DNA, 201 bp, Sorghum bicolor
  Clone ID: 14569508
ctgtgcattgtagaaatggtgggacacccttgaagaaaagctttattcggaaagcgatgaacaaaatgttagtatattcattcgttcttgtatatccgttcctctgtgagcctagcatacaagaagtttgagaatagttctcccattattttttcctcggtatatgatatagtgcaattgtattttccagtggctgtgatg

SEQ ID NO: 22910 - DNA, 468 bp, Sorghum bicolor
  Clone ID: 14569525
ccgtcgaccacgcagacatctgaaacggcatggcttacatggatcgagcataaagagtcagtatcattgcatatttgcattgcatcggtggcagtcctctacgtcgacagagaagtcggctgcctcgagagaattggatgctgatacgattctgaaggacaggagtattggacggtagactgtttcatcacagcacaccctgtttcttgttttgttttgttttttttttatctttttcctccctgaaagtcagagcagattagggtctctcaccgcagtttagagccggttgagttctctctttctctagtcacttttagagcctgcagtcgtgccgtgcgtcgctgcgtagtaacacagtaattaatcgttgagcgttctgtaaatattgttgttgagactgaacactgaagtgcgttggtgttgctgccctgaataaaaggagcgcagaaagagcatgagcctgct

SEQ ID NO: 22911 - DNA, 558 bp, Sorghum bicolor
  Clone ID: 14569529
tggcaacacaagaggccagcaatgaaggtgtgtcccatctgtggcaagaatgctggtctcagcagcagctcactgaagctccacttgcagaaggcgcacaagaagatatcctctgggagcgtagacagtgcaatgactctggagatacaaaaagcaatagaggcaatcaaagctggctggagcggcagtgacagcccagtgcataaatcacaatcacacatcgaaggattttgatgtttaatcttacattcttacggtcctgctaatgcatacaagaagacttgtaatcagcagccatacaacaaggtttgtaatcggcagccgctttaagaatgaagcctcatctctggacttaacggcacttgtaagtagcacatttctggaacatttgagggtttttttatatggtttacaagcttggattaacaagaaccatccatagagggatgtagtttctgttataaaattgtgcgattctttcttttttctgaagaaatatgtacgagatgaacattcagactcttttttggatatcaaactttgaatcctttgtcctct

SEQ ID NO: 22912 - DNA, 588 bp, Sorghum bicolor
  Clone ID: 14569591
acaagaagaaaaggggcggttgcaaatgctgcacaagagcttgctcttgtcttccaggaaatcatgagttgactgacgacacactagatatacacaattagatgggacatgcttccccctgatggcaacaagattggatattagctgccatggagcgctagctagctattcagtcttagcaccgtcatcaagctccaaggccacagcagggacaaaggcactttgttgctgctgatcgcgccttttgtacacatgctgacacataatccatgtcatttgtgaagagaagctgccatggacaatgacttcagccacactattatgtggatgtcgtttcagcgactgccggagatgttataggccccaatcaatgatgatgagcagatgtgacttgggattgcttctctggcacagtttgctgtctgtaacatctttcgcatgtaccgttagcatgtgcatgtgcaccagtgaagtggttgcatttggtagtttatggttgggttgtgttgtgttgtcgttttagtgatcattgacgagtgaagcgagctatgtacatcatttttgaagattcgatatcttttttcctcg

SEQ ID NO: 22913 - DNA, 670 bp, Sorghum bicolor
  Clone ID: 14569593
cattttaaacatggttgctcctcaagaatcaataagggactcagaaaggaggaagttttaagtctaaccatcctttagacatagtgatttgcatcgggttcaatcctggcactgtcacatacttctcagatattccgtcctgcaagagtgtatcttgaggaagctcatgatatttttttaataaaaattatcatttaaaccttgcaggaggatttttagtattatcttttgctacttatataaattattctccctgaaaggactcttaacgcattgatatttaattatcttagcaactgaaagccgtcatgtaggcgtttggaatttatttaaagttaaaaaatggatctataggaatttatttaatttgctaatgttgatgctacttttttttatttgcataaaactgagttgctggtatgaggcagaaccagtgatgaggtttggagctgagagcagttgatgcgtttgagcagaataggaggttggaggaagcacttcagttgttcgacagaatggttggggcagaactgtgacgctatttggcagcaacggttctcaaattatgtgattaccttagaccaatgattatctgcactatcattgtactgatgaagactccatatttatattagttcacatcaaaatttgaattacatttttagtgttt

SEQ ID NO: 22914 - DNA, 638 bp, Sorghum bicolor
  Clone ID: 14569594
tgcaaccaacaacgctgctgaatatcgtgcattgatcctagggctgacatatgcggccaagaaagggttcaagtatattcgtgctcaaggcgattctaagcttgtctgtaaccaggtccaagatctctggcgtgttaagaatgagaatatggctggcttgtgcaagaaagttaaggtgctaaagggaacatttcatttatttcaaatcaggcatgttttgagggaatataactcggctgctgatgctcaagctaactttgcagtagaacttcctgttggtgaagttcaagagcagtcgaactttccatgctagcagttttgttgtgctcaagtgtggtttgtgcatcgctcaggttctgggactgaatctactcaaatttgttcagttcccattgacagaaaaggaagagacaaaacaacagttgtagtggaagtggtagtctgtctgatatgtctacagggtattgaacagactgagatgcaatattgagtaggttcctaggaaatttaatcgtctcaaaattctagagagcgcaccgtgcacaagttgatttgtccaggaccggtgtttgctgatatacaatgttggtattcggaacatattactactagaatgaagggatggaccctgaaatttt

SEQ ID NO: 22915 - DNA, 605 bp, Sorghum bicolor
  Clone ID: 14569604
agaggacttccgccaatacaccaaattgttcctctcagagcttattgcatttgtgtccaatggggacagggacattccctatcttggaagctttaatgacatcttgagtaaaatggaggaatttgctaagtattggttagatgaaaagacagcagaaaggttccgtgaattactaataaatcatcctttcttgaaaccttcgataatcagatcttatttgctatcaggcatctacacagcatgccgtgcacatgatttgtcagattctgatgctacattcaaatctacattgaaacttgctggcggcacagttagttggattcgtcaaatcaagactttagcaaatacagtctgcactgctgtgttatgttttgatccaaggacggatcacggcaagaaagaaaatgataaagataaaaggagtggtcaagttgttgaagacgacaaggctgatgagatcttttctgaaaatctagagtcttttgtcgagtatatgagacacacatttcaccacggtcctgatcattcgaaagagaagagaaaacaaatagtggattctgatggtaatttttatgatcctgagaacaagccacgaaagcaataca

SEQ ID NO: 22916 - DNA, 635 bp, Sorghum bicolor
  Clone ID: 14569612
gaattcgccaacaaagatattccttgtcctccttggtttttacacagccaatgccttggcaacaatactagggcagaccggtgactgggatgttcttgttgctggtgttgtagtggctgccattgagggaattggcatgctcatgtacagaaaaccaattaccaggcctcctggtaggtttcaatctttgatttcaatggtgaactactggaaagctggtgtatgcctgggcctttttgtggacgccttcaagctgggtagctgagtttacgcaatcaccttctgctatctgcttatagtgcttcttttttgggtatattgggatcacaataacaccaggatatatttcgatgatggccattgctcattgctcgaattctaatagttgcatttggctcaaattctggtagcaatggctgctgaggtattcgttttttaagagcagatattattctgaggtgacagtattcatttttccagaaccgaaagccttgtttggtaactacttactactgcaggctgttaagcactgtttggcctgtaaactgttgatatgctgtagtttttctcacctccatgtaaccctaatatgcatctatgcttactcagagaaaaattaaaaagagttgcttctt

SEQ ID NO: 22917 - DNA, 572 bp, Sorghum bicolor
  Clone ID: 14569620
gggaggacgagagatgattgatggtttggctgagttgtagtttattccagcacccggctggtatggtttttgttcaaaaacatggaagaatatcattggtcaataaaagaagagcattcgattgatatcaatatctgaagtgcaggactgtggccaagtttctacagtttaacataggggtagtgtccaggaagaaaaaaaaaatccacgttgatctaggagttgatcatttttgtattgtaaagcagaaatataggcttttggttactctggttcatttagctgtgttgtaaagcagtgatgtagtttagaatcctctaaaccatgccttgagaggtttgttagttgtgttcatcttgggaaaacttctgccgggtacgatcaacatcctgctgagttctgattgctgagtactatgactggaaaccaccaaagctttcagaaataatccaaacaaatacttggacctgcagttgcatacagataggtgtagtatggtttacttttgaacctatgtttttagtttgttgtataacattattttgcaatgctcagaatacaaatgttgtctc

SEQ ID NO: 22918 - DNA, 571 bp, Sorghum bicolor
  Clone ID: 14569631
gctgaaaatcaagctactgatgggaagcagagtgtgtagaaacctgaggccgtaggggaacaaaacgccgtggtggagaatggtgtggaggcaatagctgttaatggtgtcgcccccagaagatattaagccaacagctgaagaggcggccattgcaaatggctgttaattttcactgcatgccatcagctattggagcctggtccaaggagacaccttttgtgccacagaagcgttggtgttcaagtcattcaagattctgctatgtttttttctctctttgtttttcctttgcaatgatgcttggttgcagaagggtgcagtctaaggcaattctgtatcctgctaggtttctcgatgcattgtcatttaaggtggttagatggatattagctgttcttattccatcgagttctgtcctttgtcttgtcgtttggagttgtacttaggcgtggagatgtgaaaggccctggttcgtgggctcatggcattggattagatgaactgaattggagctccaattcaaacacatgtggaaatagaaatgaggtccagttgtggatttgaagcg

SEQ ID NO: 22919 - DNA, 625 bp, Sorghum bicolor
  Clone ID: 14569641
tttcgaagagggtgctgttctatgcaactttcttccgcttatacgggagtacttgccatcagctgcagaggaaattgagtcagatataatttcactggcacaatcagaagattctgaagtttatgatatctatactgtcaaggaggtggatgatacaaacatggaggccacgtcagcagcttcatatccaaggctacaagtggacgatggagaagatgaatgttacgacgatgactatccatatgacacggatgattcaaatgccgaagacaatccactttttgattatcccgatgaattgtccgaggatgaggatgatggtagcaatgatgaggatccttttggagacgaagaaggttctgacactgagtatgagaaggaagaagtagaagcggaagaggatgaataatgatgactaggaattgcaatggagcgcgcgattgtagatgctggggagactagcctgtgaactgaatgtaatgtttgacgatgagataggttcggagctgactgatgaatgtctgttgctaatgctgaaaaaaaaagagaggagaaatggagctgtgtaacagttagcattgtacatcgcgtgcgtcacttgaaggaagaattcaaaaaatattgg

SEQ ID NO: 22920 - DNA, 506 bp, Sorghum bicolor
  Clone ID: 14569647
gtcgtgtctatgtgatagctagtggtcctaagctggttcaccaaaacctttaattgtatcatagtagaagagatgttcattaattatttcagatgctgacagttggcagtggataaagattctccaatgtcaatcccatattcccattactctaaaaaaagatgaaacatgccctatctggaaggggatgttgtatactagactgtccagataccgaaggacccaaaacagtgactctgaacctgtatactcttactctcgtatctacagcaatttagttttcgttttcttttatgggtttggaggccattgtacagaagggaactctcaacaagaaatccagattaaaaggcacaggagaaagcaaatgagccattcaccaaccttttctttttctttttaatcttataacagatacatatatgccggctgctcactgtaaagtgttgattcagctctggttgtaataccggttcgatccattaaacgtatccgttactctgaat

SEQ ID NO: 22921 - DNA, 568 bp, Sorghum bicolor
  Clone ID: 14569674
ttttctcgatcgggcaaatataggcccgttttgaagaaacataaattatcatggacctgctctagtaaaagtatgtttcttattttttgtactattcaactgatcaaaaattaatctatctggctctaaacttgacatcgtccttccttaccgccctctccggtctcctctctgcagatctggccatctggtcctctgatctcactcgccttctcgctcatgtcatggatggctggccatggccatggtctgatgacccagatgggagaggaagccgtactaggagtactcctacggagtagcactagctgccactgccaggaataatggaatatggatttcactgcaagcaagcaaagggcaaaggcagtggctgcaccagcaagaatccagtaaaaattccctctgcactgcattgcctggaatctcaagcctgcaggcatggggacacaaggaacatcatgccttctacggcccgaaactgcatcccactcctttttgtttgttttttttgttttcctagctatagctaggagtacactctccattctaaatgataagtcacttt

SEQ ID NO: 22922 - DNA, 464 bp, Sorghum bicolor
  Clone ID: 14569678
ctagccggctgtgtactggccagggagctttggtttgcagttcttgcgcccctgggcgtctctgcgctagtaccggtgacgaacacccgactaatcgattggtggctgcgcagcaggatagcccttctaggtgatctccgaccggcgtttgactgcttggtgttgcttgtcgcttggatcctatggaaggaaaggaatgcaaggacgttcaaccaggaagcctgtaatgtccaggaactactctcaaagctcctgtgtgaggcacaagactgggtcgcggctggcttcgtctcactctctgtcttgcctcaactgtcgcttttaaataatgctttgtaatctctgcttgttgttcctcagtagctaggttccttctggtttcaagctggctactcaccggcttcctttgtcaactctctgtaaacgttttccctcttaatgaaatacgggtgaatggcccgatc

SEQ ID NO: 22923 - DNA, 717 bp, Sorghum bicolor
  Clone ID: 14569680
atgatcaagctgttgaggtggattcagctgctaaactccctgtcatgcttgcactaacaagtttgtggctaaggaagaactatgcagacagttttttggttaattttatcgattcacttccagaaatataccctgttgttaaggaatgggtggaagatgttctcatggatgaagggaacgcaacaattttgactctctttgcttgccttgtaactgtcctctacttgcgggagcgtcaaaggcgtcaagttgcagcagccaacccccaacaacctgatgatgtggccatgtaaatgtcagttttcatgacatgggcagacctgttgcttgagggaattggagacgtaaaatgatagctccttgacgtgactcatgtacactaaattgagtagggacatgaaagccgctggaaactcggacaatgtttgctccctggtgaatattcagctctccaagacttagggagctatatgcttgtaaaggacaacaattcttggaaactgactgcttagaaatgttgtttagaaatttcacagatgttcaaaagtagactttttccccttgtgtatttgcatagccatcgaatttcgactagcacacggagaatatatctggaagaggcaacttttgggaacggataactttacatcagcatttaaacacaatgtatagttttcgttggatgtgttaattgaaaaagggcgcgctgcatatggg

SEQ ID NO: 22924 - DNA, 422 bp, Sorghum bicolor
  Clone ID: 14569682
cgatatagcaaatgccttcagcagcgccttcgacaggctttccttgggcatcgaccaccctgtcggtggtctcagtgccacggctgttgaagcagcctccttgaacactggattttcatcatcccaagaaggaggaggtggtcaggaacaacagtgaagtgatcaataacctggtcgttctgcagctccatcatcacctcgatcatgcatgtacttgcagtggtcagcagcgtctgccaagtgccaacctgtgctgccacttattcacttgcctctcttcgtttcggcagtaaactttgttaatccttatgttgaaatttggtctaaatactaggagtggatctgtattgtttggatatattcagtgatttgtgaatgttagagaccgactctacgttccttattaaatctttggacggatt

SEQ ID NO: 22925 - DNA, 586 bp, Sorghum bicolor
  Clone ID: 14569684
gcgcacgctcaggaccactgttctcaggtgatggaaactcattcgatctggagagtacgcatctgatattgctgctatgtcgtcggtcgtttctgaggatcgatggatgctgtctgcaactgcaagttgatcagtttgtttgttgtgtgaaaggccagggaaggtacggggcttcagggtagctcctgcctttgatgactggctggccgagttggccagctgcttccgtttgcaattctcagcgtgtgtttggtttgattttgaaataagaaagacggccattcgaggcgcctggttggtgcctgatgcctgcatgccggcctggtgttgtgtgcaggcctggccgtgaggcagccacctactgtctggttgtctgtttgtgtgtgtttcagcttgctgaacaatgaggtgtgtagtgtgtgtgtgtttcagccacctctcagacaagatgcttgtaataagtaaggcgcatcatccgcacctgtcttgtcttgtgcgatttgatggttgcgctcatgggatttgattgctgctttgcttgttatatatgtacccatctataactataaatgtattgtgtttatgg

SEQ ID NO: 22926 - DNA, 569 bp, Sorghum bicolor
  Clone ID: 14569709
acatcaagtgaaagaggccctggaaatgagaatgtactggatgatttcaacgaggaggaaaatagttcaaattggtcgaacgaagagcacggcggacagatggatgatgtgcaagaagagcatgatcttggaaatggtggtgatgatgatgatcttggggatgtttttgattggtactagttaatcacggctggaattaggactcatgatactacaattatgattctgctaatgtcttgagtgctaatagtcagatggaaggggacccatttttacagacggaaatctgtgtaatggacagtgttcaattggatcagcacattcttggtgattatgtcagtaccatggttgggacatgtgttctggatgctaagttttgcaagccgatgggaagtgcgtgcaagagtagttgatatcatctgacgctgtcatgttagatacgtcatatttctttttgtacttacttttttttttattacttgccacacaaatgtactagtgcccacacaaatgtactagtgctgatggatgtgatacgtcatatttctctttagcaactccgatttttt

SEQ ID NO: 22927 - DNA, 585 bp, Sorghum bicolor
  Clone ID: 14569728
aaatgggatccggtgatgcttggtggagcagagtctggtgacaccatcggtgtgcacggccacggagcggacatggagactgggctgcggtgccagggaggtgcagatgcgtgggaggtgcagtgtgtttgtggtgcacaggacgacgatggcgagcgcatggtggcatgcgatgcatgcaatgtctggcaccatacacgctgtgtcggcattgcagatggtgctccggtgccaccattatttctctgcatatcctgtagtggcgcgctcatggccgctggaccaatttctgggtgagacactaacggtacctgaagttaagtgacaattcttttgcacctttttccggttataaagcctgacggtagtagtgtaaagtgcgtcgctgtagtaataccgaatgtgtagtagtcgactaatcgtagtagagtagaggattaggcagtagaaagagaagcactatccgactggaaattttgtacagggacatattacagaagagatgcggtaaatagctgtcctgtgatctgcgcctttcaaccgtctgtgaatcttggcaacgaagttaaaattgttcactgtgtt

SEQ ID NO: 22928 - DNA, 514 bp, Sorghum bicolor
  Clone ID: 14569757
gcacgaggccccatcctcttcgccgccgcccgagccacccgccaaaccagcagctcctcctccccgcccgctgcgctcgcggcccgcctcctgcgccgtgtgctctcccgctcgccgcagacgctctcccctctcccgggctccttcgtcgcgctcctccccctcctcctctcctccagctgctcttctgtcgccgcgctgagctgcgaggtgctcggcgcggcagcgttgcggtgcatggagaccggcgagatgctggcttccgacagcggcatcgccagcggcctggcgagggcgctaggaagtagaagccagcgagtgattgaggctgcctgtaattctatattggatctctcggcgtcttcagtcggcagggagcgacttgcaggctcacctgttctgcccaggacattgtggaatctgtttatggatttgcccaaagcggaagcactgagtctacagaaagtcctacagaagcaaataaaatcctgtgcttgatcattgacacaatggt

SEQ ID NO: 22929 - DNA, 527 bp, Sorghum bicolor
  Clone ID: 14569768
gcacgaggctcgacgtgatgctgtgcataggcatcgttcacctgttaaagaaataaagagagaatatatttgcaaggttttgccatttcgcttcgtggatgatgagagggattatctgtccgtgacaaaacggtatcccagactcgcaattactccagaattttccaagattgtcttgaactgggctaaagaaaacttaaatcttcctctgcatacaccagtgagtttggagcatgatgtccttgattcagatgatggtgctgatgaaggagcaattgtcgctactgagaaaacatctccagccaccatttggaatgcaaaggtactattgatgagtggcatgagcaaaggtgcctttgctgacataacttcattgagaagtaccgaggaacgagttgcgcacttgaacaatatcttaaaatttgctgtattaaaaaaggatcgttctctttttgcaatcggaggcccttggaatgcagcaatagatggtggtgacccatcagttgactgttcttgcttgattcgaa

SEQ ID NO: 22930 - DNA, 518 bp, Sorghum bicolor
  Clone ID: 14569773
gcacgagggcctcaccggcctctccacctcctccctccccttccgcctccccctccactactgctaacccctgctccccaatcccgatccgcccccacacccgatccccggattcgccgtccccactcccgccggccgatctccccgatctttctcaatccctcggggggttttgattttccgtcgtttctgggtcgttgcgtgtgtgttccggagtgttgttgattggtattgagatgagggccgccactggcgctgggggtcgacgaccaggaacagcagctggtcgcgaaccagctccgcggtctgcgcatcggggacgcgcaggccgcgctccagcgccagggcccgccgccagtcatgagcgcggccccgaccgaggtccccgcagtgcacggcgcataccatgggtacaacttcgcggcgtcaggttcttccgtccgccatgaacacgtgttccttgatcaggccaaacctgtcgggtacgtcgcaacacggccgcatcgcttcgtgtcgga

SEQ ID NO: 22931 - DNA, 468 bp, Sorghum bicolor
  Clone ID: 14569777
gcacgagggttcgagcatttcgcccaggagttcagggacaggtacaggattgatgtcgtggggaatgtgaaggccagtatgaggttgagggcagcttgtgagaaggcgaagaaggttctgagcgcaaatgcggaggctgtggtgaacattgagtgcctgatggaggagaaggatgtgaggggggtgatccgaagggaggactttgagaagctatgtgccagactgctggagagggttgttgaaccttgcaagagggcggtggcagattcaggggttggcttggagaggctgcattctgtggaactcgttgggtcatgttctcgggtgcctgccattgccaaggtgcttgcgggattcttcataagggaacctagtcgcacgctcaatgctagtgagtgtgtggctcggggatgcgcattgcaatgtgcaatgcttagtcctacattccgtgttcgggaatacgaggtg

SEQ ID NO: 22932 - DNA, 445 bp, Sorghum bicolor
  Clone ID: 14569793
gcacgagggcgatggatgctttcaggatattgcagaagagggatgtagtctttggagttgatcgtagtgcaaaggtttcctttgctgattcctaccctcaagttgatgacgaaataatggcacaggtcagaactgtatttcttgatggccttcctccctcatgggatgaagaccgtgttaaaaaatatctcaaaaagtatggagctattgagaaaatcgagcttgctcgaaacatgccagctgccaagagaaaggattttgggtttgttacatttgatacacatgataatgctgttgcttgtgctgaagggataagtaactctgaggttggtgaaggtgatcacaaggcaaaagtaagggctagactgtcgcgaccactacagagaccacctagaatgaagcatggattgagaggaaattttagagtcgggcatggtgccccacg

SEQ ID NO: 22933 - DNA, 464 bp, Sorghum bicolor
  Clone ID: 14569798
gcacgaggcccaatcccaaccctactccctcgcctcccgccccaatgacgtcgccgggcggcgtcttctccaccgcgctcgtcgccgaggacttcccgtgggtggagagggaggaggagatggggatggccccggacacgtacagcgaggtgttcggcctcgcgcagcgcggcacgctagccttccgcgaccgccgcttcgacgaggcaatatcctgttacactaaagctcaaaatttgagaccagatccaattatccttggcaatcgaagtttggctttctgccggttaagtcaactgttgagggagagatcagcagctgactctgaatatcaaccgttgaatggccttgatcctacaacccatgcagagttagctctgaaggatgcagagaagatattatctatcaacagtaattctcctagaccatatcttctcagggcatatgcgctaattctgatggag

SEQ ID NO: 22934 - DNA, 637 bp, Sorghum bicolor
  Clone ID: 14569806
gcacgaggataagtggcagcattaagagtaaaagttcaccgccgcagcagcatccaatccctgagtgttctgatttagtgaattttccattcacagatccacagcatttgcagctacgtgcacagatatttgtttatggagctcttattcaaggaacgccaccaggagaggcttacatgttggcagcttttggagaacctgtaggttgtggcaaacctacatgggaggctgcttggcgagctgcttttgaaagatttcagtaccaaaaatcactttatgtcagtttagagacccccacaagtgcacgtataggtagttccgtgcctgagaaagctagcaagagtacagcaattacaactgtgccagctagcaaaaaaggtggcaaaactgtggcgccagcacatcctgctgtaaccctctccccaacttctaatgtaccttttggtagttctacatttaacctgcaacgaggtactcatctggattttagccaggcagtatcaccatttgcacacatgagacatccgtctcctggtgttgccccctggtatactcaaagccctggtccacgtcctgcaccctggttgattccaccacaaaacttaatatttgattcatcgatgcaaccagctattcc

SEQ ID NO: 22935 - DNA, 443 bp, Sorghum bicolor
  Clone ID: 14569815
gcacgaggcaagagcggagcggaaggccgaagaagcgcctcagcgcccaccccgatctgcccgcccacctaacgtctcgtcgggcgccgatcggccgccgccgcgatggggtttgacgggctggtcgtggtgtccgatccctacctgcagcgccgcttcacgcaggccgaccttcgcgtgctccagacccagtatgcggcgctgcgggacgcgtcgcctaacgggaggctgcggatacgggacctccccgccgccatctctagcgtccgcggccgcggtgcggtcaggggcagggacgccgagaaggagaatagcgcgccggagccaggccccggcctgggcctcactgacgaggagtgggcctccgtgcttaaggccgtcgcgcgcgccgacgagaagccgcatcaggacgccagcttcgagctcttcctccgcgtttacgc

SEQ ID NO: 22936 - DNA, 275 bp, Sorghum bicolor
  Clone ID: 14569818
acacgggaggaactgaaccggacggcgcgcgcggcaaccgcgagaaccccggtatcaaacttctactgcatcacaaaggatactgaaatgggtgccaaagagaatggagaagagagagatgatcattcaagtgatgtggaaagagatggtaaacacaggaaggaaactgaaacagactatgaaccagctagaaattccctttcatcacctgatgaggctaccaataatgaagacactaaagtgaaaagagtctcaagggttccaaagaagctagc

SEQ ID NO: 22937 - DNA, 570 bp, Sorghum bicolor
  Clone ID: 14569821
gcacgagggcgagctgtgcaaagattagatcttatgaaatccaaagcatctgttcttagttcgggtgctacaactcttggaagttcgttcttctttcttggcagtcgtctggcagatagccttcttgtgcaattttcctgtggcgtgccaacatcagttctgcctgatctaacagatgagtctgctgatatcgaaggtgatctgcctttctcaaagcgcctgaagaggattccctctgatgttctacaagatgttaccagtgttgaggaactttcttttcataataagactgtgccaaatattgtagattcagcacagaagatctcatttgttgtaagagatgctctgatcaatgttggtcctctgaaagattttgcatatggtttaagaactaattctgatcccaatgcaacaggcattgcgaagcaaagcaattatgagctggtgtgttgttctgggcatggaaaaaatggaacactctcggcccttcaacaatctattcgtccagatttaattactgaggtggaattaccaagttgcacaggtatttggacagtttactacaagagt

SEQ ID NO: 22938 - DNA, 608 bp, Sorghum bicolor
  Clone ID: 14569822
gcacgagggattgatcctacaaaagtacactcagaagatcttttgcatgtttggtctatgcccagcacagcaaatgttagccagcaagaagtgcctcgacctctagagaaagtcaaccttttggcagcaagaaatgaaagggaaagttttcaaattgctttacggccaaaggtttcgtgggcaacttcaggtattgcagggtctgtgcagatacaatgcacagatctctgctcctcctcaggagacaggttagtcgttggtcagtccataactttgcgacgtgtggtgcctatcttaggtgtaccagatgctcttgttcctattgatccactcagtcctcaagtaactcttcaaccaggggagacagctgcagtttgggtatcattaaatgttccatgtgggcaaccacctggtttatatgagggtgaaatattcattactgcagttaagacagaattagattccagaacagaatctctaccaaaatctgaaaagtacaggctatatagagaattaagaagttgtcttgacctcactggacccagagactactcatcaccagaggaaatggtacaaagactaacatcagcttctagtgcactgaggag

SEQ ID NO: 22939 - DNA, 490 bp, Sorghum bicolor
  Clone ID: 14569826
gcacgaggagcacaattacttgaaagatgggccatatgtaactcctgaagaagctgttgctatctatacaacaactgttcattggctggaatcaagaaagttctcaccaattccttttccgccgttgtcatacaagcatgacactaaacttcttatacttgcactggaaaggctgaaggagtcatacagtgtagcagttagattgaaccaactgcaacgagaggagcttgggttgattgaacaagcgtatgataatccacatgaagcactgtcaaggataaaaaggcatctccttactcagcgagctttcaaagaagtcggtatagaattcatggacctgtacagctacttgattccggtatatgaaattgaacctcttgaaaagatcactgatgcataccttgaccaatacctgtggtacgagggggacaaacggcacctcttcccaaattgggttaagcctgctgattcagaaccaccacctcttctt

SEQ ID NO: 22940 - DNA, 407 bp, Sorghum bicolor
  Clone ID: 14569834
gcacgaggcctgcccctcgctcggctcccagaacccatcccatctccggccgcccacttcttggcagctcgatccgatcatcggatcggccgtccggcgggaacgaaccaacaaagctaggttcggatcgtgtcgatcgtgtgtccatggagacgacgacggcggccaggcggcggcggcggctgctgctgctcctggtcctgctggcgctcgcggcgcaccgtgcggcggcgcggttcgtggtggagaagaacagcctgcgggtcacgtccccggccgcgctccggggcgtctacgagtgcgccatcggcaacttcggcatgccgcagtacggcggcaccatgcacggcgtcgtcgtctaccccaaggtcgatgccaaggcctgcaggcccttcgacgcctccggc

SEQ ID NO: 22941 - DNA, 494 bp, Sorghum bicolor
  Clone ID: 14569838
gcacgaggtagactgcgatgccgtccccttggctggcgtggaaattatgcaaatctacttgttgccaacagggaagcttatgcaaaccttgacacgctagatgatgtttatgattctgctatcattcgatacaagccagagatcatcagaagccctcagaaacagaagcagagaagagctgtttcaattagtggcagtatcggctcagatgtctctgacctcatattggaggactcttatgcttctggtggacatgagttttctagctttaatattgtagccattgattcaggtgtaccacgcaggccacctgccagtaagcgggcaaaagatcaggagagctaccccaaactagtggaattaacactgaacaactttgactattcttccaaacttctatttgaggtgtccttcggaaaacttggcaccccaggacatgaagaatttgatgtatcatctgattatagttataattctcctctctctgagagtga

SEQ ID NO: 22942 - DNA, 552 bp, Sorghum bicolor
  Clone ID: 14569841
gcacgaggaaggagttgaaacggagaaatctgggggtttatgtccatactgcctcctgcaaagatcagctgaaagggacaagtgttgtggctgagctagcagtactacaccagctctctgatagctacgcacgctcgctccaactccaatctccaatctcctccaagaaatgcgtcagctgccgcgctcttgaatcataacagcaagctcccagcctcccaaccaatccgttgaggaagacagtgagtgatggggcttctgtggggttccttggcgtttctcctcctgctcgttgtctcccccgcgcaagcccagctgccttcgcaggacatcctggcgctactggccttcaagaagggcatcacgcacgacccggccggctacatcaccgactcgtggaacgaggagtccatcgacttcaacgggtgcccggcgtcctggaacggcgtcgtgtgcaacggcgccagcgtggcgggggtcgtgctcgacggccacggcatctcgggcgtcgccgacctctctgtgttcgccaacctcacattgctcgtcaag

SEQ ID NO: 22943 - DNA, 280 bp, Sorghum bicolor
  Clone ID: 14569845
gcacgagggcgaggcgagtgccgcagttcctaactccggtgggcgcgctcccaccgccggacggctcaaaacccgccctccgcctcccgcgctccagtccagaacggtgcgtggtgccgcctggaggaagcagcccggtcgctgagcccggccctccggacgtgacgtgctggttgggtatcgccggataagcgggaaagtccactgtgacaggacgccaccgggtttggggcaatgttctccttgttctatggcctatggaagtatgtgttcaccaagg

SEQ ID NO: 22944 - DNA, 647 bp, Sorghum bicolor
  Clone ID: 14569852
gcacgaggaaatagatccccaggcctaagggattgctctgagaaatgtgctgggctggctcacgggctgatctagataaacaaacagcccggattgtaacaatggcccatccgagccaggcaaacaaccctaagtttctctctttaaggtggccactggccactcactacccgtcctgtctcgcctcccttcggctcaaccagaccagtcctctcttcgacctagtctctctccgctctttgcctacagaaaccctcgaagatgatgatggcaacgggccgccgtgtggctatgctggctgccggccgagccactcctatcctcacggtaggattctgatttatttcgatctgttgaagtggtacaataataatgatctaatctgccgagtttcccttgagggaagactagtgtgctgttttagattctaacttgtctgtgtcaaaactcaaaagagtgatttgtactccatctgaaaggatttcaggggatttcgatttgttgctcatgttaccatcaaaagtttgacctttcttagcttggattcctcagtaagcttttattttgtttctggagactccatattctactgttgttgagtgattggactgtggatgttctttcttgcacggatctgtgggtttggc

SEQ ID NO: 22945 - DNA, 406 bp, Sorghum bicolor
  Clone ID: 14569853
gcacgaggagtagtggcagcagtgcaagcagcagtagttcggaggcctctaagctttatgtccgaaagaaaaataaaaaatcacttggcaggaaccttcaatcacaatatagagaggccagcaagaaccccaatgcacaagaagctacgcaaggttctgaaaaaaagcagcatgatgtgaatgatacttgtattgagaataacccagtgttaaatgacgatgttggtcattacagtcaagccagggaaaatcagtcaagaaatgtcgatggggttcctgaaaaatctcaagcaagtgttcctactgtgagggatggtggtatcttcaagttcctcggtggtccaaaacctggagatattgagtacaacttgtcttctgctattcactgctatggtgcggccaaggg

SEQ ID NO: 22946 - DNA, 454 bp, Sorghum bicolor
  unsure (1)..(454): unsure at all n locations
  Clone ID: 14569858
gcacgaggcacaagcacaagcgcaggcgggccgccggcggagtggtccgtcccttctccttccgagcgaacccgagcaggtgccactggcatagccggggtacagtacaggatgcggggggtgacaagcgcggcgaagcgcgccggggagatggcgttcaacgccggcggcggcgccgtcaactggttcccgggccacatggccgcagcctcccgcgccatccgcgaccgtctcaagctcgccgacctcgtcatcgaggtccgcgacgcccgcggctcctctccggatataattctactgtgccccatccaactatgaaaacgtcgctcttctccttcagttgacacctgtagtgtctggcatgacactcatgctcaatggcccctcttaatcagtccccaacaaacctggcgaanaatatttgatggggctgatttcgaagttttctcccctt

SEQ ID NO: 22947 - DNA, 547 bp, Sorghum bicolor
  Clone ID: 14569900
gcacgagggtggcgtcggcgtgatctgaaatgagattggacccgacggcgcggtattcgctgcggaggtagacggccatgacgaccaacaccaagcgcgcctacaagctccaggagtttgtggcgcactcttccaatgttaactgcctcaagattgggaggaagacctcgcgggttcttgtcacaggaggagaggatcataaggtcaatctttgggctattgggaagcccaattcaatattgagtttatcagggcacacaagtgctgtggagtcggttggttttgattccacggaagtgtttgtggctgcaggagcagccagtggaacaataaaactatgggatttggaggaggcaaagattgtccgcactcttactgggcatagatcaaactgtatgtcagttgatttccatccgtttggggaattctttgcctctgggtcgttggacactaatctgaagatatgggatataagaaggaagaattgcatccatacatacaaaggtcacacacgaggggtgaatgctattagattcacacccgatgg

SEQ ID NO: 22948 - DNA, 530 bp, Sorghum bicolor
  Clone ID: 14569901
gcacgaggagctcaccggcacgctgccgccggagctctgtgcggggggcaagctgcagacgctcatcgcactcggcaacttcttgttcggtgccatcccggactcactcggccagtgcaagtccttgagccgcgtccgtctcggggagaactacctgaatggctcaattccgaaggggctattcgaattgccgaagctgactcaagttgagttgcaagataaccttctcactggtaatttcccggctgtgatcggtgctgcggctcctaaccttggcgagatcagcctgtccaacaaccagcttaccggcgcattgcctgcatctcttgggaacttctctggtgttcagaagctgcttcttgatcagaacgcgttctctggtgccatacctccggagattgggcggctgcagcagctctccaaggctgaccttagcagcaacaagtttgagggaggtgtgccaccggagatcgggaaatgtcggcttctcacttacttggacatgagccaaaacaacctctctgggaaga

SEQ ID NO: 22949 - DNA, 627 bp, Sorghum bicolor
  unsure (1)..(627): unsure at all n locations
  Clone ID: 14569902
gcacgagggtttctatggtggctaaaggataaatgttgcacatgagcagattgactgcaagagacgatagacttgcacaaattcttacagaactaagctagtgatgccacaaagtatcacaccaactatgcctggggttggcagacagcagtacgcccgtaggcgcaagcacaccaatggaccaaatgaattggacgcgcggccgagcacgccaaacgccgtgagggccaatctgtgggtcttaattctagaagagattatctcagtttgttagcccttgacaaaggtaaagcaacagatgatatccttctcatgtatctccttcctctaagacagggcatagaggggaaaaacttcgccccgatcccgaccacaagcaccacctacgtagtcggggtgcgctgccgctactccctgtgccccaaccacgccacatcttagtatcaggttggacatgaaaccaatccggacttccgtatcctcgcttgacgccnaggtcgacagtaactcgcaggccattcaacgcctagaaacaatggttgccaccgcacctagacaggcgagcaccacaaaagtaaaacatgatataacacctcacatccaaaaactgcttatatggcccagctc

SEQ ID NO: 22950 - DNA, 596 bp, Sorghum bicolor
  Clone ID: 14569903
gcacgaggtgcctgcgtgtgctcctgcgcggcggcggttggtttgagcggcgtggaggaggcactaccccctcttctgggctctcaggcctcccgggccaccgccgccgccactcccacagctgcccacgcgcttcttctcctcctcctcctcctcttcccggcgctccaccaagagatccgccgcaaagacgccaatggactcggctcccgccggcgaacccttctacgtcgtccggaagggggacgtcatcggcatctacaagaccctcagcgaatgccaagctcaagtcggcaattcggttcgcgacccttctgtcactgtcttcaaaggctactctctgcgtaaagaaaccgaggaatacctcgcggcgcgcgggctaaggaacgctctctatgccattgacgcagcagatgcacgagatgaattgttcgatgatctagttccctgccctttccagcaacctgatggagctgcatcctctactttgaaaaggccacatgagattgaaaccggaccatcaaagaagcatcccaaagttgatgagcaggaattacctgatagtcatctctcttgtattcttgaatttgatggtg

SEQ ID NO: 22951 - DNA, 477 bp, Sorghum bicolor
  Clone ID: 14569914
gcacgaggggaggccggggcgtcgccgaggaggggcgaggaggacggcgacgagctcggggatgcgagtgcggagtcgtggagcacgaggtcgatgggggccacgccgagcttctccgcggcgcgcgcgacggcaagtaaaccccatcctacaggcacccctccggtccgcgcgatcggcccgtcgtcggcgtccgcaccggccgcgattacagcgcacaacgcggtccacaaggacgaactgcagctgccgaactttgtggataaggaggagtacaggcagactatgacagacatccaaaaaaaaatggatgtattgaaaaactttatgaagcaggccaacaaggaggggcaggccaacaaggaggggcaggacctcaccggcaagattggggaaggaggcacaggaggcgctgatgtggtgcagccaaaggttaactgcccacactacactgacaaggatgcttcccgcttgaga

SEQ ID NO: 22952 - DNA, 299 bp, Sorghum bicolor
  Clone ID: 14569918
gcacgaggcaaagattcgatgggattgatcgtcatgatcgatatgctaacagaaatgttgtctttttcgatatcaacatgaaaggtttggatggtatccaaggccccatttacgttggtacaggatgtgtcttcaggaggcaggcattatatggctatgacgcacccaaaacaaagaagccaccatcaaggacttgcaactgctggccaaagtggtgcatttgctgttgctgttttggtaacaggaagaccaagaagaagactaagacctctaaacctaaatttgagaagataaagaga

SEQ ID NO: 22953 - DNA, 375 bp, Sorghum bicolor
  Clone ID: 14569925
gcacgaggccccacttccaccctcgcgatctccacctccctcccccaccacccccgtaacccacttctgggtgggcccccacatcgccgccggcggacccgcgcctcccctccctacctccctcgctacccgagtccccgccccgcgccgaccgcgtcccgccggacatgacgacctcgccgccgcccgccgagcaacaacagcaggaggaagaggaggtgctggttccgcacgggccccaacaggagctgcccaatggagcgcagccaatggaagttgtgcctgctgagccagctgctactgtggaaaaccaacagatagaggacccaccaatctcgagatttacttggaccattgagaatctatcaagagtta

SEQ ID NO: 22954 - DNA, 415 bp, Sorghum bicolor
  Clone ID: 14569930
gcgaagcggttccacgtcgcgcttacggcgacggacgcactgtacagtcagtggcagtcgcggataatgcactactggtacaaggagatgagggaccgacctggctctgacatgggtggcttcactaggatccttcactcggggaagcctgatggattgatggatgagatacccaccatggtggttgacccccttcctgaaggcaaggataagggatatattgtcttaaataggccttgggcgtttgtccagtggatccagagagcaaagatcgtagaagattatatactaatggcagagccagatcatgtctttgtgaagcctttgccaaacttagcgcatggtgatgaaccggcagcatttccgtttttctacatcaaaccaactgataatgagaagatattgaggaaatttt

SEQ ID NO: 22955 - DNA, 527 bp, Sorghum bicolor
  Clone ID: 14569936
gcacgagggctgctcgcctcgctccgcggcgcggcgcgggaccgcgaggccgagatcgaggagctctgccgcgcgcacttccacgatttcatccgcgctgtcgacgacctccgttccctcctggccgacgccgacgcgctcaagggctccctctccgcgtcccactccgcgcttctctcatcggcggccccgctgctcgcctcgcttgagtccttcctcgtcgcgcgctcgctcgcggggaacctctcctccgcgctagcctcctcccgccggtgcgtacggctgctcgcgctcgcggcgcgggcgaacgcgcacctccaggccggcaaccatgggctctatctcgccctgcgcgccgtcgacgccatcgaccgtgatctcgcctcgggacccgagccgctgccgctacccacgctccgccgcatgctgctcagcgtcgtccctgcggtgcgcgcgcatgccgagcgcgagatctccagggagttctccgactggatgggtagcatccgcgctgcttccaggcacct

SEQ ID NO: 22956 - DNA, 527 bp, Sorghum bicolor
  unsure (1)..(527): unsure at all n locations
  Clone ID: 14569941
gcagagggtacaacacaaacacttatgcacctagcttttggtatggttctcatgtctatggtcctgggttgtatggtgggtggaatgcgttttcgaatgggaagtacaggccaagaggaaaaacctacggatcttatggttttggcaatgaaaacttggatagtttggatgagttgaagcgtggaccgagaagtagtctgtttaaaaaacaacagggttctggagcagctgttgattccaaaggacaggagcctcccaacagtgatggctctaatgctgttaagcaggaacagtacaaccttgctgatttttgtgaaacctactcagatgccaaattttttattattaaatcatacagtgaggataatgttcacaagagcattaagtacaatgtttgggcaagcacccctagtggaaataaaaagctggatgctgcttatcaagaggctaaggaaaaatcaagcagntgtcctgtgttcctgttgttttctgttaacaccagcggacagtttgttggtctggctgag

SEQ ID NO: 22957 - DNA, 422 bp, Sorghum bicolor
  Clone ID: 14569948
gcacgagggccaaccatacggcaacgatcgtgttcaacagcacagtcgtcggcgtgaagccggcgccgatcgtggcagccttctcgtcgcgcggccccagcgttgccagcccaggcgtgctgaagcccgacgtcatggcgccggggctcaacgtcctcgcggcgtggccgtcggaggtgcccgtcgggggccccgagtcgaacagcttcaacgtcatctccggcacgtccatggcgacgccgcacatcaccggcatcgtggcgctcgtcaagaaggcgcacccggactggtcgcccgccgcgatcaagtccgccatcatgaccacgtccagcgccgtcgacaacgacggcaaccagatcatggacgaggagcaccggaaggcgagcttctacgccctcggcgccggccacgttgtcccgacg

SEQ ID NO: 22958 - DNA, 600 bp, Sorghum bicolor
  Clone ID: 14569951
gcacgagggtcttcggcggcggcgcccgccggcgaggcgtccacctcggagcccgcagcgaaggggaagcccatcgtcgtgcgggtcaagcgcaagccctcgcagacccgcccggacgctttctggctagagattaatgagaggccggcgaagaaggccatgctcgatttctccagcctctccatctccgacccaccctcctcttcctccgccgccagtgctaaagcttcagaggaaccacgagttaagaaacttcttgtccagcacatcgagacagtacaccattctgaggctgttgaagatgtgttacactcacttttgcttgctgacttgaattccaaggagataaagagcaagacaaaggagtggaatgacagaatcaagcaagacaaaaaaccagaggagctacgatcagcagccagacagaggcatgaggatatgggtagaaatgctcgctttgcacaaatatggaagagtcgaaaaggagaaaataatgatgctgatgactcattgagagaaatatgccatctttatgatgctgtccaagtagatcacgatgacgagaagcatccagcagaaccacggattacctctttcgaa

SEQ ID NO: 22959 - DNA, 453 bp, Sorghum bicolor
  Clone ID: 14569957
ccgatccctcaccccccagattcctcctgcctacgctcgcggtcgcgggcgtctcctacccgcccgatttcgtttcgcctcggagctcgtcgtcgtcgtcgtcgtccccggtgcgcttttctcttcgcgggcgattcgctgcgcctcgtcgtcgccggcgacctcggcccgagtgtagcagggcaggtctgcttccacggacgtcttcgctgttcgggaggtggcgccccacctccaccgtctccctcctcttccgcctgcctgctctagtggggtgccggacctagcggtggagcggagatccgcccgggcttggattgctttcgtcgtcttgctggctttgaggtggagacggcattaagttgaaatttttatcacacgaggaagcaaaaacaagaaaaattcacatttcagtgttgcactctgtggagggttcattgtggtccaccaaac

SEQ ID NO: 22960 - DNA, 489 bp, Sorghum bicolor
  Clone ID: 14569961
gcacgaggttctattcctgcaatttcagtttgctggggcagcacaatcacttggagctggcgccattctagtaaacccttggaatattacagaagttgcagactcaatacggcacgctttgacgatgccatccgatgagagagagaaacggcacaggcacaactatgctcatgtcacaactcacacggctcaagattgggctgaaacttttgtattgtgagtttctcatttccagttgccaagtttgtcattcggtggaccaagtcccttccgttataaatttgttaccactcaatttttcggatgattatccttttctttttcatgtagtgagctaaatgacacggttgctgaagcactactgaggacaagacaagttcctcctggacttcctagtcaaacggcaatccagcaatatttgcgctctaaaaatcgtctgctcatattgggtttcaattcaacattgactgaaccagtcgaatcctctgg

SEQ ID NO: 22961 - DNA, 492 bp, Sorghum bicolor
  Clone ID: 14569964
gcacgaggctgatggcggtcaaggcggggttcgggaacgcggccaacgcgctggcggactgggacggcggccgcgaccactgcgcctggcgcggcgtcgcctgcgacgccgcctctttcgccgtcgtcggcctgaacctgtcaaatctaaacctcggaggggagatctcgccggctatagggcagctcaagagcctacagttcgtggatctcaagctgaacaagctcacaggccaaatcccagatgagattggggattgtgtctccttaaaatatttggatttgtctggaaacttgctgtatggagacatccccttctccatctccaagctcaaacagcttgaggacctgattttgaagaacaaccaactcacgggacccatcccttccacactgtcccagattccaaatctcaagaccttggatctggcgcagaacaagctcaccggagacattcccaggctcatctactggaatgaagtactgcaatacc

SEQ ID NO: 22962 - DNA, 469 bp, Sorghum bicolor
  Clone ID: 14569978
gcacgaggcgaacatttaacggtatcagaatttttgaagatattacaaatccaaagggtggaaagggtatacttctgaaatctgttggggtggtcggtgcaaaccctgatactgtgtttgaagtggttctcaatcttgataaacataagagatacgagtgggatatgttgacagctgatttggaattggtggaaacaattgatggatactgcgatgtggtttatggaacctatgaacccaaatatttaaattggtggaaatccaagaaggattttgttttctcccggcaatggtttcgcggacaagatggagcatataccattttgcagactcctgttggtcacaagaaaagaccttcaaagcatggatatgagcgtacaaagatcaacccatcaacatgggaaataaggagtttgaacacatctggatcatcgagtccaaaatgtgttgttactcttatgttggagat

SEQ ID NO: 22963 - DNA, 205 bp, Sorghum bicolor
  Clone ID: 14569979
ttaaggtgctaagtgttcttgattcaaattaccacaatacggaaacaaaataaaagaattttctgggatcaaaggaacctaaagttgctgatcacaaactggagcttgatatgaattttgctgaagttatcaaaatacagataccattcatacggatatctttaataagttcttctccacaggaatagttgtttgcttctgccaa

SEQ ID NO: 22964 - DNA, 578 bp, Sorghum bicolor
  Clone ID: 14569986
gcacgaggatttgtggtaattatattaagaggaaatgtgagtttggaggtaagtagtttagaaattaaatcttttgtttgtttcctaggagtgggagttttgctataaaggggatggaaattgggtgagatttgtgacttaatggaagataaatgtatcctcacaatccatcataaattgttctataactgtgcacacaaaaacacaccaccaacaaatagcaggggatatgaattccctcatcgactctccctgtcccttattggtctgtgactaaaatcaaattcacagcaaagtttatggaatgcttccgtaatagttagtggatggatctaaacagaccttaatgtctccaatcttttgatgaatcttttcatgtacttaggtagacatattttgtaaaatttgttataaattcacatccccatcctaaaataaatcaacttcttcctcgagctacgtacctaaacaaacacttggctagacataggagtatatagccataagttatttttttagtgagtgagtatttgtcatttactctaagaacattgagaaacttactggcatggccatat

SEQ ID NO: 22965 - DNA, 617 bp, Sorghum bicolor
  Clone ID: 14569992
gcacgaggatttcctcaaggattcggcaaccgcgcacccgtccctcccctctgccgactccgccgacgacgacgggtgggacgacttcgccgacgattcgccggccgccgacccgctcctctccccgtcatcctgggtccccctcctcgacccaaccagccctcccccctctggcgatgagacggactcgcctgccgacgggctcttcgtggcgggcgcccgcgcgatgctctccgcagcgtccgacggggacgacgcggcgttcgccacggccgccgcgcagatcgaggccgcggcagaggcggggcacccgggcgcgcagtccgcgctggcgttcctcaccggcgccgggatgacgcgcccggcatcccgatcgctcgcgttcctgctgcacaagttcgccgccgacgcgggagatctccagtcaaagatggccctcgcgtactcctatttccgccaggagatgtatgaagaagctgttatactatacgctgaacttgcagaagctgccctaacaagctccttgatatcaaaggagccaccagtgattgaaccaatccgtcttcacagtgggactgaagaaaataaagaggccttgaggaagtcacggggtgagg

SEQ ID NO: 22966 - DNA, 413 bp, Sorghum bicolor
  Clone ID: 14569996
gcacgaggcttgcacgtcgtctttcctccgggtgcaaaggattatcatggtaacctggagaccatctgggcatcagatctcctgatggctcgttgtgtatggagcaaaggttccatcaactattatgctaatcgcttcagaagcctccggcacttgcacctgcgctgctgtccaagcctccagttcgggcttgcgatgggcactcgcccctccttcccgagcctggagactctccacatcatccactgtggcaatctcatgcacatcttcgtaccggctgacaagaggtacaagatgtaccagcacacaagcatcgagttcccgaagctgaccaccatccacctgcacgacctcccggcgctgcagcagatatgtgaggccgctgccgaggtgctagcgcctgcgctggagac

SEQ ID NO: 22967 - DNA, 454 bp, Sorghum bicolor
  Clone ID: 14570009
gcacgagggtacatacaactgtggtgcaagaggcagctcttcctatttgtcttgaaggtaaagatgttcttgtcaaggccaaaactggaaccggcaaaagtgcagcttttctgcttcctgcaattgaatcagtcttgaatgctatgaagaccaatacaaatcagcgagtatctccaatatttgttcttgtcctctgccctacaagagagcttgctattcagcttgcagctgaagcaaatgtcttgttgaaataccatgaaggaattggtgttcaaactcttattggtggcactagattcaagcttgatcagagacgtttagaatctgatccatgccagattttagttgcaacacctggtagactgctggatcacattgaaaacaaatcatcattctctgtccgtttgatgagattgaaattgcttgtgttggatgaagctgatcatttgctaga

SEQ ID NO: 22968 - DNA, 611 bp, Sorghum bicolor
  Clone ID: 14570014
gcacgaggtgttgatgcagcaattcacagaggaaagaagcatttctatggtgatgacttggatgcagaggaagggaggtgcagtaaacattcagcaccagctattgacactgatcaccttgtgcgtgagatgatggacaaggtcttgttgtgcaatggtgagatgtgttcaaaaggcgtcaaggagctgcgtgaagccctgcagcatgacgtcgcaaagaattcgcatggggttcatggaaaagggtccggacatggcaagggccgtggcaagaaacaaccgaagaagaaggaggtggttgacttggagactctcctcgtccattgtgctcagtctgtggccaccgatgatcgacgtggtgcaacggagctcctgaagcagatcagacagcatgcatcgcccaatggtgatggtgaccaacgtttggcgcactgcttcgccaatggccttgaggcgaggcttgctggtaatggaagtcagatttacaagtctgttataatgacgaggtttccctgcacagatgtgctgaaagcctaccagctttatttggcagcttgcccattcaagaagatctctcatttctttgccaatcaaaccattatgaatgctgt

SEQ ID NO: 22969 - DNA, 540 bp, Sorghum bicolor
  Clone ID: 14570015
gcacgagggtccctgtcttagatcgaatgccagcattgattacactactttagttgcccaatggagtatgctgtagttcaatttttgtcagcatttaatacataacaggtggaaattgatgactagtcaatagaaactatccttgaaccaaccaatattcaaatgagcaaatcagttgacacattagaaaccccagtgctatgctaactatttcgtagactactttaatgattttgctacctcttctgtaactatgagatcactccactgccacctccttatgcatcacagcagtggttcctcggatgactgctgatgaaggattgtaggaccatcccctctttcactgtttgttacatacttttgtgcttgcttgtaaatgagagtgctgccatgcacaagtaattgaaggatgaattgctttcctttcctgtgctgtggatactcttttttactagcaaagtaaagaaatggcccttatttttaacaaaggaaatacccatttatagaggaggaaataaccatgattatgagcgctga

SEQ ID NO: 22970 - DNA, 465 bp, Sorghum bicolor
  Clone ID: 14570016
gcacgaggctttcttctacctcccgactcgctggcctctctcccgaccctgccccgcctcatcactccccattccaccgacacgcgctgtgtcgcgcgcctccgctaaaaccctagccccacccaggcccgatggccgccccgccgcagccgcacccgccggcagcggtggagggggcagcgccggcggctcccctgaccgccgccgcgccgggtccacggccgtacgacgtggcggtcgcggcggcggagctccggccggtggactgcaacctcgcctcgctctgtgaccacgtccaggcggaggggttcggctccggggccttctccgacctcgtcgtggaggccatgggcgccacctaccgtctccatcgcctcatcctctcccgcagcgcctacttcaggaatatgctacatggtccttggagagaggcgggagcacccacagtggttttgcacatagatg

SEQ ID NO: 22971 - DNA, 605 bp, Sorghum bicolor
  Clone ID: 14570023
gcacgaggcttatttcaagtagttgccgtcctgttgtcagaaagaaggctgctctatgccttctgcggctttataggaagaatcctgatgttgtgaatattgatggctgggcggatcgaatggcacaacttctagatgaacgtgatctaggtgtgctgacatctgtcatgagtctttttgtttcactagtatccaacaatgctgaagcatattggaattgtcttccaaaatgtgtaagaatattggagaggttagcaagaaatcaagatattccacaagagtacacttactacggaattccatccccttggcttcaggtaaagacaatgagagctcttcagtacttccctaccattgaagatcccaacgcaagacgagctttgtttgaggtcttacagcgcattttgatgggtactgatgttgttaaaaacgttaacaagaacaatgcctcacatgctgttctctttgaagctcttgctctggtcatgcatctggatgctgaaaaggagatgatgtcacagtgtgtggctcttcttgggaagtttattgcagtccgggagccaaacattcggtaccttggtctggaaaacatgactaggatgctg

SEQ ID NO: 22972 - DNA, 495 bp, Sorghum bicolor
  unsure (1)..(495): unsure at all n locations
  Clone ID: 14570030
gcacgagggagacgccgatttttttatccgcactcatccacacgacccaactcgccgccgcccccgccgcacagcctcagctcgccgccgcgcctgctcccttgttcggttccggtgagctctctgcacttgggcccgcgtctgctacccatcccattgcatcgagctggtagcagtttgtcttctcgtctccaaatcttcaccttcttccgaatccctatgctgagtgaatccacgacggcgaccacgtcttatccgcaactaccttgcccgatggattcggcagcggcgacgtcctcgccatacctgcagcacccatctacatatggcggcatcggcggcggtgtccatggcggcgccgtatccgcgccatccacagcatccctccacagagcccctcagcatgattcgacggcggcagcggcaccctcaccttatacgtacgaggagaatcgctcacctcaaccatcccctagtatgatccaagacctanag

SEQ ID NO: 22973 - DNA, 522 bp, Sorghum bicolor
  Clone ID: 14570039
gcacgagggtggaactcaatgattttcgggtgttgccagtccaatgagtgggaggaggcgcggatgctgctcgatgatatgaggcgcgaaggtacgttgcccggggttgtcacgtggaacacgctgatttcgagctatgcaaggtctggggaacttgatgtggccatggagatgctggagcagatggaggagtccggtgttgctccggatgttgtcacctggactagccttgtgtctggttttgtccatagtgataggagtggtgaggcacttcgatgtttcatgcgcatgcgtcttgctggagttgaaccgaatggcatgacaattgcgagtgccatctcagcctgtgctagtttgaggctactgagtcagggcatggagctccattgccacgcgattaaggttgggagcgtgaacaatgtgctctcggggaactccttggttgacatgtatgcaaaatgtggagaaattgttgcagctaagagaatatttaatgagatacccgagaaggatatcttctcc

SEQ ID NO: 22974 - DNA, 647 bp, Sorghum bicolor
  Clone ID: 14570042
gcacgagggtacattggttcagagttgtgcttgatgaagcacacatgataaaatcttctaaaagtttgatatccctagctgcggctgctttgactgcagatcggcgctggtgtctcactggtacaccaattcagaacaacttggaggatttgtacagccttttccggtttttgaaagttgaaccatggaggaactgggctttgtggaataaacttgtacagaaaccatatgaagaaggtgatgaaaggggcttaaagctactgcagtccattttgaagccaataatgctgagaaggactaaaaacagcacagacaaggagggcaggccaatccttaatttaccccctgcaaatattgaagtaaaatactgtgttttatctgaggccgagaaggatttctatgaagctctatttcgaagatctaaggtaaaatttgatcaatttgttgagcaaggaagggttctgcacaactatgcttcaattttggagttacttttacgcctaagacaatgctgtgatcatccattccttgttatgagtcgtggggatacacaagagtttgcagacctaaagaagcttgcaaagcgttttctgcgtggtggtaatggtgctgttaatggtgattcttcttgcattccctctagagct

SEQ ID NO: 22975 - DNA, 436 bp, Sorghum bicolor
  Clone ID: 14570058
gcacgagggctggctgccccccttcttcctcccctccgagatcccggcaccttcccgtcctgccgcgccgacaggccccccgctgccccgcccagaccgcggcatgcgcagatctcgcctcgttttccgccccgctgcgatgcataggcgcgctgcgttagccgcggccgctgtcctcctcctcgcgctctccgttcccgtctccgtctccgccggcgatgtccaggctgctgatggcgctgccgggaatggcactggcgtcggcctcgaccgccgcaccaagatgttcctccaccacgcggctggggcgcgggcggctgcggcgcatgacacggggctgggacacttggatgccttcttcgccagcctgtccataatcgacgtcagcgagattggcgatgagacgttcatcattgcggcgctgatggcgatgcgg

SEQ ID NO: 22976 - DNA, 446 bp, Sorghum bicolor
  Clone ID: 14570072
ctttaaccctacaaggttcaaggataaaccggagatagaccgcgggtcaagacacttcatggcatttggaggaggcctcagatcctgtgttggagcagacttcagcaagctgcaaatgtctattttcctccatttccttgtcactagatacaggtggaaaaatctttggggtggcaagatagtccgaaatccggggctagaattttctgacggatatcacatccaaatacgacactggaattagtcaaggcctccttctggagctagtacaaagtcgtaaaaatctctttgtgcatccacgaagtggacagaggaatgaattgctattattagtgtcaaagtacaatatagttgtaccatatggaggttgaaatgtccctactgtaacgcttatgtcttttggcaaaatggccgcgattcgagctcgagcctaatcgaaagctttg

SEQ ID NO: 22977 - DNA, 110 bp, Sorghum bicolor
  Clone ID: 14570086
ggagaagctgcaaatatcagatgtggagacagtagcggctcctgacaatgtcaaggatgatgtggagacagtagcggctcctgacagtgtcaaggatgagctatatcctg

SEQ ID NO: 22978 - DNA, 384 bp, Sorghum bicolor
  Clone ID: 14570088
actaagatgcctacgagtggaatgagttcaatcatatagaaacgtacagtttaaggagcaagggctatgccagttttgcctgctggatcacaaggaagaagagtgtggtcagatatccttttgtggcaacaactaggggaagttgcgaagaattgctgggtctcttctgcttttcacaacttttcgttaatgtacctgcgaggggtgtggccaatgacctcgggtatggtagggtttgatcgcaactgtaaggttgatgaacggtttgacagtgcactgatatatagctgctgctgttgtgatatcagtgtgggtattggttgtatatctctctgggtacatagtagtcgcccctcgaaaagaatacagcaaatgtttggtccc

SEQ ID NO: 22979 - DNA, 592 bp, Sorghum bicolor
  Clone ID: 14570115
tcgcaaacgatcaaaaagcgcgatacatgtcatcgtcacttaagctgaaaaattgcacagtgattgatgattcacatggcagctcttttacgatatgcagcagtttggggctgatgaatgtcattgtgaaagatcgggagaacatggcagtgacagatgcagaggaatttgaaacagtgctggtggtggatctgcctccttcagtcgacgaatatgttgagatcctcactggggttgctcttcatgtgattggaggcgaagtgcatagtatattctgtaacgctgatgcgtttattgcaaaacctctggcggagcttcttgcagattgccgtcaggtggtgcctgagtttttcaaaaacctggagtcttcatagcagacttgtgtacacaatcagaatagtcagatcatatcgtggtgcggttgtggcacttaactgtcaccaatcaattttgttattttttgtgttgggttctacatgtaattctcatttgtcagccaacattggtattcaggcctcgaccttgatatgtgtactaatgtactattatctcatacattgtgaaatgtgaatgccctgaagccctttccctg

SEQ ID NO: 22980 - DNA, 404 bp, Sorghum bicolor
  Clone ID: 14570122
gcaatttaactgtgcaggctacggtaaaatgccaggatatgagcgcatgttcacagacttcttactaagtcttgcacaaagcaagtacaaaaggtacttaagcgggacctgaggtgcaaggaagtttgcgaagactgtattactgacaaaatggcatataacggtggcagccatgcttccctagtccccaccaatgtacatttgctggagacataagcatagcataagccggaggcttgaggaagtcggcaagtcgcagtgtatgtgttcaaaagtggtggcacatgctggactggagtaggaaataaccaaggaaatgcttggatgccctgtgcgacatgttgtaaaatgtttaactgaatgaatgacttcttcgtgatggactccttccatcataattcgtc

SEQ ID NO: 22981 - DNA, 590 bp, Sorghum bicolor
  Clone ID: 14570132
atccacctacagagaatgttggggcgatcagagattcgaatccagttcacgattttgaggccatgctggctaatagatctagctcaacttgggttcagaaggctattgaagatatgcagaattacacagcagctttgttacaaaagtctcatgatgggagtaactaccaaaaggcacttgaatgttttgctgctctgcggaaggcctgcattattgaacaggaaccacaggaattcaacgaattcctaacaaagatttacgagagattgaaggagggtgatgctgccaagttctttcaacttctctcctcaaaaaatatttcacttatcagcaaagaggaagcgcctgacagcgacgtgactgaggagatggcaaaaagtttctacctgaaacgagaaaaggcgtctcagtagcagctggaagaaactggaagcgccttgggcttttgggtttggagatcaccggaccggggttgtgaaactgtcctaactgtagcttagcctagcccgttgcatgtgtatgggcatgttttgaggctttgttcgtggatggaacttgaactaatactcaaactctctggatttagctgc

SEQ ID NO: 22982 - DNA, 551 bp, Sorghum bicolor
  Clone ID: 14570192
cagggtcgatcgcgagaagataggcatgccttcagtatgacttccttcaaagaggggctttatacagtcgaattcagatcatccattgcgttacttcaagcttttgcaatgtgtatagtgatgctccatgggaggtaccctagcaggatgcaagttggttcgcaagcagcgcaggagcatgatctccttgctggtcatgagctcaaggccatggcagccagtcaaggaagagctccgaccagctatgtgccacaccggccacctctttctcctgtaggccgagcctagcttattgcgattaaatgtatgttctttctgtgtctgtcctctttcttcagttgtgtagtgccggtgggatcgatataccatggtcctcaggtccatatgcaatacgcatatccaaaatgacaatctctgtgcaagagtctttagaggtagctacctgtacatgttgtaatgtggatgttgtatgactgtactatgatgtggctgcaaggcccatctcactgcttagttaccctttatatgtctcctaaaaaaaaaaaaaaaaa

SEQ ID NO: 22983 - DNA, 397 bp, Sorghum bicolor
  Clone ID: 14570193
cgacccggtgatcaacccggtggccatggcggcggaggagtggcgccggctcccctgcgcgcgcgttttggtcaccgtggcggggctggacatgctcagcgccaggggccgtgcgtacgtccacgcgctcagggccagcgggtggcaaggcgcggcggagctgtacgagacccccggcgagtatcacgtttacttcctgaacaagcccgacagcgatgaggcggcgaaggagatggaggttgtggtggacttcatcaatggcgatcaagtgagcagcagagcttcaagaatggacgcctgaagctgcttattttgagatgtcttaagtgccaggggtgtcacttagcttaatcattttcaaacggtctttttacaagtgattcgaaaccaaagcgtt

SEQ ID NO: 22984 - DNA, 602 bp, Sorghum bicolor
  Clone ID: 14570196
ggtgtctcgcctttgatctcctgctcacaattctgcttctgcttctgcttctgcttcagcatccgcttgattggttcgtgtgtgtgtgtgcgcgcgcgcaaatgacaacatggatgcatatgcttttgcttgcgtccttgtggttgtggtttgtctcatttgcatcagtttgctttggtttggtttgcttggtcagccttctcgatggatccagacatccatccttcacttctgcctatgtgctcctgttcggaagatggtgtgatacagacggacaggcctgtgtgctgtctggagcagtagtgaaataaaacaagagccagtgagcattggatccgacagctgaattcccttcagcttgtgcaacagcagcatgagacatgctcccatacgtgctactgccaattgctgtgctcttgtatggtgtgtttgtggactttggttttgtatggtgtgtttgtggactttggtttggtatacactgctgtgtggcgctgccgtgtttgagctgtcggttgtgtgtggagtagagtgttcaatgttattgttgctctacttatgttcgtgaacaaataaataaatgccgatggctgtatgtgtgg

SEQ ID NO: 22985 - DNA, 254 bp, Sorghum bicolor
  Clone ID: 14570199
ggtgaccccctccatgggatccagaagacgccccttttttggaagccccgtacagagatatgcattggtgcagttcgtggcttgcactcccttcatgaactaccgttcatccatggtaatgtgccctcagaaaaaatcctgctggttgaggaatgggttgccaagattactgtacttccactttccaatacttggacattatcagttgagcatggaacttatggttatgccgctcctgagtacgtgaggaccag

SEQ ID NO: 22986 - DNA, 180 bp, Sorghum bicolor
  Clone ID: 14570222
tattcttgtcaccccccatttgtgggggttacatagagaaaatagtttcttccggccattcatttcccctacatatattgtatagtatccagcagagatgtgatcttcagattcatcgtgatgtattcgacaccacgccaaaggataatctgatctgaagaagtttattcacctcctcgg

SEQ ID NO: 22987 - DNA, 437 bp, Sorghum bicolor
  Clone ID: 14570300
aggtcaactagcgatggtatgaagcttcaggggtgaagacagcgaccgcattccgtcacggatagtgcaccgctcatcgaactgggcaaatatcatcctcaactctgaccagagtgcgtcgtcatctggcattcttgtgccaaagaatagattgtcctgacttcagatgaatgaagactgtaaatgatcagccaagaaccagagattccagtatctgaccttctttgttgtcaatgtcaaatcttgtcgcagggatggttggatactgcgcaaatcattaatttttttgttagtctctgaatcgctaggtaggctgtgtctgaatttcttccgtgggggttcaggtgcttgtaattttgctgttagacgacaatgaactgatttgtttagaggttggcaccttggatcaaatgcttgattggttggtgattgttctt

SEQ ID NO: 22988 - DNA, 457 bp, Sorghum bicolor
  Clone ID: 14570308
ctattttaagtggagggttgtattggaaaatcaagtacattagtcgactggagtatctctggggggacataaaaaagggagaggttgaaattccagagtttgttattgaacatgataaggttcttgagcaccggccactgactgattatggcatagaaccagatcccctacatcttgctgatgtacctgctgtgggatactcgcttggaagatacgaagataaatggactccagaagatcgtcggtattcaaggaactacatgtgaatttttctgctgtagccaaaggcttaaaagttgattgtatagtaacacggtactatgagattgtatgtcagattgctgtgaaaaccttgtcaaggtcctgtatttccagctttgtgatccaatttaatacctattttgtatgtcagattgctgtgaaaaccttgtcaaggtcctgtatgtcagattgctgg

SEQ ID NO: 22989 - DNA, 363 bp, Sorghum bicolor
  Clone ID: 14570347
gcctcgtcaaagtacagagctcgtgtggaagctcctccaggggtggacgtcaccgtgagcccttctctcctgaccttcaactcgaccatgagaagtttgacgttcaaggtgacgttccaggccaaactgaaggtgcaagggagatacaacttcggcagcctgacatgggaggatggcgtgcacacggtgaggatccctctggtggttcggacgatggtcagtaagttctatgtcaattcatgagctagtgtgtgtttgtgtgtattacctttcactcaccaccgggtgatggtgagtgagcagacaggatgtaacctgctaatttgtcccgattctaatggcattggtgattggttggggttc

SEQ ID NO: 22990 - DNA, 255 bp, Sorghum bicolor
  Clone ID: 14570359
gcacgagggacgtgagttttcccatatcgcccgtcccgatccagcagatgtgcgcgtaccactaccacatgcggctctccggcgtcgcggccgtcgtgctgctgctgctgctgtacgcggtgcaccggtggaggaaccctcgatgcagcggcggccgcctcccgccgggatccatgggcctgccgctcgtcggggagacgctgcagttcttctcccctgacgcttccttggacgtgccgcgcttcgtccggcaca

SEQ ID NO: 22991 - DNA, 213 bp, Sorghum bicolor
  Clone ID: 14570360
gcacgaggcaccggccgccccttcgcgcagccatggacaacgccccatccacgccgccaccctcgcttcctccccatccacggcatgcgctcaaactgtgtcggtgccctagccctatggggcgcacctccacctgcagcagctccaccaaccggcggcccggcgcccagatccagatgagaggacgtcgacgccgcgtattcgtaggcgagg

SEQ ID NO: 22992 - DNA, 440 bp, Sorghum bicolor
  Clone ID: 14570368
gcacgagggcctgacgcatcagcggcgagccatggctcccgctcccgttccagctctacctccagccatggataataaggatgagggcgacggtggcgccaagaaccagaacggcatggtggtggacgagggcgacagtggcgccaagaaccagaacagcatggtggtggtgaaatccgaggctgtctgcacggatgatggccctctggtggtcgctactgagcttgtgaaatacgagggaggcgataccactgaatgctcgagctcgtttggggacacctgctctggatttgaaggcgaggcagacaatggtgaaccagaagtgaattctggcatgtccgctcatgacaatggtgttgggccctcaaagccccctagaaggaaaaaagtgatggctgagtggagcaattctgttcgtccaattgagtggagatgccact

SEQ ID NO: 22993 - DNA, 136 bp, Sorghum bicolor
  Clone ID: 14570369
gcccccgattcccttgtcgccctccgcagatcctccctcccacggagccggcggatctccttgtcgccgccgggaggctcgttgccgttgccgtttccggcgcaggtgctgctgctccccctgccgcccctgcgta

SEQ ID NO: 22994 - DNA, 318 bp, Sorghum bicolor
  Clone ID: 14570373
gcacgaggccctagtgcattgcaaagcaccggaatccatggcggtcgcggggccggggcagctcaacctcgacgagtcgccgtcatggggatcccgtagcgttgactgcttcgagaaactcgagcagatcggggagggcacctacgggcaagtcttcatggcgaaggagacggagacgaaggaaatcgtggcgctgaagaaatccgaatggacaacgagcgggagggcttccctatcacggccatccgcgagattaaatcctgaagaagctgcaccaccagaacgtcatcaatctcaaagagattgtcacctcgccag

SEQ ID NO: 22995 - DNA, 239 bp, Sorghum bicolor
  Clone ID: 14570380
gcacgaggaaagttcttgaagaaaatagaaagctatacaaccaggtccaagatcttaaaggaagcatcagggtatattgtaggatacgtccctttttgcctggacaagcaagtccatccaccgtgggttccatcgacgagggcaacataaccattgtcaccccttccaagtctggaaaggaaggccggaaaaattttagcttcaataaggtttttggcccatcagcaacacaagatgag

SEQ ID NO: 22996 - DNA, 243 bp, Sorghum bicolor
  unsure (1)..(243): unsure at all n locations
  Clone ID: 14570392
gcacgagggacatgataaaagaagccattgaaaaaagggcatcttattttagaaagaactctgatactcttactttacaaggagttcgacgtactttggaagaagatctcaagcttcagaagaaagctttggatgcctataagaacttcattactacagaattagacaggattttgcaagaacctgcaaatgggacaaagaaaaaagtaaaaagggatcttccaaggatactgaccanacaag

SEQ ID NO: 22997 - DNA, 356 bp, Sorghum bicolor
  Clone ID: 14570400
ggcacgaggcacccctccactcccggcgggcggcggctgcctcgccgaagcggtccagccggcgcgcccgagatggcgaagggcgacgacgcgctggcgcggaagcgcaaccgggtgcgccgcaagcgcctccgcagcagcgagaacgctgtctccgcgcgggtcgcggcaatcatcgcctccaagcgccgccgcaagtcggggaagcgccgcggctgcgagggcatgtgcttctcgctccctacgcccgacgacccattcaacgagcgccacggcaagaagcgcaaggtcgatgacgagccgaccgaggacacagccgccgccaaggacggcgacgaccccaagaagaagggcgc

SEQ ID NO: 22998 - DNA, 365 bp, Sorghum bicolor
  Clone ID: 14570411
gcacgaggcaagctcgagaacctgctcctcgacgaggcaggcaacctcaaagtggcggacttcgggctcagcgcgctcgccggccacgcacgctccgacgggctgctccacaccgcctgcggcacgccatcgtacgtcgcccccgaggtgctcggcgggaagggctacgacggcgccaaggcggacctctggtcctgcggcgtcatcctctacgtgctcctcgtcggcagattgccgttccacgaggacaacctcatggtcatgtaccggaagatgcagcgcggcgagttcctctgcccgccgtgggtctcagcggacgcccggaagctcatcggcgacctgctcgacccaaacccgagcaggcg

SEQ ID NO: 22999 - DNA, 263 bp, Sorghum bicolor
  Clone ID: 14570417
gcacgaggcagaacaccacgcttccaaagcccataggcaactcggggatcacccgggttggctgtgatcccacaactgcctccacgacacagtcctctggctctgtgccgtcgtttgggccaggctccggtgaggtgcttgactttgatgcacaccaccggctcaccatcaacaacacggacggcgatggggaactgcagcagtttccggcatgccctctcaatttcagtgagtacacgccgtgtgaggaccgtaagcgcggg

SEQ ID NO: 23000 - DNA, 340 bp, Sorghum bicolor
  Clone ID: 14570419
gcacgaggatggggtgctgcaagaggtcaagaacatatgctcgactcttgtgcataagaagctagtttataacaggagcgatgaagtcggtattgtcctctttggaactaaaggaacatgcaatgagcttgcaaaggagcttgggggctataagcatgtgacagtcacacgtgatattaaagttgtagatgaaggggcggcacaggctctgcaaaaccttccattaggatctgcccctggtgattttctggattctattgttgttggcttggatatggtgatgaggaaatttggtaataccaaagggaagcggaggctctgtttaatcaccagtgcacag

SEQ ID NO: 23001 - DNA, 358 bp, Sorghum bicolor
  Clone ID: 14570427
gcacgaggctcattatggaagaacttgaccgcgacaatctgggatacattgagcttgaggatctggaggcacttttgctgcaatcgccatctcaagctgctgcaagatcgacaacacaaagctcaaaacttagcaaagctcttagcatgaagcttgcatcaaacaagaacacaggtccactttaccactactggcaagagttcatgtacttccttgaggagaactggaagcgcatttgggttatgactctctggctctcaatctgcattggcctcttcatttggaagttcatccaataccgtaatcgagccgtatttcacatcatgggttattgtgtgtgcactgcaaaaggtgctgc

SEQ ID NO: 23002 - DNA, 268 bp, Sorghum bicolor
  Clone ID: 14570430
gcacgaggctcagacgcagtgttccattccaacatttagctagccaacaaggatcatcggagctcgggctcaagtacttgttcttagctgacttcttcattgtaggaaacaatggctacctcctatctgctgccttgctatgtcctcatcactgtgctcgtgctcttcttctccgtcgacgttacggaaggggccatcagggagtaccagttcgatgtgcaaatgaccaatgtgacgcggctgtgcagcagcaagagcatcgtgaccg

SEQ ID NO: 23003 - DNA, 410 bp, Sorghum bicolor
  Clone ID: 14570454
gtacagttcgtacttttgttatacctattgagctagaggtgcatacgcgaacttactatgattccagtggcttaattgctgtcacatttgagcatatatcgacttgtgatgaaactggttcgatattttcactttccttacggaatgatggaccaaagttactgagggttataggtgttactgaggatgacagaaatggcccaatgatctttcaggttaagtacctgaatggatcgatactcttccctaatactgtaacagatatagctttagtaagatatacttcttcagttccagaggacatttcatctgacagctgcaatatagttgtagaaacaaacagtacccttggtagttcaatcatattaccgtgcaaagatttagtgcgtgcatctcttttctatactagc

SEQ ID NO: 23004 - DNA, 277 bp, Sorghum bicolor
  Clone ID: 14570463
gcacgaggaaagatagtaaccatggtctgtggtacctttgagaaagaaggtcctgcactggttgttgcttgtggcgagataccataccatatgcaagttctgtaaggcgtttagctccagataatgtatttgtcattcagatacaacatcccaggtctcgccttggtaggtttgatttagttgtgactcctcgtcatgattactatgctttaaccacaaagggacagcaggaagttccacgccttttcaggagatggattactccacaagaaccacc

SEQ ID NO: 23005 - DNA, 295 bp, Sorghum bicolor
  Clone ID: 14570480
gcacgagggctgtggttgccccccactgggaaacttccagcctagtacgagaaatgctaattctgcttcagccaatgttattgcagtacttcctgatggcttccatggtacatcaacaactgggcagccattgcctttgattgagaggtggaagtcaggaggagcttgtgactgtggtggatgggatgaaggttgcacgctgagtatactcactgatgcggcccaagaaaatgatgccattcaggctaacctggcaaaggatggcagccagcgatttgagcttctagttcagggt

SEQ ID NO: 23006 - DNA, 272 bp, Sorghum bicolor
  Clone ID: 14570481
gcacgagggtcctctacaagagcggccgcgtgcagcgcttcatgggcacggacaccgtgccggcatccacggacccggccaccggcgtcgcctccagggacgtcgtcgtcctcgacgcctccgccgccgccgccgccgcgggcctcgccgtgcgcctctacctgcctccaagccgcctcgccaccaaccgcacgggcacggacgccgacgacgaaagcgaaaggctgccgctcctcgtgttctaccacggcggcgcgttcgtcacggagtca

SEQ ID NO: 23007 - DNA, 355 bp, Sorghum bicolor
  Clone ID: 14570483
gcacgagggtttactcctcccacctccaccttcccgccgccgcgcactccgtgctcctctggatgaccggactcggcctcccgccgacccccatcgactacaccgatctcatcttttccttctgccgcgccggctgcctcgacaacgccctccagctgctcgacgaaatgcgcgccctcaattacccgctgacaccacatacattcgcgccgatcctcaaggcaatctgcgataatgcggacatccaggcagctgacgcgctcataagctccatgcgctcctctggttgcctccctgatgtcgtcatctacgatatatacatccaggggttgtgtaagatcggggattttgatgc

SEQ ID NO: 23008 - DNA, 381 bp, Sorghum bicolor
  Clone ID: 14570485
gcacgagggtcggttccatctgtttgccttctgtctcctgctactgcatgccaattcaagttaaccgaggcaaatactagatgcaattgtttgtttgatccgtttggctttctacatatctccagctacggattcgacaaaataattatttgtatatgtcctactgctgcatgccaattcaacataaccgagcagtgctgcccatcaaggaaaccgcctaattcggcatcggtgtgcatggaccattcccttccaaaatgaagtggaggttgcagcattattattaattcaactgctgaagatatatatagttctgttctggtacaccgtacaaacaatccaccaagcttagccaaacggagtggcgcgtccggttacttc

SEQ ID NO: 23009 - DNA, 318 bp, Sorghum bicolor
  Clone ID: 14570488
gcacgagggtgagagcgccataggtggtgctcaaagccttcatggctgggctggcatgcgcccggcgcgacatgccgacacattcatagcctcgaagttttttcaacttcactctatagcctactcccaggtccatccgtaacggtgcgaccttcaactgttcggtggaggaggtggacggcatggccgcgtcgccacgcttgcgcacagcttctcgaccggcccacactcgcttgggatgggagcacgtgggctgtggcgactgccaagtgatcggcggcggccgaagtgttgcgattgtgagtgtttgttaccgcc

SEQ ID NO: 23010 - DNA, 409 bp, Sorghum bicolor
  Clone ID: 14570493
gcacgaggccctccccttctcgcccttaacactcctcccctgccttggtgatgcagattcgtgagcaacctgacggggtcttccctgctggagatcgcggcgctctccaccgtcgtgccggcattggtagttctcagaaagtggagcagcagagataattctaggaaggattcagcaaagaaaaatgatgatcaagttcaccctgttcataaagattggatgcagtacttctctacactaggtgtagattatctcactgttgtattgccaattattttggttttcacagtcttatctgaatgggcctttacgtgtgctatttctcttgtagttctgatatccatctacatcatgtttgaaaggtctcagcttcatcttaaagatgggttcagtcagctgccttcgctca

SEQ ID NO: 23011 - DNA, 425 bp, Sorghum bicolor
  Clone ID: 14570502
gcacgaggcctgttagccctaaaccccctcctatcccgatggcgccgccaccgccgccgaagctgccgattcccggccgccgcaacatacttatcaccagcgcacttccgtatgtcaataacgtcccccacctcgggaacatcatcggctgtgtgctcagcgccgacgtgttcgctcgatactgccggctccggggttacaacgctatttacatatgcgggactgacgagtatggcaccgccaccgagactaaggccatggaggagaagtgcacgcccaaggagatctgcgacaagtaccatgctatccacaatgaagtttacaagtggtttaacataaaatttgacaagtttgggcggacatcttctcctgagcagacagaagtctgccatgcaattttccataaattgatggaaaataattgg

SEQ ID NO: 23012 - DNA, 360 bp, Sorghum bicolor
  Clone ID: 14570512
gcacgaggctcaacatggacacggtcgagaagatcgtcgaggacttcgcctcggacatcgccctgagccccttctcctccgggacgagcctccgggagatgatacgcgcgatacgcacgtgcaagacagcggcggaggagcgcgcggtggtgcggcgggaatgcgcggcgatacgcacggccatcagcgagaatgagccggtgctccggcacagaaacatggccaagctcatgttcatccacatgctcggctaccccacccatttcgcccagatggagtgcctcaagctcatcgcggccacggggtacccggagaagcgggtgggctacctcggcctcatgctgctcctcgacgagcgtc

SEQ ID NO: 23013 - DNA, 529 bp, Sorghum bicolor
  Clone ID: 14570518
gcacgaggtgatggccttggaattgttgcaagtatcctcttggttgtgtttgtgactgcgacaagtgactatcggcagtcgctgcagttcaaggacctggacaaggagaaaaagaaaatccaagtacaggttacaaggagtggtttcaggcaaaggctatcgatatatgatcttcttcctggcgatgttgtccatttagcaattggagatcaggtccctgctgatgggctcttcatttcagggttctctctattgatcaatgaatccagcctaactggtgaaagtgaacctgttgctgtaaatgaagataaccctttcctgttgtcggggaccaaagtacaagatggctcctgcaagatgctggtcacaactgttggcatgcgcacccaatggggaaaactgatggccactctcagtgaaggcggcgatgatgaaaccccactccaggttaaacttaatggagttgcaaccattattggccagattggactattttttgctgttataactttcattgtcctgtcccaag

SEQ ID NO: 23014 - DNA, 483 bp, Sorghum bicolor
  Clone ID: 14570519
gcacgaggcatggttctcggctatatctcttgggaaatgctgagagaacaagttgagatcaaggcgtttgtgcaggtgcagattgagccacatattgataaaccaccaaggacctcccaagttgccgataggttggccgagtaggagtttttgggctacctgatgaaggaggtgataaacagcgccgagcagatagcggccgagaggaaattgaccaccgctagccaacctttctgctgccgataggtagacagaagtcggtcctgccgatcgaccacagaatacgaacttgtctagccacatgttcagaaaagtggtttgttcctttagggtgacaggtcctttcccgcggtacttctggatgtaccctgaccagccgccgatagcgcgagtctccactttggcgctgggggcggtatcgaaaaagtgggtgctatcggcagaagatatgtctaacccagtgagcatggctacatcggcaag

SEQ ID NO: 23015 - DNA, 517 bp, Sorghum bicolor
  Clone ID: 14570528
gcacgagggtcccgtccaccggtcagtttgcctacttcaacggcacatccttcgccggcaacgctgggctctgcggggcgttcctctccccgtgccgctcccacggcgtcgcgacttcgggctttggctccctctcttcgacgtccaagctcctgctcgtgctcggcctcctcgcgctgtccatcatcttcgcggccgcggccgtgctgaaggcgcggtcgctgaagcggtccgccgaggcgcgcgcgtggcggctgacggcgttccagcgtctggacttcgccgtagacgacgtgctggactgcctcaaggaggagaacgtgatcggcaagggcgggtccgggatcgtgtacaagggcgcgatgcctggcggcgccgtggtggccgtgaagcggctgccggccatcgggcgctcgggcgcggcgcacgacgactacggcttctcggcggagatacagacgctggggcgcatcaggcaccgccacatcgtgcggctgctggggttcgcggccaaccg

SEQ ID NO: 23016 - DNA, 549 bp, Sorghum bicolor
  unsure (1)..(549): unsure at all n locations
  Clone ID: 14570529
gcacgagggcggcgcgcgccgcggcggggcccagcctctcgttcgcggacccgaggcggcgggaggtgccgcgggacggggcggacacgcccgccgtggtcccagcgttcgaggtcgcggcggagggagcccagaaggtcgtgataaagcttcctcctgggacatctttctatggtactggagaagcaagtggcccacttgaacggactgggaaacgagttttcacatggaacacagacgcatggggttttgggccaggaaccacttcattgtaccagtcacacccttgggttttggctgtcctccctgatggaaaagcattgggtgtccttgctgataccactcggcgttgtgagattgatttaagacaagaatcaactataaagttctttgcctcatctgcctaccctgtcatcacctttgggccatttaatactccagctgatgttatgacatctttgtcgcatgcaatcggtactgtgtccatgcctccnaaatggtcacttggctatcatcaatgccgttggagctatgattcttctgagagag

SEQ ID NO: 23017 - DNA, 374 bp, Sorghum bicolor
  Clone ID: 14570540
gcacgaggccagattcaatcatcgattcttttctagcaaaaaaaaaatacaggaattctctgcaggagtggttttggtaaacaagcagtgctggaaacaccgctccaaagaatgcaaaatcaaaatacagtcatctactgaaactatcctgagaaggctgaaggagaggatactggcaagagtgttgatagagccgcacacctcctgcgggagtggttttggtaaacaaatagtgctggaaacactgctccaaagaatgcaaaatcaaaatattctccgttaaactgaccaaaaaccaatccagtcgttcacctgaatctatcctgcatttaacatttggatggaaagctccaagccatattctatcagggttg

SEQ ID NO: 23018 - DNA, 526 bp, Sorghum bicolor
  Clone ID: 14570553
gcacgaggatgtcttcctcctccgccgccgctcgccgccttctcctcctccgccaccgccatggccaccttctccccaaacgccacttctcttcctcgtccgctgccgacggcctcgacgacggcggccgcgtcaagatcttcgaccgcgacctgaagcgccggcaccgggaccgcgcggcgtgggcgatgcgtgagaccgacggtctcgtggatgccgtcgccgaaaacctcctcgaccgcctcgaggactgcaggaaagccttcccctccgcgctctgcctcgggggctccgccggtgccgtccgccgcttgctccgcggccgcggtggaattgagaggctgatcatgatggacatgtcagccgacatggtgaagaagtggcgagagtcagagaatggcactggtgacgaacctgagatgcactttgttgtcggtgatgaggagttccttccaatcaaagagagctcacaggatttgataataagctgtcttggacttcattggacaaatgatctacctggagc

SEQ ID NO: 23019 - DNA, 279 bp, Sorghum bicolor
  Clone ID: 14570554
gcacgaggcactggcacggaagcccaactctcccgtcagctccgtcgtctgcgccgcgctcctagctaagctaacctcctctccccttgtttcggaaagtggaacaaaccatggatgcggcggtggcggcggcggcggaggctcgggagcgggtgcgggcgagcttctcgacagggaggacgcgggcggcggcgtggagggaggcgcagctgcggggcctgctgcggatggcggcggagatggaggacgacgtctgcgccgcgctccgcgccgacctcg

SEQ ID NO: 23020 - DNA, 552 bp, Sorghum bicolor
  Clone ID: 14570556
gcacgaggcagcatattacctgcgtactcattccagataagcccacggagggtggtggccctgatattccacctcatttttattgtgaattgtgccgactgaaccgggcagacccgttttgggtgactacaggaaatccattactacctgtgaaatttatgtcatctggtgttggaaatgatggagcaagtgtacctcaaattgtggagaagaccttccagctttcccgagcagatagagaaacagtccagagacctgaatacgatctccaggtttggtgcattcttataaatgacaaagtccagttcaggatgcaatggcctcaatatgcagaattgcaagtgaatggtattcctgtacgagtaatgaccaggcctggttctcagttactagggataaatgggcgggatgatggaccactggtaaccacatgcagtagagaagggatcaataaaattagcttatcaagagttgatgcccgaaccttttgctttggagttcgaattgttaggaggaggactgttcctcaggtattaaacttgatcccaaagg

SEQ ID NO: 23021 - DNA, 169 bp, Sorghum bicolor
  Clone ID: 14570562
gcacgaggggcgcttctcccaaatcccaatctctgccttgtcgaccccctttcctgcgatccaaaccctctgtccgttcgaggcggcggcggcggcggattggcagctctactctccgcttagcttgggcggttgccacaccgcgcacctgctgaccgcggcagccacc

SEQ ID NO: 23022 - DNA, 402 bp, Sorghum bicolor
  Clone ID: 14570570
gcacgagggcggcgcgcggcgccgggcgcggatcggccgcgggtgcatggtggaggccgccgccgggcgccggccaggcaccagccgtcggcggcctagcggcagcggaggggagcaccagcgcctggtcgcgctcgccgtcgccgcgcgagtcgccatggtcaccacccggtctgcggggccagcggtggcgggaggagatggagcgggaactgctggaacgggcgccggcgccgctggcggcagcggacgatgcatggaggacttcttcgactgcctcctgggcctgctcggcgcgttaggcatgacatgggctgcggcgcggccccagcggcagccacgcccgccgctgccacgcggggttggggcgggggccgtgccaaccgacgcccggcgtttcgc

SEQ ID NO: 23023 - DNA, 440 bp, Sorghum bicolor
  Clone ID: 14570579
gcacgaggcgcacttctacgagtcctgcccctacctcaagttcgcccacttcaccgcgaaccaggcaatcctcgaggctttcgccggctgccgccgcgtccacgtcgtcgacttcggcatcaagcaggggctgcagtggccggctcttctccaggccctcgccctccgtcctggcggccccccatcgttccgactcaccggcgtcggcccaccgcagcacgacgagaccgacgccttgcaacaggtgggctggaaacttgctcagttcgcgcacaccatccgcgtcgacttccagtatcgtggcctcgtcgccgccacgctcgctgacctggagccgttcatgctgcaaccggagggggacgacaaggatgaggagcccgaggtgatcgccgtcaactcagtgttcgagctgcatcggctgctcgctcagcccggcgccc

SEQ ID NO: 23024 - DNA, 378 bp, Sorghum bicolor
  Clone ID: 14570581
gcacgaggaagcgtgatgcagctgacaggcgttgatgcgttcggtatggtgtcgatgattatccaggcggcacgcaccgcgcggcgcaacagggatctttgccagcagctggcgaagaaggtggagatcgtcagcggcctgctcgaggagctcaatatcccggagctgcggcggcaccgcaagacgcggcggccgctggacgagctgcgctccgcgctcttccgtgggtacgtgctcgtgtggtcctgcagccagcaacaacagggcgcgagccagttctggcagatgttcatggccggcgacatggcagccatgcttcggcaggccaaagacgagatcgacagctacatcatcctcatccccttgataaccaccgat

SEQ ID NO: 23025 - DNA, 427 bp, Sorghum bicolor
  unsure (1)..(427): unsure at all n locations
  Clone ID: 14570585
gcacgaggctcatacactggactcagcagtactagttcctttggtccacttcgtcgtggttcatggtgcactccgccaaggctttttcttgaggatcagtttgatgttattccgtcagaggctgcttcttcgcataattcttctatgaagagaaaagaagatgagggaaagaggaagaagggctcaggggctgtgaaaataagcccatgggcattagctcgtcttaatgctgaagaagtttcgagggttgctgcagaggcacggaagaaatccaaagttttagtaccaatcagaaaagatgactattcacgaggccatgaaacagatagtagctatggaggcatgagcagtggtaggattgatctaggccctgatagcaagagaacaaacagaagaggaagacagcccagtgatctctctctcnacc

SEQ ID NO: 23026 - DNA, 380 bp, Sorghum bicolor
  Clone ID: 14570590
gcacgaggagaaagctcagagggagtgggagaagcagtacaacgagaacaggaacgcaaacaagggtgatgtctagctaaagagtaaggcatatcacacagatgcaggggctaaatcaaatgtgaaaaacctcagcagcaccaacaacacgtctgctgatcgtctgcagaagggttccctttcagaatcgccccaaaacggtgcccagcggcgtgaagcaaacgaagagcccgatcatggttgtgctcaaacgtcttccatttcagcaccagaaagctccagcaacagcacagtcacaaggcaagaagatcaacaccgcggagaccaaatatctgacggcgattcaggctacagtaccaatgctcggtctcctaagcacg

SEQ ID NO: 23027 - DNA, 487 bp, Sorghum bicolor
  Clone ID: 14570593
gcacgaggcggcgggagcgacttctccgtgttcgtggtgggctccgacttcgcgaccgacgccggcgccgcgctcctcgcacccgccgaccgcgaggtgtggcacgactgcctccccgacctcgccgaggcggacgcctgcttcttcgacctcgaggagcgccaggtcgtgcgtgtccagggcaccgatcgggccggccgaaccgtcgtccgcatcgtcggcaagttcttcccggcttcagtagttgatggtgaacgtctgaagaagtatgtgttctacaaactccgcactgaattacctgtgggtccattctgcatcttgtacatgcacagtactgtacagtctgatgataacaaccctgggatgtcaatcttgaggacaatttatgaggagcttccacctgaatacaaggaaaggcttcaagttttttacttcttgcatcctgggcttcgctccaggcttaccatcgccacccttggcaggctat

SEQ ID NO: 23028 - DNA, 524 bp, Sorghum bicolor
  unsure (1)..(524): unsure at all n locations
  Clone ID: 14570634
gcacgaggcctccttgttcctgtagactgtagtgcgaggaggaggccactgccggtcacacaccaacctttcaaaccactccactccggttccctcttcccacctgcgccagcttcttcgtcttgctctgagctgccggcgacctgctagctacctcgctcgcgcgtggtgcctggcggcggcggcggccatggctgccctgctcggcttcttcttgctgctggtgcttcagctcggcccctcttcttgcagcaatgtgtacattgtgtacatgggggaggggaatcccgagctgcacccggagctggtccgggactcgcaccacggcatgctcgccgcccttctcggcagcgagcaggcggccaaggacgccatcctttacagctacaggcacggcttctccgggttcgccgccgtgctcacggacagccaggcggcgcggctcgccgattcacctgnggttgtgcgagtggtgcggaatcgtgttcttgacctgcacaccaccangagctgggacttcatgc

SEQ ID NO: 23029 - DNA, 437 bp, Sorghum bicolor
  Clone ID: 14570637
gcacgagggttttagttcaccgtttctcttgccaggaaatccccatatggactgctagatgcatgccacctaggttgcctaatgcatcagcatccagtttttagtaagcattttggatgcagttgggcagggaatgagcctggccatcccttattcctggaatgtttatacaacttctgctcaagaccattaggtaggagttagttgaatggttcagtgagcacagctagcaattaaatgccttgatcaacatatcgtcggactcatttgttgaaggctgtaacatgacaatagattgaacaactcttcaggaactgagtatatttgttcatgttcattaatgtcagggagcgagcctattttcacttctccacttgataaggtccatccgatgggctcaagtcctgcaggtggtctggaacatcagcaaggtcaag

SEQ ID NO: 23030 - DNA, 174 bp, Sorghum bicolor
  Clone ID: 14570638
gcacgagggcagaccacgcggtacgtgagttccaccacagggcacagggtgcggaacacacgggcaccagcgctggacgcgggtggccggggatctacatctctcacctccacctccaccaacgcgcgcgccccacctcgtctccctccagtccaccaccaaacctagccagct

SEQ ID NO: 23031 - DNA, 212 bp, Sorghum bicolor
  Clone ID: 14570650
gtgtatggcgtgcgcagcgccgtgcagaacgcgctctggctcggcctggtgcttgcctcttggcacttcttgtttgacaagaacgtccagcaggagacgaactctgcggtgctgccctatgtgacgaagatcttattctgcttccttgttgccacgctcatccgccttgtcaagacattgctggtcaaggtactggcctcatccttccatgt

SEQ ID NO: 23032 - DNA, 533 bp, Sorghum bicolor
  Clone ID: 14570653
aatctgggaaaagccgactccagtttgtcacttcaggggacaatgaagctgaagatgatttctcccctaaagaagtaaaccagaggcatctccttcatgaaggaagtcttgggggctcagcggcctccattgctattttcagccacgtgacccctattcggtgcctcattgcaggcctgctagactgcaatcctataatgtccaagagaatatgtatagacgattcttctgttactgttcttgagcattcgctgaaaacaggatggcaaataaaaaggctgaatgatactgcacatctcaggcttctctagctgatcagtgtatcatgcattgtaaagaaattatctgataccattctccaaatcagatgctgaagccactagctgcatacgtgtactatgcggccatcagaagtgtggtctcatcactgtatttcattgtatctatcgaatgtctctaagccaggtagaagggttggcctgtgatggtgttgtgtagtatttgttgctatttttatatctaaattatttctc

SEQ ID NO: 23033 - DNA, 383 bp, Sorghum bicolor
  Clone ID: 14570658
ttcaaaagcttttcggtcgttctccctactgtcaccgttccgcagcaagcacaaggtgattgtgctgtgagcatggatcagcggcaattgggaggagaggaatggcgcagtgcagcacagcacagcacagtacatacttttggtgatgtgtttggaagagcttttggttttccttttagtgtacacacacacaggtgggggggggcacacacacacacaggtatatacataattacatacatgttgtatggtggccttgtcagtacacagcctatgaaggctatgtaccgatggatggtggtttgcgttgcatttgtacattcgttcttttgttgttttgtaccctaactatttgtgttgatatatacggtccatgtgggtgt

SEQ ID NO: 23034 - DNA, 635 bp, Sorghum bicolor
  Clone ID: 14570662
tacactgatgcagggatcattcaggcagtttaatctctgtactgtatcatttatagattccactatgatcttattggacagtgcagtggcaagcctgacaaattctgcagagacttcccattacagccagtttcatgtggcatccctgctcgtaccacttatttgttcttgttacgacctggacttgtactttacacgggataggaacgaagtacagacgtagtgaaagaaagcggtactttttaccctcgtactgcttgtaaattgtaaagtgtagcatatattacagcatgatctcacttctgttgctgtgaagcatattcgtcagtgtgatcacacagcgaatttgtgcagtagaatcggtcatgtcgatgttgtaagttgaagaatcacattgcttgtacaatttgccagcatgttgttttagctcctctgatgagtatcatgttgtactcctagaaactgttggctgataagccatgttgttttagctcctccgatgagtattccgttgtactcctagaaactgttggctatggctgaaaaaccatagcagaaagtattgttggctgatttgttgtgagagaaaaacattaccgaatagctgacagatttggctgataagctcaaacgaa

SEQ ID NO: 23035 - DNA, 631 bp, Sorghum bicolor
  unsure (1)..(631): unsure at all n locations
  Clone ID: 14570665
tggataacaagtgaaatggangcagttgcatttttgtatagtactaatttaagaaggtgattccttgattactgggcttaagaacctgatctgtaggcctgcttgtgacatcgcgatctctgggcttgggtggatttctgtggagccatcaggcgtgccctcaaacagctctgatgacaatgtcgaggaagaatacgatggcggtgagctgcatctggtagtacatgtacccaaaccggttgaggtcttcgtccgccccccattgcctgttggtaaagcagcgtcgcaatggtaccagtatcaagagctcacagaggaagaagaggagttgaggcctaaatggcactactgatgctgctctggttctctacctatttctctagcagtagtacagttttgtgtaatccaaatatttagcacaaagttatatgctatgatgagatgatgttggcacgactagtgttaggatcaggtgataaggtggattcagaaaacaaattttgaataaatgtctctagtgtctatctagcacatgcttcagaaggccatgaggaaaagaatcctccagtacgtgctgtacatgtactctaaatgaaggagcttaccaacaagccatcgaagagattcataa

SEQ ID NO: 23036 - DNA, 557 bp, Sorghum bicolor
  Clone ID: 14570668
gatcctggcgcagcgcagccgcaacggcgagtgcgccgcggagctgatgcgcgcggcgtcgctcttcaacccgcagctggcgcgcgtcctggaccagctcaacgcgcggttcggcgccggcaccttcatcgcggccaacgcgttccgcgtccacttcgacttcgtcagcgacccggccgcgttcggcttcgccacggccaaggaggcgtgctgcggccagggcccccacaacgggctggggctgtgcacgccggcgtccaacctctgccccgaccggagcaagtacgtcttctgggacgcctaccaccccacggaacgcgccaaccgattcatcgtcagccagttcatgtccggctcgctcgactacgtcagccccatgaacctcagcaccgtcctccagatggacgccacattggacaagatagaggcctgatgatccgatccccagacgaaacaaccaatgcctaagtcgtttgtatctgtgactgtgactgccccgtgtgtgtgtgtgtgtttgtttgtgtatgatgatcacatataaacaacaatatatctgt

SEQ ID NO: 23037 - DNA, 583 bp, Sorghum bicolor
  Clone ID: 14570692
gcacgagcaggagtacggccagccagcttattccgccaggtgctcggcgccaccaaccgtgtccgagctcatcaaagctgtggacggagtggtcgtgttcaagccaccggtgaacttggagccactgatgaagcggagcgtctccgacttggtggtgccggcggcgaataagttcggggaaatcacggtcggcgggtggtccgttcacgtcgacgacagcttgctgggcaggctagccgccggtgccgcccgggcagcagctggagcgacggcggctacgcccatggaggcatggaccggcgaggtgctatgccctagcagcatacggcagttcaaacgtagcttgagcaccaacgacgtggacggagcgacggtggaaggcggcggccggagaaaggacagcgagatgttccctatgatgccggtgacggtcgacggcaactgatgtctgatgacgcgccgcacactccgacaatcgacctccacgtttttccatctttatttgctggtcatcaagatatgatcaagcacggtgtacattagtacattcatgtaaatttttcagcaatcagtttttttttcg

SEQ ID NO: 23038 - DNA, 581 bp, Sorghum bicolor
  Clone ID: 14570699
tcaccgtgacctcaagagtgcaaattgccttgttaacaaatactggacagtcaagatatgtgattttgggctctctcgagtaatgtcagattctgcaatgaatgacaactcatctgcggggactccagagtggatggctcctgagctcatccgcaacgagccattcacagaaaaatgtgatatcttcagcttgggggttatcatgtgggagctttgcactctttgtagaccttgggaaggaattccacctgttcagatcgtttactctgttgcgaatgatggggcaagactggaaataccagatgggccccttggaagcttgatagcggattgctgggcagacccggagaagcgtccaagctgccaggagatcctgacccgccttcttgattgcgagtataccttgtgttgaggttttgcttctagtctgtatagcggttatagggggcatcaaacggtcctgcttatatacattattttaatttcccatttcacatacatcattgaggatgtaaattaataccatgtactataataagcaaactttttataatctctgtaatggtaatgccctgaaattc

SEQ ID NO: 23039 - DNA, 539 bp, Sorghum bicolor
  Clone ID: 14570716
aaccttcggcaagtcggtctacatctgctgaaatttatatcatctgccagaaatacaaggctcctgcaaagattcaaccagaacttctagatataaagcacttgttcagtgttgttccagaacagaccaaatctagggatgttatggatggtaggaaaaagagacaccgtgatgggtatgaagaagggaatacgacattgcggaaagtcggtttggcatcagactttgtatggtctgatgcccaggcgccactggagtttttgggctcttacaatgcaatttcatttgataatccagaatccctgcccataaaaaatcatgagcttacaacagatgatataaaaaatttctgtgaggacttacttctgttggataaaaatagtttcaagcatatcttgaaatggcgaattcgcttacgaaaatcactgtcagcgtcttcacaagtcaccccaaaggtcaatgatgctgtggagaacacaaaggtcacagatgatgatgtgcttctacaagaaatggaagaattgaccagtgtcatcgat

SEQ ID NO: 23040 - DNA, 505 bp, Sorghum bicolor
  unsure (1)..(505): unsure at all n locations
  Clone ID: 14570724
aagaggtggtggagacgctggagcacatcgagtcgatgaagagccgggcgcgggacgcacgtggcggcggcagcggctccactcgggacaggcaccacggccgcaccggcgcggcgcaccagcggtcgccgcgcgccggtggcgagccccgcggccgtggcgcgtccagggcctccaatggccacgccggcagggccgcgcggtgacactactcactccggcggtgacggatgatgacgattcttcttcttcatgtaaatggcgtaattttttttttggccgatctgtgtgctgctcaatgttcatgcatgcccgctgctgccatggctcatcgctcatgactcatgaggtgattcttgcccaatcatgatgaggtgtattattaagattaattaacaaggaattcaagaggggatggtggttgttgtagccanatatatatagtccaatagtagaaaactagaaataggagaaaggaataattcattcaaaagtgtattttcgc

SEQ ID NO: 23041 - DNA, 533 bp, Sorghum bicolor
  Clone ID: 14570726
atcttcgtcagcccgtgcagcagtgggacttttcatgtgtgtcagtatgacggagttgaagatgatcttgtctatttcattgatggagttgaagatgattttgcctacttcaatgatggcgaattcctttccgatgaaaatgctgcacccgcttttgttaagtttgtgtacaatatgagagatggtacagtagcaccgtttgcggcaggcatattagagtaccttcaggtaccaaagggcaggcctatgaatccaacatggctcttcccttctgaatgaactgctggagatcaattgtggccatgcagagtgtcaatatacaggtcgctgtgatgttgattggtgccaggcgccagcatggtgttcaattcctaagaactgaaaatatttgtgtgccgttcttatatgcctggttgttattgtgattgcttttctggattcaaatgtttttaagcagtaaactgtcgtacttaatttgttttcatgtatggacgtacctttatctatatgtagttcctaatcttcccactcta

SEQ ID NO: 23042 - DNA, 542 bp, Sorghum bicolor
  Clone ID: 14570727
ttcaatgagtacaggtatgtactagctgcaagcgtcctggcttttacctactctggattccagttggtagccgaggtgcattaccttgtcacagggaggcgcatcattcgagccccattccgcagctacttcaatcttgccatggatcagatgttagcttacctcctattgtcagcatcttcagcagcactttctcgtaatgatgtttggatgtctcggttcggaggggatcaatttaccaaactgatcaatgcctcagcttccatggcattcctagctttcattgctcttggactcaactcagttatatctgcttactgtgtcttcagcttggtttcatagagctatcgttgtgcattgcatgatgtgaataacttcccgtatgtttctttggtcactgaatcttgattcatgtgaaatttctacatgatttctgtgaaatccctaagttccaaagtgggtgtaatctttacaacttgggcatattgtagcagtccattgagtcaaggttggcttttacagtaaaaatttgaagtggctgt

SEQ ID NO: 23043 - DNA, 379 bp, Sorghum bicolor
  Clone ID: 14570736
agtcggtaccgatgattgtcagcgaggtataaagccactaccattcccttgaacataataggttacaaacagattccattttagtagaagcgatggatcggcaactgcgcctcatgatctatcttttgtccaaatggcaggaggctgccatgggcgttgtatccgttgtgaattaacacccatggtgtaggcgcaatcggccaattgggtgtatattatccgctcccctgtaatgtaagctcagatactgggagatggtgtgtcaacagttacttttagcctaaacattcttgtacatctttgaaaggaacagatttgtaatcctcttggcttataaatggctccattggtcatataacttttaaactatatagaactc

SEQ ID NO: 23044 - DNA, 557 bp, Sorghum bicolor
  Clone ID: 14570738
aatctctcttagacatagagtatatttttttgctatatgctacttggaaatgccaaagatggagcaatcaaactttcctgcgacgcttcaggagttgcatcgccagggatgatgcttcttgcttcaggatgctgccatggtcggttgcgtgggcgttttccggagctgatcgatggcatgctatctcgtctgattgtcacgtttttgtaggagtagataataatctctggttggctcagagggaaaagaaatgactcccctttcggttggtttacggtcttgtcaatggtgatacccttcttttccgtgtgggaaacagttgggcaaccactgcaccttgttgggtcgtccatggcggcttgtttaagacctcttccttggtccgtagacggtagggtagctagctagggtcggccatgtttagcaaatatatagacaagcaggttttactcgttgcaaactggcttctcggagaaacagaggaagacaggggggttggtggtgcgttaagctaacgactgtgctagcgaggacttgaagcatcatgctgctttcag

SEQ ID NO: 23045 - DNA, 657 bp, Sorghum bicolor
  Clone ID: 14570740
aagtcctcgagactaaaaaatccactcagaagtccgacgtctacagctttggtgtcttgctccttgaaatgctaactggaaaagcccctctcagatcccctgggcgcgaggattccatagaacaccttccaagatgggtgcagtctgtggttcgtgaagagtggaccgctgaggtcttcgacgtggacttgttaaggcatcccaacgtcgaggatgagatggtccagatgctccagatcgcaatggcatgcgtggccattgcccccgagcagcggcctaagatggaggaggtgatcaggaggatcacggagatccggaattcttactcttctgggacaaggacgcccctggaggacaagccagagactgcacaagcaccatgagggggtacagcatagtttagcaagagatggtagctaggttgcatagcgaattgcttatagagcttcagcaaagttgataaccacctgcattcccgatcgtttccagtaaatctgttgtgcattttttttctgagtctagcgagctgattgataatccatgtcattgtattgttcagttaaatcagtagctcttctgattttcataggatagtgttgctctgtaatttgacataatctctgcagcgtgattaatgaattgaatttcccttctaaa

SEQ ID NO: 23046 - DNA, 602 bp, Sorghum bicolor
  Clone ID: 14570757
acgaattttatggattccaatggaaaattgctgtatatagtgctaatagttcctaatgacccctactcattctctgataagaccccagttgtcatctggcctggatttgccctttgggttccatcattccacattccattgctatcctcaaatcagagcatctgctgttccattttggcaatttgactgctccagcctcaggattatgaggaaaacaaccatagtgtgaaggatcatgctaacccccgctggcaaagtgacccctgtgctcatgaagcttcaagtgagctatttgacagtggcaggcacatggagctgctttaggagatgtgaagagtgctacaggagcaaaatcacaagatgcaatccatgttagggagaatcaagagctcaatgaaaagtaccattcctaacagcagtaagagtttgttcttcagtccctagaagcttatgtatgcccaggacatcatgcttgggataattttttgtgcaacctgtcgtctatgcatgttttgtggttaccgcttcggtccaggggatgtactgggatgtactgtgaacaacttactccataataaatacattctagcagttgtggaaaa

SEQ ID NO: 23047 - DNA, 291 bp, Sorghum bicolor
  Clone ID: 14570770
agcgccgcgatcaagaggaggaaaacctgaagatgaagctcagggaggcctcttccaccattcaggacctgatggaacagctcaatgctgcccggaactgctgcaagagaaagcagcagacgaagcaacttcacccccagtagtacgggagtacatgaatcatcagcacgctctccttttttggtgcatattgtagcacaaatgatgtccagatggctggagagctgttagcagtagcagaccagaatgttctatgtatgtggtaagtgtataagatgatggaatcgggtt

SEQ ID NO: 23048 - DNA, 473 bp, Sorghum bicolor
  Clone ID: 14570772
caccggtggatggcaacctggagaacaacatgctgctggtcctctacagtggagatcgcactcaagtggcgcagtcgtcgtctgaaccgccagagcctaagagcccaccgcctgcaccagcagcttagcttatacccgcatttggcaagccaggataatctttttggtggttggtgttagaatgatacaaaactatagatggtgctcctacaaggattgcaaaactttgtccccgctgttttattggttcgttggtttgggtccgtcaggatcaggtcggcttgtgttgcttgcgatcggctgctacttcaacgcgtatggcgacgtgtatgtgttgtgtacgtgttgtaccgtagtgctgctgctgggtgccagattgctagtcatggtcagatgaaactctgaaattttgggacgacaatcgacaagaacgtgtcgtccaagcgataaggtttaaggaattatgttcaaaa

SEQ ID NO: 23049 - DNA, 280 bp, Sorghum bicolor
  Clone ID: 14570787
agaggaacacactggcttcgtcagtgggcaaatctgcagcggcatgatgttcttcgagagcagctgatccatgttggaacttaccttgagacatcagctctgcagttttttagtgcccgtggatggttagctgctagatatattggtcatgtttagttcaaaaaattttatttcgttttgcttggtcgatttgttggctgtcaagaactctttgtaattattggtctgattctatcagttgatagaagaagccggatataaactatcccttatctaaaaa

SEQ ID NO: 23050 - DNA, 252 bp, Sorghum bicolor
  Clone ID: 14570790
tagtatgaacatttgtaatctttggttgcttgtaggtgtgaaatcatgttttatcaaatagcaacccaatgatatactaagatgatattcatgattgattatgactacatgtcattaaaccccatgcagatagtcaaatagatgatttgtgggttgtatgagttaacgtgcagacagtcaaatagatgacttgtgggttgtatgagttatctgtttagttgtttgtgttgtgaattttaagaccttccagtt

SEQ ID NO: 23051 - DNA, 146 bp, Sorghum bicolor
  Clone ID: 14570793
ttgcaaacttatgaaggagaggcatgaaaaaccttcctgttcttgcatgatacgcacgtggacaaattcttggttgatgtaacttatgcctgatgactctgtgtacgaattactactaaaacttccatgtgcctaaaatgtgtgca

SEQ ID NO: 23052 - DNA, 369 bp, Sorghum bicolor
  Clone ID: 14570801
tgggcagtcagctggattcacaatcagttactcaaacaacatgacattcgcgacgatcaagggcggcggacatacagcacctgagtacgagccggagaggtgtttcgccatgttcagccgctgggtgctcaaccggccactctaataatcctctctcaaaatccttgatgctgataataaatactccatcagtggtgaaactggatatacatgggaataaaacggatgtactacgtacctactgtaccttctactccgcataagcattcatacatgagtttcgagcagcattgtagcagatggaaacgtgtcccaaagcatccagcctcgaattcgattttaacgattaatgacgacataatcattgtc

SEQ ID NO: 23053 - DNA, 609 bp, Sorghum bicolor
  Clone ID: 14570820
cacgctgaggctcatgctggtgcatgctgccactggtgcttcgctcactcacaggagctcgctctacagccacggcgacgcagctgctgcctgcacgcgcgtactgcacgcaggggaggctggtgtagagagacacatggagaagaacacggcaaggaagaagaagaaggttcttggtgacaagaggacacgaacacgagacgaacaagagatttgcccgagacaaaagaccatgcaagtatggaacacagcatggatggaccggcctcgattgtagtaccatctaatgattggaagaacatttgctgagttcttggagactactgatacacgatcgagctagtctgatactccctctactctactcctatgtttgtaagtaaccggttgtgttgtgtgtcgtgtgtacaaagagagagagatggatcggacgtcgatgtcgccatttttgttcttcttttttctgcattttgcttcctgctgctcttggttcttggctccctgctttcgctacggttctagccttctggggatattaattagtgatgtcccagccagctgcgattatgatctgtgcttgtgattcggacatagataacttttgatgcg

SEQ ID NO: 23054 - DNA, 638 bp, Sorghum bicolor
  Clone ID: 14570848
atcctggcaccagcgtataacagagttgtgatgcccatggtgtgtaggatcaccggcaagaagcgagggttgtccgaactgcaacgcatcggcgtcggcatggtctttgctatgttttcaatggcttcagctgcactggttgagatggtgcgtctcgacatcgccaagaacagggtgctgatgaatatcctgtggcaggctccgcagtacatgtttgccggagtagccaaggttttcagtgtggttggttttattgagttcgcttatgaacagtcgccagatgccatgaggagcttgtgccaggcttgctctctcctcatggtcacgcttggaagctaccttgtgtcgatcatgctgaaaatgatcgattcagtgacagccggaagggggagccatggctggataccagaaaacctcaacgaagggcgccttgatcagttcttctggttgatggcaggattgcacctgctgaacctgcttgcattcgcatattgcgctacgaggtacaagtgcaaactggctacgtgagtttcttctcatagtttgaggctcagaggagtgcgttagtaaagttgaggagcatttagcattgtatattattatttgctaccaactcaagttttggaagttattttatt

SEQ ID NO: 23055 - DNA, 449 bp, Sorghum bicolor
  unsure (1)..(449): unsure at all n locations
  Clone ID: 14570869
gcacgagggtgggaaggcggggaatgcgacctccggcaccaactccacggcgaccacgccgcggaccgagagcaggccgaggtcgagcgagaccagctcgcctcggtcaccggccaaggtgtggcgggaggggagctacgagttctggaacatgatggtggcggcgccggcaccaacggacgacccgccgccgccgaggcgttcagcttcaagaaccgtccgccgcatgcgccgcaggcgtcgtcgccttcgatgtcgccgcccccgcagcagcagcagccgccgccggagggcggcggcgtggacccgcccacgcggctcatcggcaacttcctccggaagcaggcggcgtccggtggggagatgtcgctcgacctcgacctggagatggaggagctcgggaggacggcgncactgcgcgagcagccatccttctccagctcgctaga

SEQ ID NO: 23056 - DNA, 376 bp, Sorghum bicolor
  unsure (1)..(376): unsure at all n locations
  Clone ID: 14570872
gcacgaggggcaggccgacgccgcggccgtcgaggtcgtgctggtcagccacggcgagtgcgccgccgcgatgcgcccggacctcgtcggcggccggtggccggccgcggcgctcacggcgcgcggggagcgccaggggcgcgcgctcgccgtgttcctgcgctcccgcggcgccaggctcgccgctgcctacgcgtccccgcttgaccgcgcgcgcgccaccgccgccctcgtctgtcgggaactcgatttcccagaggagcagatccaactgtcagatgctttgactganatgagtcaaggtcagtgggagggctgcccaaaatccgagatttatactccaganatggtcaatctgatggaaagcacgncacct

SEQ ID NO: 23057 - DNA, 354 bp, Sorghum bicolor
  unsure (1)..(354): unsure at all n locations
  Clone ID: 14570873
gcacgaggggctcttctccccagccgcgagcctgctgctcctgccgcggaccaagtcgagcctgctgagactgcccccgcacctggtttggctgccaccatatccgagttcttcaggcggatggtcttccctccactagatccaaatttgctagaagaatttgacacccagaaagtaagttggaatccatacaagcattgcttagcatttgtgtctggcaagaaccaggttactgtccaagactttgaggattcagatgctaaagaaccatgcattttaacaagtgaccatcanacggatgttaaggctgttgagtggagaccaaatagcgggaagatgattgcagttgcctgc

SEQ ID NO: 23058 - DNA, 515 bp, Sorghum bicolor
  Clone ID: 14570877
gcacgaggggaagaggaacagatcaaacggctagaaaagcttaagctagagaggcaaaagaggattgctgcaagaagcagcacttccaatgcaccaacaccacagcagcccagagtcaagccttctcccaaggtttcccccagtacctacaagagctcaaagttcagcgatgctgaacctgcatcctcttcacctctcagaaaacttcctgtcaaaactaccacagggacggatcctaaaaaaacagcaaaatcaagcaaactaaatgatagtactaatgcagttagtaagtcaacctcatcattgacagacatgaaggagaaaagtgggaggaccgaatcatccaacgagagattgagaaaacttgctgaacctaaaactaacagttcaactggccatcctttgaattccaagtcagcaagggtggaccacccacggagaaaaagcatgccacaagacacccagacagtgaaaatttcagctataatgcagcttgaccagactaaatcagcaac

SEQ ID NO: 23059 - DNA, 411 bp, Sorghum bicolor
  unsure (1)..(411): unsure at all n locations
  Clone ID: 14570880
gcacgagggcgacccgacgacgccgatgtgggcatcgtccgagggctgcgagcgcgtcagcgtggaggaggccatgaacaccgatgacatgccgctcatcccggcgctgccggtgtcggctcaggacgcgatggagatacacagagccatgggcggggccgtggcgccggcggactggcagagccgaaaaggcagccccgtgtaccatctcggccccgggccggcagttttgaacctaacgtatctggggaacgatacgatggcaacgattgagaatgtctttgccattatcgaaggcaccgaagagcccgatagatatgtcattcttggtaaccatcgtgatgcttggacgtttggtgcatccgatcccaacagtggaacagcagctatgattgagttagctcanaggtt

SEQ ID NO: 23060 - DNA, 388 bp, Sorghum bicolor
  Clone ID: 14570881
gcacgaggggaggaaggggggaaaaggagatggcggtcggggacgcgctgcgacggctgtgcgaggagatcggctggtcctacgccgtcttctggaaggccatcggcgccgccgaccccgtgcatttggttcgggaggacggctactgtggccacacgtcatgccctgtcggatctgagccttctgaatctctgcccagcgacgccgccgggtgctctgctcctgctgctgacaccatctgctcgcttgttaacaacgttatggcgtcgcaggttcatgtcgtcggacaagggaccgtaggccgtgccgcgttcagtggcaatcaccaatggatcgtccacggtactgccaatggtcacgggctctccctcgaggttgctgctgagat

SEQ ID NO: 23061 - DNA, 470 bp, Sorghum bicolor
  Clone ID: 14570883
gcacgaggttattttctgtaggtcggaatggctgctacactagcctcagtctgttcagtcccgttgacttcagtactgcttctctttgagctgacaaaggattacaggattttgcttcctctcatgggagcagttggtttggcaatatgggttccttcagtagtaaaccagccaaacgacactgagccttctgggtttaaaacacccaaacgaggttattcttcaatttcagcagaagacagaaatggtagctcaaggcaaggtgatgttgtggacgatcttgagctcagtattatacaaactgacattagtaactatggaacttataatgaagaaatgcttctggatgatttgaaggtctcccaggccatgtcaaaggtatatgtcaaagtgttaccatctgttacagtaacagaagctcttaagctattgcatgataaacagcaaaattgtgccctggttgtggaccc

SEQ ID NO: 23062 - DNA, 285 bp, Sorghum bicolor
  Clone ID: 14570887
gcacgaggccacctccaccgctcaagccccacgcccaccgcacctccctcgccgtcgccgctgctcctgctcccccgcccgccccgcctgacggcgcggggcccgccgcgcccacgcgtggcgaccgcttcctcggccgccagctggccaccgaggccgccgcgcgcgtgctcgcgcccgacgacgccgacaggcgccgccgacgcaaggagaagcgccgggcactgtcgcggaagccctccggcctcgcctcttgctacgggtgcggcgccccgctgcagacgg

SEQ ID NO: 23063 - DNA, 400 bp, Sorghum bicolor
  Clone ID: 14570890
gcacgaggcgctggtggacaacggcaacaacaactacctcatgaccacggcgcgcgccgactcgccgccgtatgggatcgactacccgacgcaccgccccacggggcgcttctccaacggcaaaaacatccccgacatcatcagcgagcacctcggcgccgagcccacgctgccgtacctgagccccgagctccgcggccagaagctgctcgtcggcgccaacttcgcgtcagccggcgtggggatcctcaacgacactggcttccagttcgtgaacatcatcaggatgagccggcagctgcagcacttcggcgagtaccgggcaagctgcgcgcgctggtgggcgcggcccgggcgcggcagatggtgcgccgctcgctggtgctcatcacgctcggcg

SEQ ID NO: 23064 - DNA, 309 bp, Sorghum bicolor
  Clone ID: 14570902
gcacgaggcttcttaatcagagggatgacaacatccttgagagacttggatacataactcgctctgagaaaaggttggaggaggaaaagttaaatctcgaagatgaaagaaaggttcttttggaagagaaaaataagctggatctgaacatgcaggcaattatttctagggaggaagctataattcagaaggaatccatacttgacaaacgtgaaagtgaactattggttctccaagagaccattgcaagcaaagaaagggctgaaatagaaaggctgcgtcaagagcaagaagttgccttggtgagaa

SEQ ID NO: 23065 - DNA, 443 bp, Sorghum bicolor
  Clone ID: 14570911
gcacgaggagtctcgactggaacaagaggaggaagctaaagctgctttgcttgcaaggatccagcgtttaacaaaactaatactggtttctactaaggcgactccgacttccagattttctccacatcctggaccaagacgaagacattcttttggggaagaggagctggcataccttccgtacagaagacgagatataatgatggacaatgaaagcaatgaattacttcttcctgtcgaagggtttggtgtatcacttgaagattcttcgaaggaagaaaaaaagaataggaaaggacttcttaactggttcaaactccggaaacgtgatggagcttctattctgacaagttcagaaggtgataagtccagtttgactaaatcaacagctccttcaacacctattggggaaagcatcaattttcctgctgaaccaagaatat

SEQ ID NO: 23066 - DNA, 484 bp, Sorghum bicolor
  Clone ID: 14570916
gcacgagggttccgcgtcgtcgtgctggacggcgtcgaccacgccgacagcgttgtccgcgggtccatcctccgtgctatcgagtccggccggctctcggactcgcacggccgcgacgtcgccctcggcaccaacatcttcgtcgttatgtcgcagtggtcgccgccgttgccggatcacctgatgaggagctcgcaggaagccgaaccctttcttcctgacctgccatggaacctggagcacgggatgatcaccggcgggaagaagcgaaggccggagcagctgcttgaagcaggagaccggtgcacaaaggcacgtaaacactcggcacgggagccgcttcccctggacttgaatctgtccatgtccgatgaccataccgatgccgtagacgacagcggcggcgagggatcacggaactcgtccagtgacctcaccgtggagcacgagcaggagtacggccagccagcttattccgccaggt

SEQ ID NO: 23067 - DNA, 389 bp, Sorghum bicolor
  unsure (1)..(389): unsure at all n locations
  Clone ID: 14570920
gcacgaggggacgaggggaggatgggcaccgggggagacggggacaaggcgggcccggcgctgccgctggaggcgctgctggcgctcgggctcgaccagcgcaccgccgagaacgcgctcgtcaacagcaaggtcaccgccaacctcgccgcagtcatagccgaggctggtataaaggaatgcgacaagtctgttggcaatcttctatatgcagttgccaccaagtacccaactaatgcgcttgttcatcgtcctgtccttattagctatgtcttgtcaacaaagataaagaaccctgcacagctagatgctgctctgtcatttcttactaatactggtcctgattctctagatgtgggcaaatttgaagaagcatgtggtgtanggtg

SEQ ID NO: 23068 - DNA, 354 bp, Sorghum bicolor
  unsure (1)..(354): unsure at all n locations
  Clone ID: 14570927
gcacgaggccgcctcctgcttcggcttcggcggggcaggagccggtggttaggccgagcaagcgcgtgcggtccggatcgccgggcagcgctgggggaggatcgggcggcggtggggctgccaacggaggcgcgggctacccgatgtgccaggtggatgactgccgagcggatctgaccagcgccaaggattatcaccggaggcacaaggtctgcgagacccacagcaagaccaccaaggcggtcgtcgccaaccaggcgcagcgcttctgccagcagtgtagtagatttcacccactcgcggagtttgatgagggtaagaggagctgccggcgtangcttgctggccacaacc

SEQ ID NO: 23069 - DNA, 511 bp, Sorghum bicolor
  Clone ID: 14570957
taggatcttggtgaacccccagccaaggtagaaggtagctcagcacttcagcattacaagggcaccgatgttggtgaagaaattcaattcgtatggctgcttagtaggtcgtagtgtagttctctagcacctttattttgcttctcttgttcaagtcatggtggtggtataccagaggcggtgaggtgggcgtggaggtaaatataatctggggggtatactggggaaggtaaggtggggctttggtggtaaatacattgtggggggtatactcctgtggtgttaagaaataagtagactactagtagaggggctggagaaattgtgtaatagcttcaacgggttggagctaggtagtttagtggaagtcagttcattgtcaatgtctgttttttcatttggtctttggtgatgtagataagagggattgatctcgggcttgtatatcatggagtctctggaattttgatgttttgggggtgtcaatgctattccatggattcaaactttc

SEQ ID NO: 23070 - DNA, 474 bp, Sorghum bicolor
  Clone ID: 14570984
gcaaagatgcaaagcagttgaatggaactcacaagtttcatgttcactcaaaagaagaggctgagatattagcgaaattcaaaccccatttggatccgtcaactttgatttcaaacatcagaaaccttgagaaggccatcagagactgcttggaccccttcaagagcccccggcacatgatcctttattatgaggatataatcagcaacagcaatgcattatttcaggtgcaagagttcctcagagtaccggtgaggaggctgatgagcaggcaggtgaaaattcaccctaggcctattccagaccttgtcaagaactgggaggaagttagcagcaaactgaatggaacagagtttgcccccttccttgatggttcagattatgtcaagtgatggagggctggttattggcatttgaagtgcccgtgagtgaaaaaccccgtttttttgctgaaactgaaacagtattgtttgc

SEQ ID NO: 23071 - DNA, 435 bp, Sorghum bicolor
  Clone ID: 14570989
aacctcagaagaacagagtcagagggaaactgaaatttaaatctagttcaaaaacaagttctatgcggaaaactggtggaaagaagagcccatggcaatagagatcacaaaggcggggggtgctggagtcactagtcagcacagttactatcctgagaaaaccacaaattcacaaaaaggagttagattaaaagtatagcatcggtgtgttctttgttattgtcatggagcagattataggggtgcttcatggtttttggcatttgatcttcgtaacgacatttctgcagcgagggagtctgatgaaatttttgacaggttctggagtgaggctttatccccatttaaacaagatagactttgtttgtaggaacctgattgagcgcctggctgtttggaaataggagtgccatattatatctagttaccttacgt

SEQ ID NO: 23072 - DNA, 498 bp, Sorghum bicolor
  unsure (1)..(498): unsure at all n locations
  Clone ID: 14571000
cgtctacggcgttccgcaccacatgcacgcgttcccgccgatgatgtacccgccgccgcgcgcggtcgtctacaactacaagtcggaggggatgccatcgctgcctccggaaggtggggcacactcttcctaggcgcatcggctgcttcgcatctctggatcctgattattactgcagatgcctaagctaaggagttttgaattgatgcgttcgtggtaaaatttttatggtttcgtctagttcttgttggttggtgtatagatgagggacggtggatgatggatggatattgcagttttcgtctggtagaaatatattcatanaatgtatctatgggtataatatgatactagtactaagtagtatagtattcagtgtgattaattagtaccgagttaatgtaatgtgggattcatatattctaggtggttctgctctctggaggccaagtttggctattttatctttacataaactggatgttgggagaatgtttt

SEQ ID NO: 23073 - DNA, 513 bp, Sorghum bicolor
  Clone ID: 14571001
aagtttggcgaaacagtggagaagtgcctggcagactatggtgtggagcggccatcaatgggagacgtcctgtggaacctggagtacgttctgcagcttcaggatgctgattccacagtctcggatgtgaacagcatgaaccgtattgtggaactcccatcacaggttcagaacgtcggcgcccttgagagcatcagtgtgacaatggcagaagctggagcgtcaaacgagcctgatcatgacctctctgatgtgtcgatgagccgggtcttctctcagctgatcaaagccgagggaaggtaaaggtgcatgacacagcctgtaggggtactgaggaaggccaaagtcatctcttgctgaagtttacttgagagatcatgtgtaatttttcttcttcttttcctctacaaatgtactgaactaaggtttgggagttacagttgtagccattgtgagcctgtgcggctacaaattagtagatagcctatttcaaatttcaatctattactgctt

SEQ ID NO: 23074 - DNA, 388 bp, Sorghum bicolor
  Clone ID: 14571011
acccttccacgctggggctggagaacgtgagggaggggtgctgcgcgacggggaaggtggagatgtcctacctgtgcaacgacaagagcccccacacatgccaggacgccgacaagtacttcttctgggactcgttccaccccacacagaaggtgaaccagttcttcgccaagaagacgctggacctgtgctaccaggagctcctgtgacgcctagaaatgttgctactaattaatcaaatcgcggtgtgtatagcatagcattcctcccattgtcgagaacgactcgatcgatgtactgtatgtatgtagcatggttgctctgtctgtttccatgcgttgattcttttgggcttataaatgatcatcagatcagagagataaagttt

SEQ ID NO: 23075 - DNA, 373 bp, Sorghum bicolor
  Clone ID: 14571038
agcgcggtgccaagttcgtcgtcatggtgagggttgtccaaatcaagggtgtgcggatgtttatggagcacttgatcgcaacgctgccagaccgcaagctcgtgctagaagcgatggcaactgtcgtctgcctcaaccaggactaccgtccaactcgcatgttcccggagatggcgaacctgctgcacttcttctctcatcctagtaattagcgcggatcaatcctagcaagctgctttatctgctgatataggatttgtttcgttttgctatgcactgtggaaaaactatcatgagctatgtatcatagaaaagttgtaagttgtttgcttcaaaccaatataaaagctatcgcctctctctatcttccttt

SEQ ID NO: 23076 - DNA, 328 bp, Sorghum bicolor
  Clone ID: 14571050
cgaggaagaaggtttctctcgggcagatcctgagccagaagtacgaaatgttctccccgttgaggatagaccacgactgcgcttcgcgcaagcagttccagccgaggaggaagaggatggggttcgtcgtgtacgcgctgctgctcgcgaagcagaggcataggaggaggaaggctgcctcctgcactcacggtggcttcagctagtttagttcggatggtcagtgctcagctgcgctgtagtcgtttatatattttacaataagagatcggaataatcgttacatttgtaattagttagttctatgaacaaagttggtatttttagt

SEQ ID NO: 23077 - DNA, 412 bp, Sorghum bicolor
  Clone ID: 14571061
gaatcttctaccgtcaaggaagttcgagaaaactgtcaaaatggatcaaccaagcaaacagaatcagctatcggccaataatttgcaagcatgaaatgggttcatgacctgattggttgtttccaggcttgaatcaagttgtttttgtccttttgtgggaacagatgaacgcaattggtaacttctttgcaaagcctggcaaggtgcatgtaactaggagttagttgtgtagtacccaccatcacggtatcactcaatctccgtgttacgtggatgatgtagtcttcagaagacagcgcaggcacaatgtcaggggtttgacttgttttttttccccttttgttaggtatcaattagcatctgctaggcatttgattatgggctaattcaagtatttacaataatgtttagc

SEQ ID NO: 23078 - DNA, 317 bp, Sorghum bicolor
  Clone ID: 14571063
tctcactagatgatgtagatcaatctgtcagatacaaatacacccgttccatattttcttatacggataataggtccactggcatggaattttctggttcagaggaggctgagctgcaattctgatggttgttttgttatagcagaatggttccagtctagataagatgttcaaattctgtcataatttcgtgcatcacactgtttacattgtatagtgtacatttttgacaatagacaggtataatttgtcacgttgtcctagcgattctttttactattcagatttatagaggaaaagaattaattgaggtgctc

SEQ ID NO: 23079 - DNA, 331 bp, Sorghum bicolor
  Clone ID: 14571070
ctatgacaaagatcaactgaataggatggtcgcagtcgcatcccgctgcattatgtgaccggcgatgtggcggccttcaatggccgaggttatgcatttcctgtccactaatgatgagtgtctcaaggagcccgagaaatggaacattcccgaggatgaggtggacgacatggatgattgtacattgttttctgaatccttttcactgtaattgtagcctcttttttccacatttctttctgtatgtgcggttggatgcctttcttgtcgtgaggatggacttagatgactggtatttaatcatgtaatatatgacagagatttttggggg

SEQ ID NO: 23080 - DNA, 689 bp, Sorghum bicolor
  Clone ID: 14571086
gcgtgcccgacgggtgtggaccccaacatcgcgctgcagctggaccccgtcacgccgcaggccttcgacaaccagtacttcgtcaacctggtgaacggccgcgggctcctcacctccgaccaggtgctctactccgacgcccggtcgcagcccaccgtggtggcgtgggcgcagaacgccaccgacttcgagctcgccttcgtcgacgccatcaccaggctcggccgcgtcggcgtcaagaccgacccgtcgcaggggaacatccgccgcgactgcgccttcctcaactgattctcgtctgggtggatccgccgccgactctgaagctctaaaccgtgaacatacgagggctggttatatctcaaaagtgttcatatagaagctagagtaaagttttattaatcatatcagcatcaggttaagtggttaatgctaagaagattgcttgattcagcgattgatatgtagtggcacttagcttgcttggtagggcaaatgtactcctttttccttcttaatttgttcagtctcggagcaatatttgtttgaatgttttcttcttgtgtgtgtgggtgggatgggtgttttagcctgtaagggttggttcatggataacagttgacaggatgacgagtgatcatttctgtagttactttttttttcctgaaacagccggcattcaagccttc

SEQ ID NO: 23081 - DNA, 625 bp, Sorghum bicolor
  Clone ID: 14571087
gcatgggagaatattcaaaaagcaaaagctgaggcagcaattcagaagttagtggtatgttctttgctctaattcgaactatattgcactatttttaactgaattgatgctaggattgtttgcaggacattttgtttatatctaatgcatctagttgatcctgaattgtacccacacttctatgatatcagattaagctcgagaagaaaagatcatcttccctggataagattttgaacaccctcaagtctgctcaaagaaaagcccaggtgatgcgtgagcgtgagcgtgatgcagtaacagcaaaccaagatggaaaaggctctaggaaggcaaaaaagagagtgcagcttagcaagaatggtcaaatcagttcactgagtggctgcttcacttgccatgctttctgatacatgtaattccaaaattgagtaagttgccatcagactgttagggcctgtttagttcgcaccctgaaaagttttttttttgggggggtactgtagcacatgtgtaactatattaattagtgtctaatcatggaccaactagactcaaaaggtttgtctcgcaaaatacatgtaaactgtgcaattggttatttttttatctatatttaatgctc

SEQ ID NO: 23082 - DNA, 440 bp, Sorghum bicolor
  Clone ID: 14571096
tgactcagggagaactgtatagctgatgcattatttgttataaggcaagattgctgcttctgttgcaaacaaaccctgatagccactggtcccctgcaaacaagcattggtttcaggctggctggtgactggttgtggataatagtgcttgatattgtgggctaacctattgtagtgcattttcacgaggtgtgcaaccaccggttgttcatactgtacatacatatgtagttgtgcttgtggcattgtattgtagggatagggatctcaccttagattagatgattgcttgtatcggctggccgagcagattttacttccccggccagggctctaccattcttatttcttccaagtgtgtaaattgcagcaggatgtactgttacctgtttctcttacatcggtttggttattgattctgtgaaatttgtggtctgatt

SEQ ID NO: 23083 - DNA, 110 bp, Sorghum bicolor
  Clone ID: 14571103
cggcacatgtagactcaagaagaagttggtggtctatgttgtaagtattcagtgcatgcctgctgataccaaatttatgtgttatggcatatgcttgttgcgagtgttgt

SEQ ID NO: 23084 - DNA, 598 bp, Sorghum bicolor
  Clone ID: 14571104
ctgtattccaacagaagcctctgtaaactgagaatgggtgatggtgaaggcgctctatcagatgcttaccagtgcaggatgatgaggcctgactgggcaaaagcttgctatcggcaggcagctgctcacatgctactcaaggagtacaagcaagcttatgacgccctcctggatgcacaaaaattggatcctggcaatgatgagatcgagaaggagctaagcaaggctatggaatccatgaatgtctcccctgatgaagattagcagtgaagcattgtggccgtctggcaagaatgtctgtgctggttaaagaagagtaagctatcagctggatacctcccaatgattatgcgtagtagattaaggaccaaaccttgtagcctgtttagcaagcagcgttctgtcgagtgtaaggcacgggacgggagaatttttcttttgagttaagtggtagtgcaactgtggagagttgaagcacgtttctttcttgagcttggaagacaagagtttagtctagaacaggagaaaagcctgcacaacaacaggaatttctaatgcgctcatcgccaactcatttggaaaatttctgtgaagtttc

SEQ ID NO: 23085 - DNA, 545 bp, Sorghum bicolor
  unsure (1)..(545): unsure at all n locations
  Clone ID: 14571109
gacccntagcaggaagaaaacactcacactgacagtggtgcttctagcgctcatctaccttggctcaacaatgataccgaacatctggatggccttcaagttcactggagctaccacagggttagcgttgggtttcatgttcccggctctggtggcattgaggctggacaaggaagggagtcgcttgggacatggggagaggctcctgtcacttgggttgctggggctatcaatagttgttagcgtcatcggagtcgttggaaatgtatacaccttgaagagtaagtctgaatgatctcttgaagatggacaggttggtagctagggttagaggaagctttacatcatgacgacacatggtgtgttgcaatgacaggcaaacagaccgtgtaaacatggcgactatacactaggtcaaaaatgatattaagagagcctcaggatcctatatgcatttttacttcagaggtttaacactggaccatcctccagggaattctttttgtacttcggaccagattcttcaatgtatcgatttgattggt

SEQ ID NO: 23086 - DNA, 525 bp, Sorghum bicolor
  Clone ID: 14571124
tggctgctgctgcggtttatactgcacaatgcgctatcaatcgatgcccgcactggacaaaggtttgcgagtcacatagcagatacactagcgaccaactcctggagtgctcgaggatgatggtagactttcaccagaaggctggaaccggcaagctcactggcgtgcacaggaaatacagtacctacaagttcgggtgcgcggccaagaccttgcctgcgcagttcctgctggagtcaggagggacaccgcctccttcaggtgcaatctagttgaatcgccctattcaactaggtggatttttaaagtttttagcatactccgtgaacaagatgcagaaaacatcgtgttgatgttgcccaaaagtgcatcgaatttccttggagagttatgattaactgttttttttatctatgtcctgaatgaggagtgacggtcggtcaggtcgtgcagttatactgcggctaataacgaactgtcctgttcaggaatgctgttggaaccttgtaaagaaaacaatttctg

SEQ ID NO: 23087 - DNA, 526 bp, Sorghum bicolor
  Clone ID: 14571127
tgtaaaacatgtctgctctagtacttgtgaactattcatttggtgtgctatgagaattaagatgaactatgtcacatgagtgattctgtgtttgttaggagtaatttactgcaataaagaataagttgttcattttttagttgttctacaataactagaggtgtcaatttgtgtacattgtcgtgatagaggagtgcagaagattggttctatttatggatacttgtcttggtttcctaacttattataacccctctgcatcctgattcttccatgaattctagcgaagctgtaaccataggatgtggagatcaatttgtagatgaatagcttgttcctgtgtgacataacggtgggattatctggacaatatcatgttagtgatttttagtttagcgagttcaacttttcaggctagatattactactttgtacacatatatgactatgtttggaagctttattttcttaaatgtgatcattccaatccaatgaatacaagtgaaccaaaaggaagatatccatc

SEQ ID NO: 23088 - DNA, 388 bp, Sorghum bicolor
  Clone ID: 14571135
ttcatgggagcaattgtcatttctgccaacacctaaaaaactggatgatgattcagtagttgcacaacctgtgttcctgcatgcatgtatggtccgattagtagggcttttcccttgagccttttaaactggcgcatctcccaggagatctaagttcttttacgatttgcaggaggcgtcatattcgcacaccgggggaagcgacgcggatgacgatgttgaagtggtgtctaccagcgtgtgagtcgcatcactgtagtttgtgaccgatgcttttagcattttcatgtccattttactccagagaaatgctaaaaaatgcgtaacatttcctccgtgtgatggcctgttgagctgggctcccgcttcaacatttgaccaccatctt

SEQ ID NO: 23089 - DNA, 717 bp, Sorghum bicolor
  unsure (1)..(717): unsure at all n locations
  Clone ID: 14571142
tggtacagcaattcagacgattattactgtaaagaagccactgcatatggattggtcatgtggtgagaagcaacttttgcatctgttgcatgtggagcaccagatgagaggaacctgccttcctggggttnttaggtgctggtgcatcacagtcgcagctttcctgtctgtttgctgtgttccttttccagaggatggaaatattaggattggtcaactggggatctgggatgattgcttgacactggtagtgttgtgacttggctagcacagcaaatatgcgggatttggaagtgtgtacatcaaattatcttttgttggtctggtgatttctgaacactgactgcttgggagtggccggatggtatcggctctgaagtctggacactgagaacaacatcgaaggttagaaacatggataatgatgtcggtttctccaatatctacaggcactcttttgctgaatgcatggctactgtttggcatgggcagtttacagcagatcagctgaaagaaaagagacttgctcttctgtttggcgcgtgcagttttgttctgtggtttcctttttatccaaatgatgtagggctggaaacagagtgggtacatattgtaactggctaactgctcaatgttgaaatctcgaattatttatttattctttgttactgttagcccaatgttgggaatatttcaaggagatcaaggttccttcgt

SEQ ID NO: 23090 - DNA, 636 bp, Sorghum bicolor
  Clone ID: 14571147
cggagagctgagcgatgcaccaccagtggacaggcctgcagcggacacgaaggaacacatgccagcagcagcaacacccagagctgcctcctggtgtgggcagccagaccactcgccccctgtgcccaggcataatgccagaactctgccaccaagaaacaccttccccggactgcgcttgcggcaaggatgcaacacctctcgtcagttcctgccccaaggcacgggccatcaggccgtccatcaagggccatcaaatgcttggattgaggatgaagactattaggcctagattaccaagggggaaaaaaatccctcttctgcttgtgaaatgacctgcccatgacatcgttgctgtgtagagtaggggatagctgctaatgtgcctcgcgttgtcttcacaggtgtgagctagtttattctacggccggctttggagtatgctgaggttatgctaacgttggtagagttggtttcggagtctgaggatcatttcctttcgttaattgttattactacattcatgcccttatgcttgagcctgtaactttttctgacgaaacatcttgccatggtccgcggacttgattggctttgagcctgagacagcaaagatgagaaaatgaattattcagg

SEQ ID NO: 23091 - DNA, 177 bp, Sorghum bicolor
  Clone ID: 14571150
tgcccttaaaaaaaattggagcggggggggggattgtacagtattggggtgggttttttccatgcacattgttttttttaccattagggacatgcccgcagattagcccctacatccctgcttactgtatagggggggagatccatgctttttgcccgggatgttagttcatggcgc

SEQ ID NO: 23092 - DNA, 538 bp, Sorghum bicolor
  Clone ID: 14571153
gcctaacccacaggttcgagtccaaatatgtaactgtcgtcctgtacaaacccatcgaacgatagcaatagcccgcgcatcaagagcggaagttaatgcttgacaactcactgcgggagcagcgattgaacagcgccgaggtggtacatgcttgtaaaagcggttgaggttcaggagtattttttccgtgcccttagcttgcagaacctctggtagtctggttgttagctgtacatgctgcgctgtcatgatgttggccttctggtttgtttatcctgttacagagagccaaggcaaccttaattcctatatacatgtccgcttgtcgtcgtcgttcctcccccatcccatcctcgtcctcccagggatgaactgtgtgtagaggtgtcagactgaaaaccgtggaaatccacagaaatgttagttgccagggatagatcaagtgattcctagatttttgtttgtttttgactggtgaagacgatgtttttgttatgtaataaactcgagaattttacaaatgagatactgtgtgttc

SEQ ID NO: 23093 - DNA, 194 bp, Sorghum bicolor
  Clone ID: 14571220
gacccaacaaatcttttgggccccggggccccccgaaacggaaggttgcccctcaaggccaagaaaactgagggagaacttacgggcattgtaaggtattttttttcccccctgcaaaaaccccagtgggaagggtttccagttattttggcgggggcggggtttatttttttttttttcggaggtttttgctc

SEQ ID NO: 23094 - DNA, 510 bp, Sorghum bicolor
  Clone ID: 14591955
acatgcacctgtgcgttgaggattggaagtggtggtggaagtcattcttctcatcaggatcagtggcaatctacattttcttgtactccatcaactatctcgtttttgacctcaaaagcctgagtggaccagtgtctgcgaccctctacattggttactcgctcttcatggtgattgctatcatgctggcaactggcacagttgggtttatttcttcattctgctttgtccactatcttttcgcatcggtgaaagcagattaagtttcttcctgctgaggtttgaaattactcaattgagaggtgagcagaatggacactgaaaagtttgtagtcacaaatcttagttcatgtcatcttttggtatacaaaagcctgaataactattgtaagggctactaggattcatcaatggatttatggagaggtgttagcagcttgctcgatgtaatagattgaattgctttattcacatgtggcgttactataattgtttagactccccattact

SEQ ID NO: 23095 - DNA, 327 bp, Sorghum bicolor
  Clone ID: 14591982
gccttcccgaaccttatcacgtgacaatctagacctatcatctccttcctgtcgagagaactttatcagcaaacatttcaaaggaaatggtgatgcctcccgtggccttcggttaacaatgaagctgcgagattttaacaagtatgccaaggttaagacctttgaagtgtggatggataatttgtatattataaaatgtatatatgtaggtgtctagttgacatctagctgttttttcccactctcatagattgttccactaattttttcctgaatatagcataaaacagaattttgttgcaggcatgatttcagcatgcaacttgc

SEQ ID NO: 23096 - DNA, 475 bp, Sorghum bicolor
  Clone ID: 14591984
attcaaacgaagatgtatcatttggctcttggttgattggattggaagtcgagcatgtcgatgagagaagcctttgctgtggtactcccccagactgcgaatggaaagcacaggccgggaacccatgtgcagcgtccttcgactggaactgcactggcatctgcaatccggtggagaggatgacagaggtgcaccggcgatgttgggaaggcattggagccgaagggcacacacagttttgactttgacagccgatagttggcggatcattgtggcaccatttttttctttctgtagggccctgtaagtaatatgcggagatgaacctgtatgcaatgtctcagtttttttcagatgtgcagcaatgccactgtttcctggtcagtttgcgtgcggaaactggggtagaaatgtggagtacaacctgcaattgagtctctaataactgaagatacctcgctggatgctgtcgaga

SEQ ID NO: 23097 - DNA, 412 bp, Sorghum bicolor
  Clone ID: 14592002
tcgtcgaagccacagaaaccatgggagtggaggaaggacaagcgcaacgggacagcatgagcagacccccgaggttcagtatgtgccgtgtgtgttattattattagccatgaacacctgattgattgatttacctgcagactttttagggtggtatatcgatatttcggggctcagtggcggcgtagtatgattgtgtgtgtacactagacgattccttaaagttacagggctgtgaatcaggagggtagagattggtgtatcgcacagttgtatcaaatgcattgtagcaccatttatactgctgtaaagcagagtaactgagcctgtgaaatgtgttgtatgcaaagccacttctgacggtgggagctgttcaatgcagccgagcaaagttgcaatcaaaattgacacc

SEQ ID NO: 23098 - DNA, 501 bp, Sorghum bicolor
  Clone ID: 14592022
tgatctgttcatggacgtaagttcattgcaagagcccttgcctagtccagatctgccagctttccttgatggtttacctgaaagatggttccccagcagttcttgtgcttatgatccatcagcgtcacatggtggactaccgtgccttgtcgagcagggaccgaacttttctttgcggaatataccagtgggcactgtatcaactggaaatccttttgtatagagggcatcacagtgaaaaatctgcatcttggagacttggacttggcatgttcctttagttcagtgaacctagagctaggaatcttttctgtgagaacccagaccccgtgcaaggcgatcagaacgggtggggaatatgatagcgcctccaggactcgctggagcaatgtttagtgattatgagtttctgccggaggaatgtgtatattctttctccgttcatgtactctaaaatggacaggattattcagcactgcggggcatcctggtctttttgat

SEQ ID NO: 23099 - DNA, 270 bp, Sorghum bicolor
  Clone ID: 14592093
tgtgaaattgttcattagccccggaagatcccatggaaatttcagtcctaataagatgctgataggttacccagtcatagttagcatttttctcttcagattaagagtggagttacaagacaagctgatccttggcttcgcgtttcagttaaagagataacgagtgtgcctagttttcatgcttcgggagcaaaagcgtttgatttgtagacaatttgtcaaaattcagttcaggaatgaatttcattgtctgtctactgtccccagttc

SEQ ID NO: 23100 - DNA, 309 bp, Sorghum bicolor
  Clone ID: 14592106
ccacttcggttgcatatcagaaaacactcagctggtaaattttgttcggaagacatttatatctcataattacatggtgctgcttgtgtttcccactctttccatcttcacggcagttaaaagagctggagggctgatgaatccacagacgagatgccatgttactcatttggcaaacaaacgatatgtcattaaaagtttttcttgggggcagccggcagtataatgtatgtgagatacttgtagttcacctatatgcggcacgctttgtgtaacctaaacttcatttgcaataatggaattagcttg

SEQ ID NO: 23101 - DNA, 545 bp, Sorghum bicolor
  Clone ID: 14592132
taatggctccagttttctccagagatgcatggagatgtgtctggcatatgattcagaatgacttagttcatggatggggtcttgattttgctctccggaaatgtgtggagcctgctcatgagaaaattggtgtcgttgattctcaatggattgtacaccaagtggttccttctctcgggaaccaggggcaggcggagaatgggagggcaccatgggaaggggtaagagagcgttgccggaaagaatggggactcttccagacaagaatggcagaagctgagaaagcatattacgagatgatgggagttactcctccgaatgtaacatttgtctcctaggataaaagttcacatgttaaatccactcacctttttctttttgtccagcagtagctcttcgaatagagttagatattgatgatacatgtagagcatacgtgacattatatataaactgtgcaaactctaatctggaccataggatgttgatccaaggggcgcggaaagattgggtaattttgcacttaaccgcccgctcttaatccc

SEQ ID NO: 23102 - DNA, 507 bp, Sorghum bicolor
  Clone ID: 14592139
cctcgccatgaaaggaaaatcagcggaaagcttatccacctcgaggaaaacgccgagtagagatggccttgcaagcttggagacgccctggccgtcctcggcatcatgaaccgtctgagaatggtccagtccaggtgtttgccaactcaccatatgaactcccctcccggtaccgtccgtgcccgttttttcaaccgcatgccgtctgtaaatagagtttttttgagtgcctgatgaaacacattctttcgaactccatcctgcgccgctgcgtaaatctgggaccagccagcccttggctgtcaaccgcgtgtagttttgcccgtcgatgaactggtttgctctgttgttgcggggggacccaaaaacggtgaattatactgtgcattgtgacaacatcagctctggattggcgtgtgtgtgtgtggaggtgtggtgtcatcatcatcagtaataaaagacaagaagagtactactcaaagacaagcttgtggtgcggttttcttg

SEQ ID NO: 23103 - DNA, 544 bp, Sorghum bicolor
  unsure (1)..(544): unsure at all n locations
  Clone ID: 14592159
anaggattgtgagaggcgatcaatagcgaagctattccatcatcgatcagaagagagacacagtggtgcacaactaacaagatgacacacccttccaagtgatggggggcagaagagagagagatcagggattgtatttttgatatagctcagctatccacaagactgtctattgaaactttatgaccctgccaaggtgtttatactttatatactgcaagccatcttacacttgtcactctccatccagtcctgcaggccagttcccgcctttcattttttgcagttgacataggcggattaggagttagctgtttggtttttcattgttctccgtaaagctctgtttattctttgtctttggataatatggcccatggatgtctggggaagcagggcatggacttcccagattgtccatgcacaatgtattattattaccacaccactgtaggacggtgtagtgaggccatgattctcctgcaattctctgtggtcttactgaaatgtaccatacaatagaaaactgcagtatggaatttcc

SEQ ID NO: 23104 - DNA, 495 bp, Sorghum bicolor
  Clone ID: 14592164
gcaaacaaggaaagaagaaacaaattaggactaatgaaaagcaatgcagcgctcctgctcacttttccgtacacggttaacaaaaactaaggttccagagattatgagttgtacatacggaagctgaatatgcagttgtacacattagtgcaagtagtagggtttattacctaagcacatgaggcgcccttcacctcgacaagagatgcatgccttggttgatgcagtagtgccggtgctgactggttttttattttgcgtcagtctggttgggtcttcccacctgttttcaccaagaagaaacactctgtgttcggagaccccagctccggcgacaccattttctgtaatcacagttttgtgaacctccgcaatccctgttacagaaggaacagctgctccgtttgtgccatcctagaagaaaatgggaatctcagtactgtgcatcccgatgtacaatgcctgttagtttataaaaggctcttcctgtaccgc

SEQ ID NO: 23105 - DNA, 637 bp, Sorghum bicolor
  Clone ID: 14592168
tagaaaggcaagtagccaccatgatcagctccaagaaactagctcaactgtccaagaagtggcagggaatgggtgcggtgcgcgaagaagggtcacaacagtcgacaaggatccatcttgcagcagcgtagttgcagggaagggcaactgcgttgtctactcttctgatgggaagcggtttgagatccccctcacttacctccacacaagagtctttgcagagctcctcaagctgtcacaggaagagtttgggtacacaagtgatgagaggatcacacttccttgtgatacagccgtcatggagtatgtgatgtgtttgctgaggagagaagcctccgaagatgtcgagaaggcactcagttccatagtgatgccttgccaccatcaaagcagaatggtgcaaccatccagtggatttaaccaccaatttgctctgtctagctcctgaagatgaagacaccagggctttgaacttgttttctctccttttattttctcccgttccatcttttttgcccagctgtaccatggagcacggtttttgtgtaacgtttttctatggtatactgtggttgtacaaatggaatgtaaaaataattacatcgtgattagaaaaggaggaatcaagcttgcattg

SEQ ID NO: 23106 - DNA, 575 bp, Sorghum bicolor
  Clone ID: 14592171
aataagcacggatatgctgagttgcttgctcaagtcctgccaaacttctggatcaaattctccagattccactgctgtggatggttctggaaacaattccagtgaaagcattctggatatcaggaactcacaaggtgacatcccaacaaggtcaagccgcaaaatcggacggccagttgttgggaagggtgttgcagggggcatcagattcaacagaaataaggttctgaaggatggtaggggagcaagagcagttgacgatgggcctctgaagcaaagagctcaagaagcttcatcgagcttcatgttgcatagaaagatcccagcttctttcttggacagagccgaggagttcttctgcagggagacatgaaatcggctctgcagttcacctaacttatatggcacgagctactgagtttactattttgcaaggatggtgcttcagactgattatcttgaatattagggaaatgggcgtttggccgaaaaaagtctacagataaaaaaaagtcatgtacggtagcaatgcactgtttgtacaggaaaaaaaactgataagaaaatcttattca

SEQ ID NO: 23107 - DNA, 467 bp, Sorghum bicolor
  unsure (1)..(467): unsure at all n locations
  Clone ID: 14592216
gcacgaggattctcaactccctcatggtgattgccttccttgctggtattgtgtttgtcattctgctgaggactgtgaggcgtgatctcaccaagtatgaggagcttgacagtgaggcgcaggcgcagatgaatgaggagctgtctgggtggaagcttgtggtcagtgatgtgttccgtgcaccaagcaacccgatgctgctctgtgtcatggttggggacggtgttcagatcctcgggatggcggtcgtgaccattctctttgctgcactcgggtttatgtccccagcctcccggggaaccctgatcactggcatgctgttcttctatctggtccttggaatcctagctggatacgctggggttcgtgtatggaagacgatcaagtgcggggatcactctgngtgggtgggtgtttcatggcgggtggcctgcttcttcccggcattgcattcctgatcctgacac

SEQ ID NO: 23108 - DNA, 330 bp, Sorghum bicolor
  Clone ID: 14592219
gcacgaggacgacttgtcttgagcatgattgaattttttagatctgtttcctctagaataaatattggacgcttcgagaaaagtcttgagctaagtattttaggtggtgctacagacatgttaagagaatatgaaaaaatctcaaagaatattacagacaagctcctggtgcaagacagtgaattgttgccttctgttgtcccagttggtgctccatggcaacagatacaccttttagccacagagcagaaaaaggtgtacattgaattgtttcagttgactcctgtcaagttgactttcagttttacgagcacaccttggctcaatagg

SEQ ID NO: 23109 - DNA, 376 bp, Sorghum bicolor
  Clone ID: 14592223
gcacgaggacaaatagttctttgtctgtctttctaagatgatgttcagtagtttcagcgtgatgccccaaaactgattgaactcagtgtccatggcagcgttcctgactgttggactgaaaaaaaaaaactagaatcagttggcttcaaagcttaagcatctggtgtctctgcaactgcctccccggaaattctgctgaatatcttgggtagtgatgcctgtgatgctagtagcaagtaattccatgacactggagatgagttatagctgcctgacaactatccatgatcttctagttcattccagttcagctgaactcttatgttggaactgtgctggtcaccctggaggcctggactgattgtagtagatgtat

SEQ ID NO: 23110 - DNA, 418 bp, Sorghum bicolor
  Clone ID: 14592230
gcacgaggatgattttgaccgctatgagccttatcatggatatgaaaggcaagaagaaacggaaaatgtgattaaagcaagttcttatgattctcgtgaacacaaacatttttcagagaagtggcaagagcactctgacaagcatgttgacataagccatgataaatcaagatctcctccaacctgttacagttgtggtgttgctggccatattgcacgtaattgccctcgtggaatagatgataacttcataccaaggagagatggactgaactttaaggaaaaatggcagctgaggcagagaagatttgggtcaccctcgaggaggcgaccagaatttcctattcatccattggaccaaacaaatcataaagttcaagatggtaggaagccatttgctgagaggaatatgcaaatg

SEQ ID NO: 23111 - DNA, 406 bp, Sorghum bicolor
  Clone ID: 14592240
gcacgaggctcctgtcctgtctccttcccatctagcagttggccaaaagcaaaaggcaccacctttcccttcgcccgcagacttgtccgatccgcaaccaaaccaaactccacaacatttcctccagcggcctgttcaagaaacctggatcaatccaaccttaattcaatcgcacattcggcgggatctcccttgagttgcaatggaagaggggaccacggaatccggatcgttctcccgctcttcctccttcggcgggttcgaggagtgggtggcattggtgaggaaacgcaatgggaaggcctcctcgtgcgggcgtctgggtctccgttcatcagccagttcagaagtactagatcttgcagatcctgatagcaatgtcattgaccctgacccttgtgaccag

SEQ ID NO: 23112 - DNA, 387 bp, Sorghum bicolor
  Clone ID: 14592242
gcacgaggcttcgctttccctctcctccctttcgaacgaggaggagccatccgaggtggccagccacgcccacgatgatggctgcggcggcgctgaggccgcacaaggcttcgccggcgcgcgtgcccacgcggtgtgtcgccgcgctctgcgccgcctgcttcatcctcggcgtctgcgtcgtcaacaggtactgggctgttcctgagcatcccggttgcccagacaaggcaggctctgaccgctcgagggccgcgttggaccaagtgtcacagactcgcgaagtcgtcatggcgttggataagacgatatctgacatcgagatgcgcctggctgcggctagagccgcgcaggcgatgagccagggcatgtcaccgggcgactcgg

SEQ ID NO: 23113 - DNA, 371 bp, Sorghum bicolor
  unsure (1)..(371): unsure at all n locations
  Clone ID: 14592249
gcacgaggggaggacggctcggcgggcacccccgagatctgctgccgccactcccacgcggcgctggcccgcgaggtccgcgtgcaggttgatgtcctcgtccgctgcgcctcttcgtggcgccacgccgaccgcgccgccgccaagcgcgccacccacgtcctcgctgagctcgccaaaaacgaggaggttgtcaacgtgattgtagagggcggcgccgtggcggccttggtgtgccacctagaagagcctgctgtggcggcgccaacgcaggaggaacaacaactgcggccgtttgagcacgaggttgagaagggcgctgccttcgctctgggcctcctagctgtanagcctgaacatcaacaacttat

SEQ ID NO: 23114 - DNA, 413 bp, Sorghum bicolor
  Clone ID: 14592252
gcacgaggtaccccttcctccgcgccagccacgccgcgcgatcccgatggcgaagacggcggtgatggagctcaggacgctgccgctcggcttccgcttccaccccaccgacgaggagctcgtcacccactacctcaagggcaagatcaccggccagatcaactccgaggccgaggtcatccccgagatcgacgtctgcaagtgcgagccgtgggacctcccagataagtcaattatccagtccgacgatcccgagtggttcttcttcgcgcccaaggaccgcaagtaccccaatggtagcaggtcgaacagggccaccgaggctgggtactggaaggctactggcaaggataggatcatcaagtccaagggtgacaagcgcaagcagcataccattggtatgaagaagaccc

SEQ ID NO: 23115 - DNA, 409 bp, Sorghum bicolor
  Clone ID: 14592260
gcacgaggcggagacaccaccttctcgccgctgctctttatttgggccccttgctaatgtgttctcagctgtggtggaggtgcagggggttcgcgcgcttcgtgaacgtgcgggacgacaccggggcgacgccgctgcaccttgcggcgaggcagggctggcggcgctgtgtccacgtcctgctcgagaacggcgccatcgtgtccgcctcaagtggcgccttcgggtgaggatcccccctctcataagtcatatcatgtcaaacaacgtatttttatgtggaaaaaatcgctccttttgaggaaagttttgtgtcatacatttgactcgagccgagcgcgcgctcctgcagattccccgggagcacgccgctgcatttggccgcgcgcggcggcaacctggactgcgt

SEQ ID NO: 23116 - DNA, 422 bp, Sorghum bicolor
  Clone ID: 14592267
gcacgagggcagcatcattttggcacaaactcccatgtttctaataatatgccttcagtaagtgagaaaatgatgatggcacaggaacaacttcaatctcgacatggtctccctaacagctccagtgcattaccttttggaggagctgatactggtctatctcagaatagagcagttcaaaacagtcaacatatgcttcagcttcttcataaggtggataactcaagaaatagcaatgtggatgctgacatacccaacaattcccttggcgttgattctgcccagcaacaacttaaccattcttctttgcaaggatttggattgagactggcaccaccatcccaacgccaatcagattcgggtaatttatggtctagtcagactaatgctgatggcaagcaatctgaccactcagcacaaga

SEQ ID NO: 23117 - DNA, 440 bp, Sorghum bicolor
  Clone ID: 14592284
gcacgaggagcttctggaccttcgtctgcgtctcctgcagcggcatccaccgagagttcacgcaccgtgtgaaatccgtctccatgtcaacgttcagcacgcaagaggtcgaggctctccagaagggtgggaaccagcgtgccaaggaatcattcttgaaggactttgatacccagaaaatgaggctacctgatagcagcaacattggcagtcttagggaattcataaaagctgtctatgtggagagacggtatgctggtggtagattttctgaaaggcctccaagagataaacagaaccaaaaggcccatgaggaagagcatagaaggccaagttcttaccattcattttcacagagcccaccttatggttgccagtatgaagagaggcgtaatggcaagcaatctgcatttctaagtaggaagcctggttcagatagg

SEQ ID NO: 23118 - DNA, 175 bp, Sorghum bicolor
  Clone ID: 14592338
tggtggcgccgccagcgcaggcgaccgcggcggctaagctcgccagctactgctggacggcggggctcgacggggtgctcatctactgggacttcctggccgcggaggtggtgcggaaggtccaggtcgggctccccgtccactccatggtggttcctaacatttgtaggacctc

SEQ ID NO: 23119 - DNA, 477 bp, Sorghum bicolor
  unsure (1)..(477): unsure at all n locations
  Clone ID: 14592339
gcacgaggccgacccccagatgccggccacggcgagcgtcggcggcgcgcggccggagccggaggaggcgtcgcccgcgccggcacccgcgtcgacgtccgcgtcgagctgcatggggacgaggccggaggagctgacggcgaggctggcggccgcggggccggggcccgccgagggctgcggcggcgccggcgccggcggagaggaggtggagcacgagcgcgtccgcgcgctgcgcgagatcaagaaccagatcatcgggaaccggaccaagaagctcctgtacctccgcctgggcgccgtgccgtcggtcgtggcggcgctggcggagcccggagcctcgccggcggcgctcgtgcaggcggccgccgcggcggggagcttcncgtgcggcgtggaggatggcgcgcgcgccgtgctggccgccggcgctgtggagcacctcactcgcctcctcgctcatcccgatgagaaggt

SEQ ID NO: 23120 - DNA, 470 bp, Sorghum bicolor
  unsure (1)..(470): unsure at all n locations
  Clone ID: 14592354
gcacgaggcggcgagcagaggacgagccactgtcgacaatggcggagcccaaggcgtccaagagcaagtccaagtccaagtccaagagcagccacgacggggcggcgtccaagaagtccaaggccagcgccgccgcggccgcaccagggacgctggacgcgcacttcgcgccgtgcgcggacgtcaagggcctccgcttcggcgcgcagctcgtcacgcgggcgctcaccgtgcgccgcgccgcgccgctcgagctcccgcacctcctccgcgccacgccgtgcccctccccctcccccgccaccaccgcctccgcggacgcgctgtcgttcgcgccgacgacgacggcctacatcccgaccaacttcgccatcctggcgcaccacgcgtggcacacgctcaccctgngcctgngcaccaagaactccaaggccgccgtgttcgtcttcgagtccgccgccatgaaggcc

SEQ ID NO: 23121 - DNA, 203 bp, Sorghum bicolor
  Clone ID: 14592366
gcacgaggcttcctcgctttccctcccaaaaccctagcgctccttcaagcaacccccagctcccatggcgcgctcgacctcactgtccgaggcggaggcggggatatcctgcttcgcctcctccctttccggattccgcggcgtcctcaagcaccgatatgccgacttcatcgtccacgaggttgctcgcgacggcgctctcg

SEQ ID NO: 23122 - DNA, 302 bp, Sorghum bicolor
  Clone ID: 14592374
gcacgaggccccacctccttccaccccgcaaaacccccgcttcggccatgtctctctccgcaggcgaataggcgactagggtttcagcccccggggacacgccgccgctcgaggcgcctccgccaccggatcccggcacccgcgctacgccgtccgcttttgccgcctctcccccggccaccgccgccggagcgctccgccgacacccgacgcacctcgtccgcctcgtcacccgcacctccgcgtcggcgcaggattgcttagggtttgggggattcggcggctggagccaaatcccaccg

SEQ ID NO: 23123 - DNA, 443 bp, Sorghum bicolor
  Clone ID: 14592392
gcacgagggattttcatcagcacaggttatggggagacccagatgaggacctacccttcaagccaaagtaccttgttactttcactgttggcatttcacagaaagataacataaatagggctgtcaagaagttttcaaaagattttgcaatcctgttgtttcactatgatggccgggtgactgaatgggatgaattcgagtggtcaaagcgagctatccatgtaagcgtccggaaacaagcaaaatggtggtatgctaaaaggttcttgcatcctgatatcgtggcagcctacgagtatgtatttatctgggatgaggaccttggagttgatcattttaatggagatgagtacattaaacttgtcaagaaatatagactagaaatctcacaacctggtttagagccagataggggattaacatggcagatgaccaagagaaga

SEQ ID NO: 23124 - DNA, 533 bp, Sorghum bicolor
  Clone ID: 14592400
gcacgagggtcatcgaagaagcaaagttgccaagagccaaaaccattgcctacaaatcgccaagaaattgcaccttgtgatgaacccagaaaatctatccacagaaggattgaaaatgaaccgtctattgtggtgatgcctaaaagtggtgatgaggaattgacaaacattgatgaaaacatcagcaaaccaagtgggactgaaagaggagtgggaaaattttgtagctctgatgattggacaaaagagcaggacatggcattgcgcaaagcttacttcactgctcgaccatccccacatttctggaagagagtttcaaaaatggtgccagggagatctgctgaagactgcttcaacagaattcatgctgacctcacgacaccaactccaatagccccacgtcccagaacaagtaaaacaacattttctcctataggaaatttcacattgtctgatccaaaacttccaaatctcttggaatctagagttgcaaggcaaaggaccgctaaacaaaagggtcttacagcacagaa

SEQ ID NO: 23125 - DNA, 235 bp, Sorghum bicolor
  Clone ID: 14592407
gcacgaggcacagatccatttgatgtcccgatgactgactcagtaagaggcaaccctaaggatattgaagatgaagtagctaaagaatgggaacacacaatgctgcaggatagcatgggcaaggagttgaatgaattaaatcgacaacttgagcaaaaggagtctgagatgaaaatgtacggatgtgatactgttgcacttaagcagcacttcggaaagaaacttatggagcttg

SEQ ID NO: 23126 - DNA, 647 bp, Sorghum bicolor
  Clone ID: 14592416
gcacgagggaggatcatagcaatcagctcaacggaactacgggaaaattttcttcctcgttagcattttctgatggtttgaacacaaataaagtttcagctatgaaccatggaattggtaccttggctgacatacaaaggttgatggcccttgagaaatcacaagcttcacaacaaatgattaactttattacgtcacaaaacaacatgaaccatgacaaaggatttattgctttacctaataaacagttccgaagcttcattgcacaggacataccattgcctggcagtacggtgaacaaattggaagagaatgatatcttgaggaatggagtgcatcaaattcatccttgggaaactacatccaggccacatcactctagcaacaattttgctttaccaaataaattgcctggatacttaactgcagggaacgcacagttatcgagcagcacagtgaatccatccacagaaaactatattcagagtaatgctattcatcaacatcaatgcttagaaaacgttgtggctaaggtgccagtcttatctgaaacacacaacatttccagccaagagggccataaccactgcactgctgctactactgatgagcacatcagaaactacagtaatgaagttgttagatcc

SEQ ID NO: 23127 - DNA, 538 bp, Sorghum bicolor
  Clone ID: 14592422
gcacgaggatcaagtataatgtctgctcaaatcatgctgttggcagctctctgattgacctgtattcaaagtttggagatgtagaatcttctaggaaggttttagcacatgtagatgcaagcagcatggttccaataaatgctctaattacaggtcttgtgcagaacaatagagaagatgaagccatagagttatttcagcaagtgctaaaagatgggttcaagccgtctaactttacatttgcaagcattctttctgggtgtactggacctgtcagttcagtaattggcaaacaagtccatagctacacgctgaaatctgctcttttgaatcaggatacttcacttggcatctctcttgttggaatatatttgaagtgcaagttgcttgaggatgcaaacaaactcttagcagaggtgccagatcacaaaaacctggttgagtggacagctactatttcagggtatgctcaaaatggttacagtgatcaatctttggtgatgttttggagaatgcgcagtcacgatgttcgttcaga

SEQ ID NO: 23128 - DNA, 562 bp, Sorghum bicolor
  Clone ID: 14592429
gcacgaggtgaaatacagcgcaagaaagaagaagctattttcagaagagaagaggagcgcaaagcatctagtgctgcacgagaagcaagggctgcagaacaacaacgtcgaaaagagataagagcaaaagcgcaacaagaggaagctgaacttttagcccaaaagttagctgaaaagcttcgtgaaagtgagcagcgccgcaagtattacctagaacaaatacgggagcgagcctcaatggatcttagggatcagccttcaccttttcagcgtcgctttccaagtaaagatggccaaaaccgttctagttctgctaacagcggagaagattcacagacaactggcaattctagcgctgcagattctatggctaagtcatcaaataatgtgcagacaaaacgaaggattaaaaagattcgccagagattaatggctctaaagcatgaatttattgaaccatccataggtgaaagtacaggaatcacacacagggctgcccttggagctgccaaagctaagttaagtagatggcttcaagaccttcagagacttcgtcaagcta

SEQ ID NO: 23129 - DNA, 381 bp, Sorghum bicolor
  Clone ID: 14592437
gcacgaggccaagctgtcatcactggtacattctcaatgatcaagcagtgcacttctctgggctgctttcctcgggtgaagataattcatacatctgccaaagtacacgggcaaatatacatccctgagatcaattggattctgatgatactgtgcttagctgtaaccattggattcaggaacacaaaacacttggggaatgcatcaggattggctgttataactgtcatgctggtcacaacgtgtctgatgtccctggtgatagtcttgtgctggcataagagcatatttcttgcaattgccttcattgtgttctttggaaccattgaggcactgtacttctcagctgcactcatcaagttcaaggagggagcctgggtc

SEQ ID NO: 23130 - DNA, 475 bp, Sorghum bicolor
  unsure (1)..(475): unsure at all n locations
  Clone ID: 14592442
gcacgaggagtccacctgccttcagtacagtttttaggcacttacagattgttggtagaggcaatggtgacgacacattagcacactggccatcctcagcagggataatgacggtggaagatgcctttctacaggtcttgcaatacttggataaaatatggggaacactatcttcttcagaaaaaacagaactggagaaactggcatttataccagttgcaaatggtactcgattggtcccagtgaagtcactttttgctcgtctgaccattaacatgtcaccttttgcttttgagcttccaagtcggtatcttccatttgtttcccttcttagagagattgggatgcaagaaagccttacaaactcctatgcaagagaacttcttttggatctccaaaaggcatgtggctaccagcgcttgaacccaaatgaactccgtgcagttatggaaatcttggacttcatgtgncatgg

SEQ ID NO: 23131 - DNA, 580 bp, Sorghum bicolor
  unsure (1)..(580): unsure at all n locations
  Clone ID: 14592458
gcacgaggctgttcatcattgtgtacatagcacttgttattcatggagagtgtctataccttatccatgactggtacaaaaagacgacatggatgtaccttgctgttcctgttggtctgtatgtaggggaaaggactctgaggtttttcagatcaggcagttattctgttcggttattgaaggtggctatatatcctggtaatgttttgacattgcagatgtctaaacctcctgcattccgttacaagagcggacagtatatgtttgttcaatgccctgcagtttcaccttttgaatggcatcctttctcaattacttcagcacctggggatgactatttaagcattcatgttcgacaacttggtgactggacacgggagctcaagcgggtattctcagcagcttgtgagccaccggtgggtgggaaaagtggccttcttcgagcagacgagacaactaagaaagcgttaccaaaacttttgattgatggaccatatggttctcctgcacaagactacagcaagtatgatgttctactacttgtcggattangaattggtgccacaccttttattagcat

SEQ ID NO: 23132 - DNA, 538 bp, Sorghum bicolor
  Clone ID: 14592539
aacgcaaagttgggcaaggcaaggtatcttaagaatttgtatgtgaagatggcggccacggtcaccgcacaacgggatgtcgcgtggcaacgagaggaccagctccagctggagaaactggagctggcacatcacttagatacagtcaatgacctggctatgcaatatcgtgatattgcatttaatctgtatcatcaactccacccacctcccggcgaaggagaaatggatacggatggcgagttggcagacgatggagaacccgatccaggcctcagtgatgaagaggagtccgaccccaatgaccacaacccagggggtaatcaggatgatggtaatgacgatccgggctatagctctggccacaccgattagttcggtgaaaccgagagcaacgtcgtggtaggagtcctagcttgccgtagtggggtccgggtttgtaatataagttccctttcggtttgagaagttgtacctgtttactcttggtgtgtcgaactaatgtctaataagtgaatgaaagaatgtaagatatgtt

SEQ ID NO: 23133 - DNA, 517 bp, Sorghum bicolor
  Clone ID: 14592548
agtccgaggatggcgaggaacgcggtggaggggaggagcctggacgcgttcaggctgaggaacctccgacgaagaggcgtcgaaggatcgatggccgagcaggccgaggaacttccggagtggtcgggccgaggaacctccgacgcatccaggctgaggaacctccgacgcagaggcgtcgaaggatcgatggccgagcaggttgaggaacctccggagtggccgggccgaggaacctccggcgcggccaggctgaggaacctccgacgcggaagcgacgaaggatctgcagccgagcgaaggatctgagcctctgaccacgacctcactagattacggacgttcatccatatcaaatccaacgatcaatttcagacataccttatttagaaaaaaaatcccacctctttttctttttcgcaaccagccacacatgcacagcgattcttccgcacttccacattcatgtttgctttttaaggatgactgacgtcatagaaaaagagaaagtttattt

SEQ ID NO: 23134 - DNA, 464 bp, Sorghum bicolor
  Clone ID: 14592554
atcagcatcaggagctatgatgatgaggtgaccgcactaccgatgggggccgagacgagacgagacaggcatcggggcacagagccacacactccacatgcatgaagcagcttatttttgtcctccctccttcaggctgatgcttgctgttcatcgatcatcaacctcttgaatcgtgcttgtcatcatctatccatccatccatgggctaggttttgtagattgttgtgagtttgcttgtgtgctaggtggcccggccggcccgttgaaaagatccaacaaaaaaaaagtgtgtattttcactctctagcaacctgtccactcactagcagatccatggccagtcgtctttgcttcttttttcttccagtctttctttcacgttcttggctttctcctcctcgactccaccctgtacaaagtggctgtgtactactcgtagatgggaaatttatggtgcaaaa

SEQ ID NO: 23135 - DNA, 538 bp, Sorghum bicolor
  Clone ID: 14592572
agcatatggcagcgggtactcatccattgcaatacagagagaagctgaaccatggccatccacgcagcagcaaagagtgcgcgaaaatggaagcgagcctctcgacacaactgaagcctcagctcctgcaaggatcgcaaaatctggatcggtggacaggggcgtcgggggaagcagctgtaagctttttggtttctccttgactgagaagatccttggaacagagggagttggtgggaaagaagggaactacgaagcggatcggcagactccccgggttctagacttgcttgggcacggccattctacgcccggtgctctgcatgctctttgcgctgctcccttgggaatatgatgctgttgtgcttagttttatagtagttagatttatgtaatccttcagtcattttcatcgcgttggacttgaccaatatgtccagcgtatgacttccagttttaattgtatgctgatgctacatatcctttcttaagatccatgcatgcgatttctgggagaggcatgcgtgatactggcaaa

SEQ ID NO: 23136 - DNA, 481 bp, Sorghum bicolor
  Clone ID: 14592603
gaccttcaagactcaggatggcgctgaagacatgcttctcaaagatggactctacgctgcagcggcagcggctgcagcagccaacatgggcatcactccattctagccggttaggcaggcatgttctgaatctggcacgcagagtggctatcgcccttgtgctgcattctagggtttcatctcagatcttgatctcagtatcgcgtgtcgtttaactagagtatttccagtttgagggtagaaatggagaatcaagtcagaacacctaggccactgatgatccgatcgataggtacagacttgattgtctcctctctatttcaacaatccctttcatttcatgttctctctgtctctctctttttatttttttgttcctggaccccttcaattcgcctgtagaaaagtcgttgtgcctcctccagtcccatgtttgcgtctgttcatcaaggacatctttttttaccatggagaactaaaa

SEQ ID NO: 23137 - DNA, 464 bp, Sorghum bicolor
  Clone ID: 14592768
atgaacaagggtagcgagagatggctgtgctatggaggtgctgcaggcatcatacgatgccagaggatctgaagaagagcgcaatctggaatgctcctcgagaaacaggggcctgtaacacagatagtggtactgtggtattattctactctattcttttattctacttttgaccgggtcaccgaaggtggttggcttagctgtgcatagctatagaagagagctggtgcaatagacctttgcgttttagaattgaagccctcaggttctgaatacattaggtatgaaagtctggttctgatagttgcggtagtaccagtgcatgcgaacctgagctttagaataagcccgttggcgttccatcttctgtgtaactgttcccatgagaatgtgaacagaacatgatttcccgatgcattcgggaggaaataataaatgccataatgctagagattcgggttaaa

SEQ ID NO: 23138 - DNA, 408 bp, Sorghum bicolor
  Clone ID: 14592769
aagtcccagtaatagacaacttgttgcctgaagcaaagatcagattggaactgtatcaatccagaggtgcaaaaggctatcagtagattacctgctgtggaaaggcatgaatgaggaattttaaggtgttcttcttcggattggccaagtactgtatatacatccaacggcttctatctatagtctggctaaaccttttttcattcccggcatggcaaaagttgttgaagctacacctctggttgggttctcgatccagggaagtaagttttgtttgtaggcttggatgttcagaactccaattcctcttgttggtggtatagtttttgggagattagcatcttgtactctctttggcctaatgatgtatcgtgtatattacatttcactcatcaatggaaaagtttt

SEQ ID NO: 23139 - DNA, 656 bp, Sorghum bicolor
  Clone ID: 14592773
gcgagcacagctgcagctgcgggcagtggcaactaaccaagaagccctgcctccatgctctggcatggataaccacagagacaaatgccaacgtggaatcctttgtccatgactactactctgttgagcggtttagggctgcatatagaggtatagttccacccatgacagacaagtcgcagtggcctcaggtggaccctggtttcaagctgctagcaccgcagttgaagccaggacttgggaagaggaagtacacaaccaagacaagtgaggaaccgtgcgcaagtaaacagtgtgagcagtgtggagaagttgaacatcgtgagaagggttgcacgctgcattgcccgaagaagaggaagagatgccaagctgaagagggctggaaggctgagtacgacgctaactgatcatctctaggaaccatgcttcgccgtgggacaatagatctgtcgagggaggtgaagatgctccgcggtcatcgaactaccaaaactaggcacctattttgtagttgtcccaggaaggaggatttaggagctgaggatttaatctgtagctgtctgctgtgtatgcatggttaaactaacctaggacggcgcctgtaacgtgcgaagcatgttttgcattgcaaactgttttaaaggcgtggtaaa

SEQ ID NO: 23140 - DNA, 486 bp, Sorghum bicolor
  Clone ID: 14592790
tccagttcttaccgccgcagcaattccaccatggtcaagcttgttccagatataccttgctcaaatagataagcaatttcatgatactacttctgcagatcgaaagtgtaagtgcagaggagatgaaatagatcagcatagtaactgtgagattactgaaaggattcagtgtctctacgcattccatattcagcaacttcatttaatggttccacgatgacatagttatagttcaagatcatgctgaatattacaatttgcacgctgattctgacatttcacttttaagttttaaagaatgactgatcggctatagcttccttggttgtatcttttacttttcatgtagcatgatcaaaaactaacttgtgtcactggtatgtgttcgtgcgtgcgtgtgtgtgttgccggggtcagggtgatgttgtacatctttgcactcttctgctttaatgaaatgacgccaactctcctgcatcgttcaag

SEQ ID NO: 23141 - DNA, 553 bp, Sorghum bicolor
  Clone ID: 14592813
gagcttggagcctgtgcccacccatgctgaactggaagagatcactgatgaagagctgatggagattttgggggaccaattcacgccaaggaagaggaagataaccaaggccaagcaggttcacgatcgtcacctcaggtgcagcaagagaagtgccagcaagctcggtggcttcaagaaggatgtgctccaccctgtgcccttcgccatgatcacagggccaccaaggacccctgctctagcaacaactccttttctgctgctggaagttgctcaggggatagccacgggcttcctccagatctatcctagtgatgtgtcagcctccatcctcaagaaggacgccaatggaaagtgaaccaccacagctcaaggccctgcactatggttcagagtgcatcttttgtttaagttatctagcggtgaacttagtttcaaactcttaagtttgtcccagcttacatgctggtgctttatctctttagttagttgcaatggtgtaagctacgttgcttggtactttgtttgattaagttatgccatttggccagtt

SEQ ID NO: 23142 - DNA, 302 bp, Sorghum bicolor
  Clone ID: 14592835
acgacatgaacagctatagcggccttgtgagcagcaacggcaaaaacgatgagagagaagagagagagtaatattttattgcttatcgatcggtggtcaatagtggtatggataatttttattatagactatatttaatttatagaaacgcctataatgttttagtacgtagtccatatagaataatttaatcccatagatagctttttgagcacataggccatgtttagttggtgaagagaaaaatttcgtgacgctgtagcatttttcgtttgtttgtggtaattattgtccaaccattg

SEQ ID NO: 23143 - DNA, 521 bp, Sorghum bicolor
  Clone ID: 14592838
cggagcctcgccgacaacaccacgctcaacgagatggaccccggcagcttcctcagcttcgacgccagctactaccgcctcgtcgcaaagcgccggggactcttccactccgacgccgcgctgctcaccgacccggccaccagggcctacgtccagcgccaggccacgggactcttcgccgccgagttcttccgcgacttcgccgactccatggtcaagatgtccaccatcgacgtgctcaccggcgcgcagggagagatcagaaacaaatgctacctcgtcaactgatcgacccccggcctgtgccgccactgcatgcctgctggttttgacgatccacgacgacgatgatgctttcagcacttaattgcgtatcgatccgttggttgattcaattattatattcgttgcttactttacacttggttaatcttaaactgtgtgactttttttaaaagttgatggatccatggatcttaaactgatgtacgtagagtgatgatcgagtgccttttaagttt

SEQ ID NO: 23144 - DNA, 140 bp, Sorghum bicolor
  Clone ID: 14592840
ctgtcgaagcagttttccatatgctgatgtttctgtttcactgtaactgctgaaaggctatctgtgagaaaatggtgtctatgtttgctttttactagaccaggataaccgtattgccaatttcgtaatatttggttaac

SEQ ID NO: 23145 - DNA, 453 bp, Sorghum bicolor
  Clone ID: 14592866
gcacgaggctgcgctgctgcacgcgaagctcgcctcggctctgttgcagctcagctcacggtggaagaggagaagaggaggccgacagcgcacgaggagagggagcacagcagaacacgccgaccagcagcaccaccaccggcaccaccgcgcgatggcgtgcatcaacatgtacaaccctgacggcgcggcggggttcggcggcggcccgcaggcgccggccgcgctgggcccgcgcatctccttctccagcgacttcgcggtggagccgccggtgcagaaccgggcgatgagcctgcggtgccacgcggaggaggacctcaacttcgagttctcggtgggcagccaccccatgatggcggccgaccagctcttctccaagggtaggatccttcccctcaaggacaacgccgggggcgccaccgcggctcgcccgcccaccacgctgcgcga

SEQ ID NO: 23146 - DNA, 455 bp, Sorghum bicolor
  Clone ID: 14593088
gcacgaggctgctccaaaggctgtattaagtcttcattggctaaaggatggaagggggatcgttatctgtttggaagatggtacattgaagtttctaagcttgcctcggattgcaaatgatgttccagccactggaaggccatttgctggaacaaaaactcagggtgttggaacttatcagttgtcagaatatttgatttggagtgtccatgcctcagaacctacaggttgtgtggcttactgcggggcagatggtactgctgtgtacttccagcttaattcgagattctgggataaagaacctgggcgtaaccgcgttccttatttcctctctggatcattatcagaggagggagaaaatattaagattggcagcaggctgcaaacatctccattacctaatgttcctgtgatgacaaaaagggttcaaaaccatgccaaaatatagttcaggg

SEQ ID NO: 23147 - DNA, 414 bp, Sorghum bicolor
  Clone ID: 14593089
gcacgaggcccgttcacctcctcttcctcctcctcctccaattctccccccaattcccaccctgcggaggaggcagggaggaaggccggaccgaacagcccgcccaccgccgcctgcgggataggggacagggcctgggcccggccgccattcggttggttgcttcaccgcgccgccgcggcgagggggggcgtcgtcggccgggatagatggacgacctcaagcagatcctggcgcggccgatccagctcgccgagcaggtaataaagtggtccgatgaggcctacacgttccggcaggagtgcatggagctcaaggccaaggtcgagcgcctcgccgggctgctccgccaggccgcgcgcaccgacctctacgagcgccccgcgcgccgcatcttcgacgacaccgagaagg

SEQ ID NO: 23148 - DNA, 514 bp, Sorghum bicolor
  Clone ID: 14593094
gcacgaggcacaatatatgacctcaatcatgagtctctgaccttgcatgagatggctagaggcggtgatcctggtgcagttgttgaaaagatgtcaatgctcctcaaaaggattaaggattttgtgcagacagaagaccctgagatgggcgctcgagcaagtacagcaaacattttcccaaaagacaactcagcacgtcctgttattcctgatgatttccgttgcccaatatcactggatttaatgagcgacccagttattgttgccactgggcagacttatgagcgggggtacatagagatgtggctggaggctggccatgatacctgtccgaagacacagcagaagcttgctaataaatccctgactccaaattatgtcctacgtagcctcataactcaatggtgtgaggcaaatggtattgaacctccaaaacgccctgctcaaacttaggatgcaccattgccatgtagtgctgctgaacatagcaatgttcttgagcttcttcagaaac

SEQ ID NO: 23149 - DNA, 521 bp, Sorghum bicolor
  unsure (1)..(521): unsure at all n locations
  Clone ID: 14593105
gcacgaggagcgcttgttgctcacaggctaccatatccatcgagatccttcgacatggtgcactgcgcggactgccttgttccatggactgctcatgctgattccagatgggctctatattctggaaattgaccgtcttctccaacctggtggctattgggttttctctaaaccacctgtcaagtggaaatctacatacaacatttctaatcaagggaccagagacatgcagaacaatcaattagctatggattatatgttgaataagcttcattggacgagggtctctgaagagggcacaatttctgtttggagaaagccttcttgtcatctccactgtaaccaagaagcaaatgcaaagctcttaggattgccaccactctgtacaggagaagacccagatagtgcctggtatgcaaatatttcaatgtgtatgacatgtattccaagagctganacttttaatggctgtgctggtggtgctatggaaaaatggcctanaagacttcatgcagtgccac

SEQ ID NO: 23150 - DNA, 572 bp, Sorghum bicolor
  Clone ID: 14593110
gcacgagggtctggtgcggggattcgtggacgtccttgtccttgccggcggtcgcacctcgtcgggcgccgcggctacttggagcgccgaagaggtcaagaaggccctccggtgggcgctcttcttcgaggagattttcaaggacctgcgtgactcgggccagtacgaggattctgcaagagagctcgatgcggcactcctcgagctcacctcgagccccgggttcccgaagggtcttgctgttgtgcgttcagaaatgctttccatggcaagggtgttggttgtgcgacattttctgaaagcaaaaacaaccatgaatgctcgtgttggtggacttcccactagttctgatgaactgcatgcagaatccacgggccattcacggattatagttaaagaatttcagaaaacgctggattcagcattgtgtgcttgtttggctgagagaggactggaaacactttttgacagtgtgaaaagaaatagcttggaaaatagtattaataagccatccatcccagcgattcaaaaacatcgcgaatgatcgacgagtttctaatgtggaagcaatg

SEQ ID NO: 23151 - DNA, 550 bp, Sorghum bicolor
  Clone ID: 14593149
gcacgagggctgcctgcgcttttgccagcgcgcgccccaccaccaccccgaaaagaaattcccccaattccgctccatcccgcgcgcatccggatccgctctgatcgagggtgtgggttgatttggactctgtgcctgccttcctgccctgccctgcctgtgacggcggcgtggaggaggaggaggaggagggcatggacgagttcgagctggaggacaacctcgagttcatcctccagagcatccaggagctcatggaggaccagggggacaacaacgccttcggcgacgccaaccagaacgagctcttcgccagcctcgtcagctacgaccaggagaacatgctgcccgacgtctctgccgcggacgtcgctgcggggaaggacatgcaggggatcccgtgggagaagatgctcttcgggagggataagtaccgggagatgaagatgaagaactacagaaattaccagaacctaagttacgcacgggaggatgctttgcaggagtgcaaacacgtggagaaggatagcccttactatgatttccacta

SEQ ID NO: 23152 - DNA, 414 bp, Sorghum bicolor
  Clone ID: 14593167
gcacgaggccaagctcgggggtttgcccggcggcgtcctcgtcgcgctatccttctgtgcctccgttgcgtatctcacgttctcgccggcgacgggcgagggccaagggggcgctacacttccgcaggcacgcgggcctactctgctacacagcgccgcctccaggcgcctcgctcgtccgtcctcgctgccgcctggcttggtccttctcaccgcggctgggcgcacacccctactccactactacttttttcgggggtgcatggactgtggagtgaagaccagggttggcctctacaactaaaagaccccgacgccgccgcctggacgcggaccatggctggccacctcgagcctcggcgggaaccctaggtcccgctctaggggtggacggcgaggaccggcgtcggcgtc

SEQ ID NO: 23153 - DNA, 139 bp, Sorghum bicolor
  Clone ID: 14593168
ccattggaaattcatatccaccgtgtggatatagcaaactttgaggcaaggatgcaagcaatgacaaagtctacctacactgccatcacacagtatgcaaagaacagtaaacctgccctggagtatgtaccaacaagga

SEQ ID NO: 23154 - DNA, 564 bp, Sorghum bicolor
  Clone ID: 14593175
gcacgaggctccgcctcgcgatcgaaccctcgccccctcttggctcctgctccccttcctccacctccgcctccgcgccctttcgtcctcccactcctcatctcgcgattgccaaattctagggtttcgcggcggccacccggatccagctcggcttggcgagagcctctaaagcttcggatcgcgagagggcgtgctctgctcattcgttgttcccccccctctccgccgccggcgccgccacgacgacgaggagctgctgtgcgcctgtgcctgtgttcggagcctacatcgtctctccgttggccacctgggtaccagctcatgatgtggaaatctcagctctaagtccgcttaggttgtgatttcgtgacagtgtgggtactgacataacattcactgtgcaagatgttttggcacgtgcctggactctccgctgcatcacctgtggatactattttggacaaggaaaattttaagttggaggatcttcttgatgaggatgaaataattcaggagtgcaaagcactgaatacccgcttaatcaattttctgcgggacagg

SEQ ID NO: 23155 - DNA, 456 bp, Sorghum bicolor
  Clone ID: 14593176
gcacgagggtggctgcaaatgagaaatactaagtttttatgtagtataggataggataggaggagtagatactgaggccggccggctgcggtgcggaagaagcaatgtttggtcgtccggaactgtatgcagaaaataaacagaccatatcaaagatgcagcttgcaacgcagtcatgactcgtgaataacttagccagtcctatatcaaacaacattcatgaatcaatgtaggaaaattatatatatgaaagtgaggccatattttacttctctgccagctctaataaaaattatttaaccagttttttatactaaggcatacatgcatatctttagtgatgttgactaaagttaaatttcatagcactagcaggcattcactcaacaatccagaagcactcaatatgcttgcacaggatactcacacaaacaacttttattagcttttttcttg

SEQ ID NO: 23156 - DNA, 437 bp, Sorghum bicolor
  Clone ID: 14593181
gcacgaggcaaaaccctagtccccaacccctcgctgggaagtctcctcggcggcggcggagatgggcaaggcgaaggggaagcagcgtcaggacaagttctaccacctcgccaaggagcaagggtaccggagtcgcgcggcgttcaagctgctccagctcgacgcgcggttccgcttcctcccgacggctcgctcggtgctcgacctctgtgccgcgccaggagggtgggtccaggtggccgtcaaccatgcccccgtgggagccttcgtcgtcggcgtcgacctcgtccccatccgccccatccgtggtgcccactcgctcaccgaggatatcaccaccaccaagtgccgcgccgcggtgcggaggcttatggactccaacggcgtctccgccttcgacgtcgtgctccacgacgggtcgcccaacgtcggtggtg

SEQ ID NO: 23157 - DNA, 428 bp, Sorghum bicolor
  Clone ID: 14593188
gcacgaggcctcctcgtcgtccggcgaggcagcagcgagatcgaccgtcctccgtccccgcgcgagattgtgaaaccacagaatttggatgctcctgcctatgcaagatgtcaaccaccagagatattgttcagtgttagggaagttgtgcagttttggatcataaattctacagaaacaagataattatggaccgcgcagacacatcagggtttgtcagtggtggttgctttggtactacactcctgctgatattcttccatttcgtctattctacagtccgtgtctgaaagattgtcaagaacccttaagctgcctgggcagaaatatcatcaggcccctgttctttgagctctctggtgttttatctcatcttcttttctgccattgctatagcgtctcgactgtgatggataacggcttcgtga

SEQ ID NO: 23158 - DNA, 603 bp, Sorghum bicolor
  unsure (1)..(603): unsure at all n locations
  Clone ID: 14593194
gcacgaggcggggctgaacctgctgcaccggtcgtgggcggacctcctgcccgacatcctctgcgccgtggccggccgcctcgcccgcgcggaggaccgcgccaggatgcgcgccgtctgtagcgcgtggctcgccgcggcgcgtctccaccggcagccaccgccgctgccccttcttgtgctccatgacttcaatgtctccagcttctgctccgacggggccatgacgggcatccgccgcatccctcttcccttggatggcgtggngggaaggagatgtccgctgcgtgggctccttcgagggatggctcgtcggagtgcagccctacgaaggtctttactctggtgacggcccgtgcttcttgatgaaagctttttcgcgagatgtcaatgtcatccatctcccacctccttcgccagagccagactccaactctgttgctgccttgtctaattctgctgatgcctacagcagatatttcgctttcgccttcgtcaatggctctaattctttcaatgcctacatcagatctctcaccaactctgctgatgcctacatcagatatctccctgtcatcaatggctctggtgagatgcagtgtg

SEQ ID NO: 23159 - DNA, 530 bp, Sorghum bicolor
  Clone ID: 14593203
gcacgagggaacgccccagatctcttgtagatttcgacacgcacgaaaaaagatttgggatgcgccaccggtcccaccccaacgcatccatcccctgccgcggctgctctcctctttcgtcttccccaccggcgcccgccgcgcccttctccccctcgcttcgccggtcgccaccacctccaggtttcctcacccatgttctaggtgctgggcactttttgcttcagaagatgtctcgggcgctgcacagtccctgctttatggctccgctgttgtgggtcgcgtcgctactggttgtcgtctcaccgggcgatgcgttctacttgcctggcagctacatgcacacatactcccaaggcgagttgatattcgccaaggtcaactctctcacgtccatcgagacggagatgcctttcaactactacagcctgccctactgccgtccccaggggggcatcaagaagagtgctgagaatctgggtgagcttctgatgggtgaccagattgacaactcgccctaccggttccgt

SEQ ID NO: 23160 - DNA, 548 bp, Sorghum bicolor
  Clone ID: 14593204
gcacgagggcaggtagaggtccaggattactggaaaaccttgttaatattttctacaagcatctgtctggagctaattcagatagtcagctgttgggtcgatcactgttttgtcttggactcctccttcggtatggttatcaattgatgctaacatctgagaatcagctagattttcccaagattatcaacttgctccagagaaaatatcttctcagggatgacttcagcttgaaggttcgagctttgcagactttggggtacatacttattgcgaagcctgaatttatgctacaaagggatatgttgaaactcatagagacagcactatcttctggggttgattatagattaaagattcaaggacttcaaaacctatatgagtatctcagagatgctgaaagccaacttactgctgagagtactgcgaaacctcctgtacagtgtgaaataaatggcggaagtgaagtgcctgttgctgctggtgctggagacaccaacatatgtggtggtattatccagttgtattggagttctattcttgatagg

SEQ ID NO: 23161 - DNA, 520 bp, Sorghum bicolor
  Clone ID: 14593206
gttttatgaattttggagagaggaaagatcctcctcacaaaggagaaaaggaggtcccagagggtgcccctgattgtttatctggtctgacatttgtcataagtggtacccttgacagtcttgaacgtgaggaagcagctgatctaattaagcgttatggtggccgtgtgactggctctattagtaaaaagacgagctacttactggctgacgaagaccttggtggagttaaatctaacaaagcaaaagatctgggtgtcccattcttgactgaagatggtttatttgatttgatccgaaaatcaaaacctgcaaaagctcctgtagacaaacaacaaagcaacaacagctttgaaaagcttcagaaatcacagacaaagagctctccagctaaagttgaaaaacgagccgaagcaagtgctgtgggcaaaagtattgcttcaaatagtaatgctgcaagtgcctccgctgacaaacaaaagcccaagaatgttgaccgtggttctatgcaatggacaga

SEQ ID NO: 23162 - DNA, 239 bp, Sorghum bicolor
  Clone ID: 14593213
gaggaagctgcgcaagagcctcacctacgccggcggcgagctctcctccgcgggccgggcccgcggggacgcctccgcatccacctccgtctcctcgttctgcgggcccgacgacgacgacgagcccttctgggaggaggaggagggcaccgtcgagctcgtccagcttggggccaaccgcgcctagaacgtcctcatcctcatgagcgacaccggtggcggacaccgcgcctccgccg

SEQ ID NO: 23163 - DNA, 476 bp, Sorghum bicolor
  Clone ID: 14593218
gcacgagggatgaaccaaggttcttgtctcaattctctagggatattcttcctgtcttgatcaaggcggtgaactctggtgccaattcatacatttgctatggctgtgcttcaatcgttaacaatatttgttacttcagtgaaccagaaatacttcaagagttgctcaaggaaacgaacataccgggcttcttggctggtttattgtctagaaaggatcatcatgtgctgacctcatcactaaagataattgagattctcatgcaaaagcttcctgatgcataccttggcttctttatcaaggaaggtgttgtcaatgcagttgaggcgcttcttaatcaagaggattgctcaaaatccactcatctgcctgatgacatgcaacaaccagagactcaacctgtcataagagataagactacatgttactgctatgcatttgatgcccgtagatctgaagctgctgaaaaaaggact

SEQ ID NO: 23164 - DNA, 574 bp, Sorghum bicolor
  Clone ID: 14593225
gcacgaggcgaagaaccagcttctggtattgatgatgacaagggcaaagtcagttttgcaattgctgggttgggtcaagaagggtcttcagatttaatctcggagaaggacgccttctacgttgaagggacacttcctactggcatcagtacatctccgccaatgaaaagtctggaggaaaatgccagcagcaatcaatatgggattactgacattagggaaggtttgaaaacggatgaaatcaagtcaagtgctgatcatgatcttggcactaagctacctgatgattcaaacactctgtttgatgtaccatcctttgagcattcttcggaaccccctatgccataccaaagcagtgacatggatataaaagtgagtggccatgctaattatccagaagagttgacattatattatctggatccccaaggaggtgtgcaaggtccatttctcggtgctgacataatttcctggtatgaagatggatactttggtttggagttacccgtacgtttgtctcaggctccagatgatgttcctttccgcccacttgttgaagtcatgccccaccttg

SEQ ID NO: 23165 - DNA, 518 bp, Sorghum bicolor
  Clone ID: 14593234
gcacgagggctttaatgggtacagctgaggtcttacgtcttatcccccccaaaaaaaacatttagttcaataatggaaatggttttgacctataaactactcaatctatttcaaattataagacatttgatttttttaccctaaatttgaccattcatcttatttaaaacatttatacaaaatatcatttttttatcgtggcttgatttattaataaaaattttttaacaataacttaaatttaactatgtttgtataatggatggagtactttggtaactttcgaccattattgtagcaccgccacaattgagtactgcttgttttttaggcaataaatagagtgtactgtcaaaaagtgacgtttctcaaacgtgacaataaactgcgtctactccatgtacttctaaactaaagctcatgtggaagaattgtacatgtgtactaaatcggccagcttgtcacgttcctcagctttgaattgaaaacacacgggcctagttacgttgtcgataagg

SEQ ID NO: 23166 - DNA, 431 bp, Sorghum bicolor
  Clone ID: 14593244
gcacgaggccagacagtatggtgttgtaggcattgcacctggtattggccgtgcttttgtgggtttcattgtacaacctttaagtggggctctggattttttttcactgacggttgatggaattagtgcgagttttatgagatgtgtcaacattttaagtaacaaatctgttccgcagaggataagagatcctcgcgctatccatcaagatgttatagtaagagactatgacaaagttgaagctgctggacagatggccctttacctggcagaagccagcagatattttgcatgcacagatttattccgggaaccttcgaagtacgcatggtctgattactatgaagaccattttattttaccaaaccataggattgctttagtcactaataagcgggtgatgctgcttcagtgcctggatctagataaaa

SEQ ID NO: 23167 - DNA, 522 bp, Sorghum bicolor
  Clone ID: 14593248
gcacgaggtataattgttcctatgatcgactatgaaaaagaaaaagaatggaaaaggaaggcacggacaacattgactgattggtgtatgagcttagagacgataatacaatggtctccttattccacagaagcagaactgattcaggagtttggctccataggggaacaaggaactcgaattattatatacaatctgtgggaggatgatgaaggagagctggagcttgattttgatgctgacgcaaatgatattcagattagaggtgttaacagagatcagaacaaaatccagaaggcaaatcagtttccaaactccagacacttctttacttatagacattctctaaggagttatgcatcaattttatatcttcgactcccggataacttcaaaatgattttacggggaaaaaagattgaacaccataatattatcaatgatctcatgctaaagaagcaacttaattataagccaacagtgtgcgatggacttccaaaggatatgcatatggcagctaag

SEQ ID NO: 23168 - DNA, 600 bp, Sorghum bicolor
  Clone ID: 14593250
gcacgaggcgcgcccagatagccgaggcgggcgcggcggcgtccgccagcgagcagcccggcgccacggctcgacgcgatccccgccgagctgagctcttccggcggctcgacgccgcctgcgaggcacgccgcctcgaacagtcgtctcccccgcatttcccccggtctcctcccccgcggcggccgccggagcttcccgaggacgacgaccagcccatctggccgccccgtagccgctactgggaacgctacaagtccttaaggaatatggagtccaaagcagaaaattctatgatcagccccattgagaactctgtatctccaccatctgtgaagagacagaaaacattatctgataaagatagtgaccaatgtgatgatgcatctcagcaagtagtcatctataagaatgacaaaagtgataggggaagagatgaacagagtggaagccatctcccaattgtaccagcaaaaccgtcaaagaagcaaaagcgtgcattgggaaagcaaattggagcctttgctgctcaatgtgctaaatgtcagaaatggagacttatttcaacaaaagagaagtacgaagaaattcgagagcaag

SEQ ID NO: 23169 - DNA, 577 bp, Sorghum bicolor
  Clone ID: 14593260
gcacgaggcctcatcctcgtcaactacggccgcgtcacctgcgggaacagcctgtttggaccggggttcacccgggacgccgacgccttctccagggtgtggcaggcggatgtcgatttccggaacaacgacctcagctacgacgccattactgcgggcgggaagaagattttcggcagcaaccagccgcccaactacttccccaccaagctgtacgagtcggcggtcaccacgggcggggacgccaccaatgagatcgagtacctcatgcccgtggacaccaggctgtcatacatggtctggctgcatttcgccgagatcgatgctgggatcgggtctgctggccagagggtgttcgacgttgtgctggctggggagaacgtcacgaggatcgacatcttcaagcaggtcggaggcttcacggcgttcaagtggacctacattgtgaagaatctgacaagctccacgctcagcgtcaagcttgtgccagtggtgggacggccgattctgtgcgggcttgagaattatgcaatggtgccacttgagactaggacgttgccgagccaagtggctgcaa

SEQ ID NO: 23170 - DNA, 513 bp, Sorghum bicolor
  Clone ID: 14593271
ctgttcaaggtaaaattaagtttgagaagagtgttgaggatgacgtctataaatatgaaattgaaaaggtgtgggtgcagttcaagggactacctgaagagcttagggaattccccattatttgggcaattgcttctatcctaggtgttccgagagcagtagacacaaagtttaccaaggcttttggtagagcaagaatgaaggtagcggtacttgaccccagtctcattccagtttttgtggatgtggtcatatggggatgatgtttttcagcttcactttggagtggagcaagggggacaagagggtgaaccagagacttttagatctggattctaccatggaagatgaggaccctcaaaatgaattggtaggaaaagaggttgatgatccaaagaataatgaaattggtgataaggctatggaaattgatggtaaaaatgaagaacaaccccctaagggttctgatgggggttctaaaaagaatgcaaattcaaaatctacggcaatatt

SEQ ID NO: 23171 - DNA, 507 bp, Sorghum bicolor
  Clone ID: 14593277
gcacgaggcttgtgtcagcacaggtccaagcaaatgttggctgcatatgctgctaatcgggcaaacaactggaaggagaaggatgctgcaatataccttgttattgctcttatgcagaagcctggtgccacaggtggcggcacacccgtggttgacatggagagcttctttacatctgtgattgtgcctgagctcagggcccctgattggcagtctgagccaatgttgaaggcaactgtgctcaggttcttgaaggagttcagggatcagatccccaaagccactgcactggcactcctaccaagtgtggtgaggtttctgacgcatgagtccaatgttgttcattcatatgctgcaacttgtatcgagaacctgttgatcatcaaggacgctgtcccggtaccagggttgaccacagtgaccaggtctccacgttatgttgctgctgatatcaatccatttgccccacagatcattcagaacctgtccacagcactaagtttccct

SEQ ID NO: 23172 - DNA, 393 bp, Sorghum bicolor
  Clone ID: 14593280
ctttagcctttagatgtcgtcagattcttgtgtctacagtacgttgccttagagtgaaaggcaattcagtgttgcagtgtcgttaacagcaagtttctggactctcttgttccaatgctgcacatacctcactgcaatgctaggaagtgccaaacagccttgttttctattccaaattccaagggaaactgctacattatcttgttataaataaactatgctgctacaacaccgacaatttcatgcctttttgctgccaagttcatggcagtttggttttgccttccagtgtacaccttcactgctgcatggctgatgcctttgtgtggacaatttctatttcttggtcatatatttgtgtgtttcctgagtgacagataacctttcacggtc

SEQ ID NO: 23173 - DNA, 634 bp, Sorghum bicolor
  Clone ID: 14593283
gcacgaggagattctcaggttacaacagcagttggatgccaaacagaagcttgaactggaaatacaatcactagaaagcaaaatgaaagttatgaagcatatgccaggtgaacaggattctgaatcaaagaagaagatggatgaactcgctgaggagctgaaggaaaagatggatgaaatggaagcaatggagtttctgaaccaaactctgattatcaaggaaaggaagagcaacgatgagttgcaacacgctcggaaggagctgatacatggctttaatgagcttgctgttgctggccgagcaaatataggtataaagagaatgggtgagcttgatctcaaagtatttggaattgcttgcaggaaaaggttaccaaaagaggatgcagcagtcacttctgctctcctttgttcaaagtgggaagaagaaattagaaacccaaactggtacccttttaaggttaaagtggtggatgggaaagaaatggaagttcttaaagaggacgatgcgatgctccaagagctgaaacaagagcacggtgaagaaatttatgggttggtaaccaaggcactgcttgagatcaacgagtacaatcccagtggccgctatcctgtaccagagctgtggaactac

SEQ ID NO: 23174 - DNA, 511 bp, Sorghum bicolor
  Clone ID: 14593295
gcacgaggcaacccaacaaaaaaaaaaaaacccctctctctcccattcccatctcgcctcccacctcctccgcctcgccgcggcaggcaccgccgccagtcacctccgcctcccccctcccttcctcgactcgatcgcgtgcgtcgcacgaggtgacctcgctcactcgtcaggagatcgaccccaaccgactcgagcgcgacgccatgaagtacgtgctggtgaccggcggagtggtgagcgggctcgggaagggcgtgacggccagcagcatcggcgtccttctcaagtcctgcggcttccgcgtcacctccatcaagatcgatccatacctcaacaccgatgccggaaccatgtctcccttcgagcacggcgaggtgtttgttttggacgacggtggtgaggtggacttggaccttggaaactacgaacgatttctggacatcaagttgactcgtgacaacaacataaccacggggaagatctatcagtctgtcattgacaaggaacg

SEQ ID NO: 23175 - DNA, 478 bp, Sorghum bicolor
  Clone ID: 14593307
gcacgaggtagaagccagatttcgccttttccattcccctgttcttgcttgtccttctccttgtcctctcctcctggaccgccgctagcttcttgggctttggatttcgatttcgatttcgatttcgatttcttcctgctcatcagtggcaagcaactgccaagtgaaaagctgcgaggattgaagcgagcacgacaagatctgttggtggttgttgcaggaagctttgctataggataggaaggaacggaagtcctgcttgtccttctcacaagtcaagtccaagccgagagaaatcttcgcccaaattctcgcttctccgctctcaattaggcaacgctgcgtgcatgggcgcaggaaaggcggcgccttgagctgctgcgtgagggggcgcgaatggatgcagagagcggccgcggcgccgcgagtgcgcgcaagaagtcgtggcggtcggagctggtgctggcgtaccgagcct

SEQ ID NO: 23176 - DNA, 520 bp, Sorghum bicolor
  unsure (1)..(520): unsure at all n locations
  Clone ID: 14593324
gcacgagggctacagctagtatagcgagcgccgccggtgccagccagtgcaacagaacccgcacaccacgcaccacaccacacgggcgggcgggcggagacgacagatcgatcggcgcctcgtcggtcccatggcgatcggcgggtcggatgccggcggcggaggcgcggcggcgggcaggaggagcgtgctggtgacgggcggcgccgggttcatcggcacgcacacggtgctgcgcctcctggagcagggctacggcgtcaccgtcgtcgacaacttccacaactccgtccccgaggcgctcgaccgcgtccgcctcatcgccgggcccgcgctctccgcccgcctcgacttcatccgcggggacctgaggagcaccgaggacttggagaaggtgttctctgccaggaggtacgacgccgtcatccacttcgccgggctgaaggccgtcggggagagcgtcgcgcacccggagatgtactacgagaacaacctcgtcggcaccatcaacctctacnag

SEQ ID NO: 23177 - DNA, 610 bp, Sorghum bicolor
  Clone ID: 14593326
gcacgagggccctccacaacaccgttctccattccatatcccccatatatcaagaactcgggctaccccccagatccaattccccagcatcagaagcaactgcatgtacttctgcacaggtagccacgagagaccaaaaactaagctgcgatgaagaagaccgtcgtcctgtaccccggcctcgccgtcagccacttcgtccccatgctgcagctcgccgacgtccttctggaggagggctacgccgtcgtggtcccgttcatcgaccccactgagaaaggagatatcgccttggccgccgtcatcgaccgtgtcgccgcctccaagccgtccgtggtcttccacgtgttgccaaggaccgaggactctccatgcacctttgtccacgactcggagttcatcgtcaggtacttggaaatcgtgggccgctacagccagcacctccacgacttcctcctctccatgcctcctggcagcgtccacgccctgatcgtcgacatgctgtctatcgaggtgctcgacgtcaccaccaagctcggcatcccggcttacgccttcttccccccgaatgcctccgcccttgccgtgtccgtccaggctgcatcacttc

SEQ ID NO: 23178 - DNA, 150 bp, Sorghum bicolor
  Clone ID: 14593341
gcacgaggctcagactcggtccctcagcgcagatcttctgctctcggtcccaggaatcggagcggctccccctcggcggcgtccagagacggaggggcagtcccaagctcggcggcggcggtggcggctcctcctcccgcctctcgccag

SEQ ID NO: 23179 - DNA, 214 bp, Sorghum bicolor
  Clone ID: 14593353
gcacgagggtgctgtgcagtagtacgagcctcttcccagttctcacacttccgctctctctctctctctctctctctctctctcctctcgagaatggttgtgtaggcggcgggcgcaggagggaggagagagagagaggggagctacggttttgcgccgtcgtctactaccaccctcaggctctgaacccctccggtccggtttgcggaggatt

SEQ ID NO: 23180 - DNA, 650 bp, Sorghum bicolor
  unsure (1)..(650): unsure at all n locations
  Clone ID: 14593356
gcacgaggctcggccgggtcgttggacgagccgcactaccagcatgggtttaggcccatggatccagttgcttttgcgagggaaagaaatatgccttctgattcggataggaccgtaaatgaagacaagcgtttcatgtcttgtagtatgccacgggagcatcagaagttctttgaggttcctgtgtctagtgttagagaacttcatttgcaaagtgatgaaccttcaactagtgaagccaatcattcacgtggaagaatgacatctgatgatctctttgctccaagaacaaggagtctctctcctgtcccaaaaggccatgtcttcgctgtgagcaatggaaattctagagaatttggttttagcccgaggtcaccagtaagaaagatgngatgggttgaggagcccaccacatcccttacctcttcctccagcttctgctacttgctctcctcttcttccagcttctgctgcttgctcacctcttcacccagcttctggtgcatgctcacctctccatccagcttctggtgcttgctcacctcttcctccaatccacagtccatgctcgcctcttccttcatctcccagttcctgcccacctcttcctgcatctcctactacctcctcacagtcccagtcgcaatgga

SEQ ID NO: 23181 - DNA, 592 bp, Sorghum bicolor
  Clone ID: 14593361
gcacgagggtcgcgcttccccttccccatctcgccgccgtttcttgggtccgggacacgctcctctagctgtccgcgtatggcctccgacggcgccgccagagtccgccctcccaagctccccgtttgggaaggcctggacccatccaacgtcctcacctacaagagacgccgccgcggcaccggcgccaacgcaggccacatcgccgtcacgccgagccccgaccctgtcaagaataagatgagcgcggtggtgcacgccatcaattcccagcaaggtgggcgccaaatgctagacaggcactggagaagctggagggacacgctggagggcgtcctgcaatccactcctgggaaccagagcgccggagggattcagagctgcatccgagatgcgctcagatataatggttgccatcccaaagaacatgggaacttagctgatggccgaggagcaggcggagaggaccctgttggagctgtacattctgaagagaataatgctgcctttcagttagaagatggaacggctgcatctttggaagccacaaggcagtgtgccataaagctctttttgacattctaatctccga

SEQ ID NO: 23182 - DNA, 475 bp, Sorghum bicolor
  Clone ID: 14593378
gcacgaggatgctcatgcctccatgccccttaaattttaggatgaagccttcatcaccgctacttatctcataaaccgcctcccagcaaagtcatccatggccaaacccctctagagcgactgtttcatcaaaacgccagactactcgactctccgtacctctggttgtgcatgttggcctaacctccggccctacaattcccgcaagcttcaattccattccaaacaatgcgtgtttttaggctatagcaagatgcacaaaggattcaagtgtcggtatgtcgctgaaggtcgcgtttatatctctcgtgacgtgtttgatgagaacgtttaaccctttgctcaacttcatcctaatgccggagcccgtctcagatctgaaatacttctccttccactcactttgcttaatcattcctccaactttgggaacgacaattcttttgatctatttggtaatggttccctgaaaatc

SEQ ID NO: 23183 - DNA, 226 bp, Sorghum bicolor
  Clone ID: 14593394
gcacgaggagaggtttgatggtattgataggaatgaccgatatgcaaacaggaacactgtgtttttcgatattaacttgagaggtcttgatggcattcaagggccagtttatgtgggaactggttgtgtgtttaacagaacagccctatatggttacgagcctccagtgaagaagaaaaaaccaagcttcttctcttcgctttgtgggggaaggaaaaagacgtcg

SEQ ID NO: 23184 - DNA, 557 bp, Sorghum bicolor
  Clone ID: 14593397
gcacgagggtcatctcaagatgactttgctgttctgatccatctgaaagccccatatgctaacccagagcaggtcacaggcagatcggtcagtgcaacctcagttggttatcctacatcccgtgcccctgttgatcttgttaccgtgcttgatgttagtggaagtatggcaggcactaaactggcactcttgaagcgagccatgggttttgttatacagcatcttggtccatcggatcgcctttcagtcattgctttctcgtctactgccagaaggctgttccatctccgacgaatgtcgcactctggccggcagcaggccctgcaggctgtcaactcacttggtgctagtggtggcacaaacattgctgatgcactgaagaaagctgctaaggttattgaggatcgaagccatcaaaatccagtatgcagcatcattctcttgtctgatggccaagatacatacaatattccctcaaatattacgggtgcccggccagattatagttcactagttccatcctcgattctaaatcacacatttcgcttagtgcctgt

SEQ ID NO: 23185 - DNA, 214 bp, Sorghum bicolor
  Clone ID: 14593398
gcacgagggtcgagctccaggcgctcgcggagctcgagcagtccacgcggaagctgcccaccgacgaggcccgccgcgcgctccagcagtgcgcgcggtggcgccgccacgacgtgcgcaggctcagggaatcgtcgctgtggaactggacctacgacagggccgtgctcctgctcgcgcgcgccgtctgcgccatctaccaccggatccgcct

SEQ ID NO: 23186 - DNA, 471 bp, Sorghum bicolor
  Clone ID: 14593426
gcacgaggggagctcaggccgatgccgcctttgccccggcagttccagcagacgcggatgaactttccgtcatgttcaaaatccgttcctgacaccggaacaggaggtaagcgaggatcagagggtgctcctcctccgcggccgccgcctcctcctccaccgccgcctccaatgccaccggtgaaagacaagggcggcgccacagcagcagcatctgctcctccggcgccgccgccacctctgccccgagccggtaacggcagcggctggttgccccggcggcactccgagcgccaagcgaccacggtcatcagggcctcggcgagcgcagttcacccagaagagtctccagggcgcgcgccgtcagagaaacaaacggactcggacgcggacgcggctgctctgccgaagctgaagccgttgcactgggataaggtgcgcgcgagctctggccgaccgacggtgtgggat

SEQ ID NO: 23187 - DNA, 529 bp, Sorghum bicolor
  Clone ID: 14593427
gcacgaggcaatgccggagccccagtcctctgtggcctcaagcggaagcgtagatcgcctccggaatgccttcggcggagtgctgtgcaccttcaccctccttctcatcggcgtcctcgccttctccatccgactattctctgtgatcaagtacgaaagcgtcatccacgagttcgatccctacttcaattaccgcgtcacccagttcttgtcaaagaatggcatatatgaattctggaactggtttgatgaccgaacatggtatcctcttgggcgtgttattggcggcactgtttatcctggtttgacacttactgctggtacaatatggtggctgctgaattccctgaacatcccattgtcagtggagactgtctgtgtcttcactgctccaattttctcagtcaatgcgtcctgggcaacttacctattaaccaaggaaacaaaggaccctggggctggtttgatggcagcaactattctagcaatggtcccatcatacatctcaagatctgttgctggcagctac

SEQ ID NO: 23188 - DNA, 616 bp, Sorghum bicolor
  Clone ID: 14593438
gcacgagggtcaacaagtccaagacagcactgctgccgtcgtatctgcaaccatatgctcatgtttacggaggagggggaggcagcaacaacatgcgggcaacaatgaagtcttttcagacagctggtgctggtggtgccagcttgatgagcttcgtcccggcggccgatcatggcatccagcaagggattcctacttacagtgtgtacgccgggtactctccctatatctcggactacggctacccgctgagctactatcagccctacgctggtctgcagcagggagcccagctacagcagtacgccatcttgggcggcggaggagcaacagcgacggcgccggcggggctaacaatggcgccggaggcggccaacccctccgcactgtacccttacttccagtacgctccggcggcggccatggccgctggtgggtacggcatggtgcagtacccccagttgtaccagtacgctgctgcggctgcggtgggtggcacgacggcggcgaccaccctggccgccgttgccggcggcctccagcagtacggcggcgcggtggcgtttactcctaattccattgcccaagcaggcatgacaatgtctctgacgtctcc

SEQ ID NO: 23189 - DNA, 519 bp, Sorghum bicolor
  Clone ID: 14593439
gcacgagggtgcgcctcatgtgcagcttcggcggccgcatcctgccgcgtccgggggaccgccagctgcgctacgtcggcggggagacccgcatcgtgtccttcccgcgcgccgcggcctccttcgccgccctcgtcgccgcgctcgccaaggccgcgcccgcgctcttcgcccccggggcgcccaggccgtcgctcaagtaccagctgccccaggacgacctcgactcgctcatctccgtcacctccgacgacgacgtcgaccacctcatggacgagctcgaccgcatccacgacctctccgccaacgtcgccaggccgccacgcctccgcgtcttcctcttcgcgcccgcgcccgacgccgccttcggctccgtcctctccggcaccgctggcgaggccgccgcctccaccgaccagtggttcgtcgacgcgctcaacgcccccgcgccgccccccatcgagcgcggtcgatccgaggcctcctcgatcatctccgagggtcccgactacctcttcg

SEQ ID NO: 23190 - DNA, 499 bp, Sorghum bicolor
  Clone ID: 14593440
gcacgagggttctgctttcactgttgggtctggcagtggaaacaaaaattggggtgtgattcttggtgctgcccttggaggtgttggtctgtttataattgttgttgttcttgtgcttctttgccggaggaaaaagactctggaaaagcagcattcaaagacctggatgcctttctcaatcaatgggctcacctctctcagcacaggaagcagaacatcttatggtactactctcacatcagggctgaatggaagttacggataccgctttgccttcagtgtgctccaagaagcaacaaacaattttgatgagaactgggtcattggagttggaggctttggaaaggtctacaagggagtgatgagggatgagaccaaggttgcagtgaagcgtggaaacccaaagtctcagcaaggtctcaatgagttccgtacagagattgagctcctctcacgtctgcggcaccgccatttggtgtctctgattgggtactgtgac

SEQ ID NO: 23191 - DNA, 632 bp, Sorghum bicolor
  unsure (1)..(632): unsure at all n locations
  Clone ID: 14593452
gcacgagggggcggttctgcaacggccgcctcccgccggacttcatctccgaggcgctcggcctgccgccgctggtcccggcctacctcgaccccgcctacggcatccaggacttcgcccaaggcgtctgcttcgcctccgccggcaccggcctcgacaacaagaccgccggcgtcctgtcagtgatcccgctgtggaaggaggtggagtacttcaaggagtacaagcgccgtctccggcgccacgtcgggcgcgccacggcgcggcgcatcgtctccgacgcgctgtacgtggtgagcatcggcaccaacgacttcctggagaactacttcctgctggtgacggggcggttcgcggagttcacggtgggcgagttcgaggacttcctggtggcgcaggcggagtggttcctgggccagatccacgcgctgggcgcgcgccgggtcaccttcgcggggctcagccccatcggctgcctgccgctggagcgcaccctcaacgcgctccgcggcggatgcgtcgaggagtacaaccaggtggcccgcgactacnacgccnaggtgctcgacatgctccgccgcgtcatggcggcgcgaccggggctcaaggtcgcctacatcgacgtctacaag

SEQ ID NO: 23192 - DNA, 575 bp, Sorghum bicolor
  Clone ID: 14593464
gcacgaggggttgccgtggatttcattcaagtttccgcggcacacagagtggactttccctgaacgttgatgtctcaacaacaatgatcgtgaagcctggccctgttattgattttcttctttctaaccagaatgttaatgatcctagcagaattgattggcaaaaggccaagcgtgctctcaagggcttgaggattagaaccactcctgcaaatgcagaattcaagatttttggtctcagcgagaggatttgtaaagaacaaacgtttccgctgaggcagagaaatggtagcaacggagattgtgataccattgatataactgtctatgactactatgcgaagaaaggaattgatctaaagtactctggtgatttgccttgtataaatacagggagggcaaagcgtccaacatattttccaatcgagctatgctgccttgttccgcttcaaagatacaccaaagctttgtctacgctacaaaggtcatcccttgttgagaagtctagacagaagcctcaagaaaggatgacagttctaaacgatgcactgcaacgcagtaactatgattctgac

SEQ ID NO: 23193 - DNA, 547 bp, Sorghum bicolor
  Clone ID: 14593466
gcacgaggcagaatgctttcgttgccatgcctgtagtcaaccgatatatgactatgagttctccatgtccgggaatcatccataccataaaacttgctacaaggagcagtttcacccaaaatgtgatgtctgcaagcaatttattcctacaaatatgaatggccttattgaatatagggcacatcctttctggctacaaaaatactgtccttcacatgaagttgatggcactccgagatgttgtagttgtgaaagaatggagccaagggaatcaagatatgtattactggatgatggtcgtaagctctgcctggagtgccttgattctgcagtgatggatacaaacgagtgtcagcctttgtatcttgaaattcaggaattttacgaaggactgaatatgaaagtggaacagcaggttcctctgcttctggtagagagacaagctttgaatgaagccatggaaggagagaaggctggtcaccaccatcttccagaaacaagaggactgtgcttatcagaagaacagactgttagcacgatactgagg

SEQ ID NO: 23194 - DNA, 105 bp, Sorghum bicolor
  Clone ID: 14593469
gcacgaggccggctgttcgtcgagtccgcctccggcatgggcggctgccgggacgccgagccggagctctgcgcgcctcgcccgcacagggtccaggtccaccca

SEQ ID NO: 23195 - DNA, 475 bp, Sorghum bicolor
  Clone ID: 14593473
gcacgaggcaccatcaccgtccaggtcaagttcgccgggcggaccatccccgtggaggtcccggccgcggcttccggcgcggagctgaagcgcctcctccagccgctcaccaacgtcctcccgcgcggccagaagctcatctgcaaaggcaaagtgctcgaggatgccgcaagcctgagctcgatgcaagtagtggacggatccaaggtcatgctcatcgcgtcgcaggggcttcatcagggggatggtcctatcacaaagaatagcaatagctcagcaacaactgtaagaaggccttcaaatgctaaggagaatcaagcacaaaaaccagaggcagttgtcaccaaaagtcgatctgagcgctggaagttaacaggtgttgttgcgctacatgattgtgacttgaaggtagtgcctgaagaagtctgggattgtggcccctcgatacgaatactagacatcaacaacaacagta

SEQ ID NO: 23196 - DNA, 389 bp, Sorghum bicolor
  Clone ID: 14593476
tggaatatttagtttctggagatgccaattggccgttgagaccatcggagctttctgatcttccgtgttggagagagtgcatcgctggagttaggattttcgcaactgttccccccctcatgactcagggacttgtttgtttttagacgaatcataggaagtaggaatagcagggcacggcagttctaaagatgacgtgatgaagcaagcagcagtgaatgaacgaaggcacgacagcttttatttgtgtatacgtacgtgttcctggatgcatttatatagatagatatccatgttgcatcacaggcagcttgttgcacagtgcagacctgtgtcactgtgtgcagtgcaccaatgatccaatgcatgtatgtatgcgactatgtgcg

SEQ ID NO: 23197 - DNA, 457 bp, Sorghum bicolor
  Clone ID: 14593482
cgcgcggcagcagcagcttttcaatcggtcgccgccgccttcgaccaccaaacgatgccaacgcccggcggcaccgtcgacggcgagagcatcttggccgcgctcccgacacccagctgttggtctcgtctgctgtcctagcctggcggcactgcaggtcaccaccgcctccacgaccacgaacgccgctcgttcctcagactctgagggcatctgcttcaagaacatcatcctggacacgaaattgccaagggagggcaagtttttcgagttggagatgacggtccgtgactgcgacctcgacgtgtacggggtcgtgaacaatgctgtctatgctggttacatcgaaacagctcgtcaagagatggctgcgagcctcggcgtctgcacgggctcgatcgtacgcacaggccgtgccatggcgctctccgagttgaacgtcaagtacttcgcgcca

SEQ ID NO: 23198 - DNA, 398 bp, Sorghum bicolor
  Clone ID: 14593496
gcacgaggacaggacaggacactcccatagtcccattgccttcgccccgctcgccgctcccccactccgctacactcatcagcgctgcggaagtgcggcggtgctcctctcctcggccggacgcccgcgatggcgggagtggcggcgcaggcgcagcgcgccgtcggcggcgtccccgcaggtggcggcgagcaggcggcggcaatgcgggcgcgcggcgaggtggacacgtcgtcgccgttccagtccgtgcgccaggccgtcgacctgttcggcggcggggctgccgccgtctcccagtggcgccacccgccgcccgtagtccacctccgcccagaggaagaagaacttatgaaagttgaggaacaaacagtgaagctggagatggaactttttgt

SEQ ID NO: 23199 - DNA, 606 bp, Sorghum bicolor
  Clone ID: 14593499
gcacgagggcatgataaaagtcttcatgtctatcgtggaaactttgatgattttgagagtgggtatgagcagaagaggaaggagatgaacaagaagtttgtgatgtatgaaaagcagatgaaagcagccaggaagtctgggagcaaggccgcgcaggataaggttaagggccaggcgctgtcaaaggctgctaaagaggccgccaagaacaaggggaaggggaagagtgctgcagatgacgacgatgaccagaaacaggtggctgtgccacagaagtggcgtgactacagtgttgaattccatttcccagagcctacagagctcacaccacctctccttcagctcattgaggtagggttcagttaccctggtaggccagacttcaagctctcaggtgttgatgttggcattgatatgggaacacgtgtagctattgttgggccgaatggagctggaaagtctactctgcttaatttacttgctggtgatcttaccccaactgaaggggaggtaaggaggagccagaagctgagaattggacgatactcacagcattttgttgacttattgacaatggaggaagatccagttcaatatttgttgagg

SEQ ID NO: 23200 - DNA, 596 bp, Sorghum bicolor
  Clone ID: 14593512
gcacgagggtctggctctgttgccatgttcttcctgctaccgtggaaggacctcgaactgctgtatttctgcagctgagatccattcagttgcccaaatggccctgtagtccagttaaaatgggctatgtattctgacttattggttaagcaaaggctgacttccagtttagtgtgtactttctttgaaaacacttcatagttggattaatgaaattggattcatctgtttcttggcaaatgtatcattcaatttatgttgtcaaagacttctcgttgtgacaaacgtgaatgcctttttctctaattgcagacacaataatcctagtaaagatagaaaggcaattgaacacttggaggaacattgcgtttctggtaactgaggtttgtgcttgtttgtagatggagagattaagcaccaaccagctctacaaatctggagttcctgtaaccataccaacatctctgccttctataccagcttctctggatgagagcttcccgaggcttccagatacacagagtgttttgatggagagagaattgaggagcactccactaccaactcaccagaccactgttgctcctatccgaggt

SEQ ID NO: 23201 - DNA, 444 bp, Sorghum bicolor
  Clone ID: 14593514
gcacgaggggcgagtgaaaacttattggattgatggaaagagtgcaacaggtatccacccaacatctgagaacatcacatttgtccggtgtaagtcagaaaatggcattattacatttgaatttactcgccctcttaacccttcttgtaccgggaaggtagaatgcaagaacatcattgatccaactacaccccttaaggttgtctgggccatgggtgcaagctggtcgggagatgatctgacagacagtaacatgcattcagtcacaagcagtcggccaatacgtgttctgttgttgagaggttcagctgaggcagaacaggatttgcgtcctgtcctggctgttcatgggtttatgatgtttgttgcctggggtatcttgcttcctggtggaacaatggctgcccggtatttgaagagcttgaaaggagatgggtggttcca

SEQ ID NO: 23202 - DNA, 181 bp, Sorghum bicolor
  Clone ID: 14593522
gcacgaggcagctatccaagggtgtcggtgtacaactgggtgtcggccacgggcagctagagctgtgagcgagggagggtaggtgtttaggagatggacaccatcgaggagtgcggcgatggaggccgccacctgctgggcggcctcggcaacaggatcctcgtcagcgtgccggacaact

SEQ ID NO: 23203 - DNA, 180 bp, Sorghum bicolor
  Clone ID: 14593526
acggtaacgttccccaaaccttatctgctccccttgcgttgttgacttgctgttgttggaggtcatccgctctctctcctcgtcctcggattcgtgtgcttgagctccggttccgctgggtagcaatagcggccaggaaacactacttctttctcccttcgcacctttgtgatgcgctga

SEQ ID NO: 23204 - DNA, 513 bp, Sorghum bicolor
  Clone ID: 14593536
gcacgaggatgtaatggagatcatacggttttctataagcataggggagcgtttatcaccattatggcggtttatgtggatgatattgtgattacaggagatgatgtgggggaaatcaaatgtttgaaggagaatttgggaaaggccttcgaggtaaaggatcttggaccacttaggtatttccttgggattgaaattgctaggtcacctaaggggatagttctctctcagagaaaatatgtccttgatttattgacagaaactgggatgctaggatgttgaccgtgcagtacccctattgataaaaatcatcaaattagtgtcgagtctggagatcctgttaacaaagaaacatatcaaaggctggttggaagattgatatacctatgccatacaagaccagatatttcttatgcagtgagtgtggtaagcagatatatgcatgatcctagaacaggacatattgaattggtctacaggatattgaggtacctaaaagggacacctggaaga

SEQ ID NO: 23205 - DNA, 598 bp, Sorghum bicolor
  Clone ID: 14593539
gcacgagggtgtgataagccgccgccgccgctggcctgctgccacgggcgcccgagtgcgaggagacattcactcagcagcagcagcagcagcagcagaggtgaccgatctctgcgtgcgggggggagaagacagcagaggagggagcgcgaggtcaggatgggcgccgggatcaggatcctggcggcgttcttggcggtgctcgcggccgcggccgccggcggtgtgacggcgcagctgcggcaggactactacgcggcggtgtgcccggacctggagagcatcgtgcgcgacgcggtgtccaagaaggtgcaggcgcagcccgtcgccgtcggcgccaccatccgcctcttcttccacgattgcttcgtcgagggctgcgacgcgtctgtgatcctggtgtcgacggggaacaacacggcggagaaggaccacccgagcaacctctccctggccggcgacggcttcgacaccgtcatccaggccaaggcggccgtcgacgccgtgccggcgtgcaccaaccaggtgtcgtgcgccgacatcctggccctggccacccgggacgtcattgccctggctggcgggccgtcgtacgcgg

SEQ ID NO: 23206 - DNA, 532 bp, Sorghum bicolor
  unsure (1)..(532): unsure at all n locations
  Clone ID: 14593540
gcacgaggcagcgattagattatgcactcgaatcatctgcttcattgcctagcacgcgagaatctatccaagacgagcaggttgaaattactgaagattcagcttctactattgcttctataatttctaggaaagatgctgcaacccagaccagcccagagctaagtaggtcctcttcgcccaacactagaccaacatttaatcgttccctgtcgacagaacaagtgaaagagagcgggagctgtttctcagatcttgatatcagggatgttcagatggatgaccgagtgactttgactaggtggtcaaagaaaaatgtaacacggtcgtctaacaagaattcaacaaacataatagaatggaaggaaaagacagtggagtcaaattcttcatcctggggctttgcggaagcgaagtgcatatctnagtaagatatcagatcactacatattcaattattttgctgcttgaagcctaatttcctaatatttgctgtcttatgcgtcatgaaacctcctgtcatgcttatntg

SEQ ID NO: 23207 - DNA, 491 bp, Sorghum bicolor
  unsure (1)..(491): unsure at all n locations
  Clone ID: 14593548
gcacgaggggaaaaacaaggtctttgtggcaggagatgacttgtggtacaacaagattattgacccgtcaagtgacttcatcttgatatggatatacgtcttccgtgtctcatgcttcattgctctgttcatggaccctctgtatttctatgtgcctgaaatcgattacaagcaaaccaatcattgtgtcaggaaggatacacgcctagccatcatcgttactgtattccgatcaattgtcgacctcttttatgtcatccagatgataattaagttcaggactgcataccttaatccaagctcaaacttaggggtctttggtcgaggagatctcatcacagatcctaaggaaatcgcaaagcagtacttgagatctgactttgcagttgatttggtggcttctttgcctttaccacagatcattgtttggtctgtgataccagctatcanatattcttcgtctgagcatggcaatgacatgctgcttctgg

SEQ ID NO: 23208 - DNA, 519 bp, Sorghum bicolor
  Clone ID: 14593551
gcacgagggttccatcaatgccacccgctctgccggctccttcagtgacaaccataccacaggaatcctattaccctccatcagctcagccgactgaggccacccaccagcagtaccaggctccaccagctccgcagcagcctcaggcgccacagccagcaccaccgcagcattaccaaaccttgcctcagtatgctcaatattctcaacctcccccatctgcaagtgtcaaccccacagctgcgcttccaccaccagtgccccagcagcctgaagaaccagcaccttatggcccaccttctcagggctatccaccaaatgtccgcgcaccacccccttatatgccacccccaagtggacctgccgctccattctatggaccgaaccctggcatgtttgatgtgtcagctgccaggcctaattctgggccaccgctgccctacaatgctggatacaaaccaccggctgcaggtggtttctccgaatcatatggttacgccggatctccatcccaccatg

SEQ ID NO: 23209 - DNA, 541 bp, Sorghum bicolor
  Clone ID: 14593554
gcacgaggcccagtcccactcccttcctcgcgaagcttttcttcttcctccctctcaccgtctgacgacacgatcgaggtgattcaggagagaggcgcgcggcagcacgggagatcgcgcggggcgagagccatggcggcgccgttcgtgtacctcccctccaccttcaacggcaacagtcccgacgctcttctcaaggctgcgctggacggcaacctcggccgcatcaaaggtatcataaggaaccttggcataggaaatggtgatcgagcagcagtgttgtcttttcacaaggatggctttggggtgctgcactgtgcagcatgccagggccatctggaggtttgcaagtacttggttgaggaactagggtgtgatccaaatatggctgaaggctcatgtgaaggtgcaacaccatttatggcctctgcacagtcaggtgatatatccactgtgaagtatctacttgatcatggtggtgatctaatgaaagcagatgcaaaaggacgcacagttctacaccatgctgtatgtgcaggaa

SEQ ID NO: 23210 - DNA, 468 bp, Sorghum bicolor
  Clone ID: 14593559
gcacgaggataaagctcagatctctcgccactgttcaacgccccaatcctccctctcagtccaccctttggtgcttcccaactcccaagcccctttggtgctcaccaagattcatcttcttccaccgttgtatccccaaatctcctccgcagggaatatattttgttgttttgatttccaacgcccctttctacagcaagcaattttgtgttttttagtcgtagattgggcgcgaatttccttccattcgtcggagattcaggcattcggattttattcttcgcgcaatttgttcctgtatccggtcttgccaagaattttccaccccctcttggcttcctgatccatctttgatgcgccaagaggcgagatgaacacgaattactcggcgctcccattgacctccccctccatcgagctccaggccaaatctaacgcctccgccaatgccaacgtcaacggccacgc

SEQ ID NO: 23211 - DNA, 492 bp, Sorghum bicolor
  Clone ID: 14593566
gcacgaggccctctcgacattagggtgcgctccgttgcacacgtcccggcaggcggacggcggcgcggcgacgcctcggcatggcgacccaagacgcgcggctgcccctagcccgacctcccaacggcgtggcaacctcaacacgggcggcgccgtggcggcgctgtctctacttggcttccatcctatttgtctcacagcctgctggagctgctccggtgaacccactactggatctggtacctccgtggacggatcagttgatatgcccaccacatccagaggtggtgccggtgaggctgtcgccacctcatccaggtcagttgtcacaccatcatcctcctcgttcttctctacatcatcttcctgttgaacaaattactgtgctttggtgatgtggttttcttgtttgatgtaacgacggaagattagccggcaacgatggcctcatggtctgcagtggaagggcatgccataataactacaaccagc

SEQ ID NO: 23212 - DNA, 397 bp, Sorghum bicolor
  Clone ID: 14593571
gcacgaggatcaaaaagtatggatctctattgagaaagatactagacctactacctcatcagctgcatcacgagggctttcaccaagaaggcgactttcctcagatggtgtcaatgtgattccaaagagcatggatcttgttgaaaacaataacaaacttgtcaccatgtcagctgcagcacgaggggtttcaccaagaagacggctcgcctcagatggtgtccatgtgatatcaaagagtattgattttgatgaaaacagcaacaaacccttagccatgtcagctgcagcacgaggggcttcaccaagaagacggctctcctctgatggtatggaatctatatcaaagagcacaaacattactgaaaaaagtatcagaccttcaacatcgtcgatg

SEQ ID NO: 23213 - DNA, 490 bp, Sorghum bicolor
  Clone ID: 14593576
gcacgaggggcggcggggggaaagcccgcgccaggcgtccgagagatggggagccggcgcgcgctcacggagatcaagaacctcgtcggggttgccccgtacccctgcgccgtcgccaagaagcccacgctgcagaagagcagaagggacgaaaagaagacaacgttgctgccaagcagccggcccatgacaaggaaattcgccgcctccttggcgagcaaagggcaacctgaatgtcagccgatcctaactgaatgtcagccgatcctaactgatccagaacccggagttgatcaacagaaggaatcaatcggtgatggcaccgttgatatcgacgtggaaatccacgagctggtcgacgatagtgatagtgacatcgacatgggagagacagagaacaaggagatgaaccaagatgaaccgctcatggatattgacagagcagactcggggaacccgcttgcagcaacagaatatgttgaagagcttt

SEQ ID NO: 23214 - DNA, 485 bp, Sorghum bicolor
  Clone ID: 14593586
gcacgaggcttaggcgtagtgcacgtttgtcaaagcagccagaaaatcctatcaacaatgagcctgctcagcaaccagctgcttcgaatcaatgtaattcggatttagatctaaacattgataaaatcatttccaatctgtgtcgcagtccatcgcctcagcttcaaatgcctcgagcaagctcaaaccagtcaggcagagttgatgcagccactggaccacctgtgtcaaatcatactgcacctcaagataggcaactcccactcagctacagtcaattgtaccctccagaggtccccggtgaacactggcttgatagaagtggtgacgagcagccacattcaccagatgcccgatttcatgatgtgcatatgcaagggcaatggcaacaggtgcgagaaccttcagctcattccactgacttgggcgcacttatctgtgttccgacctgtgggtattggttgaagccatggctaagatacacc

SEQ ID NO: 23215 - DNA, 450 bp, Sorghum bicolor
  Clone ID: 14593589
ccagaacaagcgcacgcaaatgaagaaccagcacgagcggcatgagaactcgcagctgagggcggagaacgagaagctgcgcgccgagaacatgaggtacaaggaggccctcagcagcgcgtcctgccccaactgcggcgggccggcggcgctcggcgagatgtccttcgacgagcaccacctccgcgtcgagaacgcgcggctccgggaggagatcgacaggatctccgccatcgccgccaagtacgtgggcaagcccatggtgtccttccccgtgctgtccagcccgctcgccggggcacgcccgtcgccgctggacatcggtggcggcgtggggggtgccgctgcgtatggcgctgtcgacatgttcggcggcggtgtcgctgtggacctgctgaggggtgccgtgccgcagtcggatgccgacaagcctatgatcgtggagctggc

SEQ ID NO: 23216 - DNA, 591 bp, Sorghum bicolor
  Clone ID: 14593591
gcacgaggagaacatctcctgaagcaacaaaagccttagaattgatctccaatgcattgcacatatgtccacattcagacagcctcaaggagatgaaagcagatgcattgctgatgctacgaagatttgaagaagtgattcaactatgtcaggagtctgtaaatccgactgaaagaaattcagttttattcaaagacaacggagaaccaaagaattccagagtctctgaacagacacagttctctggaaggtattggcggccctacctcatttgcaagtcttattttctttcaggcaagcttgatgaggctcttgaattgttaaagaaacatgagcaagtcacacctgtcaaagaaagtgaagtgagcacatatcaagaaaaattctcatcattatcagcgactgtaagagaactactttcccttaaggctgctggaaatgaatcatttcaagctggtagatattcagatgctgtcaaacagtattcagcagctttggcatgcaatagtgaatcacgcccattttcagctgtctgtttttgcaatcgcgcagctgcgtatcaagcactcggtcaagttactgatgcaatag

SEQ ID NO: 23217 - DNA, 585 bp, Sorghum bicolor
  Clone ID: 14593596
gcacgaggctcatcacagcgtctgtgtgggtgtgtgtaccttctccctcctcctccctgggggtttggttggggttttgcttgcttgctcccaggaggaatcaacagcgacggacggcccccgcccccgcgccgcggcgggtgcttaggcgtgcgggtgctcgaatcgcgcggcgccgcagaggtttcatagaagtagagagatcaaacaagaatttgggtttgttaacccagaggatatggctgggcgtgcttgtgaagatagatacgctaatgctgatttagtttgtgctctgtgtgacaatggaggtgaaattgtaagctgcgaaggccggtgtctgaggtcatttcatgcaactaatgattctggtgaacaatgtccaaccttaggctacagcaggcagcagttagatgtgatgaaagtctttaagtgcaagaattgtgagtatgaaatatatcaatgctttgcctgtggaaggctaggttcagctaaaactaatcctccagaggtgtttccatgtgcttcatcaacttgcggtcacttctatcatgcaaagtgtgttgctcagttactcttccctgaaac

SEQ ID NO: 23218 - DNA, 495 bp, Sorghum bicolor
  Clone ID: 14593602
gcacgaggagcggaggagccaaccacgtgcgtcgcgcgtgctcggtgggcgtcgtaggtggcggcggcggcgctggatcgccacccgggagccccggccactcgctctcgccgcggatgttcgtgccccagacccctgtacctccactgcaaagagctgctgatgtaaccccagtgttcaaccagatattgatgaatgaacaagaagaagaatacgatgggccccctcaaaaggaaattcctgctttaattgtctggacccttggaggaaagaatgtatatgttgaaggatcatgggataactggaaatcaagaaaagccatgcaaaaatctggaaaagattattctcttttgctggtactcccatcaggagtttaccgatacagatttgttgtagatggagaaaggagatgtcttcctgatcttccctgtgagactgatgcaatgggcaatgcggttaaccttcttgatgttaatgattttgtacctgaaagtg

SEQ ID NO: 23219 - DNA, 279 bp, Sorghum bicolor
  Clone ID: 14593621
gcacgaggatacttctcagattgccattccctgaatctcttgttcagtgattcttccacaggtgttgctaataacacagtagtttctctggaccatccttattctaggaaacatgttgctggggatgatgttatgaacagctgggtgccacgaaaaggacaagcaataatgaagccagatattatggtgccagaagctcctcgggaggctttgccacttattacttcctccaatgtgaagcctgacaaaaagaaagaattggtgactccgcatttgcgg

SEQ ID NO: 23220 - DNA, 461 bp, Sorghum bicolor
  Clone ID: 14593624
gcacgaggcgacgaagtattgggataagctttgcgaaagattgccagcacgagagacttccgttactgaggtgtttgacaaacaagtaaattctcttactctggaaggagttaaaaggattcttgattgttgctacaatgatctgcatggagatctcaagacctgcttattgtacttagccatgtttccaaagggttgtaaaactagtaggaagtgtgtaacccggcgatggatagctgaaggttttgttactaagaagtatgggctgacagaggaggaacttgcagagacatactttaatcagcttttaagaaggaagttaatacgtcctgtggatcacagcagcaacggaaagctagaaacctttcaagtacatgacatggttcttgactatattgcatcccaagcaagagaagagaattttattacggtgattggtgggcactggatgatgccagcac

SEQ ID NO: 23221 - DNA, 514 bp, Sorghum bicolor
  Clone ID: 14593625
gcacgagggttgcggttaatgatgatcagcccagttttgttccaaattgtgaatctgctagcttggataaacccggatgtttttccaaaaaggacgattcaagtgagattgttgaagatagcaaatcactagaaaatcagtcagaaatttgcaatgcagagtgttcctccagaattgcaaatgaaggtccctctctaattaatatgtctgatgagtgttcctccagaattgcaaatgattgttcccctaatgaggcttctcatctaactgaggagccttgcctctcagacaagtcatgcaacaccatcaattatgaaaatggaaatgagcctgctaaatcttctgatgtggttgaaaccaaatgtgtggaagcactagtgacagaacagaaggacaatggacaccatgcttctggtgagtggcatggagatcatgcgcaagtcatcggaccacagagagtctacataattaaagttccaaagtttgccggtgatgatctctggaatagatccag

SEQ ID NO: 23222 - DNA, 528 bp, Sorghum bicolor
  Clone ID: 14593633
gcacgagggaagtctaagagatcgtgcatggtgccattataatattgtacacatgcgagtaaaatagtaaatttcatgctgaacagctaacctttccaccttggactacttgcataatctaagtaggtgaatttagtaaccatgctgtgaatatgtgtctgatacatattctccaaggtgttcttgcacaatccaatggtttatggattatggtttgacttcccttctgttaaagatccgcggcaaagtttctaagttcctgctcgaattgagaacttaatggcagagaagcagctgtatgctgcagtgcaattgcacgtccaatcagtgctgatactggaacgagaaggccttcaagcggtaggtgctcttcaagatgatcgctctgatctaacaaagctgcgaggagtactattttacaaaattttggaagagttgcatggccatttgtacaacaatggtgaatatagctctgcgactttaagtatggttgacagtgatgaagtactgactaatacagctgctggg

SEQ ID NO: 23223 - DNA, 502 bp, Sorghum bicolor
  Clone ID: 14593635
gcacgagggtctagttggattcatccccgcggagtttggtaatttgaggagtgtcatggagattgatttatcctataatcaccttggtggcctgattcctcaagaacttgaaatgctgcaaaacctgatgttgctaaaactggaaaataacaatataactggtgatctgtcgtctctgatgaactgcttcagcctcaatatcttgtaatttcataacctgaatattagaaggatggacaaaattttgtatttttctaacgttggccttttgcatctttggacagaaatgtgtcgtacaataatttggctggtgttgtccctgctgacaacaacttcacacggttttcacctgacagctttttaggtaatcctggactctgtggatactggcttggttcgtcgtgtcgttccactggccaccacgagaaaccgcctatctcaaaggctgccataattggtgttgctgtgggtggacttgttatcctcttgatgatcttagtag

SEQ ID NO: 23224 - DNA, 584 bp, Sorghum bicolor
  Clone ID: 14593650
gcacgagggccatttgaaggaaaggaggctcaaggaccagatggagaaagacccaactgaagtgattcgcaaagctgtgctgcgcatgcttccccgcaacagactgcgtgatgtaagcgaaacttcatttctctctcattctgcatttgaggcttagacatgagctctttttttttaggttgaataactggattttaatgctagctttatttgctgtttctaacattgtaatgaatattgtatctatcctgtttgtgatatgtattactaggatcatgccctgcgttgtaacgggaacaaaataatatcatgataatttaaataagcataagtctaatacatatgtatggctgaagtttgcttacgttcacaatttcagctggttttgtagcccctgtgtgtcttgcttattcgcaaaaaccaatgaagctccagctagtctctataaaaatcaatatcgtaaggatgaacattttagtctaccgttgcaaagactattctttactgccaaaccatagtagttcttcccttcctggttgaccctcaatgtttgaaatgctattcaatacaattgctatgcgtaa

SEQ ID NO: 23225 - DNA, 436 bp, Sorghum bicolor
  Clone ID: 14593687
cttcgtcatctgcgccaggtggtacaggttcaagggggccagcaactaaatccgccgaggtgaccgtcgtctcacgatcacgacttcacgggtgcagacatgaattagctctgagctctatgtggtcctgatggcaatttggttggtggcttgggtaattatgctatggccttgggagagcaggagaaaaagggaccttagaataaggtcatgataattattttgtgtttaccgtagtagttgtttgatatcggcgcctctcttttttttgtttattattactttatatttttgttactggtcctttcatttgaatctataggatgatcaagtggctgatgaaagaggagaaagaaacaaaagagttggtttcttgtaacttgtaagttgttaaactgaaatacaaatggatgtaagattgaatgagttttagttc

SEQ ID NO: 23226 - DNA, 247 bp, Sorghum bicolor
  Clone ID: 14593712
gtggcagttgatcagcaatgccgtcaataatgggttgcacttgattattagttaactttttcaccgacagaggcaaacctaagtatgtgcatgggatctcagaaagggaccagggcagcaggttttgagtgattgccagatcggagtcatcacaattaattggcagcacattgctcttttgaaggatgcattcggggttgtctaacctgtgctttccatagggtggttcgtcctgtttgctgccctg

SEQ ID NO: 23227 - DNA, 339 bp, Sorghum bicolor
  unsure (1)..(339): unsure at all n locations
  Clone ID: 14593717
gaagacatcagagatgggatgatgctacatgtaatttgcttcatcagatggaaaccatgtgaagccaaatctgctgattttttcttcttcggtggatcacctaccttatggtggtcttgcttcaagtcatcaacaggacctgtaggttactgtttcctatccgatttctcctctggtgtacacttcaagaagccgtcttacgattgacccttcgcttctgtagtaactctctagtagactgatagcaaccagtgggtggagttgtatcataacttaattctgagccagggaggatgcttttacactagtgcaaaaacngctgcacccccagtttcttgt

SEQ ID NO: 23228 - DNA, 110 bp, Sorghum bicolor
  Clone ID: 14593728
atcatagtgaggaagaaggccctgctgacatatgtgatgtcatatggcttgtatagttgtattttcatcatctaaataaagcacaatatatattggtcagtttttatggc

SEQ ID NO: 23229 - DNA, 429 bp, Sorghum bicolor
  Clone ID: 14593731
ccaacaggtgattgaaccttgcacggttgcacgccatgtcacatgccctgtggtctggtgtgctcgcgtaattgtaatcgtcagggtctacctttgcattatccgttttgaagcttattatcaacaagttgcaagttgcttccaagtttctgtgaagttttttgttttgtctgttggtaccagacacgagattaggactgctgatgtggcatgatctgatgacaggaggcaggaataggcatgcagtggtgtattgtaggtggcactgttcatataagcatttgtatttggtacaaaatatgtaaatttttctgtgcgaagattgtggctgtgatgagaatagatgctatcgaggcaacagcagatgatacacttacacctgtacacccatttcagttttgtctaaagaatggttgtatgcttatctgc

SEQ ID NO: 23230 - DNA, 217 bp, Sorghum bicolor
  Clone ID: 14593736
atagcaccattccttcatccgcccatgtaaatccaaggtggacaaaccacacacatttgccggtatagcatattatttatagatagcgcatacagggagaggaagatgcacagaaatggaagggagtatactgtacacgtataccacccgtttgcaagggtagaaattttggcgtgtcaattgatgcttgaatgacttttcaaggtcattccattcc

SEQ ID NO: 23231 - DNA, 272 bp, Sorghum bicolor
  Clone ID: 14593749
agctagtcgtcgttctagacttctagtagtgggacactgcacagtagagtttggtccgtgaatccatgattgccctcggctttgtaagctccgcccgttacccttcaattttctaaactaaaaataaatgtacctccttcatccgctttgtatggtttatttttaacaaaaaagagattgaacctctactttctaactagattaattctcagcgcgttgccctaaaatatctatgtaagagcatctccaacaacttggtaaaattcactttc

SEQ ID NO: 23232 - DNA, 174 bp, Sorghum bicolor
  Clone ID: 14593752
ttacacggttaacccacttatgcacatgtagacatgaaaccatatatctggagttattagaatttgagcttgtgtgatatgaacatatatacaatggtggtgaatgcttttattgtgatataggagcaaaaagtatggtaattattggtgtcaatgtgtgatggcttcttactg

SEQ ID NO: 23233 - DNA, 246 bp, Sorghum bicolor
  Clone ID: 14593753
ctgggtcgaggccattgtaatcctcatcatcgtaaattcgtagatctaactagctaggagcgattcgtaatgaatttttacgtcaggtaattcttttgagtggatcagtcgtggttattctttcgccatccctgtcttctaccactaacacagatcatgtgctgaggtctgcttacttgtgcaaagacttgttataactgatggagagagactgctgcgtttagtgaattgctgtatcgattttcc

SEQ ID NO: 23234 - DNA, 293 bp, Sorghum bicolor
  Clone ID: 14593757
gcatggtgttgaatgggactaggctcttggtaacagcttgagagtgctgtttggatttcctaatttagcacattgtttgtataatattgtaggaatcatattgaaactgtaaatccaataagagtggaaagaagataaattgtgctgcaagattctgttgtgcttgtatgcttgagagattggtctgcacggctttagtgagagttgttgatctgtagtacttacctattggcaaccatatttgtgggattaattggcatttaaatgcctgctgtcattgaagatttattatc

SEQ ID NO: 23235 - DNA, 188 bp, Sorghum bicolor
  Clone ID: 14593774
ccaaggacccggagttcgcgccattcagctggattcgcggccgacaggtccagctttgatcggttaaagatgatgatgatggtgaatggctgggacggatttgccgacttccacttcttcatgagatgattactatatagtctataattaaagatgatccggtgatcgttattaacacttaataagtg

SEQ ID NO: 23236 - DNA, 330 bp, Sorghum bicolor
  Clone ID: 14593775
gtacattcatggatgcaagatcagccaatagaacccagttaaagtattcttctgtgatgaacattgaagttagacgggactcaaaaggaagtcctctgttagtagtaactatcacatgttctttattcgtgctatattagatttgttagctatcatgtgtatgtagtttcatcacccatttgtggtgctttctcccctagcccgttgttggttcttgtctccttttgtcatgaaaagaacgatgagctctatgattctcgtcagctgataaatgtaatgaatttctgttggtgacaaattaatgatgtcattcaattcatggcagcattt

SEQ ID NO: 23237 - DNA, 217 bp, Sorghum bicolor
  Clone ID: 14593781
ttctccttccaaaaaaacacattgggttttgattattatttcaccttgtaaccatcatggaagtgtggattttgggtggtagtgcttagattatgtacattgaatagctgggctagttggcctcgacagaagccttgagcgactgtgtacgtggacggtgacagcccaataggcatcctctatactttaatagttgcattcatctcacaaagttcat

SEQ ID NO: 23238 - DNA, 291 bp, Sorghum bicolor
  Clone ID: 14593800
ttactgtcaccggctttttcatgtacctaaccctgttttggtccgtatggttcaaagttttcgtagcgtttagctgttctttccttacgctcgctacctgctactctatacatctgccccagatgatagattcaggttcctctgagagtatccatgcgaaggaagcttgaggtgtaacgtgtacgttgtgactgagagcctgtatatcagcagagtaattagtactgccttggcgccagttttgtatcacacacgttggctgtgtatgtccaatatatgtgttgctacctc

SEQ ID NO: 23239 - DNA, 308 bp, Sorghum bicolor
  Clone ID: 14593805
gacgtccagttagtagtaggtccaaaggcatcttttgttaacctcaaggggtctcttgtaagtagcacggtttcattttgagcttctgacgttataggctcgtggcaaccatggagtgagtggtcttcagtttaatctggcaaactaggaaccacttataataggatttggaaggttcaggttttcttttgaccttttcagttcagcactgttcttccttttgaatcttcagttgccatgtctgaagaaccttttggttaccctagtctctggaatgggggagaaaaacaagatgtcgtgatgtgctt

SEQ ID NO: 23240 - DNA, 432 bp, Sorghum bicolor
  Clone ID: 14593820
ccggaagagggcgatgaggccgacgacgacgcagcaggcggcggcgagagcgactccgcccaagagcttcaaacggcttccatggacagggaggccggagatccatactaaaacacaactaaaaacttgtagcattaagggaataatacaaggagggatagaggagaaaggaggtggggaaggaggaaccggccctccttgtcgccggcaagctcgccggagagaaggcagggggccggcggcgggtctagctacgactctctactgtcgcacggaggtggctctcactcgcaggaaggcgactcccctggtcaacagttggaattggaatcactcatgtcatcttccttccacatggcaaccgttctgtcagtaggacacgcctaaaatttattattaattttacaactcatgtcatcttacacttctttt

SEQ ID NO: 23241 - DNA, 260 bp, Sorghum bicolor
  Clone ID: 14593861
atgcggctaaaatgcctatgtcgccagagaaatacttgtgtaggatttttacctgcaatgttcacatgacggttttgctcttgtaccatgcctgagtatatgcacagctattgcagcagttgtgatactttccttcttgttgcaacctgccgtctctgtaactgtatttaatatctattggatcgttccatagatttggttttgatatctgcgcgagtaccaaaatgacctctctctccctattgaactggaagttgtac

SEQ ID NO: 23242 - DNA, 277 bp, Sorghum bicolor
  Clone ID: 14593867
gaagcatcacctcacttgggcagatgtagggggtgtctttcatagtctctgcgttagatgtgcaatgtaatgaagctgtagcacagtatgaattagattgcataaaagtgtccctgtcgattccgccagtaatatgagcggtttggtatctgactccttagagtcaaatgtctgtacaagtggatcgtcgctccaaagcaaaaaaataatgtgctggagaagcggcgatgacttggcattgtacacctttaccagttggaatttgacagaagtttgg

SEQ ID NO: 23243 - DNA, 496 bp, Sorghum bicolor
  Clone ID: 14593885
tggagacaaaatgtttagatatatgttgatgtttttatcattaatacttgtagtttttttgggacaaactcacaaaagtgctgccttagataaggataattcagcttttgttctactatatattctgttgttgtttccacggccacctttagctgcaaagcaacgctgcaggtatcaagtgctcatgtgcaggtgttaatgttctgactaacagggaagaagtaaaatacaatttccctttatcgagaagagtatttggaggtttatgtatgtatgtttaataaacattccacttgttgacacttccctgaaatagccttttcttttttttcttttctttttcttttcttttctttagctttcatatgtactgctcaggccgatatgccctttcgagtgatgattttttattttgcttgtttatgttagataccagataacttggattgttgtgacccaagtggcattaatctattgtcaaacaattctgactccc

SEQ ID NO: 23244 - DNA, 257 bp, Sorghum bicolor
  Clone ID: 14593888
ccccctgaactattgaatgtgacacatgattaagaaaagttgctgttgctcatagggtcacctcggtaccatcaataaccacctcaagttcacaagccaagtggtcttgttttttccatggtgttgttgaggcctgaggttaaatatgtagtatagctcatcgggtaaattggcaaaacatacatcccaaattttagggatcgagtattatccttgtctgagactcgagtttatgctaattctgcaactggtcttcc

SEQ ID NO: 23245 - DNA, 279 bp, Sorghum bicolor
  Clone ID: 14593895
aagaactggagggagactgggcagaagggtgtagcaacggaatgttgaacttggatcatgacgaggagaggtatttggcaatcaagaatctcagagagcagatgttggccgggtcggggttcatcatgtcccaaggtagagaagatgctgaaagagagtattgtggcttgtaaggtaaacgggccatgaagaaaattaaaaagtaatgtgtcatatggatcgctgtttgatgctaagacccaactgttcaagaatatatatagtgatggttttgggtgg

SEQ ID NO: 23246 - DNA, 217 bp, Sorghum bicolor
  Clone ID: 14593904
tgatccgaaccccagcatgacattctttgagccataggtgccccttttgttgccgaacctgttgcaagaagaacctgggaatgctgcatctaattgaactatgatagtgttaggttggtaattgaactatgatagcgtttggttcatcctcaggtaatgtaattggattgcagcagcctttgtttgattggatgtgttaatggtattgtttccagtt

SEQ ID NO: 23247 - DNA, 379 bp, Sorghum bicolor
  Clone ID: 14593906
aacattttggttagcagccagtagaaacagtagtaggaatcaatcagcatcagcaagaaggtactgctgaagtagtgctgaaaaaacagtgcgatcagcaagacgacgttgtttttctggtgctgtcttgggtactcaaatgccttcagcagaagattctggagatcagaacttttttttttaaagtgagatcagaaaattttagtgtcattgctggtttgtaatcaactcttcactgtagcattttgcccttgttgtagagcttgtcaaagtgctgtggctcctgtaggccagtgtagaattttcgtgaagaatcaaaatagttgtcaatttgtatcattcagaacaagaataatgctaaaatctcagagttcgtttc

SEQ ID NO: 23248 - DNA, 327 bp, Sorghum bicolor
  Clone ID: 14593911
cagtttgaaggagagtcatcacaaacaattcattccttttagttgggggctgatggactcaaggggctgtttggttcttgtggcgtatatttacactgcatgtgcatgtggctgccacagtctatagagcgaaccaaacagctggttcgccttgtgtggcgtgcagtaggttaggctggcggagtgcggtgtggaaccaaacagccggttgagctatagtttgtttcataatgtttgcgttttccctagcacggccatgtggtgttaaatcagctcctgaacattatggactgccattacgtattttattcatctggttgacaattt

SEQ ID NO: 23249 - DNA, 412 bp, Sorghum bicolor
  unsure (1)..(412): unsure at all n locations
  Clone ID: 14593931
ctctggttcaggcgatgagcggaagcctgctccgcggacagatgctgcctacagcgcaataccaaacgctgggaatgctgggccatctgtgactaagctgcagccggatgtagaggtggatgactgggaagaagcttgtgaatgaggaagcgtcaggaagtttggtccagatgttttttattcttctggaatttggttatagtttaatctgctctggtactagtgctatgttggaaccgagccttcatgttgtagcacacatttttaattagttttgtgattgcctggtagactgttgagtcagaagtgctgattttgttaagccggggaaggatatgtgctgattttgttaagccggccagatgaatcttaanggctgctgcttattttgcgcaggccttttgtcgagttc

SEQ ID NO: 23250 - DNA, 178 bp, Sorghum bicolor
  Clone ID: 14593947
gcacgagggccggctcgcggatgccggggacatgtgcgaggactgcgccgccgcggcggcgcctgagaaggcgatgctgtcctggatgggccggagcgagcttggagagcgggacctcgcctgtgcctgctgcggcgtcgcgctcgagagcggcttctactccccgccgttcttgctc

SEQ ID NO: 23251 - DNA, 328 bp, Sorghum bicolor
  Clone ID: 14593951
gcacgagggactgaaatacgtggtatattgggtgtgattttgtttgggaatggaggccttaacctccagttgtcctctggatcgaatctgagctgagcctgtgttgtttattttcgcgagttactgttcatcagtttttccccttcctgattcgtgcttgttttgagtttttctgtgaagtttgtttggtcagattgatgctttaccaagtgattgacaagatcaccaagtgatttgagctaattccactcatgcatcaagatccaagcagatttcatttttggggttttttcttgagttcttgtctaaatttttgtttctcggtgat

SEQ ID NO: 23252 - DNA, 317 bp, Sorghum bicolor
  Clone ID: 14593967
gcacgagggtctaacggtaacctgcagagcaccggacgcgtccggtgtacaccggtcctaaacacagagaggtctgcaaacgcgcagggtcaccggacgctgagcaccggaccgtccggtgctcaccgtgtcttaaacccagagaggtttgcaaaacgcacaggtcaccggacgcacaccaccggacgctccctgagcgtccggtgctttcagtcaggtttactcacagaagacagatagcaccggacacatgaacaggagctaccctgcgtccggtgttcaccgtccggtgcttaaccctagcaccacaacacacc

SEQ ID NO: 23253 - DNA, 417 bp, Sorghum bicolor
  Clone ID: 14593988
gcacgagggctatgcacctaatatttaacttctggcatttcaccttcggatgtttcacgcctacttacataaggatggaatcatagatttgaatattcatgtttatagctgaccataaaatcacatactggtttttcttaattaagcaccaaattcttcgatgttccacagtaaataatgatgaacattcatgctcatacacttatcttctgtgaacatgaaagcattgtctaaacggtgcttttatgtatccactgaacttacaatattttgttatgcccaatattttttaagatgatgcctgttttcatagttaaatgtttaaattcagaaacacatgaattttacaagccttctgagttgcatgtgccccttttcctgagctgtgtaaagaactacaacatcaacaagagctgg

SEQ ID NO: 23254 - DNA, 254 bp, Sorghum bicolor
  Clone ID: 14593989
gcacgagggcctgatgaagagtctgagatatctgaatctctctggtataccatttagcggtgaagtgcgtcctcagcttggcaatctgtcagagttgcagtaccttgatcttggctcccaagatcttggttacaggatgtactcagcagacatcacctggttacaacatctacctttacaataccttggcatgagcaatgtaaatctctcgcaggtatctacctggcctcatgtgctaataggattccctcttt

SEQ ID NO: 23255 - DNA, 239 bp, Sorghum bicolor
  Clone ID: 14593992
gcacgaggattagagtggacactgccagctgcacctcggccaggtcaaaatgcatcatctaagcagtcttcaacctccaaggagcgatcagcagaggcttctggtgcagaaaactctgatgaaacatgtgaaagttttgcttttgcattagtcaatggtgctcttggtgtgtttgaagtgcacgggcggcgaatacgagattttaggccaaagtggccctcatcatcatttgcatcttc

SEQ ID NO: 23256 - DNA, 125 bp, Sorghum bicolor
  Clone ID: 14593997
gcacgaggattgtgtcgtgctgtacatcatctctgctgtagcttgcattcttctatacttggagtacaagcacattgccaggctgaggttgtatcacatttctcgagcaacaagcaatcctagcc

SEQ ID NO: 23257 - DNA, 319 bp, Sorghum bicolor
  Clone ID: 14594002
gcacgaggcagaatcttgggccaacgctctggtatctgagctctctcaattaaaaaaagagaaggtggccaagagcagtgcgacagaaagctccaataggttggagctcatggatgacttcttagagatggagagattagcatgtctgtcttctgaagttaatggcaatggcagtactattgacaaaatgaagatagacgatgttggggctactttgtctggctctactgaaagagatggtgttaaagatttgcagtcagcttcaccaatgtcagaaactccatctaataaacagcgtctgtctgagaaatcttcgctt

SEQ ID NO: 23258 - DNA, 275 bp, Sorghum bicolor
  Clone ID: 14594011
gcacgaggctcctcttttccccactcaccgtgcaggaaggcgaagggtccaggcgtccggcacttcagcttctcccgttgctccttgcgtcttctccgaccgggttcttgtccggcgaccctgaggctgtggcacttgaggaaagcgacccatggagctcgaggccattggaaagcgaccccgtgcaagcagcggcggcagcagcagcagcttggctagcgacaggctgagctccctaccggattgcctcatccaccacatcatgtccttcttga

SEQ ID NO: 23259 - DNA, 149 bp, Sorghum bicolor
  Clone ID: 14594012
gcacgagggtcgtctcagtctcagagtaagggaggaagaggcggatggcatgaagcaagctgccaagaatgagagcatgggcggctgcccctggtagaagcagagcaagaccgggccacaaggaggaggaggaggaggaggggggagga

SEQ ID NO: 23260 - DNA, 311 bp, Sorghum bicolor
  Clone ID: 14594013
gcacgaggaagagcccagctgatgaaccaattcacttcagcaaagattatgggaattccgtggatgttagcagactgcttcagaatgtagaaattagttggattgaacttgatagtagctatttgattcatcatggttcagagtcgtcatcatttgaacgggaaaaatggaggcgattttttgaagagatgggtgtgactgattttgtgcaggtagtgaaagttgaaaaaagtttatcccaagttgattctcttctggcaggaggcctttctctagctgatgtatctgcaaaaccctgtaccgtgtatgac

SEQ ID NO: 23261 - DNA, 352 bp, Sorghum bicolor
  Clone ID: 14594015
gcacgaggacaggatggaagcttgttcacggtgatgttttcaggcctccatcaaactcagactggctctgtgtttatgtcggcaccggtgtccaattctttggcatgctgcttgtcactatggtatttgcggttcttggcttcctttctccatcgaacaggggtggactgatgacagccatgctcctgctctgggtgttcatggggttgcttgctggctactcttcttcacgtctttacaagttgttcaagggctcagaatggaagaacattgccttgaggacagccttcactttccctggcagtgtgtttgctattttcttcttcttgaatgctcttatctgggggcaaaa

SEQ ID NO: 23262 - DNA, 247 bp, Sorghum bicolor
  Clone ID: 14594017
gcacgaggggttgctgcgcgaatccgcgagattggctcgatttttccttgaattgcggcatgtgccatgcttcttttctccaattccaccaccaaggcagcagctcaactgtgacggcactgtagtgctttctagcctgctgctgggctccaatggcgtcgtcaccttccccttccccgggcaccatcagggccaccttgccgccttccaccgcaacgccgtcgccggtaaccaccacgcccacgct

SEQ ID NO: 23263 - DNA, 200 bp, Sorghum bicolor
  Clone ID: 14594022
gcacgagggccatgcggctggggaccaattacttcgggctctacatcgagccgccgccgccgccgccgtcttcgggcggcggcgtcgctgccgccatgtacttcaggcacacggcgatggaggccaaggcccagatcgtggccggcggcggcccgacctacgcgcgcgtggagcccgacggcttcctcgccatgtaccac

SEQ ID NO: 23264 - DNA, 102 bp, Sorghum bicolor
  Clone ID: 14594023
gcacgaggctgaattctcagttgaaaagcaatcacatccttcaggtgaaccctcaaaagccgttcatgttgacaagggtggctgtgaccatgtcaaagatga

SEQ ID NO: 23265 - DNA, 232 bp, Sorghum bicolor
  Clone ID: 14594042
gcacgaggccattgttcgccacgatcctagcctcaccctcacgtgtactgtagcttagctagagcatcccggagattcaaagtggcggcggtcatgtctcccatggcagcggcggcggtcggcatgtctccaatggcggcggcggtggcggcatcatcgttcccttcctgcggccccttccgttgcccggcagcggcgacgcgtcctcattgctcggtgagcaggaggagat

SEQ ID NO: 23266 - DNA, 379 bp, Sorghum bicolor
  Clone ID: 14594050
gcacgaggattttgtttttaatgttgatattggagatggagaacccatacgaaaactaccgtataaccgttcagatgatgcatacacagtcgctgacaagtggctcctgaaagaaaatctgccgttgacatatcgccaacaggttgttgaatttatactgcagaattctggccagaacaactttgttccagatccatcttttcgggatccctatactggggccaacgcatatgtacctgggcaaccatcgtcatcgaatggtaatgctccaaaaccaattttcaagcacataccaaagagtggaatgctattatttgagacagctcagtttgatggaatcctaaagaaagttacagagtttaatgcaagactttcctct

SEQ ID NO: 23267 - DNA, 190 bp, Sorghum bicolor
  Clone ID: 14594058
gcacgagggtcaggtttcatttatcgaccgcagtcagagcagaacttgatagatggaaggccggccagtgcacattattctctggaaaattccaaagtcacgatcatcaatgcttgtgatttgttcaagcagccccttcgggcttcacgccctgaccatattgttatcatcctcagagggcttccaggta

SEQ ID NO: 23268 - DNA, 318 bp, Sorghum bicolor
  Clone ID: 14594059
gcacgagggtcttctcagaggagctgactgaatctaagagccaagatttgccgttgacgaaagtaggggagcacaagagccgcatgctctctgaagtcacggttgctgctgatggcaccacattgaaagctgatgaagtgatcgagcaagtgacgacgctggaaccacaggatggtagcttggtgaagggagcaggcatatcagatgagcaggagaaaaatattggatcacagcagcaatcttcttctgaggaaagttcacaggacactatgcttaaacagacacctgaaaaggttattgtggagaactcccaatcag

SEQ ID NO: 23269 - DNA, 383 bp, Sorghum bicolor
  Clone ID: 14594065
gcacgaggtgaagatcaacctctcttgcgtgccagtaaacttgtgaaagtgcggaacatcctccatgagcgcaactataaaaaagaaaaagaaagtacaaatgtgtttgaattgccacccgagctctgcatagttgtcatggcgccagtgtcagcaaataccctgcgctgcttcacatttattccttctataatgtatcgtatccaatgtatgcttctttctgtgaatttgaaaacgcaattgggtccaagcatgaagcagttcgatattccagcactaaaggttctggaagcactaacagcaaagaaatgcaaagaagaattttcgcaggaatcattagaaacacttggagattctttcctcaagtatattacaactcagca

SEQ ID NO: 23270 - DNA, 155 bp, Sorghum bicolor
  Clone ID: 14594066
cgcacgagggatgtgtcacacacaagtgaagtcatctttgaactagtggacaaagcaattgaagacattggtccagaaaatgttgtgcaagtagtgacagataatgcctctaacaacatgggagtaaagaagctattgcttgagaagagaccacc

SEQ ID NO: 23271 - DNA, 313 bp, Sorghum bicolor
  Clone ID: 14594076
gcacgaggcctctttatgccccaactggaattaatgtgcctactcagctgtatcaacaacagacaagttcaagatgtgacaatcaagctcaaagttacatgggacacaaggtgcaaggcacatcatccatgtattatgttgtgcctaactatgggatcgaacattctccccatggatctcaccctttgcacccttgtgccattggcgatggtaggtttgtcagaacccaagagtaccacgctgaaactgtggagcacacataccatcaaccaattcctatgccctactgttctgcccatccatctgcagcaga

SEQ ID NO: 23272 - DNA, 329 bp, Sorghum bicolor
  unsure (1)..(329): unsure at all n locations
  Clone ID: 14594077
gcacgaggcccgtcattgtcacggccatggcgtccggttgcgtgcgcaataaccttgtatataccgcgctctctatcttccgctccatggtcgcctctgattccgcgggagtggttgacgaggcggctgcactggtagcgctctctgcatccgctcgtgtccctgaccgtggcattactggtggtattcatgcacttgtctccaagattggcttggatgggcatacaggggtagtaaacacgatgctagacgcttatgcaaagggcggtggtcatgacctgngggctgcgaggaagctctttgatatgatggagagggatgtagtgtcc

SEQ ID NO: 23273 - DNA, 311 bp, Sorghum bicolor
  Clone ID: 14594088
gcacgagggagggttcggtgacgagaaaaccccaatcgcctccgccccccctcctctactccggccgcagccgccgacgtcgccacgcgcattccgccgcgccaatcgggtacacgagaagggttgcggatggagtcgtcggcgtccgcgccggcgtccaagggcccgcgctacgcgccgccggatccgacgctcccgaaaccgtggagggggctcatcgacggtaacacggggtacctctacttctggaacccggagaccaaggttacgcagtacgagcgccccgtcgcggccgtgccttcctccccgtc

SEQ ID NO: 23274 - DNA, 359 bp, Sorghum bicolor
  Clone ID: 14594091
gcacgaggcagctccatcggccctctccctcctcgtcatcaccggcctccgccgctggggagcctgcccaccgctcgctactctcctctccctcacaggaagaagaacccggccgtcgcccactcagagctctctgagagaggcgagcctcactcgccttgctactatgccttcctcgccgctcgccggagcccaccgcctccgggccgtaaccaccaccaccaccaccaccaccacctagtgcctgtccctgatgcccatggcgccggaccgccccttagaggcctttttcgccgccgcccgtggcgccatcgcgcaccttcagcttcaccttcccgtcatccacatccctggatccc

SEQ ID NO: 23275 - DNA, 416 bp, Sorghum bicolor
  unsure (1)..(416): unsure at all n locations
  Clone ID: 14594124
gcacgaggatatatctaacttcttattatcatgtgcaggcttcataagtattgttgctttattgctgcaatattatcgtgcacaatgccatcaaccttacttgatggtctccctaacgaagttgctctccagtgccttgcacgggtgccattcttgttccatccgatgcttcagttggtttgccgctcttggcgagcatcagtttgcagtggcgaacttctcaaaattcggaatcagattgacgcgacnaaatagctcttgtgtgtgttggcgtttgaaccagaaaacatgtggcaactttatgatcccctacgagacaagtggataactctccctgtcatgccatctcagattaggaacatagcccgctttggagtggcctcaattgctggaaagctctacctaattggtggtgg

SEQ ID NO: 23276 - DNA, 321 bp, Sorghum bicolor
  Clone ID: 14594131
gcacgaggcttcttcttgggtcttgtcttgggttgttgaggtatttgctcaggcagttgggcttctggcttagagcttctggatttgtaggcattgctgggtgtctagaggaaggagatgatggtgggctcttcccagcagcagctgctgcagaggaagggcaagtccgtggctggcaaggccgcggccgccgcgaccgcggcggcagagaaggtggtggtcgcggtgaaggcagccaccagggagatctccaagacagccatcgtctgggcgctcacgcatgttgtccagcccggcggaagcatcatactcctcgtcgac

SEQ ID NO: 23277 - DNA, 449 bp, Sorghum bicolor
  Clone ID: 14594134
gcacgagggcaggtcgaccaattggctgtgcagtacaaccttacagatttcactagtggcttccgccatttcttgatcagccaatcagttgacccaaagagcaaggcgctcatcagttccagaccacacccatattcaatgaagttgcaatcaattgcgacatgtgtgaagaacagagagtgggtggagatttacagggagcttgattcgttctttagggagctgttgatcacaagagaggatttggtggtcaaggccaaggggctggctttgcagggaacagaaatcgcaaagaggctgctgtccagcagcacattggtgctgggcggtagtgccaatctgatgttatcaattgctctccgcattctctcaagtgcggctgaggtggtgaatttcctgtcacaactgatggtgttcttgtgggtgctgtattacctcattactgtgga

SEQ ID NO: 23278 - DNA, 350 bp, Sorghum bicolor
  Clone ID: 14594139
gcacgaggctctttcttgtgctttgtagttcacatttttttagatcatcatgaattactctgcactcctgcaaggctttgaatttaacatgtgtgttttcagtacaaaggggacaagaaagatccagccgcagattctcatggtgactggtggcaaggctcattttattactaagagaacctggtggcctctccttggagaacaaggtaccaagtttgttgctgtactcacttctcatgtccatatctcacatttttgtaccagagaatccttttcaaattccatattaatactcagctgatagttccgtagatacccatgttggctcacttggcctatgatacgttacg

SEQ ID NO: 23279 - DNA, 293 bp, Sorghum bicolor
  Clone ID: 14594142
gcacgagggcgcagcgccagcaccagcaggcgcaggcgcagcagcagaggaaggccaggaggtgctggtcgcccgagctgcaccgccggttcgtcgccgccctgcagcggctcggcggcgctcaagttgcgacgccaaagcagatcagggagctgatgaaggtggacgggctcaccaacgacgaggtcaagagccacctgcagaaatacaggctgcacacgcggcgcgcgtcgtcggacgtcggcggcggcgaccatctggcggccgcagccgtgggcgggctgtggtcgtcg

SEQ ID NO: 23280 - DNA, 348 bp, Sorghum bicolor
  Clone ID: 14594143
gcacgaggcctgttcgcattcctgtcactatcactaggccctagtcccgccccagctcctctccctgtaaagatttcgttcgttcgtctctcggatttctgatctcgttctccgtccccgattccacctgtgaaaaatctcgtctttgctgcaataagtagcagtagcagggaggagtttgtgcagagttccctttccttcttttcttttttcttctcttttttttttgatccggagaagccgagtccgtcagtggttgcttgccactaacgaatcacgttcggattgcgtcctccgctccgttccgctccaatctaattcggggccgcctgggaaggattcgggaag

SEQ ID NO: 23281 - DNA, 338 bp, Sorghum bicolor
  Clone ID: 14594145
gcacgaggtgacttcttctctcgtagtgcagtattgtgagctgcaacatcagctgatccaatggggacgtataagctgggtgtggaggtcgtaagtgctcatgacctgatgcccaaggatgggcatggttctgcaagcgcttgtgtcgagctcacctttgatgggcagcgcttccgaactgttgtcaaggagaaggacctgaacccagtctggaatgagcgcttctacttcaacatatcagatccttctaatcttcgtgagcttgcccttgaagcatatgtctacaatgtcaacaaaactcttgaaagttccaggtccttccttgggaaggtcatgat

SEQ ID NO: 23282 - DNA, 344 bp, Sorghum bicolor
  Clone ID: 14594148
gcacgagggctcctccgagtgaccgtacgccgtagcccccccgaaaccctaggggcgccgctgactcgccggaggcccagccatggacggcggcgcgtcggagctgcgcgaggcccaccgcctgacgggccacggcgaccgcgtgtgggcgctcgcctggaaccccgccccgggccccggctccggccccgtcctcgcctcctgcagcggcgacaagaccgtccggatctggaagcgcgcccccgacggcgcctggcagtgctcggatgtgctggaagacacgcacaaccgcacggtgaggtcctgcgcctggtcccccaacgggaagatgctggccacgggaa

SEQ ID NO: 23283 - DNA, 295 bp, Sorghum bicolor
  Clone ID: 14594149
gcacgagggaaccgagccgttgggcgtcggcggcgaccttcggccatctcgccggaggctccattaccacgagttccccattcctgagagtttcgatccattccgatagtatgcctgccgaaacggctggagcagtcgaagtgctcgaggatgacactgttaaacgcacacccatggcccgacctagcaacggtcgtgaaggaaagcccattaggttgctgtccaaccactttgctgtgaagcttataggagttgatgctgttttctaccaatacagtgtctgcatcaaatctga

SEQ ID NO: 23284 - DNA, 319 bp, Sorghum bicolor
  Clone ID: 14688919
gcacgaggaacactccttgattggtggatgtttggttcccgtgttatagtaccacttaattttttgaaattcaacctcttctcttcgggaggagactactatggaacacatgtcttccactggtactttacacagggttttccatccatgatttggacattcttaccatttgcaatgcacggtattgtaaagtctcgggaatggagactttcacgtctaattgcttgggtattaggggtttacagcatacttggacacaaagaattcaggttactgcttagctgccatgtcacaactcaaggccaaaaatcagcatggg

SEQ ID NO: 23285 - DNA, 351 bp, Sorghum bicolor
  Clone ID: 14688947
gcacgagggacgcctggcccgcggcctcccaccccacgctctccggcgaggaggtcgagctcgccgccgccggtactggcaccggcatgcgtgtcggccacgccgccgtcacgcgcccggacgctgtgcttaggcctgacggggtcatccacggcatcgagcgcctcctcgtcccgcgctccgtgcaggaggacttcaaccgccgccgcagcctcgccgcaatctcggccgtgctgcccacgggcgcgcctgaggtcgaccccaggacgcaccgcctcaagaagcccgcgccgccggttctccccggcgcgccccccgtgctcccgatctgggacgccatggcgcctggac

SEQ ID NO: 23286 - DNA, 590 bp, Sorghum bicolor
  Clone ID: 14688966
gcacgagggttcactgtaatatcgatttggtgcctttgcatttgcttcaaatctattcgtaagtggaaacgttggaggagatcgatcgatcgggatgggagggtgcttctccttggacggcgacgtgcgcggcggcatggaggccgtcggcggcggcgtgacagcggcgtctgcgcagcagggcgggctgaacgacgcggtcgactatttcttccagacgcgcggcctccgcggcctctacacgcccatcgagctatcattttcagcatcgaaattgcggaatttagatgccttttcaaagagtgatcctatgctagtggtctacactaacataaaaggaaagctagaggagattggccgtactgaagtgattttaaattcactggagccctcatggatcacaaaggttacaatgtcttaccaatttgagattgtgcaaccattcatattcaggatatatgatgttgacacaaagtaccacaacactccagtgaagatgttgaatttgtctcagcaagattttctgggggaagcatgctgcaacttatcagagattgtaacaaaatttaaccatagcctcacattgaatc

SEQ ID NO: 23287 - DNA, 549 bp, Sorghum bicolor
  Clone ID: 14688980
gcacgaggcacggccccggccttttcctcccctcctctctagatcgcgacgaagcggactcccccctccctcctgcctgagcgaagcggactcagggacgcgtccccgccgcgaggcctgatcgatccctcggtttttggcggtaggggcaatgctgcgtgcatcgagctgctgctgatcacgactgattataggttttaatatttgcatattttgattgctacaagttttggatgaagttagcacttatctatggaagttgacaactcacatggcactctaattaataaaagtgaagagaatgactttgaaaagaaaggcacttctgatcctgtggtttatcagctagttcgggttgaaggtgatggaacacttgttcctgctacagaggatgatgttttgcagtttgaacatttccttcataatgatgagaaggttgatcttccttctattgaagatgtacgccatgtggaagagtttttcaacaatgactgcatgttactgaagaagcctgacttggaagatggatcttccaaattggagactgta

SEQ ID NO: 23288 - DNA, 313 bp, Sorghum bicolor
  Clone ID: 14688990
gcacgaggatctcggcagctgcaacgatggcgaacaaggaggaactatgaacccagaggaaggtattgcctctgcctccgaagctaggtgagatctgtcaactaatcatgagccgaaacgattttagtttttttttccagaattcccagttttggactgttcccctaaataaagagttcatggctcgaacattagaggcattattaggcagattctcataggccctggtcagctctctcttcttttttatctttatttttttgaccaatactacctgcaaagccagtaccgaatcagctttgacttcttccat

SEQ ID NO: 23289 - DNA, 576 bp, Sorghum bicolor
  Clone ID: 14688991
gcacgagggggtgctggagactatgtcggcggttggggtctcgccagatgtagagagctttgggtgcctcgccttcctgtatgcttggagaggtgttcgcagtcgggttgatgagctcgatacattgcttgatgctctgggcttcagcaagaagggttttttcaagaatctggttagtgggtacctcaaatctggtgacttcgagtcggtttcaccaatcattcttcgtgcagtgaaggagcgcagagttggggatgacaatggatttgatgaggaaacctatagtgaggttgctcagtgctttgttgatcaatcaaggattaaggaactagctcagttgatcatccaagcacatgagattgagctcactcagcaatctatgtcagttgaggattctgttgggtttgggattgtcaatgcttgtgttgagcttggtctattgaacaaagctcatagcatactcgatgaaatgacagctcaaggagcctctatagggcttggtgtgtactcttcgatcttgaaagcctattgcaaggagcacaaaactgcagaggctgcacagcttgtggcagagat

SEQ ID NO: 23290 - DNA, 153 bp, Sorghum bicolor
  Clone ID: 14689015
gcagcagctcatgctgcatcaacaaatagccggtttactattttctataatccaagagcaagcccttgtgaatttgtcatacccatggctaagtacgtcaaagctgtggaccatacccgcatatctgtgggcatgcgtttccggatgcttttt

SEQ ID NO: 23291 - DNA, 112 bp, Sorghum bicolor
  Clone ID: 14689016
acatgactcccttcttgtggatgagccacacgagggtccatccatgccatggatgcgcagtgggaggggaggtatgccatggatgatgggtgggttggacatgcatagtcca

SEQ ID NO: 23292 - DNA, 380 bp, Sorghum bicolor
  Clone ID: 14689026
gcacgaggctcccttcctcaggcagcagcagccagcagcccgccaggccgccaccgcgtgagttcgctgggggctacaaatcccgccccgccccgccgccgcggcatctcatctgcatccacggccacagcggaggaaaaaggaaaaagagagcggggaaccgggggaaggagtgaccatggtgaggctcccgtacgtgaccgcgctcaccacgctcttcagctacggcctcctcttcgccttcggccagctccgggacttcttccgcaggatcctcgacgcccgcaagcccagcaacctcaagggctacgcgccgatctgcttgggtctagaggatttctacacgcgccgcctctatctccgcatccaggactgctttg

SEQ ID NO: 23293 - DNA, 548 bp, Sorghum bicolor
  Clone ID: 14689033
gcacgaggccgagggggaaggcgccgctgtcggggaaggctgtcgtggcgctgtgcgtgacgagcttcgttgtggggctgctgctcagcggcaatgtgtcgctcatgtcggcctcggcgtcggtgtcctcgagcagggacagtgccgagaacgagaagagcattcgtgtttccggctgcgacaacaagcgtaaactcggagagaaccaccccaacgatctcctgaacgaggtgtcgaggactcatgaagcaatccagtcgctggacaaggcagtgtccaccctggagatggagatggccgtggagcgcgcgaggagcggcggcggcagcggcgcggccgtggcatccggcggcaggactccccagaaggccttcgtcgtggtcggcatcaacacggccttcaccagcaagaagcggcgcgactcgctccgcgacacctgggtgcccagaggggataagctgaggaagctggagcaggagaaggggatcgtgatccggttcgtgatcgggcacagcggcacgcccggcggcggcgcgctggaccgcgcc

SEQ ID NO: 23294 - DNA, 500 bp, Sorghum bicolor
  Clone ID: 14689035
gcacgaggcacagaggaggtgtgcaacaagctagtgagggagatagaggaacacaagtcagagatcgaagccttgaaacaggattctgtcaaactgcggggtgagctggatgaggataggaaattgctacagatggctgaggtgtggcgtgaggagcgagtgcagatgaaacttgtcgatgccaagctcactcttgaggccaaatatgaacagttgagcaaactgcaggaggatgtggaggcttgcatttcgacttttagctcttccaaaggagacagcacaattgttgaagcggcacacaacattgtacaggccattgagtcggccagagaccaagaggttgaattcacgtatgagcctccaagagcatcagaagatatattggccatctttgaagagctacgcccaagtgaagagatggagacaaaggaaactgaaccatgcctgaagcaagaaatccaagaagctagcccaacagctgatatatttctggaagatcg

SEQ ID NO: 23295 - DNA, 464 bp, Sorghum bicolor
  Clone ID: 14689069
gcacgaggatggagttcaacttacagcaaacttatacctgcccccagggtatgatccatcaaaagatggccctttgccatgtctagtttggtcctaccctggtgaatttaaaagcaaagatgctgctggtcaagttcgtggttcccctaatgaatttccagggattggtgctacatctcctcttctttggttagctagagggtttgctattctgtctggtccaacaatcccaattattggtgaaggcgatgaagaggccaatgacagatatgtggaacaactagtagcaagtgcagaggctgcagtcgaggaagttgtcaaaagaggggtggctcaccctgataaaattgctgttggtggtcattcatatggtgcattcatgacagctaatctgctggctcatgctcctcatcttttctcctgcggaattgctcgctctggagcttaaacaggactctaaccca

SEQ ID NO: 23296 - DNA, 505 bp, Sorghum bicolor
  Clone ID: 14689096
gcacgaggacttcttgacatgcctgctactcctgctagcagcatcggctgcggcggccgccgccgacgttgagagcaccagcggccgatgcgtggacagctgcggcggtatgagcattcagtacccgttcggcatcggcgccggctgcttccgcaaaggcttcgagatcatctgcggcgacggcggcaggccggtgcttgccggcaccacgatgcccatcccggtcaaccacctctccatcaggacggcggaggcccgcgtgacgctgcccatcgggtgggagtgcttcaacgcctccgacgaggtgcacgcctggagcgacggcgacgtgcagttcaaccaagaagacgtgtaccgcatctccaacacccacaaccatctcgtcgtcgtcggctgcaacaccctgggctacatccagggccagcggacccaaggcagcgacgactacccgttcgcctactacaccggctgcatgtctttctgcaacgactcccggagcgccgtc

SEQ ID NO: 23297 - DNA, 459 bp, Sorghum bicolor
  Clone ID: 14689111
gcacgaggctaattgacaagatcaaggattttgcaccgataatatacactcccactgtcggcttggtctgtgaaaattacagtggtctgttcagacgaccccgtgggatgtatttcagtgcaaaggataagggggagatgatgtcgatgatttacaactggccagcagagaaggttgacatgatagttgtgactgatgggagtcgcattctaggcttaggtgaccttggtgttcagggcataggcatacctattggtaaactggatgtttatgttgcagctgctggtattaacccacaaaaggttcttccaataatgcttgatgtgggaacaaataatcaaaagcttctggaggacaagctatatttaggactgaggcaacctcggctggaaggagaagaatacttagctgttgtagatgaattcatggaggctgtccatgcacgttggcctaaagcag

SEQ ID NO: 23298 - DNA, 539 bp, Sorghum bicolor
  Clone ID: 14689112
gcacgaggcaagagaagagtaggttgaatcttctgaaaattggtgatcaagaagcatatatgaagatggtcgaggagagcaagaacgaacgtctgaaaatgctcctcgacaaaacaaatgagcttcttgaaggaattggaaaagctgtacagcgacaaaaagatgctgagcatgttagtcagccagaagggagtgaagtgccaaaaggttcagagtctgaggattgttcaggtgtcaagagtgaatcacctggggagtctccttcagatgatgatgcagactttgctggccctgcagatgaaagtaaattcaatgcaggtcgtagacttgatttcactgtccattccattgaagaaaaggtaacagaacaaccatcagctcttgaaggtggggaattgaggccatatcaactggagggtctccaatggatgctttctttgtttaacaacaatttgaatggcattctggctgatgaaatgggtctgggtaaaacaattcaaaccatagctttgatcgcttatctgttggaaaagaaggag

SEQ ID NO: 23299 - DNA, 494 bp, Sorghum bicolor
  Clone ID: 14689125
gcacgaggctcccctttccttccccttcaccggcaggcacgcacggcacggcacggcacggcaggcttctctccctgatctgccctgccctgccctgcctggagtggagtctcgctctcctcgtactccagcccgccctgccctccgaccccgaccgaccaccgctgccgcagcgacacctacacgcccgcccgccgcggctgagcctcaaccccagatctcacgccgcggccaccagatctgcggcgcgcccgccatggacgccggcaccgggggcggcgggccaacggccatccgcgtgccctaccgccacctccgcgacgccgagatggagctcgtcagcctcaacggagcggacgcgggcccgacgccgcacaaggacgcggaccagccgcggagccgcggcgccaacgccgacaggaccaagctcgtgcttgcctgcatggtcgccgcgggcgtccagttcgggtgggcactgcagctctccctcctca

SEQ ID NO: 23300 - DNA, 523 bp, Sorghum bicolor
  Clone ID: 14689126
gcacgaggggaatgtccaccatggagcgccaacatcttcctccttcctggcaaggcaatggagatgccgatgccgaagtcgaggaggaggaggatcatctgtggccaacaaaagatggccctcttccaatattcctcaagtttgagaatgtggagtacagggtgaagatgactatgaagaaccccctcacagctgcgagagtggcttttgcatcccagatgaaggtagatcagggcagcagctgcaagcacattctcaagggcatcgcagggagtgtggaccctggtgagatcctggcgctgatgggcccatctggcagcggcaagaccaccttgctcaagatcctgggaggcaggctcgatggtggcattaagggccagataacctacaacgacactccctacagcccttgcctcaaaaggaggattggatttgtgactcaggacgatgtcctcttcccacagctgacggtggaggagacgctcgtattcgccgccttcttgaggctccctgcttgcatgtc

SEQ ID NO: 23301 - DNA, 470 bp, Sorghum bicolor
  Clone ID: 14689132
gcacgagggtgaccaccgcgccagatcagggccaccacccaccgcattcaggggcaacagcaacagcagccaaggaggggaagacgaagcagtggcagcagcagcggcagcgagaacccgacgccgtaatggcggcggggaggtgggggaggcgtcgccctgagcccgtctttcgcagctgttcctgggaccttctccgacgaatggcccatcaaggagtgcctaagtttggaagctgggaggatgagggtgatcacctttacacacagtatttcgaaaatgctcgtaagggcaaatctccaggtagatctgctagtcagaatgaccacagtggagacccggaagcactctccaaggattcaccatcagctaaagcttctcccctgaggactgggtcggatcctgtggtgcaaaagcccaaggatgaaagacgtgccaacagagaagatgatcttcgtcggcacgagggc

SEQ ID NO: 23302 - DNA, 500 bp, Sorghum bicolor
  unsure (1)..(500): unsure at all n locations
  Clone ID: 14689134
gcacgaggggttaacaaactgcttagatggtggacctattgctgatggaaaggctcaaagtgttcactcgagaggtgatactaagatgtatgggtcaaacacaggccgtgtagcagttagatctgctacaacagtcagccagtctgaaaggtgcaatgatgccctaggtgatgatatgttaaatatcagaatgaagaacacaggttgggatatgatgcctgaagatcaaaagcactctcaacatgatgcaagggacgtgactgattcatctaaccggtgtgttttgagctcagatgcagctagagatgatgagtcgctgcgaaaaaggggactatcgaatagagatcttcaacgagtggagcggcaaaaatcatttgacaaaccccagaggaatgaactgagcagatctgatgatggttatggctcaggctcanaatctgaaaggacaatggactctcatagatcacatggcatgtatggcacatcacggcatgttcaga

SEQ ID NO: 23303 - DNA, 438 bp, Sorghum bicolor
  Clone ID: 14689156
gcacgagggtagggagcgaccttcccccgtgcgcgaggacgcggcggcggccgccgtcaagcccagcggagcgccggtcaccggccgccggccgtccttctgctgctgacctcgcggttcccgtttcagcagtccacaaaagcgccggcaatattcctctcctgcaaccatggacgatgccaggtcgcagcatctgcttggtgctgcaggcccatggattcgcgggtctcgagaaatggggggctgggaggtggcgcaggacttcactgtcgaggacgccaaagcagtctgcgagcttgtgcatcgagatgaatccttggtcgttgagaaacggagatatctgctgtcaatgcttcaaggacaagatggatgcatcaagcgtgtgaagagacctgagttcatggaacaactatttttggctgaatcagatgtcagggg

SEQ ID NO: 23304 - DNA, 124 bp, Sorghum bicolor
  Clone ID: 14689164
gcacgagggcagcattaggtacatcacatgaggaaatatgcgaggacatcaagaatattttgtacacggatagtgctgtggctggtgaagcagctggtattggcatgggtttgctcatggttgg

SEQ ID NO: 23305 - DNA, 297 bp, Sorghum bicolor
  Clone ID: 14689166
gcacgaggggtgatcccccagtcacttactaatctttcttccctgagggaaatcaaccttgggaccaaccacctcgagggcaccatccccatgggctttggtagaatccatggactcgagtcattcatagtggcaggaaaccatatctcacgcacaatccctgcagatctcctcaatgtgtcctcgctgataatgcttgcagagtctgacaacacgatgcacggtacactaccctctgacatgggggctggcctacccatgctcagatatctcctcctgagcatgaaccacttctct

SEQ ID NO: 23306 - DNA, 548 bp, Sorghum bicolor
  Clone ID: 14689220
gacgcggacaacggtaagcgactggaaagctctactggcaggatcgcgacacgcgacatcgtccagtttgtccccatgagggaagtccaaggtggggagatctccgtcgtgcaatctcttctggaggaactccccggtcagttcctgcactacatgcgcactcgcgggatcaagccacagcagcagcagggggcggggcttgcttcagcgcccgtttaccctcctcagcagtgaccaaaagaaaatgtgccgcgctcggaacgagctggtccctttttgcctccaactgtggattccgctagcgtcccatggtagcgtagtactctttgttcatatagcctctctggttagcttttttatcctggccgcagttggtgcatatccaaggccgtagaatctagatccagcacaagtagacactgctttcctctgggttaagcgggacgaagtaaattcgcgctgcacattctgtcaagcattcaggttgttcgtgaaacgtgattattatcccctgcttccatattaagtacagtatattgaacgttggg

SEQ ID NO: 23307 - DNA, 465 bp, Sorghum bicolor
  Clone ID: 14689232
agaagccgttccgcgacgaaatcaatcgggagctgcagcgggtgggccggggggtcctctacatgtgcaacggaggccccgactccaatacttctcagttcattatctcccttaagagaaccccctggctcaacagatgccacacggtctttggccgtgtcgtcaagggcttggacgtcctcaaggccatagaggaggtgggctcgcgcagcggaactactacggcggaggtaaagatcgccgactgcggtgagctgtagcctggaggtagagatgcccgcccgcgatgacgatgagctcctggatctgaactgatctctacctcgctaagtcaccggtgctgctggatgcttttgtgttacctttgtgtttcgaggaatgttcgtccgtggtttaatagcttagtagtttgttaagttctagatctgcaaatctgatggtatggtctgatggatgatgtctctg

SEQ ID NO: 23308 - DNA, 497 bp, Sorghum bicolor
  Clone ID: 14689244
gatgcaggtgattgaaaaggcgcaagagttcaaaatatttattgataaatggaggtataagcaagcattcatggaaacccccaagaaactgaaagtggcaaagctaagaaagcgaaacttcaggaaaatggaagccctggtagctttcaaaaattgggctggtatcaatacataaagtcacacccttgatttatctccctgttatgtgtccgattgaattcatcattttcagaaagctgtagcaagcactacggatctttagagatggttaaagtaaagctgtgataaatttgtaccaaggttatataaattggctcacttaagctctttatgttatttataggacgggatgtttactttttgtactcggtagctatactgccctgtttaggcactagttttcagtaagacctggttcgaactccagcccatgtataatactgaaatgatcaatgacgagtttttcttgaaatcccttgctgaagtgcatttctttt

SEQ ID NO: 23309 - DNA, 527 bp, Sorghum bicolor
  Clone ID: 14689284
cgaggtcgagcacgtcgacgaccggagcatgtgctgcgcgacgcctccagcctgcggctgcgtctctgtgtgtgcgcagactgcgagtggaagaagcgagctgggaacgtgtgcgtggcgtccttcgactggtcgtgcagcggcgtctgcaagtcggtggacaggatgcggcacatccacaaggcgtgcggcgaaggcgaaggggccgtctggaacgccgccacatgagattggctatctcgccggaaccgttgatgtatgtgtggagcttcacttattggcgtccaattttctgaaaatgcgaaggcgagagggaagagctcttgaaccactgtttaccatgaacattccgcatggcgagtatggtcgtttcacttgagacgtcatgttgcgatccacgtaaaagcgcatggattggtgtgtgtgaatgtgattgtagaaacagagggggaaatggtacttgatcgaccaactgcagtaaagctgctgcttactaatcatgattttattttggccctttctgatcc

SEQ ID NO: 23310 - DNA, 580 bp, Sorghum bicolor
  Clone ID: 14689285
tgaggtgcaggaagctttccatgccaatgttactggaataccatatgcctggataggctgcagtgacccagtatatgaatattggcaagattcaccgaggtccatgcttcctatttaccgtgaacttatctcggcgggcctaaggatatgggttttcagcggtgatactgactccgtcgtccctctcactgccacaagatactccattgatgcgctgtctctaccaacgatcacaaagtggtatccttggtactacgatgaagaggttggtggatggtgccaagtgtacgagggtctgacgctggtgacagtccgaggtgcagggcacgaggttccccttcaccgtccacggcagggcctgaagctcttggagcacttcctgcaaggcgagcccatgcccaagtctgtagagagcgtccagtcgttctagaagtagtttctcgatcgcttggcttgatgaataaggccggactttggcaagggatcttcacattcgccaccacatttttaggtggacatccatgtatgtttccatctgttgtccaatcaataatcgacggtttattaataaaacttcttt

SEQ ID NO: 23311 - DNA, 583 bp, Sorghum bicolor
  Clone ID: 14689286
tacaaaagatgttccggagatgacaaatgcgagattatcaagtgcaagtcttccaaatggtgtgtactctaccaccagaggctcaaatctagatatgggagacagcacccctagcacagcgcaatggagctcaccggactcaatgaacagccagctcaatcggggtttcagaggctgcatggagatggttcagaggcagagcctgaaggcaaagctcctagaagctcggatggagagccagaagattcagctccgtcatgtgctcaaccagaaaacctaagttagaacctcactctgcggcaataaataaaattccaagcattggatctatttcatttcccttgtccattgtagtatgtagcttagtctcatgtgcttctgcttcatatcatagaactatatagctagctgtagccttgtaggctgacccggccatggttgatgcatctgtctaaacaagaagcaccgttcagactaactgtaccagtaatgtagcagcaaaccagaagcattgttcagacaaaatgtaccactggcagtgaagaattgtaaaacctctgagaatgtgttttcatttgaagcg

SEQ ID NO: 23312 - DNA, 517 bp, Sorghum bicolor
  Clone ID: 14689295
cgtctgaaggctaaaattcaggagatgaaggaaaaggacactgatcccctgagcgataaagatggcaactcacatgtctgcaaagtttgcttcgaatctgcaactgctgcagtattgcttccttgccggcatttttgcttgtgcaagccttgctcgcttgcctgttcggagtgccctctgtgccgcacaagaatagcagacaggataatcaccttcacatgaactgcgtgctagcttcaggtcattctgaagcacgcattctcttgtaaaatcgccagtggtatatgtttctctttttccttagcaaagaaggtgccttttatgttccttctgtgttgtatcgccattctttgggttcccctctatagcttcaccttacgttctttgttgtatcgaggagttacaaatgatgacttctcgctctgcaaatatgtatagatatgcgactcgacgctgtaacacattttgattgtctgcccctgaggaaaagcagtgaacgacataatgacgtgtgtgt

SEQ ID NO: 23313 - DNA, 504 bp, Sorghum bicolor
  Clone ID: 14689349
cattacaaggaagaaggcctcagattctaatggtttactaagcaactttctagattgttacacaaaggataagaaagtgattgagcttgttgactctgaaattgcagtaacagggaacatggagcttcttcatagtgtggctggaatgattttgaagtgcctagatcttaatgtcgatcaaaggccagagatgatagatgtagcagagaatcttcgcttcttgttgaagagatcgcggagagaaaagattgaaatatgatattcttgtggtgagttgataaaatgatatcgtttgaagttataattgtggaagatgaaatggaatgaagttgtgagtactaaacttaaaggttatatatccaaagaaagaagtgagatttctgtttgatctaaagaaatgttttgttttctctaagcgtgtgtttttgctggactgaaaacgacgttgcatgtaaagttattctgtttattatagataactgcatatatgcatcgcttttattt

SEQ ID NO: 23314 - DNA, 417 bp, Sorghum bicolor
  Clone ID: 14689351
ggcctttttcaaagtaagtcatgacaggaagtaatctaagttgtttagtatacatcaaaagggtactgcaggaacatggtagaccttttgatctgaatctgagggatatggatccatgtagccagccatccaaacggttcgggggcatggaaaagaggagagggtatatgagggccaaacttgcagattggactcttgtcacagtatatagttaactagagagaaagaaaaagctgatgctactcctgaatgcaggcgctgatggaatgatatggtatatttaagttgaggccacagcaagtccaaatggtattgcaactgtaggcaggctgatggtcatgggtgctaaggtgataaattggtgttgtaatccttgcagctacgaaacgattgttcagaatgaagttgaagcttttg

SEQ ID NO: 23315 - DNA, 586 bp, Sorghum bicolor
  Clone ID: 14689364
gcatcctgtggatgtgcttggacattgcatgggtcacttgagtttgcttaatctgcctcttttgaatacatgaagggatccaccaatgacaactctgtattaactgaggccactacctaaccaattctgatattgtttggtgatggcaaatacttacaaaaggttgcactggttgttttgaagggaacaatgacgacttggaatgttgtttaccgaggaaagaagcctagggtttatgattcctggcctctttgctgtgatgctgttgctgggtatagtaacaattgctacaagggcttcaatgcaaagaagctgttgcttcattcctggagtacacggggtttgaagatttctctatggaggaaaatgtgatgagcaccccatgcattactgctggggcaaccacacacacccaaagaaccatcctttatttgcaattgctgtgtttgtggctgttgtactgattagcctggatgtttttcttaccactcgttgctgcaagtgtgtctaatagttttgtactgccaatgatggttgtcaaatgactaacgaattaaactgaggccaagactatcttttctgatct

SEQ ID NO: 23316 - DNA, 405 bp, Sorghum bicolor
  Clone ID: 14689365
taccaaacacgttgcagccggatgaacagcaatgcaaggaacttgggtggaaattgcagggataacattagcttttcttgcgatgttgttgtcatggacaataggattaaccagtctaactcaatggcaaaaagatttgtcactcggaaaggttctcagattgatcaaacaggcattctatgtggtgttctggtgtggcggcactgcatttttccttcacatgtcagaggcgttctgaagtccctggatgcatcgtatcttctgattgtaaatcttaagctgtgaagtgcacactagtattacgatctcatatgtgtagactgtttttcatcatgtcgtttcccaggattgacacatgtgttgaagattgtattgtataataagatgccccttgttttcgcagcc

SEQ ID NO: 23317 - DNA, 446 bp, Sorghum bicolor
  Clone ID: 14689366
tcggcgctgcagtcgtccgtgctgctgttgctgaagacctggctgagggctgttgcgatgtgggtcctagggagcttgggagcatgtctgagtcggaatcagtggactacgtcgctcggaagatgtggtaccctatttacagcccccttgtgagcgacaaatagatcaaaaaaatatcacgccctgcatagaaagaagcagatgttccattgaaggaatatatcagacttaagacatttgttttgactactttttgttaaccatttctatagctgctcatctagaaagcatttcggcggagattgatgcccacgcatggctattgtaaggccacattcatttgcttagacatggtttcgtcaccagggaacactcagcttcatactgccacaggaaccgtgcgtttcatgattattgtaataagacaccggagtttcactctaaaa

SEQ ID NO: 23318 - DNA, 399 bp, Sorghum bicolor
  Clone ID: 14689385
ctgctgctcaaagcgcagtaccacggccacctcacgtacaactgcggcagccggggcggatgccagcgcctgcagtcgtcaccgtcgttcggcacggtggacctcgatggcggcatgcgcgaggtctggatcctgctcgccatggcactcgcttaccggctcctcgcctacttctgcctcctcaagcggatcagcctcacgcccttgtgatcacccacttacctttacagccaccgatttcattctaattagtttggtatgcaatgtcgtgcttgtgaatgaatactatatagagagagtttattgatggaaaatgactgcacgacgatgtgtatcagcaatgctttgaggctgctgggccagtttattacatatatgacagataggtgtatttggctg

SEQ ID NO: 23319 - DNA, 584 bp, Sorghum bicolor
  Clone ID: 14689393
ggaatactctgatagatatgcaaatcattctgtcaagccatatgaccggagtggtgctgtaaagcaattcagaaataatactggagataaatttcggactcgtatttctgctcctagatcgccagaactccagaggagggtgagtcctcggagatttgacagaagctttgagaggtagctgactagctggctatgaatttgccttgtaggactaaaatggaaaataaagatctgtctggatgattgaaccggaaaatgttgcaaatccttgatggagttcagtcattgggatttgatggaagactcttggcagcactgcttttttctgcttctgctgcatatgttcaaggcacagaaatactggaaccatgcacttctgtagggggaattcagattaacttcataattttcctgtttcaatttgtaaatatttatgtcggtagcagaatcacaatcacttctttcagctttattatagctgttcttttttgtttctgatactttctcatgtttatcccttttgctttttttcaatgggcattatccctgtacgaggtccatttaaacatgatgaatcaattaat

SEQ ID NO: 23320 - DNA, 508 bp, Sorghum bicolor
  Clone ID: 14689413
cattggatggttacaaacatgcaaattattctcagcaaagtttcccaagctatcgtggacaaccatttcagcagtacaacaacatgacttccagttacatccatccgacgagggctcatcacaatggtcaacctgtctggactaattatagcctgacagaacctccacccactaccatgggtgacggaatgccctggggagggagagctggccattcatttgccgcgagcgggctgccacctaccgttaggaaggattttggaaggatcttttagtcctgaatctggaggaatgcggaatgccaccaaattgatggcatcaattgtttgcatttgcaatgccaggttggattatttgcaggggtggttactggttttgcaatttgttgtgttcctccgatctctctcccaggatgttcgattcaaatgattatatggtatggtatgggatataattatagtgttcgttctttgctatacctgcacgatgcagtagaaagaagtcagct

SEQ ID NO: 23321 - DNA, 477 bp, Sorghum bicolor
  Clone ID: 14689415
gtggaaacagcaagttgttctaaagatctccatgatcttttgtgatgagactgcagtgatggcccacaagcttgttggacagattatagaaagttcgttgcatgcagataccaaggaggttgatgaatgcaccagaggttatcttcgagggggttatgattctcaaggccctcaagctcctgcagtggaggatacgcaaagtgctgacattatgattaatgctgtcaagactttgtttccaaatttatcagaaagctgctttgaaaaggtccggaggatcctcaatggtggtgagcagtgaggagccttagagtacattgtgctggctttgcaactttatttttgtttgtactctagactgtgatagtgtggcttgatatttaccttgtggtacgtacaactaatctctttggagtgagcataacattaaagcacaaaataataattaaaaagggattgaattcattcttttaactg

SEQ ID NO: 23322 - DNA, 175 bp, Sorghum bicolor
  Clone ID: 14689425
aggtttcaaattggatagcttgtatcagagggttgatactgctgtgtattacatcttgggagtaagaatgttaactgttcctgcatgtgcttcgtgtttagggtattcaatgaaagtgattgcagtctaaaagcaggtaaaatgaatgagctttatgtacagaaaacaatacaag

SEQ ID NO: 23323 - DNA, 164 bp, Sorghum bicolor
  Clone ID: 14689465
gtaaatgtgttggttagacgtgctccccagaaacggtgggaattttgttggggggactcgttttgttatgtccggcagtttcccccaaacaggagaaggtagaattggttgtagcttggtagctcgaaatgttgagttgatgtaaatactgcttgacttcgacg

SEQ ID NO: 23324 - DNA, 170 bp, Sorghum bicolor
  Clone ID: 14689491
cgcaattggagttgggttctgatccatgccagacagttgctggaatgtgatgcctagttaggtagtgagtgattgagtttgtgagtctgttgtgtaatagtagtgagtggttctttgattgtgctgtgtgctgttatgtgatgtgtggaccccaccaaataatagcatgt

SEQ ID NO: 23325 - DNA, 478 bp, Sorghum bicolor
  Clone ID: 14689519
gcacgagggtggatccccggccaatagttcaggcgtacatggaaccgccgcggaggtcggcgagaatagcgtcgatgggtctaataagcagtcgggaagtggaagcggagccctgagcgatgctgctgccggacatggcagcactgtcagagctgaggccaacaaagttgcaagtgatgtttccaccaatagttctgcggggagtggcaacttggggaaggtggatttgagcaccggatcttctaataatccggcagggagtggaagtggcgtttcaggcagtgattcggatgctggaaatagcagcactgtaaagcctcatgctggagatgctgttggagctgggagcaggggttcttctggaaacggcactgataccaaggttaatctgaataaaggttcagatgctcagacaggaaactcaaatggagatgcaagccataaatcggatgtaagttctagtttggggaagaaagat

SEQ ID NO: 23326 - DNA, 427 bp, Sorghum bicolor
  Clone ID: 14689521
gcacgaggcttaaccctaccggctacctctgtgcccggaacacagccgccgccccccgcctccaagcagcaaggcagcaaccatggcggctttgttgcttcttgccgcctccagcacagccgtgaaccgctgccggctcctcgtctctcctcccagtcttcggatgtgccttgcttcattagttcatttccttctagccccgaatctacgtgttttctctactttttttttccgctgccaagtgatgctgggaatattgcgcaagggctttgagcaattagtggcttgtgtttgcctgatgcgatgagatcacaagagatgtattatcccttctgatggcagcagttcatttgctttgtggttttgtgaggtgttgagcaagagagcatttaccttgccgattctgcttgtgcttggttttttttcc

SEQ ID NO: 23327 - DNA, 201 bp, Sorghum bicolor
  Clone ID: 14689524
gcacgaggctaatcctccccttctcggcttcttcgacgaatttgtagactttactttcttcaaatccgtaatggacctgccagatcgcatcccacccaggcacttctgtccgccgatcgttgatgagaagggtggctgtgaccgtaaacattggagaaacttcggatgtcaccatggccgcgtgctcctctacaaccggaa

SEQ ID NO: 23328 - DNA, 626 bp, Sorghum bicolor
  unsure (1)..(626): unsure at all n locations
  Clone ID: 14689529
gcacgagggttaatgttcgttttcatttgccccttctctctaaaatacaatcaatcgtaggcttacattcagaacctagagacaagcaggattaggctgacccagctggagcaagacttacactacagatccagaactcagggagcagtgttcggtggtggagctctttctggttgcagtggcggactaagcccagaggcggcatggttcgacatggagcacgcgaggtggcaggaggagcacggcaagatgatgcgccacctgcgggcggcgctggaggcggagcacgcggcgtcggcggcgtcgacgtctacggcggcggaggcacagctcctccggcagctggtggacgcggccgcggcgcaccacggcgtgctggcggagctgaaggccgtggcggcgagggccgacgcgttccacctcgggccgggcgcgtgggcgtccgccgccgagcgctgcttcctctggatcggcggcttccgcccttcagagctcatcaagatagcggcccggcacgcggagcccctgacggagcagcaggcgatgggcgtctgcggcgtgcagcantgggcgagggacgcggaggcggcgctggaccacgagctgcaggcgatgcaccgctccgt

SEQ ID NO: 23329 - DNA, 430 bp, Sorghum bicolor
  Clone ID: 14689546
gcacgagggtgacaccaacctccaccaccccagtgtccaccgcttccgccgccgcgccggcgcccggctccggccgcggcggcgtcctccgccttctccgctattccgcttgctccctcctcccttcggctgccgcggccaggtcaggcgcgcggctgaccaccgcgctccgcgcaagaacccagccggcggagcccgagctggtggagcagtcggtgaacacgatccggttcctggccgtggacgccgtggagaaggcgcagtccgggcacccaggcctccccatgggctgcgcgccgctgggacacgtcctgttcgacgagttcctccgcttcaacccgaagaaccccgcctggttcgaccgcgaccgcttcgtgctctccgccggccatgggtgcatgctccagtacgcgctcctccacctcgctgg

SEQ ID NO: 23330 - DNA, 592 bp, Sorghum bicolor
  Clone ID: 14689563
tctggccatggtaatgatgttgatgatatgatggaagggccatcctcttctaaggaggacaatggttcagtaagcaaaggagataagcagaatggtgaaaacatgaatcctaaaaagaacaaaaagaccaagaaaggcacagaaaagaaaacaactgtttctactgaccagaagggtacatcaaaggctgaacagaagagcacatcaaaggggaagaaacaaaaggaggtctcaaaggcacccagtaatgattgtgaaacttgtggtggaacttttgagtcaaggaacaagttgttttctcacttggaagaaacaggacacgcaatgcttaagacgcggcagaaaagtcgtcgatgagggaaataagttgaacttccaagcactttgtcacttgttgattctgctagttaccacataacagcatgattctcttaatttttggcccaattttgatatgtagtggaacagatttttttcctagcttctgtatgtgtagtgtggagatgatgtttttggttacaatgccatatggtacagggggagaagacactgataattacaataataacgttatttgtgcgatcggttaaaa

SEQ ID NO: 23331 - DNA, 532 bp, Sorghum bicolor
  Clone ID: 14689573
gagtcaagattcattgagaagcttgtcgaggacgagactcaaatggaaggcctcacagacaactgcactcgggttatggtctggaatttcgacttggaacctccacagctgaattaccctactggctggctgctgcagaagaacctagacataatcgtgcctataacctaaccgcgatgttgctgctctttttggtcgctcctcctagtgtggaatgatgacgatgcctatgccttcctgaacttggtagcgtccaggatcatgcgaagctgctctgccaagatctggttcgaataatgtgatactagtaacaacagctgaaagcaaacaagcctgcctgacaaaaggaaaaattctttctcccccgttgcgctgcattttctcaatgctcttcaacctagataggcttgtatatttcttttcctttcatttttctctttttcccgttcattacatacacaatgcatacatacaaacatacatactcatattcattcattcataagtacatacatacatatatacatcttac

SEQ ID NO: 23332 - DNA, 258 bp, Sorghum bicolor
  Clone ID: 14689577
actttcttaccctgttgggctattcctcgagtaattgcccggcatgttccaatgcggtattgtttgaatatcggaggagaggaatggactttgtgatgcaagtgatcaatgaaccaacttatttggaagacctaaccggcctcccggacttgatgaaatccccattttactcgcaggtcgagtgggtagatgaaactgatgaagacgaatttgtcgaggtttgatatattacaatggttttgacaactgcaaatacaa

SEQ ID NO: 23333 - DNA, 629 bp, Sorghum bicolor
  Clone ID: 14689581
tgcgtgagatgctatcagaaagagggtggctgtacatggtagcccttgaagataatgatccttcagatatatgccatctgatgagcgagatggggtatgcatcacgtgttgtcttgaagaggtgtactgaggaggagagcctgtatgttctcaagttctggcgagatccgcatgctgtttcgagcgcatctcctaaatcttcaggctctgagtcatggttttctcagttgcctttcaaatccctttggcacaagaactcgtagcatttcatggccttgccagttcggagtcttcatcagctccaaaatatagcaagaagtcttttgcatattcgagatggcagtatgtttagatgtgttcgaatggaatgttactgttggtttctgattgcctcaggcactcagagtgcaagaatcattctagcctgatcggtttaaggcgcaaccaaaacatgtccttgccagaaagtactgaacctttttttttgtagcttaaatttttatcttatgttctcttcgtgtgtatatattttctacgttgctactatggattcattatcttgctgcatttggaatttgtgttttctgtatcaattattgcgttatttctgtgtgctgtatttacttgtg

SEQ ID NO: 23334 - DNA, 548 bp, Sorghum bicolor
  Clone ID: 14689606
gaaaatattgaagacaaaccatttcactaaccttactgccaatggtgctggatatccaatggaaacgctgctcaatatgagcatatcagctaacataaacttgataccgaagcacacaaatgacaccacatccttggagcagttttgcagggacacagtaacaaccatctggcactaccatggtggatgccatgtaggtaaggtggtcgatcaacactatcgggtgattggcatctcaggcctccgtgtgatagatgggtcaaccttgtttagttcaccaggaacgaacccacaagcgacagtcctaatgatgggcagatacatgggagtgaagattctaagggaaagattaggacgagcagctggagtataacagattcatggactttatccagttcattaagtaagaatgtgatttaggagataagtacatagtaatttttgaagcgattcatcaaatcaccaaagaaagaaaagctaggggttcaatttgtattgttattgttcgtataggtctatcacaatccataactgtgtattggttccac

SEQ ID NO: 23335 - DNA, 481 bp, Sorghum bicolor
  Clone ID: 14689609
tggatcacccatatggaggtgttcacgagatgatactattgatttctatagaattaatttacagattggtccaggttcttccaacttcctttggagcagagtaggagatggagctgctgcatagcccaatctgactatccgagtattcttcaggcacgttgaactttgtttctacttttatcttactgtaaaatcctaccacggtataccatgtgcagcacatatccttcagaaaaatgttcataccagctgttcgtaattatatatatgttcattgagataaaattagaagttcaacattcgattgatttgtgtgacctcaaaggccccactcttgtatgtgtaacattttgagtgatagatgacctgatataccattgcatcttgtaaccatagctgcctctggataccttgtcattttgcagctctgtgttactgcattatcaatttatcactgctactggaatacccttgttttctt

SEQ ID NO: 23336 - DNA, 679 bp, Sorghum bicolor
  Clone ID: 14689622
agccaggccgtgatgcagggctactacaggaggaaggaggagacggagagcaccatcgacgccgcggggtggctccacaccggcgacgtcgggtacatcgacgacgacggcgacgtcttcatcgtcgaccggatcaaggagctcatcaagtacaagggcttccaggtggcccctgccgagctggaggccatcctcctgtctcacccgtccgtcgaggacgccgccgtcttcgggctgccggacgaggaggccggcgaggtcccggcgtcgtgcgtggtgcggcgtcgtggcgcgccggagagcgaggcggacatgatggcgtacgtggcggagcgcgtggcgtcgtacaagaagctccggctgctgcggttcgtggacgccatccccaagtcggtgtccggcaagatcctgcggaggcagctcagggacgacttcatcaagacggcagcagcctagtgcactgcagacactagggacaagtcggcatgcttgccgtatacagttataccagagctagacagtgcaagatcttgcattcgtaaaccaataactgctgtgtctcatcttggaagatccagctggccaggagaagacgctatcgcagtacaagactttcccgatttaatgtaattcttgttaagagtgagcccgcgagagagttttaaaggggaaactcctg

SEQ ID NO: 23337 - DNA, 375 bp, Sorghum bicolor
  Clone ID: 14689635
gcacgagggcacagcatcactgctacctcccctttgctcatccccagatctccagactccagatctctgctccggtccccgcccgcctctcgcccgcgacaaccccgccgcagcacgcggcggccgcggcgagatgctccgcctgcgggcgttccggccgacgagcgacaaggtcgtgaagatccagctccaccccactcacccctggctcgtcaccgccgacgccaacgaccgcgtctccgtctgggactgggagcaccgccaggtgatctatgagctgaaggcaggtggcgttgatgagcgtcgcttggttggagcgaagcttgagaaactcgctgagggagatgattcaaagggaaagcccaccgaggctat

SEQ ID NO: 23338 - DNA, 559 bp, Sorghum bicolor
  Clone ID: 14689637
gcacgagggaggaagaaggaggaggagaagaggaagaaggagcgagccatggcatatcaggagcctgactgggcgagggcggaggaggaagaggagggactgtacgatgaagacgaagaagaggagatgagggccaagaagaaggaggagctgtactgcgtggcgtgcaataagaagttcaaatcggacaaacagtggaagaaccacgagcagtcgaagaagcatagggataagatcgctgagctgaggatggcgtttaaggaggaggaggaatctttgaaagaggcagaggagggggaaggtgattggaatgaagttgatgtggggtttgattttaagcctacacaggagtcagatgatgagagtgcattttcagatgctgcagaagagttagctgaagaatttgaggaaggtttggaggtgcatgataaagaggatggtgataaggattttgatagtgcagagcaggaggttgggtcatatgacgaggcaagtgtattggaggctatgctatcaagccgcaagagcagaaagggtggttatgtggctcctccagagg

SEQ ID NO: 23339 - DNA, 451 bp, Sorghum bicolor
  Clone ID: 14689643
gcacgagggccccgccccgccccgcccctgcttggcctggccctgtggttcctaacactaacaccaactcgccgccgccgccgccgccggcgagatctccgggtggagcaaacgaggcaaggcagcagccatgtcgctccgtgtgctgaaccctaacgcccaggtgctcaacaagtcggaggcgctgcacatgaccatcaacgccgccaagggcctccaggacgtgctcaagaccaacctcggccccaagggcaccatcaagatgcttgtgggtggagctggtgacctgaagctgactaaggatgggaacaccctcttgaaggaaatgcaaattcagaacccaactgcaatcatgattgcaaggacggctgtggcacaggatgacacaagtggtgatggcacaacctccactgtgctttttattggggagctaatgaagcagtctgagcgg

SEQ ID NO: 23340 - DNA, 405 bp, Sorghum bicolor
  Clone ID: 14689645
gcacgaggggtgccttccgcggcgctgcggctgcgctccgatcccgagcgagcaaataccctcgccaccttaccacgagaccctcgcaccgctccgacgcgatcggcgccgtcgagccacccgagtctccccttgcgctgccctgttggctcagggatcacatctattaaagaatatggggagaaagaggaaccccattgtctttctggatgtatctgtaggtgatgagccagatgaaagaatgatctttgagttgttcgctgatgttgcaccccttacaactgagaacttcagagctttatgcacaggtgagctgggaattggacagaagactaagaagccattatgttacaagggatcatcgttccaccgtgtcatcaaggggttcatggcacaaggaggtga

SEQ ID NO: 23341 - DNA, 534 bp, Sorghum bicolor
  Clone ID: 14689646
gcacgaggattcacaccactcttctctctcgatttatccaacaacatagattctgaaaacgagacgcttccgttcgatggagatgtggttgacagacaaatgctggagcttaaaagtacaaagttggagccgtttgtggctgcggcagagagtgaagccaccgaagaacaactggttgatgagagtcctccagttcctgcgatgttggatgatgaggcggacttcatcgaagcgtcgcatgtccaaccttctgctaatgactctgactttgttgcgaggaagcagctgataattgtgacgacaacctctgttcgaccacaccaggcatattacttgaatcgtctggctcatgtgttaaaaaatgtgccgccgcctctactgtggattgtggcggagtggccatatcagtcccgtgaaacagcggagatcctgaggtcttctggggttatgtacagacatcttatctgcaatcggaacagcacaaacataaggaagattattgtctgccagaagacaatgcgatttttcatataa

SEQ ID NO: 23342 - DNA, 379 bp, Sorghum bicolor
  Clone ID: 14689656
cgcacgaggcgggggcgccggcggaggacgagtcgctgaaaaacgacgtgtacaccgcggcggcgtacggcgatctggagaagctgcagcggctggtggagggggagggccgcccggtcaccgagcccgacggcgggggctaccacgcgctccagtgggccgcgctcaacaaccgcgtcgccgccgcgcagtacatcctcgagcatggagcagacataaatgctgtggatcacactggacaaacagcacttcactggagtgctgtacgtggtcatattcaagttgctgaactacttctgaaagaaggagctaaggtggatgctgctgatttatatgggtatcaggcgacacatgttgcagcacagtatggtcagactga

SEQ ID NO: 23343 - DNA, 388 bp, Sorghum bicolor
  Clone ID: 14689665
gcacgaggccaacatggagatgcggcacgagtggctcgcgcgggacaacatcgagcgccgccgcggcatgtccgtggagcagttcatcgccgaggtcgaggagcccaacaggccggtgctgctggaagggtgcatcgatacctggccagcgttgcagaaatggagcagagactacctgctggagatctcggcgggcaaggatttcgctgtcgggccagtgagcatgccattggataggtacttccggtatgctgacaatgtccaggaggagaggccattgtacctgtttgatgcgaagtttgctgagaaagtgccggagatggggagggactatgaggttccggagtacttcagagaggacctgtttagtgttcttgggaaggagagg

SEQ ID NO: 23344 - DNA, 532 bp, Sorghum bicolor
  Clone ID: 14689668
gcacgagggttgcttcgccacgaacaaagctgacgcatctcgagctccgatggactcctcctctcgacccccatccccgtcgccagcacccagtggatcccgtggcgcctccaacgccacccagcggtggagcatccttcgccgcgcgctgcttgctcgttcgtcctccgcgcgcgcccaagagggaatttctagtgaccaccagattaaagatgacacctacaacatttcaagaaaggcttcgtgtggctttaacctgatcgaatgccattcactgccgatttcacagctagcgaaatcacttgggaattcattaaatggaaatgaaaatgattttggccagaaggatgtttatgtatgttacaagctgccttgtagagattcctctaaacttgatctggtgtaagtagtctattatttgcccctagttctctggcacactgaatatagttttccttatttctgtccctgatatagttgggaatcgtgttgttttctgtactgtaagctctgtttgtgactacagacttag

SEQ ID NO: 23345 - DNA, 449 bp, Sorghum bicolor
  Clone ID: 14689671
gcacgagggcggtggcgagggcagcgactacgggagctctgatgcagggagctacgagtacgacgaagagggagaggaggattacgaagaagaactggagcaccacctccgtgtccaccaccacgggcacccctcgggcgatggtgagggagagggagagggcgaggccgagggcgccgaggggagcgactacgacgaagagttcgaggaggacgaagaaggggagccggaagtagatcccgcagagtttgaggacgatgaggcttatgcgcgtgcgctgcaggatgctgaggagcgtgaggtcgccgcgcggcttatggctctcgctggtctcagcgattggcggacagtggatgtggagcatgaggaggaccatgtgaatgatccacaggaggcatggcaagaggttgatccagacgagtactcttatgaggagctagtcgcattgg

SEQ ID NO: 23346 - DNA, 561 bp, Sorghum bicolor
  Clone ID: 14689678
gcacgaggatttaaccaaactgaatctccctcccttcctaaaggcaagcaggtttcccacgtttcagcacgaggcatatgactatatcattattggtgggggcacagccggatgtccattggcagctacgctgtcccaaaagtacaaggtactcctgctggagagaggtgggtctccatatggtaaccgcaacatcacgttactggagaacttccacatttgcctggccgatgtttcaccacaatcgccgtcacaaggtttcatctccactgatggcgtgataaatgcccgtgcaaaggtcctgggtggtggaacctgtatcaatgccggcttctacagtcgggcaaaaccaagcttcgtgcagaaggcaggatgggatgcagagctagtcaaccagtcctacccttgggttgaagagaggattgttcattggcccaaagttgcaccttggcaagctgcactccgggatgggcttctggaagcaggggtctcaccatacaatggatattcttatgaccatctctatggaactaaggttgggggcaccatatttgatgagtc

SEQ ID NO: 23347 - DNA, 527 bp, Sorghum bicolor
  Clone ID: 14689692
gcacgagggcccttcttccacatctacggcatcaccggcatctgctgcgccacgctgcggcacaagggcacggtggtggtcatggaccgcttcgacctgcgcggcttcctgggcgcgctgctgacgcacaaagtcatgttcgcgcccgtcgtgccgccgatcatgctggccatggtgaagagccccgtggccgacgagttcgacctgtcgggcctcgcactcaggtccgtcatgacggccgccgcgccgctggcgccggaactcctcgcggcgttcgagcgcaagttcccgggcgtgcaggtggaggaggcgtacgggctcacggagcacagctgcatcacgctgacgcacgccggcggcgacgacccgcagcaggggccggtccagatcgccaagaagaagtcggtcgggttcatcctgcccaacctggaggtgaagttcgtggacccggacacggggcggtcgctgcccaagaacacgcccggggagatctgcgtgcggagccaggccgtgatgcagggctacta

SEQ ID NO: 23348 - DNA, 372 bp, Sorghum bicolor
  Clone ID: 14689693
cggggaaggttgtggggaagaaagctatcaagagcgcagacccacagccaatgttcgtggagtttgtgttgagtgccctgtggaagatgtacgagctggtgctggagggcggtggtgagagtaatgcggtgaagaaattgattgaaaactttgacttgaaaattccggaacgggagctgaagaacagagatacaaaggctgtgctgcagtctgtcatgagccgctggctgccgctggcagatgctgtgatggatatggtggtggagtgcacccctgatcctgttgctgctcaaggggtcagggttgcaaggcttatgccaaatagggaggttactccagaagatgctgctggttgccctgatgttgttgagg

SEQ ID NO: 23349 - DNA, 552 bp, Sorghum bicolor
  Clone ID: 14689697
gcacgagggcaaatcgtaaaaccccacgacgctgtagcggagagaaaagggggagcgcgcgacgcgaacgcgatcgatgtcgggctccggcgatcgtcgcggcggcgggcctccgggttccgatggtggctgggaaaccatggggaggaagtcaaagaaacaagggcaagtaggtgggagacagtgggcatcatggaattccacaaatgcgacacctaacacagcaaggccagcatggggtggcaatggttcctcgcacccttctggaacgagttgggctcaagcttcagaccgtggtgctcctaacagatgcaatcctagaccgccaccacaaacagtgcgccctgttgtgactccacctctggcaaatggttggcagtggcaatccaggtctcgcacatctggttctgaagtcgagaaggatgatgctcctccatctggttctgaccctgaggtggagaatgttgatggcaacaatgcatcagatgatgaggatgatttgagtgatgatatcagcgatgactatgattctgatgcaagtgagaaaagttt

SEQ ID NO: 23350 - DNA, 216 bp, Sorghum bicolor
  Clone ID: 14689746
cagtgtgtggcacagaaggcatatggtgattcactcaggtttgcaagtgcagaaccagagtgaagagcatgagattgtagagcgcgatgatgtacactcaagtgtacatgcattatggtagagaggagggggtgtttttgtttttgggtgttttgatttaggaattggattattgtaagggggctttttttttttggtgttggaaaagatcccagg

SEQ ID NO: 23351 - DNA, 224 bp, Sorghum bicolor
  Clone ID: 14689747
gaggttttttgcaagggcagtgggttccctccccaatgaattcagggtgggggggaaaaaatgcaatacccttttgtccctgggaaaaggcaaagcgaaggggaaggttagtggccaaaacccaaagcaatagttgggcccttttgttagcgctttgttttgaatgggtaatcccaggggccccaatttgtaaatgccagtagttttttacccttattagactg

SEQ ID NO: 23352 - DNA, 324 bp, Sorghum bicolor
  Clone ID: 14689768
atcatcgattttcctcctcgtcgcttccggacgtgagcagcaatagaacaagccgagaagccattattgatgtatgatatgataggcatttgggagaggtcatacgccattacctgcaaaatgtggggaagcatacggtgcctaggaattgagttcctttcggcattttgaactgcttaatgcctttgcttgcagcatttgaatgctgccagggtgagcttttgttttgttttgaattcctatcgttatcagatccctaggaagtgattttttttcctttccgtttcctttttattttccatgggcattcatttaaaaagcatg

SEQ ID NO: 23353 - DNA, 570 bp, Sorghum bicolor
  Clone ID: 14689792
tgatttgaagcttctaagttgaggtcaaatacatcatgttcatctggaccatcaaagttgataactccatattgttgatggtcttcctcaacagcaaggactgcaataaggttcttgtagtccctcacaaggagcaaaattgagatctatgccatgcacagctctgtgttccccttcatagagatagtgggcttgaccttcttggactcgacggagttcattttctttgagatgaacttgatcttcctgaagatgatggatttcatctccatgctcaccaggaggttcttcattcaggctgaggaagatggagtggattgcatgctggtcagtttggagcaagtggatgcctcacgagcatgtgaagtcttttgtaatggaggcaatggcgcggagttaagatttgaatctccaggcacagttggcgcccgagatgtcctggaagtttccgcaatggtctttgatgaccctttgtttattggcttttgtttattcttggccacacattcgttgtgcaaccgtgttgtgctgccacgtgcttctctatttgggctttgtttagttatattc

SEQ ID NO: 23354 - DNA, 281 bp, Sorghum bicolor
  Clone ID: 14689811
ttgaccccgtcgtcggttagtgatgctgatgctaaaatgctagtaccaggggaaggcttcccttcccatcccaatgggatgtttccttccacttttgctctgttaccagggagggaaggatgtacttcttttaactaggtttatttaggttaatctggcgttagggtgaacggtggcgccggttaccaggttaatgtgatgaagctgattttttttagtgaagtagctacggaatatttttgttggggttgctaattttagggggttcgcttttccagccc

SEQ ID NO: 23355 - DNA, 566 bp, Sorghum bicolor
  Clone ID: 14822810
tccgagacaacaaattgcaggataatgaggtactggctggaaggcccaagaacgggcgaggtagaggtgtttgccaacctgccgggcttccccgacaacgtgcgctccaacggcaagggccagttctgggtggcaatcgactgctgccggacgcgggcgcaggcggtgttcgccaagcggccgtggctccggacactctacttcaagttcccgctgacgctcaagatgctcacgaggagggccgccaagaggatgcacacggtgctcgcgctcctcgaccgcgacggacgcgtcgtggaggtgctcgaggaccggggccgcgaggtgatgaagctggtgagcgaggtgcgggaggttgaccgcaagctgtggatcggcaccgtggcgcacaatcacatcgccaccatcccctacccgttggactagccatgatcatgtttcaatgcctcctagcatgtgtactacgcctatataaatggactggtggtaatcttgtttgtaactaggaggatcctcgtgtgttgccgcgagtatatagtagaactttatttaattgcatagagaat

SEQ ID NO: 23356 - DNA, 472 bp, Sorghum bicolor
  Clone ID: 14822827
ctagagatacttgcaggaagctacttctgtgttgccggagcgctcattggcatcataaatcctgggaggatgactttgtttggtacccttttggttatctggggtctggtgaaagatgcactatttgggaagccagtgaacagcgatccaactcaatcaacttatgtctacccaactattttgattgcacttatatgtgctttcatgtcaataacttacaatgtaaagaagacagcaagaagtagtcctcctgtttctatcgcgaagccactgaaaagttctgccaagtcaaaactgaagtagaccctattacaattttaatccttgtaactcattccaaatatttatttatgtgaaaaaaacaggtttgaggatgacctgaggatgtttttggtgtatatctcacatactgtaacattcagatttctaccttgtattaacagttcacaaggccatgctctctgtcatgttt

SEQ ID NO: 23357 - DNA, 587 bp, Sorghum bicolor
  Clone ID: 14822829
gaggtgtcgaggtggtggaactgaagatggacagcaaatcagcacttgctctggccaagaatccagtcttccatgagaagagcaagcacatcaggatcaagtatcattttcttagaagctgcctggaagatggaaccatcaaagctgagcatgtgtctactactgatcagctcgctgacattctgaccaagtctctgggcaaggctaaattccaggagatgaggggaagaattggcttgaggcagatcatccccaaggcacacaaggctaagggggagaattgacagggttagcctagtgttagcctaagttatctttactttgctgtaatttactttgctgtaattgttaattacctaataggttccttggcagccaagttgaatatggtgccttggcaaccaagtcgctggtggacagcatctgtagtttgttagaagctgtcagggtatgttggggtgctgtctgccctctaggctatatatgcagcagccccctcacccttgtatctgtgtagttctggttttgcaattcaatacaatccaagcggcctctcttggccaagctgccctctggcagttcaatcc

SEQ ID NO: 23358 - DNA, 484 bp, Sorghum bicolor
  Clone ID: 14822832
catggagcttatggaacgaggagaagagcatagagttagcagatgaaagaatgaatggatcattcaactcagacgaagtacagaagtgcatcagagttggactcttgtgtgtgcaggagaatccagacgaccgtccactgatgtctcaggtgcttctgatgttagctagtcctgatgccacctcactgccaactcctaagcagcctggctttgcagctaggagagttctaatggaaacagacacatcatcaaccaagccagactgcagcatatttgacagtgcaacgatcaccatgcttgaaggtcgatagaagttatgactcttcctcaaaaagatagagttatgacaaagacaccttatctaaacttaaactactagggaaatgtgtattgtagagtaaatttggtggcctcttcagtatcttgtgttgtgtgattaagcagcagaaaattatatgaatattaaataatagcagccaggtgt

SEQ ID NO: 23359 - DNA, 318 bp, Sorghum bicolor
  Clone ID: 14822891
cgctggtgtgttgttttttcggtttccgctggtagtagtctaacaatcaatcaacctgacaaaagatggggtgtctgccggtttccttctgcccgtggtaaaccaagccgggtttcgtaatgggggatctgagttttaaacttatggtgacatggtgtggtcggttcggtgtatgggactagtcgagaaatatgaggaaaaaaaagttgtacagcaatcttgcgcttgcgtggtttgtttggagctgtgcccttggtcgtgcgagacctcgagttgtgcccttatttcaataaatatttagctggtgcgtggcggtgc

SEQ ID NO: 23360 - DNA, 465 bp, Sorghum bicolor
  Clone ID: 14822914
ccgccacctccgccgcagccatcgcgcactgtgtgcagaccttcatcaccgccatggacgccgtcaagctcaacatgcttgccaacgaccaggtccgccccctgctgcaggacgtcgccacatccatggccaggctcggccccctgctgccgcccgactttgaagggaaggtcaaggttaacgagtggctgggcaagctgcataagatgggtgccgcggatgagcttaccgagcagcaggccaggcagcttaacttcgacctcgattcggcctacagtgccttcttggctgcgctgcccgccgctggtctgtaaccgggcaaggaggtgccagcttgattcttatttggttggttcgttctattatgcttgacactggagcactactctccactactgtagtactatagatatctgtaattttggtactgctattttgttgttaataagaaagttctgtttcctt

SEQ ID NO: 23361 - DNA, 657 bp, Sorghum bicolor
  Clone ID: 14822918
gttttgtattttttacatttttctatgaattactacgtatttatcaattttcagccgaattaaagaataaaaaaagtaacataatagaataaatactttgcagctagatctctatactttctttattttcaacatgctttgatgtgtataatcaataatagaagattttgcgttaggaactctagaaaaggttctattctttttctcctctccacaagcgatcgaagcggacgacattaggcagcaacggaaggcagacacggcaagcggagcaaactgaaattttaccctttataggtatagatataaaaagtttcttgtgacttgctaaaacttatacataaacattggtatgctaaattttttataatgaattaattgatgactaaattttgtgatttgccgtaattttgcttcagcaaagattagttttttctttttgcaacgagggcaaaaattagtcattcaactcctaaaacagtcgaatagtacgcatatcaaactacaacattacagcaacgagggcaaaaattagtcattcaactcctaaaagagtcgaacagtacgcatatcaaactacaacattacaccaaaaaagtttaaacatgcatcatggagtattgtatgtgtgccagaatataaaagatactccttttc

SEQ ID NO: 23362 - DNA, 540 bp, Sorghum bicolor
  Clone ID: 14822920
accagcaagagaaccatagacactccaacgataataggaattctggcttataggtttaagaaggatgtctgaaaccaccgtcatgaatcaaatgattgtacaacatggccaatacagtcacaaagatcacctgtgacagaatattctcacttgccaggagaagggttcagtgatagaagtagatctagtcagaagcgacataaatcattatctataactcaagactaattcagcgatatagatatgatccccaaagcacagattctgcttgagatcattcgacaaccatgcttggtgatgctactaaaggaaagcatgagatataccatgatgaagtacatcgtcatggacattatgaaaggaagttgcgatcacaatcactgaagggtaatacagattatttttgctttatatgccaggcatgcttgttaaattatgttgggttttctaagtttttagcaattgtgattactctactatttgatatgaccttgcagtaacaaaataatacatggctctgtggtatcagccttcagccgt

SEQ ID NO: 23363 - DNA, 531 bp, Sorghum bicolor
  Clone ID: 14822922
ggaagcatttagcaagcttccaaagtggaagcagaataggctaaaaattgctcttcaacttttttagcctgatcatcaacgcttccaatgtctcatttaatccttgggtcaaatggccatttggtgaaattcgttgtgttctatatctgattagcccatggcaactgccgtcattttgcagaacgcaatcaccatctgcaatgacacatcagttttcacattgtcctggataggtctcctttttcctagcttggatttgttttgctaggtttctcttattcttccaattcataggtgtgttttttcctttttcctttttgtcaagtgcccttcattgattcaagggtcacacaggtttgattccgaggcttgaaatttttctgtatcaactctgccttgctgtgttccttttttgtttttttttgagatgagttgctgtttgagggagcgagaggtatgtacagcagagtgccggcactgtaaaatcacaatactcttatctttgatccaatataattgtttttgtgtggt

SEQ ID NO: 23364 - DNA, 330 bp, Sorghum bicolor
  Clone ID: 14822926
cttccaccccacggagaaggccaaccgaatcatcgtcagccagttcatggacggcacccaggagtacatgcacccgctcaacctcagcaccatcctcgccgttgacgcccgcgccgccgccgccgccgatgccgctgcaacctgcaactaattgcatacgaaaacagacgagattcatgtcatatattacgcacccagccgaaccccaagtagcatgcattgggccctagtactagtacgcaagtacggttcctgctgagaatgtgaaataaaaaatgagctgtagttcatcattcagagtaagcgtaaacatatatgcagccagacatc

SEQ ID NO: 23365 - DNA, 648 bp, Sorghum bicolor
  unsure (1)..(648): unsure at all n locations
  Clone ID: 14822953
agcatggatgaggatctggcagaagaagctgatgatggcatgcatcctggaaatgatcaatggctgtggccattaactggtcaggtgttctggcctggcattgctgnccgggaaagggaggagaaatatattaaaaagctagacaaaaagctcaagaacaaggtgaaattacttgaaaggcagaagtctggttacaagcagaagcccttgggacaatgaccatgactgaagctaacaattcaagatttttccgaaccacgttgggtgccagtgctcttgcattctgttttctgattgcagcagttcaacatgtttacatggaagaatagttggagcacaaaaaggcaccgttgttgtgaatacggattctttttacgcctccttgatctccctcttcgaaggagattggtgaagctggaggatattgtcaggatggggaagcaccactttttcctgttcatatagacaggtcttataattctccatatagttgaaactgattcttttctttacttgtcttccccacctgccatgaaagggcagctggatgaggagcaaaattttggtaggatcatactaaccatcgttgtacatgtaaagaggcaccgccacggaagtaataatcatgtttcatgagatgtcatgttg

SEQ ID NO: 23366 - DNA, 465 bp, Sorghum bicolor
  Clone ID: 14822962
ccagctaaaactgaatataagagagattcattccagaaagtcgcaatctgcaagaactaaggtctcagatgaattcaggaaatcgaagggtcttatattagtcagctccgacgtatctgcccgcggtgtagattatcctgatgtcacacttgtcatgcaggttggtctgccagctgatagagaacagtatatacatagactcggaaggactggacggaaaggcaaggaggggcaaggcatcttactattggctccctgggaaatgcattttcttagtatagttaacgatttgtcaatatcagaggctgcaacaccttcgattgattcaagcattcaggcagcagtaagtagtataaaattagtgcttatcttatatcttcccatttagcttggtcaatctcagtgcaaactttgttaaaaaagggtcttggctgcccaagaaatctgaagtcaattttggcctgt

SEQ ID NO: 23367 - DNA, 640 bp, Sorghum bicolor
  Clone ID: 14823033
taggccaatttgaagcaaaatctagctagccaatacttacatagatatgatattaattagtcatttagcctcttgcatctatagattgaaccctgcataaattaatttagcctgtatgcatgttcatgaccacccctgttatccccgccacaaaacaaaattaactgctgtgtatacatattttactatatatagccagttcacataggcatgtcgttaacatggaaaatatataatatataggtcacgtactatacggtaattatattgcatgcatgcatgttgacattttgtatgcatgtagatatttgtatgcttaaagctcgaaaaagaaaggtatttgtatgcttgatgatcatgcatatgcacacgcatggacgatgttcatactagctagtagcctactacatacctacagagaatctcctaattgagccgcagctgtgtatatcgcttgcaatgggttggttgctacatataaaagttctagccttcgtcgcctgtcattgtcgccatgtataggcaccctgcagggttgtgtgcacaattttatagctgcatatgtaatctatgtttcggttggattattggactgtaatgtatatacagagacgagtttaaaaatggctagaccatttgc

SEQ ID NO: 23368 - DNA, 549 bp, Sorghum bicolor
  Clone ID: 14823043
gcaacatagtagagcatgcaagaacagtgaatggtgatgttcctggacaagagacaacccagcgaggttgcatggtgacaatgggcaaacggaaacgtaaaggcagcttatcatcttctcccatggaagtgcaggaagacattaaacgtgcaatggatctgcaaaccatgcttcagaaggatcgtgagaagatgtcagaggtacaattgcgtctctcgaaggagaagcttgagttggccaggctaaagcagttggaagcgaaggacaagaaggaaacaacgctctacgagaagtacacagagctgttgacagctgacactcagggtttcaatgagttccagaagaaagagtatgagaaggcagtgaagcgcatgggagagatgctatttggtaaagatgctaagtagcatactgtaagtcttagacgtttgtatgagcatctgtactaaatgcttccttaagaacttggcttatttaatttgttgttataccttgcttcttaactttattaacacttctttatcgatgaataacataattagtttcttt

SEQ ID NO: 23369 - DNA, 494 bp, Sorghum bicolor
  Clone ID: 14823073
aagatgtcgaagaccagacaatgtggaagagggagcggtcgaaggccaggcagaagacaaagattggtttcactgcaagggttgatgcaaagatcaagcagatcaaggggaaattgcataagaaaggcccatctttaacaatccatacagtatcttaggaatctcggtcacccgacaagctcgtcaacagtagttgccactttgtttgcacctgcaaaggcagtggttttagcttctctgagcaatatagcaaaattcttttcttttttcctatttctttatttttttccctgggatttttttctttctccatttgtgtaagaaatgttggggtgtaattggtggtgttaaccctagtagaagttccaaagccacccgtgtaaagagtatagctcctttcagttgggaaaacaacctattgagatagctgacaacatagtgtatatctgcaattttgattgttgcctattgatgtattgtaatcgattgacgtc

SEQ ID NO: 23370 - DNA, 119 bp, Sorghum bicolor
  unsure (1)..(119): unsure at all n locations
  Clone ID: 14823099
ttacagacagttatcatgtgggaatggggctgcaaaattacagatagcgtcctgctggttttacagttacatgtccttagattagagttgaaagtcaatattcncaccaaaaaaaaaag

SEQ ID NO: 23371 - DNA, 435 bp, Sorghum bicolor
  Clone ID: 14823117
ttccagtacagaattcggagaaagaattatgccttgaagaaaagggaaaagaaataaaaaaaatgttgactcaaatagaagcaagaagatatatatgggtcggtacgcgcctgtcttgttgtcagagacgctgagaaggggacacaaaatgtagcagcaatatgttctgcatgctccgagtaatatttctgctctgaataaaggcaaagacaagcaccaatatcacattcaacctacattcatgtttgtaaaaaaaagttttaatatgagctggagcatgtactactccttatcatcttctactgcttctgccatacttgtttcccaggcaattgttgcaatgaaggcgatagagatcaccacttcgttgaggggctctaaagtatcagttttctaccaattcatgttttgaggaataaaatattagatactttt

SEQ ID NO: 23372 - DNA, 424 bp, Sorghum bicolor
  Clone ID: 14823154
agatcagtgtcagatgaaaacagcacaccatcatatttcatttgccctatatctcaggatgtcatggacgatccacatatcgcagctgacggattcacctacgaagccgaggccatcaggagctggctcgacagtggtcacgacacgtctccaatgaccaacatgcgactagaacacgacgaactcattcccaatcgcgcgcttcgctctgccatcctggaatggctccagcagcagaatacggccttgtagtctgttccctgttggattgctgcgtgcttctccaccactacacacgagtcgaattactccactattagctgctcatcaactgctggcccctgccatgtacagcttcaatatttaactagatgtaagagactaagagtgtaccatctaccatgtaaccgtcgtaatatagcta

SEQ ID NO: 23373 - DNA, 313 bp, Sorghum bicolor
  Clone ID: 14823166
tgcagggttagtgtaaaaacctgtgtcatgtcatgttacggtggcattgtacgtgcatggaactcgagttgcaacaaggcacctagtgtggccaaagctagcaggcgggaacaggagctttagtactagccagtgacaataacggataacttgagccaagctagtggatgtaatgtaaaaagtaaaaggaagccgtcgtgccactaccacttggatgcaatgcagcgaatcggcaccgagagcatctaaatgaggcaacggggaattgataagcaggctgcaatttatgccggctataataagtcaaatttct

SEQ ID NO: 23374 - DNA, 504 bp, Sorghum bicolor
  Clone ID: 14823203
agctttttgtgcagtgatcagctaagcacctattgttgtatcattagtttgttgcagcggagttgagtgtgcattcttcgccttactgtaagagcaatttatacagtggatggggttgccttcccctgccctttcggcaggttagtaaagtgtaccctggaggaaagttaacatttgatgtgttttctacagctataggaaatgtattttacttctatagtaagtacatcggcaaccttgtatttttttttctttcagcatcctagtcgttcaatacaaaacgtgttgcacatgtctagcctccatttcaagggcctacaaatatatatctaaatctacacaacgcatgcacatgcaccagagtatctgtatcgaccttgaaaggtttggtacaaagtctgaaaaagtatacattgttgtccatcactgtcatattaattgctgttgcaatgtgtagtagactgttcactgaagtgcgtcatggccagatgcacccttcgctgt

SEQ ID NO: 23375 - DNA, 334 bp, Sorghum bicolor
  Clone ID: 14823221
atggctgaggtggtcagtatgcttgagatggtgaggagtcctcagggtaccccagaggatgatctggtttgagctccatttactcgatttttttatcctattttctcgttcctttttcattcgtttctttgggtcgatacatgttgaggagagggggaaagtgcggtcagaaaggttaggatttgcctagtgagtttaacttggttgcagtatttagggatgtaaagccgttgctttcttaaattattggtcggtacctttgcgcgtgtatgctactggtacatcagctggattaatcctgttatcggatagttaggctaatcctggatctatg

SEQ ID NO: 23376 - DNA, 478 bp, Sorghum bicolor
  Clone ID: 14823248
tcactcgtgtatgccaaactgctacgctaggatcatgactgtcagcggtgacaggaaccagatcattcttattgccaagagagatgtctctgctggagaagaactaacctatgactacttgtttgaccctgacgaatccgaagactgcaaggttccatgcctgtgcaaagctcctaactgtcgtggatacatgaactagaaggctagaagagtaaacagatcccacaaacagggattaagactaactccttacagaagccaaaagccagccaattttcccagaaattctttcgttagtttctcgttttatattactcatcaaaagtttataattcgcggctacccaaggtttgaaccattttgtttagaattgtaattagggcagccatagtcagtcatccattgtaaattctttcattgctgtaataagataggataagaatgctgacttctgaaatgaaaagaaaaactcaattcg

SEQ ID NO: 23377 - DNA, 497 bp, Sorghum bicolor
  Clone ID: 14823255
ggatttttcacaaggaacccgccgaaaggcggttcgtttgtttgccttcatcctcatagccattgcatcgatcactctcagcttatcctgagagctgagcatatacagttgactattgcggtaaagtcgatgaagaaagcgcggagactgagggtcccagatatatcaactcctcggagaactaacaacatattccatcagggaaggtttagaggcagaaaattctctcggacttacacggccagccgaaaacagttgaagtgattttgatggcatccattagccaatactcgctccacactgacagtgaagtagaactaactgaagattggggacgaccggacgatacgcggccaatgcacgtattgttagataggattttttttcatttaatttattttggagatgtcttccttattatgcaactcgtcagaaactgtatacttgtatattggtcaaacagataggaaattaattcaggtcaaggctggcaattt

SEQ ID NO: 23378 - DNA, 646 bp, Sorghum bicolor
  Clone ID: 14823274
caaagtatctcaacaacatggacaggtctgagatcgggtgggacgtgaggatcgcgctcagcgcctacggatccttcagcagcagagactacctcaactcgcagcgcctccgatgccgtcagatgtacttccacgagaagatcttcgagacagccgacgccatcgtcacgcccatgacaggggtgacggcgtacgcgctgcaggacgacgcgttgagcaccggcgagctggactacatcaacggagcggcgctggtgaggtactcgatcgcgggcaacttcctggggctgccggcgatcaccgtgccggtcgggtacgacagggaagggctccccgtggggctccagttcatcggccgcccgtggtcggaggccacgctgctgcacctcgcctacgccatgcaggagtcgtgcggcaaggagcactgcaagaagcccaaggtgcactacgacctcctcaagaaacagtagctccggccggcggcccgtccggcctcgagcaaattaaaatggtggccgtggtgtttcaggaggagatttaagtacagctatatatagggcgattgattgattgattgattgtgctcttgatcatcaggatttgtccgagagaagttcaatgtcatcgttgtcgagaattaagttgg

SEQ ID NO: 23379 - DNA, 396 bp, Sorghum bicolor
  Clone ID: 14823343
gcacgaggcccttccaggcttccactgccactggccatttggttctgtgggaagagaaaggctgcatgattcttcctcgccttggcctcacccttgcttccatgtttgaacacggagcgagttcctgaactcgttgtcttgcgctgccttggcaatgggggtggttcttgctgcttcctccctggtcctggtgctgctcctgctcttctgctcttgcgggcctgcaagcggcctcctctcccccaagggtgtaaactatgaagttcaagctctcatgatgatcaagaactacctcaaggatcctcatggtgtgctgaagaactgggaccaagactctgtggatccttgcagctggaccatggtcacttgctctccagagaaccttgtcaccggatt

SEQ ID NO: 23380 - DNA, 548 bp, Sorghum bicolor
  Clone ID: 14823347
gcacgagggcccgttctccgcgtacaagtcgtgattttgtggcggcgcggccgtgagttgccgtgattctaaggggtttccggcggccgatccgctctagttaccctatcctgtcccttcagggcggcgtgcggcctcgtcgtttgtttgccgtgccgcgtcttccgaggaggagtttgatctagttagtgttctcgtgccgttggttccatggccagcggctctgatcccccgaaacagtacggaataaccaagccgttgtcattgctcgggccggtggaggctgacctccagaggacggcggaactagagaagtttttggtcgaggcgggtctctatgagagccctgacgaatctgctaggcgggaggaggtgctggggaagcttgaccagattgtaaaagactgggtgaagcaattgactagtcagagaggatacactgatcaaatggttgaagaggcaaatgctgtactcttcacctttggttcataccgtcttggggttcatggacctggagctgatattgatacactctgtgttggaccttc

SEQ ID NO: 23381 - DNA, 140 bp, Sorghum bicolor
  Clone ID: 14823380
ggggaacagccctctcggatggaaccacttcctgatggctcaatgaacccaagacgaagtgcgatcaaacaagttgctagtggacgttttggagtttccagctattacctgactaatgcagatgagctgcagataaaaat

SEQ ID NO: 23382 - DNA, 528 bp, Sorghum bicolor
  Clone ID: 14823384
gcacgaggcttcccccctccaaaccatggcgtcttcttcttcctcctccccgagatctcgccgtgctccttctcccgccttctgctagctgcgtgcgagcacggccggaccgctggtttccgcggcttcctgcatgcgatatcgccgacaatctttggaagaagggcatcatcacaggccgggatcgaagaatatgaaagctgatgatagagagcacgagctagggtttgggaggcactagctaggaccgtgtgctgccattgttcatgacgccggcgaggcgcatgccggcgatgatcggtcggaatggcatggcgtttgggtcctcgtcggcgctgtctttaagccaggctgacctcctagacagccatcacctgcagcaagcgttccaacagcaactctttgatcagatcccagccaccgcagtggatagcagcgacaacatcatccatggtcgctccgacacgctggtagatgaatttgagagcaagtcctgcagtgagaatcctgatggcacctctggcgatg

SEQ ID NO: 23383 - DNA, 483 bp, Sorghum bicolor
  Clone ID: 14823400
gcacgagggacagttcgaatgtggcattctactacctacaggcttgagaacactcttaactatggccttgagcgagtttgggctttaggatatatgaaagggtcaagaagggtcgtgattggatatgatgaagggacaataatgataaaaattggtcgtgaagttcctgttgctagcatggatagcagtgggaaaattatatgggcaaagcataatgaaatccaaactgttaatatcaagagtgttggtgcagacaatgagatcgcagatggtgatcggttaccattggccgtgaaggagttgggaagctgcgatctttatccacaaagcttaaggcacaatccgaatgggagatttgttgttgtatgcggagatggagattacataatatacacagcattagcatggagaaacaaatcatttgggaccgcacttgaagttgtttggtcaactgatggagaatatgccatcagagaaagcacc

SEQ ID NO: 23384 - DNA, 371 bp, Sorghum bicolor
  Clone ID: 14823403
gcacgagggacgagcctcctcctcctcctacagagctgatgctgagagagagcatcactggggtcttcgagagagaaaggagcagacccagagagtgattgggaaagagattgaggagggtcgagacgaagaagatgagcttcaacaagagcagcaggggtggcggcggactcggaggcgcagcaggaggaggagacgagctggtgctgcgaggctccatctccaagaaatggaccttgctcctctgcctcggcagcttctgcatcggcctcctcttcaccaacaggatgtggacgatgccggagcctaaagagatcatcaggaggtcgacactcgaggtggaaaagatgagccttgttgagggcgattgt

SEQ ID NO: 23385 - DNA, 447 bp, Sorghum bicolor
  Clone ID: 14823434
gcacgaggaggccgtcgtcgccgcagacgacgcggacgtcctcgaggtcaaggccaccgacggggtcaagctgctgccgccggactcggtccttgggtccgccagcgggggtggcaaggaggggaccggcaccgtggccgcgattcggatgccgatgctcaaggtcgccgacttcaagggtggaacgcccgaggtgatcaagacgagctacgccgttctggttctggtgccgcccagtgacaggaactgggcgccgcacgagctggagattgtcgaggtggttgccgatcaggtggctgtcgcgctctcgcacgcctcgctgctcgaggagtcacaggcgatgcgcgacaggctggccgagcagaaccgcgagctgctgcaggcgaggcgggacgcgctcatggcgaacgaggccagggacgcattccagcgcgtcatgagccaggg

SEQ ID NO: 23386 - DNA, 455 bp, Sorghum bicolor
  Clone ID: 14823436
gcacgaggggaaggtgaaccatctcagttggctgctgttgacattttcgtcagtacagtcgacccaatgaaggagcctcctcttgttactgccaataccgtgctatccattcttgctgtggattaccctgtggataaggtctcttgctatgtatctgatgatggagctgcaatgctgacatttgatgcactagctgagacttcagagtttgctagaaaatgggtaccatttgttaagaagtacaacattgaacctagagctcctgaatggtacttctgccagaaaattgattacttgaaggacaaagtgcacccttcatttgttaaagaccgccgagccatgaagagagaatatgaagaattcaaagttaggataaatggccttgttgctaaggcacagaaagttcctgaggaaggatggatcatgcaagatggcacaccatggccaggaaacaa

SEQ ID NO: 23387 - DNA, 179 bp, Sorghum bicolor
  Clone ID: 14823443
gcacgaggggccattcccagcctccgttgtcggtgcccgaacccctccactccacccctccacggcggaggtaccatccccttccttcccgtcgcagcgagattgccgattgcgccaatgagggtgggtcttgtcgagacctgatcgggagacctaaccaccggggctttttgtcggcg

SEQ ID NO: 23388 - DNA, 567 bp, Sorghum bicolor
  Clone ID: 14823463
gcacgaggggcctccagcccctagcttgccaccctcccgcttgcgctgctgaggtggtcgctgtagagaatggggaaggggaagaagtcgaaggagaaggagatggagaagaaaccggtggacatcctcgcggggtccgacgaggactccgatggcggggaggatctctccaaggtccagatcaacgaggagtacgcgcgccgcttcgagcacaacaagcggcgggaggcgctgcagcgcctcgaggagcgcaggaagcagggcctcgtccccgcctctgacgacggcgagtcggattccgagtccgagtcgactgaggaggaggacgaggaggccgccattgcctcgcgcctcgtcgaccgccgcgtgttcgaggtgatccgccgcatccgcagcggcgacccccgcatcctagacaaggacgccaaggtctactcggagtcagaggaggaagagggcggcgaagaaggtgaggacgccgagaaggaagaagagtccaagcaggggaagaaaaagaccaagaaggagaagcctctatacctcaaggacgtcaatgcccgccacctg

SEQ ID NO: 23389 - DNA, 454 bp, Sorghum bicolor
  Clone ID: 14823467
tcgtacggcggaagctcgaggtcggcgaccacgacggcgacggaggacgagcagtggggaggcggcgccgccgtgggcggcgcgcctacgacgtcggcatccggcggtgacgccagctcgctccggtcggtgagccagctgtcggccaacaagagcggcgggaggagtggcagcggcgatcggaagaaggccaagggcggtgcggtggcgccggcgccggcgaggagggtgctgggaaagctgtggtccggcaaggcgagcagcgtggagaacagcgggtcggacgacacgtcggagagccccgctggctccctcaacctcgaggagaccaagtcaacgccgtcacggatcacgaggcattctgtgtcatagtggtgacgactgtatatgatttcttttttgtttgttttgttgttgtgatggtttcttacaacctttggattggatttgccgt

SEQ ID NO: 23390 - DNA, 400 bp, Sorghum bicolor
  Clone ID: 14823492
ggctgtgctcggtggctcaatattcacctttggtggggtcaaaggtgaagcagatacaatcttggatgtggtggaacgctacaaggaagggtgtggttgggtgactacggggttgaagtcgtttggcaagagatgctactgctcagcgattgttctctgactgtaactgcctacaacagtattgtcatggcgagatattgtaacttctgacatccaagtgagcaggaaattgatattaggcaaaaacttaattaattagtacttagaaggctcttgcttagcctgaactgacagcagtagacatgatggaggtcttcctcctgtttgtttatgaatctcggagaactgtaaaacattgagctgtttgtgttgactgggtcgatgatgcagcaacaaccgg

SEQ ID NO: 23391 - DNA, 573 bp, Sorghum bicolor
  Clone ID: 14823507
agactaccatcagctcgttcatggaggactaccgtccagtggatggtataatgatcgcgcattctgggcgctcggctgtgaccctgttcaggtttggtgaggttgccatgagccacaccaagactcggatggaggaggtgtggagcattgaagaggttgcattcaacgtcccagggctgtccatgcactgcttcatcccgcccactgatatcaagtctggatctgttggtgaggccatggagcttactcatggcgagaggagccgggctggccctccccaaggctactgcgctaaagttgctgccctggagaaagcagaagaagataaagtggcatggggtggtggaaccgtactcgagagtcacaactgatctgcagtctgtttatacttggttctcacagtgcagctgctgaccctgttgaatctagtgtaggagagaaacaagtgaaagttgagaggatttggaggtttggtaaatccaaatgcctcctctgtataggaagaagcatgaggcattcacatggtcttgcatatgattgaagcggatctgtgtgaatcatcctttctgatcc

SEQ ID NO: 23392 - DNA, 675 bp, Sorghum bicolor
  unsure (1)..(675): unsure at all n locations
  Clone ID: 14823542
tgttgaatgggaggatgaaagatccttgtactctgagtgcataataggtctccttaataatgatgagatgaaggatgaacttggaagtttgctgaaaatgctggatgcagcaggctttttcagtgttaatgatgatatggtggattggaataatagattgttttcagattctatagacaaattcaacgaaatggtcttccctgggcggtgtgttggcagatgtcttgtcatccaaggaataatggattatcaaaaaatcatgcaaatgaaggatgttgcctggcaagatgcctttaaaatggttgttagtaatacaattgatttgtggaaggaaaatctccgacagttttggctgaccacaagacactataaacatgactactatgatgtacttgcgcatccacttcaaaaggtgtttttaatgggtggagcaccgaagcccaggtatggttgagagatgcagtgtatctggtgccgctctgcccccaactgacagatcacttgatcatctttgatcaagacctgattcaaccacattatgattgaagcagttgtacgaagggaactttttttttggcaaatcatgccagagattgctggactaatccagtgccnaactgatgtacgtaacacnaggttaatcttgtaaggaagtgaaccttttctgctgtagct

SEQ ID NO: 23393 - DNA, 199 bp, Sorghum bicolor
  Clone ID: 14823560
gaactagtggagatctcatggtttcaaattgtgtggtacatgcagggctagctcctcatatatcaagcctgatgtttaccgagactttagatgcatttgaaagcatagaaaaaaaacagtgtttacacattccatccaacgtcctgcttgtgcaaattgttatctgtataatctttcacggaagagtaaaaacagcccg

SEQ ID NO: 23394 - DNA, 561 bp, Sorghum bicolor
  Clone ID: 14823566
tctttttgttccaaagaacctatccccaactgtaatttcccctagggagtacaaaataagattcagggcgtttatgtcacaatactttctgtcagttccagatgcttgagtcttgaggctcaatcattttctggcactggtggcagaacttatcttgagttaggagatcatgttgccgatggttatttccatatccagtaagcagtacggcatgtcgatcagcatcatatgttctgagcattagatttcccttagtttcattgctttatttttgtgttgtgtgtgtttatccttgtccattttccttctcagcagtagtgtacatagtagcagctaggacaccaggaaagtgcaaattttaagcaaatgaacggttattgacacacaaataacctaggttttattctttattgatgataattagggtggagataaaggtttgtagggctgaggagcatgtaatgtactcccgtttgtgtttattggaatatattgctgaaacttaaagttagtttaaagattcagcttttttgttactttataataaaattagtggcaagg

SEQ ID NO: 23395 - DNA, 506 bp, Sorghum bicolor
  Clone ID: 14823584
aatgaggaaaggaagaccaagttgtcttttgactgaagcctcgacatttgttgagtaccgtttgcctgttctggcaatgacagccgatgtttatccaggcaacttatgaagagtgtataaaatcgggtatggatggatatgtatctaaacccttcgacgaggagcagctatgccaagtagtctccagattagtagtggaaacgacggattcagctgtttaatgttcaaaatgcaatggatctgacttctcattcatcgaagtgaagcatcaccatctttgcttctgtccagctgactctaacccttaacaatggtctgacatggcctctcacaacactagattaaaaagatgaaagtgccgtgagctagctatgcatcacagatgaagtttctgcggcagcccagaggagtgtaggtagatcaccctgtaactctcttctttgatgtttataggctgttgtatcttctgacaattcattgaaaataccacatctcgttgcaatcct

SEQ ID NO: 23396 - DNA, 556 bp, Sorghum bicolor
  Clone ID: 14823592
gattatggtccagggaaagatagtgttccccatgatggagctgaggctgatgcaggaagttttgctttatgtcagcttctacatccatcgctcctccatgtacctggttgctcctgaaaatgttcatcatcccaacaatcctctccgtgtgctgttcaagttactttggcgattcggcgctgaaaactgaagtcctggtgtggccagaaggtacccaatggacaacggtagccgcttggaaggttttaggagctcactaggaatagagcaatgcgaatcgcttcactgtgttggctaattttgctccagggaaacttggttgtagtcaatccagtgtctatatgtggtgccatcgctattagctgttcttgtatctatgcctcaccccctaatctatgatttgtacttctacttgcgatgcatgtgcatgtgcattgcatccttttgagtctgacttgtagacggtctagctgtgacctgtgagcctatgagcgattcttgtttgggtgccctgtactgttcttgctccttgagaaattgctctacaaaattggcg

SEQ ID NO: 23397 - DNA, 363 bp, Sorghum bicolor
  Clone ID: 14823601
gcacgaggcagcaaagcaactcagtcagtcagtgagtctgttcaggaggcaaaaccacgcacaggtgctgaagcacacagcagctgtctgttcgattgcttcctccctcctcaccagagctggtaggtgctgcttgctctgtctccgacttcgatccaatccaaactgcaggagccctcggagactattccccccgggcattgcagcttggcttcttggacccggaggagcctggatagatttgttgagtacttcgccgatccgaagcgcacgtttcttggccaccagcgcccagatctctgcatctggtggccattggtggttcttggctctgaattggtgctgctgcctggtgagggctga

SEQ ID NO: 23398 - DNA, 342 bp, Sorghum bicolor
  Clone ID: 14823632
gcacgagggagaggcagagcagttcactccatccacgctccgtcgccggagtgtgagcgcgagcaagaaccacttcgatcggtgtggtgtgggcgagggtttcgctgcagcgagagtggagagcgatcgccgccttccgtcctcttccttcttggaacagtgcggcagaggggcttggcagttggcactcctccacggctccactccaagcaaagcaaagcgattccaagggcaaggacattgattctgaaagtttcgtgaacaggccacggttttgtttttgctcaaaagaacagagatttgtgggctagggggattttcctttcaccccctgaccatatc

SEQ ID NO: 23399 - DNA, 434 bp, Sorghum bicolor
  Clone ID: 14823638
gcacgagggcattatcatatttgtcatccagtgctggaagaatacggttcttacttggtactccaggaatggttgctcttgacctagatgcgacactgaagggcctttttcagcaagtcctccattgtctggagaacattccaaaacctcagggggaaagtgttcctgccattactgctgacttgactgatttgcgtaagcactggctctccattttgatgatagtcacatcttcacgatcctcgataaacatcaagcacttggagaaggctactgtgtctactgggaaggagggtttggtgtcagaaggcaatgctgcatataattggtcaagatgtgtggatgaacttgagctccaactctccaaacatggaagccttaaaaaactctacttttatcatcagcatcttaccacagtcttcagaaatacaatg

SEQ ID NO: 23400 - DNA, 461 bp, Sorghum bicolor
  Clone ID: 14823642
gcacgaggaagatcaacaaggatgagctgcgcgagatctggcagcagatcaccgacaacagcttcgactcgcgcctccagatcttcttcgacatggtggataagaacgcagatggccatatcacggaggccgaggtgaaagagatcattatgctgagtgcttctgctaataaattgtcgaggcttaaggagcaagctgaggagtatgcagccttgatcatggaggaacttgatcctgaagggcttggctacattgagctttggcaattggagacactgctactgcaaaaggatacctatgtgaactacagccaggccttgagttacacaagccaggcactaagccagaaccttgctggtctgaggaaaagaagtccaatccgaaaaattagcagcacggtgaactactatctggaggacaactggaaacgtctctgggtgcttgcagtgtggattggaata

SEQ ID NO: 23401 - DNA, 507 bp, Sorghum bicolor
  Clone ID: 14823648
gcacgagggttcgcgcgggccccgtcctccgcggtcgccgccgccggggccggcgcgctgcgcaacgacctcaggatgctcctcggcgtcctgggagcgccgctcgcgccggtccacgtctgcgccaccgagccgctcccgcacctcagcgtcaaggacactcccatcgagacctcatcggcgcagtacatcctgcagcaataccttgcggcctccggagggcacaagcttctggcctccctgcgcaactcctacgccatgggcaaggtgcgcatggtggccactgagttcgagaccggcggccgcctcaccaagaaccgcaatgctggacgcggcggcgagcctggccgcttcgtgctgtggcagatggcccctgagatgtggtacatcgagctggttgtcggtgggagcaaggtgcacgcagggtgcaatggcaagctcgtgtggcgccacacaccatggcttggtgcccattctgccacgggccctgttcgcccgcttcgccgt

SEQ ID NO: 23402 - DNA, 204 bp, Sorghum bicolor
  Clone ID: 14823681
gcacgaggccttatctggccttcgagttcttgacgcttcaacaaacaatttctctggtccattacctgctgctgtgagtaagcttggggctcttactgatattgatatatcaacgaatcagatcactgggccattgcctgaggatcttccagataacctcctatccttcaatgcatcctataatgacctatctggtgttgcgcc

SEQ ID NO: 23403 - DNA, 618 bp, Sorghum bicolor
  Clone ID: 14823685
gcacgaggctacctatatgagtatgctggaagaagtggatgcaatggatggctgcttgaaggataattatttggacgatgagattctttttgagaaactgagacctgaatttaagtcaatgtacggcattgacagctatttgcatccttatttgaataccatgacgtgtatgttacagcgtactgattcttggggtagcattttgaagcgtcttttagaaaactatgagccacagtctgatcttgtgcaatgtaatccagcaagtgtggttgatattttccgtcgttcattattgttttattgggaacctcagtttcatcctttgatacgtgaggctcatcaggaactgctgaaaacaatagcttgtcaattagccttagcagacaagagtgtaatgtttgagccactggaaccacacccacatgatttcttggagcatttacagccttatgcatgtatgtatattaagagaaagaagcaagagtttgggtattttaggattgaagaacaagtacgcatgcatgaagagtttgaccatcatttggcttcaggcatactggatcatcgtttgaatgagttcaattgttctaaggatgactttgtccataattttgctgt

SEQ ID NO: 23404 - DNA, 603 bp, Sorghum bicolor
  Clone ID: 14823703
gcacgaggcctactcctgctcgagcccgtctacgaagccaggttctcgccaaagtccttcgccttccgccccggtcgatccccgcatgccgcgatccgcaccatccgccgcagctttgcgccatacctctggtatatcaagggcgacctctccccactcctgcactcgcctgatcctgcgcttgtggtcggcgcgcttatccgtgatgtgcgtgataaaaaggtggtggatttgatccgttcggcgctgctcaccccggtggtgaccgcaagtgatgatgctgcagcgaagaagaagaagacgaagaggaagtaccagaagaagaaggtgctgccagagggggagccgaagcctgacccttactggctgcagacgttctttgggtttgcaccagaggaggcccagacacagcctgattggggccactgtggggtgttgagcccgttgcttgccaatgtgtgcctggatgagcttgataagtggatcgaagagaagattaaggagctttacaagccatccaagttggatgttgtgggaggggatgatggtattgagcagggtaacacatcatggccggagtttgttcccacgagtggccctgac

SEQ ID NO: 23405 - DNA, 498 bp, Sorghum bicolor
  Clone ID: 14823709
gcacgaggcctgttcttcccgtttcaaaagcgcgtccaattttatcacaaaaatcccagacatcgagccttcgaatccagcggcttttggattcattcattcatcccttcccttccgtcttgctctccgccatttcggaatcggggggcagcgagcacccgcccgcgtgtgtcgaggctttcggtgggcgtattcacccccggtggatttggaatcgtgccttctcggcacgcacaagtggcatgctagcataatgcagtgaagttgtgtcatgagtaaaatgtgtcacgcatgtgcatcagaagagacaaccatggatgaagctaatatcgacctgacctgcagtacatcttgctgcaagatgtgtgaccatggtgagggatcatcaattgttactggtgagatcaactggttgaccatagactcgagcccttgcagcactccttatggcacccctatttttacccgagaaaattctttctcaagctttgccagttg

SEQ ID NO: 23406 - DNA, 448 bp, Sorghum bicolor
  Clone ID: 14823726
gcacgaggcccagtgattttctctcaggatacagtttcctaccttgcacgcattgacatgatgtctggggaggaggaccaagaaaacattttgcgggccaggactactggcaaagctgtgttaacaaacccattccgtttgcttggatcaaaccacttgggagtagttctcacttttgctgtgtaccgccctgatctccctgctgatgcatcagttgagcaacgtgtggaagcaactattggatatcttggtggaggattcgatgtggagtcacttgtggaaaatttgctaagcaaacttgctggcaatcaggatattgtggttaatgtctatgatgtcacaaatgcttcagagcctatggctttgtatggaccttcaattttggatgaacaagtgcctttgcatgttagcatgttggattttggagatccatttaggaggcatgaaa

SEQ ID NO: 23407 - DNA, 425 bp, Sorghum bicolor
  Clone ID: 14823735
gcacgagggccctccagtcctccatcgcctggcctctcgtctcccgcccgcgcttcaatcctcttcgccgtcacgtctcgtccttgtcctcaccgtcgattggccgctatggtgtgtgctgccggcgacccccgcgaccctccggagatgcctctgaaccagcccgccctcttcgtcgacgacctggccgccttccgcgccgtcctcggcgcggacctcccggtggccgccgccgtcgacgcgctcacccgctgcagcggtgacaccgagcgcgccatcaaatggctcctcgacgatgcaaccgccgccggcggtgacggcggccgaaatgggatccgagaaagtggcgtcgaggcggaacccggcattggcggcgcctcctgcccctcgccgcctccgcctctgcttccagtgaaggttgaagc

SEQ ID NO: 23408 - DNA, 568 bp, Sorghum bicolor
  Clone ID: 14823755
gcacgaggctcgccgacggccgcgtcgtgcggtggatgggcgaggaggccggctgggagacgtttgccgtcatgaatcctgaatggtcagaggaagtttgtgcgaacggagtgaactcaacgacgaggaagcagcacgagaaggaggaattctgtggccggccgctcggtctgaggttccacagggagaccggcgagctctacgtcgccgacgcgtactacggtctgatggtcattggccagagcggcggcgtggcgtcctctgttgcgagggaagccgacggggacctcatccggttcgcgaacgacctcgatatccacaggaatggatccgtattcttcaccgacacgagcatgagatacagcagaaaggaccatttgaacatcctgttagaaggagaaggcaccgggaggctgctcagatatgatccagaaacaaatgccgtccatgtcgtgctcaaggggctggtcttcccaaacggcgtgcagatctcagaggaccaacagtttcttctcttctccgagacaacaaattgcaggataatgaggtactggctggaaggcccaag

SEQ ID NO: 23409 - DNA, 570 bp, Sorghum bicolor
  Clone ID: 14823763
gcacgagggtttgtggtttgaaaaatgattttttgtggcgaaggataaatttgatatatggaaaattatgcttgaagatccacaagagtataaattttgcagttgtttccattgataattagtttctttttcagcggtgctaattttccaattttacacatttaatttatggctgctttagcttccaaatcattaacactagttatttctattttttatcattttagttagccttccaccagtaggagatgtctgcttcatctgcactccatcagcaacagtagcgtgccgctagcacaaaaaaaaaaggtatgctggagaatgcagctcttccctgcagctagttttcttctgcctctgttttcttccactaaaattgcagccaccaatcagtgatatttgtgtgattaaaactaaccgagttaattcgtattttccaattcttgctcaaaggctgcttttgactagattggatttacctttcatattcactttgaatatattataggcaatttcaacttaactaaatacttcacctcgcgaatcaaactgtatgctgagttaacaaat

SEQ ID NO: 23410 - DNA, 383 bp, Sorghum bicolor
  Clone ID: 14823777
gcacgaggcggcgtcggcggcgccgtggcgtgggaagggttcgactacccgacggacacgatgctcccggagatgaaggtggggatcgactacgtgaagaagaagaaccggacgctgacgtcgtggaagagcgcgtcggacccctccccgggccccgtcgccatggtgatggacaccaacggcgacccccaggtgttcatctggaacggcggcgagaaagtctggcgctccgggccctgggacggcgtccagttcaccggcgtgccggacaccgccacctactccggcttcaccttcagcttcataaacagtgcgcaggaagtaacctacagcttccaggtgcacaacgcgtcgatcatctcgcacctgggcgtcgtgagcac

SEQ ID NO: 23411 - DNA, 532 bp, Sorghum bicolor
  Clone ID: 14823787
gcacgaggggatagtgctttcgctaacttatacgacttgatgatggagctcgtagaagtttacaaaatacgggttcctaagttcacggttaagatggctgttcagtacatgcgacgtgtcattcagaaaagagctaaatttgacataatggatcttaatgttgtccagtttgcacccaagacgtttattcctgcattatttggacatgcttcaaatgatatgtttattcagccacatcacacagaacgtattcatcaggcatatgcgggggataaaaatctaatcaaatttgagggtgatcacaattccccaaggccccagttttattacgactctgtttcaatattcttctacaacgttcttcacccacctcagtttccttcaacttgcacaaataaatttgataagtattacaaccttggtgcttttaagggtggtgctggtaccaatgagagcttattgtatgagatcatcaatggtctacgggcagctggcactgatgcaggaagttcatcagctgctacagctaatt

SEQ ID NO: 23412 - DNA, 515 bp, Sorghum bicolor
  Clone ID: 14823800
gcacgagggatagaaggtttggctgtatcagaaggaaagtgtgtggacaccgtgtcagcatcccttgaaaacgaggagcgtgctaagatatcctactgttctaatactgaaacaaaaactagtaaatctgcaatagataaccaagtggagattcatcatcttggtactggtccagtgaaactaaattcgagctttaatgagatgtcagttccaactgatttgatgagtgacgagcctcaggttggcagccattctgctgtcaaggccattgagcaccagagcaataattctgccaacttaaagcacgaatctccgcatataggtttccacatgttagaggacacccaagttgcttccatggctgcagtcccctcgacatgagggaaaatctgtcgactctggatcacacacttttgatattttacttggagctctagctgaagagtccaaggcaacagatgctcctggtaaagatgaggttggcaaagcttccttgacattaatgacactggcta

SEQ ID NO: 23413 - DNA, 515 bp, Sorghum bicolor
  Clone ID: 14823802
gcacgaggttcaaattcatttgaattaaatccccatctttctctctctcattctctcccctctcactcagatccacccgtgcgagcccgcttccgtgctccatcgccgtgcatgaccagtgccggaaacctaaggttcctcgcagcggtctcctatgactccgatcgaccgtaggcctcagcgccgcggagatggaggcgctccccctcatcgacatctctgctgaggacgatctcctctatgacctcgcctcactggccccgccgcgtcccgatccaccccacgcagggtctcaggtgggtgctgtggcgacctcctctgttggttctccgttggcggcagtccggtctatggatccggaaggtgtgatggtggatcaggcacccctgagcggacggagtctccggagtagtggaaagccaaaaagggggtaaacctctccgcaagaacttggcatgggacaacgccttttttaccagtgaagatttagaacatgagttagccggctgcacgtg

SEQ ID NO: 23414 - DNA, 619 bp, Sorghum bicolor
  Clone ID: 14823822
gcacgagggcttcctagtgaattggctagagcggtttccggagtacagggacagagagttctacatcgcaggagagagctatgcaggtcactatgtgccacaactggctgaacttgtttatgataggaacaaggacaaggaaggcaaaacatatatcaacctcaaggggttcattgttggaaatcctattactaattattactatgattcgaaagggctagctgagtatgcctggagccactcagttgtgtctgatgaaatatacgaccgcataaaaaagtattgcgatttcaagaactttaattggtctgatgactgcaatgctgtcatggatatcgtgtatagtcagtacgacgagatcgacatatacaacatctatgtaccaaagtgccttctaaaccagagttcagcgtcttctgaaaatcatgcacccttcaagaatgatcaggaaaagttcaggagaagggtacggatgttctctggctacgatccatgctactcatcctatgctgaggactacttcaacaagaaggaagtgcagaaggcgtttcatgctaatgtcatcagtgaatcgcttccagtgaaatggcatgtctgcagtgatcccatcctgaattcc

SEQ ID NO: 23415 - DNA, 420 bp, Sorghum bicolor
  Clone ID: 14823824
gcacgagggtcgccgctcgccggggccagggcagggcggttggtatactttggttgttgcatttccttggcgaaggagaagcaagccgcccgtccttttgccgctggcgatgctcgccggcagctgcgtctttgtcgccctcgcgctgcttctgccgtcggtaccgccggccgcggcgacccaggagttttactgcgacgattccacctatgcggacaacagcacgttccaggcgaacctgaacctcctcggcgcggcgctccccgccaacgcctccgcctcgccggcagggtacgccacaggcgccgtcggtgcggcgccggaccaggtcaacgggatggtgctctgccgcggcgacacgaacgcttcctcctgctcctcctgcgtcgcggctgcgttccgggacgcgcagcagcgctg

SEQ ID NO: 23416 - DNA, 533 bp, Sorghum bicolor
  Clone ID: 14823828
gcacgagggctaagggcaagtgaggtggtcaggagggagatgggacttgaatggatgctcaagccagcaagcagcagccgagctgagggcagcactgttggtaaggctgataatatcgagaaggatgaaactgcgaatgaagagattatgagaccaaacccaaaggaacttaacccataccttaaagataatggaactggatacccagaagaatcaaccccatcaaatgcaggcagtcagttgcttgcatcctctgttgtgggtgatggaggtgccagctggagacttaaagctttgaagcgtgcgaaggaacaagctgctcgtgaaggaagaaaacttgaggaggttgttgaagagagatggggatcgttaggcgacttagctgtttcagtatcagcatcaagagctgcccattcacatgctcatttgcatgccattagaggcagaaaatctgggaatgctgacaactcagaagaacgtgtcaaaggaaatccagagggtcagctggatggtagcagtggcaggcgtgaata

SEQ ID NO: 23417 - DNA, 326 bp, Sorghum bicolor
  Clone ID: 14823833
gcacgaggaaaccctaaccctacctccccaccggctcgccgccgccgccggtccgtcgtcgtcggcccactccgttcgaggcaacggagttggctggcgcgaaggtcacttggtctggagttaagcgcgtgatgtaatggaggggcgcgggaaccctctgctcaacaccacacatgctgtgatcaataagccaaggagtgtcgcatccagcaagccaaggtccacggagcagctcacctctgagtacaatggcatttgcccgccatctcggagcgctccccatgacgacgacactggcattgaagctggtgggcatctgaggaaag

SEQ ID NO: 23418 - DNA, 539 bp, Sorghum bicolor
  Clone ID: 14823848
gcacgaggctcctcctcctcctcctcttgctgtccttgtggcgaacaggcgaaggcaagcaacagcgcagatctctctccccttcgctcgtccacctccgcgccgcgcctcgcctcgcctcgccttgccatttcggagcttggtttctttccccttttggtttcggttggatttcaattgttagtttattggagggaagagaagaagttgggggtggggagaaggcgttaggtgggcggctgcgtgctccgcctcgggagaaggtcaaaagaaatcccccaccaccaacccagcccagaatccgccattgctcttccttttctcctccgtccgtagccaaaggcgccggctttcctgactccggtggtttccctccacccacgccagattgattgattgattgttcgattccttttgtcgggggaggaagaggaacacgagtccggagagatgtgcccgctgcgggtgatcctccatcttctctccgccaccatcgccggcttcttcctcatcagggggctcaacgccgagcccgacca

SEQ ID NO: 23419 - DNA, 612 bp, Sorghum bicolor
  Clone ID: 14823856
gcacgaggggtttagtttattaataaaagttcttcaaaaacgacttagtttgactatgtttgcacaaatttttagatataagatgagtgatcaaactcagggtaaaaaaagtcagatgtcttatcatttgggataaagtgagtatatatggaaatctaattgatttttactacgtgcctgattatcctatagatcggcagtagatgctcatgtaggcctgattcggtaaataaatactcctataacatgtaacaccagtcagtttaagttccagttgactttgatttatagtagaaagccagccaatacatctgtataccttgctctgagaaaccacaacagagtggcttagtggtgttttttcattctttttttttgagtctaaattaccaaatcgtggcacggcaaatcccgtttgttctttctgcacatggatagaatatggatacagaagtacagcatccaaaccatcctatttcttaatacatacatatgattaatactaatagtttgtatatttcttttaaaaaaggttctagaaatagagggaggtttgagagactgagacgttaattagttataactatacacgcacgagtagttagagcatat

SEQ ID NO: 23420 - DNA, 476 bp, Sorghum bicolor
  Clone ID: 14823858
gcacgaggccgccgcctatccctcatcctccaccgccagctcctgctctcacgtccgccctcgcccaccttcgctccgtcctctccgccgcatcctctgccctcgccgctctaccctcccctctcgaacctcacccaaccactcctatcgccagtatcccctcacctcagtctaccaccacaaaacctccactcccgcccccggtcaccgctatcaacctcccgctcccggccgccccagctccctactccgattgccccgccgtcgtccgtatgagccccgtcccaacctccgcggccacctcccttcccgccttcctcgctggcgtgtgcgcagatttctcctcttccactaccgacaggagcccctcccatccgccccgcatcctgccgtcggagctcagcctcctgcaccgggagttggactcctgggttgcggggggcgaccacctcccgggatcatactcctatgctgca

SEQ ID NO: 23421 - DNA, 320 bp, Sorghum bicolor
  Clone ID: 14823864
gcacgaggagcagctccatcagcagtgtccccatttcttcttcctaggcgtcccgcagcccgctgaacagcgaagaagcagagcatcaccagaatgcattccattgcagccaccgcgtgcttcctcctcgccctcctgcaggtgcgcccagccacggtcacggccacggccaccccgccgcgcgccttcttcgtcttcggcgactcgctggtggacagcggcaacaacaactacctgggcacgacggcgcgcgccgactcgccgccctacggcctggactacccgacgcaccgcgccacgggccgcttctccaacggcaa

SEQ ID NO: 23422 - DNA, 402 bp, Sorghum bicolor
  Clone ID: 14823870
gcacgagggcagagcctccagtgaaaaggcgagtacaggattttgatttgaatgatgcttgcattgaagaagctgagagccgaacagataaaattgtgttcaagctctttggaaaagagccgaaagattttcctgtagatctacgggaacagatccaaaactggttgtcacattatccaactgatatggaaagctatattaggcctggctgtgttattctaactatttaccttcgcctccctaattggatgtgggatgagcttgatgatgatccagcttcttggatagaaaagcttattagcttatccaatgatggattttggagaaaaggatggttgtatgctagggtacaggactgcctaacactgagttgcaatggtagtcttatgtttgcatctccct

SEQ ID NO: 23423 - DNA, 610 bp, Sorghum bicolor
  Clone ID: 14823901
gcacgaggctcaagtcaaaagttggaaggcgaccgagatcagatgatgttgatgccgttaccaggctttcagttctagacaacccatactatcgagatcttctttgtgaatttggtgctatgtttgccattgcgaacagagttgataatgtacataagttaccatggataggtttccagtcatggcgggctgctggaagaaaggtaccagtttttcctttttcatagaactttatgcctgttttggacttttggccatattggtcataccagctttcttatactaaagtttttctcttttgagaaaaaggacatggtacatgtcacccacttcaaacctgtcacactgacttcccaagccgttacttgatattgttacaaactcaactagattataatattgaggcccaatggggattatgtatagagtacatgagggacacaggagggaaaccctagactaggagattacactaatacccttgactattataccttaacaccccctctcaaatgcaacgtgaatgcaatggcgttgcatttggagagttggcactatgcactagacttgaaaaataaaagagacggattacatccaaaaaccaaagtag

SEQ ID NO: 23424 - DNA, 450 bp, Sorghum bicolor
  Clone ID: 14823913
gcacgaggattagatccttgttgctacccctggaaggcttaaggatcatcttgagaacacgcctggattctccacccgaattaaaggtgtgaaggttcttgttcttgatgaggctgaccgcctgttggatatgggattcagaagagacattgagaaaataatttctttcatccctaaagagaggcagacactgctgttttctgctactgtttcagaagaggtccgccaaatttctcaccttgcaatgaagagggactataatttcattaacactgttcaagagggcgatgaggagacacatgcccaggtaaaccagacgtacatgattgcacctctagatctgcacttccccatattgtatgatgtattgaagaagcatgttgcggaagatgcagaatacaaagtgatagtattctgtactactgcaatggttacaaaacttgtcgctga

SEQ ID NO: 23425 - DNA, 493 bp, Sorghum bicolor
  Clone ID: 14823925
gcacgaggaaattggttcgtagatatctgcgtcattcctcgctggcgctgctcgatgactctcccatagcttcacagtgtggctcatcaacttaattccccgataattagtacaactttggatgtctcccttgttcttgtagattggtaccaatatgcttctccaatctccactcctcaggcatctcgttcgattgaaagatactgttgaacatcttggttagccatactatagctatatccccgagacatctccacaccttgattgggatagcatcagggcccatcgctttgcaccctttcatccttttcagggcttctctgacctccgattcttgaatcctctgcacaaagcttctattagtgtcatcaaacgagttgtccagctgaacgttggtgttctcgttctcaccattgaacaatttgtttttttccctctcgaatacacaggagagctgcgtatcattgtattaagagaggaaaacggtcccgta

SEQ ID NO: 23426 - DNA, 586 bp, Sorghum bicolor
  Clone ID: 14823930
gcacgagggctcttccctgccatcatcacgcaggtcgccttccccaactccgacttcacgccggaccccaagtacaccctcaagggcgtcacctgctccgtccatgagatgtccatgtaccaaaggcttaccaagcactctattgtgattgatgattcccggatgtcaccactgggctggagtggtctatcatgggcaattggcattctcatcgtggcgccgctcctcactcagactgctcaccatcttgaccgtggccaatatcagtcactgatcctcattgctgccacgtcttttgggtcgttcttctgcctgctcacaggcttcttcaagacagtctgggtgttcctgttctacatcctcttcattgcgggctcaatcattattgcggaggcagtgcatacccgcaaccttggactgatgatccgtgggcttgctgcgcatgactcaagcaagcaccttgttcttcgccgccgtgctgctgcgagccagctcagcctgtactgcactgccattggaggcattggagcagccctcatggctgcattcatgtaccacatgctgcggcgcacttgatcagctcact

SEQ ID NO: 23427 - DNA, 605 bp, Sorghum bicolor
  Clone ID: 14823932
gcacgaggctacggcgcaaactgtcctcagtggatagtggcaatggaggcttgcaatgccaatagtctgatctgtgtcccactatatgatactttaggtgcaggagctgttgactacatcattaatcacgctgagattgatgttgtcttcatacaggacaagaaaataaaagagatactatcccctaattgcaagtctgctaagagactaaaagctttggtggcattcacttcggcaacaagtgaacaaatcaaagaagcagataattttgggatgaaaatgtacgcgtggaatgatttcttaaaagtgggaaaagataatcctcatcaaccttgccctccacaagcaagtgatatatgcactatcatgtatacaagtggaacaagcggacagcccaaaggtgtgatgctgacccatgaaagccatgccatgtatgtaaaaggggtggacctctttatggatcagtttgatgacaagatgacaacagatgatgtctttctatcctttctcccacttgctcacatccttgaccgcatgattgaagagtatttctttcacaaaggggccctcattggctattaccatggagatttgaatgccttgag

SEQ ID NO: 23428 - DNA, 492 bp, Sorghum bicolor
  unsure (1)..(492): unsure at all n locations
  Clone ID: 14823941
gcacgaggcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtactgtttgcaacctgttttgaccataccactctgtctgaacttgaaggatatgatcagaaactgctttccttcaagcctacttctgcagatataacctatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggttggggccaagtctcggaaatagcatacctcanaggaaaag

SEQ ID NO: 23429 - DNA, 324 bp, Sorghum bicolor
  Clone ID: 14823948
gcacgaggattgtcaatcacctggttagggcaaagcataaggaagtgtgccttcacaaggatagccctttgggagaaacaattctcgaatgttacaactgtggttgtcggaatgtatttcttcttgggtttatctcagcaaagtcggagaatgttgtcgttctattatgcagagagccatgtttaagtgttaatgcactgaaggatatgaattgggatctcagccagtggtgcccacttatcgatgacaggtgtttcttgtcgtggcttgtaaaggtaccttcagagcaggagcagctaagagctcgccaaattagtgccccaa

SEQ ID NO: 23430 - DNA, 620 bp, Sorghum bicolor
  unsure (1)..(620): unsure at all n locations
  Clone ID: 14823966
gcacgaggacgaactccacagcccgcgcgcactcacaggagaggagacaggactcggtgcgcgccgtccccgtgcgtgagcgtggcgccgtccaccaaacgcttccaccacccgccagtttcccttccgtccgcttcccgctcggccgttcctcctccccgccacggcgcgcgccccggcagcgggaggcggggcactctgcgctcgcgcgatggcgccggacccgtgcgccgacctcgcggtgacgcccaagacggccgccaaggacgaggcgtcctgctccatggccacgccgcccaaggtcactcccgacgaggtgcgcgcggtagcgcaaaagttcgcgaaccagcctatccaggagacggagcccggcgtctgggccgtcctcaccgccatctccaagaaggcccgcctccggccccagggaatgaacattcttttgagtgctgatgagcactgcctaggacgcactgttgaggagcggtttcagatttttgcccagcagatcagtgggaagcattgcaagatatacaaggacaccgtcttangggagctaaaccgccacgagcctgtgcctgtttacctcaaggacaccagctcanatggcacattcattaact

SEQ ID NO: 23431 - DNA, 538 bp, Sorghum bicolor
  unsure (1)..(538): unsure at all n locations
  Clone ID: 14823970
gcacgaggtgtggatgaggaaactaatgttgagaatttggatgaggatgaaagtgacagtggcaatgaagaggcagaggagtcagaggatgatgcatttgacgtcaatgacgaagaggacatgaattggagaattggggatggccagggggacgagggaatgtcacattccttacaacgctgtaacacatttgggggcatgcagtttgagaatctgaataaaggggaggctgagatgagggatgagttaaggtttgacgatttccctgcgaggtcatctttggaaaggatgacatcatcaaacctcctccaagccatgagctcaattccctcatcatacaatgtagcagagaatgtgcatgatctgccttctggggatttcttggctatgggggctgatgcacataagagtggagtggacctgngaccagggagctcatatttatttgggaataatggcaagaggaatattgacgatattgatggttacaatggcaatacgcaggtgcaagaggagtttcctcagtctaatcagcaga

SEQ ID NO: 23432 - DNA, 450 bp, Sorghum bicolor
  Clone ID: 14823976
gcacgagggttccaagaacacatgtcgtctttcaaacaaagttcgggcacctctcgaggggtttatgttttttctgagaacaacccgtatgttggtcaccctaatccaatgcaggaaggacaggagctcttccgcaagggcctcttaagtgaagctgttcttgctttagaggctgaagttttgaagaatcctgataatgctgaaggttggaggttgttaggcgtaacacatgcagaaaatgatgatgaccagcaggccattgcagcaatgatgcgtgcgttggaagctaatccgacaaaccttgaaattcttcttgctcttggtgttagtcacacaaatgaattggagcagggagaagcgttaaggtatctttctaggtggcttcagaatcatccaaaatatggtggccttgtccctccgcagtcaactgattcaccttatggtcctgat

SEQ ID NO: 23433 - DNA, 528 bp, Sorghum bicolor
  Clone ID: 14823990
gcacgaggatgaggtccatggagagcacggactcgtcgtccggcgagttgccaccaccgcagaagcagccgagctcggcgccggatctcccgccggggttccggttccatccgacggacgaggagctggtcgtccactacctcaagaagaaggctgcgtccgtgcctctacccgtcgccatcatcgccgaggtcgacctttacaagttcgatccgtgggagctacctgataaggcgaccttcggggagcaggagtggtacttcttcagcccgagggaccgcaagtaccccaacggagcgcggccgaacagggcggcgacgtccggctactggaaggcgactggcacagacaagcccatcatggcgtccggcggcaaccgcgagaaggtcggcgtcaagaaggcgctcgtgttctaccgcgggaagccgccaaagggcctcaagaccaactggatcatgcacgagtaccgcctcgcggatgcggcgagctcaaccaccagccggccgccgccgccatgcaacgtcggag

SEQ ID NO: 23434 - DNA, 500 bp, Sorghum bicolor
  Clone ID: 14823998
gcacgaggattttactctggattcccctataatgatgactccaaattcacaaagctagtacaaattgctcttttcatttacaatggatcctcgtcctcctagtcatttctcacattggaagagctatccaaatgagccaccaggaatgctaaatcctatgaacttccaccaccagcagtttccacagcatctttcgttttcacatccatcatatgccatgaatttcccgcaccagcaatttccacagccacacctatatccacaaaatgtccattatgttgttgtccaaccacaatatgctcctttttcactaccacaactgccacatccacctgttggagttatgccaacaccaccacctccacctgctggagttatgccatcaccagcagtggcccttccacgtccacctggtggggtgatgccatttatgacagtgccagattcaggaactccacattccgtaactggtcctgatgacaagacactgttagtgggga

SEQ ID NO: 23435 - DNA, 236 bp, Sorghum bicolor
  Clone ID: 14824016
gcacgagggttgatccatttacagatgaaatgcttgcaaggtttgttgtagacagtcatgctagatcccagcccaagggggctaaccttgaagacagggtttcaactgatgtggatgatgatccactggccgctgcaagacaagctgacccagatgtcctttcgcaagacatgctgaagaagtacataacttatgctaagctgaatgtatttcccaaaatacatgatgctgatcta

SEQ ID NO: 23436 - DNA, 563 bp, Sorghum bicolor
  unsure (1)..(563): unsure at all n locations
  Clone ID: 14824022
gcacgaggccaccacggcaccgcctcctctgcaccctctcccttctggatctctctcatcgcggagtctcccagccgcatagtggtggtgtcctcgccgcgttcaccttcttcttcctgggctctcgtcggttccggacgtccacgaccggatcgaaggcctccatgtccggatccgttcgttcctccaccggatctggcctggaggcgtctactcgctacgtccggcgtcgagggatgcggcatggatgggaacgtcctgtggatgtgtacttgctacgtggtgttcatacactgcagttgagaaaactctagtaatggtgaaacaacagctaaggcttatcaacagagttgaaaagagggaagggggtcatacctgatggggatgaatgagtggaatgggtggaggttgacgtcaatcttcctagtttgtgcgtcttcatttgtgtgatccaaattatagtctaaaaatcaatataaattgctaggacctgtcagcgacatatggtctatttttcttggttttagcacctacggagtactctctgtttatataanaaattg

SEQ ID NO: 23437 - DNA, 434 bp, Sorghum bicolor
  Clone ID: 14824030
gcacgaggcacacattcaatgggatgataatggatataagttatttgctgtcgaagaaagcttgtcagaaagggttcttgctttctcatttgccaaatgttgcctaaatagagggctttcaggcacaacatattcccatcaggttctttatggggaagatcgaatccttctggtgcaaccggatgatgctgatgaactgaagatattgcatcttcatgttccagtttcatacatttcccagaactggccagttctacatgtggtggcaagcaatgatgggatgtacttggcagttgctggctctcatgggttagtgctatatgatttgcgaaataaaaggtggcgtttttttggtgatgttacacaagagcaaaagatccaatgcaaaggcctattgtggctgggaaaaattgttattgtgtgcaactatgttg

SEQ ID NO: 23438 - DNA, 445 bp, Sorghum bicolor
  Clone ID: 14824078
gcacgaggctttactctggtccactctcaaaactacggatgctgatgatttgtcgaatggcaaagcctgaggaagtacttattgttgaagacgaaaatggcaatattgtacgtgagacaatgaaggacaacgatgttcttgttcagtacaagatcatgagggaaacattgatctatttatctcatcttgatcatgaggatacagagcaacagatgttgaagaaactaagcaagcaattaaatggagaagactggagttggaataatcttaatactctctgttgggccattggatcaatatcaggctctatggtagaggagcaggagaatagatttctggttatggttatccgtgatttgctaaacctctgtgaaatcacaaagggaaaagacaataaagctgtgattgcaagtaacatcatgtatgttgttggtcagtatccaag

SEQ ID NO: 23439 - DNA, 423 bp, Sorghum bicolor
  Clone ID: 14824080
gcacgaggagaagatttctactggccggaggattttgtgcttggggatgttgtgtgggcgaggtctgggaagaagtccccgacgtggcctgcgctggtgattgatcccatgcagcatgcgccggaagttgtgctcaactcctgcgttcctggcgccctctgcgtcatgtttttcggttattccgctaacgggcatggcagggactatggatgggttaagcaaggaatgatctttccctttgtggactacctagacaggtttcaaggacagcctctgtataagctcagaccgagcaaattccgtgcagcgattgaggaggcttttcttgctgaacgtggtttttttgatctcgaaatggatggggtatgctcaccgcggaagtctgtaaataagcagtctgatcctaatggctttcaggaagag

SEQ ID NO: 23440 - DNA, 493 bp, Sorghum bicolor
  Clone ID: 14824085
gcacgaggctcccttccccgtcccgggtgtcgtacctgctgcagtcgatgcaggtgagcaaggtgaagctgtacgacgcggacccctacgtcctctccgcgttcctcgacacggacgtcgagttcgtggtgggcatcggcaacgagaacgtctcggcgatggcggccgacccgtccgcggcgcgggcgtgggtccagcgccacgtgcagccgtacctcctcgccaccggcgacggcggcacgcgccgccgccgcatcacctgcatcaccgtcggcaacgaggtgctcaagggcaacgacacgtcgctgaaggccgcgctcctccccgccatggagtccgtgtacgccgccctgtccgcgctgggcctgcagggccgcgtgaacgtcacgacggcgcactccctggacatcatgggcaccacctacccgccgtccgcgggggcgttcgcgcccgacgtcgtgccgtacgtgcagccgctgctgagcttcctgtc

SEQ ID NO: 23441 - DNA, 582 bp, Sorghum bicolor
  Clone ID: 14824093
gcacgaggcagcactgatgttgagtgctggcatttcacctggaactgagccacacctgaaagcaatgctgttagctataaggtcctcacagctactgggtcttttggagaagacaaggatttttgtgccgaaggggaggtggttgatgggctgccttgatgaacttgggatccttgagcaaggacagtgctttatccgggcgtcatctccatcactcaataattgtctggtaaagcatggaccaagattttcctcagcaaacaaaaatgcagagaccattgtgggtactatcgtaatggcaaagaatccatgccttcatccaggggatgtccggatccttgaagctgttgatgtgcctgaactgcatcaccttgttgattgcttggtcttccccaagaaaggtgagaggccacatgccaatgaagcatctgggagtgatcttgatggggatctctactttgtgacatgggatgaaaaccttataccacctggcaaaaagagttggaaccctatggactactccccaactgaagcaaaacaactaccgcgcgcagtatccccacatgatattgttgatttctt

SEQ ID NO: 23442 - DNA, 607 bp, Sorghum bicolor
  Clone ID: 14824095
gcacgaggatcaattgtgaaattcgtggccgtggaccactattgcttgtcgcgttggatattttaggtatctagatttgagtccggctgtagtctctgctgtctttttaggggatttggattgagctgcgtttctttggaattctggaggcagctcttaaattatttgttcctgcatgcgtctcgatttgagccttgccactcagaaacttgggaggatattactcttaagaatgcctgcaagttgtatgcacggtatcattatttcactgttcctcgcattgtgccaacacaatgtattggcttagtcttaatttgattttagatttatcctttttgtttttattttgcaaaatagtttagtatttatcctatccaatcactcattgaagcaaccatcattgtctcgacgagctattgagttcacacccctctgatctgaactctttacagccaaaccttgacagtacgaatttttgggcaattaacaatattatattatgtgagcatttttttagtttaataatgctatgctagagtcgtaggtctgcagatgaaatcatgctttgctgatttccagcgatgtgtctggttctggttccgaactt

SEQ ID NO: 23443 - DNA, 566 bp, Sorghum bicolor
  Clone ID: 14824105
gcacgaggcctctctctgtttctgagctgaaaccattcctgctccatccctggttataagcagctcacaatcttggcacttgtagtcgtaggcaggcacaacagtcgtcagaggagtgaagcttctcacgcaacacaatcgtcttccagctctgctgcttcactacactcatccaaccaaacccatccatgggtctcttcagctcgccggccaaggtgtacaagccggcggcggaggtcgacctcggcccgcacagcgtcgccggcgagcactacatcagccccaacgtcaaagctcctcgcgtggccgggttgctggtgaagatgctggcgtgggtgctggagactcccgtcctcggctggatcgtcctctccgtcctcaagagagacaacctcgtctacaagctcgtctccgacgccgagatcccggagccgccgctgttcacggccacccacacatggcaagcagcgatgcccgagaagaacgtgagcgtgacggaggccggcgtgtcgccggcggagcgcgtccaggtggctgtcgccggcatcccagctgacatggagccg

SEQ ID NO: 23444 - DNA, 579 bp, Sorghum bicolor
  Clone ID: 14824170
gcacgagggcctctcctgatacccaaaatgggttttctgtatggatactctgttggaggctataggtattgtgttggaaacctattttgggtttgggtttccaaatgcatgtcctattggagacagccttagaactgaaattaaagtttttggtcctggaatatggtgtgttttcatggtaaaagtttttgctgtgttatgtccattatctttatgcttccagcaaagaagctaatgaataagcagatacccaaaagatcattttctaaaccttgtttcttgaggaggacgacactcccatggaaccacaatcattagcaactgggtgtagattagagaactatactgtactcagatttccgtcaggtattccttctcaggctactttgcgtggcatcaagtacaacaacacaattatctggcatggttcataatatgttagaaaactaaaaagaacgatggatattgcctcaatgtacaagcatatcttagtgcgtggtactatgatttgtattgcccatttgttctgttaggcatgaacttgtatctaactttgcttctcctttcatgcaaatcatg

SEQ ID NO: 23445 - DNA, 394 bp, Sorghum bicolor
  Clone ID: 14824190
gcacgagggtcctctgcctcttcctccgctcctcgtcgccgtgtccgctccccgtccacacgctccgacccggtccgaatccgccccgtccgcggaccagatccggcgcccgcgaccatggcgacgcgcaggcgaatgctcctcaaggtcatcatcctcggcgacagcggggtcggcaagacctcgctgatgaaccagtacgtcaacaacaggttcagcaaccagtacaaggctaccatcggcgcggatttcctaaccaaggaggtccagatcgacgaccgcctcttcacattgcagatatgggatacggcaggacaggagcggtttcaaagtcttggtgtggcattttatcggggagctgactgctgtgttctcgtatacgatgtcaatgtaa

SEQ ID NO: 23446 - DNA, 208 bp, Sorghum bicolor
  Clone ID: 14824195
gcacgaggactacatcagttgcatatcttcattttcattctggccattgcacacgtgattttctgtgttttgactatgcttttaggaagtgcaaggattcgtcaatggaaacactgggaggatgaaattcacaagggtactacagaaaatgggcctaggaaggtgacctatgtgcatcaatctgaatttatcacggaacatttcaagg

SEQ ID NO: 23447 - DNA, 108 bp, Sorghum bicolor
  Clone ID: 14824212
gcacgaggcccctaaccacggcatcgccttcgactcctcatgggggctcctcgacgacctggagatactcgtcaagcgcctccgctcaaagcagctgcggaagggctc

SEQ ID NO: 23448 - DNA, 440 bp, Sorghum bicolor
  Clone ID: 14824214
gcacgagggtgcggtgcggtggtggcagcggtggttggtggtgcgcggcgtgaaagaaagaaagaaagaaaaggcccgccgctttgcgctgctctgctcccgtaggtgtcacgagatttgggcctagcctttcgcttttcttttttcctctcgctcacaagggaaggcaccgagggacggaggcgttggggaggggagggggagggcagcgagcgagccgtaacatccgagctgttccaatggcgacccctgccgctgccgttgctttcgtcgccagcgctttgttggggcggtggtagactggcgctacaagcggagctgcagtactaggttggtaggtggttgtggctttggcgctgcgcgtgacggacccgagccgctcgctcgctcgtgtgcgtgcctgtctacctcgcttgcgttgcgttgcgttgcgtgcgccg

SEQ ID NO: 23449 - DNA, 376 bp, Sorghum bicolor
  Clone ID: 14824219
gcacgaggctcatactctcagcgcctctgcacaccactgcaccttctctttttttttcctcgacgaccgtgcaccactgcacgacggtagctcctggctccttccttccaccgacgtggcaagcaaggcaaataactccactagagcagtggctatttcttattattcagctcataagtgtacatcacacggttgaactccagatgatgtagccaagcaaactttgacactcattgcagccgccataaagtgaacacgattacgattcctctatggtggggatcatacttatggacttatggtacgtgagctcttatttgaacaccgagatgattttctacgctggtgtgttggtgtacatcatgcttctaatctc

SEQ ID NO: 23450 - DNA, 486 bp, Sorghum bicolor
  Clone ID: 14824238
gcacgaggcaaaattcatctggacagattgttttggactataccaaagcgatccaggagagtgtctttgagcaactgcgagtagttcgtgaggggcatctaagaattgtattcaaccaagacctgaagattgcatcttgggagttctgtgcccggcgtcacgaggaacttattcctcggagatcaatcataccacaggtcagtcaacttggttctgtggtgcaaaagtatcagtcttccgttcaaagttcagcatcgctctcaagtcaggacctgcaaaacaattgtaactcgtttgtcgcatgtgctcgccagttggctaaggcattggaagtgccgttggtaaatgatttaggatacacgaaaagatatgtccgctgcctccagattgcagaggtggtcaattgtatgaaagatttgattgatcacagcaggcagactgggtctggtccaatagagagcttgcataaattccctaggaggggga

SEQ ID NO: 23451 - DNA, 451 bp, Sorghum bicolor
  Clone ID: 14824246
gcacgaggcgggcggaggaggcgcggcgcgccaaggaggccggcaacgacgcctaccgcaagtccttcctcgagacggccgtcgagcactacacccggggcgggctcctcgaccccagagacatctccttccttactaaccgcgccgccgcctacttccgcttgggcaagtataaggagtgcgtgagggactgcgacgaggcggtgaagcgcggcagggacctcagcgccgacaacaagctggtcgcgaaggcgctgttgcggaaggcgtcggcgctgctcgagctcgccgcatgctccggagattacgcaccggcgatcagggccctggagcagtcgctcaccgagcattacagtgaggagacgcacgagatgctcaacagggcggtggtagttcagaaggagcttgaggagcaggagcgattggatcaggagatggccgaccaacaccg

SEQ ID NO: 23452 - DNA, 601 bp, Sorghum bicolor
  Clone ID: 14824248
gcacgaggccggagcacatcttggatctgtcaattatgttatgggcggagtcccactcatggggatctggtcgaattgggggaagctgtaggtattattgcgggtcaatcaattggggagccagggactcaactaacattaagaacttttcatactggtggagtattcacagggggtactgccgaccttatacgatccccctcgaatggaaaaatccaattcaatgaggatttggttcaccccacacgtacccgtcatgggcagcctgcttttctatgctatatagacttgcatgtaactattcagagtcaggatattctacatagtgtgaatattccgttaaaaagcttgattctagtgcaaaatgatcaatatgtagaatctgaacaagtaattgcggagattcgtgccggaacgtccactttgcattttaaagaaaaggtacaaaagcatatttattccgaatcagacggggaaatgcactggagtactgatgtttaccatgcgcccgaatatcaatatggtaatcttcgtcgattaccaaaaacaagccatttatggatattgtcagtaagtatgtgcagatccagtatagcatctt

SEQ ID NO: 23453 - DNA, 602 bp, Sorghum bicolor
  Clone ID: 14824250
gcacgaggataattcagtcgaacaccgaggcaaatgggaatttggaaggtgcacaggaagtccaggtgaactcaacaagcatgtcccattacaaggagatccagagaaagatagttgagttcttgagaaagagataccaccttctggagagagccttgaatttggaatatgctgtgataaagaataagattcctgttcctgatgatattactgaacaaggtgttccagcaggacatgttccacttcttccagatatcagtgaactgttgcgggaattgcccaatctcgagccaatttctaccaatgaagtggctcctgagggcacagctggtcagtcagaagttccccatctttacaataagatgtgtggagtgcttgaagagagtggtggttctgcgatcagttcgttctttggagacaagtctgcatcttctagtttggccaatagccttcatcagtttgaaattgtgtgtgagaatgttattgaggccttgcgaccacaacagaatggtactgctagtgccatcaaagaggaagtggtagatccagccaccaaagcagcagcagctcctcagcaagattcgaatgggcagtcttcgaca

SEQ ID NO: 23454 - DNA, 399 bp, Sorghum bicolor
  Clone ID: 15045481
cccggcaggactgcgacgaagtggcctctgggaacgggagcaagaggttcgctgacgcctcggtcacatcggcgaccacgagagcggactcgttcaggaaggaggagaagctcgtcaagatcgaggaaaggctgtcgtccggagcccgcgtcgtgatccactacaccgtcccttgcaatgacagtgacgaaggctctgaacgctcggaggagtgacaatgctgcagggatccggctgctgctttggcaaattagtttgggtttacattgcttgaaacatgcattctcagctatatggcccttttttcttcccgggtttttactttcttccttagaaattttaggccctcttatcatgtataagtgcctattattataatgtatcatttatgcgtttcgc

SEQ ID NO: 23455 - DNA, 583 bp, Sorghum bicolor
  Clone ID: 15045485
ttaaggcagaaatgaagaataagttattactttcaaggatagaattgggattctaacatctagcagaaatgaaactgtacaacctggcattgatttcaactcagcgaaaactaattcagacagcagcagttgtcatctcaattggatttgcagatgcctgatgaccagatgctacctcagagcctgtaaacagtggatacaagaggcacctggatcttccatgaacatggatatgctcacacaggaaggttaagcatcgatcccatggcttgttggcagtttgctttataagcaaactgaattgtgcaaataactggccaagtaggggcaaattttccaatgccgatggtatactcaatggaagagttgtcttataatcctaaaggtagtgaaaacaatgctaatgagatcaaggatgactccaaataattctctcttacgtgatgtgtgatatgagagcatcagtccattttatatggtttccttgatacattgtcatgttatgtgtaatataaggcttatgtacccaattctgaggggactctatgcagagactatgataggttttatttttctaagtatc

SEQ ID NO: 23456 - DNA, 580 bp, Sorghum bicolor
  Clone ID: 15045523
ggacaatggtttattcgatgcagatttttcaggttggtggcgacgtcagggcgtcaggggagggcagcaacagctagcattgagacttggagatagcctgccctatcaatggttgttttgcttccccttgatttgttttcccctaacgtgctatgcacttcattactcctttcctggccatgatctttacatgttcttctgatgcagctggagcgtcagatccagggcttttcccccaagaagtaatccagagaggaggaattgatggagctgcatcttgggatgatgcatacagtacacctttcagagtggcggcattaatggaaacatgctcaattagctcctttggcttctagcattgtaccttctagtaagtctgtaatagcttagcagcaagattagctgttgacacttttgtgtcactgtaatagtcattatcccaagtctatgtggggtggagaagcaaagaatgctctggttaatactaagagtctgccgtgatgtgctatatgaaagtgagcctctaaacctttgtatcatctcgatgtactacttcgaggttttaataaacgcttccttt

SEQ ID NO: 23457 - DNA, 478 bp, Sorghum bicolor
  Clone ID: 15045529
ccgaggactcgctgcccgtcgaaattgttggtggcttgctgcagttcttcttcagagaagatggtgaacgcggcgccctggtggtgctgtgatttcatctcctcgaatagaagcagaccgccgtgccgtcggaaatacctctgcttgatgcggtggagctttcgccgttctcggaccaggtacgcgcaagtgattccgatcacgagggtcacgagtccaacacttgcacctgcagcatcaggattcgaattgaaggttcagactgacaaaaactcccggggaaaaacactaatatatttatttagtagaaaaacgtctcccaggctccagcgacgtaccaacaagcggcagcatccaagttgacctctgacttttgacgcaaacgccattgatcatgtttcttcctcgtgggcatgaacatgtgaaattcccgaagtgtattttcgcatattccagcgcaggggtatttaaaatttcc

SEQ ID NO: 23458 - DNA, 209 bp, Sorghum bicolor
  Clone ID: 15045530
accagaatgtgtagcatgagttattcatttctgttctgccattgtcgtgtactgttgcagttgtggtagtgccttgttgtagtaggtataggtgcctgagtttatatgtatcatcgtgtatgtaccattggtcgctctattttatgccattgtaccaaccccagacattgattattacaattcatcttgcagccgaaattcttgtctct

SEQ ID NO: 23459 - DNA, 650 bp, Sorghum bicolor
  Clone ID: 15045540
acaccgacgaaaagatccggtgcaggcacggcaaggcacccctatgctctccaccacccagaaccagttgcacatttcgccctctccaccggagcattttcagacccacctgtccggctgtacacggcgaagaagatacagcagcagctggaggcggcgcggacggagttgatccagggcagcgtggtggtgcggaagcaggcgctgctgctgcccaaggtgctgcactactacgccagggacgccgcgctggagctgcggcacctggtggagctggtgtgcgagagcatgtcggacgcgcagcagaagcagctccagcagctgcagctgcagcacggcctccggcggagggtcgacaagtgcgtcgagtggatgccgtacaagtcgtccttcagatacgttgtacatagggatctcgctgactaagcgccacgtacggttgccctgttttggttggttggttggtttcgtgtccgttcagaacttcagatacatgcgtcctgttacaaagtgtaagtaccggggtctttgggtgtgcatgcgaaagagagtgtgcatgtaaatacaggtgtggtcatgactttgtgagtagttttgacttttgagctaggaaattgtggcttgaaatactgtacattttctttgtggct

SEQ ID NO: 23460 - DNA, 622 bp, Sorghum bicolor
  Clone ID: 15045546
caccctcatgattccttcaaattgtttaatatcatttgtttgacacttaaaaatatttgttatagtatgatatactcctaacatttggcatactcagtttttctcgaatgtttatctaacaaatattgaagtaaggctactgtatatctataaatgaaatgagctagagaaaactgtattgtttaacttcaatttactcttttaccacactcattaggtggatttggagtgttagaaaatatgttgaaaactggataaaagatctctaatggaaaagcaatattttttttccattgcagggatcggacaaacacagaagcaatactatgtctagaaggcatctgctggtcgcttgtgaggcatgaagtggtaatccttgaaaataatttctcaaccttggtgtacgagctccagggtctaggcatcgttgtttggtcattttgtggtcgcgccactaatccgagacacaataagaaggttgtcatctaagttgtgaattcgtcacaataggtaggatacgaaacaaggttctgcatgagcttgcccattctagctataagggctgagatggaattgtacaacccaagatcaaacataaaaataccatgacattattctgttc

SEQ ID NO: 23461 - DNA, 489 bp, Sorghum bicolor
  unsure (1)..(489): unsure at all n locations
  Clone ID: 15045549
tcaaaaaagaagaggtgaagattgaagcttgggagagtcgtcaaagaggaaaaattgaatccgaaatgagaagaatagaggaacatgctgagagaatgagaagcgaggccatggcaaagatggcagaaaagctagagatgacacgccgcattgctgaagagaaacgagcttcagccaatgccaaaatgaaccagcaagcagcaatagcagttcagaaggccgagaagattcgccaaacaggacgagttccaggatcaagtatcctatgctgcagtggctgcttctgtggaccttattagtagatagtagtattcgacaactagtattggtttgggataatagtggtgggaaatctgaattccaccctctagaagtcagcattccttgattttagcatgaaagaggaatgtctgaggtattcagatgcaaacacattcttgtttgtcttgtatgtaaattattaaggtacctcncagctgatccttggtc

SEQ ID NO: 23462 - DNA, 501 bp, Sorghum bicolor
  Clone ID: 15045554
aggatgggagcaggttctggaggaacttgcagcagaaattttggatgatcctgctcctaaaaggttatttcttgcacgaggcaagctccaaaagctcttggtggaatttgtacctcctaaactaatactccagaagctcgtagaactcttcctgaagggaattcatactggcgtgaagagggaagtctattattggcatgcgtactatgataagaggttgcctgtcggtgcaagtgctctgcttaaattggaagaatttgttgccaagttcatgagcatccaccggaaaagcctgtcacatgagcccaagattcgtgaggtggcgccgtgagaattggtagagcatgtcctcatgcggttcggccgtgtaaatccctgtggtgtggttactctgttttatatattgaccttatgtgtcaacttcaactgttatagttcatcttttttttttcgttgtatggtacatatgctgtctatacgagtgggtacatatatgctgct

SEQ ID NO: 23463 - DNA, 460 bp, Sorghum bicolor
  Clone ID: 15045559
taatctggagtggagggagtaacagttgttggtgtgtactgttagaaaacctaaaaattttcttgtgcaacgactgcaggtcaggaagcatcagccccagatggcgcaaataccgatcaagttccaggagccatgaagctggtattagttcacacacagacacactctcttgtgaacgaataaacagtgcaagatatctgttggtcttggcacctgtgacaagcgacaatggcagtgtcgcagcgttctcagttgtatgcgacagttgatccctccctccagggggctgttgtaaagttatagctagaattcgtacaagtaatgtaaaaggcatttcaattctcctctctgataccagatactccaatcatcttttgtataactgtggtggtgccctatggttagttgatagcttgataccagatactcctaagcccaatggttacagtattagaccctc

SEQ ID NO: 23464 - DNA, 518 bp, Sorghum bicolor
  Clone ID: 15045573
cattaaaaatattgaatactacatgaagaaccattgaattgctgctctgctaggagaagcaattggaggcacggtgatttcagttatttagaatatggtatccagtgtgatgaaaaatatgaactattgaaaaaacttgttcacaagatatgttggggttatttcctaaaatatctttcatgcctggcaagccctaatacaatggcttaaagaaggttcatgatacttcgattatcttctcatgtcattgttacagccgcagtggtgatctctttcccttgctatcgttatgctctgctcaaaatgttcttgaagtcttattagagggtggaggtatgcatagtgcacatttgggtacccgaggcattacactaggttgccagttgtctttgggactgttgatgtcacatttccatccattatagcttgattctctttggatggttagtgcgtgagtgaaaatggatttagcaagttatggataaatgttgtgtataccaaataatcatttttttctt

SEQ ID NO: 23465 - DNA, 494 bp, Sorghum bicolor
  unsure (1)..(494): unsure at all n locations
  Clone ID: 15045585
gtcctatcttgcttgattgcggtgtctgtgaacttcagtacatttcttgtgattggaacaacatccccagtgacataccaggtgcttggtcacctgaagacatgtctggttctatcatttggctacactctattacacgatcctttcactctaaggaacatattgggcattctaattgccatatttgggatggcactgtactcctacttctttgtaagagagggcaagaagaagtcagcaaatgatgctctgccagtttcacagatgtcagataaggaggctgaaccacttttggcaactaaagacagcaccgacagcaagaaagcaaatggtttatctcacgactgctaaggcttttcttatagtttaggtcctagtatgaactgctcttcagaatttaagtggaccttgaaagccacttcttttcatttcttgatttcctttttaggaaaggaagatattttanaaatttgattattatttggttgtattct

SEQ ID NO: 23466 - DNA, 142 bp, Sorghum bicolor
  Clone ID: 15045599
tggaaccaaatcaaagttgccatggcaattcagtgattgaatgttgttgaggatgtttttggtgcgccgcttaagtttgagtatccatgctgtggtttcaagatcagaatccatggcgggtggttatgtacaaatgcggcga

SEQ ID NO: 23467 - DNA, 532 bp, Sorghum bicolor
  Clone ID: 15045604
accatcggcggtgcactctcgttcctcgtctctggcatgaccccaaggattggcatattcttcttctcatttgcgaccatcaagaccgtcgatgaccactgtggtctgtggcttcctgggaacatcctccatgtattcttcagcaacaacagcgcttaccatgacatccaccaccagctctatggaaacaagtacaacttctcgcagcccttctttgtcatgtgggacaagatcctcggaacatacatgccttacgctctggagacccgcaagggaggtgggtttgaggcgcgcccggttaagctcaaccaagcagagcagaccaaagctgattaagcagtgtggtttctcctgtttatctactacaacttcccctgattcccccccccccttctgactgcatttgtactgtagaagtattttcctgtccatatagtaaaatcatttaggcaattgccatgttgtacccaaaagatatagcaaataaaggtttgttcaaaaaaaaaaaaaaaaaaactcgagggggggcccg

SEQ ID NO: 23468 - DNA, 574 bp, Sorghum bicolor
  Clone ID: 15045608
tctgcatggagcgccaatactcatatttgcaaacaagcaggattcaccagcagctgtcacggaggaagaattggctagacatctgcatcttaaggagttagatgagaggccatgcatgttccaggctggatctgccttcgatgggactgggatcaaacatggtgttgactggttggtggaggaaatggaaaggagtaaacgcactgaggcactaagggcgcgtacagaagcagctgggaagatttaacacctcaactcaggctatcacctgtgattttccagaatgcaaagcatctgaggatggctcctattaaatccatgaatagagacaattgttcgggtggagcctcatcttttcagtcaggccccagggtgcccccagaaaagatttcttggttgagctgctcttgcagttttgtcgtaggatgtccattgtagcaatggcagggccgcaggggtgaccgttgattgggtttgttgacctgcgtagcacttaagattgtgtatctaaagttgtaggggttcgtgttcatgtgattatgcatggatatactgattgtacattcgtcagttc

SEQ ID NO: 23469 - DNA, 586 bp, Sorghum bicolor
  unsure (1)..(586): unsure at all n locations
  Clone ID: 15045612
cgaccagacgccccaagttcagggcttccacttgctgcggtaccaccggaacccgtcaacgcacgggctggaacagtcagtcccaccgggctgcgccgacgccagcacggtgccaccggcgcctctgccagccgccgctatgccccgaggcttcgtgccgcggctggccgcgcagcagggggacactccggtgcagccgagctttgtgcgttggcaaatcagtctgatgtactatgctgaatggccgatgttcatgcacaaccttcaacgaggtatgcatatgataggtgagctgagatgcctaggcatccagtttctcttcgtttatccgaggcgataggaaaaactgtgtgtgtgtgtgtcaccaatgggtggccatgaagccgcgctatgatcttgggcttctcacattagtttgtaggggcttgtaaatcagcctatgtgctgtaacatttgcgttttctactctttgattataactcgctgtgagggtggatgggcggtcaacaaaactgaaaaccaaattcccctttattagtagtacntagtagtaactgctaattaccattcggttgttttgcaagtt

SEQ ID NO: 23470 - DNA, 374 bp, Sorghum bicolor
  Clone ID: 15045637
caacggccaagctcttggtattatccttgcttcacactctcaggtcccatttttcttgcataggaggaggaatatctttgagttgcggcttgatatatgtgaatattccaatgagaaatttactgctgctcgccacgcaaaatagcacgtttgtcggggcttgtgggtttgttgagtttgcatattgaggttttcatgattatgtcaggtgttacggatgcctgtaggtgactggttctgggagcgaggtgcctccatgctaaggttctcctgacttccggcaaccacgcccacgatgattggttcatatcagttgcatatttcctgcaagaacaggagcggtgctatgcgcatcggtgtttacagcagaattt

SEQ ID NO: 23471 - DNA, 379 bp, Sorghum bicolor
  Clone ID: 15045639
ttctcacgtcaggttggctacgggatgagaactccttccaacagcccgacaaggtggttccggcggcgagtccaataaccaacgcgggcaagcagatgggtgttgttctgaactcatactccctgacctcatttgatctcctcttggattcggaccagtcggtgcctccagtctcagtgtcgagcctccattccagcgtgtgattagtgtcagatatgcgtgcccacgatactcaataccgatacgggtcccccaaggcttcaatagaaaaatacgatatacgtaaattatgaagtacagctgattatgtatatggatcgttgtatacgaaagttaacaaacatgatttccatagccaaacaagctttaaagattatcc

SEQ ID NO: 23472 - DNA, 333 bp, Sorghum bicolor
  Clone ID: 15045659
gaacggccacgacgaatcagaggaaagatcgacaccagaccgcttgtccttcttcggctgctgatccggtggtgttctctcgctagatggataattcttgccttttttcccttcttttttttcttctcttttttgttcttttcttaccaccacgatgatgatgatgatgattcgatattatgtgaataattcagttatgtccatgtaagctgtgaggaaggaaatctgagcttttccttatctttctctggtgtgttcgagtcatattgctgctgctgccctttcatttgttggaaagataatggaagaaatcaagagaaattatttacacag

SEQ ID NO: 23473 - DNA, 382 bp, Sorghum bicolor
  unsure (1)..(382): unsure at all n locations
  Clone ID: 15045680
acttgtagaaaactgaagtctccagcatcactactcagcagcagcaaantagtatgaaaccaagcacatatccaaggtcatatatactgggagatgccaaaaggccagcggccattattttgttggcactacaatcctggattagtggatatacaatacaaggctctatatatgtgatcagtctgttttggcgtaatgtacataggcgatgaaacaaagtagtacacgaggaaaagcgaaaccctgtttaggtcagcattcatcagtaggcaaagtaggctattaggttctttgactgcctatttttcctctttcctttttccggatatgcttatgtatgttccagaaaccatttatatatggtgaaagttatcgtgcagtg

SEQ ID NO: 23474 - DNA, 307 bp, Sorghum bicolor
  Clone ID: 15045683
cattgtggtggggaaaaataccggcagcactgtgtatatattcctttcaccaagccttgtgccggagctgcgcctgcaagcaagtgcaagcatgttgacttgactagttattttaccagttgtcgatagcaaaaatcttcatactggcaatacagactgcaagaactgaaggcatttggaactagagagttttgactagttcggtacccttctatatttgcacatatactgataattttcacaatttgatatttttaaaatgacatgattgatgtaagacagattagtagaagttaaaggtccatgt

SEQ ID NO: 23475 - DNA, 258 bp, Sorghum bicolor
  Clone ID: 15045696
ggctgcaggaattcggcacgaggcagaggccggcggcgccgcggaaggtgccggtggtgtactacctcacccggagccgccacctcgagcacccgcacttcgtcgaggtgccgctcgcctcgccggaggggctctatctcagagatgtgattaatcacctcaacatggtgcgcggcaagggcatggccgcgatgtactcgtggtcctgcaagaggagctacaagaacgggttcgtgtggcacgacctttcggaggatg

SEQ ID NO: 23476 - DNA, 239 bp, Sorghum bicolor
  Clone ID: 15045699
gcacgaggcttgctgctaagtggaggtgcttcattgggatcctttcatgtgggtgttgttaaaaccttggtagagcataaacttttgccaaggataatttcaggatcaagtgttggctcgataatgtgttctatagtagcaacaagatcatggcctgagctggagagcttttttgaagagtggcattccctgaaattttttgatcagatgggtggaatctttcctgtgggttaaaagaa

SEQ ID NO: 23477 - DNA, 249 bp, Sorghum bicolor
  Clone ID: 15045703
gcacgaggatttccttcctccacccaacgagagccaaaagcttcgcgccccacgccgccccgccggcgacaccgtccgttccccgcagcgaccggcgaccaggccacgggctttgatcgcctccgccccgtgcctaccccggccgcgggcgtagctgccacctccaccgcagcaggtccggcccggcctcgcccggtcccccctcggcgacttctgatccagccgcgtcgcgcgacagctcgtcgtccg

SEQ ID NO: 23478 - DNA, 251 bp, Sorghum bicolor
  Clone ID: 15045707
cccgggctgcaggaattcggcacgaggcaagggcccgagagtgataagcggaaccctaccactgctcccgccgtcatggcgccgccgccggaattcgtcgaggtgcggtgcgcggggtgcggcgagacgctggaggtggagccggggctctccgagttcgcttgccccgactgcgggacccagcaggcgctcccgccggagctcatgcccccacccccgccgcgcccgcgcagggcgctgcccatcccaag

SEQ ID NO: 23479 - DNA, 239 bp, Sorghum bicolor
  Clone ID: 15045712
gcacgaggcagaactggatccaggttgagggcgataagttcaagttccctggtggtggcactatgttcccacgtggtgctgatgcctacatagatgatattgataagctcatctcattatcggatggcaagatcaggaccgctgttgacacgggttgtggggttgctagttggggagcttacttgctgaagaggaacatcattgccatgtcatttgcgccaagagacacgcacgaagct

SEQ ID NO: 23480 - DNA, 227 bp, Sorghum bicolor
  Clone ID: 15045716
gcacgagggccacttcccgcctcctaactcttccaggcttccgccgcaccgtcgtcggcgcgtccacttcccgccgcccgccgatgacgccgtcctacagctccggccccgcggggcccgccgtggggcggagggcggcgaccttcgccggcgcgagcgtgttcctgtcgcggagtctggtcgcccccgaggtgttcgacgccgtgcacgacgcgctccgcctcaac

SEQ ID NO: 23481 - DNA, 203 bp, Sorghum bicolor
  Clone ID: 15045738
gcacgaggcctgttccctcctcctctcctctctcctctcgctcgtctccttggtcggctctgttcttgggagtgctgccagtctggttgcgttgcggcagcaaaaacttcatcgacagcatctgcctgcgacgttctgatgggtttgggttgcttcgggtgcttcacgccggaggtggatgaggacctcaagccctccaagca

SEQ ID NO: 23482 - DNA, 232 bp, Sorghum bicolor
  Clone ID: 15045747
gcacgagggtcacgccgcaacccccagcgacgctgcactccctcccccgcaatctccgatctcaatccagctcccctccctatcgccttcaagctcacgccactccctccttgccgccgtgcgacgggcgccgtgcgccggacacataccattcacagcgactcccgttgctccctcgccgtcgcgacacaccgcccgcaccatagcgccgcccacagctcgctctcggagc

SEQ ID NO: 23483 - DNA, 470 bp, Sorghum bicolor
  Clone ID: 15045754
gcacgagggtaaccctgtctcaacacatccagaaagagaagttgctgataatatagaagaagattcacatgcagaaaattgttcccaggagatcaatgagttgattgcaaatgggctccacttcagaaaacatcaacaaagcataccaacattgaccaatcatttacctctgactcaaatgcccatgctaagaatgatggcactgttactcaaagtaatttgggccagccatcacaatttgtttcagctcggacaggtgtttcacgcacaactacaaaatccaattatgctactggtcgccactaccagataagcagcaccaccacttcgagtagcccatatagcaatggcagattaagtggggagagtggaaagtttagtgaaatcactgggaaactagttggaggcgtcatgaaattaacatccaccaaggtgcaaaatgatgcgtggcttccatgtatgacagggaa

SEQ ID NO: 23484 - DNA, 388 bp, Sorghum bicolor
  Clone ID: 15045760
gcacgaggcccgcgttcgtggtctccagctctccattccccaacctcctggttcagctagcgtcgccgccgcaccgtacccacacctccggtggccggcgcgctcatttcccgccgagcgagcgcgatggcctcgatcagggatctagccatagcttctctctcagctgcggcgggcgccgttgctgccgcagctgcgctgcgcctcctgtcttcccgcagaacatcctccgtcagaccccagaacctttccctcgccgccaatggatccgcctccgagcgcctgctggcgcagtcccccttcgatcctgccaagagggaagggtatatttcctgcgacgactacttcatggcgatcgccttcctttcggctgagcggtctaaggatc

SEQ ID NO: 23485 - DNA, 482 bp, Sorghum bicolor
  Clone ID: 15045764
gcacgaggatcaccttctgcagagtatggagctgttccattgcctggcaaggaaagacagcatgaagcccaagatgtgtcaattgaagctgcttatttcaatgaaccagcaggtagctcagcccttaaagacagcacaaagtctttgatgccttctttgtcatcgtcgcctcctgatgcacactcccagcatcatcactctatccttagagtgcactctcctgataaactggttggggatttacatcttttcgacaattcagttgtgttcacggccgaagagctctctcgtgcccctgctgagataattggcaggagctgccatgggacatcctacaaggctacacttgacaatgggtacatgctgacagtgaagtggctgaaggagggctttgctaagagtaagagagaattttcccgtgaaataaagaagcttggtagtgtaaaacattccaatattgtccccttgcgtggctactactg

SEQ ID NO: 23486 - DNA, 457 bp, Sorghum bicolor
  Clone ID: 15045774
gcacgaggcacctgcggcatgtttgtgcatatggttactgtgcttccattgtttccagtcttatcttcttatcctgctgtcaatgggccatgtttttgcttttgctttatgatttggtcattaatattttgctaccatggtcacaatgtacaactttgctacaatgacacataatgtgcaaatagtctcctagccccaccccgtatcttcaactgaaaagatatttggatgtttcttatgggatcgttgacatgtatgtctctttgggccatgcatctttcttttgtctttcatgtttacactctacaatatgcggtttgaaggaatgatgtatctctaggccatggccatgctaccttgaatttgtagcgtttatttatggttttgccactctaaaggtctgtattttgggttgtttcgctagaaacgagtatatacttatattttgctctaatgt

SEQ ID NO: 23487 - DNA, 534 bp, Sorghum bicolor
  unsure (1)..(534): unsure at all n locations
  Clone ID: 15045775
gcacgaggcttaataatgcttgaggaatggagggctcaacgtgatagacatgttgttgaggacgatggagttggtgttgaaaatggatatgtcgaggaccttagagagctcgacaatattgacagtgatgatgactatagtgacgatgagccaaccaccgccgttcgtggagataatttctaattcatgcacaggacaaaatgccgggcggaaggcgaccgcggcgaaaggaggtcgcctcgaccttcacgaggcacaacgacaccaacgacaccgacgacacggaccttcagcctcagctggagtcgtcaatgagcagggaccgtggacggggccaggtcacgacgtcttctagcccgatggcccagcccgaggaggagcactttgagggcgaccacgtcggggatgaggatgaggagccagttgttgaggcggcgagttcgtctagctcgagcaagctctacgcgcggngcatcacgcgcctccctgaccgggcgcccgcacgacacgcccgagcgttgatcacaccttgcg

SEQ ID NO: 23488 - DNA, 512 bp, Sorghum bicolor
  unsure (1)..(512): unsure at all n locations
  Clone ID: 15045780
gcacgaggtgattatgaggatgatagaatgaatcttcgccttcttgtcccaaataaggttataggctgtcttattggcaggggtggttcaatagtcaatgacatgaggaagaagactaaggcaaacatcctcatttcgaagggcgataagccccggagagcatcttccagtgacgaacttgttgaggtatctggagaagcagacaagctgcgtgatgctcttgttcagataattttgagacttagggaagatgttctgaaagagagtgttgaaagccaaaattctgacagggatggcaagctaactgttgccacctctgattccttatatggaagcagtctttctttgcctgcattattacctcacaacccacaaattgcccccttgagctatgatagaagaggtgaatctgagagagctctggaagtattccctcgtaccagttcatatgggtatagctccatgcaggtcactgatgatggctacggtggacttccatcatatacatcana

SEQ ID NO: 23489 - DNA, 506 bp, Sorghum bicolor
  Clone ID: 15045785
gcacgaggctctgtctctctctcttttcttggaacctggagaagaggaaggaacagggagcagggtaagaaggcagaggttgctgggacagcccaagtatcaaatttggattcagacaagcagagaaacaccagttggtcaagatgtcagctggtttccagctcggtgtgatcgggtcacttgcactctctgttgcatcttcagttgccattgtcatctgcaacaaagctctcatcagcacacttggttttccattcgctacaacattaacaagctggcatctgatggtaaccttctgcaccctccatgtggcacagcgcttacatttcttcgagcccaaggcaattgatggacatacagtgatactctttggattgctgaatggcacgtcaattggccttctcaacctgagtttaggattcaactccattggattctaccagatgacaaaattggcgatcatacctttcactgtgctattggagactatcttcttgaagaggaga

SEQ ID NO: 23490 - DNA, 122 bp, Sorghum bicolor
  Clone ID: 15045798
gcacgaggctcacggcggcggacaccctcctcaccgccttcctgctcgccacgctcttcgccaccaatgatcccccgcgccggaccaccgatcgccccgcaaccgcgatcgccgaggaggtg

SEQ ID NO: 23491 - DNA, 107 bp, Sorghum bicolor
  Clone ID: 15045799
gcacgaggatggcagcggcttatattacaccgagtgattacttgttttggtttcggtcacacacagctaaagagatcaaatggggtggcgcaaagcatcaccctgag

SEQ ID NO: 23492 - DNA, 541 bp, Sorghum bicolor
  Clone ID: 15045801
gcacgaggagaacattgaaattcgccaaggtagtggaactgctcagcggatgggcatgtcatttgaaaaagaaaaatctcaccttagaatcgataatcaagatattcagaaccctgttaatgaagttgtcaattttcctttgaaagaaggtaaacaaaaggtctaccctacttcagtaaaatctgattcattgaaaatgaaagcaaagttagtgaggttcaatgttgaaactggagtgcaacatggcactgttaagcaagcgacttcaaatactttgaagacaagtccaatgaggaaggatggtagtatgattacatttgctctcaaggaagctagagatctaaagcataaggcgaatgatttgaagaataaaggacaagaacttgaaagtacaggtctgtactttgaggcggctttgagatttctgcatgtcgcttttcttctagaaacacctagttttgacatttcaagaccaggtgatggagctaagtcaatgaagatgtactctgaaactgcaaaattatgcaatttttgtgctcat

SEQ ID NO: 23493 - DNA, 598 bp, Sorghum bicolor
  Clone ID: 15045805
gcacgaggctcatctcatctcatccatctcggagctgaggcaatctagcaaaaaggcgcttctttccctgtttgcttgggacaggacacagagccaggagaaggaaccgtcgggggcctgagcttcttcttcttcttctttcctgggctcactgactgaagcgaggatggcatttgcggtctccgacgagctgctgggcaccttcgtgccgattgcggtgtactggctctactcggggctctacgtcgtcctggacgggctcgggatggacgactacaggctccatcccaagggggaggaggtcaggaacattgtgtccaagtggacggtcgtcaggggcgtccttgttcagcaggcgtttcaaatcgctgtctcccttcttctcttcacggctcttggtgacgaggatggaacagtgaagaagcagcccccggctctggtaatagcattgcaatttatcattgcaatgtttgtcatggacacatggcagtacttcatgcacagatacatgcatatcaacaaattcttgtacaagcacatccactctaagcaccacactcttgtcgtcccctacgcctttggagctctgtacaaccac

SEQ ID NO: 23494 - DNA, 415 bp, Sorghum bicolor
  Clone ID: 15045808
gcacgagggtcactcctactgaggatactccagccacagtgaagcaaccagatggagaggacaaaaaatggttcaacagtgaagaacgcagcaaaacgcctcaccaagaacaaagtacaacagatcaagctgaacaggtccttgagggtgcaaatgccagtgctgcagaacatgagggtgcaaatgccagtgctgcagagcaaactgtaccaatcaatgcaccggcgcttactgttcaagagatcgtcaatcgaattagagcaaatcctggagatcctaggatacttgaaacacaggagcccctccaggatttagttcgaggagtattgaaagtactttcatctagaacagctcctctaggtgcaaagggctggagagcattagttgcctatgagaagtcaaacaaaagttggtt

SEQ ID NO: 23495 - DNA, 497 bp, Sorghum bicolor
  Clone ID: 15045811
ggcacgaggaccgagtccaccctccacaggccaccgggaaggaaccaccggctcccgttggctcggctcggctcagctcagcccgccaccgccgtccctccccgcgaccgcgatccagatccagccagctgcgcgcgtcggcgttgccccttccccctcgacgccactgccgtggagtggggatcatccgcctgaaccgggtcaaccgcttcgttccttggtggtgggtagctgatcgggggagttcggaaccttgcacttacagctatgttctccttgttctatggtctatggaagcatgtcttcagcaagacagagttccatgtgcttatcctcggagttcacaagtctggcaagacgaccttgctagaaaagttgaagtcgatctacttgaagggagaagggcttccgcatgatcgtattgttccaacagttgggcttaatattgggcgtattgaagatgcgaatgtaaagcttgttttctgggatctgggagg

SEQ ID NO: 23496 - DNA, 450 bp, Sorghum bicolor
  Clone ID: 15045813
gcacgaggctagattggaggtgcatgctgcatctaaaagcttaattagttctcgaagaacaaataagattgaagctactccagcatttgcaagctgggatgctgattttcagtctgctaattcagaaagtgctgccaaaaactccaagcaacctgatctgtttaagagttcttctgaggccgagtcttttagtttcccagcttcagagactgccattaaacctgtagtaggtactgaaaataaaacaaatacaagtgccatcctagaacatcattcagaagatttggcttcagcaagtggcacattatttggtgatgatgatctttctaatcaaaaggttgcccagcctatctttgagagcaacagtgctcctgagtccactgaatcctctctccgcatgaattttgctaagcgcgatcagttacatgaaatggatgatactggagtcaa

SEQ ID NO: 23497 - DNA, 590 bp, Sorghum bicolor
  Clone ID: 15045816
gcacgaggcttcttcttcgtactcttccctcttttcttggatagccatagccagagtcctttcttggctcgccggagccctttcttatgtcgccggagttttcgcgggctgtgcgttgtcgtggctgtgcgttgccgtgggttactcttcttccctttccgtgggttcttcttgttcatcttcttccctcttttcttggagtcctttcttggctcgccggagcatgtctcgccggaatttttgccggagtcctttgttgtctcgccggagttttcgcgggctgtgcgttgtcgtggctgtgtgttgccgtggcttactcttcttccctttccgtgggttcttcttgttcatcttcttccctcttttcttggagtcctttcttggctcgccggagcatgtctcgccggaatttttgccggagtcctttgttgtctcgccggagttttcgcgggctgtgcgttgtcgtggctgtgtgttgccgtggcttactcttcttccctttccgtgggttcttcttgttcatcttcttccctcttttcttggagtcctttcttggctcgccgggattttttgctggaatcctttgttgt

SEQ ID NO: 23498 - DNA, 413 bp, Sorghum bicolor
  Clone ID: 15045828
gcacgaggtcataacacgcttgcggcgttatgcgagtttctgtcgaactctggctagccatgtgggaccatcttctaccacaggcgcttctagaaacatggttacaagtccaacaaacagttctccttcgccatcaaataatcaaggtaatcaagggggatcaacaacatctgcaacaggaaactcacaaatgcaggagtgggtccaaggtgcaattgctaagattagtaacaattctgatggtgctgtcactgcaacacaaaatcaaatgagcacgaggtcatcatttatgcccatcagcattaacacgggcactttccctggaacacctgctgttagacttattggggattgccattttcttcatagattatgtcagttactgctattttgtcttcttttccgaagaaggc

SEQ ID NO: 23499 - DNA, 556 bp, Sorghum bicolor
  Clone ID: 15045830
gcacgagggccaggtgctcgccactggcgacgtccactccgcgctccgcggcctcccgggcctcgcgcgccagctgttccggtgggcggagaccaccccgtgtggcttccctcgctccgcctccgcgttcgccgccgtcctcgtcccgctcgcccgagccaaccacatccgggccgcctaccctgtctccctccgcgccctgcacctcggcctcctgctccccctcgtgtccctcctcctatctgctcccctctctcccgccccacagtcactattgagcctcctcttacgcttgtccaccaagtactcgaaggaatgcacagaccgcgacgccacgcccgacacctgttcgacgctgtgcctgtccgccttccacgagatggcaagccacggcgtggcccctgacgttaaagactgcaaccgtgtgctccgtgtattgagtgatgcggccaggtgggatgacatttgtgctgtgcatgcggagatgctccagcttgggattgagccaagtattgtcacgtacaatactttgctggattctttcttgaaggaggga

SEQ ID NO: 23500 - DNA, 378 bp, Sorghum bicolor
  unsure (1)..(378): unsure at all n locations
  Clone ID: 15045846
gcacgagggtggattgtgggcggagcttgttagcaacagaggttttgaagctggtggttctaatactccttcaaacattgacccatggttgatcattggggatgaatccaatattattgtggcaacagatcggtcatcctgttttgctagtaacccaattgcacttcggatggaagtactttgcggagctagtggagctaatgcttgcccatcaggaggagttggaatctacaatcctggttactggggcatgaacattgaaagaacaaaggtttatagagttaccatgcacattaggtcatcagaatcggtgaagctgacagtttctttaacaagttcagatggtcttcaaaatctagcttctcatacaatcatgng

SEQ ID NO: 23501 - DNA, 417 bp, Sorghum bicolor
  unsure (1)..(417): unsure at all n locations
  Clone ID: 15045850
gcacgaggggataacaggccatccacctcatcttccacatcacgtgggatgtctccacgaagaaggcttgcttctgatggcataactgctgtaaccaacggcgtggacttcggtgataatgctaacagaccatcaacctcttcagcagtatcacgagggatttcaccaagacttcaattagcctctgatggtgttggcactgtatcaaaaggcacaggtcttgctgatgaactggacaggccatcaacctcatatgcaacaccgcgaggtatgtcgccacgacgcanggttgcatctgatgccagcaatgccacttcagaaaggatcaagttcaccgaanaggattctggaactgtgtcctcttcagttgcacctagaggggtctcaacattaagacgacttgcctctgatggtgtt

SEQ ID NO: 23502 - DNA, 428 bp, Sorghum bicolor
  Clone ID: 15045862
gcacgagggttatcacaaagaccacacttgttatatgattatttcaagcagcggtttgcgcaggttacaaatcctgcaattgatcccctcagagaaggtttagttatgtctcttgaggttaatattgggaaaagaggcaacatcttggaggtcggccctgaaaatgctgatctggttgcgctatcaagccctgtgctgaatgaaggtgaactagaaactctattgaaggacccaaaactgaagcccaaagtactgtcaacatactttgatattcgtaaaggtctagatggttcacttgataagacaattcaggctctttgtgaagaagctgacgctgctgtgcggagtggctcacaacttcttgttctttccgatcgttctgaagcacctgaaccaactcgtcctgccataccgatacttctagctgt

SEQ ID NO: 23503 - DNA, 406 bp, Sorghum bicolor
  Clone ID: 15045883
gcacgaggtcatcccctacatggagcaaaagatccgtgtcctcaatcagcaggtagcgcaaacaagaaagggtttcagaaatcagatcaagaacttgtggtggagaaagagagatgatgtcccagaagcttcaaatggaccaatgtatacattcacctccatagaatcacagatcagagtactaggtgatttcgccttcatgttacgagactacgagctcgccttgtcaaactacagattactcgccactgattataagcttgataaggcttggaagcgatttgctggtgtacaggagatgagtggactttgctatttcattttggatcagtcaaggaaggatgcggagtattgcatggaaaatgccttcagtacatatttgagaattggatcttctggccagaga

SEQ ID NO: 23504 - DNA, 430 bp, Sorghum bicolor
  Clone ID: 15045889
gcacgaggggagccgccgccggcgggattggtgttgccgagtttctcggcgccaagaacttcctcatcaccggcggaactggtttcctggcgaaagttcttatcgagaagatcttgaggacaaatcctaacgtcggcaagatatatgtgctcatcaaggccaaggacggcgaagctgcattgaggagactgcaaaatgaggtcgtagacacggagctgttcaaatgcctgcaggagatccacggggaaggctacgacagcttcatcgcaaaaaagctggtccccgtcgtcggcgacgtcagggaagccaacgtcggcatttcccccgacctcgccgacgagatcgccgaccaggtggacgtcatcatcaactcggcggccaacaccacgttcgacgagcggtacgatgtcgccatggacatcaacaccgt

SEQ ID NO: 23505 - DNA, 412 bp, Sorghum bicolor
  Clone ID: 15045892
gcacgaggtgtagattgtggggttaagcatgctgcattggtcatgaaaaatggtgaggtttttacatggggtgaagattctggaggccgccttggccatggaacacgagaagattgtgttcgccctcgtctggttgagtctttgacagtttccaatgtagattttgttgcctgtggggaatttcatacttgtgctgttacaacaacgggtgagctttattcctggggagatggaactcacaatgttgggcttctcggacatggcaatgatgtaggacactggatacctaagagggtttctggagcattggaaggtcttcaagttgcttatgtttcgtgtgggacctggcatacagccttgataacatccatgggccaattgtttacctttggggacggttcatttggtgtat

SEQ ID NO: 23506 - DNA, 382 bp, Sorghum bicolor
  Clone ID: 15045895
gcacgagggtcgccggcgccgctcgcctgccgttccgcctccccgcctccggccaatccctgcccgcggggctgccgcgcctcgactccccgcgtcggatagccgccgcggccttcggatcggacgacgagctggtggatctggaactgcgggtcgagatctcgtccatcgccggtatcgaggacgcgctgctcctgaagcccgcctctggtaaggccgccgagacgcggctccgcgtcgggtgggcgcgctggcttgaggggaaggccgactacctacggcgcgatcggatgctccgctccaacctggagtccctcaatccgcgcaaccacccgctgctccaggatccggacagccccggcctcacctctctcaccaaagg

SEQ ID NO: 23507 - DNA, 499 bp, Sorghum bicolor
  Clone ID: 15045916
gcgagtccttcagcacatacccgaggacgtacgacctcgtccatgccgaccacttcttctccaagctcaagagcaggtgcaagctgctgccggtgatcgccgaggtggacaggatgctgaggccggaggggaagctgatcgtccgcgacgacaaggcgacggtggaggaggtgcagagcatggtgagatcgttgcactgggaggtcaggatgacagtgtccaagcaggggcaggggctgctctgcgtcaggaagacgatgtggcggcccacggaggtcgaggcttagagctagtgtaagttcatagtggtggctgctgctgttcttccaaatagttacgtacctagcaaaacacagaatgtggccattcctgccacgtttgcaataaccaagatagacattgggtggtatactgtatactttgttgccgagtttcgtagttgtaacctgttatttagcaaaacacagaatgtgacaactcaaaccaaccacaacatttc

SEQ ID NO: 23508 - DNA, 564 bp, Sorghum bicolor
  Clone ID: 15045922
cacacggagaaatcttgttgagaatgaccgtgttttgctgaaccgtgcacatcgtgctcaacaagaatatgaaagagtggccaactattgtcttaaattagccggtgaacaagaaaaggtggtgagtgaaagatggcttccggagctgagaaatgcagttcaagaagctcgaaggtgttttgacgattgccagcgtgttaggggcctggttgatgagtggtacgagcagccagcagccacaattgttgattgggtaacgatagatgggcagagcgttggtgcctggatcaacctcgtgaagcaactccacatggagatctccagacggacgctggccatgtcatcggtaggagacgactgaagcaaccagctgtgacccttgtggctttggaattagttcggaggctctgtgatgggttcggtttggcgccaagacatcttctatctactcgatagccttttcccattgtagtttatactagcaaatatccccgtgcgttgcaacgcggagaaaaacatcaaatggttataaaaagtgattacataatgttacatatctattta

SEQ ID NO: 23509 - DNA, 414 bp, Sorghum bicolor
  Clone ID: 15045948
ccggccacgagcaaggctagggcttatgttgtactggctcgctgtgcacctatggctgttgggcagcatcttgtgacgctgcttctcagtaccgagacccacctcatagcataattgtacaatagcacgtgttaacagtttcttctttctttcatacaatacctggtagatgttagaatgtcaattctttttcattttctccctcctgctcagatttgtaattgagcagtatgtgttaaatttttcgcacacaaagatgtaatgtgcagaaaaataacattcttataccgaagaagtcaagaagtggtagttgtagttgtagttatagatgtagatgtggtcctgaattcctgatcacctgatgagtcccatcatcgcaaattcgttgtttcaaatgcaagcgtttgaagtctg

SEQ ID NO: 23510 - DNA, 514 bp, Sorghum bicolor
  Clone ID: 15045957
gatcatcaggacgctgtcttgtgctgctctttcaaggaaaagcctgtgtttacttttggcaaccagatgggaattgacatgttagaaacaactctaattgctctacaagatctcaccctggacaagatttttgacctgcctggcagaaaggcattacacgcggaggttccgaaactgatggaacagggatatgcgtacttgccggctggggtatgcttgtctgggatgggccgccatgtctcctatgaggaagctgttgcgtggaaagttctcggtgaagatggcaacgtacactgcctcgccttctgtttcgtcaactggtccttcgtttgatgcaatctaggcgccctgtgcaaactttacgatcggcatccatttttgcattctctgtagacgagaatggtacggtgttgctgttactgttagctaggtaacacgatgttcaggtagtctttggggaaaagccagtattgtaaagatgtttctgccttgtaaatttgcgctcgtttctgct

SEQ ID NO: 23511 - DNA, 468 bp, Sorghum bicolor
  Clone ID: 15045958
gttccaaactccagaagcatggacaattgacggacattacaggtcactgatatatatgcgcccccttgcaatctgggcaatgcagtgggccttgtcgcctccaaggtcgatactggaggccccgaaggtaaatacaatggacagagctcacatttctccaggcacattccaatttctccaggatagtgttagaaagatgacacccaagaacggttgttttggaaacactgtaattaactgggattgttgatgtgattgtagcacttgtatctcattcttgtccaatgtgtgtttagggagcccctcatgtaagaaaatattgagtgtggaatgagtgccatattatgttcattcaggctttgcagttatgtggtgtacctctgacagtgagccggactttgtacattgttgtacagaaacacgtacatgatgctgtgttaccctatatattcatgagcaatgttgttt

SEQ ID NO: 23512 - DNA, 506 bp, Sorghum bicolor
  Clone ID: 15045967
gcaacaaccagtatgttgaagaaaatgataggctcagagctattctcggtgaatggagtgctcgagcagcaaagcttgaacgtgcgttggaggcagagcgggcgtcaaacatcgaattgcggaaaaacattgcaaagtttagaggtcatttgtacaaagagcaggaggcctgattttcccgtgtttgagaaacttgtacatcttcggtgtatgataactggttccgtaattttacctaagaagacaactgaccaaaggcagtcatctcggggaattgtagaattccagacgaccgacacaaatttttgatagagaagagcatctcggtctggatccattcgaactgagattgattacgagattggcacatgattgttcgatgatgcatatgcgtagtttgatgtacatatgttcgtaggtttgatcatgtagagtatggtatgcctcgtcataaaaaaaaaaatagagtatgatattcctgttattgaagactgctgagtatcatg

SEQ ID NO: 23513 - DNA, 490 bp, Sorghum bicolor
  Clone ID: 15045978
gcacgaggctgggggcgtgtctagcccattgggcacggtgatcacgcctgcacggacgaccggatctgctccaccgcctatggtgggcatcgacaggtccatgctgttggagcttgcgatcagcgccatggatgaacttgttaagctggcacagattgacgagcctttgtggcttcccagcctcaatggctctcccaacaaggagttgctcaactttgaggagtatgcccactcgttccttccgtgcgtcggcgtgaagcctgtgggctatgtgtccgaggcctctagggagtctggcctcgtcatttttgataacagccttgcccttgttgagaccctgatggacgagagacggtggtctgacatgttctcatgcatgattgctaaggccacagtcctagaggaggtgacatccggcattgcaggaagtacaaatggtgggctgctgctgatgaaggctgagctacaagtgctctcacctctagtgccc

SEQ ID NO: 23514 - DNA, 328 bp, Sorghum bicolor
  Clone ID: 15045983
gcacgagggcgttcccgacccaggcggcggagtcgagcgaggagaaggcggcgcttgcaggcaagaacaagagaaagaagaagcagaagagcaaggagcagggcgccgcctccggcgagacggcggcggcggaggaggaggaggagacgtacagccacacctggaagctctgcaacgcgagcaccggcgcggactacatcccgtgcctggacaacgaggcggccatcaagaagctcaagagcaacaagcactacgagcaccgtgagcggcactgccccggcgacgcgccgtcatgcctggtgccgctcccggaggggtaccggcagcc

SEQ ID NO: 23515 - DNA, 614 bp, Sorghum bicolor
  Clone ID: 15045988
gcacgaggatcccaggccgcgaatgcggtgccaaagcaacgagcaagcaaacaggcagtttcgactttcgattgggcgaagcgcgtggaaaatccaccgcgccaacgacaccagagcggcgtcggatcgtggcctcgtgcagcggcatccgcagcctcagccgcagcaggaataatgaatcgtcatgaaatcctcgttgccgagcccgcacacaggaacgggggagtaagcggatcggccagaagattccgcacctacgcgcaccacctatacaaggcctacaaggcgaggcgatatcccaaatccgagcgtttcatctcgccctctgctctgcccccctcatcagtcagcacacgttctccccaggttcagtgttgacttgagttgaggcccggcagttagtttgtctctgcagccatgcctcaagtccagaacaccgggcgaaactgcacactcctagctgttctttgtggggagattgccgagaagcggcagacgccagctcccctggcaccagacacaaagcgagtgcggatgtcataccccttcccggagctcgcttcgtctgggagattggaggtgcacacactaatcaatcccactttggagcaatt

SEQ ID NO: 23516 - DNA, 585 bp, Sorghum bicolor
  unsure (1)..(585): unsure at all n locations
  Clone ID: 15045992
gcacgagggttaaaaggaaagaaccaaatgcagaggtgaaatccaagaagcgcaaaaccagttctgctgtgactcctgttcgagcgtcgccccgcttagctgcattgaatgttcagcttgatgtaagaattgaacatgaagatgaaatagttacaataaatcatgtggaacaggtacaggctataaaagatgaaatagttaacgtaaatcatgtggaacgggtacggactatagaaaagagcgctatcgatcagacacagaaaagccaatcaggctctgttgatcagattcatggtaatctggaaagcactatcaatcagttacagttgagccaagcagacactgctaatggaatgccggttatacaggaaaacactacctttcattcacaaccaagccaattggataatctgaatcctacacagaanaaacaggaaaacagtgccaatcagttacaatcggtgctcacagattctttgcttccaaaacaaatcacacaggaatgcactatagatcagccaagccagccaaacataaatcatatacacacagatcaggaattcactgggaatcaattccggtcga

SEQ ID NO: 23517 - DNA, 158 bp, Sorghum bicolor
  Clone ID: 15046001
gtcagccctatctatgctttattcgatgcgactggactcttctcttctcgcctagaaggaagactaacgaacaaaatccgatccctttctggtgaatccatcatggccacggtaggagcagcgctccttcgatcggtggtaaccaagatggaccgcgc

SEQ ID NO: 23518 - DNA, 455 bp, Sorghum bicolor
  Clone ID: 15046004
gcacgaggcataaattgatcagtacttcagatggcatatctgtgttgaagattgcatgtggtcaatggcacacagctataatatcctccctaggtaagctgtacacatatggatatgggacatttggtgttcttggacatggtgacacacatagtgttgttcatccaaaagaagtggagtccttgagagggtcaagagccaagtctgtcgcatgtggaccatggcacactgctgctattgtggaaacatcaggaacactcaagagcagtgctcctggtgggaagctattcacatggggtgacgcaggtggagggaagctgggccacactaacaaaaagtcgaagcttgtaccaactcgcgttgaatcactcattgattgtgattttactcaggtatcctgcggtatgtcactaacagctgtgctaaccataacaggtgttgtatttaccattgga

SEQ ID NO: 23519 - DNA, 510 bp, Sorghum bicolor
  Clone ID: 15046020
gcacgaggcttcaaaatgaggttgaaacaagctgaatctgctgctgaaaccgcttcacatgagcatcagttgtctgttgaaagggtatgcatgctggagaaagaactcaaaatattacaggatgaatgcaacagaatggaactaaatatgcaagaatataaggaaagggagggtgcattgaaggcaagggagttagagttgctatcagttgagcacactcaaatttctgcagacagaggtataactgactatgcaatttcaaaagatcaaatggaagcccttgttgagaagataagtaagttaaatatgctgtcaggcgagtcaaatgtgcaaagggaagaggctacattctctagtctgcttgacaaactttttgttgtcattgatgaattcagtgcacttcaacgtgaggttgagaccttaagatatgaaaacgaagatttacagttaaatattgagtcctatactcgtgaacttgaacagctaagagaggtctccagaaatagtgat

SEQ ID NO: 23520 - DNA, 461 bp, Sorghum bicolor
  Clone ID: 15046030
gcacgaggttttggtattgtgaccatttcacatggtggccgtggtgttgctgcccgtgcctgtggtctggtgaacctagaaccaacaaagattgtagaaatcttgaaagaccgcccatcttggttccgtgattgtcggagtcttgaagtctttacaatgttaccagctggaaatggtgggaccattgaacttgtttacatgcagatgtatgctcctactactttagttcctgcacgggacttttggacactgaggtacacaaccactatggaggatggcagtcttgtggtttgtgagagatctttaagtggttctggagatggtcaaagcgctgccacagcacaacagtttgtaagagccgagatgcttcctagtggctatttagttcgccaatgtgagggtggcggctcgattgtgcgaatagtggaccatctcgaccttgacgcttggagtgttcctga

SEQ ID NO: 23521 - DNA, 414 bp, Sorghum bicolor
  Clone ID: 15046031
gcacgagggttactgctagggaaatgtggggcacaatggttcaggatggttcctttgaccgagataatttcagtgctggtcccagcatgccttgtttgctgggcgatacagtttgtgcagcagtttctgcttcaacctgggttgaaccacatggaagatgtacagttgcatttgcattggcttggtcttctcctaaggttaaatttaaaaaggggagtacatactacaggagatatacaaagttctatggaacttctccaagatcagccgtcaatttggtagaggacgctttgatgaagtataagcattgggaagaagcgattgataagtggcagaccccgattctccgagatgagaggcttccagaatggtacaagattacgctctttaatgagctgtacttcctaattgctg

SEQ ID NO: 23522 - DNA, 514 bp, Sorghum bicolor
  Clone ID: 15046041
gcacgagggtatcttattggtaggttttgctgctgttgccatttcagctccatggatatttctcttcgcgccagatatgatctctccattgctatgcagctccaatgctatccttcttgttcttacaggcatttttcaacaatattgggttcaccaggtcaggaaagtgagattgcagggctattatgattttagccagaaactgaagcgtattgctcgacttccatttgctactattgcttgtgggactgctttgatgctcttaatcatggtctggcaacctcttttaaaaatactatcagtttcactgcttctaaggattgccatcgtagttgaagtcacgtgtgctggatgttttatgggcttatacatatggcacatccacaaatacaactctttggatgggcagcctgatattttgcggtcattatattctgcactccagccatcttgtactttggaagatcgaagatatcatgatgcccgtctttctgatcagcaaatggcgttactt

SEQ ID NO: 23523 - DNA, 471 bp, Sorghum bicolor
  Clone ID: 15545818
cgccgccgtcgagcgccaccgcgtcacgtacatcttcggcgcgccgccggcgatgatcgcgctcgccaagcacggcgggggccgcaggtacgacctcagctcgctcaggtgcatcggctctggcgccgcgccgctcggcaaggacgtcatggtggctatggctgacagattccccggcgccgacattgtccagggttatggtatgactgaaacctgcgggataatatctctagagtacgtgcaaaagggtcgtgcccgtcagtttggttcaactggagcacttgtcataggagttgaagcaaagattgttgatacaaagacaatgaagcatctgcctgcgaaccagctaggagaaatctgtgttcgaggaccaaacataatggaaggttatttcaacaatgtgcaagccactgagtttacaatcaagcaagggtggttgcatactggtgatcttggatactttgatgaaag

SEQ ID NO: 23524 - DNA, 411 bp, Sorghum bicolor
  Clone ID: 15545827
gcacgaggattaaacactactacaccaaacgacgaatctaacttcagttgcctccaaagtccatacagagagattgacagtgtgtgagagcctgagacgatggcgaacctgttcctgaagcaggcgaagcagtacgtggcgacgcggccggtgtacccgccggagctcttcgacttcatcgcctccaagacccctcgccgcgacatggcctgggacgtcggcaccggcaacggccaggccgcagcatcgctagcgacgctgtacgaggccgtggtgggcacggacacgagcgcgcagcagctcgcctacgcgacgcgcctccccaacgtgcgctacgtgcacaccccgccggacctgccgctggaggggatccacgccaccgtcgccgcgccggcgtccgtggacctcatc

SEQ ID NO: 23525 - DNA, 554 bp, Sorghum bicolor
  Clone ID: 15545832
gcacgaggacagcatccccatggtgtccctggctgtcctggtggccgcggtgtgcgcgcgcgccgcgtcctcgtggctccgccccggcctccgccgtctcgtgtcgttgctcccggtggtcgccttccttgctgcggctcccctggtcttctcctctgcaaacatccggggactcgcaggcttcttcctcgggtggctcggcgtgttcaaggtcgtcctcctggccgtcggccgcggcccgctcgaccccgcgctcccggttgtcccgttcgtcttcaccacagcgctccccgttaagctcagaggctgctgcggcagcggcaccggcaccggcgctgccggagccggagcagccgcgtgcagcagggccaaatcggcgtccctcgtttcgtgcgcggtcaaggtcgccgtcttggccgccatcctccatgcctaccagtacgtgaaccagctgcatctctacgttcgcctcgctctgtacggcgtccacatgtactgcttcttggacttcctcctcccctgcatcgcggcagccggcggcgcgctcggcatgg

SEQ ID NO: 23526 - DNA, 542 bp, Sorghum bicolor
  Clone ID: 15545833
gcacgagggattcaaaccacaacgtgaacgcctacgctatacgcatctgcatacacattttcggcttttctccttgtctgcacgtacgctctgatccgaaagcaagttctgccaatggctggaggcggcggcgagctgaagctgctgggcctatggaccagcccgttcgtgatcagggcacgcctcgcgctcaacctcaagggcctgagctacgagtacgtcgaggaggacgtcaagaacaagagccagctcctcctcgcgtccaatcccgttcacaagaaggtgcccgtgctcatccacgacgggaagcccgtctgcgaatcacaggtcatcgtgcactacatcgatgaagtcttcggcgccaccgccgccgccggaccttcgcttctccccgccgacccctacgagcgtgccaccgcccgcttctgggccgcgtacgtggatgacaaggtgcgttcgtcaccattgctctgtttagttaagtttgacatggacctcaaacgatgctactttttgctttggacatgcattattaagtcggg

SEQ ID NO: 23527 - DNA, 410 bp, Sorghum bicolor
  Clone ID: 15545842
gcacgaggaggtgatctacgcgttgacatatcgcttcttcgagggccagcactcgttcgaagccatgtcatgggagcatcccacggagggctggtcttggaagactctgccacccccgccgtcagcattccgcagccgcgttaactcttatgtgctgcacccggacggatgcaccatcttcatgaccacggcgaataatggctgcttgggcacctactcattcaacaccaaggattctgcgtggaggtggcatggcgagtgggcgttgccattcgttggccaagctcactttgacggcgagaccaactcgtgggttggccttcgctgggatggctacatttgttcctgcaaagttgtctcccctgactgcctcaacactgctccggattggcagatgacaaaggagaagt

SEQ ID NO: 23528 - DNA, 250 bp, Sorghum bicolor
  Clone ID: 15545844
ctgccgtctgcgccggtatcaacggtgatgcttccactggtgtctacggtgcctacagcatgtgcgacgacggtgccaagcttgactacgtcctcgatgcctactaccaatcccagcagaagtccagcagcgcctgtgacttcaacggccaggcccaggttgtcagcgccaagcctgcttcttgttgctctgccgctctcgcctctgccagcgccatcaacaaggctgctgccaccgccacctgccccgt

SEQ ID NO: 23529 - DNA, 242 bp, Sorghum bicolor
  Clone ID: 15545849
gccatgccggtaaaaccgtgttgtctattgaatcagacatgaaggtcccgctgctgcaacgatcgctgtctcccaagttctctctgggcgcatcatacctactaatcggtggtgtgggcggtattggatgttccattgcgcgttggatggacgaccaaggggccaagaacatcataatattatcaaggagtgcgggccggagtgagcaagctgttgggctcattgacgaactgagcgaggtg

SEQ ID NO: 23530 - DNA, 558 bp, Sorghum bicolor
  Clone ID: 15545853
ctgctccggtcgatgcggatcagcaaggtgaagctgtacgacgccgaccccaacgtgctgcgcgcgttcctgggcacgggcgtcgagttcgtggtgggcatcggcaacgagtacgtcccggccatggtgagccccgcggcggcgcaggcgtggctgcagcagcacgtggtgccgcacctccgcgccggggcgcgcatcacctgcgtcaccgtcggcaacgaggtgttcaagggcaacgacaccgcgctccagtccgcggtcctccccgccatgcagtccgtgcacagggcgctgggcgcgctggggctccagggccgcgtcaacgtcaccacggcgcactcgctggacatcatgggcgtctccttcccgccgtccgccggcgcgttccacccggcggcgatggcgcacctgcagccgttcctcagcttcctgtccgcgacgagggcgccgttcctcatcaactgctacccctacttcgcgtacaaggacgacccggcgagggtgccgctggactacgtgctgttccgccccaacgccgccggcgtcgtcgatgagcgc

SEQ ID NO: 23531 - DNA, 196 bp, Sorghum bicolor
  Clone ID: 15545854
cgacgacgacgacatgtgtacaggccgacgttctaccggatctgcgtcgccttctccgacagcgtcttcgtcgcgccactcagcatcatcgtgcgtatatatatacccaacaactaattaaaaattatatatatatatatatatatatatatatatatatatatacgatttcgattgtacgtacctacgtgtgcat

SEQ ID NO: 23532 - DNA, 304 bp, Sorghum bicolor
  Clone ID: 15545858
gcacgaggctgcctcaagctttctgtcgctgtgctgcggttaagggcaccctatatgtgttgcggatgccagtttctgcacttcttatggatgaggaaaagaagcattttgtaggtgccagattggcatctggtcaggatattttgtgccaacaattgataattgacccatcttataagattcccaacttggatgtcccatttgatggttcacattctcacttgccaagaaaagttgcaagagggatatgcataattagcaagtccgtgaaacagggatcatcaaatgttcttgttattttccc

SEQ ID NO: 23533 - DNA, 397 bp, Sorghum bicolor
  Clone ID: 15545861
ttcaacttgatcgcgcacactccatttgtcacctgaatcgaatcttattatctaacaagtcaatttgacactctattctctaagaccaccatggacgacgaagcccgccaggccctggccaacatggacatgccgcgccgccccatcaactttgttcccgccacatcaggcgaaatcctcaaactagggcatatcacctgccgcatcatggaggatggatcgaggacagacaaccggataggcagcgcagagtttacccttccaccaaacacggctggcccaccagcacattggcacgagatgcacgacgagacgtttcttgtcacggagggtgtagtcaggttccacgcaccagatggaaaagtgatagatgctcatgtgggcgactatgtgacgg

SEQ ID NO: 23534 - DNA, 543 bp, Sorghum bicolor
  Clone ID: 15545864
gcacgaggctcatcttttttggtttcaaccgtcgaacccctccttcaggtcagcccctacatctaacgttactcacccagtcccagggtaggtactaaggttaggtataggtagtagtttgagctaccgactgatctcaaaaggtacattggatatcagcatagatcagggaaaccggtatcgtggttccaattgatcatcaagcagcccctctttgagttctctgcatctgcatctgcatctgcgtatgtgtatgcgtatgcatttgctcgctacacgctcctctcttcatcttttcaactcgtttatagttaaatccccacctgcttggccattgtgagaggattcgaagacccttgtctgttgatatcccaaccaatgagaagcttttacacctgagcacccccacctctaatcttgtcaggcctaggccccatcaagcatccaaaaacaaactcacacaaaagacggcggctaataatattcaagcaaggaccactcaattttgaccatagattgattgctttatttcaattggtgtct

SEQ ID NO: 23535 - DNA, 616 bp, Sorghum bicolor
  Clone ID: 15545867
gcacgaggcccactccattccactcccacgagatctaaactcgttatatcaacatcaacctaaccacccaccaaacccgcatccatcatgtctgtccaggatagagcccaggcgcacctctcgcagctcgacaaggagcttagcaagtaccccgccctcaacaacttcgagaagcagacatccgtccccaaggcctacgccgtcctgggtctcgctggcctgtacttcttcctcatcttctttaacattgctggcgagtttcttgtcaacattgctggcttcgtcatccccggctactactcgctgaacgccctgttcagcgccagcaaggttgatgacacccagtggttgacatactgggttgttttcgccttcctcacagtgttcgagagcgctgtcagcgcggtttactggttccccttctactacaccttcaagttcgtcctcattctgtggatggcccttcctcagacctctggtgcccagattgtcttccgttccttcctccagcccgtcttctcgcgctacttctccgaatctggatccactgctgccgatctccgcgccaaggttgactcggctggcaagtcccacgcttcttaagcgtctcttgtgt

SEQ ID NO: 23536 - DNA, 530 bp, Sorghum bicolor
  Clone ID: 15545870
gaaaaagctgcgcgccattattgccattgctccagcttggttcttggttcgcaagtatggctggcgccggtggaggaggcggagacgccggcgatagcttctacagcgacttcatggtcctgcggccggacaaaggcgggctctacgccctcttccacctcatgtggtcgtgcaaggtgtccgagaacgcggccgtcgactgccccgccggcacggagatggccgactggcgtaggcggtgggcggttctcgtctcgctggtggcgcaggtgctgctgctgtgggcgaagaagccgatggccctggttgggagagcgacagagtactggatgaacctcgtcaacgagaatggcggcggcgtcctcgtgctcgtcctcagagcgctgcaaggaaagctgaaatttccggacagggcatcccccaacttgcgatcctgcctaggactactcgacatgagagtggaactagacaaggaaattaagcaaggggatagcaactaccacgctgctctatcgatcatggctgcgaag

SEQ ID NO: 23537 - DNA, 394 bp, Sorghum bicolor
  Clone ID: 15545877
ctcgggatggccagcgcgctggagacgctgtgcgggcaggcctacggcgcggggcacctccacctgctaggcgtctacgcgcagcgctccgtcgtcatcctcgccgcgtccgcgctcctcctctcgccgctctacctcctggcggcgcccatcctgcgcgcgctggggcaggacgaggcggttgccgcggcggcgggggacttcacgctgcgcacgctcccgcagctcctgtcgctgccgctggcgttcccgacgcagaagctcctgcaggcgcagggcgaggtcggggcgctggcgtggatcggcgccgccgcgctggccgcgcacgtcgccctgctggcgctcttcgtccccgtcctcgggtggggactccgcggggccgccgccgcctacg

SEQ ID NO: 23538 - DNA, 638 bp, Sorghum bicolor
  Clone ID: 15545881
gcacgaggcagaaggcaattttagtcccaactaatcatgtagagcagctttggaaggattatgagaacttcgagaattctgttagccgcaccttggcaaaaggtttgttatctgaatatcaaccaaagtttaacagtgctaaagctgtatatagagagcgaaaaaagttcattgatgatattgattggaatgtgctggccactccccctacaggctcttacaaggaagagcaacagtgtatggcatggaaaagactcttggtatttgaaaaggggaaccctcaaaggattgatgctacaacagctaataggcgtgtcacctttacttatgagcaatgcctgatgtatctatatcatcatcctgatatatggtacgattatgctatgtggcatgcgaagaatggttctatggattctgcatcaaaaatatttcagcgagctctaaaagcaatccctgattctgaagtacttaagtatgcctttgctgaaatggaagagtccagaggggcaatacagactgctaagacaatatatgaatctcttctaggtgaaaatgctagtgtgacctcacttgcaaatattcagtttattcggtttctaaggagaactgaaggcattgaagcagctcgtaagtacttt

SEQ ID NO: 23539 - DNA, 603 bp, Sorghum bicolor
  Clone ID: 15545883
gcacgaggcacactcttcacgaaatgcgaattcttctttgccaatgccttctgttgaagatgcaattgtgcaaattgaagacacactgtattatttcagtgatgttatgtcttctggtattcctgatcttgaaaggttcatcactgaaaatatcttgcaagttctggtatttcggttcttattcccatcattgcagaggcagagcacagatttggacttaagtgtcactacatcaatgtatctactttgttgtatactacacatttttaagaataaggatatggcaagtactgtagctgctgccctttttcatcaacctgatggcctttatgataaggaacaagggacacctaatgggtttacatctgagcatgataattgcaaatttgagaattattgcactacttcctctgctgtcgagcaatcaaatgaggatgagccaaattctttgtcttctgttagttggaaacgcttgcccaacaattcaccgccaagtgattgctgccaaggcaacacaccaagggaacacttgctgtcctatatcacagaaggagatgattcacaagctttgggttcattgtgcttattcgctacattattgca

SEQ ID NO: 23540 - DNA, 542 bp, Sorghum bicolor
  Clone ID: 15545886
gcacgagggcagcatgtggctcctcgtatattcattgattcatatatatatagctactacctatagtactgtaccttataactatactgtgtacacgtataccatgtctatcatcaatcaatatcttcgagttaacagcctctatcctgccctttaatttctctctcttttctttgtcaatatatatttgaattgtgctacgtactaaactaaccctgtgcttctgttccttttatgctatgtacagttccagatcaggaggaggtcagcttggtttttgtcttgcatctgtgcaaaattttccccgtcttctttataccggtacctaccgctatcgagatcagatcacattagaatgaacatcggttgcgcattctctctgtcccaaattcagaagtactccttgtggaagtggaagcgagtgcccgtcttgtggctcatctcgtgcgatagagtcttcagctctttggcaagcatcggtgcgccgcagtagaacacaccaactgttgaattcggatgcttggaggcgatccgggtgaaga

SEQ ID NO: 23541 - DNA, 534 bp, Sorghum bicolor
  Clone ID: 15545888
gcacgagggaattctgtcgtcgataaggaagtcattggcgcgccggcgccacggaacactgcagcgtctgcgccgacaccccgggggcccgttgacactacagacgttgccggggagatcaaggcgcagtttattcgagctgcggacgctgtcagggcactttcaccacttcttgaggtcgggaggcggaggtaccaccaccgaagctcagtgtaccatgtttcatctagtatggtgtcagcgattgccttgccgcattcggacctgggaggcatcgagctcttggattgtggaagtgagaaggtgttgggaggaagaagcctgtctttgacactggagaagctctttatgtgggagaagaaattgtacgatgaggttaaggctgaagagaaaatgcgtctgctgcttgcgaagaatgcaaagcggctgaagtacttggatctgaaaggtgcagaagctcagaagatcgatacgacccgaaatatggtcaggaagctgtcagcaaaattaagaatatctgtaagagtaattacc

SEQ ID NO: 23542 - DNA, 609 bp, Sorghum bicolor
  Clone ID: 15545901
gcacgagggtacaattgcaccaactgcagattttcaacatgaagcccaagcaatgcaacaagtagtggcatgtaatgatagactgaatgaactatcaacttcagaatttgctgagcctgagaaaatgctgtcagctccggatgctgaattcaatcatgcaattgacttggggcagacaactgcggaaaaaggaacagctgaatctgatggaagtaacataataggcagccttacgagcagaaaaagacacctggaagatagcttaccagctttagagagtgagaccactgaaaggttgtctagccgaccacatggtaaaagaaccaatgattttgttcctcatgatgatgatatactggcatctattttagttggtagaaggacccctgggttcacacttgattcaacaccactgccaccgagggaatcaactctgaaacgcccaaggttggggtcgaagatgggtacactcaagagaaaagtgcaaatagatgatgccatggtcctgcatgctgatactatacggcaacagttgatcaataccgaggatatacggcgcattcgtaaaaaggctccatgcactcgttcggaaatatggatgattgagaa

SEQ ID NO: 23543 - DNA, 592 bp, Sorghum bicolor
  unsure (1)..(592): unsure at all n locations
  Clone ID: 15545903
gcacgaggctgccatagctgcggttgcaggtgaactcgtcagccgattcatctccttcgcctttagcagatattgctccagctacagctatgaaggattggaggagaagcgggagaggctgcgacaactcctgatgagggttcacaccgtcgtcgaggaggcagatgcgcgatacatcaccaactctgggatgctgatgcagctcaagctgctgtcggaggccatgtaccagggctaccatgcgctggataccttgacattccagctccacgacgacgaggaggactccacaaactgcatggttagcgactcatcaatctccttgtgttccgccactcgcttcaaacgtcaacgcacagttcttgcttcggcgaaaaaggacaaggtagccgcattggataatctggaaacagctgtggcgaacatatcagagttcgttgcgcttctgtgtgggtgtgatgagcgcttgtcccgtanaccctacgatgcatatctttacatcggcaatttcatgtttggtcgacatgccgaaaagcaaaagctcctcaacttcttactgcagcaaaacccatcagatgaccttgcaccacct

SEQ ID NO: 23544 - DNA, 578 bp, Sorghum bicolor
  unsure (1)..(578): unsure at all n locations
  Clone ID: 15545915
gcacgaggcttgatttgggggagcatgaagctgacagcaaagtggagttcacattgatttgggggagcatgaagctgacagtaagttggagttcacagggcttgagtcgctgctcctaggcctctccagcaagcccataatttctatgccccatgcaatcaatgattcctatttggcttctgcacgactgcaggtttggactttgggagaatagataatttttgaatgactgaatgaaaattggagatttgggttggctgttggaatgcttaacctacatggaaatttgcaaaacagccgaagaacaaaacatcaatggtgcaaggtgatttattatagctcatgtaaattttgcagttcttatagctaagttcattgtattatttacagatgctgctgctgtttagttgcataggcaaaaaaaactattgatacattagataggtgcagccggactgaatggtgctttgcatggtcacatttagtccttgactaanatacgaatgattacacaactatgtattanattattgtatatgcttgtattttattaatgatgggtgttctggacatttctc

SEQ ID NO: 23545 - DNA, 572 bp, Sorghum bicolor
  Clone ID: 15545916
gcacgagggtcagggctaccttaacaaggaacaatgcatatcattacttgatgagctaaataagtacaggtcgttgcccaaaacctcaaaggaagattttgaactaatctttgccgagcttgatcggagtggtgatttcaaggttacctccgaggaatttgctgacctgtgcaatactattgcaataaaattccagaaagaaccaccaccttcatatctggagaagtacccatctttctaccattcaccacagtgtgaaaagttgaagtcctttgtacggagtcgcctgtttgagtatattgttgtctttgttcttctggtgaacctaattgctgtcattattgaaacaacgctagatatagagaacagctcttcacagaaagtgtggcaagaagttgaatttgtctttggatggatctatgttgtggagatggcactcaaaatattttcattaggatttggcgcctattggatggagggtcaaaataagtttgattttgtgcttacttggactatctttattggagagaccctgacatttgcctccccatcaacgcttccttttctttcaa

SEQ ID NO: 23546 - DNA, 395 bp, Sorghum bicolor
  Clone ID: 15545919
gcacgaggatccttcagtcagccatgtgcaagaattatttgaagctgccaaagcagcaaatgatctcaatgctattgcagctatattagggaaatatccatatcatccagaatcactgttgacatttgctgaacttttcaaatattctggagaccatcaatcatcagcagatgcagtggagaaatgtctatttgcattggagtgtgcttggcatcctttatttagcccacttcagggcaactaccagttgaaattcatccatgacacaaataagccactgtttacagcactctttactcacatgaaaaatctggataggcgtggctgccaccggtctgctttagaggtctgcaagtttctgttgtcactgcactctgatgatccaaagggtgctc

SEQ ID NO: 23547 - DNA, 544 bp, Sorghum bicolor
  Clone ID: 15545928
gcacgaggcggaggacggaggtgctgctgacgaggctgccgcggcggtggcagtgaggctggccaacaagatccggaagcgccgcgcggtgtcgtcgtcggggggctcggacccggcggcggggaggaggctgcggtccaggcggcccgcggtgctgctgccgcggcgccggaccagcgcgggcggggacatgtcggagtcgtcccggagccgccattgccgtggcggcggcggcaaccgcctcgccgatggggcgcggccgtccgcgtccgcgaggaggcttgtcgacgcgttctggcaggacatggacagcggtctgcttcaaggggacgcggcggcgcgccggagcttggttctgtggagcggcgcctccacggaggtgtccaagaggtcaagaagtaagagcaagatcttggaggcggatggtaagggaagtcggcgcaatggccatgctcgatggctttcagcagatatgatgagcaccggcagcgcaatggagattggtacattctctcaagacgatgtttcaagatgtcctgacaaa

SEQ ID NO: 23548 - DNA, 352 bp, Sorghum bicolor
  Clone ID: 15545939
gcacgaggctggcctctctcatggtccttaccttggaacaacaactttctgttccttggcttctctgctcatcttgttaattaaggcatctgtttatagtccggctcaggacattggacctgagctctcgccatcattaccagatcacaatctcaatctcaagaagctatggggaatgcctgtacttttcctgtcttccttggtgtttgctcttggccatgttattgttgcttacagaacaagctgtagggctcgacggaagcttctcattcaccgcattgaccctgaatcgattttagcatacaagaatgccttctctggatgctacaaggttccaaggtctcctacacca

SEQ ID NO: 23549 - DNA, 322 bp, Sorghum bicolor
  Clone ID: 15545940
gcacgaggatccaccacctactgcccgtgatgcacggaatgcatctggtgttgtattgagtagggaacagtacaatcctcgtcccatggatttcgttccggatcttgcagatgttcgtgatgcggttggcagaatgcctcatggacatggagagcagctttcaatgccaattactggtggatgtgatgtggctgtacgaatgatgtgtatggaacagcagcaagatcgttttttgtcacggacaccgcctgagatcaatgccaatggacagttgggcaggatgcatcttggagagcagcatacacttcctatcttaggtggc

SEQ ID NO: 23550 - DNA, 343 bp, Sorghum bicolor
  Clone ID: 15545942
gcacgaggcttgatgcgggctaagggcttggagccactggtgtggagcaatgatcgcatcattaatggcttttgtaagatcaaccgatctgatgagggcatggcatggttagcaggtatgttgaaggacaacataaaacctcgaaaacagacatttgattacttggtggaatcgttgagcacctgtgggcgattggatgatgcgttgctggtcctgaatataatgttcaaggttggatttggactaggcagatttgcttgtaccatacttgttgataagctatgtacaggcaatgtatcttactcccaccaactggataacattttggttagcagccagtaga

SEQ ID NO: 23551 - DNA, 155 bp, Sorghum bicolor
  Clone ID: 15545943
gcacgaggccgggatctcgcgctcaggaggatggagagcgtcagatcctccttcggggccggaagagatttggcaacggcttccgcgagcacgcgggtgtaccacgtgacggactacggcgcggacccgaccggtgcgaccgacgctacggccgc

SEQ ID NO: 23552 - DNA, 521 bp, Sorghum bicolor
  Clone ID: 15545946
gcacgaggtgtttcttcagtggctaagcatgtagttgttggatttgttggctatccaaatgttcggaaagagttcaacaataaatgctttggttggggagaagaggactggtgttactcacacacctggcaagacaaaacatttccagacactgataatctccgaagagctcactctgtgtgattgccctggtctggtcttcccatccttttcaagctcaaggcatgagatggtggcatgtggtgtgttgccgattgatagaatgacaaagcaccgggaagctattcaagttgttgcagatcgtgtcccaagggatatccttgagcaaatttacaaaatcaccttgccaaagccaaagccatatgaacctcagtctcggccggcaactgctgctgagctattgcgggcctactgtgcatctcgtgggcatgtcaaccatgctgggctgcctgatgagactagggctgctcgacagattctgaaggattatattgatggtaaaatcccacactatgaactcc

SEQ ID NO: 23553 - DNA, 429 bp, Sorghum bicolor
  Clone ID: 15545949
gcacgagggtggataatgacttcttcctagtgcccgtcaagatctctgatcaccaggtatactcctttactcactcctgctcctgtagtttggaatttatagttcatatgaatagaggtttggatataacgatgaataaatactgaatatataaaggacgtggtgctcagaacactaaaacactaggttgaaaccgtaacacactaggttgtaatatctgagtataattgtagataatttctttgcaatttattggcatttcagaacctttgaagggaaccaagtagatatgtgctttatacatgtaatagcttggtccgatgtgatgttcaattcattgacaatactgcctttctgagtgaaccaagtctatttgtgcttgaactatatattaaatttacccatggaacaacaatttactgatataat

SEQ ID NO: 23554 - DNA, 365 bp, Sorghum bicolor
  Clone ID: 15545958
gcacgaggccaagccgagctctacaaccaggtcttcagctatatgaagtcagtggcacttgccgttgccttggatctccgcattgccgatgcgatccaccaccacggtggcgccgccaccatcttccagatagccggagagattggtgtcaacccatgtaagattcccagacttcgtcgcctaatgcgcgctctcaccgtcgcaggaatcttcaccatccagccatcagatgaacaaactgtaaaagcatcatcagccgggcatgaacctgctgctgtctacaagctgacaacagcctcccgcatcctcattagcaagagctcgccgagcttgttccctacgctgagccagcaactcaactcctt

SEQ ID NO: 23555 - DNA, 293 bp, Sorghum bicolor
  Clone ID: 15545967
gcacgaggcacttcggccccctcctccgcgccgcgaaaccctagcccgcctccatggacgatccctcctccgcctccaacaagcggaagcgcaagcgggggcgcaagcgcaaggcgtccccgccctcccccgaccgttcctccccctcaccggcggccgcacccgctccggctgggcgccgtggccgcaagccgcgccgtaatgaggcccccgcggacgcggacgccgcgcgtccgccgtccccgccccgccgcggggagccgaaaccggcggcgaatggaggcgatgcggag

SEQ ID NO: 23556 - DNA, 361 bp, Sorghum bicolor
  Clone ID: 15545968
gcacgaggcgaccctgcccctgcgggaagcagatcatcgtgcggaggtgtgcggaccggagcacgcctgtgacttgtggccgcccttgtgaacagatgctaccttgcaaaaggcatcgctgtgagaaggtttgccacactggttcttgcggggactgtgctgttctcatctctgcgcggtgcttctgcgggaagaagaatgagacattgctatgtggagacatgatggtgaaggggaagttgtctgaggaggacggggtgttttcttgcaatgaggtgtgtggccgcacacttgcctgtggcaatcatgcttgcaaggatttgtgccacccagggccttgtggagagtgtgagctcatgcc

SEQ ID NO: 23557 - DNA, 448 bp, Sorghum bicolor
  Clone ID: 15545969
gcacgagggtagcaggaacagcaggatggtcattccggccattctcctgattcttcttcagcttcttctcttcacagcgctaagcgtggacggagcggcatcgttcagcttcaccaacgcgtgtcagcacccggtgtgggtgggcgcgctccacggcgcgagctcgccgccgctggcaagctcaggcttctacctggcgccgtcggccacctcccgcctcgacgcgccgtcgtcgggggcatggtcgggcacgttctgggcgcgcacgggctgcggcgtcgactccaccacgggccgcttctcctgcgccacggccgactgcggcacgggcgacgtcgcgtgccagggccgcggccctgcgccgccggtctcgctcgtcgaggtcacgctcgccgcgccgagcagcggcgggccggacttctacgacgtcagcctcgtcgacggcttc

SEQ ID NO: 23558 - DNA, 550 bp, Sorghum bicolor
  Clone ID: 15724523
acgacgacgacgacgacaacggcggccgcgccgccgcgccgcgacgactcgctggccgagaagcaggacggcatcgccagcgccatcgcgcactgcaaggagtcgctccagtgcgggctgccgcggtcgcggagcgatcccgggaaccgccaagcgccgtagccttcgtcagttcagagctcctgaggacaggcagcaatggaggcttgatgcaatgcaaaagaaggctatcgccggaattaatagtagaatacaattcggcgaagaggacaaggagaagtgaattgctttgttgatgctagctagctagagatcttccgtatgatcataatctgcttgtttatggtgtgtgagtgagcgtgtgtgttttcgcgtcctttgattttagcttagtttaagtttggttggttcttgcttttgttggaagcgtgggaaaagagctctttttaggctttctttacccctctaggtagaagcatggactctagtagccgccgcggcgtccatctctttgcccggcttttgttagcgtgtgtgctcgttttataag

SEQ ID NO: 23559 - DNA, 371 bp, Sorghum bicolor
  Clone ID: 15724538
cacatcgactggaaaatggtggcgtacgaagtgatgatggtgaaggcaatgcatcttcaagttttcctatatttgagtatatggagagggatcctccatatggtagagagcctctgacagacaaggtatcaacttttgcacatagatttccagcactgaagacattcaaaagctgtgatctgctgccatcgagctggatgtctgttgcatgattgtgatcctcctacgccagcatgccctggctttggaggaatcaactgctgcacaactgcaactgggaaactattgttgccaacctttgggctggcaccttacaaattccgtgcctccatttggacatctgacagaacccaagagcgggaccgtgtcac

SEQ ID NO: 23560 - DNA, 563 bp, Sorghum bicolor
  Clone ID: 15724544
caagacctctaaggaggttgctaccgctatccgcgccgccatcatcatcgctaagctcagcgttatccccgtccgaagaggttactggggtaccaaccttggtcagcctcactccctgccttgcaaggagtccggcaagtgtggttccgtcaccgtccgtctcatccccgctccccgtggtactggcctcgttgcctctcccgctgtcaagcgattcctccagcttgctggtgtcgaggatgcttacacctcttccgccggttccaccaagaccctcgagaacaccctcaaggctaccttcgttgccgtctccaacacctacggtttcctcacccccaacctctggaaggagaccaagctcatccgaagtcccctggacgagttcgccgatactctccgcgagggtaagcgatactagattgggaatgttttatgacctgatgggagctggaaactggtgccgcggagtcacgaatccattgtgtttcattgcataggttggccggttaggacacttcagatcgttaggctatggtgaatgatggcttaacggtttgaaataa

SEQ ID NO: 23561 - DNA, 590 bp, Sorghum bicolor
  Clone ID: 15724562
agagaaaagggaaaatcaaaatctgtatctttttatctatcggatgcttctggggtagctactcctacagataccaattctgagatgggtaacatcggcaattcctgtagtgacaaattgactgatgaaaatttaagtaactcatctcagcagatgactgaaaagcattctgttaccgaggatcaatattcaaatgatcaggaccacgagggggagccactagatcatactgttgaacagcaaccaaattcggatgttggagaaatagcatcatctatgaaactacgttgcaggaaaaagttgcaaaaagttgggacacctaatcacactgttgatgactgttttgatgaagactgtgttgaaccttcattagctgaagaagataatgatagtggtgatgattacactactggtaataagcgtaaggctaggaaaaagtcaagggatggtgtagaagagtcacaacagcagaaagttcaaaaaaataaaagcaaggtgtcttcacggggccgcaaaagaaccttgaaggatgaattggcagcgaagcctgagaagaagaagctgacccacagaattcgtcagaggacaac

SEQ ID NO: 23562 - DNA, 476 bp, Sorghum bicolor
  Clone ID: 15724563
ggggaatcaacaaggctgtcaactatgtcaaggaaacttatgaaaatcgtacaatgatccttgctgaaaatggaatggaccaacctggtgatatcagtattactcagggtgtgcatgacacaataaggatccgttactacagagactacataactgagctgaagaaggcaatagccgatggtgccagagtcatcggttactttgcgtggtcgctgctcgacaacttcgagtggaggcttgggtacacttcgcggtttggcttggtctacgtggactacaagactttgaagaggtaccccaaggactctgctttctggttcaagcatatgctctcaaagaagaggagctagaattgcagataaggggaccaatggcttcaggtgtcatacaaagttcactctgcatatcctcttagtatgtcagatttagcttaagagaccatgcagatgattgagtctcaagactcgacaactcta

SEQ ID NO: 23563 - DNA, 460 bp, Sorghum bicolor
  Clone ID: 15724602
gctcttgtgtccagtgtgcgcaagctattggagaaacaaaatgttgaacaaatggagcagatgattgttacacgggaaagagaaaggtggaacaaaatactggaaaagaagactgtagagatcaacaaggaggcagatgtgctgaacaggaagttggctctggtaccaggccggcacagccgtcttccaagcgcgcaaacataccaggaacatcttcttgacgcaagcagtttgcagagtagcttgcagcgcgtagtccaagccctagaaagcttcacctccaattcgctgcaagcattagagcagaccctgagacatgccgaagaggaaaggtcatccagagagagcgccaaagtttcatagtgaacaagaatgtaacattatgagcatgtcctcattgggaggcgttgacgcagaacatactgggcaaatgctgctcacatagaattttttggtggac

SEQ ID NO: 23564 - DNA, 543 bp, Sorghum bicolor
  Clone ID: 15724648
tttgtcattgcacattcgaaggtacgaattcttgggatgagcgcatcgagcatgtgggtcgtcatcttgagaaggatcgtgcgagtcgcgctgacatgcttgactgtactacgtggaacatggacaagagacttgagcagtatctagttgatgaaggtcttgtcgcaagagatggcagtggttggaagattggagatggtaatccttgcagggctgccactgctggagacagtgatgcagagtctgaggaggagtgaaagcagtgttttttccttgtacttcgttttgtgcttgttatcaggtcgttacgagtggccccttttcgatttttgttggaagaaacagggtgtttttttacacgaacggtcgctattgttggataccccttttttttcccttgtcttgaacacgattgcgttcacagtagagttctgggtgactttggtcacaaattttgtatttatttcctacatcccattacacctcatgattcccagatacttcaatttgtctatcggtctacaagtcaacaaactcattaac

SEQ ID NO: 23565 - DNA, 602 bp, Sorghum bicolor
  Clone ID: 15724658
ttcaagtgcttgacgcctgatcaggagaaagatgttgacaggctgatcactagaatggtgtcccgggaagaggcgcacctagttctgatggagctgatgaaatggcggtcggatgggttggacccgttgtatgcacaagctgtgcaggtgaggcagcctgacccctccacagggaggatgaaggtcgcgaataagcagagcagcaggcttgtttgggagacatgcctgagtgagctcaagtcgctcggcaaggtagctgtgcggctcatcttcctccatgcaacctccaggagtttcagatgcacaccgtcaatggtgcgctggctctgcgcaccaggaagcttggcaagttgcaacgacagagcacaccggttggcttttgttgctgcaaattcgaagctagagaggagggacttctctagcgatgaagacaaggatgcagagttactcgctgaaggggatgatgatgtggtgaatttacctggcaatgcggaaccttaatctgcagtgtaacaaacatccctatttaattgtttcttattccttttttaccatttagcattttgtagaatttgatccctaggaattgttaggattttatt

SEQ ID NO: 23566 - DNA, 211 bp, Sorghum bicolor
  Clone ID: 15724659
cagagcaaggaccagaagctcacaaatgacctccacaagataaacaagatcctggctcgaaagaagggtgagaaagatgggggcgatgatggcggtcattacgatgatgatttgcctagcgcaaagaaacaacgtggctgaagttagtcgatcatttttttgtttctcctagcaatggtgtaacttataatgtactagttacagcaccatg

SEQ ID NO: 23567 - DNA, 654 bp, Sorghum bicolor
  Clone ID: 15724668
ctggctacaaagaagaacatgcgatttcaagtttcgtatgaaaataatagtgatcagcagcacccaacactccaaatggtttctgatcttctgaattcagtaacacttgccctagaaagagtaggtgaagaaaaatatatgcttttaaacaagatccatgacttgaatgagttgtccagaaaggaggttgatgagataataaaagtatgcatgaagcaagattgcatctctcccaatgatgacatccgtaagaggaggtacattgcaatgatagatttgtgttgcatggctggcaaccgagaccagcttataacccttctactgcaaataacggaatgtgccgttactattctccttattcattttcaggacgatgcttctgcaaaaggtctttcttcattttctgatgaacttcttcctgtgctggagagactagagcatttgaaagaggacaaagttggatgtaatctgaagttgttccacagatccgttactacacttaaggagatgaccatcagaaccatgaccctatgatggccgtagcgtgtacaatgtacaatatatatgtttcttaggatagctactcgctagatttgttgatgtaaaacattgttgtgtaatctatacttatgtatacactaacacggactgtac

SEQ ID NO: 23568 - DNA, 556 bp, Sorghum bicolor
  Clone ID: 15724680
ctgtaactccttgaagcaagggacttgttatttggagcgagttgacctgactggcaacatgcatttatcaagcaatatttttcctgcattccttgaattcaagaagcatggaaagccaattctagtagtcccaccaaacttgagcacttgtgctccatatgatgatgacccatgactattatgtaccatagtgctgctcaagtcacatcagatggaactatgagtgatgtatttgttgtgtcatctgaaggaattgtctgtctgctggttgggtccgtttagtctggggttggtactacatactcaatgtgagcaatgataaggtggttaccaacaacaaggttgggtggaagaattgggcgtagaccaagcacatttgggtgcccgaagaggtgaccaagaacatgcccaaagaggtgaccaagaacatggatcagactcaaaatgttgtggtccacaacacatttgtatgacgttttagggaatttggaaacttagcatactactagggatttatgaatgggtgtgtatcatattgtttcaagtaaatgccaag

SEQ ID NO: 23569 - DNA, 447 bp, Sorghum bicolor
  Clone ID: 15724683
tcagggtggatcacttgttacagcaaatgcattcgctgacgtgttgagaagcaacctgaatgctcaattctggctttcgatactgaacaagtgcagaaaagtgatggagaagaacctctttgcttacgggcagctcccaaatttactcttcgatcaaggccgcgaggtagacatcacggatttcgtttggagtcatgctattaatcccattcgcatgttaccttgtacgactagtagggctgtagccaaaacagaattaccaaaggtggcgtttggagaactactcctagatccttctgttagacccaaaggagaatttcgtttattgacatgggagtccaggttaccaccttatacttcatttattcacttggttccaaattccactcaagatctgcctcaaggacatagtttatcagggaggaagcgccacatagtgcctttctg

SEQ ID NO: 23570 - DNA, 480 bp, Sorghum bicolor
  Clone ID: 15724685
ctcccatcttgaaggtcctcacatgggagtgcaaggaggcattgatttaatggaaggaataccaaatctctcatttggtaatcattttggaatggatattaatcaccaacatcaagtgcctagccaccaaaggatgcaacagaacaatttcatacaggtgcaggcagaaccacatgggtttgggaatcagtgggtttaccacccaatgttgcaggataatccagtgctaagaactcctacgcgaagagcagggtagtgcatattcattgctccaattgtttcagttaaactttaggcaccatgacttctcaggctccatgacttctcaggctcctgtaatgacttcctgagtcccgaactaaccgaaggataccgaggctgtacgtggcactggcactccagagtccagatggcaagagcttcgcagagggtccaatggatccaaacatttttgttacatgatactgttagctgctgtca

SEQ ID NO: 23571 - DNA, 436 bp, Sorghum bicolor
  Clone ID: 15724692
gcacgagggcgcctcgtcgggctcctccgacgactcggacgacgcgtccctcacggacctcgatttcgtcatctccctccaccgcagccgctccgcctcgccctccttccactttcccgcgccgccgcttccgctgccgctgctcgacctcaagcccggctcccgcggcctgcggacgctcagcttcgcgggcgacagcaccaggaacgccgcgctctacggcggccgccgcagcagcttcgcccgcagctccggcggcagcgcgcggtcgctgcggctgttcatggagtcccccgcgtgggccgccgacgaggatcccgagccgcggcgggcgccgtcccgcgacgtcatccggcggtacttcaccaagatctccacgcggctgcggcacagcgtgcgcccccgccgcggcggcgccgagggcggtttccgccgc

SEQ ID NO: 23572 - DNA, 404 bp, Sorghum bicolor
  Clone ID: 15724708
gcacgaggcctctcccccctggtggtagtaccactactctagtagcaccgtcggtttctcaccttccccgaccccgagctcggacaagaaactcacctcgacagccacaagttaccgcgtcgccggttcccctgcttcgattctcaccgcgcgtcgacatggacacctcgcaccactatccatggctcaacttctccctcgctcaccacggtgatctcgaggaggaggagaggggcgcagccgccgagctggccgcgatagccggcgccgcgccgccgccgaagctggaggacttcctcggcggaggcgtcatcaacggagagagcgccagaagcggcggcggtgttccggtggccgcgccggaggtgtcggcgcccgcggagatgtacgactcggacctcaag

SEQ ID NO: 23573 - DNA, 416 bp, Sorghum bicolor
  Clone ID: 15724711
gcacgaggaacttctccttcccaccccagcgcaatcaacacaatcagacacaatggctgaccgaggaacttctcgtggcggtggtttcggatcccgaggcggtgatcgcggccgaggacgtggtcgtggtcgtggccgtggtcgcggcaagaacgaggagaaggagtggcagcccgtcaccaagctcggtcgtctcgtcaaggccggcaagatcaacagcatggaggagatctacctgcactctctccccatcaaggagtaccagatcgtcgacaacttcctgcccaagctcaaggatgaggtcatgaagatcaagcccgtccagaagcagacccgtgccggtcagcgaacccgattcaaggccattgtcatcattggtgactccgagggccacgtcggtctcggtatcaagacct

SEQ ID NO: 23574 - DNA, 609 bp, Sorghum bicolor
  Clone ID: 15724746
gcacgaggagcagatcctgctgctcctgggggagtcggagcggatcgcggaggcggcgtgggtgttcgtgctgggcctcatcccgcagatcttcgcctacgccttcaacttcccgatccagaagttcctgcaggcgcagagcatcgtggcgcccagcgcctacatctccacggcggcgctggccgggcacctggtcctcagctggctcgccgtctacaggatggggctgggcctgctgggcgcgtcgctgatcctcagcctcagctggtgggtcatcgtcgtcgcccagttcgtgtacatcgtcaggtcccagaggtgccgccgccggacgtggacgggattctcctgcagggcgttctccggcttgccggagttcctcaagctctcgttcgcgtcggcggtcatgctttgcctcgagacgtggtacacgcagatcaccgtgcttgtagcgggcttgctcaaggacccggagatcgcccttgattcgcttgctgtctgcatgtccatatcaggatgggtgttcatggtatcggtaggcttcaacgctgctgctagcgtgagagtgagcaacgagctcggagccgggcatcccatggcgacatctttctc

SEQ ID NO: 23575 - DNA, 557 bp, Sorghum bicolor
  Clone ID: 15724748
gcacgaggatttatcgtcacccaagcaatccagatatattgtgttatctgatggtgctctcagggatgcaccatggaggggtgcaggtgttgctgtacccgtattttcaatcagatcagtcgaggaccttggcgttggagaattcctagatcttaagcttcttgttgactgggcagtcaattcaggcttccatcttgttcagctccttccaatcaacgatacttcagttcatgggatgtggtgggattcttatccatacagctctctctctgtgtttgcattgcaccccttgtacctgagagtacaagcactttcagatgcaattcctgcggatgttaaggaagaaattcagcaggcgaagaagcaattggataaaaaggacgttgactacgaggcagcattgtccacaaaattgtcgattgctagaaaaatattcaatttataaaaggacaaagtgctaaactccagttctttcaagcagttcttatctgaaaacgaggaatggttgaaaccatatgcggcattttgctttttgcgggactttttcgagacatctg

SEQ ID NO: 23576 - DNA, 581 bp, Sorghum bicolor
  Clone ID: 15724756
gcacgagggtcagtatgggtatgatgttgagaaggtaatatttattttattgggtgcatgtgcatctcccagggaatacactgtgtttttactttttttttaaaaaaaattcaacaaaatcccacctattgattttagtagaaactggcctgttctctgtgtcaaccgtgttttttttgccttcagtaaatatcactttcaggccagataacactctgttctggagttagcctttgtatctacaggcgtataaaatgtagcacaaatggtcctgtgggttagcgttctagtagtcttgtgcgtatgtggctgtcatgggccagtggctgctattcaggacactcttaaactattgattgatgtgcctgaattgtagtatttgcctatttagtgcacaatttttttagactgtcgtgtttttgtaagagctttaccatctaccagtctagaagcccttgatggtttagcattaattaattattagtaatatataactacagtgtgtatcaatgtaatggaatttctttggttgtttagtgagctcaacaatattttaactgttcacaccaactgatctttca

SEQ ID NO: 23577 - DNA, 471 bp, Sorghum bicolor
  Clone ID: 15724785
gcacgaggcaatcacttgtcattgtttctttgcgttgctgatcatgaaaaacttctcccaggatggagccattttgcacagtttactatagctgtaggcaaccttgatccgaagaaagttaaatattcagacaccttgcacaaattctggaagaaggaacatgattgggggtggaaaaagtttatggagctatcaaagattcaagatggttttcttgttgacgatgttcttgaaatcatagctcaagttcaagttatcagagagaaagcagacagaccatttcgttgccttgatcgcccttatcgtcgagaactgctccgtgtctacatgacaaacatagagcaaatttaccgacgttttgttcacgaacgcagaaggaaacttgtcaggcttattgatgacgacatgaggtggtccagtttccgtgctttctggcttgcgattgacccaacaacaaaacatcgcatgtcc

SEQ ID NO: 23578 - DNA, 562 bp, Sorghum bicolor
  Clone ID: 15724800
gcacgaggcttgatatggcaattcgctgttacaatcaagctatagtctacgacccacagtttgttgaagcatacaacaacatgggcaatgcacttaaagatgctggaagagtagaagaagcaatcaactgctacagatcctgccttgcactgcaagcaaaccacccgcaagcccttactaacttaggaaacatatacatggagtggagcatgataagcgctgctgcttcattttacaaagcagctatatctgtgacatctggattatcttccccacttaacaatttggctgtgatatacaagcaacagggaaactatgctgatgctatcacatgttacactgaagtacttcgtatagatcctacagcagctgatgcactagttaatagagggaacacattcaaagagattggcagagttaatgaagcaattcaggattatgttcaggcagcaacaattaggccaaacatggcagaagcccatgccaacttggcctcagcatacaaggacagtgggcatgtagaaacagctatagttagctacaaacaggctctccggctgcg

SEQ ID NO: 23579 - DNA, 389 bp, Sorghum bicolor
  Clone ID: 15724805
gcacgagggttccaccaatgcagcgctttatggccgactcaaatccatacagcgacggcatactgcaagcaaacataccactatgcagccagtataagggatacacggagcaacaatggagcccagagaactgtttccgacacccatccccagaccgcacgtcctccggcaacaccagtcagaatactcaggatgagctgcggtctccatacatgtaccatgacactccgtatgctagtacaacagagtactctcagcctttgtttttacacccgtcgacagagcagtttcaaggaccttatcaattcgaggcttcagcgtttcgaggcaactgcagtcttcgcgaactcgagtacaaccctccaacggaggcggttgcagaggaagtt

SEQ ID NO: 23580 - DNA, 561 bp, Sorghum bicolor
  Clone ID: 15724809
gcacgaggatttggagggcctgcctccaaagcttgggcaactcacttccctgcaaacactcactaattttgtagtgggtacagggcctgattgcagtagtattggagagctgcaacatttaaataaccttagtggttcactggtgcttagtcaactcgaaaatgtgacagaagcaatagatgcaaagatggcccatcttgaaaataaaaaggaactcacagcattgtcattaagatggacaactaccgaggaggagaaaccaaactgtcttaaggtccttgaaggtctagaagctccttatggacttaaggctctaaggataaatgattaccgaggaaccagtttcccagcgtggatgagtatgctgccaaacatggtcgagcttcatctttatgattgtaagaagtcaaagaatcttcaaccattgtggcaagtaccaggtctgcaagttttatgtttaaaaggattggaagaattgcaatgcttgtgtagtagtgatacactcttcagttttcctagtctgaaggagcttgtgctggttggaatgcctgcttttgacag

SEQ ID NO: 23581 - DNA, 604 bp, Sorghum bicolor
  Clone ID: 15724813
gcacgagggtccccatctcctccattgcgccctcttcgccgcgccaccaccagcaccatcactccaatccgcaccaccaccaacaacaacagcagcaatccggcagccgcaagcgccataccatgccccccgcgtacacgccagcggaccccgtctcccaccatcaccacctcgtcgttgttgacccgtcctctgtgtactctccggcgttgcccgcgctgccggcggcccctccgccacaccagtcgtcggcactcgtgctctccggcggcaaagacgacttgggcgctctcgccaggctcgaggacagcgtcaagcgccttaagtcacccaaggcatcgccggtcgccttgatgcccaagccccaggctgacgcggcggtcgccatgctggccgactggtttctggagtcatcgcctggcgtatccctctccgccgctagccaccccaagctccgggccttcctccgccacgtcgggctaccggacctgcagcgtgccgaccttgctggcccacgtctcgacgcccgcttcgccgaggcgcgcgccgacgccaccgcgcgggttcgggacgcgctcttcttccagcttgccgctgacggctg

SEQ ID NO: 23582 - DNA, 598 bp, Sorghum bicolor
  Clone ID: 15724821
gcacgaggcacagctgctttccaacctgggaattgaatcaaagattgaagagatcctaaggaactctgcaacttctgaaaacggtggtgtatattattattcagagagaggtgatcgactgattgatcttgatgctttccatgaaaaacttctccagatgtcacaagaattgaacccacaattaagcgagtctgagaaagccggactaaaagaatcagttcatcatttgctgaaatgggcttggcgatataataaaaatcttgaagaacaggctgcccaacttcacatgttaactggctggtcacagattgttgaagttgctgtatcaagaaggatgtcattatttgaggagcgttctcagctattgtttgagctgcttgatgcttcattgaatgccacgacatctccagattgttcagtgaaaatggcatatgttttaacgaatgtatcgttgacctgtatggctaaactgcgggatgaaagattcatatgcccaactggtacagattctgatgcggttacttgccttgacattattttgtcaaagcagctaccaaatgcagcttgtaactcattgctattcaagcttgtgatggca

SEQ ID NO: 23583 - DNA, 487 bp, Sorghum bicolor
  Clone ID: 15724833
gcacgaggcatgcagagacactgctttctcttgaattcatccattgtcagctttatcctaccatcatggataaaatttgcaggagtttgtgccaggagggatctagccatggaatccaacgatttagcattaaatcgtcacaaatctgtgaaaccaagcctctgaccatctcttctggtctgttaaattttttgtcatctggcaagtcgttgcatctgctgtcacttaatgatactaagatgcagtcatcattagctcagatgattattcacactcttcttgagtcgtcatgtgatttacacacgcttgagatatcagaaaacaatattgctggctggctttcaaaactgaacaaaagttctacaaactcattagcgctgagatcagatatttttatgaactccctgtccattcttaacctgagggaaaataatttgcaaaaggatgatgttgtagatcttcacaaaattctaataaaaatgcctaa

SEQ ID NO: 23584 - DNA, 473 bp, Sorghum bicolor
  Clone ID: 15724837
gcacgaggcgcagcctctcgccgtcgcctctggcatcccgtgccgcagccctccgaaccgcccgcgccgccgccctccgaaccccgcgactccgccgcagccgccctctgcaccgttatctccgcgtacacctgcgactcacatcgtggcccccagtccggcctctccgccagtacgcggagcccgcaggcggcacccgcagccgagccggaggtcgccagcgccgccagaagacttgcttccagggatttacctggggtcaatcagattagggttcagctaaactgaacccccatgtcccatggtgtgcccgcccccatgttagaagagttggcgagggaggcaacactcgccgatgtgtctattcttgtggatgggaatggcgcagaggtacatggtaatgacacagaggtacatggcaatggcgcagtgctgaaaagagttgatgtgccccaggatttgggaggtatttc

SEQ ID NO: 23585 - DNA, 533 bp, Sorghum bicolor
  Clone ID: 15724838
ctcggcgccactcctatcgtgggtccccggggtctccccgtgttcggcagcatcttcgcgctctcccgcggtctgccgcaccgtaccctcgccgcgatggcccgcgcggcggggccccgggccaaggagctcatggcgttctccgtcggggacacgccggcggtcgtgtcgtcgtgcccggccacggcgcgtgaggtgctcgcgcacccgtccttcgccgaccgccccgtgaagcggtcggcgcgggagctcatgttcgcgcgcgccatcgggttcgcgcccaacggcgagtactggcgccgcctccgccgcgtcgcgtccacgcacctcttctccccgcgccgcgtcgccgcgcacgagccgggacgccagggcgacgcggaggccatgctccgctccgtcgccgccgagcagtccgcctcgggcaccgtcgtcctccgcccgcacctccaggccgccgctctcaacaacatcatgggcagcgtcttcggcacgcgatacgacgtcacatccggcgccaccgccggcgccgc

SEQ ID NO: 23586 - DNA, 120 bp, Sorghum bicolor
  Clone ID: 17886489
tggggtcacttcagtttatcaactttgaaagtgcatttttttggtttaaacccttgttaaggggtacaaaaatagttcatccctctttgtttggggaatagatatgacatgatttcgttc

SEQ ID NO: 23587 - DNA, 208 bp, Sorghum bicolor
  Clone ID: 18051757
ccccctggtgggcccttcgacccgctgggcttggccagtgaccccgaccaggccgccatcctcaaggtgaaggagatcaagaacggccggctcgccatgttttccatgctcgcctttttcatccaggcctaggtcaccggggaaggccccgtcgagaacctcgccaagcccctcagggaccccttgggcaacaacctgctcaccgtca

SEQ ID NO: 23588 - DNA, 554 bp, Sorghum bicolor
  Clone ID: 18052915
gcacgaggatcgacttcagcctgatgcagggcctccagtggcccgcgctgatccaggccctggcgctccgccccggtggcccgccgtcgctccgcctcaccggcattggcccgccttccccacccggccgcgacgacctccgcgacgtcggggtccgcctcgccgacctcgcccgctccgtgcgcgtccacttctccttccgcggcgtggccgccaaccgcctcgacgaggtgcgcccatggatgctgcaggtggcgcagggcgaggccgtcgccgtcaactccgtgctccagctccaccgcctcctcgccgacgacgcttccttctcggccgacgacgcccggccgcgcgcgcccatcgacgccgtcctcgactgcgtcgcctccgtgcgccccaaggtgttgacggtcgtggagcaggaggccgaccacaacaagccgggtttcctggaccggttcacggaggcgctcttctactactcggcggtgttcgactccctggacgcggcgagcggcggcgcgggcgacgcggcggcggaggcgtacctggagcgc

SEQ ID NO: 23589 - DNA, 619 bp, Sorghum bicolor
  Clone ID: 18059133
gcacgagggatgaatcaattcgaaggtctggatctgttatagcgccaacaaagttcagagatagtttaagaaagttatcttcggattttagaccaggacagcaagaagatgcacacgaattcctacgttgcttgcttgataacttgcataagtgtactcttgatcccaagtcaaagggcaaggactcatcctttgacgaagaaagtatagttaaggagatttttggaggacaactaagaagccatttatcttgctgcgagtgtggtcacagctcagagacatttgagcccttcctggatctaagcttggagattgatcaggtcgatcacctggtagatgctttgcaatcttttaccaaggtagagcatattggggactctgaaaacaagctcacttgtgaaagttgcaatgctcaagtttgtaagaacaagcagcttacacttcatagagcaccggatgttattgcatttcatctcaagcgttttacaacccttgacaattccgttgagaagattgacaaacatgtggtgtaccctctggaggttgatttgaagccgttctacagcaacccagatgctgcgggggagctgaaatatgatctttatggtgttgttgagca

SEQ ID NO: 23590 - DNA, 444 bp, Sorghum bicolor
  Clone ID: 18059385
gcacgagggtacctttctctacgaggatgcttgggtattgatctactgtccgattcattgggcaacctaaggcaactccaaacactagacatcagaggtacatatgtaaaggctctgccaaaaaccatcatcaaactacagaacctacagtacatccatgctggaagaaaatcagattacccacagggcgaaattgatagtttaatggagaggtgtcttggcggggcgtttgattgtgcgacatgttgcttacctcatcttttgaacattgatggccccagctgtaaggcccttaccaggcgagatgcatgcactttcgcttgctgcgtgcaattccctttaaacgtgacgggagcagataaaagaggtgttatggtgccaagggggatcagaaaacttaaagacatgcacacactaagggaagtgaatgtctggagaggaaag

SEQ ID NO: 23591 - DNA, 561 bp, Sorghum bicolor
  Clone ID: 18059569
gcacgagggtcatgttccgtgtgctcctcaaactgctgaggctgcaaaacttcaatcttctgatgctagtaggtttcttagtaatgcacgtgactgcgcattgagtgctccaacaagcagactcgcagtgcataactctggttttacctaccaatctgtaggcttcaatgaatctattggattctcagaggtcttgcaaggtcaagaaatttctcgggcagttcctatgttccaaggaatgatgtctgaggcttgttcactgaaaggcggatatgggctacatagttatatgcataccccagttgctgttaatggattatcagccccagctcaagaatgttgtctgacactatctactccgccaggagcacaagtgccctctctctaccctgataatatttttaaccgaactgtggttccgcagcttggactggcaagcaagtttggtggtggaggtacaaatggccagcagtctggcccatttgataggcggagggaaatttggaccaagccacagcatgaaacacctgatcaaatgaacttggatcagtttgagactag

SEQ ID NO: 23592 - DNA, 619 bp, Sorghum bicolor
  Clone ID: 18059727
gcacgaggaaatcgttgacttgaacatggcaatgctaaggcttcaagagaaaatatccaccatggaatctgaggagaaagtccaaagacaagcgctgctaggcacgccagtcaagagcatgtctgaacatttgtcaattccaattgctccaaagaatttggagaatggctatcacgaggttgaagagcataaggaaccccaaagtgcacctcctgctattaaggaatatgtgaatggtgatcctaagatgagaaaatcttgtgttgacaggcaacttgaaaacgtggatgcactcattgactgtgtagggaaaaaccttggatattgtgcagggaagccagttgctgctattaccatatacaaatgtcttcttcattggaaatcattcgaggcagagaagactagcgtttttgaccgtctcattcagttaataggatctgcaatcgagaacgaggatgacaatgacaaccttgcttactggctctccaatacatccagcttactgttcctactgcagagaagtctcaaggctgctggtgctcctggtagcgtttcacgaaagagacctcctcagccaacatcattatttggcagaatggcccaaggcttgcgttctgca

SEQ ID NO: 23593 - DNA, 610 bp, Sorghum bicolor
  Clone ID: 18059889
gcacgaggcaaatgcctccaagattcattcacaagaccacaccagctagatttatgcgccgagttcgctcctcacataatttccgtcagcgcgtgggtgcactagatgctatcaatgaaaggagactgcccaaagtcagtgaaggggatgacgagggcggtgatcaaaaagactggcaggctgatactgtgtcatctcgtatatcctcagctcgtgattggaattttgagtctgatggagcctatgagggtagcaatcacagcgattgtgcatttggcgattcatatggtgagaaccgtccagttgaagtgcaaaggatggagaggcggatcccgagctctgtgttaaaaccccaaggcaatttagtccatgccaaattggttgcctggaaggatgagcagattgcaaagctcatagaaaagtaatccttcttatcccatttttcataacatcaaaacttgatattcgttaccaattaattttggacttgttcagagaaagaaccatagtaagaagatttgtattgctatgatagtcagattttattttcaaatggctgttaggtgattactgattacatgtagtacaatatcacttcagcctgaaattg

SEQ ID NO: 23594 - DNA, 618 bp, Sorghum bicolor
  Clone ID: 18060762
gcacgagggggacaccctaatgtggtcacgctggttgcacacgccgtactggacatgggacggacgagggaggcactgctgctcatggagttctgcgagaagtcgctggtttctgtgttggagggcagaggagcaggctactttgatgaagagaaggtggctctcatcttccgggatgtttgcaatgctgtctttgcgatgcattgccagacgccgcctcttgctcacagggacctaaaggctgaaaatgttcttcttgctgctgatggggcttggaaactatgcgattttggtagtgtgtcgacaaatcataagtgctttgataaacctgaggagatgggcattgaagaagataacatcaggaagcacaccactcctgcatatagagctcctgagatgtgggacttgtacaggagggagattatcagtgagaaagtagatatctgggctcttggatgtctcttgtatagaatctgctacttcaaatcagcatttgatggagaatcaaagcttcaaatacttaacgggaactatcgtatcccagaattgccgaagtacagttcttctattacaacacttatcagagacatgcttaattcttctccagatgccagacca

SEQ ID NO: 23595 - DNA, 535 bp, Sorghum bicolor
  Clone ID: 18061058
gcacgaggtttgcattccatggggaaccaagggtctatttggtacagctcacaacagcttcatgatttgttgtgagccgttttatttgctaaacacttatttctaaaacaacttcatgggtgaagctgtttttcttctcctctcacaaagacatgagttgggatgaagctgaaaaaagtagcttattgcagctctctccctcatttctctctctcaactatgcatgaagtagttggtgaagcgattttaccaaacactttttccaaaacagtttagcttcatctagaaagttgtccatgaagctattttctataaaaacagctttactagtgaagttgagctgtgccaaacaagccctaaacatgcccttagtcacttattcagatcgtgaacttgtaggcttgttgtatatgtgctttaatggcgtctctcgggcaaagagccggaagctacatctgctcagagctgtgtggcacagctctgaaccagaggcactactccacttcgagggtggattggaagcagctgcggccaa

SEQ ID NO: 23596 - DNA, 619 bp, Sorghum bicolor
  Clone ID: 18061694
gcacgagggtacaatatatgatagttcattgcagactctaaaagtcagcaatgggaatttcaccacacacacggaaactccattgcttggtttcccaatgactagactttggtccaatgtgcttgttgagtgctatgcaaaagtgctggttcccttgttgtggtccagagtacaggtgacaggtcaaattagattactaaccaagggtagtatctgctttgggttatcagaaaatccaatatcagaatttgagctggttgctgaagaacttttaatgagtgactctgttataaaggtctatggagctttcagaatgtatgttaaagtgctcttgatgtgggattcaaatattcagattgatggtggggctaaggatgttgttcttgcatctatgcttgaggcaagaaaccttgtagtcctcaggcacgggtcagtgatatcttccaatgctgatttaatggtctatggacaaggacttcttaacttgagtggccctggtgatggaatcaaagctaagagactgtttctatctctattttacaacgttgaggttggccctggttccgttgttcaggctccacttgatgaggctgtttcaagcagcttggatgcactttca

SEQ ID NO: 23597 - DNA, 620 bp, Sorghum bicolor
  Clone ID: 18061698
gcacgaggctttacggaaggtaaaatttgttagtgccactttagctaagtgtgtgtgtatataatcttatgcaccataatgacatgatgtatacataaagccataaaggttcccttcaacttgcatctacattattggcataacataggtgtcctctagctacttgataaccaaacattagagagtagtattttgttgtttcaaaaggttagaattttgaactattcatcatatgggaaaatcctatgctcattcattacttaccaggccctgttactgccatcaccaaagctataaaagtttctaattcttgtattgaggtctaaaagtcaggtttccaccctatatattttattttgtagtagactattatgcaagtatgatgatgccttctctagtttaattttgtaaattaattactgtggtcaaaacgttttatgtttacttagttaattacgttagcatggtttctagccttcttggatattacgaggatttcatttgtgttgtgagtgttgtaccaaagttaaataagacactggatatgatggaatctttggggttttggcactggcagctctagcctgtgcgattgtaatctcacatcttgcggttctaag

SEQ ID NO: 23598 - DNA, 544 bp, Sorghum bicolor
  Clone ID: 18061810
gcacgaggcgtgaatctcagccagaggatcgccgagctcacgaatgacacggccgtgcgctccatgatcggcgaccggtttgagaagcagcaggaattcctggagaatatggcggagcggagggagtaaaggtcagcaccgggttcagcctcggcgatctgttcccgtcgtcgaggctggcgagcgtcatcggtggcatggctcgtcgggcggcggtaaaccgccgtaagatgttcgagctgatggactacgccatcaaaaagcacgaggagcggagggcagccatggccaaatctgcagagggagagggcatcgtgaaggaggatctgctggacgtgcttctgaggatacagaaggaaggtggcctggaggtgccactcaccatgggaatgatcaagggcatcatcatggtaagtagagtaattgttttaaatttcccactataacttccgctatagcccactatagcattttcaggcagtgtgttgttatctatgttcatggagtgaaagtggtgtggataattctctgaattgatcccatc

SEQ ID NO: 23599 - DNA, 572 bp, Sorghum bicolor
  Clone ID: 18061872
gcacgaggcatctgtcaagatgttcaagagcggcatttcctccttcgcccgggcggctcgcccttccttcgcggcgaccgcttcccgtcgcgccatcagaccttctaccttcagactccctgcctccagcagattcgccagcaccgccggtgtcggtgatggaaagatctaccaggtcattggtgccgtcgtcgacgtcaagttcgacggtgccaagctccctgccattctgaacgccctcgagacgacgaacaacgaccagaagctggtccttgaggtcgcgcaacacttgggtgagaatgtagtccgctgcattgccatggacggtaccgagggtctcgtccgtggcagtcccgctaccgacactggtgcccccatcacgatccccgtcggccccgagactctgggccgtatcatgaacgtcactggtgaccccattgacgagcgtggccccatcaagtccagcaagagactgcctattcacaccgagccccctgccttcatcgatcagtccaccaccgcccaggttctcgtcaccggtatcaaggttgtcgacctgctcgctccctacg

SEQ ID NO: 23600 - DNA, 602 bp, Sorghum bicolor
  Clone ID: 18062428
gcacgaggcagaggctgagtttgagtgagataaaagagctctatggcacacgtcatattggcagagatcaagctcgtaaccttgttgggctgatggatgtcttctgttttagtgaggcatgtctgattgccgatattgttcagcactttatagatgcaaaactggagtttgatccatcttacgtatacgaggatgtaaaccaatcgattcagcatgttcacagaagtggtttaattcacaggcaaattctttctgagcctcagaaatttctgatgaaaaaaagccaggtgttccgtttcttgaagatgcttaaagagaaagggaaaaagctatttcttcttactaattcacctttctactttgtagatggagggatgcgttatttgctagaggaccaacattttgatggaaattcctggagggaactgtttgatgttgtgattgcgcaggcaaataaaccaactttctataactcagatcacccattcagggtgtatgacactcaaaaggacaccttagcttttactgcagttgacaagtttctgccagatcaagtatactaccatggctgtttgaaatcatttctgcagatcacaaaatgg

SEQ ID NO: 23601 - DNA, 608 bp, Sorghum bicolor
  Clone ID: 18062432
gcacgaggggagaagttcatgcaagcatatgacttgattgaagtatactgtgaacttatagtagcacgtctgtccattattgactcacagaagacttgcccaattgatctgaaggaggcagtagccagtgttgtatttgcatcaatgcggtgttcggatgtcacagaactagcagatgttcggaagcatttcaaaagcaagtatggaaaagagtttgaagcagcagctcttgaagtgcgacctgacagtggcgtaaatcgtctggtaattgagaagctgtcagcaggagcacctgatatacagaccaaaatcaaaaccttgagctcgatagcagaggagcacaacattaaatgggagccaaaagcatttgaggagaaactgcaacagccaaatgaaaatcctctgtatggttctgcaacatattctggaggaaacatttcaactatgggatcatctacttctagcatgtcaacaccacagcctacatattcaggtgtaagtgcagcagctgtggactcagccacttcccatgtgtcaatgggaccttcgcctgtacatgtgccagcaaatagaacaacatatggcaatgccagttctaatactttttc

SEQ ID NO: 23602 - DNA, 615 bp, Sorghum bicolor
  Clone ID: 18063339
gcacgagggtgatgcacaatctcgcaatgattccttggatgcagacaagggagatgtgccttttgtttctcatggctttgagccaagaccttacaaagtactatcagacagcaacaacaattgcagtaggacaagcaatgggaaacctaaagcttaccaaggggacatgtcatttttacctcggggcttccttggaaggtctagttccagaggaatttcagtcaaagcagatgatggcttgccatttagtaatggtgcatcatcatcctttgggaatggaaaaagtaagtcaagtaaccactcatcttctataggtggcttgtctcctggtttccttacaaggcatcgcagggaatccattgccctaggcacaagctctgacatttcaatggatacaaaatctaatggtgctgcagtaatgccagagggtgcagaggaaatggtttcagattgtacgacaaatggatcttcgttccaaataagagcgtccgaccaccttgatgaaaatggccttgcaattttgcacacaaaaagtaacagctgtgggcaagaaaatgacagtaatggaacccccagcatgaatcatgatggttctgaacatggactgcgccgaag

SEQ ID NO: 23603 - DNA, 614 bp, Sorghum bicolor
  Clone ID: 18063385
gcacgaggatgcatatggtcgcaagaagtccactcttcttgctgatatgatgtttgctcttggctcacttgtcatgtgtgctgctgctggtccttacattctaattattggaaggctcctcgttggtttgggtgtgggtgttgcatcagtcacggcaccagtatacattgctgaagctgctccttcagaaatcaggggaggtttggtgtcaactaatgtactcatgattactggtggccaattcttctcctatcttatcaatctcggctttactgaggttcctggaacatggcgctggatgcttggtgttgctgctgtccctgccattgtacagtttgtgctgatgctttttctgccagaatctccccgttggctttactggaaggatgagaaggcaaaagctattgctgtccttgagaagatctatgactctgatcgtttggaggaagaggtagagctgcttgcttcatcctccatgcatgaattccagtccaacaatgctggaagctatttggatgtcttcaagtcaaaagaattgaggctagctttctttgctggggctggtcttcaggccttccagcaatttactgggatcaacaccgtcatgtattaca

SEQ ID NO: 23604 - DNA, 631 bp, Sorghum bicolor
  unsure (1)..(631): unsure at all n locations
  Clone ID: 18063390
gcacgaggcaaaagggttgtagacacatgnggaaaagcagtttactattgcaagggaggataagaaaatttcgttcctatatctatcaaatgatatcctgcaaaacagcaaacgtaagggagcagactatgtggatgaattctggagggttttacctagatcactgaagcatgtctatgagaaaggcggagaagaagggaagaagcaggtggcgagattgatattaatctgggatgattgtaaagtttttgggagccgtattgaaagtatgaaaaatgacattcttggtgacgaccctcccatattggttaacaatgggaatagtttaaatcctagctctaatcccacttcaaattccaaagctgcacggaaggattccggtacaatagtaaaaaaactcgttgttggcgggatgcctgaaaaaattgtgtctgcatatcaatcagtgcttgatcgccattttgacgaagacacagctttaaataaatgtaagactactgtggggcttttggagaggatagataaagatattaacgatgctagcatcaacggtaatcagccagcatcgtcattgatctctgacctgcaagaacaggaaatgaccctaaaacagtgcattgaacaactcgaa

SEQ ID NO: 23605 - DNA, 602 bp, Sorghum bicolor
  Clone ID: 18064626
gcacgaggagcagcgcggggcctggagcctggatcgatgcagggcgtgactccactaaccgcgcagcggcacggtgttcctccggtggcagcgcggggcctgtagcccagatcgacgcagggcgcgactcctccagccacgcagcggcaccggtttcctccggcggcagcgcggggcctggagctcggatcgacgggaagcgcggcacctacggtggtggcgagtccagatctaccgtcggcggccagggagtcgcaagtgtcatcacggaggtaataacttctatctcctggtgggttcaggttcggtgcttcggttcgtgggtgtattgaggggaaacgggctagctccagtgaatcctgaaccagctccaatcaatcgtctgctattctgctactatgattcgcgttgcagatgataggacacgatttgtttaatttatgaatacaattacttaattgggttcgaaaatttgggatgctttatttctgagttcaccatatacctattgttcgtcctctgcaactgttatgaacgctagagctttgatgcgaagtgctatgcatgcacgagcatttgagaaaattatgcactacaaatta

SEQ ID NO: 23606 - DNA, 639 bp, Sorghum bicolor
  Clone ID: 18064636
ggcacgaggcaaggaccaaatggaactggataagacggtagattcctcggaaggatttgctacttcgaatgatgcaccccctgatactagtgcagacgaacagctttcacagaaggaatactgctcgcagtttacaagcctctcatgggctggaaatatagttggctttcaagatggtgagattgaaatcatttggggtgatggctcgatttcaaaggttgggcctcatgaaatatatgttgttggtcgtgaagatgatggagcctcactagatgatggaacagcctctgatggtgctagctgggagactcttgatgacaacgaaatggatgtacttgatgattctgcaaaggatgattcgcaaaatgtacctgagaatagcattgaaagggaaaatggttcatttagctcccaggatggaagttctattgcaactggtcccctttcagttgcttttgggtttgtgacccgactggcgagtgatctctttgctcgaggtagaaggcatttagatggatcatcaaactcagatgctatggatgaagttgagtctcaccggtctaatgaggcttcagagactggtgatgacattgataaaattaatgagaatcatgtggaatcgccagagcatgctgcagt

SEQ ID NO: 23607 - DNA, 511 bp, Sorghum bicolor
  Clone ID: 18065081
gcacgagggtggaggccaggcgcccggaccacctcggcgacagggagttccacacgctcacttacgacatgatgctcgcctgggaggcgcccgacgaggagaccgacgccgtgttccagaaaacggcattcagcgttctccgcgacgatgctgatgacgacgacggtgcatccattttctattcaagcccaacgcagatggcaattcaggtcgatggcagaaggacagttggacccgaggcatttgccaagattgctcctgcctgccctgccatggcacatcccatcaccgtccgtaacctatttgacgcgctcaccaactccaccggaggacggctgcatttccttatctaccacaagtatctcagaagcttagacgaggcgttcttctctgcaaaacgtatgttaggggggcacaaagcccctgccctgcaactatctgaggacgaagtgatccttgacatccacggggctgcgacaaccaagccagttcttcagcacatcgggacgtc

SEQ ID NO: 23608 - DNA, 580 bp, Sorghum bicolor
  Clone ID: 18065348
gcacgaggctcagttcataccgtcaagagaagctgatatagcaatattggaagaaccagaacatctcaactggtatcatcatgggaaacgctggactgacaagttcaaccatgttgttggtgtagttcatacaaactacctggaatatatcaagagagagaagaatggagcccttcaggcttttctagttaaacacatcaacaattgggtgaccagagcatactgtgacaaggtcttacgtctctctgcagcaactcaagatttaccaaagtctatagtttgcaatgttcatggtgttaacccaaagttcttgaagattggagaggaaataactgccaatagggagactggagaggcgccattttccaagggagcatattttcttgggaagatggtttgggccaaaggttatagggaactcatagatttgatggctaaacataaaagcgatttggaaggattcaagttagacgtatatggaagtggtgaggactcgcaagaagttcaatctactgccagaaagttggatttgagtctcaattttttcaagggaagggatcatgctgataattcactccat

SEQ ID NO: 23609 - DNA, 679 bp, Sorghum bicolor
  Clone ID: 18065838
ggctcgctcaatgacatcaatgtattgctgcgatcaccactattccaaaggttaaaatctggaacttctcctcctgttgagtactttgtgaatggcaacaaatacaatatgggatactacctagctgatggcatttatccttcatgggctacttttgtgaagagttttcgaaacccacaaggcaacaaaaaaattcacttcacacaagcacaagaatctgtgaggaaggatgtagagagagcatttggagttcttcagtctaggtttgccatggtgagaggaccttgtaggatgtgggacaaggataccatttggtacatcatgaccgccgctgttattttgcacaacatgatcatagaaaatgagaagggggctgaggaagaggattttgactatgatcaagatggtggtgaggtgttaaggccagaggattatcatcgtgacccactcgttttgagtgacttcttgcgtatacataatgagattgaagaccgaacaattcatgagcaacttcgtgatgatttaatggaacatttgtgggcacgtcatggttcgtcatagtgagatttagattatctccgttgtgtgggctattttgaactatgagatttagattatgtccactcgttttgaactcaatttgaactttgtaatatcctactttgaataattatgtttg

SEQ ID NO: 23610 - DNA, 691 bp, Sorghum bicolor
  Clone ID: 18065867
agctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgagg

SEQ ID NO: 23611 - DNA, 702 bp, Sorghum bicolor
  Clone ID: 18065973
tattaaatatcaaagatatatgatgctctggatatgcacttgaccatatatgttgaagacaatgtctggcaatagtttgtataaatttgagaattattttattgtgtgaaaaaaatgcatatcataccagcactaatcagcactaatgaagtgcacttgttctttgttgtgcacttttctgcaacttttaggtatatgtacttggggtacaggagaataaaggaggcttaatctggctggtctggtctggtctttgaagattggcatcaggttcatactcaatattggtctggtattatacctttgctgatccgtgaatattgagatcaattgcttcttttttgggccctgatgaagtggttgaacagtgttttctttgccagtttcatgtggaggaatattcagtattggaaatttaagatggttgaatatattctggaattactattttcttgccaggtgctcactacttgcaagtattttcaaggtctatactaggatatgtagatggtccttgggtcatttgaccatctttgttgctattttagaagagccttaaaagtagttaatttatattctctccaccaatagtcacattatattattgtttgtatataatttaaattatgcggtatttgcctttataatttgtgtgttgattagcggcacgcagacggactgatctggtctgaaattttatgg

SEQ ID NO: 23612 - DNA, 625 bp, Sorghum bicolor
  Clone ID: 18066613
tatcaagaatggggattccccagagactaagatggataagacctcctcatctcccaaggaagatgtacatttgctgacgaataacatacagttttcgcctgactcggtaatccacagattccatagccaatcaaccacgcattcggtggcatcaaatgctagcggatgagataccttgtatatatactgatcctgaagaaataaagccctattggacgaactgtatacagtatagagatttgttaatgagctgattcatctgggtaacttgtttcctttttctctgttgactggttcgtggtgtaaagtcatgttgtatgtagccacagcaggtgcttggcataaattgaaacattaggcaaagtagtagaatcagtatgaggccaaaaattgtactatagtgactgttttttcgttttgagaaaagaagggggactgtcgaatgacagaattggagcaacacgaaaacgaagaaatcaagctgtatactgagtactctaattggctgacaggccagtatttggttcactatgtttgagtttgtggtgaccatgtactttgtggtctgttaggcacaatcactcccatttgatatgatcaaccgcattcgcacttgtgtgcagtc

SEQ ID NO: 23613 - DNA, 590 bp, Sorghum bicolor
  Clone ID: 18066869
tttctgctaacaaagcttacaggcagcttattgggcataggcaagttcataaagcctgtcaatggctgtggaaatcatcctgtcaaaataaaaggaagttcttcttttggttaatacttcaggacaggttaagcacaagggctttgccgcgacgtaggaacaaaacatgcacttgacgaagatcttattcacttgctctttcaatgtcctttctcttggtctagcctgcaactgacagtctccagcagtcttgatcaattgaaagttttcgggatcagttacagttgctgttttttatgaagatcatcatcacaatgtgctggtccatttggacaatgtgaaatgacgttattttcaacaacattcctcactcgtgcacaaatgcaaggttgtctttagaaaggagtttgctctggttatacttagagcaaaggcgatttaccatccaaggagtgatttatgctagaaacctttgggtaattgctttgattttcttcttgactttttttttgtctcatgagactttgtagtttgtactttgtatcagtttttaataaaattccagtaggaggtaaaacgcctcctgttcc

SEQ ID NO: 23614 - DNA, 428 bp, Sorghum bicolor
  Clone ID: 18067419
ccgaggctgacaagctccccgtcgagcgtgcccgtaagatccagcgtttcctgtcgcagcccttcaccgtcgcccaggttttcactggtatcgagggtaagctcgttgacctgaaggagaccatcaactcgttcaaggctatcctgagcggtgagggtgacaacctccctgagggtgctttctacatggttggtgacttcgcctcggccaaggagaagggtgagaagatcctcgcggatctggagaagaactaaatgactcgcgacgaaaataccaaatcacgtcgagggcggggcgttaagcctgtgtatagaagaggaacgatggaacggggaggtttcttagctcaattcaagtttcttttgtgagctgtgtaccaagaaatctacttaattcctcttgtagttgagagaatctccttatttctt

SEQ ID NO: 23615 - DNA, 431 bp, Sorghum bicolor
  Clone ID: 18067459
gtaaataggtgtagaaagaagtctcttaccatgaataactgtgctgctgttataatggttctatgctgttgttacaatggttctaagtcatacagtctaaatgttatcacacagtgagataaataaactgacactttactaaccttccgtgtatatctatatggcctcaatctcctgtttacagtgaaatggaagataactaatcaacaaaggaaggtcctgcaactgaagtttgccacacttttagttttatatatctactctaatgatcatcatatatttggatcggtattctaaactacccaactatagtattcgatagtcatgaaatccggttatgaattgtaatgcatgggtctgtaatgtatggtcgaacagaatcataatagctatggtagctgtgcacgcaatgaaagctcgtgcaatctatg

SEQ ID NO: 23616 - DNA, 686 bp, Sorghum bicolor
  unsure (1)..(686): unsure at all n locations
  Clone ID: 18067870
tatcatgggtcagatgcctccattgcctttatccataaatgaagaccatataaattcacttattcaactgaacagactggttgcatcatatggtacggcaagcatttctcatcatacgaagcaagagccatgaagctagtctaccatacncagggaaaaaaaagagaggaccagatggccggacctcctgcaattctgtaaacgtgctgttgaggaaggcttacatgttgttactgaccaagcgccagggacaatcactcctttccagataatgtttttgcagtgatctgattgtttccaacccgtctgcctgcctgcccaccaattgttgaagcatttggaagaagtctgcagttgtggtgcgagagccgcaagctatttgctgctgtttctgtttgcattatccggcatatagaccagagtatcaagacacttgatcctggactccgcaagtgattgtaaatattggatggctggaggcgtttcatgttttgtttctctgattgctcatgaatgtatttcttctttttttttgtgtccccggacagggttgcattgctcccaatatgtaactatgtacaatagccactgccctagactgctaggtgtagagcgactccattttctgactaattggacactggaacccaaacatgtgttgtccagatattctaaatttttctttc

SEQ ID NO: 23617 - DNA, 664 bp, Sorghum bicolor
  unsure (1)..(664): unsure at all n locations
  Clone ID: 18068181
gcctttccatgtcgctgaagttttcacgggtgctccagggaagtatgtggagctgaaggaaagcgttaagagtttccagggtgttttggatgggaagtatgatgacctccccgagcagtcattctacatggttggaggcattgaggaagtcattgctaaggctgagaaaattgccaaggagtctgcttcataaggaggcttcttgcttgtcgaattcgaatcctgtacaagttccatttttggattttaagcgtttatttgtgcttttcgcagttaggcaggacgagctggagagccatctcctgctgagagatgcttgtttttctcttttttgttcctccaccttacacccaaataagcaactgcagtgacattgattttggctgcaccaaaattacatgactgaagaaacttgtggcctgtgtaatgcgacccatcagaccattaagttatggcttctggttggtaaaatttgttggcccccaggttcgcttcctcattgtggaggtatctttgttcaggactggctctgcggtagtttccgtggttttccatcttgtagtgttgcaagttctatttttgtgcaagttctgccggagtctgtttaatgtttatccactttggatggagatggttgaaacganaaatactgtccttctaattc

SEQ ID NO: 23618 - DNA, 619 bp, Sorghum bicolor
  Clone ID: 18068491
aacttgtttgatccatactttgccaccatgaattcctctcagaatattgaatttgtttacaaaatgagagcaccacagttacaagaccttaaggcaatgaatgggcctcttgtcttcattggtgaatgggttaatgaatgggacgtacaaaatgcatcacagtacgagtatcagaagtttggcagtgctcagttggatgtttatgctaacgctacctttggttggtcatactggacacttaagaatgacatgatccattgggacttcgagtggaatattcagaataaatacctattattcagtggttcatccatgctgaagacaccaagcttcctgctgctgctagcgttaggatggggaattcacctgatcatcatgccaagataacctggattctaggactgagctgattgagagtgtggatgtaattacatatagaccaccgaagtccgagttatagttgaggcaaatttgggtgcctatatctttcttgtataaagccatctccagttgtttttttcaggaaaaaaaaacaaaacctggattcctggaacatcccggaggctgcagcgctaccggcagcgtcggcctaaattcagggtgaaaagtttttggtgtc

SEQ ID NO: 23619 - DNA, 575 bp, Sorghum bicolor
  Clone ID: 18069055
aatacagctacaacaacaacaaaaacagcagatgcaacaaatgttgcatcaacgacaacatatgcgggcgtcaactcaaaatctgccaatgcagcaacagaagctgcaccagcaacagcttcaacaccaagaacaactacatttacaacaacaactaatacaacatatgcagcaacaacaacctcaataccatcaacacctacaacaacaaatacaacatcaacaacaactgatacaacaaatacaacaactaaggcatcaacagcaacatatgcatcaaatgcagccccaacaacaaccactgcctcagatggtcgatacagaattaggtaatgatgatgatgcaagggaagattgggttacagagcctgggcagcatgcctagggaaagtagagagggttaatgagggattacactgacatgaggatttaagatgtttcttattgtttatcttttaatcatcaattgataattttaaacaatagtcgttgtatagtgttacaaaatggactaagagtttattaacaaatctatgttatcccagtagttaatatattgtattgagttgggagct

SEQ ID NO: 23620 - DNA, 694 bp, Sorghum bicolor
  Clone ID: 18069627
ccactagtcctgattttggatggtagatttaggtcggcgtaaatgtgggagaaggaacttaaacagttgtttcacatcaaattagttgatctgaagatcctttccaagtaaaaaatcagcttaccatgtagaattggatacggcgaggttagcttggcccatgaagtaacaattcttttgatcacactgagaggatgccatttgcagatagctattcaatgttgttggaagaagatgctagttgaaaataggtgaattgatgatgttggaaacaagaacaagatgcatttcataagacgaacaaaaggacaataattttgaggaggaacctttagcaatcttgtgtttgcatctgttattcatacatgggcatgtgtgtacctgaaatgctagtgctatatctacctgccttcatatttgctggggcttctggagctgatagctagtgccatactttctgccttatatgtccatttcctttctgtttaacagaatcatgtacaatttattattagtttctctccccatgactaaagcccttgtttgacgggcttttcattccatgtaaagaattagaagattctggccaatcttcttatgttcaatagaatgtaatatgaactgtactgtttgataagtgctgcactgctgccatataatttagttgcacactgtttcaaaaaaaaaaaaaaaa

SEQ ID NO: 23621 - DNA, 493 bp, Sorghum bicolor
  Clone ID: 18070098
agcgtcactcgaaggcctgaagatgatgtccccaaatcagggaaaggggttctgaagtcggttgctggaggaattacccttgctggcgcagtgttcttcatgatccatctcagaagaagcaaggaaagaagctttgcgacagttataccatctctttcagaaaaatcagttcggagcaactcaagggccaagaacatggacaaagaaaatgtccatgatgtgtatcctgggggatggctgaaggtttaacaagatgatggatgtgggtcgcgcacgctgcctggaagacagagcacagtctacttacagcggcttaacagaatctggataatttttgtcgagtcaccagttaaagttaaagtcagtaccctgcattcttcatgtacagaacgatatagccatatcatatcatataatataggtgataaattacagcaaataatcgaacaaattttgtacaattgtatagaggttaattgagatctttcaacgg

SEQ ID NO: 23622 - DNA, 686 bp, Sorghum bicolor
  Clone ID: 18070248
acatcagggataagtatgcctctcaggagtttgaaagtttaagtcacttggtgcagaggatatccgatcaagacatcaagcctttcgagcctaagagggcatggaataagaaagtgtcatttgttgacgaagcaacaagctcaaattccgacgaggaaccagtaatcggtttggcagagtgggtaaaaaacaagaagccgatgtcttgtccttttggacagaaagaaccagagaagtttgcctttgacaccgccaaagccgataggatatttgactttctacttcaggaaggtcaaattaaactgtcacctaaccatgtgatcccgtcggcagaagagttgaagaggatgagatattgcaagtggcataatgcaacgtcacatgacaccaatgaatgtaaagtattcagacaacagctgcaatcggccatagagtcagggagaatcaagtttgatagttccaaagcccagaagccgatgaagatagaccaacatcctttcccgacgaacatgttggatgctaaggggaaggctaaggtcttaacgtcggagacagctgagaagagtgcatcggtagatcctcagcatcaagttactaccgccgatgcaaggagtaagggcttggtccaggaaggggctagctcaggaagaattcctcgatctggtattgtcataactcatagaagg

SEQ ID NO: 23623 - DNA, 607 bp, Sorghum bicolor
  Clone ID: 18070506
cactgaggcgagttacaaagttgtcattcaaggagtactcggagggtatgccaaacctcctctttcagaaacctgcaggggtgcggaattcaaagtttctcaacttcaccaatgtacagataatccaacaaacactgtatcatacgatgctttgagctcttttatttgatctgctgagctcaaaagcacatttagatttctgctggtaaagaagtgcatttagagttacaacgggcagtgtagatgttgcaggccctagcatcttggacactttctcaaagccgagaagagatccatcgatctagagtcatgtgtagttctacaatccacattcgctgctgtgaggaggaggaaaaaaaaaggggagaggagtttgtagtgcagaaatttgcaattgctcagtgcattaatttgctctgcttagcagcttacccgacaggttgcagaagggacaatgaaagttgacagtctctgcaggtggtcatactatataggaacctagatctataaattcagctcctgaggctgagggcaatgtatgcagtacttgatatgggctcaattgccttctaacagattcaagcatatacacaatgtagcttcactg

SEQ ID NO: 23624 - DNA, 563 bp, Sorghum bicolor
  Clone ID: 18070513
tggatcgcaagcgagctgccatgaggagggtatggagctttcatgcttagatgaggtgttcctatccctcgacgactatgatgaagtcagtttgtcaaataattagaatccttatcaccagaacaggtagtactactagtaggcccctagctactacgatttcagaagatcaaatgttcattccataggtgtttagccttaaacactgtgtcgaaaccacatatgtaattattctctcctcatcaaaggagtcgaggcacatgtatgtaacaaacttgagttagctttagaaatatggttagtgtggataatcccctatcctagaaggtttttattatgtttgagcataaaaaggcgcgataactatgtctccgagtgtctctgtatgtattaaaaaatattacacaggtgggctgccttgactgtatggggaagtggtgctgcatgaactcattgacttgacaaaccagttactggatacacatgtacaggtagccattaacatttgtaaatatttgttggtggattgcagtacatacgtagtagtgcactggctttagatc

SEQ ID NO: 23625 - DNA, 672 bp, Sorghum bicolor
  Clone ID: 18070536
ccaaaacaacgcagccatgcatatatattatagctactactatagtatattttcttcttcatcaatcatccgtaataaagctatctttaacgatatccttgtcacggcgggtccgggcggcgccaccggtcgccgtccagaagaaacttacgggcttacggcaccgtttaattgtgtctgtcaccttgtggccactcaagtaaccgtcggcccaacgtgacaaaccgaaagttccaactcacatgaccatgatgcctgccgagggcagccaggcaaatcgatcggtctatcatcgacagcgatcacgctagctgcgtgtacagtgtacaagacattttcaaagtccaagttgagcagcagtagctcccgtggacatttcccggccggccggccgttggaaggcagcgcggcgctcgtcgcaacttaattaacaaccaggcactgcacccaggggactacttggactgttcaaccaccaccgtacctccgatgagttgaaccccgtaaccaactcactcacgccgacatccacgacgacgaacgttcgttcgcccgtgtcgtgtaacacatgcctaattgatcgatgacccaattacttgcaacaacgaactgaacacacaagtactgaaaacgatgaacagtagtactactgaccgtgaagaggaagttgag

SEQ ID NO: 23626 - DNA, 692 bp, Sorghum bicolor
  Clone ID: 18070604
ggtcaatgagtgggatccatgctttagcgacttcataaagaaactggaatcttccaaaccagtaattgttgctggggatctaaactgtgctcgcgaaagtattgacattcacaatcctcaagcaaaaaccgaggctgcaggtttcacagttgaagagagggagtcatttgaggagaacttctctagcgaaggtcttattgatacattccgtaaacaacacccgaatgctgtggcctacactttctggggtgaaaaccagcgcattaccaacaaaggctggagactggattactttcttgcgtcagagtctattgccgacaaggtccatgattcctacactctgccagatgtatcgctcagcgatcacagtccaattggccttgtgcttaagttgtagacactgatgcatctctcagctatttgacaactgaagcatgaagtttaagcgtcgtcctaaataaaaagatttgtagaaagattttgcttatgtaggctgaaaactattcaaactcaggtggtggtacttcgcgtggtctcctgtggtctgtggaggtagtggatcgcctattcacgttgtgttcgtgaagttaaaagtagcctagagcaattattagctgatgttcttatacctcgtgaatgcaaccgaccgaataacacatcgttttacattcacaatttggcatcttgaattt

SEQ ID NO: 23627 - DNA, 546 bp, Sorghum bicolor
  Clone ID: 18070636
tggcatgagacctaggagcgctgtctttttgttctcctttcctttcttttttaattgtagtcccattatgagccttgggtttgcggagattggtcaaggttactgtattcagaatacaacccctgaagatgtaggtgggtttcagaaaattgccattctggcatatagctgacaatggttcattaagctggtagcctggtggatttcctgcggccagaactgttcacaacattttgatggccgtggaatatagcattttgctatgtgtccagggtaccaacagaatcagggacattataagaagaatattaaccgatcgacattataaggataccaaacgctagcggcgttttatgcaattcagaattcgatgcccaacgcccatcagtcatatatgagttaccggttgtaacagtccaacggctgtctacatatgttatgtaaaactagttggaaccgcaacggtgtgtcatgtcgcatgcaacctgttatattaaaccgacagaattcaaaggaacccgcaatgaatataagctacttcattct

SEQ ID NO: 23628 - DNA, 692 bp, Sorghum bicolor
  Clone ID: 18070657
aaagaggagtagaagatttgggtcaagaaagcagtcggacactagcagcggaagcagcagtggggacatggacttgtccagccccagtggaagctttggtcaacctaatctagtgcccgacgaggaggcatgcaagagcagtggagagcagccttttatgggtgtgcctgtgcaggttccaaatcttgtgatgtccaggtgaaagccaaattcagcagcacaggttgaaggggttaacatgttagcttcttactttctggagttacaccggccttggcgagatgtaggttttgtgcatccccaggttttttttgccagcacaacccagatccaggttttgacagtttttttgaaggctcatcaactagtagtcagttagatgtgcagatgtgtcaccaagaaccagtatacagtttgtatgtactgactgacctagataagttttttatctggtccctaaaatgtgtagggttgatagctttgttaacatcgtctaggaggggaagaaggtccagtttggtttctggttttagagctttcattttttttgggcaatcgtagtctttgttgtttgtttgttcatctagtcttagctgtggctcgcctacataaagttattatgctctactaaactcagtgagatgtcactactgaaatcagtgaaatatcacaagatatagttgcttgttgcc

SEQ ID NO: 23629 - DNA, 397 bp, Sorghum bicolor
  unsure (1)..(397): unsure at all n locations
  Clone ID: 2674234
agaagcgaagccagagagccagcccgtgaacaatggacacgtgcngcactcgacggtgaagtgcacctgaagccnnacgccggaaaaacctgaaccccttccggnnccgtgtatctcatttaggaacaaacattcgcattcgcattcacattgttacagttaaaaagtctatggaacggtaagcatgttaattagtcagtctgacgctgctgggtgacaggttggtaattaggctctgcatttagctgttttgtatgtcntgtctgccgccanatcatgtatcatcttcttgtggttgtatggtacctaaccgcgtaaacatgttaaccttaggccatgtattaattactccgctctaatgtttgtatgttgtattgtcaaaaaaaaaaaaaaaaaa

SEQ ID NO: 23630 - DNA, 632 bp, Sorghum bicolor
  Clone ID: 30160722
gagctgtgtggtggcacgcatgtgcaatcaacagcacagattcagtgcttcaaagtcacggcacaatcgtcgcttggatccaacacgcggcgcattgaagcagtcgctggtcctgcagcactgaacttcttccaacagcgcgttaaattagttgataatattgctggcatgttgaagactgaagtggatacattggagaataagattcaaacactactggactcgcaaaaagatttgaagaaggagctgaaagaagtcagatctcaactgctcgctggttcaacaaagaaaagtgatgcagatcaatcaacactcaaaggacagtacaacaacatgacagtcacattgcacaacctctcgtgcggtgatgatatgacactgttgcgacagtacggcgataagttgcgccaatcagatccgcagtcagtgcacgtgctgttctcgaacaacaatgtcatctgttgcagcgaaaagagtgacgcgcgaagtgtcatgcaggccattgcaccgctgattgacggcaagggcggtggctccaaacaaatgtgctcgggcaagttcaacaaggacttgacgagtgcactgcctgatgtgtacaaactgctcggtgtagctgtttaatttaaatttga

SEQ ID NO: 23631 - DNA, 604 bp, Sorghum bicolor
  Clone ID: 30160726
cccactaaggaggccctactctggaaatcctgaaattctggatgagaaagaatttggagaatcttctaccagcaggtctgaagatgctcaattatctgcagcagaagagcttggattaatggattggccggcggaatcacagttcctgtacttccagtttccatcctctcttcctttaccgaggcagccacaatcagttgctaaccctaatgtagtctccaatgagagacgtgaggacatgaggccatcatcgcacattggctcaagactcaaagagattcctgaaggctatatggggagaatacttgtatataggagtggtaaagtgaagatgaagatcggagacgctctctttgatgtttcatctggctccaattgcatgtttgtccaagaggttgcagcaatcaacaccagagaaaaacattgctgtacggtgggggagatcagcaagcgtgctgttattgccccagatattgattatatgttgggttctgtttacaaggaatagtccattggcttctttcgagcagaccatgaccgtattatttgactcccaagatggatatggtttcttattttgacccaggaaaaatttccctctctt

SEQ ID NO: 23632 - DNA, 636 bp, Sorghum bicolor
  Clone ID: 30160739
tgcttcctcatggcggtgttccttggtgcagccgtccattcttccaatgccaaggatgatgaacagaagctaagcatgaagagtgcagacatcgagctcagcagtgacttttcagacaaagcgaagttgctgcctgctcctgaagaatcgaagaatggagatgaagaagattacagcgcttccaatgagttgaaaccaggcactgcagagttcatcatccaggttgaggagagacggtcaatcaaggtccttggccatagaaagttgctaggcctcagtctcgttttctttgctggggcctgcttttctctcttctcaccggcgatcaacctagccaccaacgaccagtggcgtgccctgaggaagggtgtcccgcacctgttggtctacaccgccttctctctcaaaatcttgttagaataggctaaaagctactgctataattgttattttatgacactgaagtgtaatactttgtacagggtgagaatgcactatactagttaagccttcttgtagtcttttgttcggaatagtactacttttggttattaatccttgtagttatcactgaggtgttcaatatgaatatccctacagctaattatgtgttgtcatattaatgtatcaaagtta

SEQ ID NO: 23633 - DNA, 588 bp, Sorghum bicolor
  Clone ID: 30160740
agttggttactgggaggcgccctatagagccaaagaggtcaatcattgagcgtgttaccacaaaatgggcaatggaaaaatttgtggaaggcaatgctattcaaacactagatccgaatctggaagcaaccgatgcgatcaatcttgcagtcgagaagttgtacgagctggctctgcaatgcttatctccaacgaagaggaaccgaccgagcatgaagcggtccgtagagattctgtggagcatacgtaaagattacagggagttggttgtacccacctctgccatgaactgaagcagatcatctggagcaatcaagtgaacaaaagatgtattccattttgcctctcttcaaaggttggtggtggaaatcacccaattgctgggattctttcagttaccgcaagtggttgtgaacaggactgatggccttcctagatgttgtgtatctactagctagaaaccagaaaaatcccttgcaggtcttagtatgctgtgtgaaaatgttgctgagcaaacatatacgagtaccagatatctaatggtgtgtatatcttgtaggatttcttatacaggtaaatgcatcactc

SEQ ID NO: 23634 - DNA, 569 bp, Sorghum bicolor
  Clone ID: 30160741
acaaaaatcctaataagagccaaatcagaactagagtccttctcgagtacatcttcaacaaatagagggcgcggtgtcgagagaggatgcacgtagcgaggccgaaccaggcacgtatgtcgagagaggatgcacctaggcacggcaactccgatcgatccacgaccagacatttgattgtgataaaccaaagagcggttaattaaaggttagttttccttctttacctctaataaataaagttgtggttatatacaacaaaactaatttgatcaagtggctagtgggtataggctttattgctacatctgatgtttgaatcttggtaaccccactttttgtttgttgcctgcgcgagcgtgcagtcgcgagcgaggcgtcacaaccgtacacggagaaaggatcgaggcgccacaacacttgcacgagaggggtaaacacgtccaaaacctcttctccgtgtagaacgtcagcttatgtaaaaacagtgtggaagcccaaaatgtctggctttttaagtatggagggagtattactgtgtaaatatttgtatcggaatgatctcgtcc

SEQ ID NO: 23635 - DNA, 108 bp, Sorghum bicolor
  Clone ID: 30160756
agctcaccaaaatgtggtactcagaaatccaagttatggctgaccgtatcgccaatatgagacaatcccttgttgacaacctcaagaagttgggcagcccccatgatt

SEQ ID NO: 23636 - DNA, 619 bp, Sorghum bicolor
  Clone ID: 30160769
tgttcggccgcgccgtcgcgaaccgcacgaaagagatcctcaaacccggaacgccgctcccgaccatcccggcgaatgcgggcgaagaatccatcgccaactttgacaaattgcgtaacgcgaacggcacgacttcgaccgccgatttgcgtttgaagatgcaaaagacgatgcagaagcacgccgccgtgttccgcacgcagaagacgctcgacgaaggcgtgaagctcattgaggaggtcaacaaagagttcgcggacgtcaaagtcacggaccgctctctgacgtggaactcggacctcattgagacgttggaattgcagaacctcctttcgcaggcgcgtcagaccatgctcgccgcgcagaaccgcacggagtcccgcggcgcgcacgcgcgtgaggacttcccgaaacgcgacgacacggaatggatgaagcacactctcacgtacgagaacccgagtaagccggtgaagattacgtaccgtccggtgcacatgaacacgctcgacgcaaacgaaatgcaaaccattccgccgaaggctcgcgtctattaaattcagagccgcgccgtttgttccctgctttgcccttttcccgatcagcaacatgcaactcc

SEQ ID NO: 23637 - DNA, 557 bp, Sorghum bicolor
  Clone ID: 30160775
tgggctatcctcaaggctcacccgcgcaacaacgccggtgaagtcctcctccagtccgctgatcctctggacatgcctgccatcaccttcaactacttcgacactggaaacggcgactactcggctgatctccaggccctgtacgaggccgtcgagcttacccgaagtgcgctggccaaccaggctgtcaacgtcactgaggttctccccggtgcgggtgttacttctcagaaggacattgagacctatgtcaaggatgttgcctggggacaccacgcttcgtcgacttgccccatcggtgctgatgatgacaagatggcggttctggactccaagttccgagttcgtggtgtttctggtcttcgtgttgttgatgcttcggtttatcctcgcatccccggtacctttacagctgtgtcgacttacatggttgctgagaaggctgctgatatcatgttggctgagcttgaggaatagatgtttatgagacaagtggtcgtaatggatattaatgttgagctgatcttagacgaagaccaataccaagtaatgttgag

SEQ ID NO: 23638 - DNA, 675 bp, Sorghum bicolor
  Clone ID: 30160789
tgttggcctgctggagaaatgctgcccagtgtgttgcgttgttctgtgcagcgccgcgcgggttcggtggcgagccgtgtggtcgctcgctcgttccacgtgacggcccgccgctccgccgtcgtggcgaactccaagccggaggtcacgtccgcgaaaacgacgctgaagtcgtatccggtcatcgagcacgagtacgacgccgttgtggtcggcgccggcggtgccggtctgcgcgccgcgttcggcctcgcgtcgcagggctttaagacggcgtgtatttcgaaactgtttccgacgcgctcgcacaccgtcgccgcgcagggcggcatcaacgccgcgctcggcaacatgaccgaagacgattggcgatggcacgcgtacgacaccgtcaaaggctcggattggctcggtgatcaggacgctattcattacatgtgtcgcgaggctccggccgccgtgcgtgagctcgagtcgtacggtctgccgttctcgcgcacggaggacggactcatctatcagcgcgcgttcggcggtcagcctttgaagttcggcaccggcggtcaggcctaccgctgcgccgctgccgctgaccgtaccggccacgctatgcttcacactctctacggtcaattgctccgtcacgacacgactttcttcattgaatacttcgcg

SEQ ID NO: 23639 - DNA, 655 bp, Sorghum bicolor
  Clone ID: 30160797
ggcatccattcttacgtcattccttcattctccctcgttgaccaaccacggccacagggacgtcattcttttgaagcactcttttgatcggatctcacttaatacaccatgagacacgccatcttcgccggccttctggccgctccagcttccgtgtgcgccgtcgccctcacgggctacgagtacatcgtcgttggctccggcgccggaggaggccctttggctgctcgacttgcactggctggtcacaagacccttctgatcgaagctggtgatgactatgcctcgctcaactacactgttcccgcctactctgccaacgcttctgaggatcctgagatctcgtggaacttctttgttcgtcactatgctgatgatgagcgacaagcgcgtgattacaagaccacgtatgatactcctaacggagagtacactggtcttaaccctcctgagggcgctgagatgaagggtactctgtatccccgcacccaagctctcggtggctgcacggctcataatgctttgatcgctgtgtaccctcaccagtctgactttgagtacattgcctctctgactggtgatgactcctggtcagcggacaacatgcgcaagtactttgtcaaggccgaggacaacaactaccgccctgctggcg

SEQ ID NO: 23640 - DNA, 678 bp, Sorghum bicolor
  Clone ID: 30160819
gactgaaattgacggtgaaagatatttagaaatttggaacctcgtgtttatgcagtacgagaacaatcctcaaggacgaaatttcacaccactaccagtaccgtgcattgacacgggcatgggtctcgaaagattggcctctgtgttgcagggcaaaacaaacaactacgatattgactccatggctctgattatgaatgcagtccgaccagtgatcagcaagaagacaggcaagagttacagcgctgattgggagactagtgtacgtgtcatcaccgatcatattcgatcagcctcgttcttgatcagcgagggtctcacacctggcatgagtggtcgtggttacgtgttgaagcgtatcattcgtcgtgcagtgcgctacggtcacaagctaggcattcgagagccgttcttggctgaaatagtgcctgcactgatcgagtccattggcgacacctatcctgaactcgctgagcgaatcgaagtcattcaacgaacactgtcgcaagaggagaatgcgttcttgatgaacttggacagagcactcgaaatcttagaacagacctttggcaaggcatcgaacaatactatccctgcagatgttgtgttcaaactatacgacacattcggtgtgccagcagatttaactgaattaatcgccaaagagcgcggctgggt

SEQ ID NO: 23641 - DNA, 682 bp, Sorghum bicolor
  Clone ID: 30160838
agacttatcctcttctcccctccctccttcgaaacctagggcaccccgcagtgcctcaacacgcagtccacgccgccgccgccgtagcgcggcagtccacacagctcctctgcacggccgcatctgccgcatccacccatcccaccaccgcacctccgctccgccgcatccacggatccacacctaaacctagcctcgctgcatcccgccgccgcacctccgcatcccccacatccaccgaatcccgccagagctggaaggagtcaccaccaccttggccgtggggacacggagccctaagccggagggaggcgccaagttgcaaaccggaggatggagccctgagccggagggaggcaccaagctgcaggccggagggaggcgccaactctgcttacgcaaatccaaagatccctcggcatcggttcttctccatcgctgtcgggcgagatgcccctcgccgtggaggacaggggcggcaccgtggcgctgatgccggcatccctcttcctcctgggcacaaggccggctctcctgacgctgctggagcgcagaggccggctgcctcagcacatctacctcggctactccatcaccaacctcgtcgtcgccgtcctgatggccgtcgcgtttgggcaggttggatatagcaggcaagacttcttcactcagctcacccaga

SEQ ID NO: 23642 - DNA, 651 bp, Sorghum bicolor
  Clone ID: 30160841
agcatagaacgtcaactcggacctcctcgcctctccctgctcggcaactggtgcgggaagcgccgacgccgacgcgccctgcttgccactttgttgcttgcccttcttacgggccaccgacgatggccccttccagtcgtcgtcgtggtcgtcgtcgtcgtcctcctcctcctcgctcttgacgcgtcgtctcctgttctcgtggtgcagcaggagaaggccgagggcgccgtccgcatccaagtggtgggatacccgctggacgaccgtaaccgtgttgccgtcctcgtcttgggttgtggccgtgaccaccttcccctcggcgtcgatccgcggctggaacggcagctggcgcgaccggaacgcccacagctccacctcgacgtcgcgcgtccagaccttgtgcctctgggagtccaggtccatgccgttccggacgaggaactgcttccactcggagatgaaccggtagccgttgttggactgcaggaacttgcaggtgagcgcgtacgggacgccgtcccggtccagtgccgtgaccgccagcccggctcgcttcgtgttcacgcggtccagctcggcgggcgagaagcaccgcgtgatggggcagccctccgtcccgctcccgcgcttgcacgacaccagcagccg

SEQ ID NO: 23643 - DNA, 654 bp, Sorghum bicolor
  Clone ID: 30160851
aagaactaaaataccagtaaaaaaatcatgttcagctgctttcaatcagtagtagaaacatcataatactagattagattttaaacagacatcttccaatgtagttgcaggctacatgacaaatactgaaaggaatcaggaagcatggaaagctaatgaagtaactaaagaaactataaaccaaaaaaggatctaaacctagttcagttggttgagggtgtggatgtatgtctagaccacacaagttcatgtcctcactgacacaaatttgggtgcctagtttcttcttaacataaaaccacctagttcctcttagtttggtcccttttagagggaaaaaggaaaagaaaaaaaaactatagacaaaaatgattacatatagaacaaatatagaaaagctcggtgcttttaacactgatactgaattatatgaaatatcagttagaaattccaaacagaatttgccaaaaacaaataccaattcgagctttcctatctgtttggagaaacatgcactgtagccaggctaggcatgcactcactgcattccagtcattgacatgtcttttattttcagcaagcataggaatacgaaaatctagtacaagaaaagcaatactgcaactggacccaagtttaaactttgagatgaat

SEQ ID NO: 23644 - DNA, 682 bp, Sorghum bicolor
  unsure (1)..(682): unsure at all n locations
  Clone ID: 30160861
atgcccaccatattatatattatattatatactttcccatattttgttttttttatacacgtatatacacgacgcagcagcacaagctcgccgcctcgccgtctcctagccgcggcgtccgacgccaccgcgctcccggccccgatccggtgaatctgacttcaccttcgccgccatgagctgcgtggcggcgtggtctcccccttcctcctccgctctcggccgccgtccctgccgtggtggccgcaggcggcgctcctcctccgtcaggctcatcaggccccgggcggcggccgtggagcaggagtggggcggtngcgggggaggaggccccgcgcccgcggctggtgctgcacgactccctcgacgccgtgggggtggccaccgcgcacgccagggcggcgcgggaggggttcgtggcgcaggtggggcggctcacccgggtgagcgcggggagcagcatcgccatcagccgcggccctgacctcgcccgcgccgcgctctgcgtcgcggccgaggacgactcgctcgtctcccactcctcggtcccgctccccgtagacgccttcatcgcgcgcctcgacgggctctccgcgggcttctgcgccggcggcaacttcccgccttccggcgcgccgcccgaggtcttcttcgattaccttgaccgctacctctacatcca

SEQ ID NO: 23645 - DNA, 548 bp, Sorghum bicolor
  Clone ID: 30160865
ttccgcttctccgctcccaaccttcccaccagcagctctctagggttttcgccgccgccgcccatggccgccactccggaccgcgccaatgccgacctccgtcgccgcctcgccgtcgacacccctccgccgccccagatcgccagagagaagcaaggccttgatactgaaatacccctttctcctcagtggcttatgaaggtgggagaaaacagggatcctgtttcacagggtatccgctcagatctttcaaagacatcagggactggtgaagacccaggctacagcgcgaagaaaaaagatattttcaggtcttctgtgcttgatggtgaaactgggcgccgtgaccgctggcgcgatgatgaaagggaacccaattcgacccatcggtggagtcgctggagggagacagataaggaacatggtgatgcgcgcaaagtggaaagatggtcagatgacacctcccagcattctgtagatggtcatcgtgttccgcaggagcgctggggcgattccaataataaggaaggcagttatgaccaacggcg

SEQ ID NO: 23646 - DNA, 664 bp, Sorghum bicolor
  unsure (1)..(664): unsure at all n locations
  Clone ID: 30160885
cttgggtgttgttgcntgcagagcaatatacatcagctttcaatgttgataactctaactatggtttgcaatatttcgtagctcacgaagttccaaagggcaacattaccaatggtacttataccgtcaagctaattgatcaaatttggcagcaaatcatgcctaatgtgaccaattatagatatattattcaaggggattgcgctgaagataactatatctataatgaaacctttggtcttttttacccaacaagtaacagtgctagaaacctaggtttctatagattccaaacgcttgatgctaacggtaaccctgttagctcaacaggaagccttccttcacttaatcctatgcaaaatgcctctcaaactgtcaccactactactgtcgatggtaatccagttaccactacttctggaggcattacagctgccccatagaagaaatggagtattatattatgctttttaaagtaaagcataatagtgaagtaaaagtgttgtttattacggtaaattacacaggtatatctctattattggtaaatcctgagaagtaaagtaaaatatttgtaagaaatgtttgatcaatatattatatacatatgatgataagttattaacaagatatacatatgatgtctgaattcacttttaaacct

SEQ ID NO: 23647 - DNA, 537 bp, Sorghum bicolor
  unsure (1)..(537): unsure at all n locations
  Clone ID: 30160887
taaaaagttcttgaaccacctattgtatggtgggagacatcagaaattagttgggctgcgctagtagcaataaggaaaaagacaatccagaactataatacaaatggggttgtttgtgcgttgtgtctatctcgtaaaaggtgtctctgtgcttatatcattctatgtgctaaggcagtcgttttgctactattaaaaaccatgttatggatttcaatctgttattgtcaaccaattggagaaccttgatgaattatcttttattccttgtttggttcttcaccaaaccaaagggggttggagaggantgaaggggattgagggagattttgacttgtaggggattaaatccccctcaatcccctctaaccctcttggtttcgggatgaaacgaacaaggctttatgggggcagaaagctagatgtgcacggttcatgattgccctgttctgctaggttgggcttacaactttgttttggtatatacatatcaggatgtagctaagagctgaatcaatgaaaactatatctgttttt

SEQ ID NO: 23648 - DNA, 604 bp, Sorghum bicolor
  Clone ID: 30160888
gaggggcggcggtggccatcagggtcggctcgcccgagaagcagaccaggtccagggtcagggcgtccatgctcacgctcgacttcggcggccggaccgcggtggaggtcgtgtgatcagtactcatcatcaccgatgatgatgaatccatgcaatacaatgatgagagaacaagtattatttttcccagtttctaacgacgatggatggatgtgtgggatgagtgtaacttctcccggtttaaggaggtgtcacagcgggaggacctgatacgatgatgtagatacagatagtgcggccgtgggataggcgaccaaagaaaagatacgatgatagtcagcggtgcatctaggatttcaatcatggtggtatggacaaagatgatataattcattaatatggacataatataattagattactaaacgatgataaaataattgtaagtgtagagtgttgaagctattgtatggactgagcggactagcagttgtatatacaaggtgttttccaaaaaaaatttagagagacagcacgccatgcttgtactatatagatctgcccctgatgatagtttttctgattcagttgaaggcttaatatt

SEQ ID NO: 23649 - DNA, 600 bp, Sorghum bicolor
  Clone ID: 30160893
gggagatcaagcagaaaactttagttgatatggcggttgaccgtggatgctatattgaccagagccagagcctcaatgtccacatggagcaagcaaactttgggaagctaacatcacttcacttccatgcttggtccaagggcctgaaaactggaatgtactatctacgcacacgagctgctgctgatgcgatcaagtttacagttgataccacacttctaaaggagaatgggaatgtggtgagtaatggaaagcccccagaggaagacgtagaagctaaaatggcacaaatggtctgttctttgaacaaccgggaagagtgcatggcgtgtggaagctagactggagctccatctggagttctggacaccgcacttccttatttgtgaccacaacattatataccaccggctgattattggagctcaataaccatagcgaattctgtgatgtaggttgaattaaaaattcccataatgggaaatatcttgttccctggatacagctacggatctctggtttgtattgctctactgagatttatgctgccgggcctgcagccaaatgtatatatctacttctatcaacgcacattgccct

SEQ ID NO: 23650 - DNA, 647 bp, Sorghum bicolor
  Clone ID: 30160894
caaggagattaccgtatccaaggatgacggtgtccgcgatggcatcactgctgagtctctgggcaagatccgccctgcttttgccaaggacggttctattcatgctggtaacgccagtcagatttccgacggtgctgccgctgtcctcctcatgaagcgatctactgccgagaagcttggacagaaaatcctcggcaagtacgtttgcgcctcgattgtcggtgtcaagccccttcttatgggtcagggcccctggaaggctatccccaaggctcttgaccttgccggcatctccaaggatgatgtcgatatctgggagatcaacgaggcttttgccagtcagtgcttgtggtgtgccaacgaactgggtattccccaagagaagatcaaccccaagggaggtgctattgcctttggccatcccctaggctgcactggcgcccgacaggtctctactcttctatatgagttgaagcgaacaggccaaaaggttggcgcaacatctatgtgtgtaggaactggtatgggtatggccgccatctgggttgccgagtagaagtttgtgtacaaatattgacagcatgtattaagagcatttagtatttatctcaatttatcctttctagaacccttctatacgagttcct

SEQ ID NO: 23651 - DNA, 635 bp, Sorghum bicolor
  Clone ID: 30160901
caaggcttcaggaattttatcaattgtattcgacattggaggcgtcttaggagggatttcggctggttttctctccgatgcaataggtgcccgtgcaataacatcagttctcttcctctttctgtcaatcccagcactcattgtgtacaggacatatggaagcatatccatgcaccacaacattggtctcatgttcctctctggttactttgtgaatggtccatactctctcatcaccacagctgtagcaactgatcttggcacccaagacgcgatcaagggaaattcacgggcgctggcgacagtttctgcgataattgatggcactggttctgttggtgcagctctgggccccttgcttacgggttacatttcaactagaggatggaatagtgtatttttcatgttgattgtttccatatcacttgccatcctatttttgatacggctggcaaagaatgagatagtaaccaagcttagcacacgaaattaaagtagtaatttgaattggggatgcttcagatgtcagattgtagattgtaggtactccatccgtccacaaataaatgcacatcttgtttcctgaggagtcaaacatttttaagtttaactaaatatatataaaaatatactaa

SEQ ID NO: 23652 - DNA, 623 bp, Sorghum bicolor
  Clone ID: 30160911
cccggtcagaagcataccctcttggtggtcaagcctatttggacatcgaggaagacacggacatgccctatctgtccggtattaaatatcatgccatgccgcctctgaagcgtttcagagatatggagcacttgtctggaggcgaaaagacaatggcagcactggcactcttgtttgctattcacagctaccagcctagccccttctttgttcttgacgaagtggacgccgctctagacaacgccaacgtggacaagatcaagaagtacatcaaggaccaccgtggtccaggtatgcaattcattgtgatcagtctcaaggcaggtctattccaagacagcgatagcctggtgggtgtttaccgagaccaggaggtcaatagttcaagaacccttactctagatctgcggcaatatgtgtaggtgaggctagagcagttagaatctttgtgattattcctctcggaccttgagggggaaagttgggtgtctggcgcacaacgtcgtggaagagacatggaatttcgtatgggccaaggaagccattatgccattcagcaccgcaactctgagttaagcataaataatgcaggcctaatgatattaagtgatgaatctcacttc

SEQ ID NO: 23653 - DNA, 656 bp, Sorghum bicolor
  Clone ID: 30160913
cgcattaagcaggaggctgcggcccgatcagcggctgaggcagaggccgcagaggctcgtgccaacctctcagagtgggaggaggattctgaatgggaaggattccagagtggtgctgaggatgataagccatccaccaagcgcccacagagaaagacccaagctcagcgcaaccgcatcaagcgccgcaaggaagaggagcgtctcgcgaaacacaaggctgcgctcaaggcccaccgtcgccaagcccagcgcatccaggagatcgccgaggagatcgaggaaagagatcggaacaaggcacttgtcttgcaaaaagacgacgaaaccgaccccattgatgagcttcgtgccgagaagttgcgtcgcaagcagctcggcaagtacaagctacctgagcgagatcttgagcttgtccttccagatgagctcgagagttcactgcgccgtctcaagcctgagggcaacatgctccgggacagataccgaagcatgttggtgcgtggtaaggtagagagcagaagacatattgctttccacaagcaggccaagcgcaagtttacggagaagtggacatacaaggacttcatgatataataaaagatagatgggcgtctaggtgttttagggagaaaataatctttcgacttttctcg

SEQ ID NO: 23654 - DNA, 641 bp, Sorghum bicolor
  Clone ID: 30160921
ccaagcatagcgggccaatttcagcattcccaggctgtggaagactcggttcagcaaccgaaaccaaagaagcctactcgccaagctggcaagtcaagggcgtcgaaaagaaaggctcccgcatcaagaagacttgaagaatcagaggacgatgatgctgttgacacgatgagcgtcgaccttaagcaggaggccgtggatacggatcccggaaacactacagaagcgacagcatctggtgacagcgacgatgaagatggcgatgcccttgaatcaagaccacctcagcaaaacaaggcaccagacactgtttcacggggcaagactgcttccaaggagagcgagagaccgccaccaccgcgagctctcccgttcgagacaaagaagtcgacgaaggctgcacctgtacccgctcctgcagggagtgagactgaatctgacgatgagctttgaattatggctgatgacagttcgccggtacagcgttgtatattgtgttctccaaagtttatgtatatatatttcattgttggttgttgcgcggccggtattggcaagccactattatatacatatagttaaccctcatagcataccacggtgcaagacgggccatgagcaaacaagttcacgcctttcgt

SEQ ID NO: 23655 - DNA, 630 bp, Sorghum bicolor
  Clone ID: 30160929
tttgcgatctcttgtggtctgatccagataaggatattactggctggagcgaaaacgaccgaggtgtctcgttcacatttggtcccgatgttgtctcgcgcttcctgcagaaacatgatatggacctgatctgccgagctcatcaggttgttgaggacggctatgaattcttttccaagcgccagctggtcacgctattcagtgcgcccaactactgtggtgaatttgacaatgccggtgcgatgatgagtgtcgacgagagcttgctgtgttctttccagatcttgaaacccgctgaaaagaagcaaaagttcggccgacgttaaacaatcatcccacctcctcgactaaggtgaatgacaaccgcgacgaagaacgaacgactcgactcgggacttgtctcgatcgaagtgcactcccaatctccgctgtctcgcagctagccttgccaccgttggtggcagggtatgttggtccactgggagggtgacggaacttaagaggcgccggacgcgacgctgacttttgcgaaacccgaatcgtctctaatgcctatatgcgaacttgataacgacaaacggctgtttcttagctccacacacagataaaacattgacaaaactttttttg

SEQ ID NO: 23656 - DNA, 644 bp, Sorghum bicolor
  Clone ID: 30160934
atttaccaagtcaagaaaagcgccaatattccaacgctccgattcgctaccgggcacccgaaactcaattccccgatgtgtgtcaacctctctcgttcagctccgatatttggagccttggctgtctcctctggaacgtcgtcggacaacgcccgctcttcgatgcctggaccctctcagaagatgacatccttcaagaccaaattgatcttcttggtgaaatcccagaagagtggtctgcctacggcgccaagcgatcagagtactgggttgaggatgtcgaagaagaggcgtcaacaaaaaccactactcaaggcggtttcacatgggatgaccgctttgagcgctgtgtgcaacaaggacgaaaggagagcggcatgaagcccatgtcaaaggatgagaaggaggcttttattgatatgatgaaaaagataattaccttccgccctgaggataggataacagctaaagacttgctggagtcacgatggacgaaacagtgggctttgccggagctgaagaagcttgcgacttcatgattgatgttaaaaatgggattggcattctgaattagcgagtttgggaaaagcgtttgtttatattgatcataaatcagatttacttaataccaattgattcatgct

SEQ ID NO: 23657 - DNA, 607 bp, Sorghum bicolor
  Clone ID: 30160939
taaggagggcagccacccctgtacctgcttgttgccaagcgtcacccctgaagcatgccatgaacacaaaaggtaaccaaatgacaaccagcaatgccacggttttcagttgtggagtaccagccagcagccagactagcaaggttgcagaaggtgctagcaaagcaaatccaccatccagcagcagccaggttaagccgaatggtgtggcggtgaacggtgctaacaaggtggtgaatccaccgtccatcaaccaagctagcgctgcggtgaacaacactaacagggctgcgataccactgtccagcagccaggttagtccgactattgacggtgccaacagagtggctaatccaccacccagcaaccaggctagcacggctgtgaatggtgctgctaacaaggggaatccgccagcagcagccaggcaatagataggccctaaatacagtaaattttgtaataatccctttaggacttttgtgcatcggttgtcccttgaaatgtgaatagggcattaggcagagatcgcatcattcttttccccttgcatttacagttgcatccatgaactggacaccactagattggattgatttttgtctgg

SEQ ID NO: 23658 - DNA, 593 bp, Sorghum bicolor
  Clone ID: 30160951
aatttttctagactcctctcgtttcgttgttccaccatcgcaacgcaacgcaactcacccgcaaagcaaagcaacgcatcctaacccaaccttgtcttttgcccatatttatccatccattcattgtcaaattttcaccctcttgtcggtcgcggcgtttgcaagtttgttcgaaggacacatttttcttcgacttgtctcttttcccacgtctctcttttttcattgccttgtatcttgttgcttcccggttcaccggctgactcggccaggtttttgtgaagtttattatctggtatcatatttcagtcgacaaagttgccccagcagttgttctaattagcgatcttgtctgccgccctcctcccccacgcgaccctcccttaactctactgcgggcatcctctcgccagcaaattctctcaaaatggcagaccaacacgaggtcgatctcgactctataatcgacaggctactcgaggtacgaggcagccgacccggcaagcaagttcagcttctcgaggctgagatccgttatctctgcaccaaggctcgtgagatcttcatctctcagcccatccttctcgaactcg

SEQ ID NO: 23659 - DNA, 655 bp, Sorghum bicolor
  Clone ID: 30160956
atctccctattatacctactacacctacctattaacaaacataacggaatggccccatttctgaatacgcccatggacacaagaaatacccacaccgatagacgataacctcttcgtggaaatggctacttgcagtctcaagtcgctgcggcgaccatcactcaccctcatgtctggagcaagcaagaggtcctttcgtctcaatggcctcatctcaaaagctgccacccgtggtttggctaccgtcaccgctcagacaacacagccagctatgatgatggaagaccacaacactagactgatcaatatgggctacaactacaaccacatcgaacatgtcgaaaacctcgaacagtaccgccttggaggcttccatcccgtatccctaggcgaaaccatcaataaccgctacctggtcctcaacaagctcggccacggtggatactcaactgtatggctctcatgggacatcttgaaacagaagtatgccgcattgaagattgtactagcagatttcggtgaagactcaacagaagtcgatgtccttcagcgcctggaagccaaagctgggaagaaacatcccggaaggtctctcattagacatgtcaccgataactttcacttcgatggtcccaatgggagacacacctgcctg

SEQ ID NO: 23660 - DNA, 637 bp, Sorghum bicolor
  Clone ID: 30160960
gatctccagttattctctctctgccagccctcatcagcccccctcacggcataaccctagccctatctttcggagccggcggcaacgcggcgcacctggcaggccagcggcggcggcgcgacgccgtacgggaggtggaggcgctgtgattgtgacctctaattatacttctgagatggcagctgtggcgccggcggcggggaaggggaagcgaaagcgccaactctctgaggacgacgtctacctcctcctccacaggtacgctccggggacgatcctgacggcgctgcaggaggtggcgcagcacgcggagggccggcgcatcgactggaaggcggtggttgggaagccggccacggggatcacctccgcccgcgagtaccagatgctctggcgccacttcgcctatcaccacgacctagaggatagcgtcgacgccggcgaccagcctctgggcgatgacagtgacctggaattggagcttgaacccaatcccatcccgaccaaggaagctttatctgaggcctctgcattagctaaggcactaatatccggatcttcacgtgagcaagcctctggtcatcgcattaacttggatcctcctgtgctgaacacccaaaatgaaaagatagtacgg

SEQ ID NO: 23661 - DNA, 626 bp, Sorghum bicolor
  Clone ID: 30160967
aaaaaggcaagaaactgattttccgccggaggccggaccagcgtcgaggagaggagcaggcagatttcaattccagtcccccctgccttctcttctccgttcacggctcaccccgcgtgcgcgcgtgctctccctctcgcccggcgatgtctgggcgcccgccgccgccgccgccatacgccatatctccggcccgtcgccaggccttagcgggcgtcgagcacccaacaccagctctgctgggtcctccgcccctggtcgatgtgagcgtaggccgaggagtgtgcctgatgagcacctcctggagagacaagcagcgcccggacctcgtcaatttcatcgccacattcctcgctaccaacctgtaccgcctcaatttcctgtcgctttctccggacttcctcttcaacaatgggggcttgtcggttgctttcatcttcgagacggactggcttcctgaaagggaagctgctgtcttcagcagggtgaatacactgaagaggcagttcaagtatctctacgtcgttgtcgtcgttcgctcagcagagcagaatgaatcattcaatcagtcatatttcaagtatggcatggagcttggctgccctacgttcgtgcctgtttgtgat

SEQ ID NO: 23662 - DNA, 651 bp, Sorghum bicolor
  unsure (1)..(651): unsure at all n locations
  Clone ID: 30160976
cgcatcgcgaaaaaatctttttctcgcctctcctcgctcctcgccatctctctctcttcccctccgcctcacccgccgccccgccgcgaaatctgcgcacggacgccgccggctgcccgcggagtgcctcagattagagcgccccccgtcgagaggtttttaagcaactatgtttgggattggttgatatgatacttgttcacgttgggggatgcaggccccccctctgtgggggttgatcgaagaagttaacagtacacttaggagaacttgtgtcttactgaaagtttcttggtttcgaggcaagtagcattactaagagtaggactttggtggcatagatggatgaactcactggcaacttcaacacggtgttgattacaggctcttgagctaccaagcatgtcagattcaaatgtgaagtggattgatggtctccagttcacatcattgtactggcctccaccccaggatgtggagcagaagcaggcacaaattttggcctatgttgagtactttggccagtttacagctgacagcgagcaattccctgaagatgtagctcagctcattcaaagttcctatccatcanaagaaagtcgcttggtagatgaagtattggcaacttttgttcttcatcatccggagcat

SEQ ID NO: 23663 - DNA, 643 bp, Sorghum bicolor
  Clone ID: 30160991
atcagctgaagcccagaaccagcgcgataaaactttgtggcgatcaaggagcccacagcccagcacagagccaagcctcgatcccgcgcagagagcgagagcttcggcgaggatggttgttggtgaggcggccgccgccgccggcaacgagatgagcctgtccaacatggtgctgggcttctacgaggaggccgagaaggagaggtggccgccggaggacgccaccgctgccgctactaccgccggcgatggcggcagcgacgacgacgatgacgaaggatcaagccccagcggcgggcgcgcccagagcgcggcgttctggcgggagcagcggtcgcgttagtgtctccgtagccgtgacgtgacagatgcgtgcgtacgtgtaggcagcgctggccaagacgagctccgcggagagccggatccaagcggacacggaggaggccgtcaggcagatgcgcgccacgcccggcggcgtctgctcctgcgcgacgccgggtacaacagcgccgtctgcaggtccaagtggtcccgcactcccgaaatcccctcaggggagcacagctacgtggacgtggtggtgccgacgaggaggagcggcaaggcggtgcgcgtggtgatcgagcccagcttccgcgccgag

SEQ ID NO: 23664 - DNA, 629 bp, Sorghum bicolor
  Clone ID: 30160997
tatacccataccccaggactactacttagctctatccctcacatccatacctatctatatatccttacatcatagcaaaaatgggtgtcaccgacagaatcattcagattggaggccagatctcgggcaacccgaccgctggcggtcgcgacaagatcctccagaagaaccctgatgatatcgttgtcaccgctgcctgccgaagcgcattcaccaagggaggccgcggcggtttcaaggatacccccgctgctgatctcatggctggtgtcctcaaggccatcctcgaccgctcaaagatcaaccctgctctcgtcgaggacctatgtgttggaaccgtcctcgcccccggtggcggcgcaactgagatgcgtgctgccagcttggtcgccggtttccctgaatctatcgccgtccgaaccctcaacagacagtgctcttctggtctccaggctaccgtcgatgtcgccaaccagatcaagactggcatgatcgacattggtattggtgctggtgttgagagcatgtccctgaactatggccctggcgctgtctccgagttctcagaagcctttgagagccaccccgaggctgccaactgcaaggtgcccatgggtgtcctctctgag

SEQ ID NO: 23665 - DNA, 663 bp, Sorghum bicolor
  Clone ID: 30161003
tgctacggagatatgttagtggctcaatcactgatgagcaaagaaagaacgtcctccgcaattcatgtccaggggcaggtgcctgtggtggtatgtacacagcaaacactatggcatctgctattgaaacattgggcatgagccttccatacagttcttcgacacctgctgaagatccgctaaagctagaagaatgccatctcgccgggaagtatcttttagagttgctaaagatggatttgaagcctaaggacattatcactgagaagtcattacgaaatgcaatggttatcgttatggcacttggtggttcaactaatgctgttctgcatttgattgccattgctcggtctgtaggtctgcatttgactcttgatgatttccagaaggtcagtgaccaagttcctttccttgcagacctcaagcccagtggcaaatatgtcatggaggatctgcataagattggtgggacacctgcagtcattcattatcttctggagcaaggtcttcttgatggtgattgcatgactgtcactgggaaaactctagccgagaatgccaaaatcttccctcctctgtctgaagggcagcaaataattcgaccacttgacaatcctatcagatcaactgggcatattcaaatactttatggcaatcttgcac

SEQ ID NO: 23666 - DNA, 628 bp, Sorghum bicolor
  Clone ID: 30161007
ccctccccctttcctcccatgcccacaaacctctcttcccactagcatccccgccgctccgatggaagccgcggccgccgcgcccgcgcggggcctcgggcggcacgagtacgcggtgctggcgctcaccttcgcgtcgtacgcgtcgttccacgcctcccgcaagccgccgagcatcgtcaaggccgtgctctccgcggactgggcgcccttcacgggcgcccggggcccgcaccgcctcggcgagctcgacgtcgccttcctctcctcgtacgcgctcgccatgttcgccgcgggccacctcgccgaccgcgccgacctccgccgcctcctcggcgcggccatgctcgcgtctggcgccgcgtgcgccgcgctcggcgccgcctacttcctcgacgtccacgcgctcgccttcttcttggccgcgcaggtcgccagcggcgtcgtccagaccgccggctggccctgcgtcgtcgccgtcgtggggaactggttcggccacgcctccaagcgcggcaccatcatgggggtgtggaactcgcacacctccgtcgggaacatcgccggctcggtcctcgccgcggccgtgctcgagttcggatggggctggtccttcctggttcctgcg

SEQ ID NO: 23667 - DNA, 624 bp, Sorghum bicolor
  Clone ID: 30161017
catgctattagttgcaccttgtcatatctcgcaacgtaactcggcctctattgcgcataccatccacgcgctcctgattccggctttattcgtttgcgcaattcgagccccggccatcactttgacgcgccctcaatcaacactacgggttgagctcaagaccaggagtgacccctctaatcaacctaccgtagcatcatattctccggtcacgactacacaactacacgccttccactctctttcctagatacccggccgtgctgccccacgacctcatcatgggcaaacttatccgtctggagttgtttaacttcaaatcgtacaaagggcatcatgttcttctcttcggagactcatacttcacctctatcattggacccaatggatctggcaagtctaactccatggacgccatatctttcgtcctgggcatcaagtcctcacatctacgctccgcccacctcaaagacctcgtttaccgcggacgagtcctgaaaacggccaagatcaatgatgacggttctgcgcagaccaatggccacgcaaacggtgacgctgatggtaacgataaagcctcccgtggcgaccccaaaacggcatgggtcatggctgtgtacgaag

SEQ ID NO: 23668 - DNA, 661 bp, Sorghum bicolor
  Clone ID: 30161019
attttcgttcttcattatagacaacgcgatatccttttccatagaggtctcgcaaatatgccactcttacaatccaagaacgccaccgggggcgatgctcccaagcagttcaaccagccttcgcgaaaaggaaagaaggcgtggaggaaaaacgttgatgttaccgaggtgcagaagggtcttgaagaattgaacaaggagattatcgccggtggtgttatcaaggaaaagccctctgaagacttgttcactctcgatgttaagggcgatgccgctctccccaaaaagttcaacaagcacatcaagaagggcctcaaggctgacgagatcatcaatgcccgttctcccgtgcccgccgtttctatgcgcaagcgaccgggcgacaagacaaccaatggaatccttcccgtgaaacgccaaaggactgattgggtgtcacacaaggagctcgcgcgactaaagcgagtggccgatggagaacatcagaatactgtccaagtacaagatgccacctacgatatctgggacatgcctgtagagccacaagcgaaggatcctgaaaacttcttggaagaggaggtcaagcccaaggctccaaagacgatgaagaaggagcccctttctctgttggagagtggcaagcaagtgcctgctgtcctca

SEQ ID NO: 23669 - DNA, 655 bp, Sorghum bicolor
  Clone ID: 30161023
actgcagctgctcccccacttcccgttccgcccctccgcgtcgctgctcccgctccgtttcccaccccgccggtcgccgatccggctcacgcccgccccgttgattcgcccctgtacttgcgggtacaatctctctgtccgtagtagaaggttttgtcaaccaattcaatcagaggaacccacatgttaacctgaatttatctgagattctgaagcagttaaggctgacaacaagtttagcctaaaaggttgaaagagagaagttatgtcttttgctaggcgtctggacccatcagcttacacggataatctatacattcacaaatttgccacaccaagctcaacttttgctgctcgaagattctcctctgatacacagttgttccgttatgacccagaaccatacaatgagtatgggcatatgggtttcactggagcaccatccgctgcatttcaaaactccctttgtagtcaacaggcctcactaaaaccataccatgtaactaatgatggacgatctccaagtgttgcagatactcagtctaactcatgctctgatgcagcaaaagattcaccagtggtttccaatgtctctcagcagaactcccagtctgtatcagatagtcagagttctgaaatcgaagtagagttcgat

SEQ ID NO: 23670 - DNA, 657 bp, Sorghum bicolor
  unsure (1)..(657): unsure at all n locations
  Clone ID: 30161027
gtaactctagcaacacgaaaagattcctctctttctctttctcatttcctgcctgtgggacgatttttgagctacccccaagccccctttctatatacttataaaaataataataataagagcttcacacatcactcaaagagaaatggtccaagcacaaccaacaccatcatcttacttacacaacaacaaagaagctgacagagcgaacccgatacccagtttgaggttctctatataatactctcgtcaacaccgctgttcttgtcttcattcttgtctcttctataataagacattccctcgacgctcgaatcttgccaagaccgcatatatagctccaaacggatacgtgctttgacacttgattcaaagcccccattcctcaaacaagccagctttcaaaggctgatctcctcggcccgtataccgtgtctcacttgcttcttcgacaaggaagttagaacgctccatcaaatattcttcccgtggcgccccgtcatctggcatcattccaccggccttgatctgaaccccgggcctgactaccacacgagtctcactggaccctttctaccgggacctatcttacccaatggcttctcaagctcgagtcttcaagttcccccggagtgacgacnaatcctcctttgtcct

SEQ ID NO: 23671 - DNA, 601 bp, Sorghum bicolor
  Clone ID: 30161039
agagagcctggtgcacggcgtgccgatggtggcctggccgttgttcgccgagcagcggcttaacgcggtgatgctggcggagggggtaggagcggcgatacggttgccggagaggaaggataaggagaccatcgcagcggtggtgagggagctgatggcaggggaagggaaaggtgccatggtgcgggtgaaggtggcggagctgcagaaggctgcggcagagggactccgtgacggtggcgccgccacggcggcgcttgacgaggtggtggagaagtgggaagctgatgaagcgaactagcagaaggtgcccgatcgagaacacctagcattgcaattgcaatgctctgcccagcagagtatgtctgcagttttaagacaaaatctcttgagttgtatgttcttgaattgaatctcccgtagttttatgtatgcaaggattaagtttacagagaggaccagtggttcgtttctttgtttgatcttcatttgtgtggtcatgtaaataatcattggagggacctagatcagatgcagcagcagtgtagcacctgatccgaccatccagcaaaggattcaacgtccgtgaccattcggacat

SEQ ID NO: 23672 - DNA, 637 bp, Sorghum bicolor
  Clone ID: 30161058
ctcaagaccacgacggtggatagggacgacaccgccgagctgacggacgacgtgctcggcgaggggttcctggagcgcgtgcaggggcgaggcctggtgaccaaggcgtgggtggaccaggaggccgtgctgaagcacgcgtccgtggggctgttcctgagccacagcgggtggaactcggtgacggaggcggccgccgccggcgtgccgctgctggcgtggccacgcggcggcgaccaccgcgtgaacgccacggtggtggtgagcggcggcgttggagtgtggatggagcagtggagctgggacggggaggactggctggtgaccggggaggagatcggcaagaaagtaaaggaggtcatgttcgacgcagccgtcagggcaagggcgacgaggaccggccaggaagcggccaaggccgtcgcagagggtggcaccagctaccggagcacgcagaagttcatttccagcctcaaggcaacctaagcgcacggccggctgcccttgattctgccttacctggtgcttgtgtgatgcccgttttattctttccacaaatttgtgtgtcgatctcctacgtaataaggccttgtttagttcccaaaaaattttacaaaatttcagattctccggaaaa

SEQ ID NO: 23673 - DNA, 553 bp, Sorghum bicolor
  Clone ID: 30161064
cgggaagaccctctgtgcccgagctgttgccaaccgaacagacgccacctttatccgagttattggtagtgagcttattacgcagcttgatggtttcgatgctcgtggaaacatcaaggttatgtttgccaccaacaggccctctacattggaccctgcgctcatgcgacccggccgtatcgatcgaaagatcgagttctccctgcccgaccttgagggccgcgctaacattttgcgcatccacgctaaatccatgtcggttgagcgggacatccgatgggagctcatctctcgtctctgccccaacgcaacgggtgctgagctgcgtagtgtttgcaccgaggccggcatgtatgccattcgcgcaaggagaaaggttgcatccgagaaggatttcctcagtgcagttgacaaagtcatcaagggtaacctcaagttcaactcgacggcgacgtatatgcagtacaactagacatactcgccataaggcaaggtgtattttaatgcggtgtatgaatacagggcaattggatggcgggaacatagacgtcac

SEQ ID NO: 23674 - DNA, 201 bp, Sorghum bicolor
  Clone ID: 30161067
gcttgtttttttttttgttttaaccaattcattgccccggtgttgagggttggtttgttactactgtaccccttgcgtttggggtgggttaggttacaactggggtggaacgtaaaaaaaagtccacccagaagagggatggctttcaaaaattttaacgagattcccaatgttaatatgactgtcccttttttttcggtg

SEQ ID NO: 23675 - DNA, 646 bp, Sorghum bicolor
  Clone ID: 30161076
caaaactagattcaagtatatggatgtcacaaagaatgcttatggtttgactgatgaagatatcttgtatgctgatgataaggcattgaaccaattcgtgtcattgaagaagattcaaccatacagagccgatgaaggccaagttaacatgcaaaccttgagaaagaagaagcacgaagtcaagaaaactgccgaaagaaacaagaaaggagttgacaaagatctggctaaatttgaaaagaaggaagaagaaatgaagaaggccggagctaccaaggaagaaatcgaagaattcagaaagcaacagaatgctttgagtgctaagcattccaatagaggatctagaaggggggtcaagcttatcaaagaagaagacgtcgttgatgatgatgaagaagttgttgatgaagacaatgctgatgctgaagccttcgaacccaagaagaataagaagatgaagatcgacagctcaagattaaaatcttacggtctcgcataaaattgttaggtggaaggatgtgtatgttttttttaaataaaatgatgaaatgtatgtagtatataaatatctctatttattcaattcaaaaaagtcccagtcccagtcccagtatcagtatatatggatctctcatcatataaacct

SEQ ID NO: 23676 - DNA, 328 bp, Sorghum bicolor
  Clone ID: 30161079
actccatcaacaccaccttcgaggaccccaccgtccccgtcgagatcaaggacgaccagaacaacctccccctttccgtcatcagcattgaccaccttccctcaatgcttccccgcgaggctagtgaggcctttagtgagggtctcaaggagtctctgcttacactcaaggatcgcaaaacttcgcgggtgtgggctgatgctgagaagctcttccatgagaaggttgctacgttgccggaggagttgagaaccaagaacgtttaaaggtgctatttatgctgtagttaagctgactacatagaccaaaatagaaggctgtacgagcg

SEQ ID NO: 23677 - DNA, 611 bp, Sorghum bicolor
  Clone ID: 30161087
gcacgctggcccgacgcgcgctgcggctggacgcggcggggccctacggctactacgccgacgtggcgtccctgccgctgtacggctccggcctgtacccgatcggcatccaggcgcacgcgtcgacggcagcgcacccggatcagcagcggcgcgaggacgccggcgccggcgctggcgccgagctgaggaggcccgcgcgggggctgctgagccccatgccgttcctcgtggccgacgaggagatgagcttcggctggcccggtagcttcagaccagccatccccgctgctgctgctgctgcgccggcggggagcgcagccctgaactcggccggcggcgtcgccatgcatgcccgggaggagcccgatctgacgctcaggctatgaagtgtgtgaactgatccgtcgactagactggttattaatccgtcaggctgtttctttcttattcgtcgcccttctttctctctctttgaactgatcggcccatgtctgacggacgacgctgatcagaccgtggcgggtctcttgcttggccagattcttcttgcttcctattgtttcgtgcgtgcaagaattttgtacagcagttggatgtgcaagagctcg

SEQ ID NO: 23678 - DNA, 601 bp, Sorghum bicolor
  Clone ID: 30161090
cagaggtttggacgtgcctgatatcaagttcgtcatcaactacgatttccccggacaacttgaagattacatccatcgtgtcggaagaaccggcagagctggcagagaaggtgtttcttacactttcttcaccagagaagactggaagcacgcctataaattgatcgacatcctcgaagagacccgtcaaaaggctcctgaagatctctatagaatagccagaagacccgtcccaagacccggctatgtcccccaacccagaaaatacgagcctgaagtcattgttaaacccacccacactcgtcttgacgcttaagtcgtactaagtgcagggtagtactggctgaattcaaagacataatacatgcttttcattttttaatttgtttgtcaattaaaaaaccaaaaagagttaaatcatttatctatctatctctctatctatgcttttttatatattatgcttttttgaacaaaaaaggaacattgtttgtgtacgtatagtccaaacctttatttgattcatattatgtattattgggaaagcctctttgaccaaataataacatgaaatcatgaaatcgtgaaatcgtgaaatcgg

SEQ ID NO: 23679 - DNA, 532 bp, Sorghum bicolor
  Clone ID: 30161095
ggttctttcagccagaccctcaacaacattgagcagggtgagaactacgttttcacctacgcttacttcgttgccaacggtgaggaggttcctttcccctccgacaatgtctgcagtgtcaaggtcagccttggcgaggatgagattgagactttcaaccccttcgcggagtctcagggcagcgacaacttccgcaaccgccagttcagcatcgttgctcctgaaagctctgccgagctcaagttcgagctcacttgcgaccagggtactcctgacttcactctcatggttgatgacatttggctggttcgctgcgatgactaagcgttgaaaacacatcatgaagcattggaatgatatggggacggggctatgaggcctgcttaaacaacttcttgtacctaattaatactttttatgatccccaataatggttggggatttaaaccgagctagggttacgtgaacatactattctaggagctcttgcattagcattacttctgaaatatatttattatgttgatcaccg

SEQ ID NO: 23680 - DNA, 577 bp, Sorghum bicolor
  Clone ID: 30161100
gctgcgacaatggctgttcaagctggtttgatttatcaggtagagaacaacacagcatcatcacatgcggcaggaattgcagctgcagcaatgctctttatctttcagggagccttcaccatcggtttccaagcaaccgtttgggtgtatccctctgagatcctacctcttcgcctccgacagcgcggttcatccatctctactgctgccaactggatcttcaactacatgatcgtacaaatcactcccatctcaatcaacaatatcggctggcgaacatatatcatcttcgctgtactgaacaccctctgggttcccctcatcttcttattcttccctgagaccaagggcttggagttggaagacgttgaccaactttttggtggcgaagaaatcattaggaacttggatgagaagaaccatggaaccgtgaccatgctggagtctgtgaatggggatggtactggcgtctagttgagtcgttgccagggggatgaccagggtatttaaccttatattgtttatttagtatgtactgagtctatggatagcgtcaccttggggaaaagaatatttc

SEQ ID NO: 23681 - DNA, 694 bp, Sorghum bicolor
  Clone ID: 30161102
atgatgacaacgatgatgccaatcgcagttctgatgccaatactgtaggttcaggtttgaatcctggaacctcagatgtgaagaaagccgataatggaagcgtggactcagactatgtctatgatccatcttcaggttactactatagcagcagcacaggctattactatgaccctaactctggatattatggttatgcatctatgggaacctggtattcatacgatgagcaaactggaacatacaaagaaattcaggatgaacaaaccagcacggccaaagaagagctgggagatgccatcaaggagtaaccaagttgctactactcttcttgttcttgattgccaatggaactgagcagcgtgtggattggtaaactgaatcgggcagctcgtgatcgatggagtagtcaaaggccggggaggcagtcaggttcggaggttggagacgcatcatcatcatggtcattcaatctggaaaatctaatacagtactctttccgaaaaggttggaacaaaaaaaggtatctctttcagaaacctctttagatggacaacgccttctgggaacacggttagggcttgtttcgacgcgaaaaatttttcatgtaaaattaaatgatgcctgtaaatttcatgaaatgtttttgtgaaatttctgtgtactaaataagcctatgaatattttttacgct

SEQ ID NO: 23682 - DNA, 575 bp, Sorghum bicolor
  Clone ID: 30161115
accacttgtgagatgagatgagatgagatgagatgtgatgagatgagcagcacggcatcactgtcctacatccatcccctaccagtaatttaccaaacctctgctgctttccataatcaaacaccacagtgccagtggggggtgccactttaactgaaacaccaccccacaccacttcaccccctctccctcttcctcactttgccccccttctctctccccgcactagtctctctctctctccctctccccccttcggtgagcacaaggggcaattggtaaggagtttccatagccatggcctgagcagagactgctggttccttggcatcgtcgtcttcttcaggcctgactctgatggattgaagcggtgcacggaattctgcttctgggtggtagaggtgagacagagaaaccaagtgacgggtgaaaagattgtcgccatcagtcagagatgaagagcaaggagatgtgccaagaaccgtgcgacgagctgtccgagatcagcagccaggaggcgtccaactcctccggcctgatcagcctcgacctctcactcaccgtccccgtcgccg

SEQ ID NO: 23683 - DNA, 671 bp, Sorghum bicolor
  Clone ID: 30161118
ataaattaattaaaaaatttgttagattcagagtcacagttgaaaatttaaaaatgtatcccaaactcgatagtggaaaccctgcccctcctcctttccgttcctacaaccatagcgacaacagagacagaaacgactcttacagatctagagatgactcttatagatctagagacagagatggtggtagagatagcagaagctcttactacaaccacagcagaagcagctatggaaacagcgataaggagaaacaacgtgattctgatcgtgaccgcagtttcaactcaagaccaagctctaacttctcttctggtggctacaactctggcttcaactctggttccaacttccaaaacaatggaagagacaagaacgtgattgccggtgcctcccttcccaaaatcgactggagccaaatggaattgagtcctttccaaaagaacttttacactgagcttgattccgtcaagaacaagcctcaaaaagaaattgatgatttccgtaatgaacaccaaatcatcatcagaagtacttttgcccccagacccattttcagcttcgaagaagccaatttccctccctacatccttgaacagctcaccagcaagttcaagactcccagtcccatccaaagtcaaggctggcccgccgccatgagtggtcttgac

SEQ ID NO: 23684 - DNA, 676 bp, Sorghum bicolor
  Clone ID: 30161123
aaccgcccaactcggtcagtcattcgcttagtttccatccttttggctcagccattatcacgctcactatgcgctctttcatcacctttgcggctctcgccctttccgcttcggatctggtttctgccggtccctgtaagcctcgtcctaccaccactgctgccgctgagacttctgccactggcatcgagacctccgctactgctggtgtcgacaccactgctaccgtcggcactgagaccactgatgttgcttctcagcctaccctctcccctgaggatggccctgtcaccaacgcctgcactggtggtggcatgaccagccttgaccctttcgtcgtccagggtgatgtctctatcaatggagatgatggttacaccggcgatgacagccctgatacttcttgtgctgacttgaaggctgagtctactggtcccactcgcaagcgtgctgctggcacggttgctgctatcggacagcctctcaccggtctcgacaccaagaagaagtacactgtccagttctactaccgtgtctccactcccccctccgaaaacaccgcctgtaccatcgaggcttccatcggcgacgtcagcttctacagcgctggaatccttgccaacggtgctaccgtcagctacaaccacgttctcgtttccacctctgtcaacgctgc

SEQ ID NO: 23685 - DNA, 619 bp, Sorghum bicolor
  Clone ID: 30161124
atccgactcgcgctcagcggcgctcagggcagatcttctgctccttccccactcgcgctcagcgctcaggctcggctcggcggctccccttccgcttctcgccagtcgcctcgcgccctcgtctccgtcctccgcgcaccggccggcgaccctgcgtacgcacctccctctcccctcccgcctctgctgtaccgtgggagcccggccagctgcctagggttgccgggccttggctccgccggtgccgtaggaaggcaagaaacgttgtgctcatgccacgctacgaggttcagtcatgagtgggcttttcatgagcttccctaagtgatgcttcatatgttttctaacaagtaacatctccccgatgttatccatgcactggatatatccttagaagtcagagatgcagaagtctgatcatcatgagcagaagctaacttcgccaagagggttaatccataagatacttcgtcgtacaaatagcaggcgttctcccactgcagctgatcaacaaccttctcctgtatctccagagacaagcaactcatcaatattctcaaagcaaaaggatgctgatgatgccatcaaagattcagaaaagccgagcacacatactatc

SEQ ID NO: 23686 - DNA, 659 bp, Sorghum bicolor
  Clone ID: 30161127
aaaaaaaaatccaactcctccaagattcaagattggtctcataatcacaatattactttttgttattgaacttcgcctatcaacatggagttgcaaggtcgaagactcatcctgactgtcagtgtcttgacgtcgttgggctttatgctcatcggttatgacaatggcctcatgggaggtcttgtcaacacttcagcttttaaggatactttcgatagtcctgatgctgatatgattggtgtcatcgttgcaatttttgaaatcggatgcttctttggtgccatcttcgcagctatttggggagagaagctcggccgtcgacgttctatccttatcggctgcattgtcttgatcatcggagctgttctccaagcagcctctttctctcgagccatgatgatcgtcggccgaatagtttcgggccttggacttggtaccgtcaactcaaccgttcctgtcatgcaggccgagttcagccccaagtctagcagaggaatctacgtctgcgcccagctctcaacactcaacttcggtatcttcctcgtctactggatcgactatgctctgtcttctcatactggaagctatgcttggcgcgtccctgtcattctccaatgcgttcccatcattatcatcatatgcctcttgaccatcatccc

SEQ ID NO: 23687 - DNA, 657 bp, Sorghum bicolor
  unsure (1)..(657): unsure at all n locations
  Clone ID: 30161129
aaacggtaaagccccaaacacatacagtagctccgctcggttcgtctcgtctcgtctccttccgcagctcaaggagggcgacgacgccaagggaggtgccgctgacctcaagggcttcgaagtccgctacaacgatggtgttaactttgttgatgatggtatccggatagagccgtttaacttggagcgagaaagggaagaagggtattttgatgagaatgggaactttgtggagtatgcaagaggcaatgagattaaggatgcctggttggatagcgtggaagttgacccaacgtatgctgcaaaggttcagaagaaaggcaaagagaaagtagaggagtttgaggacctctcttctgatgacattgggaggctaaaaaggcagatagctaacttgcttgaaccaggagaaacgataatgcaagctttgaaaaggttgaagggtacatccaaggataaacgtggaaagatggctgaggggactaaacgtatatttgatgaattgactgaagctgccatgaagctaatggagaacggcgactatnatgtttactcggatgatcgtgagacctttgaccgtgaggcagctgggtatgaacgtttggcacgtgctcgacttggttcgccagaagttgatggtgtctctgaagaccaaag

SEQ ID NO: 23688 - DNA, 598 bp, Sorghum bicolor
  Clone ID: 30161164
ctggtcctagttcaccacgacaccaccgcaccccaaccaagcgttctgccatggcaccgccggcgacgaagagcctgggagagctcgacggcggcgcacgcccgcatgtcatgttcatcccaagcgccggcatgggccacctcctcccgttcttccgcgtcatcgcggcgctcgcggcgcacgacgtcgtcgacatctccgtggtgaccgttctcccgaccgtctctgccgccgaggccgaccacttcgccagcctcttcgctgccctcccccgcgtcagccgcgtcgacttccacctcctgccgttcgacgcgtcgtcggagttcccaggccacgacccgttcttgctccgatgggaggccctgcgccgctcggcgcacctcttccgcccgctcatcgccggcgccgccggcccgcgcgtctccgccgtcgtgacagacgtcaccctgacctcccacgtcatcccgatcgccaaggagctcggtgtccagtgccacgtcctcttcgtctcctgcgccaccatgctctcgctcgctgcgtacacccctgtacacctcgacaagaagaacaagggcgagcacgggcctggcgtcggcgt

SEQ ID NO: 23689 - DNA, 682 bp, Sorghum bicolor
  Clone ID: 30161172
ctgttggcctctggacgaccacaccagcacaattcgactctctttgatcatagtttatccaccagtgccttcgtaaatacagagctctcatataaaaccctcgaaacactattataagattggagagccgcggtcctcatcatgccttccgcaaccggctccaactgggagaagtaccagaagaactttgccgatgatgaggtagaagagaagaagatcacacctctaacagacgaggatattcaggttctcaagacgtacggtgccgcgccttatggtacatctatcaagaggctcgagaagcagatcaaggagaagcaacaaagtgtcgatgagaagatcggcgtcaaggaatccgacacaggactcgcgcccccccatctatgggatgtcgccgccgaccgtcagcgaatgtctgaagagcaacctttccaggtggcacgttgcacgaaaatcatagctgacgagaagggcgacgaggccaagagcaaatatgtgatcaacgtcaagcaaatcgcaaaattcgttgtccagcttggagagcgcgtcagtcctaccgacatcgaagaaggcatgcgcgtgggtgtcgacaggaacaagtaccaaattatgcttcccctaccgcccaaaatcgatgcgagcgttacaatgatgacggtggaggagaagcccgatgtcacct

SEQ ID NO: 23690 - DNA, 681 bp, Sorghum bicolor
  Clone ID: 30161176
agggcccatttccatccaattcccagatcaaggccaatccaatcctaagcaagacccatccatagcctgcctgacccaggccagcagcgtcattccctcttgaggctcttgtgtcttcttcctcccttttcttcttctacaccaagctcccctgtgacttctttctctcaacagggtacggataccttagcttcgtctactcatcggtcccgacacttatacctatctcgctacggaccgatacaaggccgcgatttcaacaacgcgcaacaacaaccccctcgttgatcttttacccgtcttcatcaacccgcaaacgttctctcgcctcccatttatttatttcgtcgaatatggaagcaaatctctagtcgaactcccgccaaagctgtttccgtctccacccatctaaacgtttccgataacgttaccgtcgctatgccgtctcaaaagacctccaatggccccggccaggtgagccatcgcctgcgcaatttcttccgcatgaacactggaggtagcaccggcagtgcttctagcgataaggagaaggagaaggagaaggaaaagggttcggccgctaccactcccgatccctcgaaatcccgtcataccaagttcttcagtaataccgtcggccgtctgcgcgcgcacaccgtcgctagcgagggtaaccagctg

SEQ ID NO: 23691 - DNA, 676 bp, Sorghum bicolor
  Clone ID: 30161184
agcaatagataagattttaatttttattgacaaaagatattgtgggaagaagacaagacacagaagatcgacaaatttaacatcaaccaaaagttcgccaagaagtttgatcaaagaaaaaagagagaagaacttgaaaaggccaaagttaaatatggcagagacttgaatcaaatgttggatgatgaatccggctcttcttcctccagcgcccctgaagatgaagttggtgacctcgtaactggtaacatcggcagcaagtttatcaaaacattggctaagctccgcacaaaggatcccgaaatttaccaacaaaacaaattcttcttcgatgagaaggattttgatgaagtccccgtgaaggacaagaaagccaaggaaaatcccatctattataaggatttggtgagacaagccgtgaccgaagataagaaaaagaagaagactcccagagaagttcacgaggaagagcaagaagacttgaagaaagctttcaagatggctgctaacggaggagaaggggatgatgatcttttgaaagttagaaagaagaccaagaagcaaattgaagatgaaaataccgaatttaacaagttcttggaacaagaaaatgagaagagtaagccagaagaagtcgatatgctccaaagattctggggtgatgaaagtcaacttg

SEQ ID NO: 23692 - DNA, 671 bp, Sorghum bicolor
  unsure (1)..(671): unsure at all n locations
  Clone ID: 30161187
aaaaaaaaaaaaaaaaatgcccgtcaattggatcctcactgagccttttcacccgctacactcttctccgctcaacttttccaattcgatcgccaccagctaattattttcgaaacttctgaatttacagcctcagaaccgtcacaatcatgtctgaatatcctcacatccttcttcgcgccgaggagaagcctctcgagcaccgatctttctcccccgcggttatcaagacactcgtcgatgctggataccccatctccgtcgagcggtcatccaccgatcccaaatttaggcgtatctttgaggactctgaatatgaagctgctggtgctcgtcttgtcgacacgggtgtctggcccaacgctgagcctgggacaatcatactcggattgaaggagattcccgaggaggatttccctctgaagaatgatcacatcacatttgcacactgctacaaaaaccagggaggctgggagaaggttctcggtcgttggtctcgcggcgggtctactctgtatgacttggagtttttgcatgacgctnaaggccgacgtgtttctgcgtttggtttccacgcaggcttcgccggggctgcgcttggaataaagacactttcccaccagctgcaggacccgtcatctaagcttccgtctgtcgagacattcaccgat

SEQ ID NO: 23693 - DNA, 584 bp, Sorghum bicolor
  Clone ID: 30161213
aggttacattgccgactacctgaaccgcgaagaggtcaaggaggctcttggtgttgaggtcagcagctacgacagctgcaacatggacatcaaccgaaacttcctctttgctggcgactggatgcagccttaccaccagctcgtccccaacgttcttgacaagatccccgttctcatctatgctggcgatgccgactttatctgcaactggttgggtaaccaggcatggaccgacaagctccagtggtctggccagaaggatttcagccacgccaagatcaagaacctcgagcatgacggcaaggagtacggcaaggtcaagtctagcggtaactttactttcatgcagatctatggtgctggccacatggtgcccatggaccagcccgaggcttcctctgatttcttcaaccgctggctaagcggagagtggttctaagctggatcactcgtgtatgaggtgcttgaatgtacactaaataagagattgccaagactgacttttgaatacgcgaacaaggacggcattgcatgattatgggaatggttattagcttcagacagatacgaatttaccacgtttc

SEQ ID NO: 23694 - DNA, 530 bp, Sorghum bicolor
  Clone ID: 30161229
accacctgcaggtgggaggtggaggggtcgagcgacgacgtgacctacagcccgttcccggtgccgaagcgcggcctccaggcgaggctcaccagggccgccaccgccgccgctgcctgagcgcgcgacggcggccgctgcactgcatgcatgttggaggatctgctctcctgatggccggccctatcatcggaccaatgcaatgcaagcaacgcatccagcagcacacccaggccaggagatagaatagatcccggcagggggtcaatgcaaggcatcgtccagtcatgtggcggcagctagctactgtactacaccacaccttctgcatctgcatgcgcgcgtttccatttccttgtcgtcgtgtcgggtgccgccggtggactaatgttcgccggcggcggccctggtggcatgtgttctgccttctcggtcccctgcatgatcgcttatacaaatatataatatagctggtcaatcattggggtagacactgtaccacctgtccagtttaatatatgctctcgtcc

SEQ ID NO: 23695 - DNA, 617 bp, Sorghum bicolor
  Clone ID: 30161236
cgagaagaagaggaagaaggtggtcaggaagaagctgccgcaggatgtcatcgactcaattgtagcaaagccgtgtaagattgtgtatgagctctccgatgaagaccttgccgacaaatcccagcaattccgcgaagcctataggagagcaatgttagtccatgagaaggtccgcagctacgagcaggccctcatggagcagtacagagccacgggctccgtggaggatgaaattgaggtcaccgatgatgaggacgaggggacgggagaaaatgtcactggtgatgaggagacgtcagcgaacaaggtcacgggctctgtggaggatgaaattgaggtcaccgatgacgaggacgagaggacgggagaaaatgttactggtgatgaggagacatcacacatcagtgaacaaggtcaccggtgactaggaggagacggtggagaataagcccagaagttgccagaagttgcccgtggttatccaagatccagctaggttttgagtactattttgtctgtgatccagctaccctaagttatagtattgagtttgtgttatccagataccctaagttggagcagtatcatgtctgtgtgatcctattaagtgctcatta

SEQ ID NO: 23696 - DNA, 252 bp, Sorghum bicolor
  Clone ID: 30161250
cgtccattgcctgcaccttcctgacgtataactcgcttttctgatggagcttcatgatgtatttgtgtcatcatgattcgttccatattggcgcaaatcaaggcagctgggacgccattgccattgcccgaaggggctgttgtattattgttattattatatgtgcgtcgattcgattgctgtaaagtgataaattgattgcagctagccagctactgaaccgggccttgccctgcaaaattttgatcgctt

SEQ ID NO: 23697 - DNA, 682 bp, Sorghum bicolor
  Clone ID: 30161261
ttgaaggacaatcttgttgagaaggaagataatggaaacaatctagatgaagcacaagacaacaatgcaagtggatcagtcaatcctcctcaacctgatgagaaagaagttcatggaaacaatttagttgaagcacaagacaacagtgcaaatggatcagtcaattctcaatctgatgatgaatggccatttgaagtcgtcgataatgaaattgtgctcacagcccaaacaacgaccagtgctgaagttcgtcaggcatcaccaagtatgaagtgtgaaacgactgccatggcagaagcacccacagcacccgtgccaccttatgataccagcagtcccattaatccacgctcagaaaaccgtgtgtccccaactgggaggatattagaagcatggggtgaactgatgatctcatgctgctctgggctatgtcccccataagcagtcagggctcctgcttgctgaccgtaatcagctttggcatggtagtgaaatatacaatatagaggagctttgttatggtggttggaaagtactcaacctggttcgcaatatgtttgggcccattacctgcttagttaatagcttaatgtaggttataattcataatatcattgtacatatatgtctatgaatggtacctttcaagaacggagcttattgaggacagattaattatagg

SEQ ID NO: 23698 - DNA, 600 bp, Sorghum bicolor
  Clone ID: 30161274
ctccatccctgccgacggcctccccttccccttcccctgccactcgcatccgcctccggctctggcccagcgcgcccgcccgcggctctccgctctgatcctcctagattatagcatttaaaaatcaagatggttaacttcgggaagaaattgatggcagatcaaattccagaatggaaaggatattatatcaattacaagttgatgaagaagaaagttaaacagtatggtcagcagctccagcagggtgagaaagatcgtcgtcgggatctgaaggatttctcgaagatgcttgatgatcagactttagcttctctctggatatttaacttgctgattgtagcatcgacatgatagagaagattgtcctgtttctgttggaacaacaaggaatgttggcaagcaggattgagaagttaggaaagcaaagggcaatactacaagagcagccagatatatctggcattgctgagttacgagaagcttatagggaagtcggtatcgacctcatcaaacttctcaagtttgttgatcttaatgcaactggcattcggaaaattttgaagaagtttgataagcgtttcggctatagatttactg

SEQ ID NO: 23699 - DNA, 642 bp, Sorghum bicolor
  Clone ID: 30161278
tctcctccttttgttcttgtctggattaatctttgtttacctgattacctctcccgccctgtgtcccgtcgttgtatgcatgtgtgcaggaaaagcaaaggagagagcagctagcgggccgcggtcggtgtcaagttctccgttctcggggggccgtatagatgacgcttggcgccgcggccgacgacatggaggccgccggcggtgagcgcatcagcgggaggcgcgcgcggttcacggaggactggtgctgctgcgcctgcgcggggctcttcctgggtcccaacccgatgatggcgcgctacatgtacgcgctcatcttcctcgtcaccaacctcctcgcctggaccctccgcgactacggcgactccgcgctcgccgagctccagcggctgaaggtgtgccagggcgcgcgctactgcctgggcgcggagggcgtgctgcgggtcagcctcggctgcttcctcttcttcttcgtcatgttcctgtccaccgtgaacacgcggaaggtgcacgagtgccgcaactcgtggcactccgagtggtggccggtcaagctcgtcctctggctcggcctcaccgtcgtcaccttcctcgcgccgtcgccgctcgtccagctctacgggaaagtggcgcatttcg

SEQ ID NO: 23700 - DNA, 644 bp, Sorghum bicolor
  Clone ID: 30161281
agcaaccacggttggcttcacatcttacaccagctccgcagttctcgttctcgattcgagaacaaagagatcgcaaccgacctcgacttttcccctctttattccctagacgagtcaatttcgacaatcctcgcttcaatttcaactctgatttccattagcggttcacgaggagctcgtcatcatggtcgcgccagcggtccctgaaatcaccgaggagatcctccatgagtcgatcgatgcacgaaccgaatccctctctggcctcagagaacttggtcctcccgatctcgttcatctactcaagcatgctgtgcgaaacccagctaaacagacgggcgtctaccaccatgttaccggcgtcgatgcatcctcttctgcgagtctagcagcatatatcaataccctaacctacaaagaatctgggccaaatgcgacaaacaagattgttgagggtgtctactgctgctacaatgccttctcccgactcgacatgcgcgtgcacgtatcgatccccggaaccgtagaaagctactgcgttgacgaacgaggcgagaagaggaaagcatcggaggagctttggctggagacttatctatgcagtgtccttcgagcttactcgtatgcagacgatggtagcggcg

SEQ ID NO: 23701 - DNA, 666 bp, Sorghum bicolor
  Clone ID: 30161286
ttcagggggagagagcaaagcccacggcgacgcggcgatgagcagcaccaccgccggcacctacccggcggagagcgtcagctcctgccaccctcccacgccacctcctcccccttatccggcgtcggcgtcggccatccacggcggcgccccactgaggcggcggttcgacttcgccgacgccagctccggcggcgaccctgaggaggaggaggaagaggaggaggaggaggaggaggacgacgacgacttcatccgcgtagtggaatacattgagcgggcccagccgtgcgtctgcgggcgcggccgctgcgccgtggagcgggacgagcagcgcggccggtgggtgtacgtctgcccgtcgcagccgaagtgcaactatgtttccgtgtgtgaagaagtaggtcttgatcctcgatcacaacctgctgttaggagccatcctagtccaagcaataattgcgtgatcagcatctcaagcaatcatgtagctgaacctcgaacaccaattaataatgttaatctccgaggtgctggtgccacgactccaaatattatcagcccccaggctactatttatattcctaaaactccacttaattccaccttccaaagtgctggtacttcaactccacttcatgttagtccaaaaggtccaagtgctac

SEQ ID NO: 23702 - DNA, 670 bp, Sorghum bicolor
  Clone ID: 30161306
gaacacagccatgcattcatcaggtggatgccgctttggtggttgttcgtgtaatcgtgtgcgtgtggcacatgcatgcactgtcatgtccaccgtatcatgactatcctaaactaatcctcatcctgatccaatccaaaaacctgcttgcggtggctagtagctagctagctagctctacaaatactgtacccggccgtgcttattagccagcagtacaagctagcagttacggtcatcaaggagttcttcacatatcactcggcattaccattatctgaggtaccttgaccgccgccgccgacgacgatgagctcctcggcggaagcggagcgcggcggcgccaagaagcagtcatggccagaggtggtcggactgagcgtggaggaggccaagaaggttatcctcaaagataagcccgatgcagacattttcgtgctgcccgtcggatcgccggtgaccagggatttccgtcccaaccgtgtccgcctcttcgtcgacaccgtcgccgagacgccccgtgtcggctagccgatgctttcgtgctcttcagaaactgaataattcagaacgtcttgcagatcgatctccatatatatggcaagatgatcaaataatgcatcttttctgtatggatccaaacgtgggtttcctataataattaattaaa

SEQ ID NO: 23703 - DNA, 633 bp, Sorghum bicolor
  Clone ID: 30161315
aacccccgaaagtgaaaaacttgaagcaggtaaggttagcctagctagccatgatgaactacgtcatcttgggcgtcctgctcttcgtccttggcgccgtctgcggcctcaggccatctccggcagctgccgacgtattctgcgacaaccttaaacaagtggccgccactctcccccaaaacacctcctcctcccctgtacagttcgccacctccatcgtcggccaagcccccgacgtcgtctacgctctcgccttctgccaaggcgactacaacgccaccgcctgcggcgaatgcgtcgccaaggcgttcaatacaaccccgccgccggaccagcagtgctgggggggcttcttcctctacaacgcgtgcccggtcttctactccggcgacgacatcatccacccttccaacgcaacacaagcttacgacgatccttttgtgaggtggaacatcaagaacgtcaccggagacgacgccgacgacgtccgcctcgtcacgggcctcatccacgagctggtggtggataccgtggaaagggcggccagcacggcgcccaggcggttcgccacgggcgtcatggacagtggcacgaccttcccgacggtgtactccatggcgcagtgcacgccgg

SEQ ID NO: 23704 - DNA, 674 bp, Sorghum bicolor
  unsure (1)..(674): unsure at all n locations
  Clone ID: 30161322
ttcaatgctacaattctgaatgggatgggggtgattggttatgtaaaggatcagcctttatggcaaccttctgaggatattggcaatcttcttagtgttcacttcacctactcagatgtcatctggccctggacgggatatcttgctctacatttgcaagttaaagatgagggttctcagttttcaggcataattagtggcaacgttactctgactatttataccccagcagctcatggagaaagcagcccacggagtagtacatgtgttcttcacttgaagatcaaggtagttccaacacctgttaggtcaaaaaggatattgtgggaccaatatcataatattaagtatccctcgggatatgttccaagggattcccttaatgttcataatgatatccttgactggcatggtgaccacttgcacacgaactttcacattctgttcaacatgttaagagatgcagggtactatattgagacacttggatcaccacttacttgctttgatgctagcaattatgggacattgcttatggttgatcttgaggatgaatactttgatgaagagattcagaaacttagggatgatgttatacacaagggacttggtattgctgtttttgctgagtggtaccatgttgatacnatggttaagatgacattctttgatga

SEQ ID NO: 23705 - DNA, 681 bp, Sorghum bicolor
  Clone ID: 30161324
aacactcacttttcttgtccaacaactgctccgtattctgtagtctcgtcatcgccatcttcaacaaaagcagtcactgaagcctgttcaaacagcagaaaatgcgtttgtcaacctccgcgctcgtgctgggcgctgcctcttcggccgtcggcctgcaagagcagcaggttctcagcggcgactccaagcctctcgtcgatatcaacgtcaacgcctggaccaagccactcgagaagttctttggcgagatctcatcggaggccaaggctgtttgggacgaagtcactcttcttgcccccgacgctgtcgaggctttcaagaagcaggtcctgacccagcctaagaaggccaaccgtcgacccgatgcccactgggatcacatcgtcaagggtgctgatgtccagtccctttgggtcgagaaggatggcgagaagcatcgcgaggttggcggaaagctcgacaacttcaacctccgcgccaagaaggtcgatccttcaaagctcggtgttgacaaggtcaagcagtacagtggttatcttgacaatgaggaggaggacaagcatctcttctactggttcttcgagtcccgtaacgaccccaagaacgaccctgtcgtcctctggcttaacggtggccctggctgctcttcattgactggtctcttccttgagcttggac

SEQ ID NO: 23706 - DNA, 658 bp, Sorghum bicolor
  Clone ID: 30161331
gatttggaaagagttgtatcctgaggagcccttcaaattggagttcacaaaaacctctgacgttgtgatggatgtgaaccctggagttgcagaggacattacctatgatctggtctctgctgttaagagacaatcctctttctattatcaggttggaacacctacaatgcatgattcacggtttctccaagaagctctagctcgatacaaggcgtttctgtacctgatcaagatgaatcaagaaaaagggttgcaacgcttccgtgtaccaacctacgatgtggatctcttgtggcacactcaccagctgcatcctgttacctaccgcaacgacatggtgaagcttcttggaaaagttctggagcatgatgacaccgatgctgatcgatctgaaggaaagaaactcgatgttggattcaccgagactactgaacagtttgagaatacctttggtgtaagatactggaaggctggatgtatgtaccgtggcaacatgccatctcctgtgacatccactcctcagatattcagtactgaggttggtacgggatcggacatctgcaaagctcagaaggatcttaatgcccttgatataacagctgtagagttgtatttacaaattgtggacatcaataatttgccatctgctgttcgaaaa

SEQ ID NO: 23707 - DNA, 652 bp, Sorghum bicolor
  Clone ID: 30161339
aactggccgcccccaaaaaccacgctaatcacagggagaagaggagaaaaggagagaaaaaaagtgctagggtttggctaattggctcccgccatggcgtcaacctctccgcgccgctcctccggcggggacccaccttccccgtccacgccgctcatctcctcgccgacctccccggcatccggcccctccggaggcggcccgctggggcggctcacgagcctccgcggcgcggcgcggttcatccgccgagcacctcgaggagcgccagaccgactgggcctactccaagcccgtcgtcgtgctcgacatgctctggaacctccccttcgtcgccgtcgccgcggccgtactcgccgcgtcgacgggcgagagccccgccgtgccgctccgtgtctggatcgcgggctacgtgctccagtgcctcctccacatcctctgcgtcaccgtcgagtacaggcgtcggagcagggacgcggaccaggagggagccggtgatgaggatttcaagctcagtgttgtgaagcacttggagtctgcaaacacgatgttttccttcatatggtggattgtcgggttctattgggtctctgcaggcggtcaagctttatcacatgatgctcctcagctttattggctgtcaattgttttt

SEQ ID NO: 23708 - DNA, 639 bp, Sorghum bicolor
  Clone ID: 30161340
accatttggaagaaagatcctctcaagattgctcccctcgtgtccctctcgcctaacaccacagcgccactggcgcaaatcacactcggatacgaaagggaagtacagcgaaggcacttgcctgccttctgatcttgagaggatcactctgcttcttaattagaagctaggctgcagcgtaggggcggccaccacacatggctttcctcctcgctgtagcttgcatctacatcgtcgtctcactactcactctgttggtgctgctcgtcgtgagcagacgcagaacgacggcggtcactgccggaaaaaccggaggtgccaccacggagcaggatcacaacaagctgcctcctggctccctgggcctgccgatcatcggcgagactctccagctctacacccagaatccaaaggacttctttgcctccaggctgaagaggtacggcgaggtgttcaagacgcacgtcctgggttgcccgtgcgtgatcctggcaagcccggaggcggcgcggatggtgctggtgtcgcaggcgcacctgttcaagccgacgtacccgccgagcaaggagcgcatgatcggggcgcaggccctcttcttccaccagggcgactaccaccgccgcctgcgccgcctcgtcc

SEQ ID NO: 23709 - DNA, 680 bp, Sorghum bicolor
  unsure (1)..(680): unsure at all n locations
  Clone ID: 30161348
aacctggatctcctttctctctttcttcttcctgctttcatcttcattcacgtgcgatacaccccatcgcgccgaaccaccgacgcccaacgcggtgcccccgccgccaccacctccccacggctcccgtcggggccagacgcccctgccgcctccgccgcccgctggggttcctgcactgccaggctccggcggcgcctccatcgccggccggcgagcctccttgagctccttctaggtctgcaagtcacagctaagtactggcacgacgtcaatttattggcgcacaagagggaccatgaatattcattcgccaaacgaacaaggctatatatacgtggcggagtttggtgcgtggcctaaaagctttggagaaggggattatatagagggtgggagatggccatagcattcgcatttgggaggatcgatacctgcaggaactaccaggcggccacgtacaccccgaggctcctcattctatttcaaattataaatcattttgacttattggatacatttattttattatgcatctnaatataataatatatctngatacatagcanaatgaatgaaccaaaaaaataaaatcgacttataaattagaatggagagagtagtatccaaagtagccgagctaatcgatccacatactagacgttgggatgaacaacttg

SEQ ID NO: 23710 - DNA, 576 bp, Sorghum bicolor
  Clone ID: 30161358
tcattagatagatcattgaatatacttttataacaaatttatttgaagatataaatgttacatacaatttttacaaacctaatcaaagttgagaaagtttgatctacacgtattctataacaactttctttttaggatagagggagtatgtgctaaaagttaaaatagttgaaaaggttgttttataaattctgagctggtgcattgttttagagaattcctatgctcacgaaattcctaaaggcaacttgaggaggaacccatgagaacactaccaacgatttccaaacaaacgacatcgacttctctatggccttggtctcttcgaaccgaacaaaatttcaatggcgaaatggtctctgaaggttcaatggcgaaatggtctctgaaataactttgtatggcgctctgaatagtctaggtagagtggttgacacttttttccccggggagagtggttgacacttggcagacatcacgcatgacgatgtacaaatccacgaagcttaggccttgtttggttgaggagataaaaaaattagcaacttctcggagtcaaacctcttttcaagcagc

SEQ ID NO: 23711 - DNA, 577 bp, Sorghum bicolor
  Clone ID: 30161391
gccgcccgacggcgccgcgcggctccactccacgcgcgtccttggcaccttcggctaccatgctcccgagtacgcgatgactggagtgttgacgcacaagagcgacgtgtatagctttggagtgatactgctggagctgctaaccggcaggaagcccgtggaccacaccatgcccaagggacagcaaagtctggtgacttgggccacgccgaggttgagcgaggacaaggtcagccaatgcgtggacccgaagctaggggacgactatcctccaaaagcagtagcaaagatggcggcagtggcggcgttgtgtgtgcagtacgagtcggatttccggccgaacatgaccatcgtggtgaaggcgctgcagcctcttgtgaaggccgccgcagccacagctgggggggcctagcagtacatgaacatgatagatgataatgatacacaagcatatatatctccagcacatgtcctccaaagatgtgttcttggttatctgtcgcttgtgtgtacatctcaccttcagtgtggttgtaatgcaacatgtactgactgatcaatctgcaaaggattcaag

SEQ ID NO: 23712 - DNA, 370 bp, Sorghum bicolor
  Clone ID: 30161393
gccaaggtctccagatccgtttgcatgttgtccaacaccactgctctcggctccgtctttgcccgcatcgacgccaagttcgacttgatgtacgccaagcgcgccttcgttcactggtacgtcggtgaaggtatggaagagggtgagttctctgaagcccgtgaagatttggctgccttggagaaggactacgaagaaatctctggttctgatcaacccgaaggtgaggccgctgaagacttctaaacaagtcttgagtaatggccgaagttacgcgatgcagcatctggcatccgtgtaacgttactttgtactatgttgtatcactttgaatttattttgtgatgcatatactacacatataaagctt

SEQ ID NO: 23713 - DNA, 546 bp, Sorghum bicolor
  Clone ID: 30161404
gccgctggtgggcacaagcagaagcagcttgttgggatggtgttcgagcccaagcgcgaggccaccaagaagccggcggccatgatgacaagctcgccgttcctgcacgccaaccccgtcgcgctcacgcgctccgtggccttccaggagggctcctgattcttcaagttgaaggacatcgatcgatccaccagcagcagcagcagatgcaggaattttgtcatgcagccttttcatctcgacatgagcttagcctgacacagtactgaatttttttttgggtaaatcatcagaggattgtaatatatatctataggtatatatatgtgttgggtgggaaacagagctagtgtgtatatgtgtatgtgtatgtgtatgtgtatgtgtatgtgtaacatagctacttgtggacttgtaatataggcggcacgcaggatgtacatatagaattagctatttgggtttgagaaagaccaggagatcaataagaggtcccaggttgtagataaataacaacattaagaaggggaatatattgcttcaggt

SEQ ID NO: 23714 - DNA, 600 bp, Sorghum bicolor
  Clone ID: 30161441
gcgctctactccaggtgctccgctccaagctgggctacaaccaggagacgctcaacaagctctccttcttcaaggacctcggcaccaacgtcggcatcatctccgggctggtgcagcaggtggccccgacgtgggtcgtcctgctcatcggcgccggcatgaacctagcgggctacctcatgatctacctggcgctcacggggcgcacggcggcgccgcccgtctggctcatgtgcttctacatctgcttcggcgccaacgcgctcaccttctccaacacgggcgcgctcgtcgcctgcgtcaagaacttcccggagagccgtggcatcgtcatcggcctgctcaaggccttcgtcggcctcagcggcgccatctacacgcagctctacctcgccatctacggcgacgacgccgcgtcgctcgtcctcctcgtcgcctggctccccgccgccttcaacatcttcaccgtctacaccatccgcgtcctgccgtacgcccgccgcgccgacgacggcgggaagccctacaacacgcccttctaccacttcctctacctctcgctcgccctcgccgcctacctcctcgtcatgatcgtcgtcg

SEQ ID NO: 23715 - DNA, 612 bp, Sorghum bicolor
  Clone ID: 30161500
gagcttgtggctgagcacccctcgccgtggcccccacccccctccttcttccccccctcttatacccgctcgccctcccctgtccatggccagcagcagcagcagcagcaccagaccaaattccactcgttggtttctttgccggtcggcctcgtcgtcgtctctcccggctccggccgcaaagtgaacctacctgcggcgtctcgacctcgtccttccgtctgtctgtcgcctagctagctgcttcttcctccttggcttgcagcagcagcagcaagcaaagccgggagcttgtgtttgtttggatcggagtgagaagaagatgatggcggagtgccaaggaggaggaggaggggatttcctcatcaagctcttcgggaagaccatccccgtgccggagtccggcgacgccaaggatcttcagcagagcagcagcagcagcagctccactgaacaagatcatcaggatgcccatgccctggaccaggagaacccgcacccggactcctccgacccgtccccgcagccggaggtcgtggacgcagaggaccccaagagctcaccggagacgacacaccagaagcccggccagggcaacggcagcggcgacgc

SEQ ID NO: 23716 - DNA, 607 bp, Sorghum bicolor
  Clone ID: 30161503
tttttccctcctcatctcggtccacgcatacgcacctaggagagacaccgagcgagcgaagccatggctctccgtaccctggcatcgaagaaggccctatccttcgcgctcggcggcgcggcccggccgttggcggcgtccgcgaggggggtgacgacggtcacgctccccgacctctcctacgacttcggcgcgctggagccggccatctcgggggagatcatgcgcctgcaccaccagaagcaccacgccacctacgtcgccaactacaacaaggcgctggagcagctcgacgccgccgtcgccaagagcgatgcctccgctgtcgtccagctccagggcgccatcaagttcaacggcggcgttcttgttgttgtgcaggaatcagtgttatttggttggctattactgttagagctgcagttgctgatgttcagacctataaagtggtttcatgggatgtcctcacacttgtgcactatgagctacatttacctttcctgctcgagcatacccctaacttgcttgaggttatggctatattgtactccctgcgttccaaattgtcatgtgaaccattcaatcttctggaagaacctcaagccta

SEQ ID NO: 23717 - DNA, 641 bp, Sorghum bicolor
  Clone ID: 30161505
agcgccactgccataacacaacaataatagcaacttgcattgtgtgatcgcttgttgagctagctgaccatgtcacaagtgcatgcaccgcacgtcgtcatgctcacgagccccggcgtgggtcacgtcgccccggtggccgagctcgccgggcgactcgccgcacaccacggcttcacctccacgatcgtcacctacaccaacctctcgtcgcccacaaactcttccgcgctggcctccctcccgccgggcgtcgtccccaccaccgcgctcccggaggtgcccatcgacgacctccccgccgacgcgcacatcgtgacccgcatcctcgtcgtcgtccagcgcacgctcccgcacctccgcgcgctgctccgctcccttctcgacgctcccgccggcatcacggtgttcctgaccgacatgctgtgcccagcagcgctcgccgtcgcccaagacctcggcgtgccgcgatacgtcttctacacctcgagcctcatgtcgctgtcgtcgctgctcgacacgccggagctcgccaggacaaccacctgcgagttccgcgacctcccagagcctgtcgtcatcccggggtgcctgccgctgcgcggtgccgacctcgtcgaacccctccaggaccgtgccaa

SEQ ID NO: 23718 - DNA, 651 bp, Sorghum bicolor
  Clone ID: 30161508
gcgttgctccctctcccgccgcggctactcgcactcgcacgcgcgcgctcacgctcgggacgcggcggcggcgagcacgtgcgaggctaccgcggcgaggagctcactgcaggtcggcccggaggcgccacaagacaaactcgctcattctcggatcaatggaggcgctgcgggcgtggagggcctcctccaatctcattggattcgcggcctcccgcgccgccgcttcaaggacccttggcctccgcatccgctgctgttccgcggccgccgccaccacgaacccgccggcgcagcctcaggaccgccgacgccgtagtgcctcctcatccgcctctacctctgaccgcgactccatccgcgccatccgcctcaaaaaagttgaggagctcagagcgaaggggcatgagccgtacgcgtacaagtgggacaggactcacacgaccaaggagcttcaggagcagtacgctcatcttgtgaatggtgaagtctgcgaggacgtgtcggtgtccgttgctggcaggattgttgcccgaagggcatttggaaagcttgtttttatgactgtaagagatgactctgggactatgcagctttattgcgagaaagacagccttacggaggaccaatttgagcaactgaaggcattta

SEQ ID NO: 23719 - DNA, 555 bp, Sorghum bicolor
  Clone ID: 30161509
atactagcgcagcagaccatcagcagcaagctaataattagagcgttccactacagaaacgagccaggcagagtagaggaaatggccggcagcagcagcgaggagaaagcggtggcggcggtgcagaacaagaaggtggtgctgaggaggcacgtcaccgggttccccaccgaagacgacatggagatcacggtggacactaccgagctgcgtgtgccggcggggctgaccgccgtgctgctcaagaacctctacctgtcctgcgacccatggatgcgcggccgcatgaccaagcacgaagacggcgcctccgtgccggcctcggactttgcgatcggagaggccatggtcaattatggtgtcggcaaggtgatggactcgacgcacccagagttcaccgccggcgacctcgtctgggggatgagtggatgggaagagtacacactcatcacccagccggaatccctgaataagatcaaccacgccgacctgccgctctcctactacaccggcgttcttggcatgccggggctgacggcgtacgcagggttcacc

SEQ ID NO: 23720 - DNA, 609 bp, Sorghum bicolor
  Clone ID: 30161515
ccgctgccattgaagctatcctagcccataaaaggaagactgggaatgaaggagcacctgcttctgatgcaaacaccctggatggtggctttctcagtaagctaggccttaaatcagctggagaaggggcacttcaaggcaatgcaacagaaagtggagacgatggagaagtggcacttcaaggtaatccaacagaaagtggagacgatggagaaggggcacttcaagacgacccaacagaaagaaatggagacaatgtgcagggacatctgtgatgaccacaagttatgtccacaatttgttcatcacactcaaatcataagctatagcttgccagtttatatatcaatatctgagcacgttcgcttgtctgaagagccatggctgaaaggttcatctctgggtaaaattagattgcttttggttgagcattgtgttattgcaatggatgcacacaagcatttatagaattttgatgtgtagtaattattggaagccattttctatttgttcagtatcaaaacaactgtctgtgtttgctacagtagcgttaagtcacatgaattgttgttgcaaaatctattcttaacaacagaattgcaaggtccg

SEQ ID NO: 23721 - DNA, 641 bp, Sorghum bicolor
  Clone ID: 30161531
agaaagcaaatggaatccggtcaagctggtgacaacgtcggtatgttgttgagatccctccaaagagacgaagtcttcagaggtcaaatcatctgcaagcctggttctttgaacgtccaccaaaaattccaagccaacatctatatccttaaggaagaagaaggtggtagaaagaagcctttcgtttctggctacagaccccaatgttccatcagaactgctgatgttgctgttgatataaatcttcccgaaagcgtcaagatggccctccccggtgacaacttggttgttgacatgaagctcgatgtcccccttgctattgttcaaggattgagattcgccttgagagaaggtggcaagactgttgcttccggtgttattacccaacttttgaaggacgacgaagaagctgctgaagaacccaagaagaagtaaatggatactaaagggaatttttcgagtcgatcgtagaaaagaaagccctaatgataattaagtgcgcaaaataaatttcgttatataaaaatactaagaagaagaagaatatatagagtgcttatatatacatcattaattcaaaagaaagcccttgcattataactcttttattctgttatgacaaatctcgattaagtaaaatt

SEQ ID NO: 23722 - DNA, 609 bp, Sorghum bicolor
  Clone ID: 30161533
gctcaatgctaacatacaaacaggccttcccagaaattttgcgcggagttcctgtgcagccacacgtaaggcgctacacgccaccatttaacgagtttgaggtcgattgctgcttggttcctccaggtgaactgcttgtcatatccccggtaccaggaccatccgtatttctcgtaatgaccggggaaggcgagattcagttggattctatgtcaggtggagaaaaggcaaaggaaggtgatgttttcttcgttcctgcatacactgaggttaagatctctgcgtgtggccccgagtctgtgctgctgtacagggctggggtaaacagcagattcttcagctaactggcgcgtcgatctttggtcggaaggaggatttttgggttgtcgtaagtggaccacactgtaatttagggaagttttctccagctaagaaatatacgagaaaagaaatgattagttagcaaaaggtttcatatactaatgtatagggcttcaggctgataaaagaataactggttcctttcatatcttgataatttactgtaaagatgccttgcagtgcaatccacgttggatgcgctagaaagaaataaaaatgatgattagt

SEQ ID NO: 23723 - DNA, 625 bp, Sorghum bicolor
  Clone ID: 30161534
ccaaaagctgaaccggctggtgacctgcaagttggagcgtgtttggcctcaatcaagcggctctttcagcagcttgttcatgttcgaaccatcatctcatccttcagtggaaagctaccatccgatgcttggttcaatcatgtcaaacatttgacctcagatgcagaagaatctcttgaacatctgcactaccagatgatgctggccaagcttggggttggggttgggacacacctcgagaaggtaatgcccaaagtgtcagggactcgttccaaaacaacagctataagcttcatgcacttactagcttcacaggaacttgtcatcttaccagttactgacaaattggaaggccttcgacatggaagccctggattgtctggtgtagttcttgggaactacagtgatatgttgtcacttagttcttcagtcatacggtgcatccttttgtgtcgtggcattttaggcattattaacatggttaacatggagggtaaggataagagcctggaacttcctgtgtttgcttttgatgacctgacatatgctggtctgaacaagggaattgggatgaatgcacatagtgtaccagcacacatgactgaccctatatatttgttgccta

SEQ ID NO: 23724 - DNA, 523 bp, Sorghum bicolor
  Clone ID: 30161535
gcctcaagatggtcactgaccccactccttacaacgacaaggtccttgtcatgcctaacctttacggtgacattctgtccgacatgtgtgccggtctcatcggcggcctcggtcttaccccctccggaaacattggtgacgagtgctccatcttcgaggctgtccacggttccgctcccgatattgctggcaagaaccttgccaaccctactgccctcctcctcagttccatcatgatggtgggacacatgggtctcacagagcacgcttcccgcattgaaaccgctatcttcgatactcttgccgaaggcaaggctctcactggtgatcttggcggcaaggccaagaccaaggaatacgccgctgccatcatctccaggctgtaaatatacatcctttagtttagatacctgcctcctcacccgaaggtttatacgcgattttcttttttttaagggtagtgtacttattgagtgtaccagacctagaatcaggcacggcgaaatgattaagttacggagtg

SEQ ID NO: 23725 - DNA, 643 bp, Sorghum bicolor
  Clone ID: 30161547
tcgctgatcgccatgtgctccagcacggaggcgatcgcgtacatgatcacgttcgggttcagcgccgccgtgagcacgcgggtgtcgaacgagatcggcgcggggaacgtggagagggccaagaacgcggtgtcggtgacgatgaagctgtcggtgttcctggccgtcaccttcgtgctgctgctggcgttcggccacggcccgtgggcgcgcctcttcagcgggagcgcgacgatcgtgtcggcgttcggggccatcgcgccgctcatggtggtctccatcgtgctggactcggcgcagggcgtgctgtcgggcgtcgcgaggggctgcggctggcagcacctggccgcggtcaccaacctggtggcgttctacttcgtcggcatgccgctcgccgtcctcttcgccttcaagctcgacctgcgcgccaggggcctgtgggcggggctcatctgcgggctcacgtgccaggcctccacgctgctcgtcatcaccgtccgcaccaagtggtccaagctcgccgaggccatgcaggagaagaaggccagctacgtcgcgtagcaaaggcactgtaactaccagttttttttttaagagcactgtactaccagttatacgaacgaatgactaatgagaaatgcgc

SEQ ID NO: 23726 - DNA, 111 bp, Sorghum bicolor
  Clone ID: 30161550
cttcgttcggatcgttgtattcatatttgttttgcgctgcgatgagcgctgtccccggcgacaccgctgtgcgtcggcgttctctctcttcgctcgcgttccaacaaaaag

SEQ ID NO: 23727 - DNA, 636 bp, Sorghum bicolor
  Clone ID: 30161572
cgtcatgaagactgctaaggaaaagggcgtcaagattcacctccccgtcgatattgtttgcgctgaaaatcctgaatctaaggatactaagattgttagtgttgaagaaggaatccccaagaacctcaagggttttgattttgggcccaagaccatcgaacaaaacagcaagatcatcgaaagagccaagaccatcgtttggaacggtcctttgggcttgtttgaacaaccccaatttgctacttcaagtattgctgtcctcgacgctatggaaagagccacaaagaagggcgctttgaccattgctggtggtggtgatactggcgctttgatccaaaagcaaaatggtgagagcaagatcagtcacctctccactggtggtggtgcctctttggaattgttagaaggcaagaaacttcccggtgttgaatatttgaccaaccttgatgacttgaaggacgtcaagcaacaagttaaggcttaaagattttatgatggaaaggaattatctatttagaggaaggatataaagtgtatgttaattgtgatcattaagcataagtcgtagtaatttatggaagtaatgccttttgaatatatactttttaaggaaggatcaatgatttagataatgcg

SEQ ID NO: 23728 - DNA, 560 bp, Sorghum bicolor
  Clone ID: 30161583
cacttgttgactgtctacatgcacccaagcagcagcgatgatcttaaggccaaagccaagaagggacttaaggctattctccaaatgtgtctttacctccctgctttggagcccctcatttctgaagctcccaacgagatcttacaatatgtccttgctcaattcgccaagatcttacctaatgataacgtagccaagaagaccttcgtcatgagtgaaggtttggccaagattcaaagaattagagctgaacccggtacaaagttggctctctatgttcaagaaattaacagtttatacccacctgaggtcgttcaatattattcccctgattacgcagatacacttctcaagaagctcgatgaatacaatcctgaataagatcaaagttttcaacaggagatcaggaacgaagaactcggaggaaatctttacatttataagcttttcactatttttttttgttcaatacatttataaaatgcataaatattagaacagtgtaaaacatagcctccctctatagtgctaaattatctgctctgctcaaactatcaatt

SEQ ID NO: 23729 - DNA, 678 bp, Sorghum bicolor
  Clone ID: 30161594
ataataattaatttcatcgagtaaaaaacccaagttaggtatccaaccatgtctatgcttaagaaagtcggtattgagaacatcctcaatctcatccccaaccgtagagtcctcctcagggctgacttcaatgtcccagtaaaggaaggcaaaatcactgacaccaaaagaatcgatgctactattccaaccattaaaaaaactcttgaaagcggagccaagtccgttgtcattatgagtcatttgggacgtcctgatggtaaaaagaaccccaaacactctttgagacccgttgttcctgctcttgaacaagctctcggtaaaaaagtcactttccttgaagactgcattggcgctgatatcgaaagtgcctgcagaaacgctcctgaaggatcagttatccttttggaaaaccttcgtttctaccctgaagaagaaggctcctacaaggataaccaaggaaacaaggtcaagattgaaaagtccagaatgaagacattcggagaatctttgaccaagttgggtgatatatacatcaacgatgcttttggtactgcccatcgtgctcacagctccatcactggtatcaaccttcctatcagagctgccggttatttgttgaagaaggaattagattactttggcaaggcccttgaagatcctgagaagcctttcttg

SEQ ID NO: 23730 - DNA, 658 bp, Sorghum bicolor
  Clone ID: 30161606
aatttacagattctttattttaataaacctgcaaaaacagtttcaaatgagtagagccgttcttcaacccttcgaagtgtaccaaaaggcaagagtccagttcgtgcaaactgttgccgaactcgccaccaaaccccaaaacatcgaagccttacaaaatgccggcgttatggccctcctgagaccacttttactcgataacgtcccaagcattcaacaatctgctgctcttgccttgggaagactcgccagttactctgatgacctcgctgagtccgttgtcaacagtcaaattcttcctcaactcgtttactctttggctgaacaaaatagattctacaagaaagctgctgcctttgtcctcagagcagttgcttctcactctgccagtcttgctcaagctgtcgttgactctgctgcccttgaagccctcgttgtttgtctcgaagaattcgacccaagcgtcaaggaagctgccgcatgggccttgagttacatcagtaagcacacacctgagctcgctcaatctgttgtggacgctggtgccgttcccttgcttgttttgtgtattcaagaacctgaaatcactttgaagagaattgctgctagtgctctcggtgaaatctgcaagcactctcccgaactcgctcaatccgtt

SEQ ID NO: 23731 - DNA, 668 bp, Sorghum bicolor
  Clone ID: 30161617
atagttcattcatctcctgctcccaattctccactcccggaaggccgaaacccccaaaaccctcctcaccgtccggcggccggcggccgtcgcccaagcccaacgccccaaccgcggaaagatgtcgctgtcgaagccggtctcggcgcgccgcctcgtgccggcgctcttcccgctcgcgcacgcggacgtcgcctcggccgcggcttcccgctgtgagcgccgcaaggacacgttcgtcgcgacgccgccgacgcccgcgccctccccgcgggccgtgcgcctcgcggagccgctccccacgctggcgccgtcccgcctcgcgttccacaaccggatcctcgcgctcctctcgggcccgcaggccgacctccccgaggcggcgctcctcacccgccacgcgctccactccaactgccgcccctcgtccttcacctgcgccgccgtcctcgccgcgctcctccgcgcgcgccgcctcgaggacttcttcgcgctgcaccgcttcgcgctccaggccgccgtcccgcccaccgccgccacgcacgtgctctacctctccgcgctcgctgcgcgccgcctcgccgacgacgcgctccaccacctccgcctcctcgcccgccccggttcccccgtgccgccctccccgacggcctaccgcgtcgtcgtcg

SEQ ID NO: 23732 - DNA, 664 bp, Sorghum bicolor
  Clone ID: 30161618
attttagaagtattagagataaaaagatagataaatgaatatttctgctacaaacagattcctgcactagctagtgctagctagtgctaggtgtatttttcggccgcttcgcagcctaaaaatctgctgataaggaattacagaaataagcgatatttttttttaataaaaaagaataaaagtgagctaaaagctatatatgtagcttttagccttgcttaattgcatgcattagagctagagctagtaattaacaaattaaaagcagctctggatatataaattataaatgtaatttagaaatttgttattcctaattaggaatcagcaagctcttctaaattatataagtatggaaagaaattattgtagaatttaagctatatattaaagagatttatttatataaataggtttgctagctgattgtgtatatacgcaggccaatgcttctaatttcatagcaagctcgcttgctatgaaataggcaacctgtaatataaccaagtgtgtgctatttatagcgctagcctacaaacctataattatattaactctaagagaaatttaataataaacgaagtgaattgaaatatcttagtaactttaggaaaagaaatcaaaagagattctatgattagcgtgagctaaaatagactagcct

SEQ ID NO: 23733 - DNA, 183 bp, Sorghum bicolor
  Clone ID: 30161622
acggtgcggactgcggagtccggggcgctccatttctgaattcagatgtcgggctgggagacggtcgcgggcggtcggtggtgggcaaggcaatgacagcggcgacggccaaggcaacgcaaccgggccagccacattgacgtcttccccctccctcctcctcctcctggcgccctcccctgc

SEQ ID NO: 23734 - DNA, 660 bp, Sorghum bicolor
  Clone ID: 30161632
gcagagattatcgtagggctcgcctctttacaaaaatgttcaaaaatatccttagactcaaccaagctcccaaggctttccaaccttctatctacaatgttcccagtttcaactttgccaagttcgtcagagatcgtccccatttgaacgtcggtaccattggtcacattgatcacggaaaaaccactcttacttccgccatcaccaaggttttgtccaagcaaggaaacgctcaattcgttgattacggtaatatcgataaggctcctgaagaaaaggccagaggtattactattaacactgccactgtcgaatatcaaactaaaaccagacattacggtcacgtcgactgccccggccatgccgattacgtcaagaacatgattaccggtgctgccaagatggatgctggtattttggtcgtctccgctactgatggtgccatgccccaaactagagagcatatccttctttgcagacaagtcggtgtccaaaagattctcgtctttatcaataaatgtgacgtcgccaacgaccccgaactccaagaattggtcgaaatggaagtcagagaactcctcagcaagtacgactacgatggtgatggtgccaaggtcgtcaagggatctgccctctgcgctatgaacgacactgaacccg

SEQ ID NO: 23735 - DNA, 651 bp, Sorghum bicolor
  Clone ID: 30161636
aaccgtcgtcagcctagctcaatccccgcccaaatggaggacccaccagcgcttgctccgccggagccggagccggagccggagcccgaggcctccccggcgccgccgcaaaggctgctgcggctgcgctgcgcggtgcagcactacgagtggggccagcacggagccgcctccctcgtcgcgcgcctcgccgaccagaaccccgacccggctcgcccctacgccgagctctggatgggcactcacccgtccggcccctccacgctcctcggcgacggcgcgctcctcagggactggctcgcgcggaaccccgacgcgctcggccccgccgtcgccgcgcgctggggaggcgacctcccattcctcttcaaggtgctgtcggtggccaaagcgctctcgatccaggcgcacccggacaagaaactcgccgaggtgctgcacgcgctgcggccgtccacctacaaggacgacaatcacaagccggagatggccatcgccttcacggagttccgggcgctttgcggctttgcccctattgaggagctcaaggatgtcctgaggacagttcctgaaattgaaggcctaattgggcatgaagatactggcaagctgatgaacatgaaggagtatgatggggttagtgaagtaaag

SEQ ID NO: 23736 - DNA, 622 bp, Sorghum bicolor
  Clone ID: 30161637
gttactagtctctacactaaaaaacccgcgtgttatcgtactcgccctgctaatgacccctcgtcatgagctaatcccccgtcacgcgctaatcacccgctccgcttcctctatgcgcacgcccgcggaaccgtcgcccccgcgcagcccacgcacgacgtccaactacttccctcccgccggcacaagcccaacctttgtttcacgcacgtctctcacgtctctcgtgactagcgggcggcgcggcgatcaggaggaggcagagcagcgtgcaaacagcggaggcggagcggcgaccctgcggcagaggcggcgcggtgcccaggcggcgtggcctcccgggcggaggcggagcagcgaccctacggcagatgcggcgcagcgtcccggtgacttcgttgcgcactttgccggcgaggagaaccaccaggtgtgccaatcccttctcttcccttcctgctgtgtgaaacggagcacccaaaccctttttagctaattggctattgcactgaatgtattatgcctcgcagctcccgtagtccggcctcccgtccgggctccctgtgacctgtggcctggccctgctcgcctctcgccaagcgcccgaccatccagtcggcct

SEQ ID NO: 23737 - DNA, 664 bp, Sorghum bicolor
  Clone ID: 30161639
ctgggcgagtacgctcttcccttataccctcaccctctcttccatcctcgccttacattgcctcttctttctcaagctctgtctagctagtctctctgctcgctcctcttcataatgctggccattcgagctctccgaactcccgcctccaggcaagccctgcgcgctgctactccccgcgccgctatcttttacaaccgatgctactcgacctctggcgaacgagtcgccaagtacaacggtaccaaggatgccaatggcaacttcctggtcagcttgatcgagggtgacggtattggccccgagatctctcagtccgtcaaggacatcttcgccgccgcaaagacccccattgcttgggagcctgtcgacgttacccccattatcaaggacggcaagactgccatccccgatgctgccattgagaacattcagaagaacaagatcgccctcaagggtcccctcgctacccccgttggcaagggacatgtctctctgaaccttactctccgacgaacgttcaacctcttcgctaatttgcgaccctgccgatccgtcgctggctacgagaccccttatgataatgtcgacaccgtcctgatccgagagaacactgagggtgaatattctggtattgagcatgttgtcgtcgatggcgtcgttc

SEQ ID NO: 23738 - DNA, 656 bp, Sorghum bicolor
  Clone ID: 30161648
atgctcatagctgagtcgcacttgcacgccattattccccgcgggcgcctcaggcaaagagaccgaggccgcgcgcacgatataagcaccaccgccgctccacgattcttggtgggtagtcgccgatcagcagcagcagcggggagccggaggctactaactggtggtcaccgccggcggccgttcgccgcgagctccggcggcaccctgcagccggccggcggcgcctctggtccgtcatcggacggcggcggcagcatgccttcgtcggccccgctgctcggcgccgaggaggccggtggtggcgagcccgcgccggcgccgcggccgtcgtcgtggtcgtgggtggagcgcgtggtggacacggcggaggcccgcgcgcagctgaggttcgcggtgccgatggtggtgacgagcatggcgtactacggcatcccgctggtgtcggtcatgttctcgggccatctcggcgacgacgtccacctcgccggcgccacgctcggcaactcctgggccaccgtcaccggctacgccttcgtgaccgggctgagcggcgccctggagacgctgtgcggtcaggcgtacggcgcggggctgtaccggatgctgggcctctacctgcagtcgtcgctgatcatgtcggccgccgtgtccgc

SEQ ID NO: 23739 - DNA, 665 bp, Sorghum bicolor
  Clone ID: 30161651
aagcgaaaagagttatttactctatactttaagatgccgaaagacacgaaccttcacaaagccgcctataagggcgacgtgaacgttgtgatcgagctgttggagcagggcgacgacgtgaactgtcgcggcgcacagatgcgtacgccgctccaccgcgcggtcggcaaaggccacaacgcgtgcgtcgaagtgttggtcaaacacaacgctgacctcaatctcgtcgatggcggcggtctgacgccgttgcattgggccgctctcttcggtttggtcgaaacgggtaaaattttggtgaacgcgcacgccgacctgaacatcgttaccaaagccggtgagacgccgctgcatctgtgcgcggagaaaggaaaagtcgatttcgtcaaattcctgctcgcatccggcgcgcgcaccgatatcaaagacaaatcgatgaacggcggtttgacggcgtacgacgcggcgaagaaagcgggtcagaaggaggttatgctgctgttgcagccggagtctccgaagggctgctgtacggtcatgtaagaggtcgatccggatcgatcgttacatcgtgtgtcgtgtgtctccccgcgtgtcgtgtgtatgtccgcggtttgggcggatcgcgcttatgatcgggcattcgaatcgtggattgtgatgcg

SEQ ID NO: 23740 - DNA, 671 bp, Sorghum bicolor
  Clone ID: 30161665
ttttttatttaattaaagtttcgacacatatatatccacacggacatgttgttccgctctcttaccaaaaactttgttcgcaacttcgctaagcaagccaagggcgccagaacccaaaccgcctccactgaatctgttgaagaaaccaccagatctgaagaaacccaaactcaagccagagaatccactggtgtcgtcagcgccggcaaaatctctcaagttatcggtgccgtcgtcgatgtccaattcgaagaaaaccttcctcccattcttaacgccttggaagtccaaggagtccaatctagactcgtcctcgaagtcgcccaacatctcggtgactccagagtcagaactattgccttagattccaccgacggtctcgtcagaggtcaagaagtcagagataccggcaaccccattatggtccccgtcggtcccgaaactttgggaagaattcttaacgttatcggtgaacccatcgatgaaagaggccccgttggatccaagaagttctatcccatccatagagatgcccccgctttcgaagatcaaggttccggagctgatgtcttgatcaccggtattaaggtcgtcgatcttttggccccctacgctagaggtggtaagattggtcttttcggtggtgctggtgtcggtaagactgtgctcat

SEQ ID NO: 23741 - DNA, 644 bp, Sorghum bicolor
  Clone ID: 30161670
actcgtgccggtcgtgtgtggcttccacttccacccatctccctcgatagtcagcaagtacccagcactctctcctcctttctcttcctcagtcttcaccccacatccttcgccgttccttcgactatagccgctatcctcgtcagccccgattgaggcggcggccggcgcgccccaagcacgcacgagttgacgacgggtccagtggcggcggcgggatcttgccgccagcggcagtgccaatccggcccggccacgcaggatttcgtggatacactggtctaagttgtcaagttcttgagtcttgacctgaccttatcagttttgcttataaggatgggggtttacctcagcactccaaaaactgataagctatctgaaaatggagaaaatgatagacttaaatttggtctttcatctatgcaaggatggcgagcaaccatggaagatgctcattcagcattgctagatcttgatagcgagacagcattctttggtgtttttgatggtcatggaggaagagtggttgccaaattctgtgcaaaatatctgcatggtcaagttctcaaaagtgaagcctattcagcgggtgacctaggagctgctgtccatagagctttcttcagaatggatgaaatgatgcg

SEQ ID NO: 23742 - DNA, 332 bp, Sorghum bicolor
  Clone ID: 30161677
aggaaattgctgtttaaaaataaaatccaatcaaatattttcacaaaaattttattatcaacaaatattttatactcaacaacactttttacaaaaagtctctcaagtgagtcaaatgtttgttcacagtgagtggttcaaacttgagtttctttgttttgtctataattatatgtcaaaatctgtctgctaatttataatcaagtatcaaactttgaattatatatacaagcatatgatttctacattatgtcatttatagtaaataaacctcaataggattttgatataacaactgaagtaattttacatatcataaaaacttccaaaac

SEQ ID NO: 23743 - DNA, 473 bp, Sorghum bicolor
  Clone ID: 30161680
agtaatgaggacaaacctaatggaatcaatgccgccgaaggagccactcctgctttcactgtcgagacaagtccggagagctccgccagttgctcacaacctgcacttgctgctcacgctgctactgctgatgcttccaacacaactacaaattctcttcaagggaaggagatccaaaacctgaattataggaggactagaaagggtcagtctgcaacgcgtgccacacctccagctgagaaatcaagaggtgtgagcattgtgagccggataaattccaaggctgaacggattgaagcatggagatgaaatcaaatgacatttccattgttcttgtgcactagatgaccaacccaatgtttcctggaacccagactgctgggttgcacattttgcattttgtctgtgtatcatttcttgttgtatcatggtcatggtattttgagattcattcttcttgccatagctaactt

SEQ ID NO: 23744 - DNA, 578 bp, Sorghum bicolor
  Clone ID: 30161686
aaattttgaacaaatttttgaataagacaaatggtcaaacttggtgtcaaatttgggatggattgagtactttctattgtcaagaaaatcgagttggttaattgattatattagcagcagtgcataatgccacttgccatcttattttgtttcagtgccatcatggcatgcgctcaatgcaggtggctaaatggttgcagtcacaggtgattggtttcactgctgcaaaaggatgctcttactcttcattcgataatatgtgaataatattggactttttaatcctcattttccatcactttgcagggtttcaaaaaagtttacaatgtcgcaggtggaattcatgcctatgcggttaaagctgactcctccatcccaacatattagcggatccccgttgtgaccgttaaccatggctgaggacttttcatatgtcatagacaatggtttggccgttgatcaatgccaaaattcagagtcaactttctttttcacactgtgttagaagttttggaacccctatgaaggaatgtatacagctattttttgaaaaagagagatacatgagaatttgcttt

SEQ ID NO: 23745 - DNA, 645 bp, Sorghum bicolor
  Clone ID: 30161696
atattggtgacaagagctggggtgtgactgtttgccagcagtggtttggtagcaaggagaatggtggcgccattggcggagagaacacactgcatgtaggcgaccaattcttgagtgctgggtcgaatgacttcaaggcgagaagtgtcggaacaacggcttggatcgcaagcccagccgagaccgtggagctactcgacgagttggctgatcttatgcagaagaaattgtcttgattgcaaggagacttcggctttttgcatgagagatctaccttgggtgtaccctggcgccaattatgtcaggagtagattggctgtttcttgaggagaatctcggttatacgtggaccttcgtctttaatcgtggcatcggcaacaagtccgtcgacgtcctggcaacacgggagattgatcctcgtcgacttatgttcggacgaatgacaggaattgccgacggattaattacttacttgatttaacccatcccagatatcatatcatgctggttctatacagtcacatatcttgattaagctttgagccagggataatgatgggatcaagaacagataactgtgtttatttctgggaaagatctatgttggagtttgacatctaccaagacttctgaatacaaataccc

SEQ ID NO: 23746 - DNA, 519 bp, Sorghum bicolor
  Clone ID: 30161701
gatgctcaaggtgcaaaccaagaactcagagtatttcgtcgactggatccccaacaacgtgcaaacctccgtatgctttgttccccccagaggtctccccatggccgccacattcgtcggaaactccaccgccatccaggagatcttcaagcgcgtcgacgaccaattctccgccatgttccgtcgcaaggctttcttgcattggtacaccagcgagggtatggacgagatggaattcaccgaggcccagtccaacttgcacgacttggtcagcgagtatcagcagtaccaggatgctgagatcgacgacgaggttgaggagtacgagggcgagggtgagcctgaggagtatgagggctagagggattggagagcagctggttaagatgataaactatttggcttattatttctttattaccccccaaaatgcttcgtccccttctagttcatatatagcattcaaaactgaaattggtttattaggctctgttttatagccgattcataattatatgt

SEQ ID NO: 23747 - DNA, 355 bp, Sorghum bicolor
  Clone ID: 30161706
ccaaggtcattcttcagatgcgcaagacccttcagcttggcagcttcttcaccgtcggacctgatgaggttcgacagtggaccatccgaactggcaccaaggcgcctcaggctgccggtgtcatccacaccgatttcgagaagaccttcatccaggctctcgtcttcaactacaacaccctgaaggagctcggtgacgagtccgaggtcaaggccaagggcaagatcatgacaaagggtaaggaatacgtcgtcgaggacggcgatatcctgcacatcaaggctggtgccgccaagagctaagctctcaataccaccaggcgtatttaagtctatagaaaaaagttaaaatgcaa

SEQ ID NO: 23748 - DNA, 519 bp, Sorghum bicolor
  Clone ID: 30161713
gagctgcggtgattttcagttttggtcagaaattgttcatatgtcgtgaaaatgagagaacttgtttgtggcatgaatagcatgttgagaattggacttaacatcgggaagtactggacaattgatctgatttctgaggaccccaccccgccttgggttttattggaacacttttgacgactatgcagtttttctgaaaagaattctttcatcagctcccatgtatcaagcagcaccgaagaagtttagtttgctacagagcgcccaggatcagagtgtacgcctgactcttcactggatggctatcaacagaaaacaacggttggacttcccttgtgttctacagagaagtgtctgcaaaggcaggatgttttttttctttcttttcatgaagaatatatagaaaatacagtgtgggggtatcaagaaaaggcttgagttgttgcaagatgcgaccaatacgtttttgttgtgttttgcgttaatagctaagcaacatcccccagcctttcatccaaa

SEQ ID NO: 23749 - DNA, 479 bp, Sorghum bicolor
  Clone ID: 30161717
cgccgcccccggccgccgcggctggcgggaagcgcaaggcgatgatgatgagcccggacgagtacgccgccgggatgatgatcaccacagctgttggcctccaccatcactcgccgccgcccaagaggctcaacggcggcttgccggccacgacgtcgcccgtgctcggcggcggcctcaaccatcacatgcttcctcagttctagatacaccttttctactagtagctgactttgttgggggcatgcatatatcttccatgcatacgacgccatcaactgatatgcatgatggatcgtctaaggaattgctagcaacctgcggcgacatggaaaacaaggggattgagctcgttggttattggatgggattaattggaggccattaataagatgggtcgtacggtgaagaacaattgtagaagtagcagcactaccgattgtactggaaccagtattgaacattaggcgtatggtata

SEQ ID NO: 23750 - DNA, 471 bp, Sorghum bicolor
  Clone ID: 30161732
atggctgccccgccgtcaccccgctcaccatctgccgcctccgccgcggcgtccccctccaccacagccgccgcctcctcgccgtggccgccgcagcgccggaagcgcctgcgcctccccccgcgatatcccagtcgccgccgtccccggttccgccccgcaagggctacttcccgaagcgcggcgagaccgtcgagctcacctgcgaggcgctcgccttcaagggcaagggcgtctgcaaggtcgcgggctccaccttcgtcctgctctgcgatggcgcgctccccggcgagcgcctcgtcgcccgcgtcagccgcctccgccgcggcgccttcgccgaggccgccaagctcaggaccctcgagccgcaccacgacgccgttgaggcgccctgccccctcgctgctgattgcggcggctgcaagacccagtctctcgcgtacgccgcgcagatccgccacaagcatctcc

SEQ ID NO: 23751 - DNA, 594 bp, Sorghum bicolor
  Clone ID: 30161744
actagctagccagcatagcctagtctatatcttcatcaccaaggaagaacagctacttactgatcgaagtaatggcggctccccttgcaaaagatgaagaagatcacaagaaacatggagagggttgtagccatagccacttcctcgtggtggcctacagcatgcaaggccacgtcaaccctgcacgcacgctcgcacatcgccttgctcaggtcagcggctgcaccgccaccctctcgatcccgctctccggccaccgccgcatgttcccctcttcctcctccgacgacgacaaggaggccgccatcgtcagcgacgggctcatctcctacctccccttctccgacggcgtagacgacgggacctggcccatcgaagaggaagaccgggcgcgccgccgtgacgccaacttcagaaccctctccgccatcatcacccgcctcgccgccagtggcggacggccgccggtgaccaccgtggtgtgcaccctcagcatgccggtggtcggcgaggtcgcgcgcgcgcacggcctcccgctggccatctactggatccagccagcgaccgttctcgccacgtactaccactacttcc

SEQ ID NO: 23752 - DNA, 377 bp, Sorghum bicolor
  Clone ID: 30161752
acttgaagcaaagcaagcaacctagctctaccatccatccaatccatccatgaagaagagcctggaggagcagcgcgacgaggaggagggggcggcgttggtgccgcaacatgaacatcgtcagacgatatcttcgccttcgccgcctcatcaggatccagagcagagcggtgacgacgacgacgatgctcatcatcatctggtggcggcgccggcgtggtggaggcggcgggcgcagaagctggtgcccaccagaggcgtgggcctggtcatggccggtctcctggtgcttgccttgctcgtcggcagcggcagcaccagccgctggatccacctcgacggctatgcatcgttgcagtcgattctgctcggcagcg

SEQ ID NO: 23753 - DNA, 673 bp, Sorghum bicolor
  Clone ID: 30161755
tttacagagatgctaaaagataatgactgttctgtaaactacccagcagttcaaatctcaaaatccttggaaggcatactttctcttcctcatggcaatgtgtcaacccctaggagtagcctgaggggaaaggattaccttgacccctcacctggagaaacagatgtttgcattgcatgtgaggttgagagagaagaatgcacacaagagagaaaccaatcacaaaaggatttaggaagcattgttctctgtaccagtgcagcagttgatgatcaggtgacagttcgagaaggatattacacgaatgaagcacaaaaaggaccaagacatgctgatgatgagccaagcactctgtatactgaaggaattgacaaactcatttgcggtgaaaacgtttgcaatgaacggtccattccagcagaacaaagcattgatgatgtatgtcaggaaacactagaagaaataaaacaaggaaaagaacatgtaaaagtgtccccgacttctgctgagggcatagtcgaaaaattggggcagcaagagccagaaacaccagaaccaagagcagcaaccaaattaatctcagatggttctcctgagcaaagcgatgaaaagcaagagaggcccagtccagtatctgttcttgagtcattctttgaagatattggcagtccag

SEQ ID NO: 23754 - DNA, 173 bp, Sorghum bicolor
  Clone ID: 30161760
acgctcaacacggtctccttcttcaaggacctcggcgccaacctgggcgtcttctcgggcctcatcaacgaggtgacgccgccgtgggtggtgctggccatgggcgccggcatgaacctcttcggctacctcatggtgtacctcgccgtgtcgggccgcacgtcccgcccgcc

SEQ ID NO: 23755 - DNA, 541 bp, Sorghum bicolor
  Clone ID: 30161764
tttgtttcttgtaaacaaatgcgaaaccagttcaatacctccttcaaattcaccaaggagagctcttatgttggaggcattcaactctcaaaaggaatgctttgggcaaaaatgaagcgtgaagaagaagccaaaaacaccaaagttgtcaacaaaatcttctcaaaccaagaacattcacgaggaagaacaaatttaggcgagctgaaagaaaagttcgcctagattatgaaaaacctttcttctaatttcaatttcaatctgtttaaatttaaatttaaactttctaggcaccagctcactctaataccaaaaagaaccaacctgtcatcacttcttcttctcaaagaccatctgccaaaggaaatgattcttgggcctcaacccctagaactgcttatacaacaaaaccaaatgctagtccaagagaaagcttcagatctaccaagaccaacttcgagcttattgataccaaagaatccaaacttatgaagctctcaaagaagattaccaagtatgaacctcctaaagagcctctcta

SEQ ID NO: 23756 - DNA, 332 bp, Sorghum bicolor
  Clone ID: 30161770
ggagcaatgacggaggtggcgctgccccggggcccggccaacctcgcttcccccgcaagccgcgcctcctcgtcctcctcgctgcgctatttagccagtgccgacagcgacgtgctccctggaagcggcagccccgagcggtcagcaggatctacagggagccgaggaatccggcaggcaggagggtcggaggaggaggaggaagaagaggagcggtggtcgttcttggcgctgctgtttgagctgctgcggaagtccctgctcggctgcagtgtggtaggcggcggcggcgaaggtgaaggccgcggctgtgggatggagattgggttgcc

SEQ ID NO: 23757 - DNA, 625 bp, Sorghum bicolor
  Clone ID: 30161776
actcggtaacggacgcccctccatggcagcaaactcctatccttcacaggtaaagtgcacaatggatgacccagagttgaatgctcctcccaagaatgatccagaggaggagccaaagcaggcaacaaataggattctgaagcgtacctcatcattcgctcaaggcactattgccactgcgaccggcttcctcaccgcagctttctcggtgcgcaaagatgctctgttgcaccggcacatcctggtggccggcggttgcttcctggtgattgcatacctatctgcgctcctgctggtctacctgaaattgttcttgtcaggacacaggcagctgcataaggggcacatccgtttcatccagttcctctgcatcatcagcggcgcggcgctggtggccacgaactccctgctcctcctcctcataagtgaagacagcatcttgttgtctctcaatctgctgcccatacagggcctcatcggcattctcgcgtaccacgcgacgccgacggaggacagcatgcgcgacgaggcgttcgaggcggggatcaagagcggccgcaaggtcgccctgttcgccacagcgacggccttcgccgtgcagaccacgctcctgttcggctacctc

SEQ ID NO: 23758 - DNA, 610 bp, Sorghum bicolor
  Clone ID: 30161780
cgtcggccgtcgccgcgaatacacttggctttgcgcctccaccttgctctaggctcccacggtcccacccatggcggagccaccgtcgacaccgcctccatcgcagccgcaattgaagctattcaactcgatgactaaggcgaaggagcccttccagccgcgcgtggagggcaaggtcggcatgtacgtctgcggcgttacgccctacgacttcagccacgtcggccacgcccgcgcctacgtcgccttcgacgtgctgtacagatatcttaaattcttgggttatgaagttgaatatgtgcgtaattttacggacatcgatgataagattattaggcgtgccaatgaagctggtgaaacacatgcaagtttgagtagccggtttatcaatgaattccttcttgatatggctgcgctccagtgcttgcctcctacacgtgagccacgtgtaacagaacacattgagcatattatagaattgataaccaagataatacagaatgggcatggctatgctatagaaggggatgtttacttttctgttgatagtttccctgaatatctccttctatctggaagaaagttggatcaaaatcgtgctggtgaacgt

SEQ ID NO: 23759 - DNA, 647 bp, Sorghum bicolor
  Clone ID: 30161790
acagcaaacaacttctcctcctattcttccctcttacaaattcattacccgaaaaagtatcttttatcttttcacatccttcaacatcaactgaaccctcgtaccaactgcaacaatgacaacccgttaccgtgtcgagtatgctctcaagacacaccgaagagaccaattcattgaatgggtcaagggtcttctagctgtccctttcgttctctactcccaacccactggtgtttttggagatggacctagtgttactcagatggccgaagaggctcaccgccgttacgctgagattatgcgtgacgttgaactaatgattgatgatcacattagccgtcagcaagatgataccatgctcccgtccaagttgcggatgctgattcccactgcgggccctttcttcacccgcctgccccttgaggcagctttcaagtatcaagacagaaagcggcacatctcatcacgaagatttgttgccccatccttcaacgatgtcagacagatcctcaactcagcccagtccatggctgttacgaatgggtcactgcagttggccacgtttgatggtgatgtgaccttgtatgacgatgggttcaatcttgagccatcgagtcctgtgatcccccgacttctcgacctcttac

SEQ ID NO: 23760 - DNA, 644 bp, Sorghum bicolor
  Clone ID: 30161806
acgtaattccaaatcaattcacttcacaatggctatcgaaatcgaaactccccaggaacactaccctacccgccacgccctgtcctgcgtgctaatgcgcgccgggacatcaaagggcctcttcatccaccggaaagacctccccgagaaggaatccgaatggggtccacatctcatctcagcattgggttcgcggaacaacgatgctaagcaggttgacggcgtcggcggtggttcatctactacgtcaaaggttgctgtgatttcgctgtcgaaccgcgaagatgccgacgtcgactttacttttgttcaagtcgctgttggcaaagaatcggtggatttctcaggaaactgtggaaatatgagttcgggtgttggaccgtttgctgttcaggagaggcttgttacgccgaagccgggacagacagagattgatgttaggatcttcaacaccaacacgagcagaatcattgtcgagactgttgagttggatcgtaacggtgatttcaaggaggatggcgactttatcatccctggtgttaaatcacccggcagtgaaatcaagtgctccttcgtcgatcccgccggtagcatggcgggaagcttgttcccctctggtcagaagcagcagtggcttcacgtcg

SEQ ID NO: 23761 - DNA, 609 bp, Sorghum bicolor
  Clone ID: 30161824
caactacccggccatcgtgctcccggacctgggcggcacggtgacggtgaagcggacggtgaccaacgtgggcgcgaaccgggacgccgtgtaccgcgtcgtctccgtggccagcccgcagggggcgcgcgccgaggtgtggccgcgggagctcgtcttctcctcgcgccacgggggcggcggcgaacaggcctcctactacgtgaccgtcacccccgcgaagctgtcccgcggccggttcgacttcggcgaggtggtctggtccgacggcttccaccgcgtccgcacgccgctcgtcgtcagggtgaccaacctgcccgacgacggcgtccaggtccagaccgccaacgccacggccgacgtgcacggcgccgacggtctccacgccgccgcctagctgcctccggttcttggcacggttctgagcctgcaagattttagatattttcaggtttgttgtgtggactacgattcgtaccgagactttttcgcgtccatttcttgtgtattggtttttgtcttttgatgaaaagatggttgtgtactcctggcattggtcaaggcagaactactgccacggaattccatggcgtcgctgtcagtggactg

SEQ ID NO: 23762 - DNA, 575 bp, Sorghum bicolor
  Clone ID: 30161827
gtggaagatgacaataaccctaggaacgccaagaagccgaggcctgatgcgagcagcatggcctccttgctagacaagtaccgaagagaattttccgtcgtcccgtttgccattaaccataatagcaaccagcaggactattgttcaactactaacgaagccgacacaaacaaatcagttgaattctatgattttctccaagtgaatgcgaactcgagcgacaccaagtgtggttcgagcattgaagagcaagaggagaaccgggatgatcaagctgaagggcaggtgcagttcatagatttcctggaggttggggcttctcatcgccagtgatttatctattctatatatttaactagggatgcatccaaagcaggttgtaatgctttgtgaaagaggcatgctgcaaatagcaacctaacaccaaacgtacttatagaggaaggaaaatgcaccgtacatatgacatgtaatttattgatgtatacatatctgtccatatatccactgttgggggtacatatatatgcaaaattattctgagataaatgagaaattaattattatctcagcta

SEQ ID NO: 23763 - DNA, 591 bp, Sorghum bicolor
  Clone ID: 30161831
tcccgctgcgggtgcgcgcgctgggcttcgcggtcggcgtggccagtaaccgcgtcaccagcggcgtgatctccatgacattcctgtcactctcgaaggccatcaccatcggcggcagcttcttcctctactctggcatcgccgcgctcgcgtgggttttcttcttcacctacctcccggagactcgaggtcggacgttggaggagatgggcaagctgttcggcatggaagacacggacatggctgaaacagaaaacaccgctgctaaagagaaggtagtggaaatggccacgagctaaaaggaaaccaaggaacagctgccgcagcttcagtctcagccgagctattcgctttctcaggtgccgtgcacgtgtgctgctgccgcctgcacgtaggagagtccgacggtgacggcgaggccgaacccgaggactcttgtgcatggttacaaaaactcttgtttgtctcgttcgtcgtgtactcttttgtggagcgcgcgatggcgtgaattattgttgtcatagtcgcgtgtgctttgcaaatgcaagttgcagacccgttgttttgttccaagagggactattataaaac

SEQ ID NO: 23764 - DNA, 651 bp, Sorghum bicolor
  Clone ID: 30161850
actatatcagtcttgggttagttgatgaggaggcaatccccaagtatgagctcacagttgaggatggtcggcgacttgccaaagagtacagtcgtgtgctaatgaggcggcaccgtgcaaggcaaacggcagagtcaacgcttctgaccctcaaaaaggaggccattgctgctctccctgagaagctgcgagctgcggctatggtacctgacatgacaccgttccctgcaaaccggtacatggcgacactcacaccaccaattgaaggatatattgaaaaggtgcgggaagcggccaagaagcactctgtgaaggagaaacttcgctgagaattcaagggaggaaactgtctccacataaggtgaatggatattgaatctaatgtacaagaacagctttggcacaaactacacttgccaaatttggtgatctagtcagatatcccaatttgcagagcagtcatgatctagtgaaatcctttttgccaatttttatgcagaactctacaggattggcgttttttttttaaagttgtcactagactgtcatttcacctttttttttgctggtttaggatgtttattgttgacagacttctgtaataaagggttaacagtgagaccgtgaaaccgaagaatctctgcttctctc

SEQ ID NO: 23765 - DNA, 593 bp, Sorghum bicolor
  Clone ID: 30161853
gttgttgcgaccgagatgaagaacaacagttgcaagctcgcccgctggacagtgcagagcatccttgccagcgcagacgtgatgaagcttggctttgtttcccgtcttaccccccgttccaatgacaaacacgtcgtattgggcgttatcggctggaagccccgcgattttgctaaccagatgaacctatcgctctccaacggttggggtattgttcgcactatcgccgacatgtgtctcagcagcgagagccaagatgctaagtttgtcctcgtcaaggacccgaacaagtctatcctccgtctgtacgaggtgcctactggcagcttcgacgacgatgaggaggaggaggttgaggagcctcagggcgaggaggagcagtagatcaaagagaactagacatggccatgtcacgttgtgcatatttggtagtttcatgatggtggggagggccacgggataaaaggcataagaattgcagggagtcccaagctctaatgatttgaagcagtggatgcaatctctatcaggttctggaaggccattttttgtatttgactgtggttgcagtctggaatgaaaaagaacacgtg

SEQ ID NO: 23766 - DNA, 533 bp, Sorghum bicolor
  Clone ID: 30161866
aagcagccggctgctgcaggcatgttgtgccgttgactgcgcacagctgcctttgaaggacgcagcaacagtgactgcaaggacctctcgagtgtcctgcagaagtttcagtgaatttttttcagtgaaatgctgtgtatttttgggcagctcaaagcgtggcaacacggggttgtgtgcatgttgttgtatgttgtactctgtagcataaacaggcacatagggatactcatgtatgcacaatgcatttttttttccatgaccctcaggtcgctgtagtatttactcttgtacagcatttgctgacgtcatcatgtactcatgtccatgcaccatgtagcacgtgtgttccttctcaatttttgtcagaggcatctggttttgctggcaggacacgagcatacctttgtttggccgatggcttgtatgtggtattgtgttacgcaggctaccacatgtgcgtgcttgcatgttgcatcaggtaccagccacacgcattcccctttttcggtgattttgagatgtaactggct

SEQ ID NO: 23767 - DNA, 498 bp, Sorghum bicolor
  Clone ID: 30161869
ctgacgtgctggaaatgatcgccggagtgtggatcgagatgctgtgctaccccgcacgacactgcaccgaggtttcccacgccaagcagctgagcagcggtggggaactggtgactgcaatggggatgctggtggagtacaccgctaggtatgacctgcattctgatggtcatggatcagaggatgatcgtccactgtcagggacatctatggagaatggagaacctagcggagcggcggctgaggtatctgtcgatctcgatagtatcagtgaaggtgccggccggatcggaggtgaaatttgcgaggaataatggggcggaaaatttgatcgccgagagatatggtaacaatgctcgttgcctagtggaaatgaattgaagaatcgacgtataggtaggcattgtcatgacacctgatgcgatgcatgcaagatttctaaccgatgcggatcttttatgatctttttttattcaatatatcaataataattgctcc

SEQ ID NO: 23768 - DNA, 551 bp, Sorghum bicolor
  Clone ID: 30161871
cactcaatgttgccgaagcagaggtggttccagcgtccggtgaggccgttacgccgttggagcaacgtgtcatggagtatgtacgctggatggtcacccatcacagtggcttcgtccccgcgttcatgtcgagcattcgctttgcacccctgaccgatcagcatgaagcctgggccaagttgtccaagcgtgctcctggcactacagctattttactagctagatctgacgagattattgatctcgagtcctatcgccgggatgcactatccctcgttggcggtgagcaccatgtccgctggcgaattcttccagggagccatgatttcgttatgacgcatgcgggagacatccttagtgagattgaagacatgttcaatactaacaaggtgtgaagatggtcgtgttttattgtatctctgtttgatgtcatctacgacagggttccagacatttacaaagtgcgagagcagggagttgagttcaggagtttgttatatccatgccctttatttttccaggatagaacatagagtagagagcgattgaga

SEQ ID NO: 23769 - DNA, 621 bp, Sorghum bicolor
  Clone ID: 30161887
gcgataagagcgagatagatgggtggcatacaatccagtttgcagggggcaaaaactcgccgacaaaattccagctaaccttatactggtctaccaaagcatctcaaagagaagctaaagcggcggcggaagatcctttcctgataaaactaagaacagatgtgaatagagtcacaccacaggtgggaagggttctcgagaagctgccacggtggtgcacgcccttcggcaagtccacttctccctacacgctagcgttcttgacggcccttcgtgtcaatatttagtcagcaacatttgtttgtttcccatacatagatgtgtccacagctttcgtttctccagtattttagctgtgcctattagttttccatccaaagatagcaaattatataggccccacagaattgtacacagaagctgccaaaagtccacaggagttagggatataggcatcaaataaacgtacaattacagggtagcctggtggaaacgtgttttgcgtttgtattagtttgtctttaatgtgaaaggtttcagattagtttgtggtattatgtacacaaaaagtatatctgttcgtgcttttggatttcctgtccaatctccataaattattgg

SEQ ID NO: 23770 - DNA, 655 bp, Sorghum bicolor
  Clone ID: 30161889
tgaccagtaagcattttcaggaatataacaatggccgctctgtccgcaaagtctgctgcctccggcgttgtctcaaggccttctgctcagagggtggccaatgtgcgcgtcagtgctcccaaggtcacagctcgtcgtgctgtcatcagccacgtagctgctccaatcaaggagcagtggcacggtactgttcacgctccaactgagaagagcaaccgtgttggtctgccacagctgatcaccaaggagcaggttcaggctttggagtccgagcttgaccagggcgagtccattgttgctctgcgtcgtttcaacgatgccctgaaggccctgccagctgaccgctgggctgacatcctgcgcccagtgttctctgagctgacctacaacctggagtccttcaaccctgccttcacagcatgtctcctgcaggtccagcgcaccattggtgtgagcgactacgtccgccgtgacatggccctgaagaacctcattcagccactggctggagagtacggcatgcacaacaaccagccacaactgaagacccaccgtgagctgttcgctgagttctaccagagcctgttccaggagcccattgagaacctgctggcccagggcacacagccagctgctgccacactgctgtgggcac

SEQ ID NO: 23771 - DNA, 651 bp, Sorghum bicolor
  Clone ID: 30161891
attctgctgagagctcagaatcttcgtaagctagacaacaaatcccagtttaagcattccgatccaataaacaagccatcctgctgagagctaagaatcttcgtaagctagacaacaaatcccagtttaagctaagcagttcccggctcgtcgcctcgtcggtggttgcagcgtccggcgcccggtgggcagctacggcagcagcaggctgccaggctccctccttcatcgctgggtcgtctactcttctgtgtcttcttcggttcttcctgttttcgccgtcgccggcatccaatctatccacccacgccaaggaacaatgggcagaggagggctaatagacatttggaagaaatgggagatccaagtgctggtgctacttaattagcttcacactgcaacttatcctcctgatcttggcaaggatccggcgccgcaaaggctccgctctgctgaggatcctcctctggttggcgtacctcatggctgactccacagctatcgccacctctccctccgcgccagatcaagcgagaatcagctcgtcgcgttctgggcgcccttgctgctcctgcacctcggtggcccggacaccatcacagcctacgccttcgaggacaaccagctctggctgcgccacctgctaaacct

SEQ ID NO: 23772 - DNA, 671 bp, Sorghum bicolor
  Clone ID: 30161893
agtatctttcattctatttcttgtccctatcgatcacgggttttcttttcaaaaagcgaaaggagctatcatgcgctgagcatttccgctttatcactgtggctgcaccgttgactctggcgtgctacacaccttaccaacctacacatacagacctaatcaaccaatctcacagagttgctgaacaagtgttcaccctttctcttcaccagccagcccatcagcttctagctcttctcaccatccagtatcccacaaatatgtctcctcaagatacgtcaacggccctcgtggtcacaacaactgttttctcaactgttgcctttctcgctatcgcccgcgcacttctttaccccgtgcgcccgaaattcattcgcaatccgctcaaggcgggcgtgtacgacaaggccaatgctgacaagttgaagaatcttgtttatcaacctgatcagtttcctggcgctcgagatgtagaaaccccatacggaagcattcgtgtttacgagtttggccctgagaatggtgaaaaggtcttctttgtgcacggcatcagcacaccctgcatcactctcgggcctatagctcttgggctcgtcaaacgcggttatcgtgtgatgctctttgatctctttgggcgtggtttctccgatggtgtcgctgatatcccacac

SEQ ID NO: 23773 - DNA, 668 bp, Sorghum bicolor
  Clone ID: 30161898
gtcccgcaggcgcagaagcaggctcctttttcatcaggtccggagggactagggaggggcagggacagagagagagagagagagagagagagagagcagccgtggagtggagcagagtggagcagactgattgagcccccaagatgaggagctccgtgtctgagcgcagcctcatcatcgagagcgacgacgacgacaacgacgaccgtccccaatcccagccatccgccgccgccgcccgcagcagaagacgccaccaccaacacgaggagggctccggctccggctccggctcaggatccgactccgattccggctcctcctcgtcgtcctgcgccaccccgcgtggtcacgctcaggccaccgcctcctcctacacccagcaatggccacagagctacaggcaatccatcaacattcttagtagcgtgcagtcaccaaatctgagcttcttggggaccccaactctaagcagattatccaactctttcatcaccaattcttttcggggtaaaacccctgaaatcatctctaatcttgttaagccacttcttcgccccactacaagtgatgaccttcagcagcagcatgaagaaagaaagagttcacagtaccttctgccttcgagaaaaccgtctttgcaacagattcctgaggatcaaaagcca

SEQ ID NO: 23774 - DNA, 675 bp, Sorghum bicolor
  Clone ID: 30161908
atatgcaaatcctcgcctcggcggacggcgggactcggggggtcgacgactagcacgcgcgtccagcgcagcagctgcatcacggaaccctcgcctcgcacaccccagcgccgccagtctcccaccacgggaaattctcatctcatccaccaagtcaagtcgtcctcctctcttctcagtgcacgagcgtcgccgtcgcgctctcctcactgcaccgacctgccttcaattggctccgtcgtcttcgtccgcctcagtgcaccggcgtcgccggcgcgtcgggtggacctgccttcaattgattccttcgtcttcgtcttcgtctgcgtctgctgattgtcaggatgcctcgagggcaaggctcttctgtgtcaaccagtgagaagcccaaagttgatcaggcaattgattcaaatgataacaggcgcaagcataggaggggtgcttacttgttactgggattgttgataatattccttcatggatcatggtctgtttatcagatccagtttggaagccttcctttgccccttgatgctgagaaggctggcaagagggggttctctgaagcttctgcacttaagcatgttaagtatttgacaggcttgggtcctcacccagttggttcagattccctcgatcgtgctattcagtatgtatatgcagtagcagaaa

SEQ ID NO: 23775 - DNA, 639 bp, Sorghum bicolor
  Clone ID: 30161923
agctcgatcaccatggacacacgtacgaccaaacaaacccgctttctaactgagcacaactaacccctgcggtcacagcaagccgacggtgcacgtatctccgagcaagaccgtcgtcggcgaaacgccggcgccggccgtggcctacttctcttctagagggccgagcaccgtctctccaaagatcctcaagcccgacgtgaccgcccccggagtgaacatcctggcggcatggccgcccaagtcgtcgccgacggtaatccccctggacaagcggtcgacggagtggaacttcgactccggcacgtccatgtcgtgcccgcacgtctccggcatcgccgcggtcatcaagtccgtgcacccgacctggtcgccggcggccgtcaagtccgccctcatgaccacagcgtacatgtacgacgacacgtcggacgtgatgcaggccggcgggacggtgaaggcggcggacgccttcgacgtgggcgcggggcacgtggacccgctgcgcgcgctggaccccgggctggtgtacgacgccggcgcgcgcgaccacgtgctgttcctctgcagcctgggctacacggagtccgccatccggagcatggtgctcccttggccggcgctggacacgagctgccc

SEQ ID NO: 23776 - DNA, 627 bp, Sorghum bicolor
  Clone ID: 30161926
atctccctcctgtgcctccttttgttgccctcccctcttgcatcatccttgttcatctcgtctctccccctccttccctccagccgcccagcgcagcgttctcgatcgatcgatccgtgtgttcttcctgtgtatcgcctagctagccagctaattaattgctgaatcttcttcaattcttcgcctgctgccaattaatttattattccacgctcgattattgcagcagagtggctttagttaattagtataggaagctgagtaagagacggtgcaggattattggaaggaacagagacagagagcttagcatcaggcaagctgttgttgattgggtgatcgatcgatcgaggatgtgtacgaggggccattggagaccgtcggaggacgagaagctgaaagagctcgttgcgctgtacgggccgcacaactggaacgccatcgccgagaagcttcaagggagatcaggtcggtgctgctacatgcatatatgatcatcatcatcaagactatatatgatcaatctcttatagacagcatatatatatgtcaagttttttttttggttggatttggtaaactatgtcggccaaagctagctaattccttctctttggttcattaacc

SEQ ID NO: 23777 - DNA, 674 bp, Sorghum bicolor
  Clone ID: 30161929
aattatattctgctttgccgtacgctggtgcgcctcccgtccccctccccacctcggcatcgacgcgattttgcgtgcccgacggacatggcggacgcgccggtggagctgccgagccggctcgccatactgcccttccgcaacaaggtgctgctccctggcgccatcgtgcggatccgctgcacaaaccccagtagtgtgaagttggtagagcaagagctctggcagaaggaagagaaaggcctgatcggggtacttcctgtgcgggactcggaggcaacagctgttggctctttgctgtctcctggtgtgggcagtgattcaggtgaaggaggcagtaaggctggtggttctgctggagagtcgtcaaggcaggacacaaaaaatgggaaggatcccattcactggcacagcaagggagttgctgccagagctttacacctttccagaggggtggagaagccaagtggaagggttacatacattgttgttcttgaaggcctatgtaggttcaacgttcaggaactaagtgcaagaggaccataccatgttgcccgcgtttcacgccttgacatgacaaagattgaattggatcaggcagagcaggacccagatcttatcgctctttctaggcagtttaaagctactgccatggaactaatttctgttctaga

SEQ ID NO: 23778 - DNA, 678 bp, Sorghum bicolor
  Clone ID: 30161938
ctctcctctcccccgtccgttctcctggcggtgggggtgtggcctcctggctcttcctcctcgtcctcgccctcctctcgaccgctagctcacctccccgtcaccatataaaccctatccctctccggtccccgccttgtcgtgacgcgccccgcgccgccgccggcgacaagctcgcaggagcagcagcagctgccgccccccaccaccgatggcgactgccgtggcgtcgcagccgcgccacctccccctcggcgccggcggagagcccaggtgcacggccagcacatcgaaggttcatactctggagaaagtatatggtttcagattcctatgtagaagcgttgttgatgtaaagagccacaaattccactcccgcatttcaaagaggaagtgctacttgaggaactcaccgtcggagtgtgacaggaccatccacagtgctagatggttggagtttcggagacacaagggactcttccagagaactagaaggatggttcacattattccattggcttctgacgatgatggcaaccgtgtatctgttaatggagctccgcaagttggttcgacaagcaacattgatgaaataaggttgaaactgaataaagcattgcagagtgaagatatcagcaatggactcgtccagtcagtacatgatgctgcgagatctat

SEQ ID NO: 23779 - DNA, 655 bp, Sorghum bicolor
  Clone ID: 30161953
ctggtcgcttgtgaaccgaaagatgattgacgcatcccccgcttccgaagtcaacaccgagcttccttgattttcgtctatcgcgcacccgaaagtgcaaggaaatcatcgatactgtttttcacaaaatggcggactctctcgactacgtcaagatctgcgaaagctgccccgccggcgacggttggggtcctacagtcaccacagagactaccctcaacggcgtgccatatgcgcctttctccaagggtgataagttgggacgcatggccgactggacagcagagggcaaggatagagagagaggtggacgagcacagtacaacaggaatttccgagaccaacaagtctatggctctagccacgccatcacctttaatgcccctcccgccgaggacgaatcaacattctcagtcgttagtaacgtccgagactcgacaaagtcaagatacggccgcggggccgtcttcactcgtggccgaggccaacgtggaggccaggccggtgcccgaggcggacgaacccagcttcagagaggcggcgccggtgccgctggtcgacagggctacgaccgaggtggccgatccaatgctggtcgtggtggtcgccgctttggctggaaggattatgacaagcctgctcgtaaccgagacgc

SEQ ID NO: 23780 - DNA, 252 bp, Sorghum bicolor
  unsure (1)..(252): unsure at all n locations
  Clone ID: 30161994
gtcgcaatgctttccgtgacgaagtgcgaagccaggaggaagagaggcgtatgtaaaagaggtgggattttgtaatcttggatgtcatgtcattgctggttttattccaatattcccaaatgacatgttataatgtgcatctagatggctggaagttgggtgtaacgttttcccccgacgcataacgaaaaccaatacgaaanaaagcccttcctagcccgaaaaatagagggaccctgttaagcccccggt

SEQ ID NO: 23781 - DNA, 592 bp, Sorghum bicolor
  Clone ID: 30162022
tccaggtacgcggtgacgcccatgctcaagaccccgatgctgtaccaggtgcgcctcgaggccatcgccgtcgcggggcagcgcctcgacgtgccgcccacggtgttcgccgccggcgcggccctcgactcccgcaccgtcatcacgcgcctcccgcccacggcctaccaggcgctgcgctccgccttcagggacaagatgagcatgtaccgcccggccgccgccaacggccagctcgacacctgctacgacttcaccggcgtcagcagcatcatgcttccaaccatcagcctcgtcttcgaccgtaccggcgccggcgtccagctcgacccatcgggtgtcctgttcggcagctgcctcgccttcgcctccactgccggcgacgaccgcgccactgggatcatcggcttccttcagctgcaggccatcgaggtgctgtataatgtcgccggcggctccgttgggttccgccgtggtgcatgctgagcgctcaataacctaccataccaacctcctagctgcctacctatagccagctactacatgcctatcgctattaaattttgcatgcatgacctaaataattaattac

SEQ ID NO: 23782 - DNA, 633 bp, Sorghum bicolor
  Clone ID: 30162029
ttgttaggggttgtggccgacaaaagattggtgcctttatcaaccttgctgcattctatattgtcggcatccctgtggcggccatctttgcctttgtttgccatcttggtggaatgggtctttggtttgggatcttgatcggagtagcagtgcagatggtcttgctcctttgcatcaccttgtacaccaactggaacaaagaagtattgaaagcaaatgacagagttttcagttgtcctctgcctgtcgacgacacgataacatcaggttgtagcgagcagggaaatcgatgtaattttgttgggaataagcaggatgatgctaatggagcaattgagcggacaaatggtttgaacaaaggttgatggcaataattctggttttctagagattagttgtaggctggtaagtggtaatatgtagcatcaagtggaatgtactcactgctttgtcttcatttgaaagcagagcaaacctagggggtcatgggtttcttttttcccccaataggttcagcattttttgtgcagttttgcgtcccccccccccccaagaagaacacataaggcacaaatttcaaacttgggaagaatcatgaattctaatgttatcaccaagcattacacaattgat

SEQ ID NO: 23783 - DNA, 572 bp, Sorghum bicolor
  Clone ID: 30162030
tcagactgcccctgctaccgctcccgctgccggtactgaggcccctgctcccggctacgaggctcctggtgctggtgggactctcatcactggcaagcccgctgtcggcaccggtggtctccctgctcccaccgctactggcgttcccgtgactgctggtgccgctcgcaacggcatgggcatcgccgctgccatccttgctgttgccattgccctgtaagggtcatgatgcgcttcgcacatctctgtttttccttgttgtttatagattaggtcttggtacctgaggcggaacctgtatgtatgctatgtacacccgcacccgagatcgcttgagcttccagggaagttagacagcgcgctcatccaacatgtatcattcttacgatccttacgaactatgcattagtgtggaaacttgatgtcacatgaggatctggtcagcaccaagtctggaggtcgaagaaaaaaatgaagtagaaaagaaaaagagcaagggaagttaccagttgagccgagatgcacagaagcatatatacccgctggctggttgtttaatgttaatattgact

SEQ ID NO: 23784 - DNA, 655 bp, Sorghum bicolor
  unsure (1)..(655): unsure at all n locations
  Clone ID: 30162047
atttttcgatcaccaacgccggcccaacgcacactgaattgaaccagtgagcgaggtccagctcgatcgaccatggagaaccagcatcacgcggcggttgcgcgaggtggcgaggagagcatcagctcgtcgtcggtgtggatcgagaccaagtagcagctccgcctggccgcgccgctcgccgcggggttcctcctgcagaaggtgatccagaccatctccatcatgttcgtcggccgcctcggcgagctccctctcgccggcgcctccctcgccacctccttcgccagcgtcaccggcttcagcttgctgaccagacaggcatggcgagcagcctggacacgctgtgcgggcaggcgttcggcgcggggcagcaccacctgctaggcatctacaagcagcgtgcgatgctggtcctcgcggcggtgagcgtgccggtgtcgctggtgtgggcgtacacgggcgacatcctggtgtggttccggcaggaccgcganatcgcggcgggcgccggcagctacatccggtgcatggtcccggcgctgttcctgttcgggcagctgcagtgccacgtccggttcctgcagccgcagaacgtggtggtgcccgtcatgctcagctccggcgccaccgtcgccgtgcacgtcgccgtctg

SEQ ID NO: 23785 - DNA, 664 bp, Sorghum bicolor
  Clone ID: 30162048
tggatcactcacctttttcttttcctcttttctttacatcaaagtttctcttttttgttctggtgtcaaagtcattcgtttcctttgactccatttcttaatattctgttctgcatataacacactcgctacacacacaactagttattacccactccccgccaattcttttaccatgaaggccaactttgcccttctggctctcactgccagccttggcgaggtctccgctcactggggcaagtggaaggaggctcccaaatatactcctcccactgccatcgacaacaagtgtcaggagaaccagaaaaaaggctggtactgggatgacctccaggtcggtcagttcgagaagtacaacgattttgatttcaagggctggacctgtggaaccgataagtcgaagcgcgatctcactggccgacactttggcaagtctatctctgctgagtgtggccctgtcaaggaggccgctccctctttcggatgtggtgctggcagcaaggagaagtctttctctctgaagaagttccacgtccgacccgagtttgactgccgtctcgagttccactatgacatgcctgacggctctacttgcaagcaccaggccgactgctctaaggacggtaccgatgtttacaacagccagtgtggtggtgccaag

SEQ ID NO: 23786 - DNA, 644 bp, Sorghum bicolor
  unsure (1)..(644): unsure at all n locations
  Clone ID: 30162056
aagtttgcaactgacattgccgcgccgcgcacgacttccgccctccccaccctccgcccgcctcacgcatatatacgcgcgcgcctgcctcccctccctgcctgcccacgcgctccgctcctcgcgccccctctccacctacgccgccgccgccgtacccgcgggcaggggcacggctggtggctcatcgcccgcccccgcgcgcttcccctccgtccgaatcccaacattcattcaagcgccggcgccggcgccgcgggattcagctccgtccgccggcccgcgcggacggaggccaggcttcctttttgtttccgtattaaagctgttgccactatgatctccccatatgatgcgtagcatttgtcgcttgcaactgtatcgctcctctagctgcacccttgttctagagcatggcgaagctcgcagctcttggtcgcagtgtgcttagattcccaaatggaagcatgaggcctgttatggtaacagttattggagcagtccttggctttttcattggaatttcattcccttcggtcagcataacaaagcttcactttccagctagctttgtttcatacattgaagacnaaaactctggactcacaacccaggctatactcaatcatgcttggacttctgcc

SEQ ID NO: 23787 - DNA, 667 bp, Sorghum bicolor
  Clone ID: 30162065
ggtcccgaaaaggagtcttattgtggaggggaacatgtcagttggatttgtgcttgcttcagctggctgtgatacacctttgcagggaagcattattgagtccttttcccagtttgataaacatgatcatactgctacagttgaaccaaaatctcgtagacaaaaatctccaaatctacctcactgtgccgatgagggggcagatgatggtggctccagcaatcagtcatctaaggtttccagtcatgaaggactgagcgctcatgccacagtaactccaggttttgacagaatcagcgatgtcttaccgacagatgcatctgaacctggacatttgcctgagtgcataaccgcacaggatacaaccatgatttcacagcctgtttgcaggaaagctcatctgagtgctctgcaacatgaaaggggtgagaaagtaaaccaagatctggaagatgtctctgcaagtactcggccactggaagaggaccacgttcatggggatctgactttgcaatctcctagtgctttactttctgtaagctgcaatggtgctaatcaaggaagtaagtctgggaccaatcttcaaccagggactgctacagaggatagtatggcttttgaagagcagaatgcagacaagtcttgcttagaattcactggtgccaac

SEQ ID NO: 23788 - DNA, 676 bp, Sorghum bicolor
  unsure (1)..(676): unsure at all n locations
  Clone ID: 30162081
cgcccttgttctccgtcggcggttattgcgtgtgactaggcagagtctcaccgggaaaggaacgacgtgtcaaggacaaacatcgcatcgtgtcgccgaaggaacaataacaaaacaacaaaaatgcacgcatcaaagatcatcgcctcaattggccttgtggcttctgcccatgccacagtcatccgctatgagcgcgatctcgaagctaatgctcctgctctcgagaagcgagccgaaccgactgccgcttgggttactgtcgatgacgagatgcagcctgcgacgacatacactccctcgtataccaccgtcgatggcaccacttctctgattgatgctcctcctcacgatcttaccgccagcgtctacacctacaccagctggggtaagattcacaccagcactggcgagcctcccaacccccaggctaccggcaagcacggcgagggtgtctttgcgcgatgctacaacaaggatggcgataatgctcctttctgctcgccttacgccaacagcacccttgatgttaagaacacatactttgttacctgngatcccgattacttcaacaagaccaagtcctctgataactctactctcctagtcactgctcgcctcgacctctacaaccgtactagtgaatcatgggtgaaatacaangaattcactgatt

SEQ ID NO: 23789 - DNA, 683 bp, Sorghum bicolor
  Clone ID: 30162103
atagaacaccagccatcagaaattcaagatcgatccatccatctgcacaataatggcattgctggatgagtacagcagcgatgagctactccaggctcagcttcagctctggcaccaggccctcggcttcttcaagtctgtcgcgcttgcagtcgccttagacctcggcatccccgacgccatccatcgcctcggtggtgctgcaacccttcctcagatactcgcagaggctggggtcaacccctgtaagcttcgcaacctgcgtcgcatcatgcatgtgctcaccttatctggcatcttcagcatcaaacaggcagcaacggcggcgtcagacggagaaggtccagtctacaagctgacgacggcatcccgcctcctcgtcaaagacgagagcttgacgaggagccagcagctgcctcctgttctatacacgcacctcatgctcacaccttgccgagaatccacggccggcatgggcataaacgcgtggttccggcaggagcaggatcagccgcagccagcggcgggtccattcgccctcgagtacaatggccagacggtctgggaaagagcagagcacgacgccacgacgttcccgttcgacgacgccatggcctccgacacggcctttctcatgccgatcgtcctcaaggagtgcagcgaggttttccatgggttaacct

SEQ ID NO: 23790 - DNA, 648 bp, Sorghum bicolor
  Clone ID: 30162108
agcaagctaagttgagtaccatccctcgctgctagctgccacatcatcatcacactggttcgaaccagctccggctagagttcgttccaccggcggaaatcctcgccgtacgtgcgctgatggctacgaaagcagcaggccacgcgggcagggaggcggcgttggaggtgtcgtccgtggaggcaggcaaccgcgccgacgccgcggccgcgcggctagacgacgacgatgggcggccgcggcggacgggcacgatgtggacggcgagcgcgcacatcatcacggcggtgatcggcgccggcgtcctgtccctggcgtgggcgatggcgcagctgggctgggcggcgggcaccgccatgatgctgctcttcgccggcatcagctactacacctccacgctgctcgccgagtgctaccgctgcggcgactccgggaacgggaagcgcaactacacgtacacggaggccgtgcgcaacatcctcggcggcgccaaggtcaggctgtgcggcgtcatccagtacgccaacctcgtcggcatcgccatcggatacaccatcgccgccgcaatcagcatgagggcgatcaagagggcggactgcttccacgtcagaggccaccacaacaacaagaagaacccgtgccggagct

SEQ ID NO: 23791 - DNA, 487 bp, Sorghum bicolor
  Clone ID: 30162129
catcgcgcgaggtgaatctcccccaggaatggacgtattgacttgccgaatccggtcaccgctgcaaagatgatcccttccccagattaacgggtcatattcaaggaaaaaaaagagattactattgctgttgctagcaataggtaggtgttaggctagaagtaggaggcagcagcggtggtagcattatgcatcgtgcatcatcagcgttaggtgttcttttgtgcgggtgatatattggttattttgggggtgatggttggtgatggatgggagccgatgaacaagagcgaaatccatggctgtcgcaggtcgttggggggaggaacaataagtgggtgcttttggagaactactcctatggtttagctggttctcgtactatgatgatgatgatgattcccaagaaaaatcatcagcagtctgtttgtgaaagagatgcgtcagtgtaagcaagaagaaataataagagctccatatttccttc

SEQ ID NO: 23792 - DNA, 589 bp, Sorghum bicolor
  Clone ID: 30162131
tgtcttccgctccaatagtacccatcagcttggcttggatttacaccatccttgatgtctcaggagccccctcaaacggttattattattactatttaatgtacgattatctcaagtcaaccctgttaataatataacctcaagatgtatataaaagaatcaagacgtactttattaattagagatcagatctcttcttcaggatattgagatcatatgaatgacaagatgaagaatccaagatacagttattaccctttgcaaaaacaaaaaaataaacacaagaaattgaaattcaaatataaagcttttggatttaaacaagctaatgtttgtaccttatgatgctatccaaatcaatgaaacgaattgttattgactcttaccctgtactctcttacttcatttacctatccattatagagtcattacttgcttacttattacttgatacattattttgtttgttacatattacatatgacatattgcgtttcgttattatatgataataagtcatacatattgagaaagaggaaatgaaagaaaaaatcctctttccattattattttacttttactattaacg

SEQ ID NO: 23793 - DNA, 559 bp, Sorghum bicolor
  Clone ID: 30162136
cgcagcggaatgtaacaagtggggtcctttgggatgggttatgaacgatggtgcccacccaatcatcgacttctactctcaaggcagcgacgacatggtcgatgtttgtgctgaaatgctcttcgatgtcctcggttgccagaacaatttcctgcgcatccaggctgacatgctggagggagacctgttgttgatggactgtgcgactgatgacaacatgaaggcgctgattgaagttggaagtaaggttcttgagcagaaggtggcgaaggtgaacctcgagacgggcttgtacgagcatgtccctgacgggccaaccaacgacaaggcactcgaggaattcgccaagaagctgtcccaggaacgcaagatgcgggcatgcaagtgaacacgtactctacgtcctatattgatttctatatcatgcattctgtgatgttctttgacaaaataatattctatgttgtattatgatgttttagatgcatgtatttcatgattcacgacgtacacatgtgatgctttatgtaatatatatgtgatattctataatgcattt

SEQ ID NO: 23794 - DNA, 601 bp, Sorghum bicolor
  Clone ID: 30162152
ctgccgactgacggcagcaactactcacagcacgcggcggccgtggccaactcagtagcagctgcaacgaagaacaacgacgacgacagctccgcctcctggaacatgcttcgtcacgcggcagacaacaaagcagcaatggggacgaactacagcttgcaccaccaggcaatggtggcgaaagttctaggaagcggctgcggcgtctctccgaacttcggcgctggtttgccgccggcgggttcctcggtggcggcggccggaataattgcgcagaataatgttgtgccgcagcagaggcttgctgggaactacaggggaaattatgctgcaggttaccatacaagcaagtagtaatggtggagctgcgctgcggaaaatttagtgatcgatcgtgtcgttagtagttgtgtggcagttttgttggttgcttgattcattaattagtctgatacaggaggatgatgcgtaacagtttgttggtgaggatttatttccttgttagctggtggtgctcatatatatatatcttttataggtgacacatatagtttggaacttatatataatatagttttggtatcatcatcggatacatttt

SEQ ID NO: 23795 - DNA, 673 bp, Sorghum bicolor
  unsure (1)..(673): unsure at all n locations
  Clone ID: 30162167
aaatttataaggtagggtgggctgagaactttatttttnagatatattttgtgaacttcatcattaatgtatttttaagagggataatagtagagctaagttgatgtagaacttttgttcagcccttcctggcttcatccctgggctaggcggatcagggatcagctgatccactatcccataggtggctagatgggtccggcctccccatgtacaaatctagccaaaggcgatctatggtggcatagtaaatgttagtttagggaagcatcttagtcatgcgttgactacgtgtttggttgatgacatgagtggcctctaacacaaaatggcagcagtaccgtggccttggttgtgcgtctgggcaacattggcagcaacaacttgccagcggaaaggggaggcatagtttggtgctcgcatcgtagtgttgggtaagttgcacttgggtgtggcgtcatgttttgacatcctcttggcataccacacttttgacacatgtgtggatggctctaggcttaagttttggttggtgtgaccgaagctaatgattgtgatgctcatggacgtcgcactctctatcaaggactgcaaaagtctagaccacatcaaactctatacgaaaagtgtaattttctgatactcctaaactctatataaatttaatcaaatt

SEQ ID NO: 23796 - DNA, 288 bp, Sorghum bicolor
  Clone ID: 30162175
acaagaagcagagcacatgaattagctgcagtgaagccacaacatactagaccaaaggaaaccaagtttttggctttggatggtattaaggagttgttggaaagaacagagaatactctgactcaatattgtggataaatggggcgccagatgggctaacccaaaagttaaagaagatttgaaaaagagaagtcagagaagaagaaagacaaggataaaagcaaaaagaagaagaaaaaagataaagaagaaggcattgaaggagtagaggcagaagctatagaaaag

SEQ ID NO: 23797 - DNA, 545 bp, Sorghum bicolor
  Clone ID: 30162177
gaggtggtgaagacgctggagagcatcggtttcagccaggagaggctcccgtccgacctccccctgttccacgagatccaccccaaggaccccatgaaagccttcggagcttgaagaagaagacgcctcggcgcacgattggatcagcgacgtttgctcgatcgtgtcaagtgacgtgctccactcgttgtctgtggtgctgcgcgtgcgacttttccttgtggagatagatgtttttcttccccttgtgagtacattattcagtatgcataaaggactgctgaggccattgcaggaacattttgaggcttaataaatggctttttttttcagtaccgtatattatagggacaatgtggtttcaacaaatgtcactatggaacagttaagcctgtgtcttggatggagccgtctgatgacgaactgacgtacgaaaaaaagggctcaggccttgtttagtttggaaaattttttggttttgattactatagcatttttgtttgtatttcacaattattatctaattatatggactaattagcctt

SEQ ID NO: 23798 - DNA, 677 bp, Sorghum bicolor
  unsure (1)..(677): unsure at all n locations
  Clone ID: 30162196
gcagtcctgctcctcggatctcacggcggaactcggaagtcgtcggtgcagtcagcgagcaaacgagccctcgcggcggattccccgatccgagcaaagcaacccggtcgacatgcggccgcggctggtgctcttcggcgactccatcaccgagcagtccttcgcgtccggcggatggggcgccgcgcttaccgaccgcttcgcccgccaggcggacgtggtgctgcgcgggctcagcggctacaacacgcggtgggcgctcaaggtgctgccgcgcgccatggagggcgcggcgggcgcgggtgcggacccggcggcggtgaccgtcttcttcggcgccaacgacgccacgctgcctgatcaggtgcaggcgcaccagcacgtgccgctccaggagtaccagagcaacctccgcgccatctccgcctacttcaaggagcgatggccctccactgctatcatactcatcactcccccaccgatctatgaaccagcgagaatccgagacgtgtatggagaagacgacccttcacgccnaccagaaagaagcaatgaggctgctggcgcttatgctcaggcatgcatagctgttgccacagaattgaatcatccagttatagacatctggacgaagatgcaggaatttccagattggcaaacatctgcattgagcgacg

SEQ ID NO: 23799 - DNA, 656 bp, Sorghum bicolor
  unsure (1)..(656): unsure at all n locations
  Clone ID: 30162203
gcaagctcccgcgcctacgtcgagccctccctccctccccgcgctctcccagcgccccaggccgcctcccaccgacgcgcggcaggcacgccgcccagctcggagggattcggggccctcgtgttcccccgccgcacccccgctctactggcctggagggggaagcgggggatccaccaggaattgattggatcgccttctcctttttcttggtacgccgccccgccctaacctagcttgctctggatgtatgttttgttttgcctgtacatatcttctcccaagcgggcaatggattccaaatctcgctttctggggtgggtgctctaatcccacggggagaagaaaaaaaaaaactagcgtttacctgaacagtaaccgcatgttgctgtttctcggccatttctatgcaatcgtgaatcagtcccggttttgagatttctgaaatcagatggtagtttacaactttgcatattcagtcctgtcaacatgaaccagaatgtacttgttatttctgatgaagtcagctggcagtttacgtattctcaatcttgtcgacatgaaccaggatatacttggaccgctgctcgcaaacacggngttggcagggcaatccctctttccaaagtgagctcggacaggtttactttgcctct

SEQ ID NO: 23800 - DNA, 664 bp, Sorghum bicolor
  unsure (1)..(664): unsure at all n locations
  Clone ID: 30162204
aatatctttttctttatctaaggcaaggcatctttaatgtcttacagaaactacgtcaagatccttacctatacatggtctaaagactcacatgggctttttgactatgagagctcacacttgttcactggaaaattcaaaatcacaggacaagcccatttctacagaaataataaccaaatccaaatgaatgaaggaaataacctcgttgaccaaattgaaaatgatagaaactcactcctatttagcattcatgaacataaagaccaaaaagataaatactatctctcgcttggaaccaaccttaatcctagccaaagtctcggacttgccgttagaggcattaaaaaggatagccaccctgctggatatgagctcaaagtcggagaccatgtcaaaatcggtcgtgtcagattcattgtcagagaaatcaaagacgctgagggaaatgtcaataaactccaaactgctcagcagatcaactatctnaaaaaaggagacatacaagaagaaactgagaatcccagtcagaatgtctgcaggatctgcttgaccgaagacgggtacactgatccaattgaaaacaccctgattggcccttgcaagtgtaagggaagctgtgaatatgtccacctaanatgcttgaaacaatggatcgatagca

SEQ ID NO: 23801 - DNA, 634 bp, Sorghum bicolor
  Clone ID: 30162225
tgaaaaaaaaatcgtgtccgtgctggccattattatttcttcctccagcggcaatttctggccggccaccgggcaggcgtgctatattactcgggttcgtggccgtctcgttccgtccaagcatgcagagtggcgtgtccttccttggcggaatggcggaggagtgcccaaccgctggcggcgcggagctctggcttcccgacgagttcttggatgatgacttcttctctgaggaggagaaggcggcggtcgcggccaagagcgagagcgacgaggaggaaggggtggacggcctctcgcgccgcgtggctgggctcgtcgtcggcaacgggaagggtggaggagacggttcccctgcaaaggcggaagtgctggccggctcgccgcagtcgattctgtgcggcctgcatgcttctggggaggacagccccaacggcgtggcgtcgcaggtcagctcgccgccgtcgtcgccgctggagcaggcgccggcggatccctgggacctgctgagcgaggcggccggccaggtggctcgcttgcgcacaaccagcatccccgtgccaacgaacgcggccgccaatcaaggagaccccgtcatggcgccgccagcaaagaagctctccgcgccgaccga

SEQ ID NO: 23802 - DNA, 664 bp, Sorghum bicolor
  Clone ID: 30162226
caggcttgacttctcttcctcttccctcctgtattggtcgagccacagataattaacctcctcctttactcttgcttcaactttcttgtctgatcttgcctttgctaagcttcaatgattagctctcatgcatttcttctctccctgcatggattagccatggtttccacacttataacaaacactgaagggcaagctttttgcccttctttctcctgtgggcatcttcaagacatacgatctcctttccgtatgcaaggtgatccacaaggttgtggttttccagagtatgagctggtttgcattgatagcaaggctataattcacatcaacagtggaagatactttgtgactaacatctcctacactgactctactttctgggttgttgatgccaatttggataatagcagctgtcccattcctgcgagcaaccaacatccctatataaatggtttgcaatccgaaggcagcaccttgctggatcctgatacagtaacttgggctgcctttatcacttgttcagagatgctaagtgatgttacttccttgttcagcagatgctgtagtggtatttacaggcctgtcaattgccgaagtacgaagaattcttttgattatgtcttcactaccacattcttcccaatggttggatacatcaagc

SEQ ID NO: 23803 - DNA, 641 bp, Sorghum bicolor
  Clone ID: 30162234
ggggagacaggcgaacaaatcccatttgcagaattaagctagctagtcctgaattaattagttagctactacaatggaatccaacacagtgctcatggcgctcccgccagcgcagcagggaagggttctcactgtgttgagcatcgatggcggaggcatccgtgggatcatccctgcaaccatcctagctcgcctcgagactctgctccaaaggatagacgggcaggacgccaggattgctgactacttcgatttcatcgctggtaccagcaccggcgggctgataacggcgatgctgtcggcgcctggcaaggacaagaggccactgtttgcagccaaggagatcaaccagttctacctcgacaatggcgggcacatcttccctcgcgctcacggctggtggttcgacaacatacgggaaaaggttatggacatgtggaaaaagatcaagggaggcccgcagtacaacggcgagttcctgcatgacaagatcaacaaactgatcaaggacaccaagctggcggacacgctgagcaacgtcgtgatcccggcgttcgacgtgagccggatgcagcctgtcgtcttcaactcgctggaggccgagcgggacgccgggaagaacgcgcgcctcgccgacgtct

SEQ ID NO: 23804 - DNA, 500 bp, Sorghum bicolor
  Clone ID: 30162281
tcaggatcaccgtgtcgttgggcatcgcggccgccgtcaggactcgctccagcctcgcgtcctcgctctcgctgtcctgcacgtacgcacgcagcagcagcaactgcaggtcagtttgatctgcaggacacgattagcctgttcactcgccattgctgcactgcacaaggtgaagactgaagattctggctgtctcgtctcactcggcatatataatccaagtggccgcatacacaccatgatcgacattgaatcacatggcatggcgattggcgactgctacaaacagaagcagaattcttgcttgcttcgatttttgaagatactcagcactaaggtttacagaaagaggcgaggttgtctagtccagtggtttatactccactagtgctagtggtttatgctacaggaaattgcgaacagtatttcgtcagttattttttcaacaaagtatttcatcagttcacccatgcttctgatgaaactgaaataattagcgt

SEQ ID NO: 23805 - DNA, 433 bp, Sorghum bicolor
  Clone ID: 30162292
gtccgcgagctgcacaagcgcaagtttgatgccgtggtagtgtcggctggccccgcgaacgactcgaagaaaaaggtgggtgaagtgaaggctatggagcaggataaaaagcaggacgaaaaagaaagtctcgaccccctcccagtgacctgggtattcccttgttgatgtctggtggaccgccactcagtttttgcctctaacctcatgagcgacgtgcgccctcaccggtcgccatgtaggcgtagcatagagacagtggccgcgctgcacgccccgcaccgctaggagcttaggacactgggaaccagtgccgccactacgtcatgcctggtcggctagggttaggggttagagatttaggaatgaggattatggaattgtctcccactcatgccttgttaaaagaatagttcgtgatacatgttatcag

SEQ ID NO: 23806 - DNA, 589 bp, Sorghum bicolor
  Clone ID: 30162309
cacaaacatccacttcaagcacaacaacaacgtggacagtatatctgcacgactacatttggaactggtgggtgtagtggtgctgcatgtttggggtgtgttcgggaatgtggaactccatgcgcgggttgatggtattaggccacgggacggacctcttgtgcaatcgtctgatacccgcagcaactgctggatctacaggcacagggggtggggtggttttgaaacccaatccagcgtttacatcacgtgtagcattcaccctgactggacactcattatgcatcaatgcgttctgtgtggctctgattacgtcatagcgtgtggcttcgaaggcacgattcacactactacagccatgtactttaaagcacgcatttctcgggcgctgtatgagttcccaatacgttatgcgtggatttttcggcagcatgtgtgaattctggaaacgtgacgatgctgctcgacttccttgcatgatgcctgtattcatgatgcagcatgcatatgtttcccgtactcaggttgactgggtgccatcacaaataacggtatgccatgcatgcggctgtaaattgtaacccactcc

SEQ ID NO: 23807 - DNA, 485 bp, Sorghum bicolor
  Clone ID: 30162312
actggtatgctgcttgtgcagcttactgtggcggcatctttggatacgtctgctacgatctcacacattacttccttcaccaccaagaccttcctctgtggtacaaggaactcaagaagtaccatcttgctcaccacttccttgactacgaactcggttttggtgtgacgagcaagttctgggacagcgtgtttggtactgagctgatctacaacaccaagaagacgaaataagtctttaataatgcacgaaatctgcctggcgcaagagaaaccaattcaagccaggacacagtatatatctgtcttgcttccatagtagttggtgaacactgggttgtacggaacagtcatgattttatggatggtaacgaacatggtggtcactgacattaatggcgatgaatcattctcataaatagttttaatggttgggactggtttgcccaatgggtcggtctattcttggacagagttaatttaata

SEQ ID NO: 23808 - DNA, 582 bp, Sorghum bicolor
  Clone ID: 30162313
tacagaagaaccgacgagcccctcagaaagtccaacatcatcgtttatgccgtttactccatgcttattgattgggccttcatttacatcattggttccatgttgagaggctactacgttgctaagcaccaatactacaagactagagaagaagcctggcaacaaaagtcccagaacagaatcttcggtttctacttctgcatcttcttgtgcgctgttgttctgtggcctttctgcgtctggaacatgagtgaattgcaccctgaaaaggatgacagagcctccaactactgggttgcctccttcttcattggtttggccttggaattcttgatcgttgatcccatcgtttgtatcttggccaagagcatcactcccttgagaaacttgatcaagcacagaggatacttctatgataacctctgccacgaaacctaccttgatcacttgaaggtcgactaaagcaatgttggataccaaactcgatttatcgtaacgtcgatatgatttatgaactatgaaattattgattaaacaagatttatgatctatattgaaattatgaagatactataatctcat

SEQ ID NO: 23809 - DNA, 647 bp, Sorghum bicolor
  Clone ID: 30162320
gagacatggtttcccacaaggatcccaccagacaatttgacaaagctgactattatgctcatccagaacactacgcccctgtttttcatgaaaggattgctccatatgcatctgtcatcgtaaactgtatgtattgggagaagaggcttccaccattactgagtatggatcagttacagcaactgatggagactggttgtcctttggttggcgtttgtgacataacttgtgatattggaggttccattgaatttgtcaacaagagtacatcaatagagaggcctttcttccggtatgatccttctaataattcataccatgatgatatggaaggtgccggagtgatctgcttggctgttgacattctccctacagagttctctaaagaggcctcccaacatttcggaaacatattatctaaacttgttcctagtttggcctcagtgaagcaactggcagaacttccttcctacttgagaagagcttgcattgcacatgctggcagattaactccgttgtatgaatatatccctagaatgagaaatactatgatgtaagcttcaaatacttctattcttcactgttgtatcctctcagatagttctattgtacgatgtgatccataaagttgcaaaccagttagatga

SEQ ID NO: 23810 - DNA, 660 bp, Sorghum bicolor
  Clone ID: 30162328
cgacgagatcgagaagatggtcaacgatgctgagcagttcaagagcaacgatgacgctttccagaagaagttcgaggccaagcagcaactcgagtcctacatcggccgtgttgaggagatcgtctctgaccccactctgtctcttaagcttaagcgtggccagaaggagaagatcgagagcactatcagcgacgccatggcggctcttgagctcaacgagtcttccgctgaggacctcaagaagcaggagcttgctctcaagcgccttgtcaccaaggctatgtcttcccgataaatgcacaatgttgttaggaattgcagcagtgtagatattttggagtactgatgctggagcaaagaaccgagcaccctcgacgcctcgcgaggggcgattgggtttacgactggccacggtggattttcctttgtcgtttacggtaattggacgaggagaagccaaggcatatgaaaagttctgcatgtttcatgggtatgccgcgctaggacatgggcggctatgactactaaaatgagagctgatggaaaaatggtccaaggatgtttgtgggcttgttgggccagagcctacgagagcggttgatggcctgtgaatttaagcatagacagggtagaatgcagatacagaatgagctttttcct

SEQ ID NO: 23811 - DNA, 651 bp, Sorghum bicolor
  Clone ID: 30162333
tctggaactaatccttaacccccctctcaggtttcgaccattctatccttcactctccttcagcttccctcctttttcatcctccttggttgtcgacgaggagcatctctgcttgtgcgctgctcgaatcgtcttgtctccccatcctcatctcgacccgtacgttccgaccgctgcttcaacaaaatgcctggacgtactctaccaactttcactcgcgctgaggtggaagcgcataactctggtgactcctgctatgtcactatcggcaacaaggtctacgatatcactgattttgttgaggatcatcctggcggccccgaatatattctcgaatacgccggtcgcgatatcgaagacatcctcaaagattctgattctcatacacactctgactcagcctacgagattctcgacgaaaaccttgtcggctttctcgtctctgagaaggctgtaaatggacacgccaatggaaaggccaacggcaacggacacgcaaagctacctaatggtgaagccaacggacacgcaaatggctccgttcacccccgaaccgggatgtcttgcgcggaggacttgagtaaggatacagactataacttggactacaagaagaacaagttcctcgacctgaaccgacctctcttccct

SEQ ID NO: 23812 - DNA, 666 bp, Sorghum bicolor
  Clone ID: 30162348
aatttcctttcttgaaaccccacgttcttcttcttctcctcttcatccttcttccctttccccacaaacctttcagacaagacaaaatggcggacgaagtgtatgacggtgccattggcattgatctgggtactacctactcctgtgttgctacctacgagggtaccaatgtcgagatcatcgccaacgagcagggttctttcaccaccccttctttcgtttccttcactgataaggagcgtctgatcggtgaggccgccaagaacaacgctgccatgaacccccgcaacactgtcttcgatgccaagcgtctgattggtcgtcgtttcgatgaccctaccgttaagaaggacatcgagtcttggcccttccagattgttgatgacaacggcagccccaagatcgaggttgagtacctcggcgagaccaagcagttctctgcccaggagatctcctccatggtcctcaccaagatgaaggagattgccgagaccaagctcggcaagaaggttgagaaggccgtcatcactgttcctgcctacttcaacgacaaccagcgacaggccaccaaggacgccggttccattgcgggtcttaacgtcctccgtattatcaacgagcccactgccgccgccatcgcttacggtcttggtgccggtaagtccg

SEQ ID NO: 23813 - DNA, 647 bp, Sorghum bicolor
  Clone ID: 30162358
agttttgtctggtgataacggttgttgtttgatctcaaaaacaatcttgaaaatgcagacccttcagagcaggagcacctccgttcgttgcaatgctctgttcaagaagcagggaactcagacaaccaagccagctggcactgccaagaaccagaggaaggctgccggtactgtgaccaagaaggctgtaggctacaggaagtacgatggcgaggctctgtggctgccaaacactgagcgcccagagtggttggacggttctctgccaggtgacaggggtttcgacccactgggtcttgctcgcccatccgagttggtgcagattggtctggacggacaggaccagaacctggcccagaacctgaagggtggtgttgaggctgtgttcacccctgaccgtgacgaggttgccccaaccccactggctccatacagcgaggtcttcggtctgcagaggttccgtgaggctgagctcatccacggtcgttgggcaatgcttgccaccctgggtgccgttgtcggtgaggcctccactggtgtgtcctgggttgatgccggtaaggttgagctggacggtgcaacctacctgggcctgtccctgcccttcagcctgacacagctgatctggattgaggtcattctggttg

SEQ ID NO: 23814 - DNA, 663 bp, Sorghum bicolor
  Clone ID: 30162371
gattgctttcgccggatggctccggcgtccgcgatggagctggaagcaccgcccccggcgtcagcatcggcggcggccaaggagatcaagtcgccggaggtgctgccggagccaagctcgctgtcggcgctgcagcggaagaagctgggcgcgcacttcctggagagcgacgagcgccgcttctcccgcggctgcaggacgccgctgggcggaggctacgacgagccgccctcctctgccgccggcgccggcggcaccacgccggtgaacatccgcggcgagccgatccgggacctgtcgaggaccggtgggtgggtggcggccttcttcatcttcggcaacgagatggcggagcggatggcctacttcggcctctccgtcaacatggtcatcttcatgttcaaggtcatgcaccgccctttcaccagctccgccaacgccgtcaacaacttcctcggcatctcccaggcgtcctccgtgctgggcgggttcctcgccgacgcctacctggggcggtactggaccatcgccatcttcaccaccatgtacctgctgggcctcatcgcgctcaccgtcagcgccagcgtgccggcgctcgtgcccacgcaggagggatgcgacaagctcgccatgctgctgggcgcctgcgcgcccgccgcgccc

SEQ ID NO: 23815 - DNA, 463 bp, Sorghum bicolor
  Clone ID: 30162380
atggcagatcgagcatctcctctaagttctagtagtagggataggaatcagggtcagtttcctctcctggctgtagcagcagcagcagcagtggaaggggcatgcagaggagcacgagggttggctggaagccgacctacgcctcgctggctctcctgtgcctgcctcttccattccttctgctacgctatgattgcaacagtcagagctcagaaatgcaagcatctgcaattgccatgtgaggcaacaccgcaacggcattggcctctccacattccacctctgcattgtaagtttctcagtcatttctgaacctcaattgtgttatattagcaggtgaatcacatggagagctccaggacttctgaagtctgaagatagaccacggatgcgaacgccacggtcgacacagatctggcgggcaacaatgtccaagtacctgcatgtgaacagatcgaggggc

SEQ ID NO: 23816 - DNA, 635 bp, Sorghum bicolor
  Clone ID: 30162398
cgtgtcactctatataataggctaggcctaagcaggcgcatgtgaccctgccaagtttctgaggttgactgaagtgtgccaatggacccatctcagcctgcatacgctgcagcatcttacctagacttcatcaacgaggatgctgcatcttccttatttgcggacctgctggacccacagacgctgaatgccgtgtgcactattgagcagacgttgcctcgtcctgaagaagtagcttcgacaaggaaacgtctggcagagcatgacagcgattccgacgatgaagactttaaggacggcaagaacaaacgtggtaaaggtgatggatctgctagcacaacagcggcaaggaaggcgagcagagagaaggccaggagagaaaagataaacgaaaggtttgctgagctggcatcattgattgatcctggaaacgagcccaaaaccgataagccgaccatccttgctgacgctatcaagtacattcaacagacgcgtgtcgagaatcatcagctcaaacaattgaacaagtttttggaagagcgtgtctctcagtacgaacgcgagcgaggacaagcactgtaccagcaaatgctgtccaatcagatgatgccaggatttggaggtgcaggtgttct

SEQ ID NO: 23817 - DNA, 669 bp, Sorghum bicolor
  Clone ID: 30162406
agacccatgaaaaaggcttgttccctccgcttagaagagctatattgttgaagaagagcggaaagaaggagcttgctgaagcttctttcataaaattccaagagaatttctcacaaagaaataaagaggaccacccctgtttcttctactatgtgattggaaaagcgtacgagaaatatttggatgacgacagctatgcaattttccattatgataaaggctctagagctgaaagcagcaacgtctctgaatatctcgtcatgtttaatgaatattggagattcaggtgtgaaaagagaaaagaaaaattgatccgcagaagcaagctcagaaagttagccgccggtgttagtactggtaaaattgctactgctgctcctgcgaccactccataaaagacttggcttcaaagagattgtagatgttttatgaataataattattattcagatttttcaacgcgagaatctggaaatagagttcgtactttaaataacacacaatttatatattatgatttcatttcatttaggtatgtgtataaaaacttttcatattcgtagtgatttctcgaggaaaagacttgcctagatttacccgaatttatactaaatttcataatttatcctccttgttatttgtatttatccctctctcgactgatgattt

SEQ ID NO: 23818 - DNA, 641 bp, Sorghum bicolor
  Clone ID: 30162409
atttggaaggtatcaagaactggctcgataaaatggacattattttctctgaagctgctgtcaacttcgattggaataaaattatgagtgaagttagaactcaactcagaaacaacccccaaaagttccttgaagatggtggttgggacttccttcaaccttctggttctgaaggtggtgaaggtggtgagggcttagaagaaggtgatagtgctttctccgtctcctccgaagaatttgaagaagaaagtgaaagtgaattttctgatgaagaagatgaagatgatgaggacgagtctgatttcgaaggagattctgatcttgaagaagaaggtctttcatgggatgaaatggaagaaatggctgaaaaagaggacttgagaaagcaaatgaatagagactccaaagatgccaagaatccaaagatcccaatgaagggtaacagcaagccaccaatgaaggctatgagtaagcaacctcccaagaagatgaagagataaacaaagaagaattctgtcacattaactattagaatttatatataattgatattaatcctgttgcttactttgaaatatggtatttcgtaagaattttgggaaaatcttcaaagagtttatacatattttgacctttaataa

SEQ ID NO: 23819 - DNA, 655 bp, Sorghum bicolor
  Clone ID: 30162432
gaagattagccagtctttaagaagtctaaatgctcaaacaggattgtttactaagcacatgaagattatacaccaagaccccgaattgcgtgttcaaagagttgctgcaatcaagaaaacaaaaggtactgctgttgcaagaaagcgtgcttcagaaattcaaaaggcattcttcagtgatcctgagaaccggctcaagagaagcattgccatgaaaggggtgaaattttactgcagcaaatgtggacaagaaggacatagaagcttttattgccctacagtgaggaaaggttcaactaggctgcggttcaggtgccggttgtgtggaggagaagggcataatagtcgaacatgtggaaaaccaaagtccgagaaggagcaccaacaacaacctcggcactgcagccaatgtggtgaaaggggacacaaccggcgtaactgccccacatccactgatgtgggcattggtgcttcaggttatgtggtcaacaaagttaatggttctaattcagctgtttattcatgtagtatctgcttagaaaaggggcataacaaacgaacatgcccgaaaagaaaggctaccctagtaaatgaaaagtgtgagtagttaaagttgcatactaatcgagagcaatcatgtgaaagacctgctata

SEQ ID NO: 23820 - DNA, 611 bp, Sorghum bicolor
  unsure (1)..(611): unsure at all n locations
  Clone ID: 30162442
gcctctagatcccatgcgaccccttgacgagcaacgacagccacagagcccgtccgggtccgggaggactggaggtaccagctcaccggggcgacagcaccacaccacacgccgccgccgcccacctccctcccgttactcgtgggatgctagtaacgtgcggccagcccgcggcttccgcggtggcccgccggttgaggctgcccgggcgtgcgcggccagcgccgcgtttacgccgacgctgcgtcgctgcttctgcgtcggacggcgccggcactccaagctctccgctccactgcaaccctttggcggatctcctggggccggacgttgaacccagcggctcacgctcacagagtacagctccaattacagaaaaggggaaactgaggtcttgggtcggtccaaatgggcagtactaccgtgagctgccttgccccagctgtaggggtagaggttacactccatgcaaggagtgcggaatagatagatcaagtttggactgccctatgtgcaatggcaaggggattcnaatgtgtctacagtgtagtggagagcgtgtgatatggcaggaatctgttgatgaacagccatgggagaaagttcggtca

SEQ ID NO: 23821 - DNA, 244 bp, Sorghum bicolor
  Clone ID: 30162443
gctcactggtctgaatgtgcgaactcagtacaccgttcagttcttctacctggtcttcacgcctccccaggcgacaacctcatgtgttcttgaggcattcatcggctcgcagaagttcttcaccactggaattttctccaatggtgctagcgtcagctacaacgaagtcttggtctctacttctgccccagctacccagggtttcttgaacatccagactacctgctctgctggaggatctgct

SEQ ID NO: 23822 - DNA, 644 bp, Sorghum bicolor
  Clone ID: 30162457
tctggaaaaaaaacaaaaaatttgaaaataaacaattgaatttctcagcaaaatatcatttcttccccatgagttgctttgatctcaagacctggctcaccgaattctatcctcttatgaactggaagcatgactttgctgccttcataggtcccgacgtccttgaaaaatctgcttctgaggacaacggtctcactctattcatccgagccctcaatgctgagttcaccgagaaggactacacaaaggctttggagctgtaccacgaaggcgctaaatatatcgaccctttatgcttatttaggcttcatgaaatcagtctgggtaataaatttttcggaacagagtttgatgaagtgaaatctattgcatatcttttatggagcgcccagttcgttctcgatatcaacctcaaaggacctatcagtcctattaagaagttggtgaagttcctgatcggcttcgataaaaacggagagtattccgtcaatttgatccttttatatgaagatcctcatcttgctccttcaagagaactcgtcaagtccttattcctcagaaactactttaacaacaccgacaagaagcaaaacgaagaacacctcattgctgcagtcaactctttatcttccaagactccgatc

SEQ ID NO: 23823 - DNA, 613 bp, Sorghum bicolor
  Clone ID: 30162459
tggaggaagacggaagagacacaattccctagaaaccgcccaaaagcttcctgcaatccggcggctttggcgttgaactcccttccttgccttgtttgattagcagtatcggctgccaaagatttctcttttttatttttctcggttcggaaggtgcagcgcaggggagggaaataaatcgctccggcgagattcctgtggagatgagttaggtgcgaggaccactcataaattccgccctgcccgttctttcagatctgctccgtgctgtgcatctgctgctgccttgcgtttctgttctggtcacccatgcgtcgtcgccggagcccaatctcgccgctcggagtttcttgacctggtcggagtttccatttccccggtggtcaacttgttcctctcaaaggttgaattctttcaccccgaggatttcgtcatttcgtgtcgactcgcgctgatttgatttttcctttttctggagcagtccaccgcttccagtggaggcagaagcgtgttcttgaagcagagctcaattcctgcttgaaaatccctccctttccccttttcccttggtttctttgctctcgctcgcctttgccgcgatttgcttgctcca

SEQ ID NO: 23824 - DNA, 674 bp, Sorghum bicolor
  unsure (1)..(674): unsure at all n locations
  Clone ID: 30162461
ctactggaattttatcttaaaaaaaatatacacacacttgagaatcaaaattatgagcgctaagcctcaagtttcagcccaaaactttttcagacgtgttaagagcctctatactcactggaaagacaccaacaaggagttttctgacattgatgccatctgtgtccaaaatggtaaagatgaagaatctatgaaaatcaaaaccaccgctgtctatgtatggctttttggttatgagttccttgattcatggctcttcttcacaaagaatggtgtcattttcctcgctagtcaaaagcatatttcatatattgaacatttcaacactgaaaaaggagactttaatttaaaccttgatctcattgtcaaggatgaaacagataattctagaaactttgagaccatcaaagccaagcttgaagccgagtctgacctctccagtctcaagatcggtaagctcgtcaaagagaagcaagtcagtgcattctccaacgaagtcgaaggattccttcaaaaactctccccttcttatgttgaaattggcccactcgtccaagaatgtctctgcgtcaaagaatctgatgaattagaactcgtcagaaaggcaggcaaagttgctgtctggttcgaagacnaagtcatcatggaagttgaaaatatcattgacaacgaag

SEQ ID NO: 23825 - DNA, 325 bp, Sorghum bicolor
  Clone ID: 30162513
cctcacatttgagttttgtgcccgagaagctagtcagatttttggtggtctgagttactctcgaggaggccagggtgccaaggtcgagcgattgtaccgtgatgtgcgagcatatgccatccccggtggcagtgaagagattatgcttgttcttagcatgaggcagagtttgagggttgcaaaggccgtgggcatgaagctgtaaaagccggagttgagatcatttgtatttatatatatatggcgcccccttggagttacttatttggctatgcccttggtctagatgtcaggccgagtagagcgaataatgaataccagtttt

SEQ ID NO: 23826 - DNA, 453 bp, Sorghum bicolor
  Clone ID: 30162524
gaagggcagagtgggcgaaagatatctgctcaccggagagaacgcgtcattcgttcagattttcaacatagctgcgaatcttacgaacacaaagccacccaaattccacatacctctacggttgcttgccatctacgggtggatttcagtttttgttgctcgcatcaccggaaaaccccctctaatcagttaccctggagtggattgtctcagacatcagtgggcttactcatgtgacaaggccaagagggagctgggctatagtccacgaagcttatctgaaggcttagcggagacactcttgtggctaaaaaatgcaaacttgatcaagttttagttctctacccattttaatttgatattccattttgataataacgtcatattgttatcttaaagaacttgcacggatgatatagaaaaaataaggtaagaaaaagtgaggcagaaagc

SEQ ID NO: 23827 - DNA, 601 bp, Sorghum bicolor
  Clone ID: 30162546
actgctcccactacagtaccagtacatactgcctctctccctttctgctagctagctcctggcctggtggtcgtcgtcaggcatctccctcctcctcctgtgccagccttgtacacctgcccgcacccttcttctccatctatctatccccttcgtccctcctcctccaccgcccttttctttccccttttcctcacacccctctttccaatttgtgctgactgctgtgctcgccggccggacggctgcccggcctcatctctccaattcccccttcctcacctcaccacgcctccactagcgctagctagacacttccatctacatgcgcgcgagctacctccactactcccgcgcgcccatcttctccgatccggccacctctccataattctgccgaagcagcagcagcctagcctgctacaggctagctagctagaggcgagatcgacccaccagcgccggccgggcgccgggaaggcgcaagatttcgcctttgattccacgcgccacgcaggccggcatgcagcagccggccatgccgccgccattctcgcctgccgcgggtacggtttccgcggcgggccagcacgccacgccc

SEQ ID NO: 23828 - DNA, 612 bp, Sorghum bicolor
  Clone ID: 30162556
gcctactgagatccaagccgtgcctctgatcacgagagtagagtcaacaccccagcacgacgtgctcgtgtcgcgccatctctggcagccgcccaacgccgcagcatggatctctggtctactacgcgccgcagatgttgtcggacctcggacgcgttgcattgatcctggggaggcgacggcgacggcggcgtgcgagtcaagaggccaatatcccggacccatacgcgatggagattcgagaagaagccgctgttggcggtgacgataagctcagagtaacgacgactggcgcgcgggccccgcccgtcgggcttggacgcccgcccgcgattggcgggcctccctcccgttccagaagtactggggggcgaagggcagcagcaagcagcacgcgcccccacgcatggcgtgccacggctcgcggccgcgccccccacgcggcgcccatgcgcgcgccctcccgtgtggtcggcctcgggcgcctcgcgcgcgtcaccggtgattcggtgaccggataagcctattcagccgtcccatccctccgctctcccgctcccggatcgccgcgagctccttttttgactcgcgtcgcatctcctctacgcctac

SEQ ID NO: 23829 - DNA, 172 bp, Sorghum bicolor
  Clone ID: 30162567
ttattaattatacttcccggcagcttccatgcttaccaaattcctcaataaatccatccctttcaccagaaacttttctctctggaaaaacgtcgaaatgggccccactgaccccatccttggtatcactgaagccttcaaaaaggatcccgctcccaataaagtcgggctc

SEQ ID NO: 23830 - DNA, 559 bp, Sorghum bicolor
  Clone ID: 30162568
acgccaccattcttcccagttcccacccgtgcctcagcaattcagcatcgccgattcgccgcggcaccgacacctcgccggccatgggcgcgtcctcctcgaccggcaacccgtccccagaggcgcacgagcagcgggagcaggagaccctcgcctccgccgccctctccctcccgctcctccgcgttgccttctcccgctccgccgccgccgccaacgccaacgcgctgccggatgccctcgccccgccgcccgcctcctaccgtctgcccggatccccgccgctgccgccgcacttccacggcatcctctcggggctcggtccgaccatcgcctcccagttcttcggccacggagctgccgcgacgccggagggggacgccgggtgggtccctttcctcagggggttcaaccgctgctgcgcgcgcgtgccggcctcccgctcgctcgcgctgctcctccgcgtgtacgccgccgcctgcgccggcgcgggggcaccgtgcggcgtcctgctccatccggacgagggcggtgacgaggacgggaaggtcgttgggga

SEQ ID NO: 23831 - DNA, 583 bp, Sorghum bicolor
  Clone ID: 30162590
ctgggtccaagtctttaccacaagcgacgttgcgtcgcataagaagcccgacgacttgtacatcatcgtcgatggcgatgtttacgatgtgacaaaattccaagacgaccacccaggtggtaagaagattctccagcgcgtcggcggcaaggacgcttccaagcaattctggaagtaccacaacgagggcatcctcaagaagtacaagaagcagcttcaggtcggatcccttgactccaaacccgcggcccccaagcctaagcctgaggccaatgctgctccggtgcccgcggcccctacacccaaggccgtcaagactacacagaaggaggttgctgccaaggaggaagacgccgaggctcttgagcctttcggtgaccagattccctttgctgaccctgcctggtaccaaagctaccattcaccatacttcaacgaatctcatgctgctctccgcgccgagatccgcgaatgggtggagaaggacatcgagccttatgtcaccgactgggacgaggctaaggaggtccccgaggagatctataaggagatgggtcgtcgcggttatctcgctggtctgctc

SEQ ID NO: 23832 - DNA, 557 bp, Sorghum bicolor
  Clone ID: 30162602
ctgggaatgaggacgactaaagagagcagcagggggagggaccaggtcagcgcgtgcggtgccgtgccgtgccgtgccgtgcagcgacttggtacgtgggggctccgtccgtcggaacacacgcacacggcgggctctagctcgggtggtcaccagccatatcatgagggtggtggtgacgggcgcgacggggttcatgggcggccgcctgtgcgcggcgctggccgacgccggccacgacgtgcgcgccttcgcgctcccgggcgtcgacgtctccggcctccccgcagccgtcgaggtggcctacggcgacgtcaccgacgaggagtcgctcgccgccgccttcagcgggtgcgacgccgtgttccacgccgccgcggccgtcgaggcgtggctccccgacccctatgtcttccacaccgtaaacgttgggggacttgagaatgtattaaaggctgccaagagaacaccagcgttgaagaagatagtgtacacatcgtcatacttcgcaattggcccaacagatggttatgtcgccaatgagaaacagattcatc

SEQ ID NO: 23833 - DNA, 253 bp, Sorghum bicolor
  Clone ID: 30162619
atctcagttggttcaagagaagagcattgacgagtgtgtcagagctgcctgttacgccgccaatgttatcatccaacgttctggctgcacttaccctgaaaagcctgacttcaactagacccatctaaaaatcgagagagttataaccatacttctataggccacagtcttatggcatctgatctgtataattggtcgtatcagcagattcatcttgatctatctgcggtacattgtggtgtcaccttacagg

SEQ ID NO: 23834 - DNA, 595 bp, Sorghum bicolor
  Clone ID: 30162635
cagatcgattgagaagtggttgatgaggggtgtcattgctagcttcactatttttttgtttcgccaaggccaacattagtggtcaggactagattatgtcatggtagttacatttgtttatcatgggatgctttgtgtattgcaacaatgtgagatatgtaagaagccgtacgaaaacttaaggaatctttagatttggcggctatagactcaaagggcacagacaggctgctggtacagtttttttagctaactaaagtccaacttcctttgccgaaagaggatgaaacggatcagccgattcaacttagcattacccgactcgtaacttcaagcacaaccatccatctcaatccaaaatctccgatcgtctgtgatccctcctccggtttgggatatatagacagtgcctgctctcaaaccaaccaagacagcagcaagttcctatcgagaacaagacgacagatcaatatgaccaatttatctaatatgttcccttgatgtgggctggagagacatttccaagttattgcagtttagaaaaagggtaaatggccatttaaagttgaaatttacctcaatcaaccttgattca

SEQ ID NO: 23835 - DNA, 394 bp, Sorghum bicolor
  Clone ID: 30162637
gagacgtacgtctaccaggtgaagagcgcggtggtggacgacagcaacatggccgacaagatgaacgccgacgagaaggagaaggtggaggaggcagtcagggaggccaacgagtggatcgaagtgaactcggatgccgacaaggaggattacgaggagaagctcaaggagctagaggacgtgtgcagccctgtcatctcgtcggtgtaccagaggtccggcggtggtgcaccggcagacgacacttacgatgaggatgaccatgatgagctttagggacgactaggttagattgtcagcattagctagctcttaatatagttctgtgtctttcctttacagtagccagtagtaatttcaatttgtaatctccatctaggtattatttctcttt

SEQ ID NO: 23836 - DNA, 409 bp, Sorghum bicolor
  Clone ID: 30162650
ggaggaggagagggagaaggcggccaatggcaggaaggggtgagccggtgaggtggcggagcgggaggggaaggaaggcccacagctcgggtgtgttgacttggtcgacgcagatgcggtggcttgattccactggcgggtttgactcggggctccgtttcccaggggccacggctaggtagatgctgaagcagggaagcgggagcctagtagtagtagtacatacacgtcctccttggtgaaacgcacagtactcctactactgtcaacaaaagctaaaatatactactagaaaagcacgtatacggcgtggaaggccactcttggaagaatgacgagtggggtctactagtgttgcattcacccgtgatgactgatgatgggaacctaacacacacaacaggtagta

SEQ ID NO: 23837 - DNA, 383 bp, Sorghum bicolor
  Clone ID: 30162657
ctactggaccaagaggtgcacacacacacaaacaaactccggcagctccactccgatccgccgctcgccgtcctcgctctcctgctccaccggccgcctccgatcccagctccatcggtttgctgccgtgtgctaagctagctagctgctcgttggccggctgccatggagacgtacactacagatgacgcgctcacggccatggggtttggcaagttccaggcgcttgttctcgtgtacgcggggacgggctggctcgcggactccatggagctcatgctgctttccttcgtcggaccactggttcgacagcagtggaatgtctctccccagcatgagagcctgctctctagcgtcgtcttcactggcatgctcctgggagc

SEQ ID NO: 23838 - DNA, 322 bp, Sorghum bicolor
  Clone ID: 30162677
gaattctccggccggcgccgccccgtgcccccgtccgtggttccagttgccgaactcgcccgtcgccacacgatctctctcgctccgccgacgccgcgctcggcttcagctcgagaggaggaaatggccagcagcggctacgaggggatcctcctggggatggggaaccccctcctcgacatctccgctgtcgtcgacgagggcttcctcgccaagtatgacgtgaagcctggcaatgccattcttgccgaggacaagcatttgccaatgtatgatgaattggctagcaagagcaatgttgaatacattgctggaggagcca

SEQ ID NO: 23839 - DNA, 210 bp, Sorghum bicolor
  Clone ID: 30162679
tggaagtttcttccgcctagtgcgactgcgaccgactcagctccggcgaccctcaaagccgcgccagccatggacgggccgcgttggacggaggaggtggacgacctggtcgacgccggcgacgtcgacgccgccatcgccctcctcgagtccgtcgtctccggcctctccacctccgccgctgccccggccaccgacctccgcctcgcc

SEQ ID NO: 23840 - DNA, 312 bp, Sorghum bicolor
  Clone ID: 30162697
attcgttctcataaattatatagatcagtctaccagaaaacaatgctaccttgtggtaactttgtataattaaccaaaattattattgaaaaattattacctcaacggctcaatccgcactgctccgagcttccgacgaacagttgtgaagaaaaaggtatgcggcctatccaggtgaccttctccatactagcactaatcctgtaatgaatttattttgttttagattttagatcttttttatttgaatgaacacctctgttttagagcagatcagtaaaatttgttactgcatagcatgagatgatagcg

SEQ ID NO: 23841 - DNA, 620 bp, Sorghum bicolor
  Clone ID: 30162714
aaagttgtaggtcaatcagcagatcttttcacccttcagaggttcataaacagaactaagccgcaactaagcaaagatcaacaacaaacccttaccagatgggcagtcctatttgctgcatcacttctgaagaacaataaggcagcccatgaagcgcttatgccagggatgtcccaaaaggcaagcgtgttggggtgcattgaagcaatagagaatgcatcctgatcacaatgtaacctgagtgtactagcatcactggacttgatattgtttcaccgcttctgactactactgttgttggttcgttgaggaatgaggtggaggaggggatcgaggcgtaggaaggagagatcctagtcatcgtcgtctgtacttctgtaaacattagaaactcagatcacagggaattcaagtactcgaaagcaaaggaaatttacataatgacaaaaacaatgtccgaatctgctgccatttactacacgtgtggcacaaatattactcccatattttgtttttgtataaggcacgattgccctctccaacaccacactttgaccactaatatcttgtatcctgtattattcatactatgaattggacatttataaaataaaggtttc

SEQ ID NO: 23842 - DNA, 681 bp, Sorghum bicolor
  Clone ID: 30162728
ttgaggaggccaaggacttcgttgataaacttgtagagcatcttcagtactacatccgggatgtcaacctctatggtgtgggttgtgagccaatgatgaagcagtcctctagctaccgcagttcccgtgctgagagctttagcagccatgaaaaaaccaaagtaaaggcagtctatgctgaggagatgctcacaccagcagagtcattttcggagcacgcaaggcaagctagtggaaagagcaagcattttgcacaatttcagggagacaagatgaatatagtagagatgctgaagattcagcaggagcaacaagctgtccttgaagagatgagtaaaggtgtggtgtacatatttggagagagtgaggtggtggcaagaccccattcctcactcattaagaagatagctgtcaactacttatactcttttcttagaaagaactcaagaaatggtgagaagatgctgtcaatcccccgtcgccagatcctaaaggtcggaatctcatatgaaatctaaggaatgtggatgaagaacaggatatctgattgcacacacaactctgatgccaaaaaaaggactctgtattcatttatttcatgaaattaatgtgcttgatttactacagcaatgatggatacagaactttagttttatgcataagtgcttcactgatatttag

SEQ ID NO: 23843 - DNA, 654 bp, Sorghum bicolor
  Clone ID: 30162732
taggtatgaccaggaaaaacccaaaggaaagattgacaattgaccaggttaaagaatcaagctggtacaatggggaaatctattctgatgaagaactgtttgaaattatggaagaaatcgtcatgctctagagaggaaatacaaataaaagtaacttaaacctctagagtttgagatgagaactccataataagcggtactatattacaaaagcgactttcctttgacaatttttccagttattgagtcaaaaaaggaatacagagaaggttcagtatcttttttggaaaaccataatttgaaaagaaatctacgtaacttatacatacatctttaatttgtttgtctgcaaatgttatttatctaattgatgttttacaaagctctctctctatctatctcaacttgtatttccttcggtggttctatgccttttcaattggaaaagatggagtcagaaggctgagaagaagaagactgttgttggaaactatcaattttacatgccccattcaaaaagaaaaacacaaagattggtctcacgtatttttgctttaattattttattttgtaatttaaatatatattatattattatgagaaagacattattttgattgtcttttatatcatatcatcttcattgaaaatttg

SEQ ID NO: 23844 - DNA, 570 bp, Sorghum bicolor
  Clone ID: 30162733
acaaggttgaggccaagtacggcaagcgatggttccgtatctgggagtacttcctggcctactccaccatcatctctcgccagggtagtgccacttgcttccagatcaccctagtcaagaacatcaactccacccaccgggttgagggtattgagacccagttcgccatcaccggagctctggacaactgccgcgctaatctccagtcgtgggctgagaaaaacaacgtcaagactccctccgagtacctgtaaagttgcgattgagaggtcgaccgtgactggtcaaatcttgagccgtgccagacgcggcaagaatttaatggggtgtcttatgataagaggccagctttgagtcttcagttgcctacgtgacggtcagctcaggaaatgggaactggatctatctgcatatttaacccggaatgcgcccccttgaccgatagagtcggttgaggctggtccagtcgcaaagggcaagcttcatgtgtttcatgatagatgtgtaacggcaacataaaacaaacggaatgggcatgggtgagtatctatatagatgctatatagggaa

SEQ ID NO: 23845 - DNA, 274 bp, Sorghum bicolor
  Clone ID: 30162759
tatcctgagaacatggatttctcaaccttttccaacattatcaatggccaacccacaggtactgctgccacacgccatggcatcaatccttcaacatgcaaagcgttaccagactgtcccgtgtcggaccaaacagacattgaggatgctatacaaatagcccgctctgcattccaaagttggaaaacgactcctattgaggttcgaaaagagaagatcaaggccttggcagatgcgatcttggcacataaagcagaattcgcacgtctgctta

SEQ ID NO: 23846 - DNA, 597 bp, Sorghum bicolor
  Clone ID: 30162779
tctggatgcggctgcctctacctcctccggtctccgagatctgaccggcggcggcggcggccatgaagcggctccccgtcctggccgtccctgtcctcctgctcctcgtctccctctcattcttcctcttccggcctaccacgccgccagtcttcagctcgcggcaagccttcgaacccgaccggcgtctcagggtctacgtggcggacctcccccgcgcgctcaactacggtctgctcgacagctactggtccctccgcgccgcggactcccgcatccaggcctcgtccgacccggaccacccgccccggcacgatcacccgccataccccgagaaccccttcttcgcgacgttgtccgcggagatggagctcgggtggggaaccaagggcgcctttcgcaagaaggacggcaacgaggactaccggcggcagcgggaggtcgtcgaccgcgtcacctcccaccccgcgtggcggaggtccggtggccgcgaccacgtcttcgtcctgacaggttatgttaaatactgaagcattctttgacagaccctgtggctatgtggcacgtccgggctgagattgctcctgcgattctttt

SEQ ID NO: 23847 - DNA, 560 bp, Sorghum bicolor
  Clone ID: 30162793
tagacactgactagacacgtcagtagtaacgccaagtcgtggcgtgctgcagcagccgtctcgtcctcgtcgtctcggcggcggcctccgtcctgctcgccgtcgtcctcttcggcaccggggccacggccgccgccgcggccagcgtcccgccgagatactgcgcagtggggaaggccatcccgcacagcccgctctccggctgcgcctggtacgtggcgacccggagctgcgacatggcggtgtccatgctccccgtgctcaaggagacttgctgcggccagctggagcaaatcccggcggagtgccggtgccgggcgctgcgggtgatgatggaggcgccgctcgtcgtgggcgcggacacgggcgcccagcggaggtgccgcgccgcgcaggcccgcttcgcccccgccgtggtcgccgccggcgagtgcggcctgcgaaccgtccacggcaggcccttctgcaacaagctcgacgccgagtgaccatggcgatgcagatcatactgctcgtaccgtacgcgtggctgaataagaggggcatatgtggttgtgtac

SEQ ID NO: 23848 - DNA, 563 bp, Sorghum bicolor
  Clone ID: 30162804
gcctctagagctccacacgacgtacttggcaatatatgctagtacatattatatatatcctttgtgtgtgtaagaccagtcaccaggccagctcctccgatatatcctgtgtgattaattataatccacgcatagagcggtagagatcgatcgagctatctgtcaggtacatatggcgtcccaacaagcagctgactacagaggaagtagggaagagatcgtcatcgtggacctcgagagcgaagaggccgccgtcgacgacgtcgatctgccgccggcgacgatgcagcggcaggattccctgtacgtggccgcaacaagagccgccggcgcgaaccaccacggacaggatagctgggccaggacgctgcggctggcgttccagtgcgtggggatcctgtacggcgacattggcacgtcgccgctgttcgtgtactcgagcacgttccgcgacggcgtcggccacccggacgacctgctcggggcgctctccctcatcatctacagcttcctgctcttcaccgtcatcaagtacgtctacatcgccctacgagccaacgacg

SEQ ID NO: 23849 - DNA, 617 bp, Sorghum bicolor
  Clone ID: 30162807
cctctggatctatctttggtagccattgggatctgtcgtcacaatggcagagaaatcaggcgtcaccggcgccgacttcgagtttgttaaaactcctgcttatcccaagcctgactttgacaagcttgaggatgttggtgttcctaccaccaggtatcccgccatcaagaacgctcctctccctgccgatggctctggtgccgataccttcaacaactatgtcctcatctccatcctggtagcggtcccttggctcctcagccgaaaggttggcggtggactcaagaccactatcttcttcgccctcgtcgttgatcttcccctgctcgccgcttggtggcttgtgatctcttctattagccctcgcaagaatgagaaagttcgccttcctaaccgtggtgtcgagcactacctcgagttcaagaaggaggccgaccgcctcaagtaccgcggcagcaacaagatccccatggagaccttccacgagacgtactttgatggtgatgttgacttcaagggtgactgcctcgaggttatggagtaccgccatgattgggccagcttccgcttcacattggccttatcaagttcttcccctttggcatgattcccgaggt

SEQ ID NO: 23850 - DNA, 613 bp, Sorghum bicolor
  Clone ID: 30162818
tgaaacgtgggatgcagtctactatatatgttgaattggcatctggagtgactcccagggatttgtttgaacacctgaagtatacttacgaggatgaagaatttgtcaagctgttacatggtagcagcgctcctcacacaagccatgttgtgggatcaaattactgcttcatgaatgtctatgaggatagaattcctggaagggccatcatcatctctgtcatagataatctcgtgaagggagcatctggccaggctttgcaaaatcttaatctgatgatgggactgcctgagaatatggggctgcaatacccgcccctgttcccttgatcttttgtgtcaatatctatgattacattatttaggagtactgaaaccaatttatcattactgtcaagaggcaaagagccccagattagaattcaatcaagtcgaagttagtatagcttcgcctgtgttgtttttaagagaataacgataatgacatttagcagtacaatggtagtattatgtgagcacttggttccaataaaatcataagcctatatacatcttgtacccacaatgttgtttgctattttgatcatgaaatcaatattgaatttggacgcagt

SEQ ID NO: 23851 - DNA, 299 bp, Sorghum bicolor
  Clone ID: 30162823
tgccggagaccaaggggctccccatcgaggaggtggagaagatgctcgagcgccgggagctcaggctcaggttctgggcgccaccacgccacgacgttgatggcaacggcaacgacagtggcaagaacactggcgtctgagactgtttgctccagagcaatattttggcagtagatttgggggagtagacgccgtctgacaggacaccttcgtgaaattctgcgctaggttctcaattttcatccattttctggtcatggacacggtaaaattcctccttctggcttttactatatgcc

SEQ ID NO: 23852 - DNA, 242 bp, Sorghum bicolor
  Clone ID: 30162836
tttccaacgctctcaaggccggaactgtctgggtgaagtgttataatatgcttcaccaccagcttcctttcggtgggtacaaggagagcggcattggacgagatctcggcgaggcagccctcgcaaactacacacaaaacaagtccgttgccatcaagctgtactaagattgcgaagcgaattgaggacttatggaagaaatatgcccggcgttgtaactgcatgatcaatttgtacatgat

SEQ ID NO: 23853 - DNA, 657 bp, Sorghum bicolor
  Clone ID: 30162866
atgattgatttttatttgaattcataagaaaattgaatccaatgccacaacagcaggttcagacaatttggataccccctacaacctctaaaacaatcgttttccctttgaaccaacaatccaataccttctataccgagttttatgagcctgagatgacaaaagataaggtctcactggaagagatcaaccaattcatttcagagattaatgctgaatacgaggtgtacaagaagaaggtggcgggtgaaaagcccaagcatgaatgcttctccttacttttgatagtcaccatgggcttggatcttggtttgttttcctctcattatgagtttataaaatctttcacaaattgagaattaatcatcctcaattggttgttcttattctttcttgtcaatttttgtggctgtatttgcagttacccaccaaatagcgatttgctgcctcgactacaaagtaggtgccaagatattgtggataagcataatgagaccttaagagatcgaaatctgagatggcaccttcctgatgaatttccaacttggattgaactcaccaaaggcatcaaaaagaagaacaatcacttggagatcccaaatcaagtcccccaaacgacagaaaatacaatcatctttcctcgtcaatgctacaaat

SEQ ID NO: 23854 - DNA, 441 bp, Sorghum bicolor
  Clone ID: 30162881
ctgcctcgctcgtctggccactccagccaggtccaaggggacgcgccagagctgctgcatcccgccagagcctagcagcacagcaggcgcatagctaggagaagtaagtggcgcggggtacgcagcggacagggcgccccatagatcagtcgagatggacggcggcaacggggaggcgtggcgcggcgcggtgtcgccggcagcgcggtacgccgagtccggcggcgccagcctgacgtgggagaacctcacggcggtgctgccgggcggcggcggtagggtgaccaagaagctggtgcaggggctctacggatacgccgtgcccgggcgcgtcgtcgccatcatggggccttccggttccggcaagtctacactcctcgactccctctccgggaggctggcaaggaacgtggtcctcactgggaaggttttgctcaacgg

SEQ ID NO: 23855 - DNA, 184 bp, Sorghum bicolor
  Clone ID: 30162883
gatccccgctattggccggctacacccttttccctcttcccatttttgaaggcagaaaacacggctcacggaacccttgccatcggcggcgacctcgcgatgctgcatatgctgggcctccgcgggggaagccccagccccagcgccggagacgcggcccccgccatgagcggggacggcggcg

SEQ ID NO: 23856 - DNA, 471 bp, Sorghum bicolor
  Clone ID: 30162899
tctctctccacaagtctcctcttctcttttatataacctcttcgctttaagatacccaataccctttctctccctacctataaacatattatacacaatggctctcactgtcgagttgtccactcccgttactggtacctaccagcagcccattggcctcttcatcgacggcaagtgggttgagggtgtcgacaagggaaagttccaggttatcaacccctccaccgacgaggtcatcacttccgactgcgagggtaccgagaaggatatcgacctggctgtcgccgctgcccgcaaggctttctaaggcgagtggagaaagactgctccccagacccgaggcaacctcctcctcaagctcgccgatctcgctgagaagaacctcgaccttctcgccgctgttgagtacctcgacaacggaaagtctatcacaaacgcccgtggtgatgtcggtgccgttgttggctgcct

SEQ ID NO: 23857 - DNA, 666 bp, Sorghum bicolor
  Clone ID: 30162909
gtcagtttttgaagacatgattttggctggagctcaacctgatggggtcactttcacagttgtgctttccacctgcagccgtggtggcttagttgacattggcatcaaacatttcaactctatgacgaatttgtttgatgtttccccacaaaagagccactacacatggttcctggatatgctaggacgagcaggccgctttacagaggtggcacacaccatcgaggccatgcccgtccagccagacatatcaatttacaggaccctgctggcatattgcaagctccacaatgcacaggtggttggtgaatatattgccaagaaggcactagagttggatccatcagattcactcttacggaatatgctttcaggcatctccttggatacaagatcacggtgaacagacatatttgtgggatgaacagggatgcaggtatccaaaagctgtgagctaccaatcaactgctgaaaactgagcttgggttcttgttaaatattcccaagaaaacacatgtattctctctgcgcaatttcttcaatataagaaaaggagctccacattaagcttgggatgaaaagaaggttaaattctgggtctgcttatttcttcttgtaaaagaatataattggtggaatattggatatattgcattgggccttatg

SEQ ID NO: 23858 - DNA, 562 bp, Sorghum bicolor
  Clone ID: 30162913
cgctcattacgatcactttctgtcatgtggaccccaatgatgcaaacactccctcaatccacaaagcaccttaggtccctcttcacactggaaatcggggattgggacaataatctgaagcagctacctgacgtcattcagcacctcacatcacttgaagttctctacttgacgcgattccccgcgctgacagagctgccagagtggattggacaactcactgcacttcgtagcctttatatccagaattgtcatgcccttgaatgcctgccccaatccatacaacgcgttacttccctccagagtttgtatattaatagctgccctggattgaaaactcgttataagcgaggaatgggacctgactggcatcttgtctctcacattcctgatgtgcgcggagtatagtaattgagccaccttgtctccgagaacaaatgagcgcggcagcatcaaacgcacccttggtttcaagttggagaatgaagatggattggtctgtcagttgatgaccgaattttttgggttattcagaatttttttttttgcattgctttacaag

SEQ ID NO: 23859 - DNA, 316 bp, Sorghum bicolor
  Clone ID: 30162919
ccaaactgttaagcccgccagaaactccaccctgggcagacttgtctccctcctcaaggaagccaagaaggaagtcgttaaggccaaggacacctagaagaacgccaccagacccgccatcaaggaaatcaagcacgacttcaagaacctcacccacaagggcaaggaactcctcaagaatgccaccaagcctgctgcccccaagaagggactcctctccatgttctaaatctgaacaggagtcactccataaataattaattaatcgtaataaataataataaattaagatctatgtgatgataatgtccattat

SEQ ID NO: 23860 - DNA, 227 bp, Sorghum bicolor
  Clone ID: 30162953
accggaggaccggccagaagccccaagcagacatgagcgctgctgctactctcccgaccggccatggtcaggagccgcacgcggtgtgcgtgccgttcccggcgcagggccacatcacgccgatgctgaagctggccaagatcctccacgccaggggcttccgcggcaccttcgtcaacaccgagtacaaccaccgccgcctcgtccgctcccggggcgcggacgcc

SEQ ID NO: 23861 - DNA, 678 bp, Sorghum bicolor
  Clone ID: 30162957
agcttgcttgaaccgccgcgcagcgacatgccatggcagccatcgccgctcttcgccgtcttccgccaacaacgcctcgcttcctcctgggctgccgccgtcgctggccacgcgcgctccggtcgccacgccgccgcgcttaccgtcttccgccgcgtcctccgagcccaccccgccgtcgctacctccgaccacttcgcctatgccgccctgctccgctgccgcgaccgccgcctcgcctaccagatacacgcccaggtgtgccgtcgtgggctggccgcctccaacccggtcctcgcttgctctctcctcgtcttctacgccgactgtgaggactggagcagcgccaccagggtgttcgccgaaatgccgcgcccagacgccgtctcttacaccgccatgatctccgccctcctccgcgcaggggactgccacggggcgctcgcgctctacccgtgcatgctcccactttgcgcgcccacccagcacaccttctccaagctgctcgccccctgcgcctccatgcgcttgcaccgccacggtacccagctccacgcgcagctcctccgctggggttgctggggcccccacctcggcctggtcctcaagaccgcgctcctccacatgtacgccacttgcggcgccatggtctctgcacgcgccgtgctccacgccact

SEQ ID NO: 23862 - DNA, 604 bp, Sorghum bicolor
  Clone ID: 30163003
cagaaggatcccgccgatgtcgctcgctgggacaagctcagggtgaagtttgtcgatgccaagacgctcctcgaccaagcggaactcgacctgggtgacatccctgccgagtttgaggaccccatcatgggtgatctcatgaaggatcctgtcttgctacccagcaagcatatcgttgaccgatcaaccattgtccagcatctcctaagcgatcctaaggatcctttcacgagacaagccatgactaccgatgatgcgatcccacaaacggaactaaaggagaggattgagcagtggcgagaggagcgggtgcaagctgccaaggacaagttgaagagcgatgccatggacaccacagagggttaagatcatgcgagggaatgtgtttgaaaagggtaattatctgattggatgcgtttgttgtctgtcgaagatgggagacggcgcatgtgtagttcacttcgctcatggtgagcatggagaatggcctgcttaaaagggacagtttacatgagacggcaaacagcggtccaggaactgcagcgcatttttagatgataaatatcttgttcgtcagaaaatatagcgtgttgcatttcgaaaa

SEQ ID NO: 23863 - DNA, 561 bp, Sorghum bicolor
  Clone ID: 30163007
atgcgcagatcggtgccgtcggtgtgttcactggcgagtgcgacatgttgatcgaacagtacggcgagcagatcatcaacttgctcgtcaagggtgtcgacccctcgcaggtgtgcgctcaaatcggtctgtgcccctcaggctcgtactgctcattgtgcaccaccgtgttgacttacgccgagtacttgttgtccaacaacgccaccgatcaagtcatcctcaaggccctcgagactgtgtgcaactacttgccctcgcccaatggtgaagctaccgtggactgctctgtcatcccctccttgcccaacttggtcatcaccgtgtccggtcaacagttgatcatgagccccaagcagtacattgtgcagctcagtcaactcggtcaaaccacttgcctctccgctttcattggcatcgatttgccgcctcaaattggtcctttatggattctcggtgatccgttcttgggtgccttctacaccaagtttgactacggcaagcaacgtctcggatttgctccctctaaataagcggtatcatgcttaataaacacgtagt

SEQ ID NO: 23864 - DNA, 454 bp, Sorghum bicolor
  Clone ID: 30163010
atagagaaaggcaggtatattgtccgtgagatcaggccagcaatagatcaatatgatcaagaatactatggcttgaagggcctaatcgatccaaaaatccgggattcagctaaattaattggcttcaggagatttgtacagttggctatggaatgtgtggaagagtctgctgttgaccgcccaacaatgaatgatgtggtgaaggaacttgagatcatcatacagaatgaaggggcacgattgttaaactcagcgtctttatcagttgaacaatttggaaacaaaaagagtcaagatccttatgcagaacatttgccaatgaatgatgaaagcagcagcaacacttttgactacaacagtgtgtattcatactcagctgttcaaccgaagtagataacagtctccactctttgtttttgttgagggatgtattatacgacattatctttttttc

SEQ ID NO: 23865 - DNA, 574 bp, Sorghum bicolor
  Clone ID: 30163013
attacttatgatgagttgtggactgttaccatggctactcaactttccttggacgtgaccaccgctgaatgtcacgcaccttcatcgtcgttcgtagatgagccgttccaatgcttgatcatgggcagagacgtcgacggcagagtgacaggtgactcgtccatggcaaagaacttcaaggtcgttgtcaccaatagcgccaactcgaccatcaacaccgctgaagtcatgtacttcggatccgctttccacttcgcattcagagtgaacactactggtgaatataaggtctctatcacttacctcgacgatgtgttgcccaaagcctcatctttgactgtcaatgccgaatgtccttcaatgtactggggatctacttgctccgtcaatggctggtgggtcatcggtcctgttatcggtgtggtcgttctcgtggccattattgttactgtcgttgtggtccgcaagagaaaggctggctatcaacctctcaattaagttagtgcaagtattgatcgataccgatgtgatattacatttacatcatatttagtagataaattgtgctttattc

SEQ ID NO: 23866 - DNA, 550 bp, Sorghum bicolor
  Clone ID: 30163025
gtacgtcacgtacggtgccttgcaatatatggattccttgcgttggcgcgttgcattgcttggtgtgcaggcatgggatcggggtatgtgcagggtacagttcaacgtacatgccttgtatatatgtacatatgcagtacggcagtacgtgcctacgctttttgcatgtacatgtgtacatacgtatcgtgatgcatgtgaagaaccaaggtctttgagtccccgttgttttggttgctgggacgactgatacaagcaagctgcccgtgtagggttatttcggtgttgcacgtttttcttcttcttttgtgtgtatgtcaataatagcaagtcatgcatatccatcgatgtaatgtaatgtaatgtaatgtaatgtaatgtaatgtaatgtaatgtaagctactcctatgtagtatatgtcctactagatacagaataaattatgttaattacagtggtttgcaaccacctttaaaatatcttattagtacatactacacctttgttcatcattatccacaaggccagaagcccagaatgcatgatttgt

SEQ ID NO: 23867 - DNA, 500 bp, Sorghum bicolor
  Clone ID: 30163030
gacgccgcgctcaagtccgccatggccgccctcgccccgaagctgccggggctcgcctactccgtcgccgacagctttggcctcacgcaggcgacgttcgccgacccgatggggctagggttcgtgagctcggacagcccctgctgcgggagcgggcggctgggagcgcagggcgagtgcacgtccacggccatgctctgcgccgcccgcgacagctatattttctgggactctgtgcacccgtcgcagcgggccgccatgttgagcgcccaagcgtactttgatggcccggcccagtatacctcgcccatcagcttcaagcagctggccaacatgatgagctagattgttatttaatcattccgagacctttttttatataaacaaagtaatgtatgtgcttatgtatttctttcgtgcgtgcatcatgtgtgcgtgtttcatttgtttattcttgtgacaatgtgatccatagcaataatgaatcgaagtaaatgaga

SEQ ID NO: 23868 - DNA, 472 bp, Sorghum bicolor
  Clone ID: 30163035
tgaaattttcaagtttcaagattcatccaagggctgagctttggggtgatattgtcagcaacaggtttggatcattcatgttagcatcagatgtgctgtttgacttgaaattggaggccgctgagaggtgcttttgtcaaatggttgagagcaaaatcccagcaatgttgcataaagatacttatgcagcttgtcaggcaggcccgcaggaagagttttattgccaggttaccagtaaagatggcacaatttggttgactggcccctgaagagtgccaagggcccaacgttcagatgaaaccaaccctaataatggtgacgcagcagatgctgatatattgacagcagcttagtatataaattttgacaaactgatcgacaaagtacttattggatattcctgagttctgtactcgggtgtcttccctgaattttgccatgtttcaagaatcaagatttcccttgtgccccc

SEQ ID NO: 23869 - DNA, 578 bp, Sorghum bicolor
  Clone ID: 30163043
tccctcacctacttcccaactcttaccagtggccaagcttctcagtactggggtatctctgtttctggctttacctatggatccacaagtcttggttccggtaccggcatcgtcgacactggcactacgctcatctacgtccctactagtgtctacaacaagttcctgtctgccgctggtggttcgactgatagctcgactggccttgctgcatttactaagaagcctacctctaacttcggtatcaagtttgggtttacaacctacactctcacacccgcacagtacttgatccctactgctcagtatagcaacttcggtctgagctctggcaaatactactcctggatcggcgatggaggttcctctggtgtcaacatcattatcggacagaagttccttgagaactattactctgtttacgataccaccaactcccgtattggtttcgctacagctgcttaagtcaatgccctgatttcagagacgcttagcctttgaggaactttatggcagcgagcatggagggaaggtggcatcacatagttcttagtacatactaaattgaatgagactgt

SEQ ID NO: 23870 - DNA, 643 bp, Sorghum bicolor
  Clone ID: 30163044
ctgggcagagattgccaagactttccctaccaggacagaaggatctgtcaagaagcattggtacaaggacatgcattatgctgagtttgcagaggacgagagccaagcgttattgaacgccatcaaggagtacgagaacaacaagtggaagtcaattgggcagaaggtcaacaaacctgccaaggcttgcgaacagtacgccaaagaacactttccagatttgttccctaattccaagagataggggcgaaccgcaaggtggctttggggtcctcttgcaagcttcgtactcctgtgagaactcgagagccaagaggatgatctttagcccagacttccttactgcacagggaaaatacacaaaacaacaaaaacaaagggaaaattagcagtggcgttctgcaccatttctatgcgggaaactgtttaatatttgttaattgtggagttgcctcaaatgttttatgaggcacggcggacaatgcctcatcggcattgttaccactctttcggatcgggatacggaaaggactggaactgggaactggcgcgtaaaggtggaaaaattgaagacgaggagcagcgtatgcacctgtcgaactggcctataggaggagagtgttacaaaggaacgggacttgtg

SEQ ID NO: 23871 - DNA, 608 bp, Sorghum bicolor
  Clone ID: 30163058
cggggtgtgcaacacacacaatgtttacttgccgataccagaagtcatcaaatccacgaggtttgtcgatccaaacagtcggatgtggcaccggtgcctgacctcaactgggcagccagacttccattgatcaattattaacgaagcttgtagtagagcatctgattttaaaagtggtgtatagtaatagtatagcaaaagggatttagttacttcgtcagcatggcaaaataatcgtcggatggatttttcatactccatctgaaaaaagagaaacatctttgtgaccttgagacgcaagatggatacaataggcatcttgctacgctaaccagttattcatctgctgatctgcaagggaacggtgtccagttccctgttttatttagtgcatgatagcagaactggactcatcggaggagcactgcccgcattttgtttcgagcaccaaatcattgtctcctgaaatcaactgcagatacagcgtctgtattccagttcacgtatcgcttcaagagcaagacgctggttgctgcgcaggttttatttgtctgtagtatttagccactaacgattctcctgtaccccttgtaaatggaactatagac

SEQ ID NO: 23872 - DNA, 486 bp, Sorghum bicolor
  Clone ID: 30163063
atactagcgccggccggtagcagcaccggcagccgcgttcccctccgccatggatcccgcgaacggcagcgcgggcgccgagctcgacgacgcggccgagtggcgcacccgcgcgccgggcggcacggagtacagctggctccgcgccgtgccgggcggcacgggcaccacgctgctcgcgctccacctctcccgcggcgacgtggcgcaggcggcgcttcactccctgcggaacgcgcaccccgtcctccgcgcccgcctccggacctctccctccggcccgacgctggcgttccccgacccggcagcaccgcctccgtccccgccgctcccgctggcgacgctctacgagctcccgcccgccacgggaggcgcggcgctgttcgtccggatccacacggtcgcgtgcgaccgttcggcggcgaatgcgctggccagggaactcgtcgcgctgctggccggcggtgaggagggcggggagcgcgc

SEQ ID NO: 23873 - DNA, 578 bp, Sorghum bicolor
  Clone ID: 30163065
atcaccatctcatcatctcagccatattctccggattctcgaactcccagcaaagatgctcttcgctgtcactctcactcttgccgctgcggctgctgtctcagcatcgccccttgagcctagggccaagactgccgttcttcccttgaagcacgtcgtcaaggccagctccatcaaggccatcgtccaaaagggccaggcccgtatccgcaaggtcaatggagaggattctttccacgtcgatgccgtcagctctggctctgtcactaacgaggatgtctcctacgtcgcgcccgtcgtgattggaggcaagacctggaatctcattgttgatactggatcttcaaacacttggtgtggtgctcagaccaagtgtgagccaacatcaaccggcaagtctaccggcggttctgtcagtgtctcttacggctctggttcgttctccggcaccgagtacaaggacaaggttagctttggcggcctcagtgttgccgcacagtcgattggtgcggccagcagtgctagcggtttctcaggtgtagatggcatcatcggctttggtcccgttgatcttactg

SEQ ID NO: 23874 - DNA, 639 bp, Sorghum bicolor
  Clone ID: 30163066
attctcctcattattgcgtctttactcgttgaaatgaaaacctgtacatgtttttgagcgcgcgtcctgtatcttccgtcattgccgagttgagactgagcataaactcgctcactctatttactcaatgactcaatacttcacccatcatcatcaatatcacctgtcgcatcgcatcgcatatacctacctgcccattgtcttgtcacgaccacattcctacgtttctgttcgctacgtacctcacatcactcgcgtcttatcgcagacacgttacgcgtgtgtccgcctgtcctctctttgtccggcttgcttgcattttcctgccttgttatagccccagccccaatcaatctcttttcgctcacaagcgtctgcctcgtctccaaccaccccccaaaaacaacggggcactcgctgccaatgtattctacataccttcgccgagacgcacgcgaaaagcaacacagcatctgaccgcgcacacggtttagacacgtagagcatcgcgcaaattggattccgttgcactcgaacaattttttctttatttccactctcaccacttacacgccgatactgaccccaccttaaccagcgcacaaacgttgattgcaagacaaaaaactctgatcatca

SEQ ID NO: 23875 - DNA, 630 bp, Sorghum bicolor
  Clone ID: 30163082
ccatcgatcacctcgtgcgtgtgccgcagccaggcatctccggcgaatctcgttttaggtgcggagagaggatattagcgtgctgagcaatctaaacaatggcactagcgcccatggactacgctggttctattagttcaggccagaagtacctgggccgtttcggagtacccaccagcagtagattgcgatgggtgggatatgacacgaaatcaaggacatatcagttggttgctagagccatatccgtggatcaaccgcaactagacttctcgaatccagattggaagaagcagtttcaagaggatttcaataagcgcttcagcttgccacacttgagagatgtaattgatgtggaaccgaggccaactacattttctctcaagagcaggaccccccttgagaatgtgaatggtaccatgcaagaatcatggaacggctatgtgaatgatgatgacagagcacttttgaaggttattaagtttgcctcaccaacttctgctggagctgactgcattgaccctgattgtagctgggttgagcaatgggtgcaccgtgctggtccacgcaaacaaatatattttgagcctcaatatgtgaaggctgggattgtatcgtgtggtgggctct

SEQ ID NO: 23876 - DNA, 772 bp, Sorghum bicolor
  Clone ID: 30163112
attatcaactgtactatccgtactctgtacgtcttcgtgaggcttgggtccacacctcatagatctcgtccatttcactctcagcctcgccattccatctgaacttctttctttcaacgtaattctcgtcttatttcacttcctccctctttctcatccgcactttgactcgatatcgccatcatggaccccaacgagcaaccctcatgggctggaggtgatgccccagacaaggagaagatggaacagatccgcgcgagacgcctcgccaagctagggacatcaacgcctgtgtctgccaagtcagatgagaataaggctcccgattccgaatcgtcgaacccctcgcgcacgtcaacgccgaagccgcagccgcagccgcagcccgcatccgctgaatcacggcccaagatcaacgtcactcccgccgctccgccggcttcttccagcccgaacccctttgacaagctaggggtcaaggcggagccgtcaagttcaacagcggatcgaccctcccccaagccatccaccactcaacccgagtccgacgaatcctatgccgaccgaacattgtcacagatcttccgcatcactgttgatccgcataatatggtcaacactagtggtcaacggctgacgttcctcccgaacctgaatgaagagctgagcgagtccggagagcctctgaagctgtccgtcaacacgctagaccaagctcttatggaggcagccagcagctatccccatgataagcctcttatgaactacttct

SEQ ID NO: 23877 - DNA, 609 bp, Sorghum bicolor
  Clone ID: 30163115
agtcttcttcctctacacagacaacactatgactcgtacacgtactgtcaccactttgttggtgattttgtgtgtggcgttgctctctgaggctatcatcaaggtgcctttgacgaagctcgctcaacctgctaaaattaagagacccgctcgtgctgctggtcctatcaatgtgcccttattgacctatgctaatactcaatactacggtaccgtgactattggtaatcctcctcaaagcttccaagtgctcatggacactggctcatccaatctctgggtgccctcatccaaatgcccctggtactccattgcttgcgatctccacaacaagtacgactcctccaagtcctccacttacgtcaagaacggtactgcattcaacatcctctacggcagcggtggtgttcaaggcttcttgtcgcaagacaatatcaacattgctggtgtgaccatcaagaaccaagtcttcgctgagatcaacagcgaatctggtctgtccttcttgttcagccagttcgatggtgtgatgggtctcgccttcgactccatctccgtcgatcacgtcacccccgtgtggtacaacatgctccagcaaggactcgtctc

SEQ ID NO: 23878 - DNA, 631 bp, Sorghum bicolor
  Clone ID: 30163121
cttacattgcaaataacaaacatgaagcacgtctgtatattgttagcgttgagtctcagcttggttagtctcgctttgactacatacacaactccttggactctcttgaagcctagtggtcgtactccagccgcacgacagtatcatgcatcaatttataataacggtgtttggatttatggtggtatgagcaatcagacccaaactggcttgcaattgttctgcgatttgcaaacctacgacgtttcatccaacagttggagactcgttgacaactgcacgcaatcaaaggactacaaaggccctggaaagctttatgactccgcgtatgctcaatggagagactgtttcttgatctttggcggaactaacgacaaaggtgtaagaataaccgatacttggtgctataacttcacctctggtcattggagcgaattagtcgttaaaatggacgattttcaccagtcttatctccaacaaactggcttatcagccgttgtctaccaagacaacttcatcatctcttcaaaccaagccatcttcgtcttgaacttgactgctgaacccaagacttggagcatggtatctagtggcgatagcaactctcaaacactcgttgcagcgaacaact

SEQ ID NO: 23879 - DNA, 565 bp, Sorghum bicolor
  Clone ID: 30163141
aaaatgccgcccaaacccgcgccccggctcttccagtacatctccaacaagtcgcgcaagccgccgccgccgcccgccgccacatccgccagccacgatggccccgcgtctgatgccgacgccgacgccggcgaggtgtaccggatcgtcacgtccgcggccacgccgtccgcgatggagtccgcgctcgcggcgtccgccgtcccgctctcgtccccgctcctcgacgccgtcatgcgccgcttccgcttcgcgcacggggacccgctccgcgcgctctcgctcctctccctcgccgccgaccgcggcggcgtcgcgccgtcgccctacgccatcgacaccgcgctctacgtgctcggccgggcccgccggttcccgcacatgtgggacctccccgcgaccacccgccgcatctgcccggacgccgtcacctcgcgcggatgttccacgccgtcgacccggcctgcctcttcaacgcgctgctccgcacgctctgccaggagaagagcatgtccgacctggtgacctacaatagcttgatcgattgccactgcaagaaccggga

SEQ ID NO: 23880 - DNA, 607 bp, Sorghum bicolor
  Clone ID: 30163148
cagcatcgcaaacacccaagggtggtgtgcccactccaactggcacccagacttccacttccacttccacttccacttccagctcgtccactggtaccagttgccctactgcaacctctgtggctgtcactttccaagaagttgtcaccaccaactttggtgataccatcaagatcgttggcaacatcgctgctctcggtaactgggacacatcaaaggctgttgccctgagcgcctccgactataccgcctcgaaccctgtgtggaaggccaccatttccctaactgcaggacagtccatccagtataagtacatcaatgttaagaaggacggctctcttacctgggagaaggaccccaaccgcacctacgctgttcctaagacatgtgccacaacggctaccaagtctgacaagtggcagtcttgagatgatactttttttctctatgccttgagggctatttcgataggttggtaggcagagttgaattatgactcagattgttactttgaccgggctgggagtaaaacccaatgagtttgatgacgaaaatgaaggatacgtgtttggagatagcaagtgtgataataacatatctgtttatg

SEQ ID NO: 23881 - DNA, 389 bp, Sorghum bicolor
  Clone ID: 30163171
gttttaggggccctttgccgacccgccaatcctccacccttgaggtttttttgttgcagcctccacagccgccggttataacactccacatacggatacggtgcggccggccggtaccgtatattttacacacacgagaataggaagcttttgtacgtatatcagttacggtagctgtgaattgtttcctatcgacacccttttttttttttttttttaaaataactttgttgttaaacatcctgtattcctgtcctatggcatgtatacagtatagtactcccgacttttttttgtcattcatgattcatgttgggtatacttcaaagttcaaactcactgtgtgtgtgtgtgtgtgtgaaaactcagaggactcttattttagtttc

SEQ ID NO: 23882 - DNA, 717 bp, Sorghum bicolor
  unsure (1)..(717): unsure at all n locations
  Clone ID: 30163172
tgagagtgttaaggacattgacggtgcaaggatggaagacaataagttctgtgtgtctgtgcactaccgtaatgtggcggaagatgactataaaaaggttttccatcgtgtaagtgctgttttggaagattacccttgcctaagactaacccatgggagaaaggtttntgaggtccgtcctgttattgattggaacaaaggtaaagctgtggagtttttactcgaatcacttgggctcaacgagagtgaagatgttctccctatctatgttggagatgacagaacagatgaagatgcattcaaagttctgaaggcaagcaaccgtggctttggaatattggtgtcatctatacccaaagagagtgacgccttctattccttgagggatccagctgaggtgatggaatttctgagaatgttggcagcatggaaggagcagtccacctgataccagttttgctgggtctggagaagaaccaagattataaatattagcaagatatataatgctaaccaaataagtcggctatttggaggagtcaagccaaaatatttttgatttggcaatttataagaggctaccatgttttgataccttttcagtcccactttgttcttgtgttaaatgggtttctcaatcagttcaattctttcattatttagtttcctttagtatatattgaaatattcttgaaaaggaattttgtttcctgctag

SEQ ID NO: 23883 - DNA, 656 bp, Sorghum bicolor
  Clone ID: 30163176
aatttcagaaaagaattcgtagtcgatggtgaaacgtataagctcgctatagccgatactgatggcgctctcgaatgtatcccggtagtcgaaaaatattgccagatgtcccacggattttacatggtctattctgtcacttctaaagaatcatttcgtagactagatgaatatatgagcattatagtccgcgttaaaggcaccgaatttccattaatcatcgttggcactaagtgcgatttagaatcagaacggcaagttacacaagaagaaggcagaagatacgcgcaaaaatatggtgctgaatggatggagataagcgctaagacaaagcataatatcgaagaatcgttcaatacattagttcgtttgatatctgacgccaattacgaccgcacgtttagtccttcttttacctaaaaacaaccatcatcacgcagaaaagatcgttgtcttcttatgtaaagataattagaggcctactaaagtacagagatcttattgttggcatagcagcttttaaagttaaattgtttcccaatgaatcaaactcaaatgcagatgaatattgattgaacagcacacaatttttgtcctaagacaagagaattgacaattcatggcattagttgctattaacaataaactattatcct

SEQ ID NO: 23884 - DNA, 541 bp, Sorghum bicolor
  Clone ID: 30163180
gttgaagagattgttgatgcgttggaaagtgaagcagctagctcaaatgaagaatggtgtaccttggcactgaaacgattgaaagaggcctctccgttagctttgaaagtctcactgcgatcgatacgcgagggtagatatcagacactcgatgagtgccttgtccgtgagtaccgcatgtccatgaatggaatctcaaagcaattttctcatgagttctgtgagggtgtcagagcacgactagtcgagaaggacttcactcctaagtgggatcctcctgcccttgaatatgttacaaatgacatggttgacgcttacttcgcacctcttggtgatttggagcctgagttgaagctacctacagaatcgcgagaggcatttgtatgataaaaaaaaaatcattccaaggtcccaacctgataaacgtgttataatttgtgtagccattatttttggcagcacaaccagccctgttggaccaactacccatgtgctatatacacgttttggcgtattcaattttgagcgctaaagggaattc

SEQ ID NO: 23885 - DNA, 228 bp, Sorghum bicolor
  Clone ID: 30163183
cccccccacccccaccctgtatatatagatcccattcgattattccattgagcctgctcgcccagtacggcaaggctctctctctctctcctgtacctaaggatcagctgctgtcaactgagttgcatgagatgagggagtgaaactttctcgtctccggcgttagaaggcaactttttgatggaacaattttggacacgtaaatgtttctcaagaggtagaataaat

SEQ ID NO: 23886 - DNA, 556 bp, Sorghum bicolor
  Clone ID: 30163190
tggatttttccttgttcaatatgctcacctgtggcaagatcatcttgacaaactttttgacctgtatgcctctggaaagctaaaggtttccctagaccccaagaaatttgtgggtgttgcttcagtcccagatgcggtcgaatatcttcattctggcaagagcgttggcaaggttgttgtgtgtattgatccgtcgtacagtcagatcgttgcaaaattataatccatgggcataatgcgcattatctcccatggtcacgtaggttacagtgttataggcatacatacagcaagaccatattttcccagccggtgagtactgaataagggaacaggttggtgtatagcttagtttttcccccagaagtgtaagatgcaggactatactgaagggcaagcatgggcatggaaatcgaatgattttctattccaggatgcaatcgtgtggcctcgttccacgttttgtgtatacagtatattatataacttgtgccagtgccacatgcttcaatccgaaccggtaattcatatagagcacatgcagatgcattcactg

SEQ ID NO: 23887 - DNA, 463 bp, Sorghum bicolor
  Clone ID: 30163191
cagtggggcacatggagttcctgtacgaccaggcgcccgagagcatgcgcagtaccgccgccgcgctcttctggctcgccggcgccttcgggaactacctgggtaccgtgctggtgacggtggtgcagcgcaccacgcgcgcccgcggcaacgactggctccaggacaacatcaaccgtggcaggatcgacaattactactggctcgtcacctgcctcatggtgctcaaccttggctacttccttatctgcttccgtttctacaccatgaagccactggagatggcagacgaacaagacgatcatgacggagaatgtgagctctccactctacagaaaaatgataccggtgctggaggtgtggtgtaaggttgcagtcaattaattagtgtgggcttcagtaattaatatatatatatatacttgcgtcatgcgtttcaatttatattgggatcgaactttcc

SEQ ID NO: 23888 - DNA, 560 bp, Sorghum bicolor
  Clone ID: 30163196
gccgtcggtatggcctctcaatgccagaatgtggccaacaccattttccaacagttcttcccgacattcctcgccaagaccggcctcaagtgcctcttcttcttcttcgccgtcaacatcctgctctgcgttttcgtgtttttctttgtccctgaaaccaagggtatctcccttgagcacatggatactgttttcggtggtgccgaccatactgagaagggtgcccagatgctcggtattgacgctgctcagcatcagacccaggagttcaaggacggtgctgagactcagcagagcgagaagaagcgcgagtctgtttaaatctactgtaattgatgggggattttgagttaggataattttgcatctaggaattcgagatgtggaaggcaatcgttttagccgtgtatctacctcgacatgtatgctgatataaggacacattgaaaatacggagacaatgctgtgatccctaggaaaagtccagtaccctgaaagcggcatgtcccctccagattgtgtaataggaggttagctgacagacatcatatcagaagtcg

SEQ ID NO: 23889 - DNA, 523 bp, Sorghum bicolor
  Clone ID: 30163209
cgacgaaatcgacgctattgccactaagcgtttcgatgcccaaactggtgctgacagagaagtccaaagaattctgttggagttgttgaatcaaatggatggtttcgatcagactactaccatcaaggtcattatggctaccaacagagctgatacgttggatcctgctttgttgcgtccaggtcgtttggatcgtaaaatcgaattccccttgcccgatcgaagacaaaagcgtttggtattccaagttatcacttccaagatgaatttgagcgaggaagtcgatcttgaagattacgtctcacgtcctgacaagatctcgaacgctgacattaccgccatctgccaagaggctggtatgcaagcagtgcgcaagaacagatacgtcattctgcccaaggacttcgataagggttataaatccaacgtcaaggctacaggagacgagttcgagttctacaaataatagttttatttgtttggacttgatccggttctttttttacgcaatgtaaagcttcac

SEQ ID NO: 23890 - DNA, 576 bp, Sorghum bicolor
  Clone ID: 30163214
gaagtggagggctttgcatagctttgtgtggtcctgaccacagggttattggtgggagtgtaggtggagtcctgacagcagctggaacagttcaggtgatagtggggagcttcatgtacggaggttcgaagaagaacaaggcgaaagctgaggcggacatcgagcccgaggaggcgaacgccggtgacgaagaggtggcccctgcgatggcactcgcggaccacagcagcatggcccctcctcctgagatgagcggcgggtgggcatcgggcatgatgaggcagatagactcgagaactcccaacatcgatatcaactcgatccgcgagtagtagggaagtggtggttgcatctggttggtcgggttgggtggataaggctccttgacatggaacgaagtggaatcctcctccttggacacacagcatgcatgtactaacaactctgttgtaggcgttgctgtggtttaggaaactctgaactccgagtatatcgtatatgatattattgtgatgtgatgttgtacttgggatgttgttgtatgagataatgggagatgctttgccacctaacgat

SEQ ID NO: 23891 - DNA, 439 bp, Sorghum bicolor
  Clone ID: 30163219
attacaagactcaaattgtcaaacatcaatttcttcttgccaccaagggtttctggcgtcctggcagtacagattctaagtcatgatgattctggcttccacgcaaattggtattggtgccatggactcattgtgttgattcttcttattcttttggtgtggattcttctcatggcatagatgatttcaagttccaacttccctgctttgttttattgtttttaaaaatgttttggccttgaccattcaaatttctgtttggtattgcaaacaggttaaatcaataggttagtgctgacaagtctgttaggtgaattctataattttttaatatatatttagctataaacttcaactgtatgtcatagatattgtatataaaattcttgccttcttgcaaacgaacgaagtatgacctttgaattattctttgttactc

SEQ ID NO: 23892 - DNA, 507 bp, Sorghum bicolor
  Clone ID: 30163229
atgggctgagttgcgtgaggcagtccgccgttgttctaatgccttgcgtgcagctgggcttaagcccaatgatgttgttgcgggcttcgtctcaaaccatgttgaagcgctggttgctatgcttgctgccgcctcagttggcgccatttggactggtataagccctgataacggtgtttcagccgtgctggaccgtctgaaccagattgcgcccaaggtgctatttgccgataatggtacagtctataacggcaaggagtggtctagcgtagcaaagacgactgagattgtggctgcgttgaaggacaaggggcttgcgagagttgttgtgatcaacaacatcagctctggtggacttggccttgaggagcttcagaagcatggcgtgttggctgttgattacgccaagatgctcgagtctgcttctgaagaccccctgaagttcgagcagcttcctccagctcatcccctctacgttctctactccagtggcacaactggcctacc

SEQ ID NO: 23893 - DNA, 586 bp, Sorghum bicolor
  unsure (1)..(586): unsure at all n locations
  Clone ID: 30163233
ttttaattgtaaataacgaagtagctccactagtacgactttgttgtaatataaaacgatggaggaaattggattgactcgcccaaagaagcaagaaaagaaagacgtcgcagagaagactaaagagaaggaatttcacaaatatagagtcactaaggacaacgatttagatgtatcagatcattatgcaagattgaagctgttagagcgaaagttgaagtttttggagattcaagaagagtacatcaaggatgaggttaaaaatttaaagcgagagcttttacgcgcacaagaagaagtcaagcgcatccaatccgtgcctttggttattggtcaattccttgaaatgatcgacgaacacactgctattgttggctcaactacaggatcaaactaccacgtcagaattttaagcacaatcgatagagaacttttgaagccatccgcttcagtcgctcttcaccgtcactccnacgccttagtagacgttttgccgccagaatcagattcgagcatttcgttgttggcagcttcagaacgacctgatgttaactaccaagacatcggtggtctcgatatgcagaaa

SEQ ID NO: 23894 - DNA, 580 bp, Sorghum bicolor
  Clone ID: 30163238
gtcccctccccttgctctgagtctgatccctcgctccttccgtcagccccccatctctagggttttagcgccccatttccgcatcgccattcccgatcggatcgcccccttctcatccgccgccgagcagatcccggcgcgagccacccaaccctccggcgccgccacccttcgtctcagagggtcggtctccaccgaaagcctcgccacaaatcccctccgtttctcgctccggccatttgttgcaaagattgtgttttttcccctcatccatgcctcgcgttccattccatccgtctccacaaatcccaccgctttcttgagatctctcgttcctcgatctgatctcgcctcgtcccgccaccacaagcaactgcggttttgtgcgagagttccttgggggagggcaagatcctcagagttagagattcttgcgtccatttgctcgctccaatacctttcgggagcatctgatctccaacagtgagacaaagtagccacctttgtgccgttccttgcaactaggcttgcccccgcctgcgcatcggtgggtggcggcgctgcccattcctatgaatgg

SEQ ID NO: 23895 - DNA, 535 bp, Sorghum bicolor
  Clone ID: 30163242
accgcccacggccgccgtgcgcttccttcccggccgccgccttccagcttccgcgctttccccatcccgcattcccgttcaccatctacgaaacagaggagaggaatggccatctcctccttcctctccgttcgcgggcgcccaatcgtcgtcgtcgtcgccgtcaccctcttcattttcctgtcctctctcttcctcttcttcagccccggaccgtcggcgctcccacttttctcctcctcatcctcacacgtctcctctcaagtctcaattcccgactcctctaccgcatcttcacccgaaaccgcatcccctattgccggcagcagcagcacttctgttgatcgcgtctctgctgacgcatctccgcccgtaaccggaaccgccatcgcgtctgatgcggtcaacaacagcaccgcggacccgcttcggacagatgtcaccgccgctgcgggcgctggtgacgcggaggctggcgtgccccaaccagatcacggcatgccctctgccgccactgaagcgatagcgagtggat

SEQ ID NO: 23896 - DNA, 692 bp, Sorghum bicolor
  Clone ID: 30163245
ttttccccatttgccattcccgacgagcaccttcaccgtctcctcccacctcgcgtggcacgccatggctttctccccgcgctcgccgtggtcgcgtcccaagagaaacgacgtctactcaaccttcgtcgtccacggcgatgacgacgaggacgacgcccgcggcagcaggcgcggcaggggcccgtccacgcgggcggaggaagacgaggaggaagacccctcctcgctgcctccgcttctccagcggctccccaaggacttcggcggcccctcctttgacgaagacgaggacgcctactcctccgaccccgacgatgcttccctctccgctacggtggtcttcaagagcggcgccccggcctccgttcgatctccgttcctggatctgcggcgctccagcccccgcgctaccgatgacgacccatactctaccttcgtcgtccactccaccgcacgctcgggggggacctcctccagccctcgagggtccgcctcaggcacattcatccgtcgctccgggggctcgtccagccctcacgaatccgtctctggcacattcatccgccggactagcaccccgtcgagcccccgggactcggtctccggcacattcatccgccgaccagggagcccgtcgggcccccgcgggtcgttctctggcaccttcattcgccacaccagcgggggtt

SEQ ID NO: 23897 - DNA, 623 bp, Sorghum bicolor
  Clone ID: 30163250
ctcatcagtctcgatcaactctacagcctctctgatacagctcatcatgtactttgtgtcttctgcctttcttctcggctcattcgttcttcagaacgtcttgggccgaccaaccttcgatgagaggagtctcttacaagagagacagtcttcggtcgactcctttatcaagtctgagagctcaattgctattgagcaactcctctgcaatatcggttccgatggctgcaactccaagaacgtagccactggtattgtcattgcttctccagacacacaggatcctgactacttttacacctggactcgagatgctgctctagtcttcaagtacgtcgttgataggttcatcaaccagtatgatgctggcttgcagaggaagatccaggagtacatcgcctcccaagccaagctccagggtgtttccaacccttctgggtcgctttcggatggctcaggtctgggagaggccaagttcaacgtcgacatgagtgccttcactggtggttggggtcgacctcagcgagatggtccagctctgcgtgcgactgctatgatcacctatgccaactggctgattgccaacggctacacctccacagccaatgacattgtgtggcctg

SEQ ID NO: 23898 - DNA, 564 bp, Sorghum bicolor
  Clone ID: 30163260
atagacaccagccctcgcccgccgccgccggggctgacgagccgtgggaaattgaagcggaggaagagagagagagagagagagagagagagagagagagagagagagagatgctgcaggtggaggaggcgctggcggcggtgctgtccgcggcggcaggccacgcggcgccgcgtgccgtaccgctgcacgacgcgctggggctcgtcctcgcggaggacgtccgcacccccgacccgctccctcccttccgcgcctccatcaaggacgggtacgccgtcgtggcctccgacgggccaggggagtacccggtggtcacggagtcgagggcgggcgacgacgccctcggcgtggtcgtcgctcctggtacggtcgcctacgtcaccaccggagggccgattcccgatggcgccgacgccgtcgtgcaggtggaggacaccgagcaggttaccagcggagcggatggggccaagagggttaggattctggcgcgggccgccgaggggcaggacatccgcaatgtgggatgtgacatagagaaggattcattagtactcaactctg

SEQ ID NO: 23899 - DNA, 631 bp, Sorghum bicolor
  Clone ID: 30163278
atcatccatgcttgttttaccgagcaggcctgccgtgtccccgtccggcgacccggtccgcacacgagagtttaaacaggcgggcgagcagggcggccgtcgacacgggactgaagccaccgtcgcggcaccatgaggcgccgactgctgctggcgtgcctggctctgctggtgccgttgctggcggcgccgcgggcggccgtggcgcgggagtacgcggcggtgttcagcttcggggactccctgtcggacaccgggaacctctgcgtggacggcatcccggactacctcgccacggcgcgctcgccgtacggcatgacctacttcggctaccccacggggcgcgtctcggacggccgcgtcgtcatcgacttcatcgcgcaggagctggggctgccgctgctgccgccgtccaaggcgaagaacgcgacgttccaccgcggcgccaacttcgccatcacgggcgccacggcgctgggcatggacttcttcgaggagcacgggctggcgcgcgccgtgtggagctccggctccctccacacccagatcgggtggttccgggacatgaagcccagcatctgcagctccccgcaagagtgccgggagctgttccggcggtcgctgttcgtgg

SEQ ID NO: 23900 - DNA, 725 bp, Sorghum bicolor
  unsure (1)..(725): unsure at all n locations
  Clone ID: 30163279
ctcccttcctctctctccctcccaaatcccctcctcgtcgccgcctccctcctggtttccaagccccgttgggaggctcgccggcaccggcattgggtataacctcgccgcctccgtccgaatgcagggtcttcacatttaatgggctggatgcggtacatgcatgtttgcagtgacaagaacacattgaaacgttggtttttcattgacaagagggttggttaagcattttggtgcactaaccttttgtagtctgtaattggtttcacaacaagtctcttggagttgtgtcttgttgatggatttgaagacaggcctcaattcacctgttattgctgaccatctccctacgttagcatcacctgctgctgtcatgactttcacaacacctactagctttccctctccggggctttgcttgaacactacaaagaagatacctctacctggtaagattgaagaagttcgtgctactggatggcttgacctcatgaaggcctcatcacctacccgcanaaggcagaccaaggatgtcatctgtgatactcaatctgatgatcttgatttgcaataccgcaactggacggtgaactatccttctgctttgacctcatttgaggaaattagtgatcttgctgggaataaaagattggcattgtttcttgattatgatggaacactttcaccgattgtggacaatcctgaaaatgcattaatgtctgatg

SEQ ID NO: 23901 - DNA, 629 bp, Sorghum bicolor
  unsure (1)..(629): unsure at all n locations
  Clone ID: 30163282
gtatagtgcccggttgttaaaaacacaatagttctttgcttacacagaaagacggcgcaatcaaaaaattcggtttagtagcgatcaaacctcaccgagcgcacttgacggactaactaacagatgcaacttgaagtgtattttggcatgttaattgcgatgttgtggactgtaacctaatttgtcgcgaaacgtattgggtttggtaagcgatcgaattttattttcaacggccgcaagatcggatctacagacaggttagttaatcgaatattgtatctattgactttttgataggatttgttttttacggacattcgtgtccagtgcattgaaataaatctcgcgtatctttattaaatcaattttcgcgttaccacaatggaaaacaacgaacctgagctgaatactagaccctcgtttggtgatatttcaaactcggattggcagtggaaacagattcaacaatcagatcctccatctccgcgtcatttacactcgttagtttattatcacgcttacgatagtttatatttaattggaggccttggagacgacgatnaatatccnaacgatggcactagtacctggcgatattcattagacagacaacaatgggagcagagaag

SEQ ID NO: 23902 - DNA, 516 bp, Sorghum bicolor
  Clone ID: 30163288
ttcacttagtgatgcatatggagctgagggtgaactaggcattgtattgtctgaaaggttcatggaacatgatgcctattcaatgtttgatggtttgatggacggaggtagcggagtggtccgcatggcagagtttttctctacatccaaggttgggtctagctcaagtctagcgcctgtcatcgaagcctcatcatctttatttcacttgctttccattgttgagccatctcttcatagccatttcattgagctggatgtagaaccacaatatttcgctcttcgttggctgcgggtcttgtttggacgagagttctgcctcaacgatcttttagtcgtatgggatgaagtttttgcttgctccaatgacatgctactgggagaaaatgaagaatacagttttaagatattgtgctcgactagaggggcattcattgcagccatggcagtctctatgattcttcaccttagatcatctctgctggccactgaaatcaatacgtcatgtcttcagag

SEQ ID NO: 23903 - DNA, 597 bp, Sorghum bicolor
  Clone ID: 30163295
aaactccgcggcatcgtctccttcccccacttctccctcggcagttccgcgtgcctgccggtgccttgtacccaatcgcctcgtcccgcttcgcatctcgcacttcgccgctgcgattcctcagcagctccacagcaccccacccccgcgccggcgagatggagctcaagcccggcatgtcggcgctcgttaccggcggcgcctccggcatcgggaaagcactttgtattgcttttgcaaggaggggtttatttgtgactgtcgttgatttctcagaggaaaatggaagagaagttgctacattagttcaaaaagaaaatggcaaatttcatggagatcttagagttccgtcttgtttatttgttaagtgcgatgttagtaatgcagataatcttgccgcatgttttgagaagcatgtacacacttatggtggactagatatctgcatcaactgtgctggaattgccaataaaacactagtttataatgatacatctgatggaactagaacgtggaggcatgctgttaatgtgaaccttgttgctgtcgttgatggtactcgtatcgcaagtcaaataatgcgagaccaaaagaagc

SEQ ID NO: 23904 - DNA, 594 bp, Sorghum bicolor
  Clone ID: 30163296
aaaaaatcctcgcatgcatgtgagagccatatagctcagtctcactgtcgcctgcatgccctgctctgcttgtgagcaccacacgcatcaatcactggccatgaacaagcagcgagagctccctgcatccagccatggcaaccacgacggcggttggtaggaatggagaaggagagcagaagaggagggagaaaggaggcttcaagaccatgccattcatacttgggaacgacatctgcgaccggttcgccacggccggcttcggcgccaacctgatcacgtacctgacgaagcagctgcacctgccgctggtggaggcgtccaacctcctcacaaacttcggcggcacctccagcctcacaaccatcctcggcgcgctcgccgccgactccttcgcgggccgattctggaccatcgtcgccggctccgtcttctaccagctcggcatgctcggcctcgtcgtgtccgcgctcctcccttggctacgcccctcgccgtgctccgctcctcccggcggccccgaatgccaccgcgcgtccgggttgcagctcgccgtgctgtacctctccctgctgtgcaccgccttcggctccg

SEQ ID NO: 23905 - DNA, 627 bp, Sorghum bicolor
  Clone ID: 30163300
cccactctcctcattctcttctctgcctcttcttgagcccgacctttctcattcttgagtcatataatcggcaactctttctagacaaaagacacccgaaaacaaagaaaggcacagggccagacaccgccaacatgcccagcaagaccagagtctacaactggttcattgccatggtagctgcgtcttgtatgacgctctacggctttgactccagtgttttcaacgctctccaggcctcggagaactggctgaactggttcaatctcgacctcaagagtgacagttacactgtcggtctcatcaacacatgctacactattggtgctatcgttagtggtttcttcatcggtggccccttggctgattggcttggtcgacgtgccggtatgggtattggttgcttcatcaccatcatcgccgctatcatccaggcttttgcccccaagggaaagcttggtgtcttcattctcggccgtgtcctcatcggtattggccagggcactgctctcactgctggccctgtttacatcggtgaggttgcccccgctgagattcgaggtcaggtcatgaccttctggcaactcttctactcggtcggtgccttcattgcctactggatcaact

SEQ ID NO: 23906 - DNA, 501 bp, Sorghum bicolor
  Clone ID: 30163332
ggagatcgagaaggagcccaaggccatcaagtccggtgatgccgccatcgtcaccacggtgccgtccaagcccatgtgcgttgagaccttcactgactacccgcctctgggccgcttccccgtccgggacatgcgccagaccgttgccgtcggcatcatcaagtccgtcgccaagaaggaggccaccagcgccaaggtgacgaaggctgccgtcaaggccggcgccaagaagtaaaccggagagtgtccgttactcccgctttgttggcacgaggtccccaccacgcaccccctctcgctacattcggctcgcagcgccttcatcctccattttcgtctccgactgtggccccgcccttcaagacgacaaatgcatctggaaaaaataggcgcggacgataccgcatggaaggtcgagcgtgcttctttttaaaatccaatccgctaaacacctcttcacacgcagaaggctttcaataatggaagcacgctgcgttaatg

SEQ ID NO: 23907 - DNA, 388 bp, Sorghum bicolor
  Clone ID: 30163335
attgaccgaaaccgcgatatcggtactttcctgattactctccttgccggccttcccgagacaccaactgccgacgccgttgaggccctcaaccaggtctttgacatctatgccgatgaaggttattcatacgacaaggaggttttctggaacaacaacttcctgaagcaccttgatgagacggttcccaaggtgcgaactatgatcaagagcattgataagcgtgccaacagcgagcttcgcctgcgcgccgacgaggccgtgttgaacttgaatcgtttcctggcatacaaacgaaagaacaagccccaggcataattgggtaaataaaagcacttgatttttctggacgtctatagaaagttcatccatttctgattcacctccc

SEQ ID NO: 23908 - DNA, 545 bp, Sorghum bicolor
  Clone ID: 30163357
tccatcatgaagtgtgatgtcgatgtccgaaaggatctctacggcaacattgtcatgtctggtggtaccaccatgtaccctggtctctccgaccgtatgcagaaggagatcactgcccttgctccttcttccatgaaggtcaagattattgctcctcccgagcgaaagtactccgtctggatcggtggttccattcttgcctccctgtccaccttccagcaaatgtggatctccaagcaggagtacgacgagagcggtccctcaatcgttcaccgcaagtgcttctaagctacccgaccgacaaaccaaatcctcccactcgcgcaacgacgacaagatcatggaggtggcgacagacgctaagctttgggtggttggcaaacgtcaaagtcgactctcatatttacgaaaagtttttgacatggtcagaagggtgggcgttgcgcttacgacgagatgtgatagcccctttgttgtagttgcgcgtgtaatacgtgcctaggggtagaagctgaggttgacatacaaatacttttttatttccg

SEQ ID NO: 23909 - DNA, 536 bp, Sorghum bicolor
  Clone ID: 30163364
gagggcgagtgggagatggtggcggaggaagcggagcctacaacggcggcggcgtccaccgacgcgccctcgcaggaaccgatggcgagggaggtaatgaggacgacgggggaggccggagctgccgccgacagcaacctggacactcggaaggtgatggagatggtggcggcgctgtgcgagcagaacgcgcagcagtgcgcggtgatcagggctctggcggagcgcgtggacacgctggagcgcgccgtgcggcgggtggaggacgccgagcgccgccgccgccgtggcaagaagcggaaggaggggaaggggagcaagggcaacaacagcaagtgctacagcgattgatgaggaccgcaaatctgaactccaataacagctctgctcacaaagcttcttgtatctcagtagctaagagaagtttattttgtcgctttatttcatttgttttttctcctaaaactgccgggatttgttctcggcctgtggtggcgttcatttgatctgtataattagggccttgtttagtttct

SEQ ID NO: 23910 - DNA, 322 bp, Sorghum bicolor
  Clone ID: 30163374
aacattaaccctcaagaaccctgcaagtgcatgatggagcccaaggtcatggactggctggctggaccttcacaggcttcctgatccaaaggggttttttgggtaattatgacgtttttctggctgtaaaatttcaacctttgtcgaagttggtgtttgagccgtatgtacaagcaaatatgctacttcaaatgtttagctcaccctcatgcctcctttgcggtaaccagattcgagcgtttagctcgaacagctttcggtaggtgttatgagttgagcatcccgttaacaacttttgaatttgtagcaagttttaatttgg

SEQ ID NO: 23911 - DNA, 646 bp, Sorghum bicolor
  unsure (1)..(646): unsure at all n locations
  Clone ID: 30163376
gatacattcgagcacgccggacgcggtcggaaggggacaaagcagcaagcggcgccgggctcccccccgtctcccttcccttcctcgcccccgatcgacgccgatcggggccgactgctcgcgggggacgccgatcgaagcccgggcggcgcgctgcttccaatatacggaacggaagcagtgtctagttttcttcagttggccgctacagtttccagcggtttccgccagttgtctaataacgtattgttgttgtacttaaggttgcttttgtcagtatttgccgggttgacatacttggtgttgtaaagcattgccatttttgggtcatgacttgtttttattgaaatcaattggctgccaagggatacaataaatccttgatgcaacataataggatcaccatgctgtcttcctcagagacttgccagcttggttctagttctagcaaccctgtcatggatcagcagaatttacttcccaacaactctnacgtggatgaacagattttactcccaaatgcattagagcatgaggactacccacactatttgctcaatagtcatgaggtgggaatgccaagtggaagcctgatcggtcagcaaaatacaagcttgagcttgtgggaaccagctggatctagctc

SEQ ID NO: 23912 - DNA, 580 bp, Sorghum bicolor
  Clone ID: 30163385
atcgtcacattcacagaacaactcgaactcgaatcgcagctccaacaaaaagctcgacgccccagcagcaatggcgtctcgccgcttcttctcctacgacccctacgactactactacacctccccgtaccactactcctacccgtactaccagtaccagcacccggctccgtcacgcggcgtcagcgggttcttcccggacgccgtgccggaggcggtgaaggtggacccgcggcccagggtcgagtcgtcgaggccagtctctattcccgtccgcttcgtcgggtctgacccggagccggagcgccgggctacggcaaggatgccggcggcgtcggcggtgccgaggaagcgggcgccgtcggcggaggcggcggcggtgaggctgcaggccgcggcgcgcgggttcatggcgaggaggtcggtgcgcgctgttcgcgaggtggagcgcgaggcggcggaggttggcgagaaggttgcccgcgaggcggaagcgctgcgcggggacgcgagggcgcggatcggcgtcggggagtcgctgatgaagttgctgctgcggctcgacgcggtgcgcggcgcc

SEQ ID NO: 23913 - DNA, 439 bp, Sorghum bicolor
  Clone ID: 30163394
ctgcgcccgccccgcgtgcccgaatttcgccgtaatccggctggtttttcccgtgcgcagcgagcgggccgtacccgtaatggcgctgtccgcgtcggcggcgtcagccgggcgggggtcgcgggcggagaaggtgaggaggatcttcgagcgcttcgacaccaacggggacggcgggctggaccgcaacgagatggccgcgctcgtcgtcgccgtcaacccgcgggtcaagttcagcgaggaccagatctccgccatcctcgacgaggtgttccgcacctacgccgagttcatcctccccgacggcaggggcctctccctgccggggctgctccgcacctacgacgacggcgccggggacgtcgaccgcgacttcctcgcgctctccctgcccgtcgtcgactctgacgcctcatccccggagatcgccgcgggggac

SEQ ID NO: 23914 - DNA, 568 bp, Sorghum bicolor
  Clone ID: 30163398
atttaatcctaataaatcatttctcatcctcaatccgatagaaacaacatgacgacctcctctctctcccaaaatctctcctttacacctgcgacccccaaaatccgccgcccaatcttcccaatcaaggcaaactggagatgtttagtaccttctgatattacttctatcaacaaatataaaccaaagatggtcagaactgtcgagatatcccaactaaaccatgataaactcaagggtcaaagctttcgggagctcaggagagccttggttgataacaaaacagcttcttcaatcaagatccatgatcaaaaatggcaaaatctcaccctggtggttcctcatatcagctctcttttcaactgcagcaaccattataaaaagcttgaatttccttgttttgacaaccgaagcctccaagttccaactcaaaatgccataaaagctctgacaaggcttggaagaagcaaagatcttcaaagcttgaaaatcaaattcgattgccaaggaagaactagaaatagagtcataaaacgcctttcacctcaacttcaaggccttacaaagt

SEQ ID NO: 23915 - DNA, 470 bp, Sorghum bicolor
  Clone ID: 30163404
agctccatccgaacctgtcacctgtgtgtgtgagtcctctgaacgtcttcagttcttcgttctactccaccaaattgccatttaccaagcacaaattaaccacgtcgcaaccgatggaggaggccgtggaggacatcgtcattgccggcgcgggcctcgccggcctcgcgacggcgctcgggttacacaggaaaggggtgcggtgcctggtgctggagtcgtcgccgacgctgcgcgcgtcagggttcgcgttcaacacgtggaccaacgccttccgcgccctcgatgccctcggcgttggggacaagatccgggagcaccatttgctctacgagaggatgattgccttctctgcagctacaggtgaagctgctgcagaagtaagcttaaagattcagggcaaaagcgggccacacgaaatccggtgcgtgaagcgggacttcctgctgcagacgctcgccaacgagctg

SEQ ID NO: 23916 - DNA, 577 bp, Sorghum bicolor
  Clone ID: 30163405
atttttttgtacaggaaggacagctgcacgtgtatacaatatgacgcaactgtacaagacacctgtcgtgttccaagatcttcggcctgccgaggcttacatgcaattattcgatgccttggatcatgtaaataaattgtctgatgatatatttggcaagattagcgcaagagtccaacaagaaaaaactcgactggatgcgatcaagaatcgaattgatagcgccaaggaaaaagtcaaaaagatcagcggcacaactaaggcaattacaattatctcgcccaacaaatacacagcaccagaacggttaccggacttcaaaccattattctgcgatacccctgcacaactagatattaagcactcaaagtttaagctcgacccacagacgaatccgtttgccccgcccgagccaatctcgaactctggtggtgaagtgaacattgacatcaagagtgttgatcagcgtatcgaggcagcagctgaaggtcttggtcgtcttccagagtacttgccttccattgcggatctgctgttgttcaatacctcctacaatccttaccgcgcttatgtatca

SEQ ID NO: 23917 - DNA, 413 bp, Sorghum bicolor
  Clone ID: 30163414
tggaaggtggaatcgccagaaaatgccctccgtcctccaccttctcttgctgctgctcgccgcctcggccgcggcggcagccaccgctggcgctggcgctggcgctggcaccagcggggacccgcgggcgtacgaggcgctgttcgacgcgtggtgcgcggagcacgggaaggcctacgccacgcccgaggagcgcgcggcgcggctggccgtgttcgcggacaacgcggccttcgtcgccgcgcataacgcccgcgtcaacgccgctggtggcggcggcgcgcccccgtcctacacgctcgcgctcaacgccttcgcggacctgacacacgaggagttccgggccgcgcggctcggccgcatcgcggcgggggcggcggcgctccggagccccgccgcgcccgtgtaccggg

SEQ ID NO: 23918 - DNA, 707 bp, Sorghum bicolor
  unsure (1)..(707): unsure at all n locations
  Clone ID: 30163445
atttaattaatttctcattaaaccctcctcaatgggcaatctttcaacaaaaatcaaaccgcccaaaatctgttctcttcgtaaatctcccatttccttcaataaaaacgaataaccaatcatcttctaccacccaagcatcgattcacaagatcaactctctttacgaactcaccttcaaaggagtcaatccatctttatattacgcgaatctgaaggaatttttacattcgccaaaaattttcagaccagctttattctaattatctcaaagaaagatgaagaagcccagaatgtacgtgaaaaattgaaaaatgttcaggacatttttatgagaaggttagctgattttgaagagaaggaaattctcaaagcaactccatataaaaagacagagcctttggaggcgcacgtgttgtatacacgtcaggattttgaaaaggaggatatcaaggggataatgagagaactgaagacggcagaggcagcgagagggttccgtgaggagtttctttattgggaaaatcctcaaagagatggggtatttcaggaatctgaaggatgtgataaatatctaggagaggaagtatataaagaatgccagaggatttgcaaagcgacacttnaaagtctggtaaagacgaaagggaaagagaaaacaaagatgattttctatgtaaacctcgcagaaagctgtaaagaattcg

SEQ ID NO: 23919 - DNA, 443 bp, Sorghum bicolor
  Clone ID: 30163454
tacctgcctcgcgaagtgacctgggttgccaaccccggtgagggcgagatggacgttatcgagcgagtaattgacgaccgagacggtttccttaagcgaagacaagctgtgagggatcttgccaagaacctcatggagcagaaccatgccaacaccaaggcctggatcgaggaggcctttgagaagtacgagaagaactaaggaaagggtaaacgcgcaactagacatgattttactggggatttttgctatcttgtttttaactgtacaattacgcggcaccatttcacatgatcgggaatcaaggatgagcggctttatgattcgagagtttttattttattaccacccatgcatgaacaaacaacattcttaatatacggtttttcaagtccattaaaagaaaaatgaaagcaaaaaatacaattacgaaatcccccttt

SEQ ID NO: 23920 - DNA, 502 bp, Sorghum bicolor
  Clone ID: 30163462
acgcagaatccgaacgttcagtgcaggacgccctggaccgggtgatggtgaacagaacaacagtgatcgtcgcgcaccggctgtccacgatacagggcgcggatgtgatcgcggtggtcaaggatggggtgatcgtcgagaagggaaggcatgacaccttgatcaagatcgagggtggtgcttatgcgtccctcgtcgcgctccattcagcagcgccgtcgtaacacatggcaagtccaggcagatagtctgaatttgtgataggtgagcaactgagcatgcaaagactggcagcttaacaaagttgaggcgcccgttttggttgtccagctcctggtgaaatagacactgcaaggcaaaagatgtataaactccgtagcatagctaagccggaaagaagactacacaaatacagcaatgtagcaatcctaagttacacaaatagcaatgtaacaatcctgtctaagttactactaatgtgatgaacacagatattcagtgt

SEQ ID NO: 23921 - DNA, 527 bp, Sorghum bicolor
  Clone ID: 30163479
tcagggagccgttcacggcggagaggacgaaggccttgccgccggactcttgcgcgagcgtcaccagctgggagttggaccccggagggacgggggtgatccagtcggtggccgcggcggcggcggcgccggtcttggcgtcccattctccggtagtgagaccggcgaggaggaacggcccgaacaggactgcttgtatagatgcgtactccggacgatcatctgaacgtttcagttacagtgttgtcaattgtcataaaattatcagagatttcgatgcttaagagtgaaaattataagtggaaaataagtaattatcctataatgagtgcatcatttgaaaaattaactcaacacaatttaatcatcaacagaactcgaaatttcagaccttttattgcttcagtccttaggtggataggtaattggagtaacaactgatcaccactaccccactgcttgctgacagtgaggaaagtccctggcagaaatcaagattttgttagaacaatcatccctgtaaatat

SEQ ID NO: 23922 - DNA, 543 bp, Sorghum bicolor
  Clone ID: 30163481
tccccgaccagccgccggtcatcttcgactacaccgccgatgccagcgacacggccatgttgcagtacacgcccaagtcgaccaaggtgaagacgctcaggtacaacgagacggtggagatggtgctgcagaacacgcgcctgatcgccaaggagagccaccccatgcacctccacggctacaacttcttcgtgctcgcgcagggctttggcaactacgacgaggcgacagcgacgcctcagttcaacctcgtcaacccgcaggagcgcaacaccgtcgctgtccccacgggcggctgggctgtcatccgcttcctcgcaaataaccctgggatgtggttcatgcactgccactttgatgcccatcttgatctggggctggggatggtgtttgaggtacaggacgggccgacggccgaaacgtcagtgccgccacctccagcagacctaccacattgctaactgctaagtgctaatcatggtcgacagccaactgtgattgtctgaatgggccaatcgggtgcggagatagatgggatttgtc

SEQ ID NO: 23923 - DNA, 397 bp, Sorghum bicolor
  unsure (1)..(397): unsure at all n locations
  Clone ID: 30163484
aactcagatcaagtcctgggatcatgctgttggggtaatctgcgtgcaggaagccggtggtcagaccagtgattggagtggaaaaccattggatcttgcagctgacctaacatcgcgcagaatcatctacccttcgggcggtgttttggtgacaaatggtgtgctgcatgacaggcttgtcgaaatgatctcagcaaataacgagtagctgaatagtgaatagcttcacaagccanacacaatgtttttttttttgagagggggggagatgttgtgaaattgaatcattttaccttatttacccccatgaaattgtatttggtctccacattcagcggagaaacaaagcatgttcagatggcttccattgccgcaacagttacatgaatgaaatttt

SEQ ID NO: 23924 - DNA, 578 bp, Sorghum bicolor
  Clone ID: 30163490
tccgacggcggtggcgacgagtacatgaactgcctggcagtgccggccaccgctccaggcgtgccccggcagcatcagatcggcagcatactgaacggaggaggtgtcagtgtcactggcagcagcttcttcagagagggcgtgcatggccagcagttccagggtcaatggctgaaccgcttccctgcgccagcagcaatagagcagaaaccgcagctcctggactcgtcggcgatgaccattgcgttccatcagaacgatcagagcgtcgctgccgccgccatgacgaatgatcagtgctacaaggacgggtactgggacgagattgcaaagttcatggaggtcaatgatccaacagtactttacgactgtagatacgcttgatcaatagaaagttcagagctcggagttcagaatttcagagtagagagacccaggtaccaagggtgcatgagagactggcatgcagggcctgctcctccagtgaggccgctagtcagttagattttgcccggcaatgtgcccaaaaaccccccacccttttgtgttcattattctgatcggatgtatacaggacg

SEQ ID NO: 23925 - DNA, 671 bp, Sorghum bicolor
  Clone ID: 30163492
atgtgatcatccgtaaaaggtttgaaggatgagttatgtttactgtatggttgtacccgtccgaagagcatgcaattcatttcgtactttatacccgtctgtatcattgtagagtagttgataagttgtgcattctttagaccaggactgctgcggatatgacatgctcagcacacacacaatatgtgctcacacgtgactgtatcaaacatgtatggaatgagagggagttgagtatgtttgtggtccagcagcaagcgatattatggtctgctcggaaagtgttgtgatgacaagaaatggttgcggctgtttcagcttcctaccacgcagggttggcgctcgcaatggtgctggcgaataggcctctgtgcaccacgcagctgtggtttgcatttgagccatgttgaatctgcatgtacctgtgccctgatacgcctcaacgcaagcgtagctgatgttcacactatcatgtactcttggtgttcagcagctgaatttggttgattgtggactggatcttgcaactcgttgctttcgcttggcatggggaacatgacaagtgcatcattgcaggatttgatgtacgccttcgacatggtgccagctgctgaacatgcgatgttcctgtggctttgttggcggggcatgcatacatgaactgatgtaaa

SEQ ID NO: 23926 - DNA, 521 bp, Sorghum bicolor
  Clone ID: 30163508
ccgctcttgccctcggtcatcgcaatgacgcgaatatgggacaccggccgctgctcatggacattgacacagcgttcccggatttggccggtcacctccgcgcgattccgaacgtcaatccgcccgcgatcggccgtcaaaacgcgcacgcggccgtttacgtcaagggcgcgcacatcccggccattaacccgatgcacgtgagcgcgtggccccttaactttttggccaccaaagcccgggtccacgccgtcatcgccgacgcggatgaggatgaggacaccgatgccgatgagttcgaagccgacgaagacgcagaagacgcagaggaggaggaggacacggaagacgcggcggaggaagaggaggcggacgaattggacgcgtaactgcgtaactgcgctgccacttctctccttcgttcgctttcttgcgttcgctctcttgcgctgcggatgttctcgatcctgtctcgcgcacgaccgtttcctctctttgtgatgagatggcgtaaactcgtt

SEQ ID NO: 23927 - DNA, 619 bp, Sorghum bicolor
  Clone ID: 30163516
cgctggcttcggtaacgtccacggtgtttacaagcccggcaacgtcaagctccaccccgagcttctcggcaagcaccaggctcacgtcaaggaggccctcaagtccgacaacgacaagcccgtcttcttcgtcttccacggtggctccggctcctccaagaaggagtacctcgacgccattggcttcggtgttgtcaaggttaacgtcgacactgacatgcagttcgcttactgctccggtatccgagactacatgatcaacaagcgcgagtacgtcaacactaccgtcggcaaccccgatggcgaagacaagcccaacaagaagtacttcgacccccgtgtctgggtccgtgagggtgagaagaccatgtccaagcgtgttgcagaggctctccaggacttcaacactgccaaccagctataaatgtcgatgaacgacaatagctagttctaatgatatcccaactgcggcaaaattcatgagtcgtttggaaaagaaaaagaggggtatagaaaatgccctcaccttggttccgacacaacatagcagtgtttagttgcaggggcgttacgaggcgatgaaagtagtaaaattaatgaagaaaaaaaattgacgacg

SEQ ID NO: 23928 - DNA, 396 bp, Sorghum bicolor
  Clone ID: 30163517
gggaccaccccgtgacgaacccgttcggccccggcagccccgcgctgggcgccgtggcgttcccgaggttcctcgtggtgtccgccggccgggacatcctccacgagcgcgtgctgcgctacgcggcgaggcttcaggagatggagaagcccgtggaggtcgtcgtcctggaggagcaggagcacgccttcttctcccgccagccatggagcgacgggaccagcgagatgatccgagtcgtgaagcgctttgtctccgaagagatcggcgcggagtgcaagtaatagtcccgtggttggtctaataaaaacgtgttgtgttcttggcaccttgcttcttgattctctccatgtaggagtaggagtatagaacatggcaaggctggacttaaccccg

SEQ ID NO: 23929 - DNA, 605 bp, Sorghum bicolor
  Clone ID: 30163530
aagcgaaaagagttatttactctatactttaagcgtgtcagctgccgcgatggcgaaagcgaagcagttcgtgtgcatatgtgcggcgatggcgctggcgttcgtggcgacctttgccaatgcgacggtctgcaacatcatgattctgacggacctgaacgcgtgggatcacgaacagcgtatgggcgcggacatcatggtgtcggcactcgacctgcacgctgacacggactatcgcgtcgtgtacggcggcagcgctctcaccggaggtgaactcacgcaaaccgctaccgccgtcgcggaaaagatcgcagcgtgccatgcggcgggtcggaagatcctgattgattggcacagcgcgcagagcacgcgctcgatcatcaagaaaatgggcccgctcctgtggcagacgctgcgcagggccgcggccggcggtgatgccaatcacctccgcaacgccgtccatgcggcagtaccgcgtccggtcattaacatgttctcgtgttcgcccttcgacttcggcgattacgactttatgcgcgactctgtgaacagcatcaacgtcgcgaattggggcggtgtcgccggcagcggcgcagcggcca

SEQ ID NO: 23930 - DNA, 535 bp, Sorghum bicolor
  Clone ID: 30163544
aactcgttctgtcgtcttgctctccgcatcccctcccacctccaactctccaatcgactccgtcccaaactacaatccgcggcaacagaaaaaggcggctccttttaccagaaacagaagcaagatttccggattgctccgcttgatcgccggtgaatcgacccgacagagcggcccatggccggaaccgagcggccaaacggcccgatggacccgccgcggcccgcgagcggccgctccggcggggtcggcgctggtgactcgccggtgaggtgggacgacgacgattacgacggcggcggcggccgcgtcgaaggcttggcgggactccacatatttgaccaagaggcagacgagccaccagtcaataacgacatggccagcagccttgatactaactgcattcctattgctaacggattcaacactgaaacaaccgaaacttctctagagacagaacctggaaagggcattaacccgcttcatgagcatactggcatctgggtccctgtttctgtcccgccaatgacagcgc

SEQ ID NO: 23931 - DNA, 541 bp, Sorghum bicolor
  Clone ID: 30163549
ctgtccaccttaccttttccccatcccccctcgcagtaggcacaggcaaggcaaaaaaatatctcttggctcttcttttctgtcgccgctttgaaacgaacttccgactttcaatcttcctctccatcctttcccgccggtcgagggctgtgatgctttgatatttctctccttcaacatccatcaatcaagctcaatcgttcgttcaatcttgcaaagcaaagttcaaaaaggaaacaacgaaataattcacaacaatggccgtcgctctacctcggcgattttattcgctgctctgggtcgcagtccttcttgcactcgttgtcttctttgtcttcctccgcgaagacacatggtcatcaattcctcgacctcctaacggctggaagattcctttcaccaccgatgatggcgtcctctcctcatggatgggtaacaccaagaaggcacccgcaaagaaccccgacgaccctctgcgcattatgctcgtagagtcctccggtactcacgatgaagttgctgctgccctcatgcacgcctt

SEQ ID NO: 23932 - DNA, 675 bp, Sorghum bicolor
  Clone ID: 30163557
aaagttctccgtttcactttccccaacgctccgaatcctgcagaaatcaccctttccaccccccaccccgcgccgctcggatccccaggcgagcacggcctcccgtccctggcccggtccagcgggttgcatggtgtgcggccgccgcttgtgagctcgatcgatggcctcggcggaggcgcgacgcctcgcggtcgtgccgcagctagagatcgagcagatactgaaggaagctcaacaccgatggttacgccctgctgaaatatgtgaaatactgaaaaactacaggaacttccgtattgctccagaaccaccaaacagaccaccaagtggctcactttttttatttgatcggaaagtattgagatacttcaggaaggatggtcataactggaggaagaaaaatgatcagaagactgttaaggaagcccatgaacggttgaagtctggaagtattgatgttcttcactgttactatgcccatggggaagagaatataaacttccaaaggaggacttactggatgttggaagaggactatatgcacattgtacttgtgcattatcttgagacaaagggtggcaagtcgtcacgtgctagaggaaataacaacattattcaaggaactgctgtggatagtcctgtaagtcaattaccttcacagactatggaggg

SEQ ID NO: 23933 - DNA, 419 bp, Sorghum bicolor
  Clone ID: 30163565
accccaatcctccctccacgcctctcctcgtcgaagagcggacgcggtccacgcctcccaccccttgcccctcccagatcccgccctcctccgatccggccgggaccgtcctcctccgatcggggcagcagccatggatcagagccggcgggcggtggagtcgtactggcgctcgcggatggtggacggcgtcaccgcggacgacgacaaggtcgcgcccgtctacaagctcgaggagatctgcgagctcctgcgcgcctccgacgccagcatcgtcaaggaggtcgccgacttcgtcctcaagcgcctcgacaacaagagccccctcgtcaagcagaaggctttacggttgatcaaatacgcagttggaaaatccggtactgatttcaagagggagatgcaaaggcactcagtggcta

SEQ ID NO: 23934 - DNA, 411 bp, Sorghum bicolor
  Clone ID: 30163568
actactggtaagtaatctccctcacttacctatgaaggttcctttcgctccaggcagggacaggaatagtcattgcagcactggctggtgaagctctattgagatcgaggggagaaaagaaagcagctcgccgtcgcccggctggagaagttccttgcggccgttgccggcgttgaggagggggaagcctgacaccgaggtgtgcacggtgctaagcattgcggcaaatgtgctttggtatacaccacaacttgcagtaaataagattatgactggaaatctcacacagtgccatgataagataaagcatgaagctgacatcaatggcaacattaagatttttacagaagttgagattgaaagaattactagaaactttagcactcttatcggaaaaggtggctttggaga

SEQ ID NO: 23935 - DNA, 643 bp, Sorghum bicolor
  unsure (1)..(643): unsure at all n locations
  Clone ID: 30163577
gaactactactcctggcggaaaatatattgtacgtacacaagtagaaaagatcgatcgatcatggttgccaaggagtttggaagagaagcagtaataagcatggagaaagttaagagagacggagaggcgctcatcgctgccagagccggagacgaagaggaagatgatgtggtgctcccggggttccggttccacccgaccgacgaggagctcgtcacgttctacctccgccggaaggtggcgaggaagccgctcagcatggagatcatcaaggagatggacatctacaagcatgatccatgggacctccctaaggcaagcacggttggtggagagaaggaatggtacttcttctgtctgagaggaaggaagtaccggaacagcatcaggcccaacagggtcaccggctccggcttctggaaggccaccggcatcgaccgcccgatctactctgccgctgccgctggtgccgccactgcaaactccggcgagtccatcgggctcaagaagtccctcgtgtactaccgcggcagcgccggcnagggcaccaagaccgactggatgatgcacgagttccgcctcccgccggccgccgccgccgccaccgccacggatgcctccccgagcatgcaagaagctgag

SEQ ID NO: 23936 - DNA, 649 bp, Sorghum bicolor
  Clone ID: 30163579
cttctggtaccccatgtaatattggtggaacgtaaatctgtcatcaccatggtttccgcaagtcatgcctacagtcttgaaacatcattgggccgggcgaaacccagcaacaccaactggcagagtcggcagacacgcggaaagtgcatcattttgtgtagaaggactgttcagggaggaaaggataagacgtctgtagggggcaagacaaaacccaagaacacgaaagtcaatgtatcgacgacgcaggctccttcagcaacaacaagaagagttccaaaggaatcttccattcaaaagtttgtcaaacaaacgccgctcctcaacaggttttcagatggaactttgctcctgggtgatattgtcatggtggcagcaacagaggcctcttcagggcgcattcgttatgaagacatgccattactagcaggcgtgtcggtggtgtgttggtgtgtggctggagtagcgctgggggactacaggggcgtcccacctcagtcggataactggtatatcaatctgctaggcccagtgttcctggctatcgttgactcaacattgacatgggcattatcagtaactctggctctggctgtgtacagtgtgcttgtgagcagcttcctcatggattcagcacccttatttgatg

SEQ ID NO: 23937 - DNA, 421 bp, Sorghum bicolor
  Clone ID: 30163590
atccactccacgaggcagctgcttcatgtgtacgtagtccgcacctcttcctcttcctcttccggtgacgcgagctgagcgatcctgacgagcgaccaagctgccatgtccaccagcgagagcgtccagatggcggggatggcccacggcgccagcagggcgcgtccgttaccggagccgctccggctgccgctgccgctgccgccggcgcgggcctccttcgtcgacggaggtcgcgcttccggttcccccgctgctgctgccaggacggcggaggcgacggagaccccgcggtactccgtcgccttcagcgtcccggcgtcgccgtcggggctgcacctcggcgcgtgcgcgtccgtccgcagcgtcgcgccgccgccacagccggtcgagcacgagcaccagcatcagaacgctgagg

SEQ ID NO: 23938 - DNA, 185 bp, Sorghum bicolor
  Clone ID: 30163611
agaggaaggttccggcattcccgataaggccgaaaccacgaggagtcggacgcgcacaaacgtgtaaaccgtggcgcgccaacagtctgttcgttaaaataatgataccgtccgaaccctgaatagccattggttttttggcacgatcgatacgatgatttgattaaatgtaataacaagatttt

SEQ ID NO: 23939 - DNA, 657 bp, Sorghum bicolor
  Clone ID: 30163626
ttgtagattggtatagttttgcacagcaagttgtaccaacattctgtcacgacagactgttgaccttttgagcagtcttgactaatccaagcataactcttgattgtgatgtccaaatgagatgagactagaggcatttgaaagcagactttaagggatttcaaacaagtacttatgggccttcatagcttttgtgagttaaaagttatgaagatttctttgcaatggtccgtttttgactcttctggtccgtttagtagtgtcttctgggacttgcacccatccattctttagggtccgattcatccttctcttcttcgatatacctgagtacaatcaagaacatcgtgtaggtgtataatgtttgtgttcacttgttttgcatggtgaatgctcatcatgttccatcatatgatgacttggcatgtcctcatcaagttgttaagaaggcaatggtggtgttccgattggcaaggatagataggttgttattttccataattattagggtttgttttatgtacggttcctatttggtttagaattacgtccaagttgtatgcgattgtaactctttagaacagagtataaatatgggcctagtagcgatgtaaagacaatcaatgaatatcatgcacaaagttttatatctatttc

SEQ ID NO: 23940 - DNA, 617 bp, Sorghum bicolor
  Clone ID: 30163627
ggctcggcgcgggtggttggaagactggagagggaggcgtctcgtctgaaacggccgtgttgaccgcacccggcaggaggccgatgggagtgctaccagcctacccctagccagccagcgctggtggtttcgtttcctaggaggaccgcgcgcgcgcgcgcgcgcggtgagtcctgggaaccaagaacccggcgttgcgtacgtgcgtgtgactttttctttgtcaaatgaggaccgagccataacgggaaaggtgaatgcgacttcgctataggaaaaacgacgtcggaggcgagaaaatttcaaacgtttccgttttgggcgtcctctcggatacggtttcaccgcgcttctcctactgttttggacttcgattcggaaggatggggatgggcggaactggattgccatggacatggcgtgttttgcatcgcatgacgtcatcccttgccaagacatgccatcataaaccacaatagcgcggcatgcagcaccccaccctcagcttccaaagaagctcctttcaagtttgacaagatcggctcgttcgggagtatttagaaatgattagacccatttcctattgtgaaaaaaagtgaataatgccagccaaattt

SEQ ID NO: 23941 - DNA, 616 bp, Sorghum bicolor
  Clone ID: 30163640
acccctttcctcttattctacttttctgttctttctcttttcttttctttgaattttttgtttctgatttttttgaactcttttttttatactaacaagggtgcggataacaaatgaaacataacacaatatatgtaaagagggtgactagcaacttgatgaacataaaaacacaagataacagtaccgtcaaagggctataagattgtttgtggctttttcagtggactatagatgatgaacaaaacaatagcaaacgatagataaactaaaggcagatatgtggatgattgtgagacctaccgtgacaatgaaagctttgataccagttgataggataccgaaataaatcgacacgagggtggcctgatcttcacgatagtagatcaaaagaacaaggataacttactgcgaacagcgggtaactagctttatacctgacaaaggttggatgcgaccaagtgacggggagagaggcaccgaaaccgcgaagacttcgactcaatctccgaacgaccacagaaccacaatccgaaactaatccacataatacgacacagcccaatggaagtcgtagagcacgaagtatgggaaaccagaggattcacttcacaag

SEQ ID NO: 23942 - DNA, 487 bp, Sorghum bicolor
  Clone ID: 30163643
atgaatgcgcgcatgagccatgaggtactcacggagtcgagcaggatgttggaggccttgaagtcgcggtagatgactggcgtgtcggcctcgtgcaggaacgccagccccttcgccgcgcccaccgcgatcttcagccgcgtgcaccacggcaaggtcgacagcagatctgcatatgcatgcatgcatgcgctgccggcaggtcaggtacggtggtgtaacacaacttagaacacacacacctttttttttaatagagtgaacacacaccgttgtagtagtagtagtaactagtaaggatagcttactcttgaagaggtggtgctcgaggcttcctctggccatgtactcgtacacgagcatcctctgctcatcctggcagccgtacccaatgagtttcaccagatgcggatgcttcaacatccccaggtacaccacctccgcctgcagcaagcatcaatcgttcgtacgtacgtaagtgcgtcga

SEQ ID NO: 23943 - DNA, 556 bp, Sorghum bicolor
  unsure (1)..(556): unsure at all n locations
  Clone ID: 30163670
aagcgaaaagaagttatttactctgtactttaagatgagcgccgaaggcaaaggtgctccgggcgggccgaaggaggtcaaacccgccgctgcagcgccggcgccgtctgcgtctgcgagcagcaataaagaccagaaaaagagcgttacgatggcgccgggcacggtggacaacaccaaacccgcgaccgacaaagccgccgccgccgccgctgccgccgccgcgtcctcgaacacgacggcgacgcccgacgatgaggagttctcgacggccaactgccgtatgtacgagagcaaatacccggaagccgacgacctcgttatcgtgcaggtgaaaaacgtcgccgaaatgggtgcgtatgtgtcgttgctcgagtacaacggtattgagggtatgatcctgctttcggagctgtcgcggagacgaatccgttcaatcaataaactgattcgcgtcggccgtacggaggtcgtggtcgtcctccgcgtcgactaagagaagggttacattgatctttcgaagcgccgcgtctctccngaggacatcgtgcgctgt

SEQ ID NO: 23944 - DNA, 461 bp, Sorghum bicolor
  Clone ID: 30163676
aagcatcgagggcccgcggtcccgccagcagaccagcggtcacaaaacaacagggcatggcgaaaagaagcgccgccgccgccgcgccagagttccggagccggcgcggcgcccgcgcccacgccgtccggcttctccagaggatccatcaccgcttcctccgccttctcggcgccaccgcacccaaaaccggccgccgcacggccaagtctgcccgcaaggtcgcgagaccgagggagcccaagagcctcagggcggcggatgaaaagcaggagcaggacgtcgaggcacggagccccgatgccgccgccaccgacgcttccgcttccgcttccgcttccgcttccgaggcggccgtggcgggcaagtactgggcgcaccggtacagcctcttcaacctctatgaccgcggcgtgcgcatggacgcctagggctggtactccgcgaccccggagtccatc

SEQ ID NO: 23945 - DNA, 610 bp, Sorghum bicolor
  unsure (1)..(610): unsure at all n locations
  Clone ID: 30163682
cacatcgacaaagagctccattctattagcgccatagacgacgacgatcgatcgcgatcgttcatcaattcaggttcactgctgcttcattctcgaccgatctgagagagcagactagcaatctcaatcggctccggatccaagtccccgacaggagcacgcacgtacgccggccgatctcggcctctcgacgtttctcagtgctgcacacgatcctcccagccctagctacattccaaaaaccgcgctccgactcgatccgaggaagaagaaggaaggaattcacacacacacacacacacacacacacacacacacacacacacagctgctgcattccatcagtccgatggcgtcatccgcacaacagaggtcgtcgtccgccgtgatcagcgacgacggctgcgccatcgcgtcgcggctgaacgcgtctgcggaggcggcgatggggaacaccgagcacgccgcgcagtgggcggcggcgcggccgcggccgcggtcgcgcgtcgactacgactacgagaggcccgcgtcggcntcgcccaagaagaagtacgacgtgttcatcaaccaccgcggggtggacaccaagcataacgtggcgcgcctc

SEQ ID NO: 23946 - DNA, 616 bp, Sorghum bicolor
  Clone ID: 30163688
atgccaccgtcgcgagtcgcgacccgcggccggccggggccggctggccgccgctcaaccgcgaccgcgcccctgacgcgggacgcgaccgcgaccgcagcccgagagagagagagagagagagagagcggcctgcgcctacctacctgcctgcctgcctgcctgccctgcagcctgcagcagactgatgattagagcgcgtgcgcaggagtataaagctatctccgctcgccccggggccgcgccatcgggctgccgctgcttcctatcgcgtggtgcgacccgggattccctcgtgctccttctgtccccttcctccgccctgaggggagcgggaggaccccgcagatcccatcgaaattcacggccgaccgaaacccaggccggccccctcccccggctcccggcgacgaccgattcctccctgttctcgttcctcctacccttcatgatgtttagataatctgtggtgctgggttttagccctgttttgaatttttaaattgagctaaggattcagtattagtcttgaaagatgaatggttcaagtggttcccaagggcatcatgtcagtggagagaagcagcaagtgcatcatgttagccgacccattctt

SEQ ID NO: 23947 - DNA, 567 bp, Sorghum bicolor
  Clone ID: 30163712
atctggttcccctattttcctatatggtatcgagcttttttcgttcctcccggaactgatcctcatggccgccggctcttcctcctccgctgccatgccgaccttcgcctttggcttcctgccgcctgtctccgagaagctgactcgtgccaactacaacatgtggcacgcgcaagtctcctccaccatcaagggcgcgcagatgggggactacatcaagaccggcgctgctccaccgccggcgctcctcgatggcgtcgtcgatgcgaccaccggcaagaagggcgacccggtgcccaaccccgcgtaccaaacgtggatgattcaggaccaacaggtcctcagctacctcttctcgtccttgtcgaaggaaatcttcgcgcaagtgtcgtctgcaaccactgcggctgcgatccatgcccagcatgcctcccagtctcgtgctcgcatcatctccacccggatggcgttggccacggcgtccaagggcacatcgtccgtcgccgactattataccaagatgaagggcctcgccgatgacatggcgtcggcgggcaagaagctgga

SEQ ID NO: 23948 - DNA, 603 bp, Sorghum bicolor
  Clone ID: 30163724
aggatcaaacttcattgaagttgatgtggatatcgggtcttctatagttgcaaatgcaattgttcatttggcatttggctatatcacaacgctaactgtagatttggcctttctcattgagagtcaaaatgaatcagagctccctgagagacttcttggagctgtaaggttttttgagttaaatccaggatcagctggtttgtttgaaaagcgatccgaagagcatcaggaaagcactcagtctcggcctgtaggattttggcagggtttctctcaactgttaaacaaccaaggcaatccgagggagccatcccctactttgcagaatactaatggaagtttgcacaaagaagaagcaaatgagaattctaaatgatattcttcagacccctactagaagagatcaaaaccatgtcttcattgtttcggggccaatttatcagttaatcactgcatcacaattcttcagtaggatgatcagtaccagatagtggggcttgtttctttgtcctcacatctgctgtaaaaactatatacatttaccacagacaaactgcataactgtgtacataaacggaatacctaatgtttatatagtcgctt

SEQ ID NO: 23949 - DNA, 720 bp, Sorghum bicolor
  Clone ID: 30163730
caagttcgttgaggacgtgaacattcctgatggtactgaagtccctcccggtaccaagttcaccaagatctggaagtttttgaacgacggcagtgtcgactggccagcaggcagttgcttgttgaatgttggtggtgacaagctcggtgactccttcgagtctaagatccctcaagccatcaagcctggtgagtcttgcgatgtcgctgttgagatggtcgctcctcaagctcctcgtcgctactcctcttactggagattgcacacccccgacaacgtgcgcttcggtgaccgtgtgtgggttgacatcatcgtgcccgtgcccgctcctctgcctcaaaacactcagcctttgccctctgctcccatccctgtcggtgttcccaacgctctacctttgcctcaacaacccttcggcgtgcctcaaagtcatcctcaacccttgccagtggcacaattcttgccgaatccagttcctcaacctttgcctcaacaacctcaacctttgcctggcgtgccaatgccgcctttgcaacccaacgaccctcaagccgatgcattgaagatgttggctgatatgggtttccacgacaccgagcgcaaccgacaactgttgatccaattcaacggtgacatgatccgcattgtgcaaaagttgcttggcgtgttttaagcttctttgttgttatatttgtgtttttaagtaaataatccatttgt

SEQ ID NO: 23950 - DNA, 656 bp, Sorghum bicolor
  Clone ID: 30163740
gacaagccatgagcgctagacagcgttggaaaacaatgttctgtacgctttatatcatttggtacatatttcccggcttcagcatacactgccgacccgccacacacagtcattttggacaattttaggcgagaccttattgtcaagcagggagtcacagcgttatggttatacaggcattcaggatttcggagttcaagatttaaaaggcgtttggaaccaagagtcttgtcatcgcccagcaccaatgaactcggacagctctccgatgaggcgcgaccagggaaaaggagactagctagcttggtgcagtcccccgcaaagtgtcagagttgcagtcagtgtaccgcatgagcacaactggggctgcctgcttacacggataggctaaaaagaagggaaggaaaggtactccctcatcctgtaaagaggttaaacctgagatacctgccttccttgatgtgaaggtacctttcgttttggcataatggtattttctatacgtccccagggtcctgagtttacgctacgcgcgtgggagctaaatttgagcgagatgtgaagccagtttggaggggtgcgatattatctactccatgtcagaagatccatgatctgcttcacttgtagggcagaaatatacacaaattttttgc

SEQ ID NO: 23951 - DNA, 629 bp, Sorghum bicolor
  Clone ID: 30163741
gatgcaatgatctatcaggcaaaaacaactactgaaatggaagaggtgatgctcaaaggtctgaatagactttcatgggaaagggtagatgttagcttcaagaaaagtagacaaaggatttttgctcatagcactattcaggtatgtgattaacccccctggcaatcagttcatgagttagaaatactattttgttgagcagaaatataagttagttgccttctgagcatcgatccattctttccatttcttccttttgtgttgcaggtcaagacctatttcttgaactctgatggagctgacgtgatcttccacatgatcgatcattttatttattaagatgagtgtactaagaatggtgccaggttcttctctttgtggatcaaattctcggccaaagaggaacatgtgagaaatattcttgttctgaagacaggattagagttatactggaagcagtagaacccactgtaaagtgtaaaggggtatcgggtctctacccttcctgcaaattttggggcgtctaggttcttttctcttcctttcaggcttcagaatctcagttgtacatgtactgatgatgtactagaccaaaatctgttgtccaaatgcaatgaaattcgctgcgt

SEQ ID NO: 23952 - DNA, 599 bp, Sorghum bicolor
  Clone ID: 30163744
ctgaacgaccgcagcagtacaacattggtccgcacggtcagatcgtcatcaccgccaatgtcaaggtgtcctccaccgagaacggcatcatcttcggctccatcgtgtacgacattgccggtgccgtgcaatcagaacgacgcaactgcgtggtgctgaacgagatccacatcgatgtgatcgactacattgccccgggtcagtgtcaggacagcgagttccgtgccatgtgggctgactttgagtgggagaacaagattgccgtcaatgctgcattcagtgacttgcaagccttcttgacgcatctgatcaagtccaccaacatgcgacccctcaccagtcacgaacacatgcccgatgactgtggcttcctctccgtcaatctctacgcgcgcagtgtgttcggtgaagatgcactggccaatgtgagtgtggagcagatcggcgagaagattgtcggctttgtgcgcatccgaagcaagacgcagggcattgccatctccatcggcgacaagatcagtcagtcactcaagaagtgaagtcgatactagtgttagtcgtgtatagtgcgacaataaatagcactctttgtaattctg

SEQ ID NO: 23953 - DNA, 557 bp, Sorghum bicolor
  Clone ID: 30163749
tcacgaattattgaaacatgaagaggaaatgcgatattgcttgtatgtttgagaaatatgaagcaaagaacaaggcggcttctccatctccttccctggttgcagctgatccagaagaacaaattgaagaacaagaagataaggtgctgcaagatcatctcaaagacgtcaggcggtgttagctagcttgttggcaggaaggatgttggaagtaaacttgaatgcttttgtattgtactggatgctatcttatggtgaactagatgctatctttgaatgcttttggactacaatctggtagttttagtttgtggacttgaacctgatggtcgtaaactcataatattggatcacttttggatgatgatgacttaagctagattatgtattcagccactatatgcaatgttagcttgatggcacatgattatatacgtactcatttgatatggatgtatgagattatgattaatgtgcctatttgtgtgtgtcattcactattgtattggttcagaataatgtgggccaattttaaatatatatgtattatttttttc

SEQ ID NO: 23954 - DNA, 601 bp, Sorghum bicolor
  Clone ID: 30163755
gacgaggaggaggagcacgaggggcgccacgcccgcctcgccgtgctcgtggggcacacgggccccgtcaagtgcgtcgcggtggcggcggacggcgacgacgactgctacgcctacgacgcggacggcgagcggcggttcgtggtgtacagcggcagcctggacgggtcggtcaaggtgtggcgcctgtcggaggagcgcgcgctggagccgccgccggcggtagaggcaacaacggctccgtttatggcggcactgcgggagtcggaggcatggatgccccggcgccggacagcacagctgccggcgtcgccgctgcaagcgtgggcgccggagctgaagggtgtggctgctgcatgagcacgacgaagaagctactggctgcacgtactgcatgaggtcgcgcgcgtgtgcgtgcaagaagaatgtgccgcgcacacgtgtactgtaggagagtgtgtgtacatatacgtgtataacatacggtatccgtgtggttagatggattttgaggaggatttgaatcctctgtggagtgtgccggggtttttttttttcaaaatttaaagaaaaaaaattaagtgtgtggtgatggtgatct

SEQ ID NO: 23955 - DNA, 657 bp, Sorghum bicolor
  Clone ID: 30163760
gagtggttactttgccaaggtcgacgatttctggagggttcctgtacgtgccctttggcttcagggcggtgtcatggctctcatcggaattctctacaccttcgcctcaacagtcttggaggctattctaagcgtcagcacaatcgcgctcacagtatcctacggcatgcccattctgactctcctcctcgtcggccgagataagctcccaccaggcgagttctcccttggacgatttggttcagtcatcaactgggtcagcgttgtctactgcgccgtcaccaccgttttcttcttcttcccaggcgcaccgaacccgtcggtttcagacatgaactacgccattgccgttttcggcatcatgcttgtcatcacgctggtgttctgggtcgtcaagggacgtatcacttatctggagaccgaggaggcgcagggaaatatcatctatgcgcagcgcgcggagcgggctaactatattgatgtcgatgcccaaaccaaggcggatacggaagctcgtcgagcttctcagaccggagggcctagtgcttcctgattggttgggaggaccggcattgcgagagatggtgtgaagatggaacagatacgcgtagttgtagttgaagtttagaatcaatggaagaaagcacttgcgcaggg

SEQ ID NO: 23956 - DNA, 584 bp, Sorghum bicolor
  Clone ID: 30163777
ccgcaagcatttggccaatgtaccgctttcatctccacatatctcaagggtgtcgaaattttcgaagtcagctcaactagcaaggcagctgaaattgccagtaaggacacaacgggtacctgggccgccatctcaagcgagctcgccgctaaacttcatggtctcgattttctgggaaaatcgattgaggacagagaggataacacgacccgtttctttgtgattggtaaacatgctgcaggcccgaaggaccttgaaaaaaccgaaaaagctgttgctgagaagggaagcaagtcgcttgtctctttcacagtacctcacacatcacctggggctctggcggatgtgctgagctgcttccgaacattcgacatcaacttgaccagcatcaacactctaccgagcctcgtgaaacccttccagtacattttcttcattgaattcgaaggtcacaagtatgtcgatcctcaaggccgggtcaacggtgcgctggataaaatcagtcgtgtggccgagagttggaggtggcttggaagctgggagagatacatataactttaccaaaagcaacaaacaaattattc

SEQ ID NO: 23957 - DNA, 579 bp, Sorghum bicolor
  unsure (1)..(579): unsure at all n locations
  Clone ID: 30163785
tcactggtaatggcagagaaagaaataacatgcccagtattgaacgcagcgaagaatatctcgatagaggcggctacgatagaaagggaaaacaccaaccttcaggatcaatgcagaatgtgggaagcacatcaaatatgaatgcaggaggagtcgtgaatacaggaggcaatttaccaaatggatcatcaaatagaagagacgataaaggagataaaaatggaggtcaaagaacaagtcataaaagcgctagtcctgctcctgataaattgttgagaaaagaaggcaaatttgccctgttatcagctattaaaatctatggcggaaccaaaaaagataaaccccctatgcccaagaagttacccagctagaaaccttctggcgtaaggcagaaatatttttttgtatacataattaactaagcatcctcgaatagagataatataatttttgtacttacaataattcccttttattggatgtgatttttccgtattactttgtggaaaattatttttatttctcaataaataataacgaanagatattgactatccttgtcgttgtcgaactaagaaa

SEQ ID NO: 23958 - DNA, 550 bp, Sorghum bicolor
  Clone ID: 30163807
aaaaaaaaaaacaaaaaacaatttttttttcgctaatacgacatggataaaagattgctagaagtttgttctaaaggcagtatggtttcaagatcagatgatccaggtaacgatggatctcgtcaattacttggtgttcaaccccctttaaatgatcctcaaagtaacagaaattcacatcaaccaaaaggacgcgatgaagacgaagagtctaatatcttggtcgctgtgagagttagaccaatgatcagtagagaagtgaaccttggagactttgatattattcgaacagaggataacttgattattgtcatggatcctgtagaattgcaacacggaatgcagaataaacaagtgactgatattttgcacagatctaaagaacagaaatacgcctttgataaaattttcactaatgaatctcaagaacaaatttacaatgagacttgtaagagcttgattcatccagttttaaccgggtataatgcttgtatgtttgcctacggcacaacaggtgctggtaagacatacaccatgttgggatatcaag

SEQ ID NO: 23959 - DNA, 598 bp, Sorghum bicolor
  Clone ID: 30163815
ctctcgggtagcaggctatagctagcacagctagctctcggtgtttcttgcatcttcatcgcgctgcagtggtgactggccggtgaggagatgcagccccggccggatccggatgatcaggcatcgatggcgtttgctgcttgccggccggcctttcatcgacgacgagcagaccggctgccatgcatgtgcggccttctaggttctagctagcccgtgccgccgtgcggccatggcaagggagtagcaagctatatcttgctctgggtggacgggtaagcctcccctcttgttcttgagttgtgtcgtcgatcggccgttcttgtgtgatattttttgtgagctactctgaatctcttgctctgtcaaatgtttatataaggaaaaaaataaaacgaagagattttgtgagatcttgctacatctctggttcctgttcgcactacagacaagtttaccagttttctgtacaaagcttttcagattcttcgctcgttgttgtatttgttctgtcaagatccattctcgccccccgccattaaagcaagagatttgtgtcatgttcgggatggacctgctgtggtaaatgaaatttcga

SEQ ID NO: 23960 - DNA, 603 bp, Sorghum bicolor
  Clone ID: 30163819
aaagcaaagcaacctcccttcccttctctccccacacgcgcacggccgcaccgcacaaagcgaccgtccccgcgacggtccagactccgacgccgctcgcgttcgggtccccgccgtatccgcccacacccaccctccctccccgccgcttccgcctcgtgcgcgaccgtacggcggggccacgttcgccgcctcaaactgttgtgtggtggggggctgtggctggcgcgggaggcggcggcggcgctagggttccccccatggacggcggcgaggatcggacgttcaaggcgaacttcaccggcgagggggtgacgatgctgcaggaccgcgtcaaggagaagcttagggagctcatgggcgactactccgacgacacccttgccgagtatgttgtggtgttgctaagaaatgggaggcgcaaggatgaggctgccaaggagctacaggtttttttaggcgatgacaatgatgcttttgtatcctggttatgggatcatctgtccacaaatttgcacctatatgttcagcctaaagctgcctcttctaaagatgatgctagaagcactcgcagtgctgctagaggattgcctgttcgtgatg

SEQ ID NO: 23961 - DNA, 598 bp, Sorghum bicolor
  Clone ID: 30163824
aatttcagatatgttgtgacctatgaacttcttttgaggaatcattagtgtcacaaaaatcatccacggactgatctgatgaccgaaaagggctcaaatgaggaaaaaattagattaaaatttgatagcaagaagtacagaaatctaaaatactaactactaagctaatgataacaaactccatgtagacctgctagcccttggtgacatggcttcaccaaattgcagagaaatctgctagtggggatctctatagtagtagatggatgcaaattgtagtgacaacctattgtactgatgatggtggttagtcatcatttaggagcataccaacaggtggtggtagcttttctgcgatgtattatgatttttgaataatttgtcttccttcatgcctcatgggatatgctggtgtcttaaagcatttgatgtccatgtccctcctatactcgatttctctgaaactaaccctgctatactctgctgatggtattcaatttatgtgcgacaactttgcttaaataaactctattatctaaatcattcctgtatattgcagtgatacacaaaatcattttcatgtgtagctttgcttcat

SEQ ID NO: 23962 - DNA, 380 bp, Sorghum bicolor
  unsure (1)..(380): unsure at all n locations
  Clone ID: 30163835
aattattcttttatcaacacaacaacacaatgtcgcttgtagtcaaaatccaatttggacaagatactagacgtgtctctgtatcgtctggcttgccaaactttcaagcgctagcagatttgctcctaagacttttcccgaatctcaatctgcacgactacgcaattcgatatactgacccagagaacgatttaattacagtttcttctgatattgaattgcgcgaagctatcgatttgtgcacgagcgaacgtgctcctctgcgcttattgatcactcccaaggatcaaatttcaggttttccaagtttgatgatgtcatccaacctgaacgcatccatntctcaatcccaactcttccccaacaataacaactcgccc

SEQ ID NO: 23963 - DNA, 641 bp, Sorghum bicolor
  unsure (1)..(641): unsure at all n locations
  Clone ID: 30163845
tttactcaaccgattcatagacatttgaccgtcccgttactacgtgattatcattgtcattcccattcatcgttaccaatctcacctcgctcgaccttcagttatacaccaagcgacaggcgtcattagggacttctgtaacatcataaatattcctgaaagattggctttgttggctctcttaattactcgatacgaaaaatgctttcctacgaacccacaccaatgtcaatcaagactcccacaaaaccaactaccattgctttgccgcccaccacttcgtcaccaatgacggtagcgcccccttccatcaactctgccaccatcaatggccacaaagcccagggacaacaacacatctngctggttacgggccctgccggctgtggaaagacaacagtcgctggttatttggctcaatcactaggcctgccttatatcgagggtgattcgttccaccctcccgccaatattgataagatgcgaaatggtattcccttaactgacgccaatcgatgggattggctcacagctctacgggaagaatccatcaagagactgaattccggatctaatggagtcgtccttacttgctcggctctcaagcgcaagtatcgcgatgtcatccgcgttgctggata

SEQ ID NO: 23964 - DNA, 418 bp, Sorghum bicolor
  Clone ID: 30163848
attattagaacagcggtgtattacaaccacaaatcactatggctgataaaccttgtacactgctagtccacagcattggcttggaacctcctcaaatccagcagctgaagaaccagttcgagaatggcacggaccaagagaagatcgagacgctgaagaaggtgatcttattagtactcaacggcgagtcactgccgcagctgattatgcacgtcattcgcttcgttatgcccaccaagaaccacaccatcaagaaactgctgctcatttattgggagattgtcaacaaaaaatcagctgatggcaagctattgcacgagatgatattggtgtgcaacggattgatgcaagatctgcaacatcccaacgagtacatccgaggttccactctgcgcttcttgtgcaagctgaaagaagc

SEQ ID NO: 23965 - DNA, 407 bp, Sorghum bicolor
  Clone ID: 30163853
aaaaacataaaacaccgcctcttctctgctcccctcccacaacgcctcttctctggtcccctcccacaacgcgccgccgtgcacctcgacggagcccaacctctggccggcgagctgcccccacagtttgcctgtgcccagattgaagtttgccccgtcgctcagccgcctgctgccaccagctccccatcctcggacagctgccctgccgcccggctgcatgccccgccgccgcccgcccgcccccggcggcttcgtggccctggacgtctaccccgcggcggcttcgtctctctcttggctctcgatctctccctctcttgtgccgaccctctgctggatctgaggagcagaagggtgagtggcagcaacaacgcacaatggaggagggtgggggagagggtaag

SEQ ID NO: 23966 - DNA, 493 bp, Sorghum bicolor
  Clone ID: 30163860
aacctcgcaagctagtcgcccatgcctgcctcctgcgctctgctctcttctccctactcctcctcttcctcctcctctccctttcggcggcttccgattccttcccgcgcgcgcacgtcgtcggttgtcccttcccgattcgctccgtccgacgacgctccagctctccaccgtaccgccgtgagctgaggtagggtagctacctgcgcgatccagctagcgcgccattaaagcgacctcctctttcctcctcgacctgccgcgccaagcgcagagagcaagcacgtacacacgaaccgcgacccatttccagccatgggcaaccgcaagaagctcgtgcacttcctccgcgtcgaccggccggcggcggcggccgcggtctccgctacttcctcccctaggtccttctcctccaactcctccttctccgacgacgacggctacacctcctcctccttccagggctccgcgtcgtcctcgccgtcgcggtcgt

SEQ ID NO: 23967 - DNA, 477 bp, Sorghum bicolor
  Clone ID: 30163864
attgcattgaccatctctctgagtcacatcgcattcccgctaaggctgcccgtcgcctttttccccctcttctacccttttacgtcatttttattctttctctcgacgaggtcatcgtcagacgcggccatgaccaacgacgtcgagacaaactctgcgctcaagcgctcagataccaccaaccaagccatccgcgatgctgaagatctcgcaatatttggccatgaccagtgtctcacgcgaaaattcagcatgtggagcatgtttgccctggccttctctgtcctcggtacatggtccacgttcgcgcagggcatcgacagcggcttgaccagcggaggccccatcgccatcctctggggcctggtcctcgtgtttgtctgcaatatctgtgttgctgtgtcgctgggtgagatgtgtagtagtatgcccacggcgctcggtcaggcgtactggatctcgcgactgtggccgaca

SEQ ID NO: 23968 - DNA, 595 bp, Sorghum bicolor
  Clone ID: 30163879
tgaaaggtctgatagttttcagctaagccgctcactacaattacatgctgaaaataatggggttgacccagtcaagagcacatcaaatgctgaaaatgatggggttgacccagtcaagagcatgaattctgcttttcttgagcagaaatcagaagttattggtgattcagaagaaaatatcagcccacctgaggttaccagcaatgtagcacctgatgtcaagcatgctgataacctgaaagttgatgcattcatcccttttgcagaattatcactatgcaggcacctgttatctgaaggcatgggggaggatgctgcttgcagtgcatttgattctgagaagataaccttagagaagttccgtgacatgaagcaatcgctgatgcgaaacaacaaactagttgttaggattgctggccgctattttccctgggatgctgctgcgcctatagtgcttggtatgatttctttcagtgaggaacaagtttttgaacccaaaggaatgataaaggtggagcgagttgagcaaagtgaagctccaggtggcagctggagaatctggccatttagttttagacgaacaaggactattagt

SEQ ID NO: 23969 - DNA, 309 bp, Sorghum bicolor
  unsure (1)..(309): unsure at all n locations
  Clone ID: 30163881
ngacattagcacgacatcgccaacgccttctttggtgttcaattgggtcaaagacagacaaaagcgagagtcgaagacacctacagacgagcaaagacggaatagccagagaagtttcgtcactgagccaattgactgcatctcctcccaattctcacagcttggtgacagcctcattctcaagcaagacatttgcatttgcagcacaacattttcaaaggcccaaccattcttggtatgcggataaaccctaagactcggggctgaaatttccgttacgctgcaccagaattctgtttgacgccgcat

SEQ ID NO: 23970 - DNA, 513 bp, Sorghum bicolor
  Clone ID: 30163885
agcgagcgagcatggaggtctcagccatggaggatgccctccccaaggcgacggcgaggaggaagggaggcctcagaactatccccttcatcatctcgaacgagatcttcgagaaggtggccacgttcgggctgacggccaacatgatcctgtacctcatcgagcggtacctcatgtccagcgctgtcgccaccgaggtcctctacttctggaacgccatctccaacttcctgcccatcttcggcggcgtcctcgccgacgtccgcctcggccggttccgcgtcatcgccctcggctcctgcgtcagcctctgcgggatgtgcctgctgtgcctgacggcgatcctcccggtgtacaagaagaccccggagtgcgcggcgggaagcggctgcgtggtgctgccgtggcagctgccgctgctgttcacgtcgttcgcgctcatgtcgctcgggtcgggcggcatccggccctgcacgctggcgttcggggccgaccagctggacaagcgtgaca

SEQ ID NO: 23971 - DNA, 271 bp, Sorghum bicolor
  Clone ID: 30163890
gattcttacttgaaaacgaggaccttattgagagagaaatcagaaactatcttaaggaaagagaagaagcaaatatgtaaaagatgaactttctatattgagaatatatatatgaaatttacccatccacctacctacctatctattctcgtttcgagttttcttcgatgatcatcaataatattttgcgtatttcacttttgtgcttattcttcttctcaaggagaaaaaacatttattcaatatattaccataataaaaggtaactccc

SEQ ID NO: 23972 - DNA, 273 bp, Sorghum bicolor
  Clone ID: 30163893
gtggagcagcaagtcaagttgaggggcattccagcgacaaaacaggggtattaattttgagaattgagagtatttttatctttacatgtacaccatggacaggtgaaagtagatagcagaaggtcctattgagtctacctctcagaatactcaaatattagcgtgaagctgcttgcgatattgaagcaagatcactctagccttttgctatgtcaactgaatcatgctgtcgttttagtttgttatctaggtcaatgaatatacataatccgc

SEQ ID NO: 23973 - DNA, 501 bp, Sorghum bicolor
  Clone ID: 30163899
ctcaagatgcgctgcccatgcccgtccagcaacggccagatggaccccacggtggtgccgcaggaccctgtcacgccggcgaccttcgacaaccagtactacaagaacgtgctggcgcacaagggcctgttcgtctccgacaacacgctgctcgacaacccctggacggccggaatggtccacttcaacgccgcagtcgagaaggcatggcaggtcaagttcgccaaggccatggtgaagatgggcaaggtccaggtgctcaccggcgacgagggagagatcagggagaagtgcttcgtcgtcaacccacactactagtcaagtttagctaattaccttatgtactatgtttgtttatttatttatacgttccacacgtcaatacgtcataagtttgagttgttttctcttcaagtctgggaatgaaatcaaatacaagtttgtcaagtaaaattgtgtaatttgcacaacatgaaagaaatttagtgatgacatcctctt

SEQ ID NO: 23974 - DNA, 533 bp, Sorghum bicolor
  Clone ID: 30163906
gagcttccgtcgtctcgacttcgccagagaaccatcgtgttggcccgaaacgcctacaacattgtcggtgtcgcatacaccaacatcatcggcttgtactcgctgaacccgacggcttggaactggggggctaagtcggccttcttctgggctggtaactgcgctttgtgttttctgtgggcttacttccgacttcctgagcccaaggatcggtcctatgctgagctggatatgctgttcgatcagggcgtctcggcgaggaagtttgcgactacctatgtcaatccttatgaggtgaccgaacgacgaggcgaccatgattcggatatcaaggagaagagtatgagccatgttgagtgatcggttggtgtttgtatatcaggcacatggcttttgtgtggccattcactgtatggaaactcaggcttgaaggagaagattgcttgaacgttctggatagcttggggtttgaaacatgcagatagttacactagctttattcataagtttcaagtcaatttactttgttgaat

SEQ ID NO: 23975 - DNA, 562 bp, Sorghum bicolor
  Clone ID: 30163934
tgatatcaaatctaataatatattacttgatgagaactttgaagcccatgttggtgactttgggttagcaaaggtgatcgacatgccatactcgaagtcaatgtctgcaattgcaggttcatacggctatatagcaccagaatatgcttataccatgaaggttactgaaaaatgtgatatatatagctatggcgtagtgctgctggagctgctaactgggcgtgcccctgtgcaacccttagaactgggaggtgatctggtaacatgggtgaagaactacatcagggacaattctttgggtccagggatccttgatcaaaatttggatttacaagaccaaagtgttgtcgatcatatgatcgaggtcttgaaaattgctttggtatgtactagcttgtctccatatgagagaccaccaatgcggcatgttgtagttatgttaagcgagtctaaagataggacgagggtgagctctgcattctcacctgcctctgatgattcttcaaagaaagataactcatgatgtatttataatatgttcgattagtcaaaggtaatacac

SEQ ID NO: 23976 - DNA, 573 bp, Sorghum bicolor
  Clone ID: 30163939
acgacccctctatttgcaagcgcagtctgacgcaactgttcgcgcacttcaagcaacagggcgtggactacaatcagatctggaaccagatcaagaagatgattatattgacctgtttgcccatgactacactcgagcccaagacaccgcacgacaactgctttgaagtgctcggattcgatgtcatgctggacgacaagtacaacccgtggctgattgaagtcaattacagccccgcactgagcattggaggactgatggaccaatcgatcaaagagccgctgatcgaagacacggtcaacattctcaatctcgatgccgatgtgcagcacgagttcaccgcgcaccgagtctcgcgcgtcaatcccccgcactccactctcggcaactacgagcagatcttccccttcaataaggccactagagatgcagctgcaaatatctccgcggacaagagaccacaggagaatgtggcgcgtatcgtgcaggaggtgggtcagatgtatccttaatactactgtcacgcactggtggggtgatgatgcggatgttcaaataaatgttgatgctcac

SEQ ID NO: 23977 - DNA, 527 bp, Sorghum bicolor
  Clone ID: 30163944
cgccacccatgtactcttcctacagggagagtcgggattattacccctcctacagggacagcagggactaccctccctacagggacagccgggactactctcctccccacagggaccctcgggactactacgaaagcaggggtggccgtggctactcgccgcctccttacggcggtggtaggtcaaggagggagcgatcgatttcgccgtatcggatgccagaaaggggctatggtggaggcccccgggcgggcggcggtggctacgacaggtaaaagcggaggttttcgctccgccctatgggtggtgaccgaccggccaaccggcaagatggatgtccacactggctgctgcgatggtggtgtctggcccttgcagctcccgtggtatggttagaccgttgtagctgtgtactacttgtgaggactgtttttccggcgtatgtggatttggtgaaacttttgtatgagcacctttgtttgtatcctgcaatgattccttctaaagaatgactgggaacttgctcc

SEQ ID NO: 23978 - DNA, 581 bp, Sorghum bicolor
  Clone ID: 30163950
tcgagcttcaaagaccaccttcatcggttctcctttccactgcattgggtctctgcaagcgccatccagctgcagcactggaagctgtactatttccactggttcttagaaagggcgggctaaatgttccccagtgtgatgtgctaacacgtattatcaaggaatgcatgcatccactgcacgtcactgctttctgccataggctgctttcaggagaggatcaagagaggaaaccagtttgtatgcctcagcatcaggagagtattggtactaatttggtctggacagaatctctgttcacactattttacaacattctcagtcaagatatttgcttgacaccgagcaccgttggtgagctaatttctgtgatcgatgaccaggcatcaaagttcctgaggtccttgaaatttggcaactttctgaagtgcttcgtgtcgaagtgttggcatgaatgtaagcatcagaggggtttactcaagagagctgctgagagagccgacactttcctgactaaagctgtgttggcaaaactgcacccagcaagttgaatttatactgctaaggcatttaaactcgaa

SEQ ID NO: 23979 - DNA, 607 bp, Sorghum bicolor
  Clone ID: 30163953
ctcatctcgggcttcctcctcggcttcgtcttcttcatccgcccgcagttcgcctggctcacccagcacagaagagtatcagcagcagcacagcctgacgggcaaccaccggcggcggcgcctactcctcctccggttgtctcggtgaagcgcaagcacaagacgtaccagtacgtgctgtggctggccgccgccgtgctgctcgtcgtcgggttcacggtggccaccgtgctgctgttccgtgggtacaacgcgaacgagcactgcccgtggtgccactacctcagctgcgtccccaccaagcggtggaagtgcgacgcgtcgccgaccacgtgcacggggacgctgcaggagaacacgctcaccgttgtttgcgccggcggcaagaaccagacgtacgtcgtggcgtcggccgcggacgcgtcgcaggacaggatcaacgacctttgcaaccagctttgcacctagttggtatcggccctattctttctttgtgtacatcaaggaaggaaggaatagatagattatagatgctccatttttactcattcagaggctgagtgagatgatgaacaagcattaacagagttccaaaacaggctgttgc

SEQ ID NO: 23980 - DNA, 585 bp, Sorghum bicolor
  Clone ID: 30163958
tgggtgatcatggaatggatcaacaaggcttaaatcttgatatcgatctcattgatgatagctacttgcatgcccccttaaccaaatctcctcatctccaatttgttggcagtcaacctaccagcaaatgctcattcaagaagtttggagagtggactttgagccctaatgcttccttcttgccaaggaagaagttctaagcgtttttatggattataagcaatgcgaggtgtgttaattattcatcccactactgagtaattaatatacaagcaaagaatcaatgagcttttggagagtgaaatgaaatttatgatgctatattcgtaaatcatctaatttattccgctagtaaagctacttttcttatcaagatttgtaaataactccatttttatgagtctgtttttatataaagaaatacccatttattattattgttatttttatgaatatagaacaattttttaagacttcaaaagtaatttcatagttacctcctgttagctcaattttgatatttattacttatatatatttttattttactccattacccctcttttttattattataccctttgg

SEQ ID NO: 23981 - DNA, 678 bp, Sorghum bicolor
  unsure (1)..(678): unsure at all n locations
  Clone ID: 30163963
ttttaaataaaattaactcatagattcacttaatgcacgcagaatcccaacaaggtcctcaagctggacaccctcagcaaccccctgctggatatgcgcaaccacaacaagctgctcctagaagctcagctcctcctgcacaacaacaacaagatcctgctttgagaggagatccaaaacttctcgttagctcaatgtttgaaaccaccaatccttttgagattcccaaggatttgtatgagattgttcctaatctcaagatatttgacaaattacttcaatgcgaaaaaaatatcgataaattgttggcaaaaaagagaatcgatatccaagaacaactctccaaacctttatgcagaactaaaagaattcttcgtatccacatcttcaataatcatgccaatcaaggaaatatggtcaattccgaaaatcctccttattggatagtcagaatccaagccaaattattgaatcaaactcaaggaacctatcctagaaagttctcgtattttgttcaaagactccnagttggttttgataaagctgactatcccacctttgaagatgttaattggaagaanagctctcaatcagctgaattagatggctttgaaattaagcgttttggtaataaagaaactactttgaagattgttcttcatcctttcaacttccctc

SEQ ID NO: 23982 - DNA, 538 bp, Sorghum bicolor
  Clone ID: 30163964
aaaacgccttctaactaatcagcactcaagaaccgatcgatcgagctgagcccagtatataggagtagaaaaaaaaataatgggtgtcttccaacaaggcgatgcgacgatgagcgtgatgatgaggccggtgctgcacctcatggtcgggctggtgctctacggcgtcgccgaggagatgaccgtgccggcgctcgtcgacaaggtcaccgccgcgctctgccccgccgacgacaggtcttgcccggaggctctctacctcaccggcctgcagtcctcggttggagggattttcaggacgatagggttcactctgatgggccagctggctgatgagtatggccggaagccactaatccttctcactgcatccacttccatcatcccgtttgctgtgcttgcatggaacaattcaaggactgctgtgtatgtctaccttgttctgcgtaccctctcattcatgattggccaaggaaccattttctgcctcgctattgcttacacggcagatgcagttgaaccatcagggagggcagct

SEQ ID NO: 23983 - DNA, 469 bp, Sorghum bicolor
  Clone ID: 30163973
agatgcaagaagaggtggcgtggggcgaccacggaggggcgtggggcagtgcggggcggcgcagggcgactgtggggcggcgcccttccccttcctcgtccttctcgccggtgattcactcgctatctccttcatcctcgtcctttctccctcctcatcgaatccggtgccgacctgctcgatctggccgccgcccgtgccgacctgctcgtcgaatccggtgagcgctcggccttcctctctctctcttctctctccaagagcggcctgtgacggcctgtttacctgcggattcggggaggagagttcccctttcgtttaggggtgggcggctggttttgtggggtcagaaaaggaaaaaaaaaccttctccttatgtgggattggggttctattggagccccccaaacccccaaatggtagttttaactcaattgttattgggggtggtattctcactctgtttgga

SEQ ID NO: 23984 - DNA, 416 bp, Sorghum bicolor
  unsure (1)..(416): unsure at all n locations
  Clone ID: 30163977
cttttccttgttgtggctctctcctgctcctgcagtctgtcttgtctagctcacctgcgcagctgccctgcttcctcctctgctacgccttccttccttctttcctttcctttccttccagcaggcaggcaggcaaggctacagatcgatccgagtgattcgtgtccttcctcctcacgctctcccggccccccccccttttcccttttccaacgccggccagccggccgcccaattccatccatcaattgtcttgttcttgccttctccaacaattaatcatcaatcccaaccagccatccngccatccatcatatcagcacaactaacaacaaacagatccgtccaccatcgccggccggccctgcctgccgccgttgcacgactaactcaccaccgcccgccgccgacgcatc

SEQ ID NO: 23985 - DNA, 539 bp, Sorghum bicolor
  Clone ID: 30163983
attacttaattaaattcacagtctatgggtgacagaagggcttggagcgaaatagaagacaaagctatcaaggagcttgttgaaaagtacggaatccgcaaatggactgtcgttgctcaaaaaatggaagaaatttactgcctcaagggaagatccggtaaacaatgccgtgaaagatggcacaaccacttggaccccaagattaacaaaaagccttggactgagcgtgaagagcagattattttcggagctcataaaaagtttggtaataagtgggctgaaatagccaaactgctgcctggcagaactgataattctatgaaaaaccacttctactctactcttagaagaagtcttagaagaataaacaaatcactcggtgataaaaacagtactgctcaagttaaagatatcaagcccggtgtcttgcccaaaattatgaacattaccgaagaggcaaactcttcaactggccaagatgaaaacctcaagagacttattaccgttgctaaaggtctcgaagaaactttgcttgatta

SEQ ID NO: 23986 - DNA, 318 bp, Sorghum bicolor
  Clone ID: 30163994
acaacaaaacattcgtaagacaatcgtccacaccgcttcgctcgcctcccctcgtccaacctctcccaccccgactccccccgagtccctcccgtccaacgcactcctctccgccgtctccctcgcctttctctcaactcagcgcagaacggccgcaactccgacccatccttgcctccttgggacctcgccatcgccgcatccatgcctctcagtatcgccgcggacgcgagaagagaggacgcactggcgctgcctcccttgcctgctccatcgccgtgaatgcgcatagcgccgctcttcgcctcctcctcctgc

SEQ ID NO: 23987 - DNA, 274 bp, Sorghum bicolor
  Clone ID: 30164000
cttcatctcttactcaccatctcgaattctcaatcaaggtccaaagctaaagcagctagcaagcccagagtgagagtggcatctgatcgaccaatatatatacagctcattgttcaccatcgccatgaggttgacgtggttagcaattgcctttgccttggcggcgctcgtcgtcgtctcctcatcggcggcacacgcacaggcctcaccggcggaactggaggtcggtttctacaagcactcgtgcccacaggccgagtccatcgtgcgcgac

SEQ ID NO: 23988 - DNA, 574 bp, Sorghum bicolor
  Clone ID: 30164005
acattaagactacaattgtctaccatctcacctcacccttaccattctgatactctcacaatcacccactgccatacatcatggcgttcaacaacgggcctgatgaaaagggcgtcgctcacatggacgatcgccgtgagagcatcgcagctcagcacatccacgaggtcaacgacagcgcagagctccgtggcatcctcaccgcagccgaaaatgccgccgccgcagaacacaacatgactttcatggagggtctccgtgcctatcccaaagccatgggctggtcaatcgccctctccacctgcatcatcatggagggctacgatacaatcctcatcggcaacctctacgccatgaagcccttcaacgagtactacggccacccggacgggaagggaggatactccatctccgccgcttggcagtccggcctcacaaacggtgccagtgtcggcgagattataggcctgtacgttagcggctggctcgccgaccgttatgggtacaagaaggttctagcagcggcgcttgttatgatgactgcctttatcttcatccagttcttctctgtcag

SEQ ID NO: 23989 - DNA, 311 bp, Sorghum bicolor
  Clone ID: 30164009
tgtaaatttcctaccttttgctattggtaaaaaagaaaaagaatatgaaaatttgcgatgcctactgggtgttgattagtttaattcgcgtgcgtttggatgctgtggatgactggatgcgccaaattgcgatcacggaaactgggacccagtgagttcttgtttgtttatgcatagcagattgtgtcgttgtcccggtaaaaaagcaagagcgggatatattgcaatccaacccaccaaaatcgaggcgactcggctagcgagcagctccagagggggggatcatgcaggaggggcggaaatcggaaccg

SEQ ID NO: 23990 - DNA, 584 bp, Sorghum bicolor
  Clone ID: 30164025
actccgttactccggaacccaaaatcggcagacgttctctcctttccccccacctccgtagattccccttccttggagcacgcaagaacccccaccccgcgcggccgcggccatgtccatcccgcggctcctcgtcgccgtcctcttcgccacgctggcggcggcggcgtccactccagcccacgcggccggcgccgggtcctgcgcggcggagaagttctcggacaaccgcgtgttcgcggcgtgcgcggacctgacccgcctgggcgcgtcgctgcactggtcctacgacgccacgacctcctccctctccgtggcgttcctagcctccccaccctccggcgggtgggtcgcctgggggctcaaccccaaggcgcagaccatggacggcacgcaggcgctggtggccgtccccaaggccaacggcggcgggtacgaggtgcagacctacagcatctccggcaccacgctcgacaacccgggcccgctccccaactaccagacgtccaacctcgccgccgaggtcgccggcgacggccgcgtcacgattttcggaacactcaagctccagaacggcacgggcg

SEQ ID NO: 23991 - DNA, 592 bp, Sorghum bicolor
  unsure (1)..(592): unsure at all n locations
  Clone ID: 30164036
tcttataacacaagctgactggtgaaatcccaactacatttgttaatctgtccagtttgcttgagctaaatgtctcctacaattatctctctggtgccctgccgccaataccgctttttgataatatgtctgtgacctgttttattggaaataaaggattatgtggtggacaacttggtagatgtggaccccggtcatcctctagttcccagtcatccaactcagtcagcccccctttaggcaagatcatagcaattgttgctgctgtcattggtgggatttcacttattcttattgcaataatcgtgcaccatatcagaaaaccaatggagacagtagccccattgcaagataagcaactttttccagctggttctaatatgcatgtttcttctaagggtgcatatacatttcaggagttgctcatcgctacnaataactttgacgagagttgtgtgatcggaaggggtgcttgtgggacagtatacagagccatcctgaaggctggacagacaattgcagtcaagaaacttgcttctaacagggaagggagcaacacagacnacagctttcgtgcagagatcctgactct

SEQ ID NO: 23992 - DNA, 173 bp, Sorghum bicolor
  Clone ID: 30164040
caagttcaccccagttgcttaagcaacccgcaggggaccgcagaattcctttgattttgtacacatgtaccatcggatggtcccccacaaggcgtttgccaattttgtaacttgacctgtacatccatttttcctgtacacccaagttttttatttgtaaccgaaccattctc

SEQ ID NO: 23993 - DNA, 523 bp, Sorghum bicolor
  Clone ID: 30164047
cccctccaacatcaagctgtttgtcaaggactccctgaacaagttcaacgcattggacagcagcgtcaacacgggcgtgaccggagtgaacaccggtaaggtgactgtgaccaccttcaactttgcacagcagaacggcaacattggggactacaacaccatcgtcaactaaacagggaatcgctctggatctgtggcaacctgaaccgcagcatagttggcaacctcaagtcacaacaacgtttttcgttacccttaattttacagaatgtaaatccccatccaatatcagtttcgcttctggttttcatttttaatcctgcatcaactcgaacaaatcgtgggagcttgatctgtcatttggcaagcaccgggttgaaaacctttcttgtgtatcctgtaatgctctcacagcctcatttgtgattgcatggcttcagaacttgatccatactgacattgcatgacgaatgaagctattcctgaccaaatgcatcgctgtacatgtaatgcagctgctcgg

SEQ ID NO: 23994 - DNA, 482 bp, Sorghum bicolor
  Clone ID: 30164061
aggttcaaatagccgatcaccaaatacatcccagggtggtggatggatgggaatgaatagtacccccaaagtgattccggatccaataaacgataccaaaatgaaatcaaaaggtcagaattataaaaagtatagcgatttgtttagaaagcaaaaagagatgtcagaaattgccaataattttttgaaagaagaaatcaagggaaagatccaacgcaaataatgaaaggaggagaaactttttttgaattgataaataggagtgaggatcatgtataagtattatcgagagatcagagcgtttttttaaaggaactctctgtctctctctcgttgtaatttttattttatttatattgatattgaataattatttcctaatttttccagcagctcacgaccatcgtttattatttatctaaatattattgttaccgcaaatatggaaaattttcacacaggattttattgtcatcaagctc

SEQ ID NO: 23995 - DNA, 484 bp, Sorghum bicolor
  Clone ID: 30164064
ggacggcggtcgaactgtgacaatgctgaaaatcaaccccagcaccgagacagtggagctcgttcccgaggcacccacgcccagcggcatcacagacctgacaaaggccatctcatctaccgagccgcggttcaccttctaccgttacactcacacgcacgacggtgccgagtcgagtcccgtgctcttcttctacacctgcccggcgacgcccggaaacaagtccatcaagttccgcatgatgtatcccttgatgaagcgttccgtgctggaagttgcggagagccaggcgggacttaagctcgagaagaagtttgaggtggaggaccctagtgagattaccgagcagtcggttctggaggatttgcatcccaaggctgcggcccgacagggttttagccgtcctaagcgacctggtcgatagatgatgaatgtctcttgtctttagtgccgtatatgttggctttatatacttatgaccgtg

SEQ ID NO: 23996 - DNA, 607 bp, Sorghum bicolor
  Clone ID: 30164073
tccattcgaccaaacttggctcttcgccttgcagttcaggcattcaaacgtgaagaagattcagcaaagtcattgaaaagaagaagagaccgccttgaactggataaatgtggcgatgacgatccaaatcgaactgaccttgctagtagaggtaaaggtgtgcagtttccttttgctgtcttcgaccgggtcataatcaagggaaacaagaggaccccggaacggtttgtgggacgtcaggcagttgtgacagcgcagtgcttaaatggatggtatgttgtgaagacttcagacaacgcagagagtgtgaagctgcaataccgttccttggcaaaggttgctgacggcaatgggccttctggtctggtctcaagcaacacccaaagttcaagctggctatgagctacacacagtaggggtagcagtcccccaggccccctgcagcaccagaaacacctcttcaaagttcatgtattcgctgaggttctgcaatgacgcgaacatgctaaattcagattaggtttactttgcccctttgctctttatgtacccaagacaaaagacacagatcttgtgagtgtgaccaaagaaatgtgagtacagtctc

SEQ ID NO: 23997 - DNA, 743 bp, Sorghum bicolor
  Clone ID: 30164075
tccttcaatgctgcatttgaggatgcacatagggtgcagtcagggtggtgtgtgccagataaccagctgagggaggagctcaggatctcaattgctgagaagctgctgccagcataccggtcattccttggcaggtttcgacatcatatagagaatgggaagcatccagagctgtacattaagtactctgttgaggaccttgagatagctgtgggtgatttctttgagggtgttcctccttccccacataacaggaggagatcacatggatgaaggacttgtacctcctcaggtattcaactagctgatgttgctatttattcttttattcttcacaaggaaagctggtgctggcatctgggctcgatttctgctgtcctgatagatgtgagtataaatttggtgatcttcaatcaaagatggcaaatatgaatacattttgggatctttctgaagctgtcaatcggcccagtggttcctactctgtaagagaagttgttcatttggtacactattattatataaattttgcatgtagcatgtccatataggaaattctttcagtaacattggatagttggaactcatggcattcctgttttgcaccagcttttgttacccttttcatcgttaacaattatccgaagggtctatgcttttgtggattaggtgtaaaaagatttatatgactcttatgtaccacatgattttgtaatatgataatatcatgctgttacaaattc

SEQ ID NO: 23998 - DNA, 594 bp, Sorghum bicolor
  Clone ID: 30164078
cgaaaacaagttcctcgttcgcgccatcctcgatcagggcgatacggaggtgtatttcagcgatttcatcgagaaaatcagttcgtggaacgcacggcagaagcgcattttgctgatcaccgagaaagctctgtacacgttcgacgcgtcgacgttcgagctcaaacgacgcatccgcatcgccgcgatcgactgtgttcatctctccaaagacgcatccgacatgtttgtcgtgcacgtcaacggcgagcacgatcatttgtattgcgcgccgaagcgcccggaaatcatgtaccatttaatgcggttgtatcaggcgctgcatccggcgcacgagcaccttacgacgcgcttcggcgaaaggatggtcgtcgacgataaaggcaattggcgtcgcgacgtacttgtgccgcagtcgcagaccgtgtcgttcggaacgcgttccatctttgaagcgcaaaagaaattccaacaaaaatcataaaacacgaatgccggcggcgggcgcgtcgtttgtcgttcctcatcgtatgtttcagatcagatccatttcttttgttttcgtatcccaaatcctgcgtaaaacgcgcgggg

SEQ ID NO: 23999 - DNA, 595 bp, Sorghum bicolor
  Clone ID: 30164087
tattcagctccatttgctatatatcatcagtatcttgatcctcttgctaagtgcatgcacagcttacaagtatcaaagatggctattggattgcagctttctgaaccttggctacgtgaataccaggtccttccatcgcgcacccatccacacatgcaaatgaatgcgtttggcggttatatcctgagcggcataaggatacacaatacagattgtatgatagcaaacaagtgagtcatcaataaggcatgcttcagtctttcaagcaaaaaaggatagcgtgcctctcttaccttaaaaggcgggcaaaattttgtactctagctagcagtcagctttgcatgttggaaccagacatacgttgccatgcttacagagaataacaccgggagtaggacaactggacaagagattgctatcaagatgtgtatgccaatcctatgtaacttgtatttttgtttgttgtagttttagagaactcgtattaaacttgtacgggtcgaggtatttaatgcctccagctgtagtatttgctggagatatcctagtgtacggtttatatgcttgtggtgaacaaacagatgtatgagtttct

SEQ ID NO: 24000 - DNA, 152 bp, Sorghum bicolor
  unsure (1)..(152): unsure at all n locations
  Clone ID: 30164094
tccattgtgcttagcgattccaagaactggagtttcctgtctgtaaatctgcaaacttagtaaggtaatagtatttgtcccatggatgcttttattgcgagtatcaaanaaatgtgttccataactaaacctctacactattacctattagt

SEQ ID NO: 24001 - DNA, 259 bp, Sorghum bicolor
  Clone ID: 30164108
ccatcgcgcacacccacgcgcgcgcgcccacacgtgcggcttcccggattcgcgccgccgcggcagagccagccagccagccaggccagcttcggatcgagggagaggaagaagaggaggtggtggtggtggaggcgaggagtcaacccagcttgccagccatggacggatcggccgcggagctggaggcggcggagcgggtggtgatgcggtgggactcggcctcggcgggcgccggcgcggacgagccgatgctgtt

SEQ ID NO: 24002 - DNA, 575 bp, Sorghum bicolor
  Clone ID: 30164110
agattgcaccagtctctaagccctgtgtatctaccaggtcttgcatccgaacacagccgttgctcatccacgttcttaacctcagtcattcgtcatggcatccacaacaagcgccattttggctgttggcttggcactgcaggcttccttgggacaggctgcttcaggaactgcccaggacttcaagtctcgctccctactgagcactgctaagaccaccaccaacatcaagctctccgtacaggactccctgaacaagttcaatgcgctggacagcagcgtcaacactggcgtgactggtgtaaacaccggcaaggtgaccgtgagcaccttcaatgatgcccagcagaacggcaacattggcagcggcaacacaatcaccaacggcggttctggcatcgtcgttattcccctgcgccgcctgtccagcacaagcacaacaacgacctccaacatcaagctgtccgtgaaggactctctgaacaagttcaacgcactggacagcagcgtaaacactggtgtgactggtgtgaacaccggtaaggtgacagtcaccaccttcaacgatgcccagc

SEQ ID NO: 24003 - DNA, 585 bp, Sorghum bicolor
  unsure (1)..(585): unsure at all n locations
  Clone ID: 30164116
aagcgaaaagagttatttactctatactttaagaaagcagagaccgaaggcgctgtgatggacgcgaagcatagcctcggcgcacgctccgggacgccgggtcctttcggaggcggtaccacacccgtgcagactccgactccgacggccgcggcagcaggtcggccgggttcggcggcgtcgacgacgacaacaacgacgacgacgctgacgctcacgaccaaacccgtcgacgctccgacaccgacaccgacgtcgttggcaggtacgacgggcacgacgatgggcgcgaccggtttgttgggcgccgcaacgggtacggcactcccgaagaagaagcgttcgacgcgcgagaagttggccgctttggaagcgctgttgcgtcagttcgacgcgcagttcctcctcaccgatacgagcacgcatccggtccgtacgtattacccggaatgggctgtgccgcacgcggcaaagatcanagcacagatcgaacggctgttaaccaaagcgaaaggcgcggaactcgacggcgcggcggcggagctcggacaccgcgaacgcgccgaaggagaacagcacaccgga

SEQ ID NO: 24004 - DNA, 492 bp, Sorghum bicolor
  Clone ID: 30164124
agaacatcggttcagtaaagaaacaaaatggcattcgcaatgaagtctgcaagcctgaaggccatcactgtgcgccagaccaagagtggtcgtttggccccagtgcgtgtctccgttgagtggtacggccccgaccgccccaagtacctgggcccattctctgagaacgacaccccagagtacctgactggcgagttccccggtgactacggatgggacactgctggtctgtctgctgacccagagaccttcaagcgctaccgtgagctggagctgatccacgctcgttgggcccttctgggtgctctgggtattgtcaccccagagctgctgtccacctacgctggtgtgtccttcggtgagccagtgtggttcaaggctggtgcccagatcttcgccgacggtggcctgaactacctcggtaacgagaacctggtccacgcccagtccatcattgccaccctggctgtccaggttgtcctgatgggtctg

SEQ ID NO: 24005 - DNA, 616 bp, Sorghum bicolor
  Clone ID: 30164126
gccgccgccgccgattcgccgggaggcgtgggagggctgcagtgtcctcctcgacatcaatgacggggaccgcctagccttcttccgcctcacccccggagcgacggcgaagattgggaacaagacctgctcgctgcagccgctcgtggggcgcccctttggctctctcttccgcctcggcgccggcggactcgtcccctgcgccgctggtgacgccacatctcgtgatcataacacacgagatggtgccgatggccaaacacaggatgaaaccagagacaataggtctctggttgataataatacggctcaaaatttatctagcgatgacatagaggcaatgaagagggatggtgcaaccggtgatgagattgtggaagctttaatagcaaatagctcaacatttggaaataaaactgtgttctcgcaggagaagtacaagttaaagaaacaaaagaaatatgcacctaaagttcttttgcgacgcccttctgctcgaagcatttgcgagacatacttcaagaaaactccagctcgtatagggtttatgcgagttgacacactatctctcttgttgtctatggcaaatattggtgcgtattcagatgtgcttgtt

SEQ ID NO: 24006 - DNA, 524 bp, Sorghum bicolor
  Clone ID: 30164131
accgcgttgccttctcttctccggttccccgcgtgctcgctctcgtagcgcaactcggtgaccgccgccgccgccgccgccgccgctctacgccaggtgcccaggtctagccttgccggtcccttcgccggcgacgaccacccaaccggttgtgagatcagaagccagaagttcagctaggagtgcatcttgtttacctgttgcttaatcatggacaacactcagaatcaaccactaccacctggtgttggtacatggccgcaggctcctcccagtcacccaccacaatgccatgctgatccgcagtcttatcatctacaatttgacactagacctgacaatgctagtgctaatagtagtggtagtgcagcaaacattgagtcagctgtccaggaggctgttcttcacgcacaggacattgagacccagcaagtcatacagaatcaaagacatgcaaacacaacaagtgaacctacaacatatggagaagacttactatcgaaccgccgtgaccctagtgcgtt

SEQ ID NO: 24007 - DNA, 393 bp, Sorghum bicolor
  Clone ID: 30164139
cctggcctcgtctcgtctctgcgcacgcctcgcctcgcctcgctcgcctcgcctggcttctctctgtctagctgcttctctctctagcccccccttcctccctctcctcctggctcctcccccactcgcacagtgcccaatgccgcgcaaaccctagtgcccccactcccaatctcgcgcggcagcagccatgggaaactgctgccgctcgccggccgccgcggcgcgggaagacgtcaagtcgtcgcacttcccggcctccgcaggcggcgggaagaagaagccccaccaggcgcggaacggcgccggaggcgggggcggcgccggggagaagaagcggctgtcggtgctcggggaggaagggggcgacgtgggcgccgggatcgaggagaa

SEQ ID NO: 24008 - DNA, 393 bp, Sorghum bicolor
  Clone ID: 30164145
aaggggcaagaaagagggatcgatcttgttcgcggagaagaggaggggtgaggtgcttgacggttttgactcggatcatggtgtgcagctctacccgatagagagagctgacctgaggtgggagacgcgggtcgcgcgggggtggaggcacagctcagtaggagatcaggaggaaggagagaggggagggggaaggaggcgacagcgggggaggatggtgctcgtgcttgcgctgggggatctgcacatcccgcaccgggcgcccgacctgcccgccaaattcaagtccatgctcgtgcccggcaagatccaacgcatcatctgcactggcaacctctgcatcaaggaagtccatgactacctgaaaagcctttgccctgatctccacattac

SEQ ID NO: 24009 - DNA, 559 bp, Sorghum bicolor
  Clone ID: 30164148
acatttcgaatcttatagacaaaatgcagtcgggaatatcagcttctcaggagctccagaacgagttcaactcgttgctgtcgaacgacaccttcggactcctcgcaaccatcgagaaggagtccatggtccccatcaccacgatcccttccaagtcgagctctttctccgataacctttctggtctcgagcctcaccttaagaccgataccgccctctacatcatccttcgtcgtcacgaagatgctccgcgattcatagccattacctacgtccctgactcggcgaaggtccgacaaaagatgttgttcgcctcaactcgcttgacctttgtgcgtgagttgggtacagaacatttccgagagaccatcttcgttacaacacccgaggagctgagtgccaagggcttcgagaagcacgatgcgcataataagatggctgcccctctcaccgaggaggagcagcaattgggcgaagttaagcgtgctgagcaagaggctggttcaggaacgaataagaaggagattcatctgagcaagaactttgccatgcccgtctc

SEQ ID NO: 24010 - DNA, 413 bp, Sorghum bicolor
  Clone ID: 30164175
ttccaagtgaatttcaattccagatgcaggtgatccacgggcagtgtccagcacatgggttgtaatgggaggccgatttcggttggagctccctgtaatttcaggagctttattggcacaaggttgagggagagctccaagatgtgctccaataatccgtatgggatttttttgaaaatttagttggtgagaaagaagaatagcccaaattgtatacgtatagcaaataattatagtatgttagtaaagcccatgaatcgatgagaatgagaatgaaaagtatataatgatgatggagacagatcaattgttaaatagatgaaactcaatgtcctttacaacaaatgcccattcaacaacacaattcgttagttttttcatggtcatagctgtaaactatgtggttttttttc

SEQ ID NO: 24011 - DNA, 605 bp, Sorghum bicolor
  Clone ID: 30164185
gcgcgctgtgggcgaggaagccgtcgctgctcacggcggcgctgggcacggagcaggagtacatcctcaagtccgcggcggcggacgggcacgacgacgtggtggactacaaggactggtccatgacgctgacccggcgattccgctcgctgaagctgtggctcgtgctccgttgctacggggtggagggtctgagggaccacgtccgagctcacgtcggcatggccgcgtcgttcgagaacatggtggcgtccgatgcgcggttcgaggtggtggtgccgaggctgttcgcgctggtgtgcttccggctcctgtcgccggagaagctcggcggcgagaagacggccaacgagctcaaccggaggctcctcgaggaggtgaacgcgaccagctcggggccgtacatgagctcggctatggtgggcggcatctacatgctgaggtgcgccatcgggagcacgctgacggaggaacgccacgtccaagaagcgtggaaagtcgtgcaggatcgagctgcttccctgctccgtaaaatggagatcatttacagcgtgctcgcttaagctggcctcatttcatttgtgctccgaatcctgcattaacaa

SEQ ID NO: 24012 - DNA, 687 bp, Sorghum bicolor
  Clone ID: 30164186
ggaaagagatgttattatgccacttgttgctcatcatcaagtctatttataccagattgacaattatcaaaaagatagcttctggttccaaattaaaaatgctgcggctgtgcttcaagcaagtttcagatatttagaattttacgaagaagctgatcaaaccatcttcaaaagagttaatgaatcaagaattttactcccaggaaaagtcctgattcatgattcggctgaaatcgataaaactgcaaaaattggaccaaatgtgacgattggagcaggagcaaaaatcggagctggagtgagaatttcaaatgctattattcttgatggcgctgaagtcatgccatcaacttatatttcaaactctattattggatggaattctgttattggaagatgggcaagaatcgtcggattgtcaggctcagaaaaagcaccttctgaaaatgaaggcattacaattcttggagtcggagttactgtggaagctgaagtttttattagtaactgtattgttctcccatataaaaatcttgcagaaaatcatcatggtgaaattcttctctaactaaaaagtagtttcaaaaattatgtcaaatgtatgatgtataaattcaatgcaaacttaacccaaacgatttatttaaattacataatcgtaatgtcaattggtgaagagaaaaaatc

SEQ ID NO: 24013 - DNA, 528 bp, Sorghum bicolor
  Clone ID: 30164191
agcagaaaccctggaagatctagaggtgaagaagaggcgagtgcttgaggctggagcagcgcaggacgaagtaagaatctgcggagtgtgcaatgttgtcgtgaacagccaaaaagtgttcgagttccacattgcggggcagaagcaccaggccatgatacagaagcagcaagcgctacattttgtcacatgatgcagagccattttgcttattgtctttcgtctagtctcttcttgcttgtccggaagttcctcgggaactcacaatattcatgtcttcaactttgttagctagagacaagttgataacattccctcgttgttatcaactggtagcgtaccaaaagaatcagatgattgtatggacttttgcttgccgttcataattagtggagggctgaaagtctgaaactgaaaatattgtaatgtatgtcgcaaagttgtttatcaacatgcttagagcatttgagtctttgtaaaggtcactctaaattttggagaggtatttgcataaaaatcattttctat

SEQ ID NO: 24014 - DNA, 269 bp, Sorghum bicolor
  Clone ID: 30164197
actgacaacatcatccgtgcctggggtgtcatgtcgagggcataaattgctttcccctaaaaaagaggcgtggtgacgaaggcgagcggaagaaggtagatcattggtagggcgtcaaatggttggcttcctcgtttggtctttattgatgcaaaggaaggggggcgactacaaatttgacgagggcataacccatttgatggttataggcaccccctgaaattcccgggactcatccttttgttttccaataaagaactcgagttttc

SEQ ID NO: 24015 - DNA, 639 bp, Sorghum bicolor
  Clone ID: 30164199
taggtgatggttgtgctggaataaacgcatggatcgtgacggttatatgttgatgcttatcctggaatagtgaaggttttacggttttagaacagggttcctctgtgaagtttcgtttcatagttcatactagctagtaggatcatctccaactacgcaccgccatctgccacgctgaaatgaattacgggttgtgcagcttaaagctctttactctggtcagatgtgctgctcatgacactttggtgaccataacaatctggtggcaccagcacaccaagacaggctgatactgataggggggacatctggagccatcggcggatcggccaaggctgcgatgttccatccttggatgcgccgtgcatgagcatttactgtacagtacttgtctccctctcctgtggaaagctgaactcggcgcccttttgcttcttttttctacctacagaattggagtctggaaaatggaccatatattgccggcgtcctaagtcctaacatttgcttcttgttcttgcgttcggcgttccaaagaaacccatgttttcgtgatgggttttttattattattatcatcgatacccatgctttgctgtgattattgaatttcgaacagtgaataaggccctgtttggt

SEQ ID NO: 24016 - DNA, 629 bp, Sorghum bicolor
  Clone ID: 30164209
caggcggaggcggcggcgcggtccgtggtgtacatcagcctggggagcctcgccgtcatctcccacgagcagttcaccgagttcctgcacgggctcgtcgcctccggctacccgttcctgtgggtgctccggccggacatgctcggggcaagccaggacgccgcgctccaggaagccgtcgccgcggtcgggagtggcagggcgcgcgtcgtgccgtgggcgccgcagcgagacgtgctgcggcaccgcgccgtggggtgcttcctgacgcacagcgggtggaactcgacgctggagggcatcgtggagggcgtgcccatggtgtgctggcccttcttcgcggaccagcagatcaacagccgcttcgtgggcgccgtgtggaggaacgggctggacatgaaggacgtgtgcgacagaggcgtggtggagaggacggtgagggaagccatggagtccgccgagatcaggaggtcggcgcatgcgctggcggagcgggtgaagcgagacgtggccgacggcggggcatcggcgttggagttcgagcgcctggtcagcttcgtcagggagctcagcacgtcagcagcacagacccccatctccaatgtttgaaatgaatggattgaaattaa

SEQ ID NO: 24017 - DNA, 555 bp, Sorghum bicolor
  Clone ID: 30164219
ggaaataaaactgaccttgttgacaagaggaaagtgaccactggggaaggagaagccaaggcacaggagcatggtgccatgttcatagagaccagtgcaaaagctgggttcaacgtcaaggtcctgactccttattaacgttttcccttcactttgacaaccaaaagctctcttgatactgatggctgctcaaccatctgaaaactttgaatcctgcagcctctgttccgcaagatcgctggatcccttccaggactggacgcgctctcgtcagcaaagcatgaagacatggtcgacataaacctcagacctgccagcggctcatcggcgtcaggcgcagtcgcgcagctggagcagaaatcaggtggttgctcctgttgagacttcgacagttttgtagaactgcaacattgatcgagttagtactttcagagagatgaagagtgggtttcgtccagacgcccagtagtgatatactgatatccatagagagaggccaatttctgtgtacagatatatttatcaagtttatatactagtacataactgtttgaa

SEQ ID NO: 24018 - DNA, 250 bp, Sorghum bicolor
  Clone ID: 30164225
gaattttgatacttttgcttattaaataattacaaacgggatcctagtacttttttcatgcattttcctttttggccatacatagggcccctactttatgtttaaatttattatatatattattgccagggctataaatagtgattagtacactacccttttcattcctgcatgtattggaagtattccattttcgaaatttattgtttagatgactaaaatgtgatactttgaataactaaggtttcgg

SEQ ID NO: 24019 - DNA, 549 bp, Sorghum bicolor
  Clone ID: 30164229
atcggcccggcgatctagtactagagtagagcagtgcagtgcagtgggatcatcgcgcggcaatggcgaaggcggaagcggcggcggcggcgcacgtgctggtgttcccggccccggcacagggccacctcaacagcttcctccacttgtccacggggctcctccgcgcgggcctccacgtcactttcctccaaaccgaccacaacctccgccgcctcggcgccgctgtcgccgaggccacggccgccgcgccgcgcctccgcttcctgtccgtgcccgacggcctccccgacgacgatccgcgagccgtcgacggcctcccgcgactcgtggaggccctgtgcaccaaggccagcgcgtcgtaccgcgccctgatgctcgcctccctgtcgccgcgcgcggacgggggcggaggcgccgccgacggcttcccgcccgtgacgtgcgtcgtcggcgacggcatactgccgttcgtggtcgacgtcgcggaggagctcggcgtcccggcgatctcctaccgcacggtgagcgcgtgcgccgtgctggcgt

SEQ ID NO: 24020 - DNA, 241 bp, Sorghum bicolor
  Clone ID: 30164240
agttgcaagcgtccaaaccccagacaccaactccgcggttctgcgatccgaaagtctccagacgcccagcctcgaaggtcggctacactccggcgcggcgtgcggcgtgcggcgatggcggtggtgtcggcgctggccaagtacaagctcgtgttcctgggcgaccaggcggtgggcaagacggccatcatcacccgcttcatgtacgacaagttcgacgacacctacctggtcggtccgc

SEQ ID NO: 24021 - DNA, 251 bp, Sorghum bicolor
  Clone ID: 30164252
atagcagaggcagcatcgcccacgcccaatcatccgcccccaaatccccagaagcacccacccccctcgcgcgtcccaccagcagtccagcaccacctcctcccgcggattccctcctcctcctccagcgcggtcccaggccggcggtggcctgcggaggccctgcgacgaagacccatggacggggcggcgaagaagaagatgacgcggagcatctcgcggcagctctcgtcgggggcggcgcggctgtg

SEQ ID NO: 24022 - DNA, 542 bp, Sorghum bicolor
  Clone ID: 30164253
ttattctaaacggccttgataacgccaatgagatccttgatgaacaagccttcaacactagcgagtggaaggttattggtgagtacgtctacgatggtgaaggcgggcgacatcatgcgtttctcgctccgacatgacccacggatgttctcggttcaaagatcatgccccacgaacgggtatggatcgaacaaagtctcaagtattccgaggaagaaaagacaaagctttggaagctggcaggtctgaccgatatgggtcgctggactcggggagatgaatatggacttcacctttttcctaattcgagtatgccgttcagtttgatcccttctctctatgccgcaaagcctctgccaacagtccacgactggaaggcgctttggtaggcatgggatgtcgtgaccaaggatatgattgccgatgaggagcttcaagaaaagcccatcaaattgcgaaacgcatgcatcttttaccttggtcatattcctaccttcctcgatattcagttgaccaaaactaccggacaaccaccaactgat

SEQ ID NO: 24023 - DNA, 554 bp, Sorghum bicolor
  unsure (1)..(554): unsure at all n locations
  Clone ID: 30164256
attggccattactgagggtaatgcgcggtattttcgaaggtggactggatgctactggaagggcagatcttgaggaagacgatgaagctgctggtgctgattggggtgatgaagacttggatattgttgatgcaagtgaagtggtggccaatggtgatggttttgatgtagaagagggtgagccaaatgaggaggatggtgaggaaggtggctgggacctggaagatctggaacttccacctgaaactgatactccaaaatctgttggcaatgctcgctccgctgtatttgttgctcctacaccnngtattcctgtcagccnaatttggacccagagatcttctctggctggggagcaagcggctgcagggaactttgacacagcaatgaggttgcttagccgccagttgggtatcaagaactttgttccactgaagcccttgtttcttgacctgcacatgggcaggcatacatatctgcgtgcgcttgccgccgctcctgttatatcagttgcagtagagaaaggttggaatgagtctgcaagtcctaacgtg

SEQ ID NO: 24024 - DNA, 599 bp, Sorghum bicolor
  Clone ID: 30164257
cctactggactaaacaggcaacatatatatgtgcttttctgctacagcaggagctcgatacgagctagccgaccacatctagctagatctctctccttataattatctgtacgcacaggcatcaccattagctgaactacatgctagcttagccgcttgctaacttcgccgctttcaccattagctggatgcattggccatttttagcctgacatttgcagttctcgtggcccagatcgatctgtcggactgtgacagtcagcacttgatcagcagggagaggctgcagggctgttggtgagagagatgaacactaataataagacaaatagcagaagcggcggcggtacaacagggaggagatcaaggagcaggagcaacagcaacaatgccagcaccggcaccgccacgacgccgccggtgttgctgcggaggaggaggtgccggcggcggtggtggaggtgcggcacagccacgacgggtccagcctggaggtggtgctcatcagcagcgtgcggcggccgttcaagctgcaccaggtggccaccgtgctggaagaggaaggcgccgagatcatcagcgccaacgtctccgtcgac

SEQ ID NO: 24025 - DNA, 644 bp, Sorghum bicolor
  unsure (1)..(644): unsure at all n locations
  Clone ID: 30164266
gcttcctgcagattttctttgcagactatttcctcctaagatgcaagattcatcatgttctgcttttttcttataagttttgttatagtgtttttaaagtagaattgatcttaggagtttaccctttaatgagtacaaacaataatgctcacagtaatttttaatgttagaggtatgcaaaagtcatcctacatatgattttccatgatatgaattactactttcaggctaatgtaaagtatgtgtagtctctcctagttatgcctttagccctgttagggnttgattttttatgggagccattgttttgatttgcctcagtcatctttatttcgttgaatctagcttctcttcaaccacgtgatacactgcaatcatctattgtgttgtaatgactgatcaccatgagctaaggtcttttaccccaaatgatggaactgtttagaatacattaaaatattaaatgttgtatggtgatagtttctgctaatcttttccattttactcggaaaattgcctgttttaccgtggaaatttctggatgccttgatgtattcagaactagtagttgctatggtgcttttgtgctaacttcaatgttatttgacaaaactcagaaatatcaagtgatggtggaactcgat

SEQ ID NO: 24026 - DNA, 699 bp, Sorghum bicolor
  Clone ID: 30164271
gataaatttatcctttttaatttttatacgattatgagtgaatcttacaagggagttattttagtgggaggtccatcaaagggaactcaattccgcccactttctcttgatgtccccaagcctcttttacctgttggtggcgttgaaatgattggacatcaagttcatgctctttccaaaatcccaaatatggcagaaattatcattattggcttctatggagaatctagtttccaaaccttcactcaagtcattgaagaaacttacaatattccttgcaaatatttccaagaaaaaaaggctcttggtactgctggaggtatctttgaatttaaagacaaaatcttcgatgccaaaaccacaaatatttttgttttgcattgtgatatatgttgtcattttccacttacggaaatgctcaagttccatttgtctcatggaaaaatctgcacagttatgtcagttgaagttcctgtaaatgaatctaaaaactatggatgcttcattaaagccaaggactcaaacgaactcatccattatgctgaaaaaccagaatcatcaattggaaatttaattaactgtggaatctacattttcaccagcgatctcttcaaacaactaaaggaagccaaagaacataaacttgaagtccattgggagtttttgatatattttaaccatttatttacaggaaacctc

SEQ ID NO: 24027 - DNA, 408 bp, Sorghum bicolor
  Clone ID: 30164272
aaaataccaatatatttcctttcattaaattcctcatccctccacccttctttcatgttcggccaacctatgaacaactttggctatgccaacaactcttttggagatgccaataaccaaaaccaaatgggcttccaaaacccctccatgatgggctccaaccaagccgactcctttggtatgcaaggccagtcaatgaatagttttcccatgaatagtaataacaacatgatgcaaaaccaattcatgatgggtcagggtcaagattctcaccaaatgcaattcaataatggatttaattcaaataatatggactccatgggaggacaaatgcagcaaaataacatgggtatgacgaatcaacagaatatccccgctgagcctgatgcttctgtgtatactacctat

SEQ ID NO: 24028 - DNA, 589 bp, Sorghum bicolor
  unsure (1)..(589): unsure at all n locations
  Clone ID: 30164274
actcgagcactgccttctcattcattcattcacttcattcattctttagagttacatacactctctttcaaaacagtcactctttaaacaaaacaacttttgcaacaatgcgatcttacactcttctcgccctggccggccctctcgccgtgagtgctgcttctggaagcggccactctactcgatactgggattgctgcaagccttcttgctcttggagtggaaaggctgctgncaatgcccctgctttgacttgtgacaagaacgacaaccccatctccaacaccaacgccgncaacggntgngagggcggtggttctgcttatgcttgcaccaattactctccttgggctgtcaacgatgagcttgcctatggtttcgctgctaccaagctctccggtggctccgaggccagctggtgctgtgcttgctatgctttgaccttcactactggtcccgtcaagggcaagaagatgatcgtccagtccaccaacactggaggtgacctcggcgacaaccacttcgatctcatgatgcccggcgggggtgtcggtatcttcgacggctgcacctctgagttcggcaaggc

SEQ ID NO: 24029 - DNA, 367 bp, Sorghum bicolor
  Clone ID: 30164278
aatccacccggaaccgcggtctcagggtcgcattcgcaccgcatcaccgcgatggactatgccgcagccgctactaacgcgccggcgccggcgccggcgccgggcaccgatcacgcccactacccgcacccttacgctagctactcctacccctacggggcctatcaccaaccagccccggccacgtacgcctccgtcgcggccgccgcctcgtcatcctactactaccccgtccctgccgccgtgccgtccaccgccgtgcagtacgacccttactcgggttaccagcactacagtcccccggagggaagaggcgccgctggggctggcctggtgggctactacttcaccgtcggcgaggcgccgc

SEQ ID NO: 24030 - DNA, 655 bp, Sorghum bicolor
  unsure (1)..(655): unsure at all n locations
  Clone ID: 30164285
aacgaacgctaaaaaagtaacagtttctgtactttattggtttccttgcgaatgcgaaagcttctctttgttgcagcaatcgtgctgctgtcgatgaccgtgagtgccggtggcggcggctcggaacacaacgccgaggcggaaatccctggcgttgtcgatttgaacccgacgaacttcgaaaccgtcgtcggacaagacaaggctgtgttggttgagttctacgccccgtggtgcggccactgcaagaacctcgtgcccgagtacacgcgcctcggtgccgccgtgcttgcggctggcagcgacgcacctgtggtcgtcgcgaaggtcaacgcggatgcccacaacgcccttggcagtcgctttggcgtgactgggttcccaaccatcaagttcttcccagccaagagcaccacccccgaggactacaagggtgcccgtgacgccnaggcatttgtcgacttcctcaacaaggagactggcgcgcagctcttcgttccccgtgaagtcacctctgttactgtccttgatgcatcgaacttcgacaagatcgccctcgacacgaccaaggatgttcttgtcgagttctacgctccgtggtgcggtcactgcaagcagctggcgccgacttacgagaaggtggccctgacctacg

SEQ ID NO: 24031 - DNA, 430 bp, Sorghum bicolor
  Clone ID: 30164290
aaaaaaaccaaatgcgcagaaacggctattgctacaggcctccatcagattgggaggcgatccatccatccatcacccgcgccctcgacaaccaccacccctagcagacagatcgaccgaccaccacgggcgccgccatgtccaccgctgacgcggcgagcccggcgctggcgccggacggggacgcgccggcgggcgagggcctggccctggcgcagttcgcggcgggctgcttctggagcgtggagctggcgtaccagcgcctccccggcgtggcgcgcacggaggtcgggtactcgcagggccaccgccacgccccgacctaccgcgacgtctgcggcggcggcacgggccacgccgaggtggtgcgcgtgcactacgaccccgacgcctgcccctacgccgtcctcctcgacgtcttctgggccaa

SEQ ID NO: 24032 - DNA, 365 bp, Sorghum bicolor
  Clone ID: 30164298
cccttttcccaaccctaataactcttctccatgtctgttaaactcggtatcaacggtttcggtaaaatcggaaaactcgccttcagagctgccctcaagaaccccaaggtcgaagtcaccgctatcaacgaccccttaatgagcttggactacttggtttatcaactcaagtacgactccgtccacggcagattccaaggggatatcacacacgaaggcaacaacatcattgttgacggcaagaagatcagagtcttcactgaaaaggacgttaaggccatcgactggacccaatccagctctgatggcatcctcgaatgctccggtgttaacctcacccaagaaaaggctcaagcccatctcgg

SEQ ID NO: 24033 - DNA, 338 bp, Sorghum bicolor
  Clone ID: 30164306
atttacatctacatgtgtctgatgatgtgcgctttggtgatcttgcacatttactggttcacatatatcgtgagaatcttgctcggaatgctttcaaagaaaaaggaatataacattttcgacaagaaaacaacagctaagaccaattaaatgatgttggcttttacatatagtaagtgtttttgtaattagatagatctatgattgattatatattgaaaaaagatcgttatataccattatatatttgattttgtgatcctcttggcgattccacgaattcaaatcaatattgttattaccgcggtaatcataattataatttgtcttctctctct

SEQ ID NO: 24034 - DNA, 519 bp, Sorghum bicolor
  Clone ID: 30164324
aaggaaaaagttcggttcagttctggatattgttcccctggctgactcagtcaccaagctaacagcacgctgtgagctatgcggtcaccgagcgttcttcacattgaggaagacgcaggaaaccaagactgaactaattggaggagctgatgtgtatatgcctgtgtgcaggcagcactacatggatgggcagattgtcattgaggccacaaggattgtattggaccttgacaggtccaccacggcggcgaaagctttgaaataggtcaatacctgacttctgcatgcagatttgcagtgtgtaacaacttatttatgatgatattggttgctgttgagtgttggagacactagcatctcaattctggcatccgtctaatatagttgatgaaaagctattgacgacattgagatgcagccaccattgagggaagctaaatgaggctatcccacaaagtacaattgagatttgagaaagattgtaaatatcgatcagtttggattttaaatgtgaacatt

SEQ ID NO: 24035 - DNA, 579 bp, Sorghum bicolor
  Clone ID: 30164325
taccgataacatcagcacacgtcaaacgatcatccgaaagttgatctcgcctcctggtttccccagcaagggttacgatcaagacaaggttcgacgtgtcttggaggccttcgagtggcttggactcatctccgacactgaagaagtcgctcacgttaacactcccatggacgccttgtgcgctcaattgctcaagaagttgaacttcgagcccaacgatcgtgacatcgtcatcttgcaccacattttcggcatcaaatggcaagatggtcgtcgtgagactcgtaccagcactttggttgtgtacggcgagcctggaggtgagaccgctatgtctaagactgtcggcttgcctgttgccattgctgcagatctgatcctcaagggtgaaattaagggcgccggtgtggttggtcctattcgcaaggacatttacaagcctatgttggagggcctgaagaacgagggcattgtacccgtgaccaagtcttcagtattcaacgtcaatctctaaatattcatgtgcattcttgataatatataacaatatcttaagtagataaacgcgataaaaaccct

SEQ ID NO: 24036 - DNA, 505 bp, Sorghum bicolor
  Clone ID: 30164326
taccccgttcttgcatgaactggaaatggcatatgctgcctctgatgtcgtaatttctcgagctggtgcaatgacgtgcaccgagatattggccactgggaaaccatcaattctgataccattgccaacaattctggatcaccaccaaacgagaaatgcatatatcatggctgatatcatgggagcaaaggtcatcactgaagatgaacttgattctagcagtctcacatctgcagttgatgaaatttttggtgatgaaaaattgatggcagacatgtctcagaaggcattaactgcagcccgaccaaatgcttcagctgatataatccgccacatatgttcattgattggttcaccttacccatcatgaaacttgttttaaacatagcaaaaagttcttcatgtcatgagcacattttgtattgtttttgttttgaagcaacagcatgatgacatcattttcttgaggtggaaactgatgtttaattccattgattatttgctg

SEQ ID NO: 24037 - DNA, 561 bp, Sorghum bicolor
  Clone ID: 30164337
gatgttcctcgtccaacaaatctccaagactttgttccaagtcagagctaagctcagatggattcccgaattcattggatatcccctcagatggtaatgagaattgatagttttcctttgaaattaaccttcatttaggctcttgtctggattctatatcaacttgttcggtaccactttcgttttgctcgaattgaacaaggccatcaaattatacaacgcttggttgtggatccctaacatcgccttgattgtcgtctatgccgccttcactttacttggtattgaaaaactctcttatgaaaagtattaataaaatccctaggtgtcggaaagaagcccagagccaaaaaggctggtgaaacccccgcccctgctgctgaaaccaagaagactaattaagaatatgttatcagatatatatttaaacatcataaaagttattgcatttatgttttaagttttgtcgtcataaaaaatctatttgatttatgtctacaaaataagactatatgtcttcattaaaccttttattgcatctcattcatttgtaaacgacaa

SEQ ID NO: 24038 - DNA, 574 bp, Sorghum bicolor
  Clone ID: 30164340
gagttggcaacagttgttgtgatggcaagtgaaggctatcctgggccttacaagaaggggactgtaataaaaaatattgatgaagccgagcaggtttctcctgcagtaaagatattccatgcaggaacagcctttgatacagatggaaactttgtagcagctggaggccgtgtgctcggtgttactgcaaagggcaaggacattgaggaagcaagggctaaagtgtatgatgcgcttgacgttgttgactggccagaaggattctacaggcatgacattggttggagggcactcaaatattgccatttggctgcacactgatgacaagagtcccccgaatctctgtaattatgtcgggtttgcaatggtaaggcaagcataagaatttgtcgcaatagatgctgttagccttgtgggtcagtgggtgcaagaagattgagtatggaagtataacttgcgtggagcagttccttgaccggggaacagctgatgtttggagagtagtttttgtttttttaagcttatatacttatatatgagtaccacttctggtatttatcacttattagtaagg

SEQ ID NO: 24039 - DNA, 643 bp, Sorghum bicolor
  Clone ID: 30164346
gagaaactgacaatagtcaaattcacagaagcatagggtatgtactccttgttttatcattcggagaagttgctgctggattgtcagttggacgtcttgctgatattcatgacaaaattaaactctttaccattacaattttcctgaatgaagccgcattactcctgacatttttagcttgcttattcaacagttattccttagccctacttggaggtttgttctttggatatggagatactgcaattcaaacaatgatcaattctctcattgggtccatgtttggtggaaggccagaactcttttctgcctatagattcttccaaagtataggattgacatatgctgctcttttgactgtttttgtccctgcaggtaaccctcttctttacattattctcattgggggctccatgcttactttccataccctttacaatcgctacaagcctcatgatcaagatagcactaacgtctcttatgataagagacccctgcttgagttaaaaaatctttaaaatgagttcataaattcattcagcttattttttgtcaagtatgaattcataatcttcaatttattttctatcctttaatcaataatttgctgaaagatctcgttctataaataagaacttaattg

SEQ ID NO: 24040 - DNA, 511 bp, Sorghum bicolor
  Clone ID: 30164349
atactagcaaaccctgcaggatcgttcatcttctcagagctaattgtcagtaacttctatgaacatgaagctgagaaacaagctcaccaacatcagatgtcagcattgctgtctccacgattgcttcgcaacacgggctttcttgccgatggaccactgaagtgtgaagggcctgcttgcttctttttcagctctctaattatgtcagtgttctgtgctgttgctgctggcttgagcctcctcgttgtccacaggaccaaacaagtttatcctcgcctctatagttctgtccggacttgagaaccaccaattctccatggatggaaagttcaaatcctcctattctatgtccatgtttttttgcatacatatacacaaagataagtttatggataaattctcaaaaaaaattctgtgcttgtattgtaaagccagatattcctgaatggcatgtcccttgcctatggattctgacacttgctgtcctgaaaagtgaaaagaaactcttctt

SEQ ID NO: 24041 - DNA, 259 bp, Sorghum bicolor
  Clone ID: 30164351
gcctcggggcctagtgaggagggctcctgtgtcaaagacccgacgggcgtcatggtgctgagtgatatcaagaaggccattgcagcgaaccaagctcccgtagagctagacagcgaggctatgcagaaggttgcgacttggggaagtaaccagtggataggttatgacgacgcagatacgctggcactgaagatgacatgggctgatggattgtgtttgggcggcggtgtattctgggcgcttgatatcaatggcggtg

SEQ ID NO: 24042 - DNA, 297 bp, Sorghum bicolor
  Clone ID: 30164359
gttgtaatgcaacatgtactgactgatcaatctgcaaaggattcaagtgttcatcacctttttggggactcttcaatatatagtatgtagtttagactccacatcaccagtcctccttgtccccttccgttggtaggaaaggaacttgctgcttgccccacaggcagagagacctgccgcactgttttgtttttatcctgttcctgactacggatcaaagattccccggaaccagaaaatgttaagcgagaggagacgatggaccccccttgtgcagttgcaatccgtaatcatcgg

SEQ ID NO: 24043 - DNA, 425 bp, Sorghum bicolor
  Clone ID: 30164368
agtctgcctgtctgcctcatcggtccatttttttgttcccctgtttgtcgtgtgtcgcttctttgcttgcgattggaagccttctcgtttctccggcctgtgtggcttgtcctgtctccaaatctgcattcctgaacaaaaaaaaaaaaatctcctgtaatcctccgacccatggccatgggcaagctcggggagaaggtgagggcgttctggaggaaccgatggctggtgttcgtgggcgccatgtggatgcagtccatggccgggacgacgtacatcttcggcgccatctcgccggtggtcaaggccaggctgggctacgaccagcggcaggtagcggcgctgggcgtcgccaagaacctcaggggctgcctcggcctcctcgccgggacgctctcggcgacgtggccgccgtgggcgctgct

SEQ ID NO: 24044 - DNA, 122 bp, Sorghum bicolor
  Clone ID: 30164389
cctcctgcgccagcgcaacctgcctctatgatcggtagctgccgcgccgctcgagcccgagcgtcgccggcggcagagcctccgctgcgctgccgtcgacggggacggcgggccatgggagg

SEQ ID NO: 24045 - DNA, 249 bp, Sorghum bicolor
  unsure (1)..(249): unsure at all n locations
  Clone ID: 30164397
ataaaaaaaaaaaaaattcatcaaaattttttaaccccnttctccacatgcaacaagcccctcaacctgtccccagtgacaagatggccaaggccaagaaggaaagcaagtttgatgtcaacttcatcttgaaggagatcattgagttcaaagggtgggaaatcatcttccaagccctcctctacggattcgtcatctatggtatatacgctctctacctggtctatagattncaccacgacccctact

SEQ ID NO: 24046 - DNA, 458 bp, Sorghum bicolor
  Clone ID: 30164413
cgtccacctccggccgagcggtggccacctctgtgttcccttccctccgaaaaggcaaaaaccctagcaaaaaccaccgccccaatccaaatcctcctcgttccctccactccacttccctcccaaaatttcaaacctcgaatcgaagctatcatgtgcgagcgcccacctaccccacgttgattggaagaacaagtccgacctcaccacctacccaatttttcctcccaaaaaattcaaaaaattattcgattccgccgctatcccgtccgccctacaaatcccgccaacatgcgttccatctgcgccatgcgctcgctgctcgccgctgccgctgctgccgcctccgcccccaacgtactccgcgccagcgctttcccgtcgcggccgccgctcctctccctacctttccgccggggtcgtgctctagctgccaggaacatgcttggcgcggcgag

SEQ ID NO: 24047 - DNA, 442 bp, Sorghum bicolor
  Clone ID: 30164414
aagacgagcacctacttgccccgaaacacgttgccgagctcgtgaagaagggaattaaggtcctcgtgcagccttccactgttagaacctatgctgataagaaatacgaagaagccggtgccatcatccgagaagacttgtccgaggccgatttaattgtcgccgtgaagcaagtaccctcagatctgctcttgccggacaagacttatatgttcttctcccacgtcatcaaagctcagcccgaaagcatgaaaatgcttgacgcaatattgcaaaagaatattagactgctcgactacgagaagattactgataacgagggcaagcgtctggttcgtttcggtaaatttgctggctatgctggtatgcttgacactctccacgcattgggagatcgtcttcttgctcttggcttctcaaccccattcttgcacttgggcta

SEQ ID NO: 24048 - DNA, 651 bp, Sorghum bicolor
  Clone ID: 30164415
aaccccaaccccaacctccccggccctcaccacctccgacccagaccgagaccccgaccatgaatccgaatccgaatccgaagatatcctacgcttcgccttcgcgtgtggtggcgccggcgccggtggccgtgtctactccgccatcgcgctcgccgacgagctccacgcctcgctgccgtcctctcgctccctcatcctcggcgcgcccgccccgtccttagagtcctcagctgccgccgcggcctcctacccgttcgcccccgtcccgctgcgctgcctcccgggcgggatcctcgccgcggcgctgcacctctgccgattccgcccacacgtccttgttgctacaggaggcgctcccgcgctaccggcctgcctcgccgcgctcatgctccgcctccccttcgtgatccaggaccaggacgcctctcctgctcccgccacccgccttctcgctcccttcgcccgccgcgttttcctcgccttcaatgctcccgtgcgactcctccccaaacgcaggtgcgccgtctacgggaaccccatccgcatgtctatcctcaagtgcagtgcatccaagattgaggcgttggcgcgcttcttcccgagagcggggttgttgggtgaacatgatgcccaggttgtgctcgtgct

SEQ ID NO: 24049 - DNA, 323 bp, Sorghum bicolor
  Clone ID: 30164419
agatacttttgcgaagcggttcatgggtcaagcgcttgtttacttgcagactcttttgctccttggcttgttgggtatcgcgtcgagcgcgcgcagctcaacctgtcccctatctttgggtccatcccttctgctgtcacgcatacaactgcgctcaaggcggcttgctttattggttgggccggccacctgatgctccgcatggttcttcctatgtcgacttctcagcttctcccagtcatcgcccttaatatcccggctatccagtttcttctcgggaccttcactgaccgtcttggctcttggtgggggtcctctcatca

SEQ ID NO: 24050 - DNA, 322 bp, Sorghum bicolor
  unsure (1)..(322): unsure at all n locations
  Clone ID: 30164420
gtccctgcttcaagcatcttcagccatgttcgtttctttccctcaagtcgtcggccatctggccctggttctagggcttctaccaaatcttgtcctcgcccagtgcggtccagacaacgatggagctcgctgccctttgaacgtctgctgttcctcggccggatactgcggaacatcatccgtatattgtggtgacggttgtcnatctacgtacgggagctgctctgtacctacggttccgtcttgctcatccgacggtaagacggcgactaacggccgtcgcgttggatactggcgcgtacagcaggcttgggaccgatct

SEQ ID NO: 24051 - DNA, 676 bp, Sorghum bicolor
  Clone ID: 30164426
taaaaataacatttcagaaatccttcatacattagtgatggggctcggtatcgatcatttttttgaaaatttcggtggacaagttggtgttcctggagatcaaatcaagatggttttttgtctcttgatctcttatcccttcggcttcatcttcagagccatctctaaccccactctcagacatgttctcggaactgccctcggtttcggcttccaatttttgatttacaaggccgatatcatttaccccttggctatggcccttatggtttacttcgtcatgaagtttatgggaagaaacaaagctgtcctcatcttcatcctctccatgagtttcctttccatcttccacatctacagaatgtgggttgattggggtggttacaagatggacgttacctcagttctcatgattaatgtttgcaagggaactaccttggcctggtgttatcaggatggtggcaaggacccctctaagctctctgcaagccaaaacaagtataaggtcactaagctccccagcttacttgaatacttgtccttcatgtatttctatgccaacacccttgtcggccccgcttgtgaatataacgatcacgacaacttcatcaacaagagagaaacctacagcaagccccctagcactttccttgcttctctcgggtatttgattacc

SEQ ID NO: 24052 - DNA, 571 bp, Sorghum bicolor
  Clone ID: 30164430
ctactggaaaaaaaaaaaaaaagcgccacggcttccgcttccgcttccgcttccgctcctcctcttccccttctccgacctctgctacggcgagctgcacactgttaggcagaggaaagggtgatggcaatggcatgcttctctgcgagcaccaaggtttcgctcaagttcggagctaaggcgttcgcgaagaaccgcttgcctggctacctggattctgtggtatcttttcctgtttctcggacattggatggtggtctttgttctcccatcagggtggagaatgagaatcgcgcctatggttcaaacgtgattgttggggctctcaagggcagacacctcaacacaacactctcttcgactaatggtcacgtgaaggttcctgagagggtaactgtactggtcattggtggaggaggtagggaacatgctctttgttatgccttggaacgctctccgtcttgtgatgcagttttctgtgctcctggtaattctggcattgctcagtctggagatgccacatgtataccggacatggacataacaaatagtgaaaatgtcatctcattct

SEQ ID NO: 24053 - DNA, 411 bp, Sorghum bicolor
  Clone ID: 30164436
atgcgtacctctaccaaattaccaatggctccccacctcctggccgtggccgtggccgtgtccgccatcatcgccgccgtatcgctgctcgcgcccggcgccgctggctacccgtggccattttgtggcacgagcaacgacttcaagccaaacagcacataccaggccaacctcaacctcctcgccgccacgctgcccaagaacgtctcggcgtccccgaccctctacgccaccgccgtcgtcggcgccgtccctgagcaggtctgggccatggggctctgccgcggcgacaccaacgccagcagctgcctcgcctgcctcacccaggcgttccaggacctgcccaacgactgctcctacaacaaggacgccaccatctactacgacccctggatcctccactactccgac

SEQ ID NO: 24054 - DNA, 516 bp, Sorghum bicolor
  Clone ID: 30164438
atataatttttattttttaaagctatgaatttagaacccattcaaaaggaaaatcttaaaaaagtcctctatactggagcttgtttcacgacactcttcacagcctacgtcgctgctcaaaatctagtctctcagatttactctcaacttggttatcctcgccttggccaagtatgcctcttcacttactttgccttttttgcctcaatgagtgttttcgcaccccacttgaaaaagaagctttcgacaaaggctgggcttatcactggagcaggatgccacatcgcttttgtatttgctggagctttaacaacattctgcaacaagtacgacttccatggtggattttgtaatgcttctttcatcccattcttcaacatactcagtgctgtttgtcttggaagcggtgctgctctaatttggaactgccaagcaacttatgttgatgaatgcgctgatgaaagtacaaaaggtctcttcaatggttctttcctggtcaatctttcagacctctca

SEQ ID NO: 24055 - DNA, 652 bp, Sorghum bicolor
  Clone ID: 30164442
gccgcgacgtcggcggcgccgcccaggtgctcgcgctccacgaggaaggacgcctcgtcccgctgctgccggtggtgccaccgtcgccgtgcgcgggcggcgacacgaagctccccggcgccggaggcaagcgcgggtgcgacgcgtgcggcgggctcaggttcgtggtgtgcggcgagtgcgacggtagccgcaaggtgttcgacggcgggcggtgccgtgggtgcaacgagaacgggctcgtcatgtgcccgctctgcttgtaggcggcggcggcagctgagcccgtcgttggcatcggcccgagcaatccattgtccattagcggagcgcccccgcgcaattaatcagtaattattgttactgcgattgctctaatttgcgttagttattagttctctactgctactagtcgatcgatggatgtgtttgagtggttggtttgtcacgtacaatgtatgtacatatacattacatgctggacttggagcaatgtgtgatgtatatactctatgctgctgctagtttagatgtccatgtcaaaacccatgcaaagatagataggagtacgcacatggttccatccatccatcttgtgatccatccatgtacctatctatcaatcaaatcaatcggaaacaggtttccccag

SEQ ID NO: 24056 - DNA, 557 bp, Sorghum bicolor
  Clone ID: 30164451
atgttctgtcttggattgggaatactttgcggtgctgttggatatttgggctccactctatttgtgaggagaatctacagaaatatcaaatgcgactaaacttggtcgaggctgttagcatgtcttgtcacagtacggtgcagagtaataccttgagcttctgattaattttgaaactacacaggaggttgctctcccttcggttactcttaatcttttttttggcctatcttccgccatggaagtgtggaactgccctgataaatgtatacctattagttggggaattagtcagagtactggaaagtacatgtaggttctttttgtgtggcctctcttggtcaattgtaggagtacattgatgaatattaccgccgtgcagattccagcgggctagaattgcccctcttatgagttgccacatccagttttcatatcccccttgtagtataagtaggctaatatattgaagttaagtatatcttaatgtgtttgatttattttttgttgttgcacttgaaagtatattgaagattttgaagtagacttcagcagtc

SEQ ID NO: 24057 - DNA, 577 bp, Sorghum bicolor
  Clone ID: 30164455
ccattcctccatgttggtgattgcgttgtaaaggaactcaaagcagctaacttgaaacctgttgagtatggaagtaatgtccgtgtaggagttctgtccactgacaatacattggctacaaactgttatctagacaagttggagagccagggttttgaggtactatgtccagataaagcttccatggagcgtacagtgttaccatcagtcgatgcattcaggaagggggacatggaaggcgcaagaaacctgttgcgagtatcgctgcaggttcttcttgtgagagctgtcaataagataatccttgcctccgatgaccttgtaggcattttgcctgatgatgaccctctgctcaagaaatgtatagacccattggatgccttggtccgagaggccatcgtatgcgcacgagcaccacgaccatgatgtgcccaattactctgtttccttgctcgtataggccttcagtggtagctgtttacacacaccttgactgctgatgagcacatatgtaaattttacaataagataaaaaaggaaggattcctctcggccaagatcatcgatggttaattga

SEQ ID NO: 24058 - DNA, 651 bp, Sorghum bicolor
  Clone ID: 30164461
ctgggcggatttggtggtggggtatatgggagtaccgaaatatgctggggtctccatgacacagcatcctcagtacattacagtcaggaacgatcgtggacgggagatgctgagcctggtagatgcccttctggagagcacacctacaattagcagtggctctaggcaaccatttgttatggagacagtgaaagctgacgatgcggcaaaattggggaaaggcccttcgaaaccagctcctagatttgtcggcgacattctggccttcctactgaacttggttggacccaagggtctggagttcgcacgctactctctggattatcacaccattcggaattacctgcatgttaggcgggtatggggaaaacagagagccgagcagcacatccccgggtatgccaagaagatcgtggaggcctacgacaaggacggacgaatcgaggcaatggttacgcagtcaagtgactgactcaccattcacactctactagctagttgtattttgcattgcaagaatgtagcaggattatgtctgtaatgtgacgtagtggtgatgtatacagtagaatgtataggctgcccagcagcagctctgatctgtacatcttgcgcttgccaatttttagtttgcatttgcaggagcccaaa

SEQ ID NO: 24059 - DNA, 505 bp, Sorghum bicolor
  Clone ID: 30164487
aagctatttacaaatcaactttgtgcactttgtccgtctgatcatcgaacaccgttcaacactcaaagaagttgacctgcagagtatatatggatggtgtgatcctttcagttcaactgacattgattgggatctcatctttaagctcatgagggagaaactcgaggtgttggagacggttcggatcaatggcaggttcagtgacaatgtgggctggtatcagatcttctttcgcaacgatgtgcctgctgtggacacgattgttaggctcatgggagaaaagagtgaaaggcttgagaggtatactctcgagggaggggagtatcctcagcctttgtggaggatataagatgtaatgctggggatggggtaacaggagcgtaacgaatcatgacgagattgttttggagtttttatgataacgaggcgagcagtatctgtacaaagaaatgagagggagcgaatattgggccgttgtccttatagggagatattgggaagcata

SEQ ID NO: 24060 - DNA, 153 bp, Sorghum bicolor
  Clone ID: 30164502
ttggattttatttgaaataatactttaagtatataatcatgttatacattaacaagttatgtttgtttttactgtgtaaagctgtttggatactttctaagagttactgtatgtaccaactcatgggaaaaatttcgaacttttatttccctc

SEQ ID NO: 24061 - DNA, 630 bp, Sorghum bicolor
  Clone ID: 30164522
aaccataaatcccaaaccttctccgtcctttccatggagacgaggccggagcgccaccgccacgaccacgtccacgagcagcaagcccaggagggggaggaggacgacgcagcagcagcagtcatggaacacggcgctgctctctcgctgcaacgcggagccaccttgtttgggcgccggcgtcagcacgatgaggaggccgaccgccgccgccggggcgagatccgggaggtggacttcttctcgagggactccggagcccggggccaggacgacggcggcgggcgcggggtgcccggaggcggacgcgacgacgtcaacatcgggctagacctgctgaccaccgccaccgctgccacgacaagcgccgccggcgaggaaatgatggcggtcaagaatcaaaagatagaggcgtcagctgtggaagtggagctcaggcgggtggtggaggagaaccggcggctgcgtggcatgcttgaggagctcaaccggagctatggcgcgctgtaccaacagcttctccaggtcacgcagcaccgacagcatcctgctgatctcatgatcaacagatcatcactggctcatacccacctgacgaccaccgcggcctcgcacaacacgtcgtccact

SEQ ID NO: 24062 - DNA, 638 bp, Sorghum bicolor
  Clone ID: 30164524
gtttttttgcttcgcaactaacgcccacatcaattgtcaagctgatcatataataatgtcttttcaaaagattaaagtcgacaaccccgtcgttgatctcgatggtgacgagatgaccagagtaatctggaagctcattaaggagaagctcatcttcccttacttggatattgatattaagtacttcgatcttggcatggaataccgtgataagacagatgatcaagtaaccgttgatgctgccaaggccatccaataatacaacgttggtatcaagtgcgccgtcattacttttgatgaggctcgtgttaaggaattcagcttgaagaagatgtggttgagtcctaatggtattatccgtaacattttgggtggtactgtcttcagagagcccattatctgcaagaacgtccccagattggttcctggttggactcgccctattgtcatcggcagacacgccttcggagatcaatacaaagccaccgacttggttgttgaccgccccggaaagttcgaaattaccttcactcccgccgacggatctgagcccaagcacattgaagtcttcaacttcaagaaccgtggtgtccttatgggcatgtacaacaccgacgagtccatcgaggcctttgttt

SEQ ID NO: 24063 - DNA, 617 bp, Sorghum bicolor
  Clone ID: 30164525
atccatcgccaaaaccacacgcatccagaggcagaggcaaagcgagacaagaaagcgcgagccccgatcgaatcgaggtctcaagtctcttctaccccatcggccatcgccatccgcagctcgccagcccagcccgcgccgaccgacagagagtccattccggttccgccatgatcatcaagaccctcaaggcgcgcatcctgcgcgcgctcaaggcggccgggcacgacggcgcggcgggctccccgccgccgtccccgaccaagcccgccgcccaccagtaccagtaccagtaccagtaccacggcagcgacgccctgtccgacgacgcgtccttcttcgacgcgcgggagcccgatacgccgcccaccaaagcccaccaccaccgccgccgtccctccgccgcggagccgctggacgcgtgggagctggtggacgacgaccaggacgacggcggctgcgcgtcccccgcggcacccgacgccgacccgctgctgggtttccccgcgcggtgcccgccgggcggtgagtccgtggtggtgctgtacacgacgacgctccgcggcgtgcgtcgcaccttcgaggactgcaacgtcctgcggtcgctgctggagaac

SEQ ID NO: 24064 - DNA, 568 bp, Sorghum bicolor
  Clone ID: 30164545
cctactgggtcgcactcctaaaataaaataaaatttaaaaaaaaaaaaaactttccggcctcgttggagtgcagcgagaatgcgagatccgtgccgccggcaccgtccctccctcctcgccggccggcgcgcccgtcccgtcctgtcctgtcctgagtcctgatcgcctgcagatcacctgcacgccctgcagattaccaaccaccgctcgtggggacagccctccatgctcctgcgctccgcgccgcgccgcctccacctactccacccgcaccacctccggctcctctccgccgctgcgctcgcctccgcggtcccggcccaggccccaaccgagtgggccgaggctccgcttgcctctgtgcaccctgccgccgacgacgcctcgctcttccacgtctccctcgacctctccgcgcaccgggggctcctcgcctcccacgccgccgccggccagttcctccccttccgcctccccgcctcgccctaccccatcttcctcgccatcgcatcccctcctcctccaccacaacccgcgcccgaggccctagcggagccagcctcctgc

SEQ ID NO: 24065 - DNA, 679 bp, Sorghum bicolor
  Clone ID: 30164569
actctccatcttcccattgaggaccaggttcattcgtttacaaaaccaaactcattcattctttaatacattcgctcaataagcaaaaaccctaatcatgcgtttctctaccggtatgctcctggctgcggcctcgagcgtcatgggtcagcggttcaccaactccagtatccctgctactgagtccgctaccactacctcggacgttgctcccaccggctctgctgtggctgctcagcctatcgacctcagcggtgccaagctgggacctggtgcctcagtcgtcacgcgctctgatggaagcgtcgctattgctctggtcgccggtcccaatggcgttgcttcattcaccattggcgtccccgaagacatcttctccagcttccccgctggtaacctcttcatcatcctcttcgagattttcgtcgagctcattgaaacccagaagcgtgctgagaccgcctgctctcttgatgtcactgctgacggtgagagcatcttctccgaggatctctccaccggatctggctccaagtcctctgatagccaagcttccactggaaaatcccccaccatcgagtttgttcagtcttgcggtgctggttccgccagacttgaagtctctaaccttgctgctggtccccctggttccagcaaccctggcggtggtggcggtggc

SEQ ID NO: 24066 - DNA, 606 bp, Sorghum bicolor
  unsure (1)..(606): unsure at all n locations
  Clone ID: 30164571
tttttttttttttttttgagacaatactgatccattgaattcagcaacatttgacagaacacactgcatatcattctctctctctctctctctctctctgtttattgcagagccatccgtggatagaaactctggtggttagtagataaaagggccaattcttcaactctgttgggaagcagtacaactgtacagtaagctcaaatttgaaagaaattcgatcctcagcagtgcttttttttgtctccatcgatcctgctttgactagcttacatcagaaagactggggacagaaaactgtgaataataaccaggagttggtcacctatttgagtactatttgttatcctgctgaagcacatggntggttgccttgggtggaagccagagacctgtgccggtcacaaattcacgctgtcacatgtgtgtagcatgcttgagagcatcccagcaagcaagctgagtctcagtgtcacctactctactgtctactctactcaacaaggcaataatcaagcacgggaattcctcttcccccaagctttgcctttataacaccagctccctactcctactactcttcactcttcagtgcagacagttctg

SEQ ID NO: 24067 - DNA, 420 bp, Sorghum bicolor
  Clone ID: 30164572
cctactgaaaaaaaaaaaaaaaaaaaaaaaaaataaccatgttggcgtttttctatcaagccgagatctcaaaaacttgagactctcatgtaaaacgattgcggaatgtacaaaaccactccttgcgttgcccagtttcgatggcgtcccgtggaggaaagatggagagaggctgaatcatctttcccttgtaccgagctgcgcaaggcgcatttactccgtcaaattcaacatggctcgcttggttgaggaagaagtcgaatacgctacatcgcgaatcatcaacgcaaatgaactgaatcgagcctggggtccttatctcgagactcaagatatcttcctcgaaccaatcgagctgcctcttgacttggtagttccagctatcatgagggtacccaatcttgattccttgtgcctgac

SEQ ID NO: 24068 - DNA, 323 bp, Sorghum bicolor
  Clone ID: 30164575
tccatgttctcttcgggccccttctcaggcctcagcccctttgagaccgaaaccattccaagaactgcggttttctcagaagatctccatgaaggtcgatgactgatctggggtggttgccttgccgctctgtttctgtagagcctgtacgtagtcacgcattcaaaggctggtggtgcaattggcctggccagccattgggaaggaagaggtacctgtaaattccatttttctgcgccgtctcaaaagactactagattattacaacccacaaggacgttctctggctttgtatggaagaaatgatttgttcgaagttgttg

SEQ ID NO: 24069 - DNA, 697 bp, Sorghum bicolor
  Clone ID: 30164579
cacggggtgcagggcaagaggagcccgccaagttcatggagaaagtcaagcaggcctgcaccaagtacatgattgccagcgttgccaccgcagcggcggcgttgccggcagcgccccagcagctgggcttgaaggctgacacaggaaacatccccatcattggtgcaagcgcggcaggcacgacgaatgcttcaacagggaagcagttgattcttgatgctaaggctccaccaccaagggcagcaccaaaggctcctcctgctacaaacccctcaggaatgcgtgacgcaggaaagctcattctgtaggttgtcattttttgaagtttgatcaggatgcgtctggcttgaatgtagtggtttgtgaggttaggtcgcattgacgaggcgtgttgtggtcgacaaacggatccaagtctgcgtcttcaatggcagtggtgtggtgtgagagtgtgcgcatgccaggagctgaaccacgatttttgtcagttttgagccggtgcttgcaaagtaaagttttggttgttctaggtataggcatgtttgtgtatggcgaattgatcacattcttgttgttgcgtgacagacctgcgccttgttttggtgtgatgcgctggtctggtctgatgtctctacttcataacgtcgcatgtccattccatgtagtcgccagtcagcccttttaacccccacggtat

SEQ ID NO: 24070 - DNA, 413 bp, Sorghum bicolor
  Clone ID: 30164621
caatgagattgtggaaagcaattgaactttcagcacaaggaataattagaaagggattggagtataagcaacaagcaaaggaattaaaggaatatattgcattgttgcaaaaggagactgctaacttgcaatccatggaaagatcaattctattcacttttaaagccatggaacagttgccatcttgtgatcagattgaagatgtgattgtagcaagcattattaaacgattaccaaagccaaatccacctggctgggggaaaataccaagtgcaattaaggaagagctaacggcaatgagtggaggtgcaaacaaggacgaattggaagtgatgctggaacttgcaccattgatcaacccaacacttggagaagaagatgaataattgagcacattaaaagtttcgttaatt

SEQ ID NO: 24071 - DNA, 515 bp, Sorghum bicolor
  Clone ID: 30164630
tcaaggagggcaagaagaaggaggatgtctccaagaagccctacaccgtcaagtacggtctcaaccacgttgtcggcctgattgagaacaagaaggcttctctcgtcctcattcccaacgacgtcgagcccattgagctcgttgtcttccttccttccctttgcaagaagatgggtatcccctacgccattgtcaagggcaaggcccgcctcggaacggtcgtccacaagaagaccgctgctgtcctcgccatcactgaggtccgctccgaggacaagaacgagctctccaagctcgtctccgctgtcaaggatggttacctcgagaagcacgaccaggcccgccgacaatggggtggtggtatcatgggtgccaaggctcagatgaagatcatcaagaagcagaaggctctcgaggctgctaccaagatctaagtctaatttgtttatacccctcacaatgcattgcgattatgggatcaaacggtgttgcacggttcagggcatggaaaatga

SEQ ID NO: 24072 - DNA, 556 bp, Sorghum bicolor
  Clone ID: 30164637
cgtttgacgcggtgggcgcgcccggggccccgcccacgcccattccgccgcttgacttcccctacatttgcaacatgactgtgaagacgccactgagaaggagaggaattggaaagcaacttcttaaggcatgcgaggatctggttttcaagatgaatgccagaagacgtgtgtatcttcattgtagaataatcgaccaagtcccattcaacatgtacaggaaagctggatatattattgtccagactgacagtattttggtctggctgagccttcaaaagcggaagtacttgatgagcaaggaattaccccaagcttctgttgttagtgagacttcaaccaaaaactttgatgataatattgacaagctgaatgtgctacgggactaacaggtacacataagaatggtttttgtgtataaaggggttctgtttacctcacatttccactattgtgtaacttgtgatgaaatcaactgccattcataattgttaattggccatcacaagatgttttaactgaaaatgagttggtagtggttttaacccatatggcc

SEQ ID NO: 24073 - DNA, 560 bp, Sorghum bicolor
  Clone ID: 30164654
atccaccattcgtgtcccggacttttgctcttcaacccacgagcaactactaaccccaacgattcaagatggtgagtgaataaaacaatcgactcgactctaatggccacagttttgtgagtcaaatgtgctttatgcgcagttgaagccgcagcgtcgtccatttcggtggacgacatgtgctgttggtattccgccagttttcgattactgtgaaacgtatcgagctggtgaagacttggctggagatgcggcgtgtgcagaaatgccacgaccaattctcgttagagttcagagaagaccttttgttggcttgaatgccttgctgatgtcttcttttctcaatgacagcctcccaagtccggcaagaaggtcgctgccgcccctttccctcagggtaaggctggcaagaaggccgccaagaacccccttctcgagaagcgaccccgcaacttcggcatcggccaggacatccagcccaagcgaaatgtctctcgcatggtcaagtggcccgagtatgtccgcctccagcgacagaagaagatccttcagatgcgtct

SEQ ID NO: 24074 - DNA, 581 bp, Sorghum bicolor
  Clone ID: 30164655
ctttttttttttttttttaagttggattgtattactataatgttatccgatctggtacatgttaactttgaaaaagaaaaatacaatgtcatagtattaagcactgcatgacatatccccttggatgctatacttttatgaaaggggtgatacataagttgtattggatgattcttgttcagaatttccgaagaatcacgtcgaccttctggagcgcagtcgtggcatcatagatgtcgatctttatcagttttttgttcccagcatcccaggaattaaaagccttttccatttcagcagctagggaccttttctatcacacgtcttctgttgtttgacaatgcctaggtaggaagtaaggaaggggattttcgttcatgcatctggcattaggagatcagagcttggtgcatcatcactaaatgagtaaatgatgaagcatttattaggttgttgtgatctatcaggtaacgtaaaactagtttgttgacctggcgtcagagcttgacagtgcatccatctgagttgtgcctttatgccttttccagttcatagaatcaataagttttggtttcattttt

SEQ ID NO: 24075 - DNA, 675 bp, Sorghum bicolor
  Clone ID: 30164676
ctttttagactgcgctgcttgaagtcatcaagatccaagcgctaaatccttgctctcatttgcggatatctgagtgccagctcatcatcatcatcttgcaagtcaaggtcaatactcacatatcacagaagatgcagacagccagcatcttacgtaagggagctatatctggagctgcccacgtctccaagcgcaatgtgactgcaaaggttggaggctttggagtgcagccaagtggaccagcagctgcagctaacaagcttgcagttaaccatgacccagatgaccttttcaagggtattccagtgaagagtggtatcattgacagacgcatgatgacaaagcaaatggaggtagacaaggagtttgcagcggcaatggcaacagcatctgatgacctgaagaaggaacagctgctgcgtcgtcaagcaagaaggccacctgctaacaaccaagagctggtcgagtactttttgaacacagtcacagaagatctcgagtacgaggttgccaggtaccgaccaagactgacaccagacttcttcgcgtatgttgataatgtgttgggtcaacttcgttttctgcctgatcctgatgaggagcagcaggaaacgcttgctgagctggacctcctgaggcagtacctcagtgaggcatctgaggctgtggacaagt

SEQ ID NO: 24076 - DNA, 491 bp, Sorghum bicolor
  Clone ID: 30164688
gacttgccaatagccctgagacattgacagcatctgacaaggagtgcaatgaaactggtgggtcaactgaggcaccaatggaaaattctgcgctgatagatgcccttggtggtcgtcagattggtaaactgtatgtctccaataaagaaattggtagagggagcaatggcacagttgtttttgaaggatcttatgatggtcgtcaagttgcagtgaaacgtctgctgcgttcccacaatgacatagctgaaaaggagactcagaatcttattatatctgatcgtgatcctaatattgttagactctacggttgtgaccatgacagcgattttgtttatatctcccttgagaggtgccactgcagcttggctgatctaatccaaaaacactcatatttgtcttctggagagtctatttctaacaacgaggtcagtatcagcatcaagtcaaagattccaaatgttaagggaatagatgtggaattatggacg

SEQ ID NO: 24077 - DNA, 497 bp, Sorghum bicolor
  Clone ID: 30164714
ttccttctccgctcttccatcccctccccactgctatctctcacagtgactcctccgcctcgttccgcgcccgcctgactcctccgcttcctccctcggcggcgtcgagggtgcgctcgcccgcgcggtggccgggcggatctcgccgggcggccgagctccccggctagaggtcgctcgctccttccccaattccggccggtgagcccccacttctttcctgtccttaagccgatggacgcctccgccgccggttcgcgcggcggcccagccctgcgcttcctctgtcctaagatatccctactctccccgccctcgcactccttgctgcgctggctcgtcggtgcgcctcgcgtcctccctcccttcaccgtcgctgctgtcttacgtcccactcacggcgaccacgccgcccctgatctccccagggaagcagatgaaatccgggggttgctgccgcggggtttcgacatcatcggggcactgctcgtgggggg

SEQ ID NO: 24078 - DNA, 497 bp, Sorghum bicolor
  Clone ID: 30164720
aaaactgcaaaacaacaaaaaaaatgtttccagtactagacaatgttcaaaaaatgcgtgatgccgttgcgctcattcacgcacatattaatgcacagccattttacgaaaagcaagacgagtcaaaacgctacactttttttaattataaatttcaaaattcctacgtgttccctgggttagattcaacagaagatgataaaattaaagaggcgttaaaaataacaagagaatgtcgtggtatttgtttttctcttcaaagtggtgcttgtgtctctcgtggctttcacaagtttttcaatgtgaatgaaaaaccagagaccatggacaacaatattgatttaaatcaagaccatgtaattttagacaaggtagatggtagtatgattgtagccatgtttgtctctgatgattcacttgttgctcaacaaaatcctattggtaccattcgttttcgttcaaaaatgggttggaacactgatgtttcaaagcattgt

SEQ ID NO: 24079 - DNA, 577 bp, Sorghum bicolor
  Clone ID: 30164722
tgcttataaactgtttacaggctcttcgtctgttatcctttctcggaaattcattgaatattgtattgttggtatggataatctgccaagaactctcctgatgtactacactaacatgcccttgccacacaggaagtattttcagacagttctttgcaactcccctgaattcaacgagactgcagttaaccatgacctgcactattcaacatgggatgctcgttccaaaaacgagccacgcctgctgactatagatgacctagaaaatatgaccgatagtggtgcagcctttgggactagatttccgaaagatgatcatgtgcttgatcacattgatgccgaaattttacaccgccttcctggagatccagttacaggaggatggtgcataggtgttgggcatgacagtccatgcgacatttcaggtaacccagatgttcttagacctgggcctaaagctgtaaaacttgctaagttccttgctgaaaggctgtcatatcagaacttttatggccatcaatgtatatgggattgatgctcatataatttcaatatcagggaacccaatctttcaggt

SEQ ID NO: 24080 - DNA, 639 bp, Sorghum bicolor
  Clone ID: 30164738
cgacaacttgagaagcatcatgaactctgaattcaagagaatgacttacgatgatgccatcaaggtctgcattgaacacgacacagctggtaaagtcaactttatcaacaagttggaatggggtgttgatatgagcagcgaacacgaaagatatttggtcgaaaaagtctacaagcaacccgttattgtttacaaccatcccaagtccttcaaggccttttacatgagattgaacgacgatcaaaagaccgtcgcttccatggatgtcctcgtccccggtgtcggtgaattgatcggtggatctcaaagagaagaaagattggacatcctcgatgctagactcgaagaaatgaagctcgacaaggaagtctactggtggtacagagatctcagaaagttcggaactgtcccccatgctggtttcggtcttggtttcgaaagactcgtcatgttcattactggtattgataacattagagatactattcccttccccagatggcctggtcatgccgaattctagttatatttatctatacagttgcattctgttcatgatataataaatttatgcccctgattgtaatacattataataaatcctctcatgttgaataaaatatcatgaaacaaaatctc

SEQ ID NO: 24081 - DNA, 541 bp, Sorghum bicolor
  Clone ID: 30164739
cctttaaagagacttaaatgttcagagctgatggattctgagtttgacaaaatgtgaatgtgaatttcctatctcgaacaagcactaggggttacttgaatattggtactcaccagtcttgatacggagaagagtactgctgaggaatattaaacatagctgcatatattgaagcattatctccttcctatcggtgtaaaaaacaaaggtcatcaagactggtacaagaaatttttagacccaacaccacccctgcacttgcctttggaccaagggtcgggcccttcatgcaccgtcaccagaagctcgcttcctaagtagtggagcaggtgaacggggcaaggtggatggccaggataatttcacaaggcgagaaatccacgatccacatgtgcaaggggtgggcggaggaggttcccctttctccctcagaactggaataggaatggccctgtaagaagttgattgttggattaacagtgttcattctcctgaccttgatgaagtgtgatattggtacgcaaagtacagttacgcagtc

SEQ ID NO: 24082 - DNA, 497 bp, Sorghum bicolor
  Clone ID: 30164747
gtgcccgtcggcggcggccgcaagaacaggcgcggcgccaagggcggcagtgcgaaggcgtccgcctcggcggccgcggctgcgacgaacgtcctcggtgttggcggcgccgacacgttcccggacttcctgcggcagcagctgttgcagttccagccaggcgcggccgtgggcgggggtggctacgccatcgacctgggcgcgtggcagcaaatgtccgcggccacggcgccgccgccgccgccggggaccggcggcgatgtcagcactcttggagcagcggggacggcggcagccgaggcggaggccaactgcgccgccttgcagtactggagcgaatggcagcaagatggcatgcccggccttgatggggcttgctaagtgcgtactgctatactatagactactagtagagcttgtattagtacatgttcttgcctacttacatatgcttatatgtctgcgtgtattgcaaaacgtacgtatactagtacacg

SEQ ID NO: 24083 - DNA, 558 bp, Sorghum bicolor
  Clone ID: 30164751
acggctacgactccggagcgagcgtcccaacagtatagcctcagagacgagatccccaccaagattgtcgaggatgacgaagaggacttcgaggagaatcgaagcgacaacggaggggtcgcacatgagacaagcgtcgtttctaagcatcagctccagcaccaacagtccttgatgcacaggccatcaggcgccaggatcagcgctcttggtggcactcgttgagtgaggtgttttaaatacctaaacagcttaactaacgtctgagcatgagccttgctttttttgtcaacttctcacttcttccttatttcgatttaattgtcttgtatttggcggctggtttggatcaaaacctgcgggttcggcgtttgatgtcccttatatcttttttgtcattaccatttttctgcctcatctgatgagcagcttagctcatatacctatgttaagcctgacgggcaccttctcattatgttagagtattcttctatgcagcggtgtttgtatagtcttcctcctttacctggttgaaggggggtacaagaatggaacaca

SEQ ID NO: 24084 - DNA, 550 bp, Sorghum bicolor
  Clone ID: 30164756
cagatcgttgaggtaatacagcatacgtttcagcgcttgattgcgcctgtctgttttacccttaaaattggtattctcgattgattgaagtggggtttgtagtatgaactacgaggaggaatttgcaggccatggtggcgcggttgaatattccaaaatttacgtttttgtgattgaggaaatgagagccttattactcagaattttgatgaattaatctgaacagtttagtgttgagtccgtttcacaaatcaactccggtaaggccctgttcgtttggtctggattagaccctggaactgtgtcagttcatcgtgaatcaatccagccaggaatgattccaggcacccagcttcctgcttcagctattagctctgttataagtcaaatttcagacctcgacgctaaagaagacgacaatttgcgacgttggcgatggccccttttcaggatcagcacctcttcaggaatcaggatccttcacccttgttaagagtgaatgtaaatgaacagtgaacaacttatgtctttcattgatctcatagaatat

SEQ ID NO: 24085 - DNA, 550 bp, Sorghum bicolor
  Clone ID: 30164760
gagaggccaagaatggaggtaccgtctttgactggcttctggctttgtccggtcttgctttcctcttcgtttggggtactatctgcctcgctcacgcccgtatgcgatctggtttcaaggcccagggcatcaatctggaccttgtcccttacaagactcccttcggtgtctggggcagctacctcggcgctttcctcaacgtcattgctctcattgccactttctactcttgcctctatgctgccgacggctctcctcccgatgctgagtctttcttcatgggcttcctcgccgctcccatcattctcgtcctgtacctcggctacaagatctactctcgcgactggaagctgtatgtcagggccattgatatggatctccagactggcatcgtcctccttgatgagcccgagcccgagaccccctggtcatggaagaccgcgcccagacgccttctctcggctattatctaaatatcttggcagaaattgtcctttaaatagtttgctccggggcacagtagtttaaatctcaattcaatatacctccg

SEQ ID NO: 24086 - DNA, 514 bp, Sorghum bicolor
  Clone ID: 30164762
atggaaattgaaggccccgttcaataaacaagttgattgtacttctgcagcagccactagcacatattgatccaactcaacgtgctttcatcagtgccttgtaccatcctaccaccaaaatcaaagcttcagatgatctaggcttttgacttttgtgatctttgtgtcttcgacttcaaatggcttcaaatgccttgttttgccctaggcattttaatttcataatgcaagttcacaatagacaggttcaccaccagttggaaactctgctgcgtctttcggattcctttttgttgtcattattgtagctcgtgttcattgaaaatatcaagagagcggattatccggtactggctgcttactacttgttgtggttggtttatgtgtatgttatcttagggcttgagaaaacgcagcctgatattgtacctgttcagtgtgttcatgtattgctacttaccagtttgtacatgcacttgtatttaagcccaaaaattgttcatggttttgatgt

SEQ ID NO: 24087 - DNA, 470 bp, Sorghum bicolor
  Clone ID: 30164765
aacaagggttacttcatcaagcccactatcttctccaacgttggtcccgacatgaagattatgcaggaggagatctttggccctgtctgcgccatttccaagttcaaggacgaggaggaggtcatcgatcttgcccacgataccgcctacggtctcgctgccgccgtccacaccaagaacctcaacacagccctccgagtttccaacgcattgaaggccggcactgtctgggtgaactgctacaacatgctccaccaccaattgccatttggcggctacaaggagtctggaattggccgggaattgggcgaggctgcgttggcgaactacacacagaacaagtctgtagctattaagctgtactaagcaaagcggaatgggcatttacggaggatataagggcggcgttgtaactgcgtgatcaatttgtacatgattccatatttagttttacggctttgacgaagaaa

SEQ ID NO: 24088 - DNA, 553 bp, Sorghum bicolor
  Clone ID: 30164772
tacatcatcctcaaggaccccttcagcgcccgcaacgtggtgggcatcctcatcgccgtcttcggcatgggcctctactcctactactccgtcgtcgaaagcaggaagaagaccgaggccgccacctcgctgccggtcgccgcgcagatgagcgagaaggactcgtctccactcctcggcgccaagagctcgccacggacagagaacaagagcgaggagaccttcgactacatgccgaggacggcgaagagcgcattcaccggccggtgagcctgatgtagcttgtaccaagtacgtacttaccttttcaagagtggtggtaggcgacgaacaacacggcaaaacgggaatgtgcttgtgaaagatgtaacggaggcaagtgaaattccaattatcattttgcgatttctcctctcgggtggtgatgggttgctagagcctactaggtgacagaatgtgttgtttctcgagcttgaaatagcagattggattggtggtagtacaagacgcgtcctgtaaggtttgcgccaattttaaaggaagttgcaaggtt

SEQ ID NO: 24089 - DNA, 211 bp, Sorghum bicolor
  Clone ID: 30164774
ttgcccgtgactttattggcgcttaatcaccaagcgcacacactagtgatcaatgctcttttgattggtcactgccgctgtttgcccccgtgacagctaattagtttgcaatttattttaagcaccctctcacttacacaaaaacacatgtaaatatttgcgttagagtgaacgatgttcactgatgttaataaagcgtgcttgcgaaatt

SEQ ID NO: 24090 - DNA, 635 bp, Sorghum bicolor
  Clone ID: 30164783
ataaaaattctggaattttgaaaataacagaaaaaagctcaacttacgcaagacatgaggtcaaccatgttcatagaaattacaatggagatgctcaattgagaatcaacaataacggaacaattgatattatcggatcaaataatcaactactctggcgtccctatgagcctcacccagtttccgatactttgaatgttggaaatcgattgttgctgagcgatgtccttgtctccaaaaatggaatttattccttgatccttcgtgaagactgcgaccctgtcctttacaagcactcaatgccaatctggacatctggagctatctcttcagctaccaaaggacagtgcgaggctcgtctcactcagcaaggatcccttgttattaacagcttgaatcaaagctttactgttgttcctcaacacccttcctatcaaggaaaaacctccttgttggtcacggatgatggagcactcgttattaaaggagaggatcaagaactatggaatagtggaaaggaaatggaacttattagagaggctctatattaaataacttttaagcaaccaatacttctattaaattttatatgattaaataaaacataaaaagtacttttacttactacctaaagc

SEQ ID NO: 24091 - DNA, 552 bp, Sorghum bicolor
  Clone ID: 30164792
tttgctttgggctcatcccgcagcatccaatcatattttgacatggctacaacttctcatttttctcaggcgacgccatccatgtactcgtccgatgtgtacatgcagaattccaaatttccagttgcagcaggcatccgtaactttgcttgacattcaacttgctgtacatttgcacatggtgcctgtgttgctgcgcccggtacatgtgttcttggaactcctgcaagaaaggtgaacatgcgctccgatggatgacgtgatcatgatgattggaagatacggaaagcatttgaaatttctgcaagcgaaggaacaccacctcgtgcgcgatgtggttcgcgatgttgttgcctgttatcatgattgtttcggaatggttgctggtacgatggctcactgatcgctgaaagttttgacagggtcatggcaatgcatattcttcagttggtgcgcgctgacatgggtgctgggtgaacacaaggaaactgttcaagaccttcagtgttgcatgcattcgagatacctggtatacatgtcgaagtccgccgg

SEQ ID NO: 24092 - DNA, 520 bp, Sorghum bicolor
  Clone ID: 30164799
accgcacctgctcggcacggccccgctatataacaacttgccgctcttccgccgccacgtgctcgctgcccgccgccgcgccgcattcgcattcgcatcgccgcaccgcgctgccgaggctggctttgcttacttactagacggacgaggagtggattggagtaactagcagcaaccctagcccggcaggccccgtcgcgaaaccctaggcttcgccggcggcggtcgccggagatggcctcctcgccgccgcgcgccccgcggcggtttcttttcgacctcaacgtcgcgcaggaggaggtcgaggaggaggagcccatggagacggaggtgcttgaggaggagggagcccctgccccggtggcgcagcccgaggaggctgtcggcgaggaggtcgctgagcaggtggtcgagcacgcggtgcctaccgtggaggaggaggagcctgtggaggaggtgatcatggaggaggagccttcggaggaggtgatcatggaggaggatgaatctgctacggcgc

SEQ ID NO: 24093 - DNA, 587 bp, Sorghum bicolor
  Clone ID: 30164800
atcgagtcgctaattaattatattctttaaatgcagtccctactagcattttgctcaatatgtctccaactctctaatcttggagtccagaaatctgaactcctgatcaaaagagatgaagcttgtaccctctgcttaacagaactgctccaaccgtctaataataatattatcaacggaaacggtaagccttatcgtgagattttaaatgacggtctctacttcaacaaccccctcttgcaagaggccctcaagttaaaactggagcaacaactccttgttgagccagaggaagccaaaagagaggttgccaaaaaagaagaagacattcctgaccccttttcaagaatgttgactcaagggcagattgaagagctgttcgaaaacttggttcaaacagtccaaaaaatatcctcagctgaaatgaatctcaaagaagaatggacaaaacaaaagaatctcgcttatcaagccattaataaaaaggtccaactcttgcatgttatgtacaagaaggccagtttggatcttcctaataaaccctcactgccagaccgcctcaaaaataggagctcagatcttgaaga

SEQ ID NO: 24094 - DNA, 351 bp, Sorghum bicolor
  Clone ID: 30164804
aaaaaagcgacaaggccgcggcaaagatgatgatgcagcggggcgcggcggccgccgggacgacctctgtctccggagcctcctcttggactcgggccgccacgcgcggcctcgcctcgcgccacgtcggcgtcgcctcctcgtcctcctccttcttcgggccccgcggcgccaccgccgcggcccagcggttgccgctcctccgcgtccgcggcggcgacggccggctcaggcctctgtcgctgctgtccgatagcggcggcaagaatggggaggtcgccaaggcggtggctgcggcggcggcggcatcggtgccggcggacgatgctagtgccgccgcggggacgggag

SEQ ID NO: 24095 - DNA, 509 bp, Sorghum bicolor
  Clone ID: 30164810
aagctcttctcttgtctgtaacgcagtcatgggactgtcagaagtttcccttcagcacactagacatgtgctcatgcctgtccagcaatctcatccatgaggttttctgcttcaaacaacgaaaaaatgcagagcaggtgcagtgccttgacaccaaaatcatcaaaccgtgcaagctctgggttgcaaggactggttctgcacgctccacgcgacaggttgtgcaaagtaacttgtggtgctcagcataaagatgatcatgtagaactagccgtgagcaggcgaggtctgctacaagcagcctcgttactttcatctggtcaattggtccttgatcgagtgcaacctgctcaagctgcaactatcaagcctgaagttttggatgcatttagacaagccctatctgttcgaggagaatttcaggaaaaggatgatgcttggactaaagtgatcaaactggcaccggagagttctgcagcatggagcaaccgtggaaccttgcggcttca

SEQ ID NO: 24096 - DNA, 528 bp, Sorghum bicolor
  Clone ID: 30164811
agctcagaatttcccctctccccccatgcaatgcaatccgccgcggcggccgcgccctccgccctgccgcacagcgtcttccccaaggactcccgcccgctcccgtgcctcctcctcacttccctgctgctgctgctgaccctccacctcctctcctcctcctcccccgccccctcgccgcctccaccacaacagccccgcctcgcgccgctcccgtccgcagcctccgcggggccggccccgccctcgctcgcgttcctcctcacgggatccgcgggcgacgccgaccgcctccagcggctgctcctcgctaccttccacccccgcaacgtctacctcctcctgctcgaccgcgccgcctccgcggacgaccgcgcacggctcgctcgcagtgcgcggtctgctcccggacgcgacaacgtccatgtcgtcggggaccccgggttcgccaacccgcgcggggcctccgccctcgccgccactttgcacggcgccgcgctgctgctgagggtcgaccagggctgggac

SEQ ID NO: 24097 - DNA, 562 bp, Sorghum bicolor
  Clone ID: 30164821
gtcccaaccacagccagcgagagagagggaggcgggcgggcatctcgcgagatggcggcgggggcggcggcggaggtggacgacccgtcgctggcggcgacgctggagaagttccgcctctacgagacgcgcgcgaggttctacgtgatcgggagctcgcgggagaagcgctggttccgggtgctcaagatcgaccgctccgagccttccgagctcaacgtcagcgaggaccccgtctggtactcgcttcaggaggtcaagagcctcctccagcggatcgacgagggcaaccggtccaccggtggactcaccttcgtcaccaaggcctacggcatcgcaggttgcatcaagttcctggagtcatattacctgattttagtcaccaagcgccgccaaatcggttgcatttgtgggcatgctatatattgtatagatgagagccaaatgatcaccatcccacactcgtcagtgcaaacagatgtcgcgacctctaagaatgagctgaggtacaagaagcttttggctagtgttgatctcaccaaggatttcttctatagctaca

SEQ ID NO: 24098 - DNA, 636 bp, Sorghum bicolor
  Clone ID: 30164829
attttaaaaataaaatattgatacaaaatggttgatactaaacccgattacaaatctcctcacgtcgaagaaagattttatgccaaggctgtccccaagcacggtattggtgaaatcctcagaattgaacacatcgtcaagaacgctgaaaaatactacgaccaagtcggagtcgttgccggatgggccagaactcttagaaatgctggaggtaacaccatcatcttcattgaacttaacgacggttctgctctcgattctctccaagttgtcgtcaaccaagccatgcccaacttcgaagaagtcagcaagaacaccgctggtgcctctttcagaatcaagggaagattcatcaagagtcccgctcaaggtcaagccatcgaagtccaagtcgatgatgctgaaaaccactacgtcaaggttgtcggacccgtccttgaatccgagacctaccctatggccaagaagggtcacactttggaatatttgagagaaatcgctcacttgagacccagatccaagtacgtctctgccatgatcagaatcagaaactctcttgcccaagctactcacatctttttccaaagcaatggctttttgaatatccacactcctattgtcaccgcctctgattgt

SEQ ID NO: 24099 - DNA, 545 bp, Sorghum bicolor
  Clone ID: 30164830
atgccctctctgtttccctctccctcgtgtggatgttgttttctgtcaaaaaagaaaaaaaaagttttgcgtcgccggtcgccgccgccaccactggacgccgcctacgcggacgccggatggaaggtagcgaaggccaccgagacgcgtcgtcgtcacggctgcggccacgtgcgctcgctgccacccgctcgcccactctggttctctgtctcatcgccctcgctcgccgcttcaacgccgcaaacgccgcaggccatgaccacgccgtgaccactagcaatcctcagcgtgttgtgcattggctacgcagacgccaaggctatcgaggcacaggaacgtcggaacagactcggagtcgggcggagcggcgcagaccgacgcgattttgtctgaacaggtcttaattggaattggattgaaaaaaaaattaaatcaaatgcaaggagaattttctgatttcactggacaaagtacaaacctatatccttgaatctcgaattcaaatccaagttcgacacgaatttcatctgcttttttggctt

SEQ ID NO: 24100 - DNA, 411 bp, Sorghum bicolor
  Clone ID: 30164831
caaaactagtgagtgtgaaagaaatggcgagcgtagcctcctcgaggtgttccggccttctcctcccgccgagcttcgccggagtccgatgctcctcccgtccgtcctcttcgctccgcctgcggccgcggtggggcctgcgccggccgaggaccctcgcctgcgtcgcgccgccggattccgcggagccacagacggatgaacaggctgtgaaagctgagtctgtcaaagaagaggctccgactagtgcacccgaggatcctgggcttccagctctcccaaataaggatctcaacagaagggtagcactactgtcaactcttggggcagtggctctctttgcgatcccagaggctcaatcttagcgaggcctctcttaaagatctcgctgccaatgccatgccatatgaa

SEQ ID NO: 24101 - DNA, 568 bp, Sorghum bicolor
  Clone ID: 30164838
atggctcgtggccttcgtgtttcacttcagcttcgttcctagagctagctagctataccttctccttcgatcgtcatcagggtatagttacaccaattccatagcacagtcgcgccagctcctgagatcgagaactagctaggatatattacattacttcgagaaactgttaattaatcttgcatgcagagctgtgtgttttggaggcagtactgcctatatagctagaggagctcgacctggaggagtcgtgggcgggggcgcatcaccggtccggcaccgacatgcgcagagcgtcaccgtggcactcccaccgcagcaagcagcgcgcaccgttcgacgacgccgccctctccgccgccaacaagctgccctggccgtcgccgcgacgccccgccagccatgccgtcctcctttctgacctctccttcctcttccgcttcgtcgcacctctcttacctgatccctgctagtgctaggccgccgcctccccttgccatgggacagggatacggtggtgccaccggtggtatcagtgttgtaccaacaggtggcgtcgtggcgacga

SEQ ID NO: 24102 - DNA, 581 bp, Sorghum bicolor
  Clone ID: 30164843
aaaaaaaaaagcccggttgactcgagcattgaatgaagccttgagtgcggtccggagcctcaagtaattcgggcactccaagacaagttccaggactgaccaaacctgctagtcagtataactcaggaataaagacagcataatttgagagcataacgactattctcaaaaaagccattccgacgacaactactatatcgatacccgaattttacgaaggaaacgagaggcctttcaggctcaacactatctatcaacaatgcctccctccttgaacacccatccctcctttacccgtcctcggactagcgaccgcgatggcaggcccagcacccgcgaccagggcgctgatcagaacctcctgatccccagccgaacttcttcgcttcactcgcgcatcacccagcccatcccttcaaccctcaacatgaagcctcagcagcgaactccaaagactttgacacatgcctacatggtttgtggtgttggacgtgagccctctcaatgggtcaaggctccggcgcccgcccaaggcaagattggccacatgaaaggtgctgttgggcagttctggctccctg

SEQ ID NO: 24103 - DNA, 551 bp, Sorghum bicolor
  Clone ID: 30164850
atctgtctacagtctactgtaggagtcaaaaccatcgcgtcactcgtcgtccccagtcccctctccgtggccgtggctccgctcccagccggccaccgccacgccatgctccctctcctcctcgtcctcctcaccggagctacccctgcggtgtcagcttccggggacggttgccgtgcgggctgcccgctggccctcgccgcctactacttctccgcggagtccaacctcaccttcatcgcctccctcttcggcatcgccgactacaccaagctgctcccctacaaccccgacatcgcggacccgaactacatcgtcaccgggtaccgcgtcatcgtcccgtttccttgctcctgcctcgggctccccgccgacccagcctccaccttcctcgctgggtcgctctcctacacggtctccggcggcggcgagacgtacggcgacgttgcatcgcaattcgccaacctcaccaccgcctcgtggctggcggccaccaacgcgtacccggcgggtaagctgcccgccgctgggaagatcgatgtcaacgtgaa

SEQ ID NO: 24104 - DNA, 584 bp, Sorghum bicolor
  Clone ID: 30164853
agacagacatttctaataaccctttttcttcctcactgtttttttactgtgctacagtagaaacattgcccagcatgtcgtcaccaccgcacaaggatgaggtgaattatgagaccaaggacgagactacggtcacggtgcctcacgatgaggagcagggcacgacttcgggcgagggccagctcaagcgtgatctccgcggtcgacacacgcagatgattgccattggaggtgccatcggtgctggtcttttcgtcggttctggtagcgctcttcacaagggaggtcccgcgtcgctggtaattggctatctcatcatcggtgtcatgttgctctgcaccaacctcgcactcgcagagatggctgttctgtaccccgtcaacggtgccttttacacctacattgtccgcttcgtcgatccctcttggggttttgcttgtggttgggaatacgctctgtcctggcttacagttcttccctttgagttgatcgctgcatccaagaccatcgagttctggcgcactgatattcacatggctgtttgggtcactgtcttccttgtcgctctcaccatcgttcagatc

SEQ ID NO: 24105 - DNA, 474 bp, Sorghum bicolor
  Clone ID: 30164855
ctgtctatggacaaggtccagttcctcaatgttcttctaagcatgaagactctgatgctgcaagcaagttgagcactgatggtccacaaaatccaacgcaagaaatcaagcaggacctttcaaattcagtggaaagtcagcttgttctgtatgctggtggcaatcagcagctgactcgtcgtactcatagcatatcttctcctgaagctgatcggcggatccttaatgcatttgaaagatctttgaaagaacaaactcggtcaaatgagctcaaggaatttgagataagccttagcatgagaaagttgcaacttaaacagtctcaactagaacttaactcctactcgcacatgttagacaagattaagttatccttgggatttcagaaagcttccttccaaacggagaaattcaagactcagatgcaggacacgaggcatgcacaaataatgaggacactcatagatttccttg

SEQ ID NO: 24106 - DNA, 407 bp, Sorghum bicolor
  Clone ID: 30164856
tcgctcaatagccaacagcacaaacgagcatctcctttctccgagctagtgaggtgactgaggtctggtctgtctgattgttgattactcggtgatcgagtgaacgaagtacgtaggtcgtagatcgtacgtgtcttccatggcgccggtgtatgctggggagctcgccggcaccaacggctccggctccggcctgacgctgaacccggtggcgcggcgggcgctcagccgcggcgcgtctacgtcgacgctgggcacgcccaagtcgcctccgccggcctacgggagcatcgtcaccgtgctgagcatcgacggcggtggcgtgcgcgggatcatcccgggcaccatcctcggcttcctcgaggaaaagctgcaggagctcgacgggccggacgcgaggatggcgg

SEQ ID NO: 24107 - DNA, 467 bp, Sorghum bicolor
  Clone ID: 30164859
atctcatcatctcctcttcactcttctcttctatcgacatcctcatttgatacccaataccctccctctcctctacaacatctcatatatatcacacactatggctcccctcactgttgagctgtccaccccggtcactggtacctaccagcagcccatcggcctcttcatcgacggcaagtggaccgagggtgtcgacaagcagaagttcgaggtcatcaacccctccaccgaggaggtcatcacctccgtctgcgaaggaactgagaaggatatcgacttggctgttactgctgcccgcaaggctttcgacggcgaatggaagaacacctcacctcaagctcgaggcaactaccttctcaagcttgccgatcttgctgagaagaacctcgatctccttgctgctgtcgagtctcttgacaacggagagtctatcaccaacgcccgtggcgatgtcggcgccgttg

SEQ ID NO: 24108 - DNA, 113 bp, Sorghum bicolor
  Clone ID: 30164872
tagaagtcaagcaccaagtgtagaacataggtcaaacatgtacgtattacaaaataaaccaagtatatacacattattcgccataccatcggagtatgtagtgcattgtaacc

SEQ ID NO: 24109 - DNA, 664 bp, Sorghum bicolor
  Clone ID: 30164874
aacccagggtaacgaatctgatgatgaaggccgccgcaggaggtacgacgacagtgaggacgagacttcacgtgccagactggtcgattcggagcacgagaccgacagtgagtccgatgacgatgacgataagcctgtcacgcggcccactcattccacgcaatccaagggcagagactctggagagtatgacccagagcgcgatggtgacgatcgaacaatcataggaagtagtgcgagcgcccgtggtcctcaggacaaggttcctcaagagctataccccaaggagtagaagagtttactcgagctttggacagggctctgttttgtttcgagttttatcggggtttttggtcgtatgggtctttcacaaacaatctgcactggtttcgagtcgtggcgtcttatcaaatggatggagataaattatattgcaaatactggcggttctttgtcggctttcaggggtagtcaggctcatagcgtaaataggagccggggcgttttcagatgggattacaattcgggattagaagcgacatcaaatcaaactttgcaaagcctcagcggcggtgatgattttcgtttagcaaactcgtcatttaaatgaatggctaagtcttgactataacgccaagcttgcctgaatagagtttcatcacgt

SEQ ID NO: 24110 - DNA, 553 bp, Sorghum bicolor
  Clone ID: 30164887
tggagagggctgagagggcaaatgaggggaagcttggttttgagcaggagctgagaagatggagagctgaacatgtgcagcgccggaaagcccatgaggctgctgcacaacatggggttagtcctgtgagaactccaccgagaatgtttgtccagcagaagggtttttatcaggaagaaaatgaacttttaacagatccgaagttgcagaactcaactggtagtaaggatcaatttgtttcggacgagaaaatgcgaaaaaagaagttgtttttgccccagatgtccacacttttgtttagaaaggcccagacccaaacataagagtgattgttttaaaacaaaagtttttgtatttttgtaaaatgtacatgaactgatggacacatggtgtaaatttagtttttgtccatacacttgtaaattgtttcacacctgtacactatgagggtatgtctttgtatgatgtttttggagtggatgtcgttacccaaggccttgtttacttgcaaaatattttgcaaaatgtgaataataccaatttcgtttgtttt

SEQ ID NO: 24111 - DNA, 621 bp, Sorghum bicolor
  unsure (1)..(621): unsure at all n locations
  Clone ID: 30164903
cagcaagaacgtgatgagacctataataaggctgtgactgctgagaatctcacaaagatggaagagctgcactgtttgataaaggagaccttgagaatgtatcacccagcacctataacttntgatagagaagcattggaggatcataaattgggcgatttggaggtgcctaaaggaacttgggtgaagcaggatttctttgctgtgtctcataatgagaaatattgggacgagccattcaagtttaagcctgaaagatttaaagctgatgcgaaaaagattgatccttatgcttatgtgccgtttggtggtggaccaagaaactgtattggacaacatttgtcaattattgaagcaaaagttattatctcagagttcctggagagattccattgtaagcttattgaaggatatgagctgaaaatggcgttcaagttcttgtatgaacctctcaatgaactcacatttgagatctcccctaaacatcaacagactgttttagcttaaatatcgtgagttatatgagatatattttagtaaatttttctattttctattttcatcctctacattattttatagaatccataaaatattattctcgtttattatagtcatttc

SEQ ID NO: 24112 - DNA, 392 bp, Sorghum bicolor
  Clone ID: 30164925
ggagactggcaagctggagcgcttggtgatgaaagatggcaaggagcatggaaaccctatttatgcctaccccttggcctggccccctgagttcctcactccaagaaactgactttttggttgttgaccagtgaacagtgacgcaaatcagctcccctctttggtttctggattactagtgccgtgccattttcactaaaactctttgttccgtactgtatgaattaatgcagacaaagctgttgttgaacttgtctttttcgcattttcggactaagatggcattttgaagacactagtagggtgtaccccgttatgctggttccaggcaaaacatatatgccttcttgtcatgagatatttgcctcattagattaatatgtcatttgggg

SEQ ID NO: 24113 - DNA, 469 bp, Sorghum bicolor
  Clone ID: 30164947
tctcggctctcgatcgatcaacatttcaaaagaagaaaaagtctggtaggctgtggagtctcgcggccgctcagccgagagtgacctgcagctctttgtctttcgctgcgtgttctgttctctctcccgttctcccctcaactagcagctgcctcggactctcgtgactcgtctcatcaatcatggcgccccaaagcagctgccgaggcggcgaggaccaaaccctagcgtcctccgctgccgctttccctcgccccccggcgttggcgcctgcgccggtggtgaagacgacgacgacgacggtcgccgacctcacggacgtcatcctccaggccatcctcctccgcctcacccccgccgacctcctccgcgcggcgctcgcctgccaccgctggcgccgcgcagccacccgcgtcctcccacgcgtgccgccgctcctcggctacttcttccaccccaggaaccccgc

SEQ ID NO: 24114 - DNA, 581 bp, Sorghum bicolor
  Clone ID: 30164966
ctccattcgtcatcttctttttggtctttcttttttgctcttcaccgttataccaagataaatacaagtttcatctcttaacaagttttgtaagagttttgctctcaacgactcccattcgtctccttctttgcccccgttggaccctcttggttgtcctgaaacatcaccacttctctctcctctctattgagacgttggacattataatcagtcaaaacgtccacgtatgtacacatgcagcctccgtcgaacctcgaagatataccagtcgccgtcgatgatgcttcttccttgattctcgcccattcttcaacagttctagagatggccacctcagtaatcgcctcggccgcctccatggcttcttccacagccgcatccgcaaccttcatcgcgtccggaccaccacagtcatccgacgaagacgattccaacggggagtgctcgttgctgggctccttcgcgctgcttgtgcaaggcgcacttggtgctctggctctactctccctcgtctacaagcggtggcgggaacggcctcaacgacctctcaagatttggttcttcgacgtatcaaaaca

SEQ ID NO: 24115 - DNA, 682 bp, Sorghum bicolor
  unsure (1)..(682): unsure at all n locations
  Clone ID: 30164999
ttctagacttctaataacctctttttacacaccccttatgctacctttctttactctcttcaaatttttcggcctcactctccttacagtccttgcttatttcttcctctccttcgtcctccttccagtcctccgcatcaactcctacaaacgcaagggcttcagcactttcttcttcccaattctgggctatctccgctactgggacctcggcctaaaatcaaatgaggacgcctttatgaacttcaagacctccagtcaagatttccccaataagaaagtcttgatcactaatctgggcaataagactctgtttcttctaagagatccaactcttatcaaggacttcttgcacagccagcacaagtaccataaagttggcagtgtaaataacatgaagccactgctgggaaatgggcttgcgactgctgaaggatctttctggagaaaccatcgaagaattatttcgaattctttccattatgaacttttgaaatctcatgttcctattattcaggaaacaacaaaggaattcttggataagatcaagcctgaagagtacgggaactttaagattatcgatnaagtccaagagatcactggagaagtcgtcggaagagtcttttttggaaataacctgagtcattatcagcttgacggtatgccattgaccttatatctt

SEQ ID NO: 24116 - DNA, 565 bp, Sorghum bicolor
  Clone ID: 30165009
cgcaccccacacccacaccgtcggccgctcgagaggagagcagcagcacgggcagcaccaccacgcaccggcctgcccacgcgctcgctttgaccggcggcgccgtcgtcgatcgggacgaacgcacgctcgctcgctaggccgtgtgcgcgtccgcgcatgcgagtggccggccgggcgacgatggatcctgcagtggcggcagcggcggcgcacggcggcgggcaccacttcgcgcagcccgtggcgccgttccaccacccgttcggcggcttaggcggacaccaccaccacctgttcccggggcagcagcacccggcgttccagcatttccaggagcagcagcgccagctggagctgctgggcgccgggggcggtgtccccggcggcgtcaacaagcaggagctcggtgtcggtggggacgacagcaacaacaccatcaacagcgccgggagcaacgggagcggcgacggcgcggtcgcgggcgcggaccagcatgcggggggcggcgacggcgaccagcagcagcagcagcacgcgttggtgatgcgccgcccgcgtggcc

SEQ ID NO: 24117 - DNA, 410 bp, Sorghum bicolor
  Clone ID: 30165010
gatgcgtttcctacatggcgctgacgaggctgctcatgatggcctcgcgcccgccgtgctcactcccgtcgccgtcgtataagacatcgcgctgctgctgctgtcaccgcgctcgccgactcctccgcagcgcaatgcgggtaggagcctgcaaggacctcagcaccgtcacgcccacgccgcggcagcagagtatggcggcgcagctcgagcgcgggtccctactggttggcgggcgcgagctcctcgtccgcgccccgcctaacgtcaccctacggcctgccggtgaggccgccgccgccgacgactcgggcgccgcgttcctcggagctacggcggcggcggcgtccagccgccacgtgttctccgtcggaaacctggcaagtgggtggaggtggatgtcactgttc

SEQ ID NO: 24118 - DNA, 491 bp, Sorghum bicolor
  Clone ID: 30165012
ggtctgatcctattgtggcttcacctggtttcaaggcaggaggatctgctagtgcaagcacacgaagaagtacttcagatgcttcttttagcactcagttagctgcctcacgacctactgccagacatgcccggacccctctaaaagtgacttcatctggttggaagcctcttactcaacctgttgcaatgaatgaagagaggaaatgtgcaagccttacaatcaaccctactgctaagcgttcaagagttgcttcttcccgagctgtcaaagattcaatcaaccatttagcttcaaaagctaactcaaacattcccagtggcaagaagtacagagatgaagaaattgtgagcctgggtgatcagtcagatggagctgtcttgccatctcccacaaagaagctacaaatatgcaaaggcctttcagatgcaccttcaataaggaaatcaactatcagaatcctgggtgttaagggagctgctctaccaccc

SEQ ID NO: 24119 - DNA, 501 bp, Sorghum bicolor
  Clone ID: 30165027
gattacttatgttaattaaatgctatgcttccgatagtttctttcgtatgtcgcatacaaggcttttgctctttgcatggttgcatgtttcagtatgaaatttgtttattaaatgcttggacagagaggtctggttattgcttgcttattaaatttgtttattaaattttgaggcatgaaatacaattcatctatgtgttacgatgttattgcttgcttattagaaaattttggacacaatgagtcgaggttcagtgcttcctgatattatttaatttcttggatatcagcaccatgagctcttaatgcaatacttacaagggccaaaattttgtttcacagttgagttggtatcttcttaaagaactttgtcacagtatgatctgcttgatagatcgattgagaagcttagtgacacactatggaatgtaaggactgctcgtgtttaaatcgatgtacatcagcttcatttgttctgtttactaatcatagagaaatgct

SEQ ID NO: 24120 - DNA, 438 bp, Sorghum bicolor
  Clone ID: 30165031
gcattgggatttgagttgaggatcagacggagtttttaaagagagaatctcgtgttcttattaatgactttcaacagttttgttgaagcaaccttatttggccaaagttatgaagaactcaaaatcgagaactgatggccagatgataaaatttcagtttgtttgaagcaatagaaatttatcagcaatgagcggcatggatatttttgattttaagcacatgaaacgccaataactcagaagcctgcatactgtaaaaatgagaatatctttctgaatgacttctgagaaaatctcaagcctcaaacctcattcaaaaaatattcaaaacttatttcatagaaattgtttcctttttcttatttcgatgcaaaaagagttatgccttctcttttgcttctttgatgagccaagagtgagttgtctaaaattggggat

SEQ ID NO: 24121 - DNA, 412 bp, Sorghum bicolor
  Clone ID: 30165039
tggtgagaagatgaccgatgaggaggttgaacagatgatcagggaagcagaccccgatggtgacgggcaggtgaattatgacgagtttgtgcttatgatgaagaatgctgagcggaaaatatttggatgaagggtgcaatatgaaactagtagtcctcttgatcggattcttatgtcacaaatttagtactgtaaattgcaattgtgtgctcagtattatgattgtgttctttgaagtgttgtgagcaggttcccgtgtttaaggttgtgctctgtttcagactggactgttaactatgtaaacattaatttttagatttttagatttgccacagatatttagaagttcatgtgcccccatgctcgttgattcttgaagttatgctaagaatctatgttgtcttttcccgtc

SEQ ID NO: 24122 - DNA, 641 bp, Sorghum bicolor
  Clone ID: 30165048
tttattgacgaaatcgatgccattggtacgaagcgatatgattccacatcaggtggtgagcgtgaagtccagcgaactatgctggagcttctcaaccagctcgatggtttcgatgaccgtggagacgtcaaggtcattatggccacaaacaagatcgataccctggatcccgctctgatccgacctggacgtatcgatcgaaagattcttttcgagaaccccgaccagaacactaagcgcaagatctttacacttcacacctcaaagatgaacctcaacgatgatgtcgaccttgaggaattcatctcccaaaaggacgacctttcaggtgccgacatcaaggccatctgctccgaagctggtctgctcgctctccgagaacgacgaatgcgggtgcaaatggcggacttccgatcagcgcgtgagagagtactccgtacaaagcaggagggtgagccagagggtctgtatctgtaaagcacttgtacatgagcgattgggacaggtagatggatctcggttattaatgagaaatagaggtttaacagccactttgggcggaacgttttgtactagggttattgcttaggttggcaatggcctaggacttgatgttcagtgtaatgttatatttgacagcg

SEQ ID NO: 24123 - DNA, 513 bp, Sorghum bicolor
  Clone ID: 30165049
attgcggatggaactcgacgctggaagcagtagttaatggtgtgccaatggtggcaataccacactgggcagaccagccgaccatatcaaaatatatggagagcatatggggattgggtgtccgggtgcgcaaggatgagaaaggcttggtgacgagagacgaggtgggaaggtgcatcaaggatgttatggatggggatagaaaggataattataggatgaacgccactatgtggatgcaaaaggccaaggaagccatgcagaatggagggagctcggacaagaatgtttgtgaattcgtggcgaagtattcatcaaattagttttcaaagttaatgcattagttacttaattcctatatctttgtggattgtatgtgttactgtatattacattatgtctggggttataggtgctactttgtgatacatacatagaaaatgcttctgtgctctagtgcaataatgaaatagggatcttccatatacaaaaatatataaactattatgcagc

SEQ ID NO: 24124 - DNA, 496 bp, Sorghum bicolor
  Clone ID: 30165080
gataagaaggtccccctcaacaaacgactagagcgcgcacaagctttggttcttattggtgatgtctttgtcagggctgaacgatcccctgaagaggaaggcgactacctagtgttcgagcaactggtcgccgaggccgccatgaagaaggacaaagaggaggcccataagaagaagaaggaccgcaagtctttccacagccacagggacaaggagcaaaaggataaggaacctgctgcctcgacaccctgagctgcagcaaaaagccgttagagcttccgatttggacaagatcgcgtgagagtaaagttacacagcaggggaacaggacacctgcgtggttgagacatggcgagaagggtagtagatatccatttgaagcaggtttgcttgacgattggcagatggatgatgggtatagatgaggacaactggcagtggtttagatacaattttcataacgctattccccctttgttaatatgatcttccagcc

SEQ ID NO: 24125 - DNA, 520 bp, Sorghum bicolor
  Clone ID: 30165083
cgtcaagattggtaaggagctcggtctccgcggctcctactccggtattggtgcccgtctcttcatggtcggtaccctcaccgccggtcagttcgccatctatggtgatctcaagaaggccatgggcgcaacaggaggtgtagaaatcgctgcttaagcgcgtttaaacacatctagaaagattcgcggggtgcgagaggtgatataagaagtctggggagtgtggcccaagtattgcccaagagctgggcctacttgtaacaacagctgctgttaatgccaaaacagcttggcaggagcttacggatgacgtccagatttgctctcgctgtctgggaaacaaaaaagtgatcttttggttgaggggggatgctcgtgttagactcatgtttgcctatgatacctttccgcattaatgggcagcagacgggtgataccccgccgaaaggttgtataatagtctctttttacgctgaaatcatagactgggagtttgtggactcttatatctacttgtctg

SEQ ID NO: 24126 - DNA, 186 bp, Sorghum bicolor
  Clone ID: 30165097
acccaccgtctcgtctcgtctccctccctcccacataaagctagtagctgcttaattgctgcacgcgtttctcccttcctccccctgtccggcggcatcatgtgtggcatcctcgacgtgctcgccatgttcctactggtctcacgccaagatggctcgcgtcctcgcctgcgccagaaggctgaa

SEQ ID NO: 24127 - DNA, 547 bp, Sorghum bicolor
  Clone ID: 30165098
aatgcggcgcctccacttgtgaattgtaatgcccgcgtcctcgctcacgctcccctccccatcctcctcatctaccgtgccgtccattctccacccactcccgccgccgcccgcagatgccgcccaaggtggtcgccgtcgccgcgggcgaggcccacacactcgccctcacgggtgacgggcaggtgtactcctggggcagggggccgttcggtcgcctcgggaccggccgcgaggacgacgagctggtccccaccgcggtggcgcccgcggtctctgccggcgggacaccgcggcccaggttcgtcgccgtcgccgctggtgcctaccatagccttgcgctggacgatgaaggttcactctggtcatggggttacaatctctatggtcaacttggttatggggatcagaattcccttttttccatgtttggttgagcaatttcaggatctaggttctcctgaaacactgaatgatgaagaccagaacacacgtgatcagacttgtttaaagctgtcttctgtcaaagctggtggcatgatgtcat

SEQ ID NO: 24128 - DNA, 579 bp, Sorghum bicolor
  Clone ID: 30165101
atcctggttgtacaggcgcaacaggctacacccccctatctcgcgctctccgaacccctcgccgaaacccttccgccgcccgccgcccgccgccaacgctcgccgctcttccgctgctaaccgttgcctccgggctccggccgcggacccggcactgtcctgaagccgtggcctacgggggattcacttccatccgacgccatctggcctcctcttccatctcgcgggcgcttgttcgtgcgcgtggattttttcgtccgggtctcgtgcccctgcaggagcccctgcgaccgccatgtttcctcccaaagggcccaatcactacggccagcagccgccttatggcgggcagcagccgtacggccaaatccctagtagcactggatttgcagccccgacagcggcaggtggcactgatggtggtcggtttggtgcgcgtgcaggacaaggggctgctgcacagtatggagggccttatgcgtcagtgtatggcacgcaacaggttggtggacttggtggcaaaggtccagcttcttcaagtcttcctagcttgccaactcgtccaacttcgctcaccga

SEQ ID NO: 24129 - DNA, 446 bp, Sorghum bicolor
  unsure (1)..(446): unsure at all n locations
  Clone ID: 30165105
ttattaaatgaataagatctcattcaaatttatgcattaggataaacaacatattcagggttgacctgatcttcaccatcctcattttcagtggcagtgatctcgactctgtaggtttgtcccttgctgttaactaacttcaccaagaaaacgtattgaggagggaaaccagagtcttccaaataggcattgtagacatgggaaagggtgtacttagacttgggaagttcaccgttcttctgagcatcagcaacaacatacttgatagcatcgttcaaaaggggtgagagatcatcatctcctttgttaagaggtctgacatcgatcaaactgggtcctccgacactgggtccgttattggggttacctccnataatgttgtagttgaaagaagtgataacgaaagcaccgttcgagggcttggagctggatcacataagtggctc

SEQ ID NO: 24130 - DNA, 622 bp, Sorghum bicolor
  Clone ID: 30165108
tactggaaaaacaccagaagctctctccctttccttcttcttctccttctttcactccaccatctcccctcagtcttttttttttgtaaacgtctgatcacattaccattcacaatggctgcctctaccggttccaccaaggtcgacgccgtcgtccagaacatcaaggctgagacccccgagaagaagactggtcttgctctctactcccgattcgcccttgccggtgctgtctgctgttccgtcacccacggtggtctcacccccgtcgatgtcgtcaagacccgtatccagctcgaccccgctacctacaaccgcggtctcattggtggtttccgccaggttgtccagaatgagggtgctggtgctctccttactggtgccggccctacctttgctggttacttcctccagggtgccctgaagtttggtggttacgagttcttcaagcagcagtggattgatgctctcggctacgagaccgcctccaagaaccgaactgctgtctacctcgcctcttccgccaccgctgagttcttcgccgatatcgccctctgcccccttgaggccacccgtatccgtctcgtctctgagcctacctacgccagcggtctcgtctctg

SEQ ID NO: 24131 - DNA, 655 bp, Sorghum bicolor
  unsure (1)..(655): unsure at all n locations
  Clone ID: 30165148
atcactaagctcgggagcctcgacctctctcctccacatcaaatcacatccaccatcacgactcacctcattgaaaccactgccacgccaaacaaacgacatcacataatctatagctcctagagctgatcctgacaaaatgggtcaaggtcaatccggcatgggagaagggggacgcgatgagaaggacaagaagaaggataagcccaagtacgaacccccgcctcgacctaccacacgagtcggtcgtaagaagagaaaggctggcggcaccagcgccgctcagaaactccccgccgtctatcctaccagccgatgcaagctccgacttttgcgaatgcagcgaatccacgatcatctcttgctcgaggaggagtatatcgaaaaccaggaacgcctgcgtaaggccaaggcagccaaggagggtcaatccgctggcactgatgccgatgtcgatcgattagcggacgagcgtggccgtgtcgatgacatgcgaggaagccccatgggtgttggaactctagaggagttgattgatgatgaccatgcgatcgtcagcagtactacnggtcccgagtactacgttagtatcatgagcttcgtcgacnaggacttgctggaacctggcgctagtgttcttctgcatcacaagagc

SEQ ID NO: 24132 - DNA, 547 bp, Sorghum bicolor
  unsure (1)..(547): unsure at all n locations
  Clone ID: 30165153
aaggatgcggactctagttcagaggacataattttaaaagttgaagaaatcctcttaagctgcaaagagatcaagccactaggcagggatggtaagagaacaacaaggccagaactatgttcaaagtggcttgctttgttgacaatggaaaaggcgtgcttgtctgctgttgcattagaggatacatctgacatggtgttgaaacttggaggaaatttcaaagaaacattaaggcagttgggtggccttgataatatttttaatgtcatggtgaattgccattcagagctagagaaacttgtaaaggatgcctcaactacggctgtggagggaaaggaaggagctcctctgcaaagtaccgcgctcctcttgaaatgtttcaaaattttggagaatgccacatttctnagtgacaacaacaagacccatttgctcagcatgactcgaanattgggccctaaatgcccctcacttccatttgttggtgtcattctcaatattattgaattactatcagctctctctctccttcagaaaccttccactg

SEQ ID NO: 24133 - DNA, 518 bp, Sorghum bicolor
  Clone ID: 30165156
aaaaaaaaacgctccattcagctgactgaccatcgactcgctcatcaatccaatcctcgtcttctcaaaaaaacaattctcatcccctcttgagcgcatcgaatcggccgggttggaatcggactcgatgctgcttctcttcctctccctcttggtgcttctgccattgccccccctcccccacgcatccgccgacgccgacatctgcatcgtcggcggtggcatctccggcgcctccaccgccttcttcctcaccaactacaccacctccctcgctggagcgcagctgcgcgtcttcgagcgccgtcacaaggtgggcggccgcctcggcaccgtcactctcgcgggcgacagcttcgaggccgggggctccatcatccacccccgcaacctccacgcgcgccgcttcaccgacctcctgggcctcgccgccaaggccggcggcgacgacaacgacgggctagggatctgggacggcaaaagcttcatcttccagacgctccgcccaccgccgaccg

SEQ ID NO: 24134 - DNA, 522 bp, Sorghum bicolor
  Clone ID: 30165161
acttaaatacccaaatcaccacctacctgcccaaggtatctagttcacatccaaatatcagtctagaaccgggaaacacaatccatcatggttgtcgataccgcctattacgacaccttgggcgtccagcccacagccaccgagctggagatcaagaaggcttaccgaaagaaggctattgtccatcacccagataagaatcccgatgatcccaccgcacacgaaaagttccaggccatcggtgaggcctatcaggtcttgtccgattccgacttacgagcagcatacgataaatttggcaaggagtccgccaggccgcaggaaggcttcgccgatcctgctgagttcttcagctccatttttggaggcgaggccttcgttgactggatcggcgagattagtctcatgaaggaccttacggcgactatggacatcacaatgcaggaggaggaggctgccgccgctgaagctgctgctgaggaagccgccgccgccgaggccgctggagaggatttccccgga

SEQ ID NO: 24135 - DNA, 155 bp, Sorghum bicolor
  Clone ID: 30165171
aagcgaaaaagagttatttactctatactttaagcaatgcgtgcgctctgtgttttgctcagtatcacggcggccgtggcgtttgcggcgttcccgccgaccccggattcatgggagttgccgccggcggcacccaactacctgtacaacgcgca

SEQ ID NO: 24136 - DNA, 614 bp, Sorghum bicolor
  Clone ID: 30165186
tgtttctcctatttattatgtaatgtttactacccttacaatagtggcgagtggaattatgtttaaggactgggctggtcaaagtttcagtagtattgcttctgaattatgtggcctcataaccatcctttctgggacgattttgttgcacacagcagaggagggagccaacaattctgcagctttgttgccttggcctttggacaaagggtctatatcatggtgtatcagcttaagcagcgacaatctgctaaagaatgttgaagaggactacttcgcagctctgcaaagttcaccagccccagtatgatgatacattttcgtacgcttctgctattgaagaaactgataaacatcaaaaaccgaacatgcgaggtgtaaatctatgtgaggtgtaaatcttaatagtgccagcaatctggcagttttgggtgaggagatttcatcagccatttttcgggttgtacacaggagcctgtgaatttgtgattgtttttgtactgggataggatagaacttttaccattgtttaaagcaagcagaattattgcctgcatgttgtcgtttgtgtaaattttctcctttaactaaagctaagaagtttagattgactc

SEQ ID NO: 24137 - DNA, 603 bp, Sorghum bicolor
  Clone ID: 30165187
gatcagcaagcaaatactttattttcttgttcattttgggctttggtttctctttgggaagtgtgacttggatttatatttccgaaatccttcccgatattggagtcggtgttgcaactttattgagttgggtttcatgtgttattgtcgctcaagccttcccctatttgatggatggtattggatcaaaccccacctggttgattttggcctgcattgtatttgctggcttcctctttatcctcagatttgttcccgaaacacaaggaaaagagccccacgaaattgccgctttattcagtggcaaggaaaaatacggtcttgagtacgctgaccccgaagcccaaaaagtaaatgagaatcaagccgctaaacctgaagaagttgaccaaaaagcataagcaaataattttacttctataatatctcagtaagatatatctaattcaatctcagattttgagactcttatatctaatattagtttagttatctaacaagctattaaaaagaaatatatataattgatcgttaaatataccaatataaattttactttcataaataaataccagtattactctaattattgaaaaaatatct

SEQ ID NO: 24138 - DNA, 566 bp, Sorghum bicolor
  Clone ID: 30165195
cgatcttgagatgattcaggggctctcgcagcgccttgaaacggtcgctaagcttgcgaagcgcaacatggacctgcagacgctgctcgagcagcaaggtcagcgacacaagcgcgagaccgcggtgctcatcgccgcgattgaaaacagcgcgaccgagccgcaggcgcatcccgcgatgctgcccctcgaagcgcgcgttgaatactcgcgcgccaccatgagtgctagcccacgcaaagcgatcccgatggcgcagctgcccaagtcgcagcgccttccggccgtccgcatttggaagcgcagctccaaggacgggacaccgctttcaagcgttgcgccacccaaggcgcccagcacagcgcgaccgttgcagccggcgctgcgcgggggctggcagcccacctcgcgcccagacagcggggcttccagcgtggaggatccatcgcgtgctcaagagcggtcgaagccggtcgcaggcagcggcgaggagctctacttcagcggctacctgtgaaatgtacacccccagcagacacacatcccttctttttcacacgcacaaa

SEQ ID NO: 24139 - DNA, 620 bp, Sorghum bicolor
  Clone ID: 30165240
gctctctctctctctactagtagtctctctcgcacacagacacactctctctcctccctctcttcacacggtttgcctcgcctcgcctcgcccacgaaaagacaagcggagagcaggcagggaaggggagggggagaggaaagggaaaaagcgggtcgcgagtgccgcccccccgcttttgctccaatcggcgccgcctcgcgcgagatccgctccgcgtgcccccgccgccgcgccgctgccgagatagagggtgtcgtccccagcatcggtttccacggagagttgttgatttggatacctgatccaattgggggcggattgagtcacttggaccttttcaacagctgtcccgttcctgctgctttggtcccgataagaggcttgcctggttccagagatgatgccattgtgagtggcgatggattctgcgagaagttggttccagaagttccagccgagggataaatccaagagtccagctgtggcagccagccatggaaaggatccaggaaagcccccggtcgatgatgccccttctagtgcgacgaagcagagggtcgccgctgcaaagcagtacattgagaaccactacaagacccagatgaagtccctgcaag

SEQ ID NO: 24140 - DNA, 646 bp, Sorghum bicolor
  Clone ID: 30165253
gtgcagcagctggaaggcatgggctaccgcgacggcgagacgctctacgccgcgccgtacgacttccgctacgccgtcgcccctcccgaccacccatccgcggtgggggaccgctacttccgcgacctcgggcgcctcatccaggcgggccgtctcaaccatggccgcccggccatcgtggtcgcgcacagcttcgggtgcgcgctcacctaccagctcctcctctcccgcccgctcgcctggcgccgccgctacgtgaagcacgtcgtcctcctgggccccgcgctcggcgggttcgccgcggggatgtacgccctcagcgccggcatggacttcggcctcccgaacgtcacgcggccgacgatgctccggctggcgcggagccagcagagcgcgctgtagcgcctgcccacgccgctggtgttcggggaccggccgctggcggtgaccaggaccgccacctactcggcgcgcaacatgtcggagttcctcgaggccatcggcttcgcggaaggagtgcggccgtacttgacgcgggtgctgccgatgtgggaggcgctgccggcgccgatggtgccggtgaccagcgtcatcgggttcggtgtcaggacgcccgagacgtacgtgttcggggccgatgggttcg

SEQ ID NO: 24141 - DNA, 510 bp, Sorghum bicolor
  unsure (1)..(510): unsure at all n locations
  Clone ID: 30165258
acaaaatcagctcatccaccgcgagagcatggcggccatcgtggcggcgcgggcgtccgcccccggcggcgctgccgtgagcactatcgccgcgttccacagccacgcgtccccttcccgcgcgctcacgctcgcttcctcctccatcggcggcgccaggcggtaccaccacgcctccgcgtgctgcttcgccaccaagcccaccgcgccgaccgccgccgagctcgtcgaccaagaccccgccacggccacgcaggaggccgccaagccgcgccggaaacgccggtctcggaaggcgaagaagtccgccaccgccgccaaggaggaggacggcacggacgacgagccggtggcggcggcggcggcggcggcggcggcggaggacgaggcgaaaaggaagaanaaggacgcgcccagcgccgaggagagcgcccgggcattggtggccggcctcgacgacgtgatcgtcaaccccgtcgggctgggccggcggtcgcggcaggtgttcga

SEQ ID NO: 24142 - DNA, 569 bp, Sorghum bicolor
  Clone ID: 30165284
taaacaaattctaattcaatgagcagcacttataatcctgcatatgtatatgcgatcgccatgactggagccttgggatctattttctttggctacatcaactctatcatgaatcctcttcaagactacattcaagacaatgtctatactactatgagtgactcactaatgactctcacttcttcattagtgcctgcaggagctgccatcgatgcctttatttcgacagatctggccaagaaagtcggcagaagaaatgctatgtttgtcactgatgcagtttcagttttaggtgtcattatcaccttgattggcagccaatatgccttattggttggtcgcctgatctctggtgtctgcgtcggtttcaactcttctcttgttcctctgtacatcgctgagatctcccctgctgaagcaagaggggtaacaggcagttttacccaactttctgtgagtatcggaattttaattgcttatctgtttggactccacgtccccactggccaagattactctacgaccaagtgggtggtggagattcatgcttgggttcggaattatcattg

SEQ ID NO: 24143 - DNA, 588 bp, Sorghum bicolor
  Clone ID: 30165285
aagtaacagtttctgtactttattggcctaggcggcactccgttgtcccctccctcatcgtatcttcagcttagttgaagcgcgtagccatgcccgggtcgtacggcaccgcggcgtttaaaagttcggcccggaagcccctggtcaacgaaagcggcgtcgaggtcggccgcatttactccacccgaggaatcgcggatgaagtccgtgactcgcatagacttggcgctgccgccgccctccgtcagaaggcgccacgcttcaaggaacagacatcaaagagcgacacgcccagcgcagcttcttacacgccacccggcgtcgctgacaagccgctgaatcccggccgcgctgcggtggccttccgacagcgtgaggcgcgttttatcgacccgacgttcccagtgcgagtcactggtgctcttgacgccgcaacgcccgttcccggcctagccgacgaaattcgcaagaagcggcagggctcagcggcgttccgagcgacgccgcgcttcaagccgccgccgggcgcgccgtccgtgacgagccccgagaccctgacgtggtacgtaccgcccccgctgggtcaag

SEQ ID NO: 24144 - DNA, 635 bp, Sorghum bicolor
  Clone ID: 30165293
tcccccgcttcggctcttcaccatggccgccgcccacctcctcgccgcctccgccgccgcctcgtcctcctccaccgccttccgccctcctctccgccttcgctctccactgcatccaccacatctccgcttcaatcgtactgggaggaggccgttcccggtggtacgcgcggctgagaccgacgccaaagacgcgaaggcgaacgccaaggtccccgagaaggcgcccgcggcggatggctccagcttcaaccagctgctcggcatcaagggtgccaagcaggagagcgacatatggaagatccgtcttcaacttactaagccagtgacatggcctccacttgtatggggagttctctgtggcgcagctgcctctggaaatttccactggacagttgaagatgtcgcaaaatctattgtatgcatgataatgtctggtccatgccttacaggatacacacagacacttaatgactggtatgatcgagacattgatgcaattaatgagccttatcgccctattccatcgggtgctatatcagaaaatgaggtaataacccagatctgggtgctattgctaggagggcttggattgggcgctttgttagatgtgtgggcagggcacgattttccta

SEQ ID NO: 24145 - DNA, 568 bp, Sorghum bicolor
  unsure (1)..(568): unsure at all n locations
  Clone ID: 30165295
gtaacagtttctgtactttattgagaaggtaagggaggaaaggaaaagaaaacacagcacgatgagccttcccgcaccgcggccgcagcggaaaacgggcatgtccgcggcccggctcctgtccatgttcgaaggctcggcagcaccctttcttacgcagagcagcaggacgagatctctcgaacctttctgcgatcccaagcgtcggaggtgctgaccccacgaagcaactcttcaggcatcggattccaccaacaaaacaccgcgccgcgaaccaactccgtcgcttgccagagcagcatgggcaacgggcactatggcctgtgcgagctcctctttcaacagcccccagggactgtcgtcacagctgaccacgcctacgagcggcgcctgctgatgcagcagttcgatcaccgccagattgacttactcggtgaggagcggtacaaccgcgtccagattttcctgcaacatcgcgactggatggacctcatgtggaaggtgttctgcaagacgatcccggncgtcaccgcgcagcagcggctcctcatcgaacagcgtgactacg

SEQ ID NO: 24146 - DNA, 699 bp, Sorghum bicolor
  Clone ID: 30165296
cagcacacagcctgatagccgccgccgtttcttatcttcgtcgcagcgccggcgctccatctgctgctccctcccccactcgcgctcgggctcgggctctcagcgacggcggggcagtcccaggctcagcggcggcgtcagcggctcctcccgcctctcgccagtcgcctcgcgacctcacctccgtcctcagcacaccggccggcgacactgcgttgtctgtttcttggtcctcccaagtcatgctgttctatctcagcctttggtggtgtggcagcggtttctgatgattttgtagaaagctcgccatcaagcagtggatatctgaatagtgctatggatgcttcatctcatgaagataatcaatcagaaagggctgttaagatgaaccaaaactccagagacaataaaatgattaaaatatgtgataagttaattggtgtattcctggtggataaacctacaccaacggattggagaaaattactagcttttagcagggaatgggacaacataaggcctcatttctttaaacgctgccaggaaaaagcagatacagagctgaaccctgagatgaagcacaatcttctcagacttggtagaaaacttaaagagattgatgaggacgtacagaggcataatgaacttcttgaagtagtaaaatccacaccatcagacgaacttggttctattgttgct

SEQ ID NO: 24147 - DNA, 620 bp, Sorghum bicolor
  unsure (1)..(620): unsure at all n locations
  Clone ID: 30165299
ctactggaggcgcatccggcatccccctccccctcgcatcgcatccctcggctcggatcgccgccgccgccgccgaacgaagtagcaatccatcctaacccccacccaaaccctagccagtcagctatggagccgcccgccgccgccgactcctcctcgcccgatccgacgccgcaggaccaagccccgtccccgtccccttctccatccgcctccccggccaagcgctccgcctggaagcacccctcccccaacggccccgccgtcatggacgccaaccactggcccgcgctctccgacgccgccaagggtatcaagctccccgactcctcggctccatcgcctgcgcccgtcgccgccccgtcggccgtcgccaactcctccagttcgcagaagcacagcgcccatcacggccgccacaagtccgccaggcgcggtgggcggtggtggcgagcactctccacgagaccatcacgaccggagcgctgcctctggctgggaccatgccggtgccgccggcggnggggaggggtgcccagaggaaccataataacggaggtggcaggaggggcaatggcgcagctgcctctgccactgggccttctcatcatggctctggt

SEQ ID NO: 24148 - DNA, 233 bp, Sorghum bicolor
  Clone ID: 30165330
agtgccctttggagtttggaagcatatcccccaatcccattactgctttggatgctgcaaaaatcaatggtatttgttcagaggcgctggcggtggtagtgaattccccgggcttccagtgttggggttgtctttgtgtattcgaggttaatttaatggaagaccgttcgcttcccaaatattgtattggcgtgtacgtatatccctgcttgcaaaagacgacgtgtttctgt

SEQ ID NO: 24149 - DNA, 455 bp, Sorghum bicolor
  Clone ID: 30165335
gacattgaactccacggcaaagatttgcccaagctgatcgaagacactgaagttagcaagactgaccgcattgaaggccgcggtgctttgactgacgttaccatcgccaccacttctggtcgcgcacacgttggtttccgcgagtgcaagagacaccacgacaagaagcacgccgaggaaaagcccaaggaagagacctctgatgctgatccttctgagaccaccactgagcacgacaagcttaagatccaccctcatcacattaagccccacaagaccaatcaacctgttattggtggcaagcaccaagagcgtcctcaccgcactcaggcttaaggatctggtgcttgatcctcatccactcgtgctttgatctggaagccgaccctagctgcgtatttgctaaatagctaaaatatttacgcacttacgctttgtagttagattaataaata

SEQ ID NO: 24150 - DNA, 594 bp, Sorghum bicolor
  Clone ID: 30165342
cgacgccagcgagtccggcaacgtcaccgaccttaaggacatgcaggtcggcgtcggccgccggttccgggggctcaagctctggatggtcatgcgcacctatggcgccgccaagctccaggagcacatccggagcgacgtcgccatggccaagatgttcgaggacgccgtgcgcggtgacgaccggttcgaggtcgtcgtgccgaggaacttcgcgcttgtgtgcttcaggatcaggccccatggcggcggcatgacggaggaggacgccgaggaggtcaaccgtgagctcatggagcggctgaacaggaccgggaaggcgtacctggcacacacggtggtcggcgacaggtttgtgctgcggttcgccgtgggttcgtcgctgcaggaggagaggcacgtccggagcgcgtgggagctcatcaacaagaccaccactgagatcatgcaggaacagatcgatgctgagtagtactggagtagtagcatattatatagtatatttaattatttattacatgcagtttgtacttggattaagatattttattctttgttgtttgcccaatggaggaataaaaagcaattaaagat

SEQ ID NO: 24151 - DNA, 590 bp, Sorghum bicolor
  Clone ID: 30165354
tccaggccgtgctccgcggcaacctgcgcttcccgccgcgcgccttccctgccgtctcgcccgaggccaaggacctcatgcgccgcatgctctgcaaggacgtctggcgcaggctctccgccgagcaagtcctaagtcacccatggattgtgactcgcggcggaagtgtggcggtggcctgatttagatgctcggccgcgtcatccgatgaatctccatctgcagtgtagatagtggcgttcgtccaagaggagtagagagaccttttgcagttgatctctttgctttggttctgccaatcgtcaatgaacagtagtgcctgccgtagttggttactagtagaattagtagcacgcagcagtaatccttagtgttcgtcgtgttctgcagtaggagtaatccttaggcgaagcaggaatttggggggcttcctcttcctgggttcgtgttgcttcatctttgcattgcaacccatgtatagtactacagccttcatgtggctgaagaagagaggactagctctgttcaggagaaaatggaacccaaaaaaactcccagaaaatctatgtacagttcagcttcaggctcaa

SEQ ID NO: 24152 - DNA, 584 bp, Sorghum bicolor
  Clone ID: 30165355
gatgaatgaattggacttaacggatacccccaattcattcaagattttccctacgacgaaactcgcccaattttgttggtgcacgttacaacatcggatcgcatcactcactacctgcctcacatcttattatggttgggttgtgtacccagccatggggccttgtttaacgactttttacttgggttacttttccgtcccacatgctttctctccccccttttactctggagccttgggagaggcttcaatttggatatctggggtggctacggactgcagagctttgcaaggctggacgtagcataggtcatcaccgacatttttacctaattttccttctatggcgttgatttatacttttttgctgttattgctgcttctgcaccttactacccagcttcccacgggaacagcttggggttggttgttgcatcattatttctagagctgacaggtgactgtcaggcgctgcaatctgtacataacacaacaaaagtattgcaggcgagttctatgggaggatatgggcttatggactttaacctgagtgaggcaccaacgaatacaaacagatatcagtc

SEQ ID NO: 24153 - DNA, 576 bp, Sorghum bicolor
  Clone ID: 30165366
gagtggtgagaagcccgttgttcctcccactcctgttcccgtccctagcaaccccggcaaccctgagcagtgcgttccctcccagtctgtgactgccatcaccaaggagtacaccactgtcctcaccagcgttgagtactctaccatccaggttccttgcgctactggtaccactcccggcaaccctagcaaccccggccagcctgagtctcctaccggacctgctgttcctcctcctgccaccacccccattggcggaggtaaccagaccgttcctactcctcctgccgtcactgctggcgctgctaccttcgccggctctgctttctttgctgccgttgctggtctcgccgctttcatcctggtctaaaactattcccctttctcctagcatctgttgaagcctgcaggctatggcaacttatgaactcttttgtgtttaatggtctcgctggaatgtatagtactcgagtagacttttgaatacattgcttttttttggcttacttctatgtacttatataactgatccgcagtctgggatatgcgattggaacttatttgctatgtttaatt

SEQ ID NO: 24154 - DNA, 543 bp, Sorghum bicolor
  unsure (1)..(543): unsure at all n locations
  Clone ID: 30165379
tttcaccactttcgatatatcaacatatnttttgagcttatagcttcagcctttcattaccaacttccaaccaattcttcaagatgcgttactctactgccgccgctgctctcctggcctctggtgccatggccaccgaggtctccaaggtctacgagaccaagcgagttaccatcacctcttgcggtcctgaggtcaccaactgccctgctcgatctactgtcaccagcaacaccgtttaccctgtccctccccaggtcacctctgctgagcagggcagcgagaccaccaaggaggtccctgaggttcccgagaccactgaggctcccttgaccacctctaccatctactctaccaacatcaggactatcacctcttgcgctcccgaggttcctgactgccctgcccgatctggtactcccgtcgttgtcaccgagaccattgctgtctccaccaccatctgccccgttgagcccactggtggcagcgagaagcctggaaagcctgagcagcccggcaagcctgagaagcccagctctcccg

SEQ ID NO: 24155 - DNA, 539 bp, Sorghum bicolor
  Clone ID: 30165400
gccaccgagcaatctcagctccagcagtcagagctagtgacctcgtcctgtcctcagctgcactcagcctctcttagctcgacgacctctctaagcttcaacttcgtcccagttgtgttcatcaccatttaagcgatcgataagagccgccatgggcagcttggacaccaaccctaccgccttctctgccatcggcgacgccgccgccaccggcttccagccgctgaaccccgacgacgtccgctcctacctccacaaggccgtcgacttcatctccgactactacaaatccgtcgactccctccccgtgctgcccgacgtcaagccggggtacctacgcgaccagctgcggtccgcgccgcccacgtcctccgccccgttcgacgtcacaatgaaggagctcaccgtctccgtcgtccccgggatgacacactgggccagccccaacttcttcgccttcttccccgccaccaacagcgccgcggccatcgccggcgacctcatcgcgtccgccatgaacaccgtggggttcacatggc

SEQ ID NO: 24156 - DNA, 686 bp, Sorghum bicolor
  Clone ID: 30165402
tgttgtaggacctaagtccgttcttgtaagcccatattctacggattgagtgcagatctgccaaaatgggttctcaattgacccccgcgacagccccctgggacgcagtctcagcccaggagcagctgtttgtcctaatcacaggcgccaacagtggaatcggtcttagtatcggagaacgcctcatcgacgaattcctcgctacacggtctttgcgatcgcaccttatcctcatccccactacacgatctaaatccaagtccttgcaaacgatcaaggctcttcgcgactatgcacgaaaggcggcgcaaacttctaaatcgctacaatcgagggtcgggagctcgtatcgttgggaggacactgttgcgagggtgcatgtgctgagcttgcaggttgacctttgcgacttgcgcggggtatacgcctttgcgaatgcgctggtccatgaaccagtgagcaaccctgagggattggagggtgaatatctacgaaatgtgcgcattccaagactagatactgtggttttcaacgctgcgtacggtggctggtcaggggtcaattatcccaaggccatctgggtgatcttgaccgaggggttggtgcagtctgttacttggcctagttacaagatggcgcttcctacggctcgcctgaacgacaagtccaactacaactatcccaag

SEQ ID NO: 24157 - DNA, 587 bp, Sorghum bicolor
  Clone ID: 30165415
ttcatttttgactcggatctctttcgtggacaaggaattataactccaggcgatttgcttcctcttgctcaagctattaatgtcccctactctcttttaatactactgtccaaccaacctcgatatcaccgaaacaaccgagcaacttacatgagtacttgacttgacctgctgctggtaaccatatagtacaaacaccaatacccagtcgagacgaacaattgcctccccctttatgagcagggtcaattcaaggacaggacaagacacacaatcccccgagacgaaacattttcactcggtacaaatcgaaagcgtacggcattgattgcagtacgaatacctggaaacttaatctccacatcctcgactcctccattacgaagccagcctccctcgccgcgtcctcgaatctcaccgagagatccgaactgatcgcccttacatatacacgggctcaatctcacctcttctgaacgcaacacctgaaacttgatacatccaccgcaaaaatgggcaagtctctcatggacaagatccaggccaaggctggagctcttccgtctcgagcaacgctacacccgccg

SEQ ID NO: 24158 - DNA, 207 bp, Sorghum bicolor
  Clone ID: 30165416
ccctccatcgtacgccgaccgatcctttgttccgaggagcaaaccgatagcgatgttgtcatcaaggatatcatgtgcggtgacgaatgtggcgccgcgaggacaatgctccagatcagctaccccatggagaacgggatcgttaagaagtgggatgatatggaacatctttgggattatacgttctacgagaagctcaaggttgat

SEQ ID NO: 24159 - DNA, 653 bp, Sorghum bicolor
  Clone ID: 30165419
caattcattctcatgatgcagcatcctgcactttggatgttgctgctgatgactactcaccacagtgcttgtgttgccatctctctgcaacatcgctgatctcaccacttgcagtcccggagcctgcaacagatcgactatcgtgacacaccccacacccattgtacaattgagcagcaacgatcgatagtcctcgccgcctctacttcctcgtcgctgtgccgcctgtccagattttcatgagaaaaataaaaggattaaatgcctacccagtccaaggctctttgctaccatgaagaagagagtagtgaataacctctcgatgttcttttagatttccaactccgaaaaaagagaagaaactatcgtgttcaggccttgcggtgatgtggattgaggactatgaattttaaaataatttactatcatcatctacatgccatctaaatatttttatttagaattgactatatactaatcactgacaatatttattctaatgcagtatgtaaccacaaccatggagctattggaatagcttggagcaaagactacgaagatgtacttttagcgatggcgtaatagtgaaatttttttggagtactaaaaatgtgctggctatttcgtgacatagctaattttctcaatgatcc

SEQ ID NO: 24160 - DNA, 598 bp, Sorghum bicolor
  Clone ID: 30165422
ctcagttgaggacaagatactcagaaaaatacgggataaagaggcggaagtggagaccatcaacaaaaggaactctgaactagaggaccagattaagcatttgggagtggaagttggtgcttggcagcaaagggccaagtacaatgagagcatgatcaatgcactcaagtacaacttggaacaggtatgtgctcatcagagcaaggatttcaaggaaggttgcggcgatagcgaggtagatgacacggcgtcctgtcgcaatggtggtgctgtcaatttgcagctgacaccgaaggagaacagacaacagaaggatttgacggcttgcagggtctgtaaatcaagtgaggcatgcatgctcttgctgccttgtcggcatctttgtctatgcaaggaatgtgagagcaagctgagcttctgccccctgtgccagtcatccaagatacttggcatggagatatattacgcgtagaatagaatttatgtatcacatgagtatcttacgagatactgctatgttaatacgtcaatgtattgccaaactttagaacctatgtaccactatgacttgccactggatctaaaaagactgccgttt

SEQ ID NO: 24161 - DNA, 570 bp, Sorghum bicolor
  Clone ID: 30165442
gatcaggaggaatatcaaattcgaaggctgacagcacttatgattgaaaagctgttccaaaaaatagaagtgaagatgtcgttgttttcagagattgagcaggtggtccttcgaacaagagagtataccgagaagaccagaaagaagctcctaatggaacgaaatgccattattgcagctcggatgggtgcattgccgtctaggccaaaccagcctggtgtagccggaaacaggttaccacctggatatagcaaccctcctgtaaggcctccaaacgcaatgccgcggcctaccagctgaggaatccggattcaggacacccagtgatctatactccattcttttagaagcatacctcaaagactcaaacctgccagattgttgtagcattttttagaaagtacattgtataattgtctgtataactgcttctatgaaagttcaccattttcacttaattttcgatgtacttgcttgtaccaaacctccacaactgttttaaaccttcaatcagataggaaaaatccatttttttttacaatgaacagtccactcgaccattaacaagat

SEQ ID NO: 24162 - DNA, 553 bp, Sorghum bicolor
  Clone ID: 30165449
gcgggaggccgtgctgcggagctactgcgtggtcaagggaaggctccgggacatggtcgtatacagattcatctctaccgaccctctcgttgactgatcaagattcgaactcatggtcccgcgcatcacgccgtgctcccgcaccggtggttccgcgccatgtgcgtctccggcgcggtggtgggcgcggtgtccgtgtccccggtgccagagcgctgccgcggggagcctggctacgtgctggcccgcgcgtactgggaaccgcggctgtgcggcgcgctctgcgggacgtgttcgcggacctggagacgaaggggcagcagcgcgtggaggcgatggtggacgtgggcaacccggcgtcgcagcgcgtggcggagatggccgggttcctccgcgagggcgtgctgcgccggcactactggcacaagggacgcgcgagggacatgcataatagtttaagtttgaccgaatttataataaatattattaatatttatgtctctaaattaatctataataaatgtattctataactaatttagtggtgcttatt

SEQ ID NO: 24163 - DNA, 578 bp, Sorghum bicolor
  Clone ID: 30165451
tccccttcagtgctatgaatgttgagctatattatgctttctctgctatttggggccataagatgtacaccatgtacggaatggtctttatgatgttcatcatgatgcttaacatgactgcttgtatttccattactttgacttacttccaattgaacgctttggactacagatggtggtggagatctttcttctacggaggatcatcaggaattttcgttttcctttatgccatctatttctatcttaccaaaactcaaatgcatggtttcttgcaagtcatgtatttcttcggatattccggattgttctccttggctgtgttcttgatgatgggaagtgttggtttcctctcaagttctgctttcgttagacacatttatgttagatccaagactgactaaattaagctcaagtagaattttgaattaaattggaatagtagtcgtcgtctataaacacatacataaaatatatgtaagtaaaagtttaattcataaagcgctcccttttattttataattcaaccacttgatgaataactttgtttatatgattcataaatgtttgctttctct

SEQ ID NO: 24164 - DNA, 581 bp, Sorghum bicolor
  Clone ID: 30165464
tattaagagcctcagcacgcccacattgatcgtaaactctgcttacgactcttggcaggtacgttttgttgttgcgccggatggatcgtcccccgatgagtcatggcgcagctgcagagctgacgttcgcagatgcaattcctcacagatacaagtcctcaatgcattcaggaaggagatggtagatgaccttgaggctgctgacgacaacaccaacaacagctggttcatcgattcatgcttcacccattgtcagactatcttcgatgattcaggatggaacaaacaggtcgccccgaggatcggaaacaagacactgaaggaggtaatgggggattggtactttggtaggagcccaagcccggtggtaagacaagttggctgcgagtatccatgcaatcccacaggttgccagcttgcacaacagagctcttctgcacgaaccaaagaataaatcatctatatagtagtataatataacaacccaactgtcacacgcattcttgtattgggatggatacattatatgtaaacggacaattctaaagatacagatatatagcacacactacatgagaaca

SEQ ID NO: 24165 - DNA, 681 bp, Sorghum bicolor
  Clone ID: 30165467
aattacaaaaccccgcaaactaattagttcaatgaaatatcttctatttgcaatcctacttgtctttgcgacagcgacgaccgagccagaatttaaaaaggatgaaccaatcagaattatggtgaataagatttccccttattccaaccctactgaatcctacagatattatgaccttcctttctgctcccctcaagaccccttcgaagagcctcaaagtatcggagaaaagctcagcggtgacagaaaaatgagctctttatacacagctaattttgaaagtgccgtcaaaaagagacccctatgtaaccaaaaattaactgctgaacaagtcgagaaattcagagaagccattaaacaaaactatatctttgaaatgtttgttgaggacttccccgttggaaactatatcggtgtttacagggacggcaaaacttacctggccaatcacttgaccttcaacattctttacaactgagacttaggaaaaattatcaaagttagcgttgactacgaggatccctcagacactgtcgaaatcactgaaaccaccaaatcttacgatattaacttcacttactccgtcaactgggctccaactgctctcaccaatcctcacatcaacaaaggagctgattctttcttcattgatgaagtccattggttctctttcttgaacgc

SEQ ID NO: 24166 - DNA, 147 bp, Sorghum bicolor
  Clone ID: 30165474
tttctcctcgccgccgtgtgccgaagagtttgcggccgatgtcgagcccaagaacgtccccgcggtctttcgcgacgtggctaaggggtgggcggcttcctcccggtgggatcctctccatggcggcctcgactacctgctggaaaa

SEQ ID NO: 24167 - DNA, 552 bp, Sorghum bicolor
  unsure (1)..(552): unsure at all n locations
  Clone ID: 30165480
tgcttttagaccagacacagagcctgctggcggccaggccaacaatccagctaccgatcgacgatggccaccaccgaactccggtcgccgctcctccctctgccgccaccgccgcagcgccagcgacgaataagcgctcgggcagcagcgctcgccgtttcggcgacggtggtcgtcctgctccttcccttcctgatcgccagcttcggcggcaccaccagcacgagcagacggcacccgccccggcaccgatcatcctcatcctcatccaacctcgtcgagctcaccctgctgaccgccgctcaggacaagggcgcagtgtgcctggacggaagcccgccggggtaccacctgcaggcgggcaccggcgccgggtcaagcagctggctcatccatctcatggggggcggctggtgcgacaccgtgcgcagctgctccgaccgcagcaagggctacctcggntcgtccctctacatggagaaactgatggacttctctgggattctcagcaacgatccggcacagaatcctgatttctacagctggaacaga

SEQ ID NO: 24168 - DNA, 428 bp, Sorghum bicolor
  Clone ID: 30165484
tccggcagaatagagcggccgagaggatgcagcacgccctcccgatcgcggcgtctcacgtcgactctcacgggaaccaaagagctggagctgagcttcttgctcgagttcaagaacttgaaaatgggaacactgaattggagagggaaaataaaatgctcttgtccaagattgctgagaaggaagttgagaaggatgcccttgtaaaccgtttgaatgatctcgagcggaatgtagtgccctctttgaaaaaaaccttgaatgacatttctttggagaaagatgctgctgtagttgctaaggaggatgctctagctcaactcatgagcatgaagaaacgactcaaggaagcagaagaagaacagtatagggtatttattgaaacatgttccttattagtggaatggtcactttgctaatcctgaaat

SEQ ID NO: 24169 - DNA, 314 bp, Sorghum bicolor
  unsure (1)..(314): unsure at all n locations
  Clone ID: 30165507
ccgaacagcagaggtaggagagcaaaggtagaagaagaagaagaagagcactgctacgggcagtcggcagacgcggcgcgctcccctcccaagtccccctccccggttggtctgccgggagtaagggaaacgaagccaccggcgcggcatggagcccaagccgtcttcggcggcgcatggtgacgcgcccgcggtcgaggccccccgccgccgtggcggcggcggcaagcgcaagtcggccgggtcctcgnttactccgtctaagcggcaggccaaggagcggaacgcttccttccacgtgccgccgcatcttc

SEQ ID NO: 24170 - DNA, 224 bp, Sorghum bicolor
  Clone ID: 30165516
gcaacgcgccggaccggaggctcagagatggagcaagaagcggctgcacaacaggggtccgtggccgcggtgacgctccgacggttcgagctcgccgacgtcgacgcgatgatggagtgggcgtcggaccccgaggtcacggcgttcatgacgtgggacgcctacacgtcccgggaggctctcctcgcgttcctgcgcgatgccgtgctgccacacccgtggtt

SEQ ID NO: 24171 - DNA, 602 bp, Sorghum bicolor
  Clone ID: 30165518
ccgcgccctgtccgtccgcggcgcgttcgtcacgttcgtcaccacgccgctgaacctgccccgcctcggccgcgccgccagcgacgacgcgctccccatccgtttcctcccgctccgcttccccagcgccgacgccggcctccccgagggctgcgagagcctcgacgcgctgccgggcctcggcctcctcggcaacttcaacgacgcctgcgccatgctccgcggcccgctcgtcgcgcgcctcatggagggcgacaccccgccggcgagctgcgtcgtcgccgacgcctgccacccgtggaccggcggcgtggcgagggagctcggcgtgccgcggctctcgttcgacgggttctgcgccttctcgtctttctgcatgcgccaggatgaatctccacaggatcttcgacggcgtcgacgacgacaggcgcgccgtgcgcgtccctggcttccccatcgacgtcgagatctcgagggcgaggtcgccagcagggaacttcacgggtcccggcatgaaggagttcggcgaggagatcatggccgagagcgcgagagccgacggcctggtggtgaacagcttcgccgagctcgagcccgtgttt

SEQ ID NO: 24172 - DNA, 623 bp, Sorghum bicolor
  Clone ID: 30165523
aaagaagagccaagaagatggttgaagaaaagcttgaagaagttgccaagactaatgaagaaaaggaagctgaactccttgccagaattgaaaaggttgaagaagaaaagaaagctttgttgaagaagattgatgatatgcaatgggacagagcatacgaatacactgagaaacagaaggctgaagagaaagaagaagtcaataaaactgaagctactgctgcttctttgaatgccaagaagaagaagaacaagaagtaaataacgagacaaagtggatatgttaaagggactggattaaattaaacaatgtaaattgaagaccctttcagttctgtgtcattatcaagctttcttgttcttatcgagtttctccacttctcaactttcaatttcttcgaccttgtgtatgtccagagtttcaaaactaaaaaaataatatcaaagaaattttactcaaaactatcctttcataatgtttacacccttgaaaactattatgagttgataggtgtattaaaattcatcatatttgtgttatcaattgtgtttgagatatttgaaaatgtttatgtataaaaattattcaacattcatctattattttttaaaatcagaatcact

SEQ ID NO: 24173 - DNA, 538 bp, Sorghum bicolor
  Clone ID: 30165532
ccagcatatgtggtttcatcaagcccaaatctctctgttgacaatgttggtacacatggatcatctgttcgaatggaaactcccgaggaaacattgagtaggattgcttacggaggctatccttgtcatgtgaatgccacaagtgatgggggtacatactctcccgaagatgatgaatttccattgctttgacatgttgcatcggaatctactatatgatgttggtctgctcgcttctgattattttggctgcactgtgcagcaaagctgctcgctgcataccaggttgcaatatgcacctgtgttgtagttcagttaggtcattttggtggcacatgtggggtttgtgttagtgcctctaatgacatattgcaatttaaacaatatggattgatgaatgtgcctagctaccaggttgcaatatgcacctgtgttgtagttcagttaggtcattttgatggcacaagtggtgtttgtgttagtgcctaatgagatattgtaatttaaatccatatggattgatgaatgttaaattctg

SEQ ID NO: 24174 - DNA, 598 bp, Sorghum bicolor
  Clone ID: 30165543
caacaatttatgaacgtgcaggtagagtgtttggtaagccaggttctattacccaaattccaattcttaccatgccaaatgatgatattacccatccaattcctgatttgactggttatattactgaaggtcagctctttgttgacagacagttgcacaatagacaaatttatcctccaattaatgtgcttccatcactctctcgtcttatgaagagtgctattggtgaaggtatgccccgtaaggatcatggtgctgtttccaaccaactttacgcaaatattgctatgggtaaggaagcacttgctatgaaggcggtcgttggtgaagaagcgcttacctttgaagataagcgttatttggaattcttggaaaagtacgaaaaggaattcttgtcacaaggtttcaatgaaagtagatctattttccaatcattggatattacttgggagttgttgagaaagttccctaaggaaatgcttactcgtatcgatgatcaaacaaagggtgaattttaccaccgtcaagctccatcagctgaaccaaagaagtaaaatgtcttgtacactgacagccaacctagtaaaggaacaaaagt

SEQ ID NO: 24175 - DNA, 460 bp, Sorghum bicolor
  Clone ID: 30165548
tgctgacaaataaaaaaaggaataacgttatttggaagagtagcaagacctcatcgccttggatttggtacacctgcaacctccaacctcccattatgtcatctgccacaatctaatttgtatgatacactcagcttgcacaccaaatcgggaacccctacaccaatcgtcctagcagatggactgcatgtgattcttatgcacttacattcttaacttagagtacttacaattctttttgcccttgggagtgaacgaaaatattattcgtgttaacgcttatcgtttttacagttgcctgttgctgcttggtggtttctttagatttgcactgcactgtatttttttgcatctctttctacctaggtcaattggtttctcctgttttttaccatctcttcctatctattctgttgtctgtattttggagtcaccaatgagagttggtgtttgctgccta

SEQ ID NO: 24176 - DNA, 585 bp, Sorghum bicolor
  Clone ID: 30165551
tgttcgctatgatcatgattcttctgaggaaattgttccactgaggaaggtgtgccgccgaccagatactgactacaggcttcagattctgcatgctgctagagtggcagccacgaatgcagatattcacactccacccaaagagattaaagtggagttgacatccaatgataaaagcccaaccgagcagaaaccccagaagcagcacaagatgatggacgtgaatactgatgaggtgaccatggtgtcccccttggaacaagacgagacacaaggcaagactgtcgcccccttaccgtcatcaactgtagaaacccgcaattcaagttcagatgcggtgatgaaggatgcggaggcttcctcggtggttgaagatgacgacgaagttcaggtggttgacaagatgaaagagggctagttttttttttttttggcaactttctaactttagtttgtaattttttttttctaatttagtgtgtatctaggtcatcagtacctgtcttacttaccctgtagtatcttaatggcttcagaacttctggacaattgaggtgaaggatgttgttgggttcaagaccataa

SEQ ID NO: 24177 - DNA, 568 bp, Sorghum bicolor
  Clone ID: 30165576
ttctccacctcccgcaagcaaactcccggcaccgccccgcacccacttctctttctctccagtgccgctccctctagcttcttcctcccgcctttcatggcaggaaaggctgaggtgatgatgcccataagccatccaatttgacccatgctaccctggacctctatacatacttgccccagcgcaggcactcgcaatctctactaccacttctctaccaccctctctcctccctgcttctgcttctgcttttgcctcagcctgctgcaagcttttgctttggtttaggtgcttcttttccactcctttactgttcccccacttttgcttgctttgtcacgcacacgaaaagctcctgcctttaccttctcggaccttatctccgcccccgtagtgggatttggtgggagctgcgctgcttgcccctcgcgtttctttgctcaattggggtcacagcgcgtgctcgtggacggaattcgggttcttgcgcggtccccgtcccccttggcgattgcgggacgctcgctgcagatctttgcgtaattcccggagcgccggagatgaactg

SEQ ID NO: 24178 - DNA, 593 bp, Sorghum bicolor
  Clone ID: 30165582
ttttaccctaaattcacatggacgcctccatcactttgcaaagacctcgtccccaaaatctctttgtttctaaccccaatactacctccgacttgaaatgctctactgcagctctcaagcctatttctggtgaatggtcatccatctctctcagatcaatcaaaccaatcacctctgccactctcaagaaggctcccggcatcgactgcgaacccaaatctgccactgccttagctcaagagtacaaagatcagattgctgccatcttacttcaaaagaaacaccaaactcccaaggcatctgctccccaagtcatcgaagtcccttctgaaggagagtctgaaggaagcagagtcctttctcctggaaactccagttctgaaaccaagaactctgccgattttagtagaagagagtttgatatgatgttggacaaatccaaatctgatgttgacgatatcgaaaacaaaaagacctctgaacttctcaatgaaaagatcgccactctcaataaggaactcgaagacagctccaagcttatcactgaaaaggataaggaaattctcgctcttaaagccaaaatcgaaatcatt

SEQ ID NO: 24179 - DNA, 510 bp, Sorghum bicolor
  Clone ID: 30165606
gatagaatccaaagcgcaagcggctgctgcgcaggcagcgccgcgcaggcgtgggctgcgagagaggaaaaagaggaaccggccaagagaagcaagccggcggcggcggcgttccgtcagatggggaagtacatgcgcagcaagtgcaggggggccgcgggcgaggaggtcgccgcagtcgaggtcacgcaggttgtcggcgtcaggacgaggtccaggtccgcggcggcgaccggcggtgtcgcgaaggtcgctccgaggaggaagaaggcgctgacgcccgccgcgaacgtgccggcgggggagcctgccgccgtgggcgctggcggggacggcgggagctgctacatccacctgcgaagccgcatgctgttcatggcaccgcctcagccgcagccgtcggttccgacgcccgcggaggctgctggtgcaggacagcagggcgcggcgctcgtggctgggctctcgcgttgctccagcacggcgtcgtcggtggacgtcgggggccag

SEQ ID NO: 24180 - DNA, 193 bp, Sorghum bicolor
  Clone ID: 30165608
aggtacttctggattgatgtaaaatttactcgtgttgaatttaccggtgacgttttgaaaatgcctgttctgagaatgttagcagaattttcaatggagtggtaagccaattgatgatggtcctccagtattggctgaagatttcttggatttcaaggccaacctatcaatccttttgctcgtgtctatccag

SEQ ID NO: 24181 - DNA, 661 bp, Sorghum bicolor
  Clone ID: 30931907
ggataatgcaatctcttcacgtatgccacctgggatggaagccatttcagatctagagttgcctgtgttgttagaaaatgatggaaacatagaaaaagctgaggcttgtagaaaggagcttgaggatatatgcattctattgaaaaggaaacatgcagaagctaaagagctagcagttcgtgctatcgttaacaacaatacaatgctgatgttaaaccacccaatgattgaggagaaaatttgctctattcagaaattcacaaacaacctgatatcgaagaagtacttattcgaggaagttggcaccattaacactcactaatgcgggacgaatgcagggagaaaatgacttatccagcggagcgtgggtaatgtaaatacaacaaaagagctcaggatccaatcttgaagtatcttgaataactaccttcctcgtgcattttggtacacggttggcttatgtggatgagtccgttcacatatcgtagcaactgttgagtgcctacatcttattacctaataattctggatttctggtagtgagatatgaccttgtggactcgatgactagaatggcactgctgcactaggcaatacctggttgcatctatgccaattgcagttggtgacaaaccgttcacattggattgatgctgatggg

SEQ ID NO: 24182 - DNA, 459 bp, Sorghum bicolor
  Clone ID: 30931920
gagtttttcagcaccgccaaatcgcaacccaacatgaatccgttggtcgctcccgccactaaccctgcgccagtacaaactggtccgttgggcgtgactattacacctcagcctactttggacatgatgactcacaacttcaactcgcaattgaatttgaatgccggcactagccaacaaagaatgagcgttggtccgacggtccccagtgcgacttcaaatggcaatatgttcttcccgagtgttggctttacgcctgctatgaatcaagtgcctcctccttttacgagcaacccatttttggtgcaaggaaccggcgctacgaatgttgcggccacatcccctcaaaaaccgactcagcaaccttttacatacaaccccttcctaaattaacgtgtttttttaattaacttccatttttggtaaataaacaaggcggcggaagtgccgtttctgctt

SEQ ID NO: 24183 - DNA, 590 bp, Sorghum bicolor
  Clone ID: 30931932
tgttagctttgtttccaatgttacaagtgctattttagtttaacaattgtttttttttaactgatatcaaggaattgaaactaagggaagagagtttagctaaagaactggaagatcttaaagtgaggcttagtgaaattgagcggcttgctaaagggcgaggcttgacaggaatcttgaacttgaaaagggtccatgggccagaagtcggcaaggcagcaacacctgcgtgagtaagcaatttggttttggtgcggcaaagtaggattccttgtcgcccccattatttggtggtgacacttgtgtagtcatgcccactctattctttggtgctcatattggatctaaatttgtatggttgatccatggtcaccctgaaagaataatacagtgtaagaaagaaattaaagtgcattatgtatgtgctacttggtggtggcaatcacagaaccatatgttaagaggaatgcagtcttgcattgcattggcctgctgctaacacatcaagattcaagatgagaacacaagtaaatgtttgaacttgctttgtatcttttcctaaataatacatctgcgtgctaattatggtc

SEQ ID NO: 24184 - DNA, 147 bp, Sorghum bicolor
  Clone ID: 30931949
cgggtgtttttgtaagcccaagactggagacaagcccagcccaaggggagacaagcccgtggactcatgacccagcacaagcggcccgtggactcatgaccctgttggctcggtcgcttgcaacaaacgaccacgtgaggctcttcc

SEQ ID NO: 24185 - DNA, 614 bp, Sorghum bicolor
  Clone ID: 30931976
agcaaccgatgatgtagttggactccaaatatgtaaggacaagaatgctcaccctcaagtatgggaatatgtagctcctgtgaaaggaggatttatcgtcaatcttggtgatatgcttgaaagatggagtaacagcattttcaggtcaaccttacatcgagtggtcctagatggccgagaacgctactcgatagcctactttgtggaaccaagccatgactgtgtagttgagtgcctgccgacctgcaaatccgaatcaaatcctccaaagttccctccgatcacctgttttgcatacctgtcccagcgttacaaggacactcatacagatttgaactcctacaacaacagcaaggcctaaaggatggcctactaaatctttttttcactacttttgtcagccatttgtacggcagacatgtaacctgcaataacactaggtggaggacggcactgtgtgtgtagtgtgtactaatacggtaataccaataccagattaccagtgtatcccagtatcaatataggtatagcagttttgtagacgccattctccatgtaagatgaagagaagaattgaagatcaagaatggccttcctgtcgtgttgtgaagttc

SEQ ID NO: 24186 - DNA, 655 bp, Sorghum bicolor
  Clone ID: 30932000
gtacattttgggagctaacctgctgcgtctgttggcacctgcaaggattcttgacattgccgctttggcaatagtaaagttacactctctgttctttgactctcctaacaactagggagaaaaacacactacgacatgcctttttattatataataaatcttgacttatgtctttgtattttttattagaatcaataatcaagaattaagagtatgcttaggtactgtttttcaaatatgagtttgtttacatacctttccagatcagtgtatgtttgcatacttttgttcatcttagtatcatttgatatttttcatattacaatataacttgacaagattttttctgataggtttggaatcatgatcttcataaagggctcaaatataccagatgagtatggcacggtgtgaagtagcaagttcagagtttatagctgaagctatcttgtagtgactgcatatatgttcgtaacttttgtcagccatagatgcagcagaattgcatatcagtttgcatctatattatagatagagttaccgcaatatacttttacacaaatactccttagaattgtatacaccatataatctttttgtaaagtagtatgtatacacactctctttttagaagtatgactcatactagctcgtc

SEQ ID NO: 24187 - DNA, 655 bp, Sorghum bicolor
  Clone ID: 30932036
atctcgattctgaagtttcccaactcgtagtagccgccgccgccgccgcctcttcctctttcttcctcctcccgaccttcaggctttaccggagcagctagcgcctccttcgtcgagcaggggctgccgcccatgccgaacagagtcaagctccaccccttcgaatcatctccatgccaaagtccaagctccgcccctattgagcgggctgcgaacgccagagcctaagatccgccccctgccgagcagctcgcgaaggagtccaacgtcaccccgccactcaagatctagagtcgcctgcatcgtcctcgcatcaacggcgcctccttcctccttcctcctcgatccggcggcgcccactagcggtatggatctcgtaggccaagcgacggcttcctcctaagttctagcggtggtggcaacctctccatcttccatgtgagcggctccccatctccaatggtggcgcggcctgtcttacgcggaaggcgcctgactgcacgaaggacgcttgatggctgcggccatcgagatctagcgttgcatgcatcgtccctgacgcctaagattgcccgcgctcgtctcttccaaacagctcgcgctagccatgtgcgttgcctccgctagccgggtcacgctggctgcctctgcctgt

SEQ ID NO: 24188 - DNA, 611 bp, Sorghum bicolor
  unsure (1)..(611): unsure at all n locations
  Clone ID: 30932040
aaaaagctctgctgagctgcacttcttccctccacaaccttgctcttccttgttgtctggtctccaatccatgcgcccgccaacaaactactcttcttcttcttcttcttcttcttcttcttcttcttcttcttcttcttccccacatccgcagagcgagcgaggtagctagaccgccatggggtgcgcgagctccaaggctggcgacgacgtcgcggtggccgacgtctaccgcccgccgcccaccagcgtctccctcttcgacatcaccgccgtcgaggagccttggctcatcgccaagcagagcaaagccgctgatgacgacgacgacnacgaggatgaagagacgacgaccgatgacgaagaagaggacgacgacgagaagctgcagcccgccgccaagaccgtcgtgccgctcccgctcctcgacaagctcgagggctacgagctcgccccggcgtcgtggtccgaggtcagcaaggccctggaggacatgaagcccgtcctcgactccaagccgccgcctgctcctgttgctctcaagaagaagaaaaagaacaagaccaagaagaagaagaagaagcagcagcagccgcaacagccgacgacga

SEQ ID NO: 24189 - DNA, 653 bp, Sorghum bicolor
  Clone ID: 30932046
ggaatgcgttaggatgccttttacttcggttcaccccgcttgcgcctcgctcgcggggacgactgcgcggaccaccgccgccgccgtctccgcctccgcctccgccctacgctaggcgcccaggacttcgtcggaaccttcgcctggcacaagcaccacccagcagtttacagctgtgatctctggaggtgctcttcctattctttgtcggtgctttgatggtggcttgatggctagtaatatgcaggctcctgggccgcctcagcctcccaggcctcccatgatgggttctagtgcccagccacaaaatcttggaccaccaatgcctatgcagtttaggccagtggttccttcgcagcagcctcctcagttcatgccgccagcagcacagcagtttcgtcctgttggtcagcctatgccgggggctaacattggcatgcctgggcaaatgccacattttccacaacctgggcagcatttgcctcactcaaatcaaggtccacctgcatcacaaggggttcccatggtatatcagccagctagaccaatgtcatcagcacctatgcagccacagcaacaaactgcgtatcctgggggccatttgcccaccatgggtgcccctatgcagcccccgacctatacatatcaaccaa

SEQ ID NO: 24190 - DNA, 258 bp, Sorghum bicolor
  Clone ID: 30932078
aattaaaaaccggcaataaatcgcggaattcccaacgcccccgcattcaccgcggactccccaatccatccccacccctatccgccggcggcggcggcgcggttccgggccgcgcgcgatcggattggcgcgggctcggtttccccttgagcggcgcggattcgtgcccgatcggagggcggcaccggcgccttggggtgtgatctgctgcggccggcttcctcctgggaggggaggagtggaatggacggggaagcg

SEQ ID NO: 24191 - DNA, 664 bp, Sorghum bicolor
  Clone ID: 30932082
aaaaaaaaaaaaaaaagagatatacccaacgaaggcagctgttaacctaccttctcaggatttctcctgcagtgccatatctagtgaagatccaacacaagggctagcagatcctgtgaacagtaaagatgcacctatagtgaactctggtaaagttcatgtatcaagggagagtaatgacgatgagcggtcgaatggtttacgatccagggacaccagcattattagtcccaatgtctcaagaagaccggtgggccaatttaattcccggaatgaggttctggaggaaagtgtttcgcttaatgaaggaagtcaagacaaccaaagttttagtggcgctcctaagaagtttttaaagaagacatcacatgggagtgggacaaagaatactgaggaagagatttcaggtcccaagagtctctcttgttcaatgcagagggaaatcagaagtgttgaacctgcactgacgaaggagagaggaagcttctctcttttatccaagtctgtacatatgaaagcaaccagggttgaactagcttcagaaacagccttaaatcaattgtccagtgcaagtaaagtgataaaaaagatggctacacatcctacggacttgaagagggaacacatgcaagctaatgcagtacctgacaaatctaaaactgct

SEQ ID NO: 24192 - DNA, 642 bp, Sorghum bicolor
  Clone ID: 30932101
cttgatagcaattgacgtgtaattaattaaggcgcaaaggcgtgattaatcagaatgtcgtccaaatcctcacgcaaatctatcaagagcgccgtcaagaaggcgacgagaactagctggagtcctccaaaggagaagcatgtcaagagacttgttctggctactttcgctcgagaaagcattgaagatattattactcaattacacagacgatttacgaagaataattgggtggttattctcaaaactctgatggtgttccataaaatcatgcgtgaaggagatcagttctttatggagagcttgaagaataaggctcacgctttatttgctttacgcaattttacaggcaatcctagcaacgtgtatgtgatattcgtacgcaaatacgccaagtacctcgatgaaaaagtgagcgtgttccgcttgttaaatttgcagtttgaaaagaaccacgaagcatttaagaacgcctctgtcgatgcactgctcaaacaagtgcccaagttacaatcacaattcaacgctttgctcaactgcagactccgtgctcaatatatcggtggcaacacgttgattatcgctgcgctgatgatgatgttgcgtgacagtttgacggtctacccaatgctcaactctgga

SEQ ID NO: 24193 - DNA, 185 bp, Sorghum bicolor
  Clone ID: 30932114
agtatagtactgtaatagccaatgaaactcagcaggaacaaaatcccctgttccgttttcagctgaagccttttttttttttttacgcgttctacggactcaattcccttccctcccctctccgggctccggccctcaacagttcctcttcatcatcgcttcgattcgatcggattggtggcatc

SEQ ID NO: 24194 - DNA, 666 bp, Sorghum bicolor
  Clone ID: 30932116
ggcccctttcgccgccccccatcaaccccacccgtcggcggccatggagactctggcggcggcgcctcgccgtgccaagagaaggaagccggaggcacccgagagcccggaacaggaggctgaagcaaacatctcgccgctgccagcgacgagcgcacctgattccagtcctcctggagccggcagagacgtatccctcatccaagatccgccatctctggcgctccgcccctctcaacctcgacgtcggtgacctcttcaccatcgatgtcgtctcccccatcaaccgtgacggcggtgaacttggcaccatcggtgtcgtctcccgcatcctctccgctcaccggggcccctgccgccgctttcgcttcgccgcaaaacacctacaggaccaccccgccactgtggatgcttggctccggtcccccgccctcgacaacctccaagagattgactgctggatgcgcttattttcgccggtggtgttgcaaccgccacctccgccagcatctgccttccgcttctcgtcgtgcctttgcgtcgccactctcagccactgccacctctctgacgacgtcgcccaggcgcttcagttccccaagctcaagaagctcgcacttcaatgtgtcagcatttcggaggattccctgcatagcatcattgctg

SEQ ID NO: 24195 - DNA, 655 bp, Sorghum bicolor
  Clone ID: 30932118
tgtggccttttttttttttttttttaagtggagaataataagcaatataatgccacaacttgtatacagcttcacatgtttcattgtgacaaatgtctgtctcacaactatactgggaaaattttgctaagccttacagtcctaagttcatctagcccactccatgttcaggatagaagtataaacaaacaccacaagtttattctcgctcaccttcagcctaggaccatcagcaaccctagttgcctacatgagtatgagctttgacagagacgctcaggattaggagctgatggccaaaaaacactaatgctttacaatggtatgaaccctggttaaacacgggcaatgttcataggataagcaacttttcctcttgaacttttcatgctttggttgttgaatctgtgggcaatgaacctgttggtgaggggcatgtatcgagatcccgtttgccctttgatttcttcatcttcgctttgaaccttgatttagtcatcaaggtgtccactgtgtttgcaaagtttccaattgccattgcaaccagcaggatcccacagaccacaacctgccactcagggacgacaccagtatgagctgtgcgaagaagtaaaaatccgacataaccctcaaagccctgcaagagaaaaaggag

SEQ ID NO: 24196 - DNA, 627 bp, Sorghum bicolor
  Clone ID: 30932149
tggaccccgctacacggtcgctcaccacccaccaccgctgccatgctcctggcctcgtctccagctcgcgaaacgtagcttccagatcctctccctccatccaccgcaccgcattaccctgagatccaccccgcgagctcatttcagatccgcccatgcgcctcccggtccttttcgccctccagctggtcgccgtggcggcggcagcttcggtggccgaggccgcggcgacgctctcttcgaggatggtgcaccgtctgtccgacgaagcccggctggaggcgggccctcgtgcggggtggtggccgcagcgcggaagtgggcagtactaccgcgcgctggtgaggagcgatccccagcggcagaagcggcggctcgcgggcaagtaccagcttctctcgctctcaaagggcggcagcaccttctcccccggcaacgacttaggctggttatattacgcttgggtggatgttgggacgcctactacctcctttttggttgcattggatactggaagtgacctgttctgggtaccctgtgactgtatcgagtgtgcccctttggctggctaccgtggaaatctggtgctccgtcataaatggagcatctattatgcaggatagagat

SEQ ID NO: 24197 - DNA, 658 bp, Sorghum bicolor
  Clone ID: 30932162
acggttcccccactttctctctcggcgcccgcgtgcgctctctcccctctctatttctctggaggggcgacgagccgacgactgcgcgcccgccgcccgccgcccgccgacttacaccaggtgccgggtccttcaccggggacctcgccggcgacgagcacccaccggtgccggggacttcgccggcgacgagcacccacagttgccacccttatacctggtaaaagagggcagtttttgtgtgtgcaacagaacacttgcagaaagatgtgattcaagtgtagaaactgtgtgagaaggctaactttttttttcaaaggcaacgtcttttcggtggatctgtagaggactcaattctctgaaggagtgcactggtcaagatgcctgcactgagaatgaagaggatgtttgatgttgatgattttgctaatgagttcaacaccaggaacgtgaaatccgttaaagtttcacacttttatgtcagtggattggagcagtcagctgtgttgaattcgtcagataaagctcctcatgatgagtcagatccaaccattcaacttgctgaccaggatattagggcaacggaaccttctggcttgcatgatccgatcggaggacaatccatgctcaaggatttaacatccgatgaagtgataga

SEQ ID NO: 24198 - DNA, 612 bp, Sorghum bicolor
  Clone ID: 30932166
tcctctctccccactgcctcttcactccgcacgccgcgcaagcagcgcagacccggcaaaatggtgattgctcagaagacgaaggaggcggagatcaccgagcaggattcgctgcttctaacaaggaatttgctccggattgccatatacaacatcagctacatcagaggcctattccatgagaagtacttaaagatggtatactatccagggcaagcaaagatggttatactgttaaccagaaggctgatccaaaaacagtgcatataaagaaggaggccatcatgacagatgtaccaccaattgaagtaaccaaacacaacaatggggatctgctatatatgaaggcattatatcatgcacttcccatggattatgtgacaatagccaaacttcaaggaaagctggatggggaagccagccagaatatagtccgaaagttgattgacaagatggtgcaagatggatatgtaaagaattcagctaaccgaagactgggcaaagctgttattcattctgaatctaccaacagaaggctccttgagataaaaaagatactgcaagccaacaaaggcgaacagatggccattgacaccaatacagagcatgctg

SEQ ID NO: 24199 - DNA, 639 bp, Sorghum bicolor
  Clone ID: 30932178
atactgctgcgctcttcgtgaatcgccttctcctttctcaccgccacagccctcaggcgtccactccgacatcgattcgcgccgaccaccttccgccgtttcctcctcggccccagccatggccggcggcgatggcgatcggcaccgcgggccgaagcggcacaagtcgtcggcgccgtcgaaagcggccctggtggatgagagcgccgagttcgactacgctgatgacttcgacgatgatgctcacgacgcggatatggaggtgaagaagagggatttcacgaagcttgagttgaaggtggatcacgcgagccgtccgctctgggcgtgcgccgatggccgcatcttcctcgagaccttctcgccgctctacaaacaggcttacgatttcctcatcgccatcgcggagcctgtgtgcaggccagaatctatgcatgagtacaatctaactccccactcattgtatgctgcggtctcagtggggcttgagacaagcactatcattagtgtcttgagtaaactgtctaaaaccaagttgccccgcgaaataattgatttcatccacgcatcaactgctaactacgggaaagtgaagcttgtcttgaagaagaatcgatattttgtcgagtccccatttcc

SEQ ID NO: 24200 - DNA, 568 bp, Sorghum bicolor
  Clone ID: 30932199
ggaagagcatgtggtgcgtcgtgtacaaactgttaggtactagtgattggtcacttggtattggagtatgtaaagacttggaaggccatgagggggcgatgagcggtcaagagacgctgcaggagctagaggacggcgtcgaagccgtggagactgggctggagcatctgttcaggcatatagttcagagcagagttgctctgctcaacgtgcttaccttgtaaaacaaacacgtctcatagtgtgaatagattttgggtcagtgtcaggaatgactcttgtgaagaccaatttttattttctgagcataggccagttcttgtatctattgggtcaacgctctttcagacagcacatcgctcaggtagatagggaaaaaaaacccccacctttggaaccactttggttggcaaatggcaactggcaaatctgtgccacagatttcctttgaaatggtggagaatctatgaaacgatgatgtggcggtttcccaaagaattcctaggccttgtttagttccaaaatattttgcaaaatgtgaatggtaccaattttgttgtattgaaaa

SEQ ID NO: 24201 - DNA, 532 bp, Sorghum bicolor
  Clone ID: 30932205
cttcgcgcgccccgcgcaggggggccagccgctcagggtcctcgggatggagttcgacgacggcaccgtgctcgctgcgctctgcggggtcaccgtcatcgccatgctcttcaccagcgttggctggaacgtcgtcggctccgtcatgatcgggggcgcgctggtcagcgcgcacgccgcgctcaggacaacggacgacctcttcctcacggagcaggaggccgccggggacggcctggtggcagctggcatgagcgccgccggtcccatcttgcccacatatgtccgcattggttgattcgtgcagccgggtgggtgtggtattcatcatggtttgcagtctttatgcagttcagcaatcttgatgttattgcttgcagatagtagcaaattttccttgtaattaccatcacgatgtctaatattggttgtgggtgtgttaagcttttctatatttgtggtgaaacaagtgcaacgatcatgtgaaatcattgctggattccgattgtgtttggaatgatgatgttcgaat

SEQ ID NO: 24202 - DNA, 560 bp, Sorghum bicolor
  Clone ID: 30932212
tcccagaatgtagaactcatgctgcaggagaccagcacccaccctgatggcgggagccttgtggtgtttgcgactgtggatgtggatgccatccaagtgacaatgagtggcgaggacccttcctacatcccacttctccccctgggctttgccatcttcccggccaccaacccttcgccagcagcaaccagcacaagctccggcaatggcgaaagcagcccaggtaacacagatgagcccaccagtggctgcctcctcaccgtcggcatgcaggtgctagcaagcgcggtgccctcagctaagctgaatctctccagcatcactgcaatcaacagccatgtctgcaacgccatccaccagattacaaccgcactcaaaggccaaggagctggggtgagcggggttgaaccggtggctgctgctggctccgactaggaagagtgggaacagaggagagcagatccatgccgaccaaaatgccttccaagtccggttatttttgctaacaaacatatcgcaggtgcaagcgaggatttgacaagagcccgaaactaacacag

SEQ ID NO: 24203 - DNA, 593 bp, Sorghum bicolor
  Clone ID: 30932279
ctgttatgaatgcggaaacatctgttgccaaagtgggtttttttgggaatacatatcagaagctttggtgtttaacccatattgagacattaagtgtctgggactggattgacggggctagagagttgaatatagaagatgctcgttccttggccactgataggtggaaccttgaccatgttgactatttcgttgactgtcactattccatgccggatgaccggctatggttgattggtggcacagctgcagggacgttaggttactttcctgtaagaaatgatcacgcaggagcaataggttcagccgaagcaatccttgaaggaggccatacaggagttgttaggtccgtgtacccctctgcaggaatccatgagagccttgggcaaaacaggggcatctttggatggacaggaggtgaagatggttgtttgtgctgctggcgctctgatgaaatcgcagagataaacaaatcttggatctctagttcactagtgtgcaagcagcaaaagaaaaccaagaatcggcatcagccctactagccgctatggataccgtttgtaacgtttgacactgacaagggaaagcctggc

SEQ ID NO: 24204 - DNA, 646 bp, Sorghum bicolor
  Clone ID: 30932285
gttgattctgttttaagcattgctcaggctgtcttaggtggaactgtcacggtaccaaccctcactggaaatgttacagtcaaggttcgccaaggtacccagcctggagagaaggtcgtcctccggggcaaaggaataaaagcgaggaactcgccagtgtttgggaatcagtatgttcacttcaatatcagggttccaacggaggtgacccaacggcaacgggagctgatagaggagttcgataaagaggagtgcacagaccgggaaaaacttgcggctgcctctggatgaaattttggtgcaaccattcattggttatagcaccccccattagtttgatgccccccaatttttccaaaaaagtttgatgcccataaggccccaacccgctataaggtgctgtaggcaccaaaagcttattgtagcatttgacccttatatagcatctacctagtgtataatgtatacattacgcgctaaattattgtatcaatctatccattttatgtggaactaggacagcaaagatagtgaggcattttccctctttgtagaagccatggaagggttgccttcagtaacattcttttggggtgttgttgtgtgccagtatgaagagaaaagatggagcacgaggaaggttttg

SEQ ID NO: 24205 - DNA, 567 bp, Sorghum bicolor
  Clone ID: 30932301
gcaaacaaagcataggcgcatcttgtttcaggatcgcgagatgtgccttgccttggagtctgcagtgcaagaacaatgaagggcagagagtggatgggcttcaagcaagagggtatctgctgccatactcttctgcagttacaagaaggcatcagtcagtagttagtgcacaaacgctgagcttgtgtgtgtgtgtgtgtgtgtgtgtgttttttgacaaggctgagcttgtgtatgttgactagtggttaactacttcaaattgctcaccggatcagcaatctttgttgcgttgtaccactcttgtggtgttcgcaagctgatgactctacaagggtggtccggagagcttcatcctcagtttgtaccggctgcgatggacggtcaccaagctgcaccccatagaggccatccaaaacggtagaagagtttctaccattcagggctcccatctgtcctaatcctatgtaaggcgatgaaacgctgcaatccacttgtgctctcgagccctgcagataagatgcagttgatttcctttttgagcaacaactacgctcgttctctctc

SEQ ID NO: 24206 - DNA, 524 bp, Sorghum bicolor
  Clone ID: 30932311
taattgcacagtttgagagtaatttgtaaaatgaattttttgagtctagttagtttataattggacaataattaacaaatataaacgaaagtgttacaatgtccaaaatccaaaaagtttttgaatctaaacaaggcctaaaattgtagtagtgctattcatagataagtgttctttcctctattcttacgaaataaattaggaggccgaaaaagctatattttgtggtttctccggatccaactcctctgtatagaatcagagtagagggagtcctgccaaataatgatctatagacatccatataatgtgatttgttcttttttgcataggttggtttcaggttgtaattttgtagagataactatgtatatagttccataattattcgtctcttggacaaggctcaagttatgctttagatataacttctaaacattgtattcctaagacagagacgacatgctgcataatgtgtttttcttgatttcttttattcattatggaactagcagaaagagtat

SEQ ID NO: 24207 - DNA, 752 bp, Sorghum bicolor
  Clone ID: 30932341
tgcacgtgatttcttccccgctcgctccctcccgtccactcgcgcatcacttttccccatcagccgccgctagggttcgcagcacgccgccaatccgccgctcgactttcttgtgcgggtgtccggcgactcccaggaaggtgcgacctatgacccctgcaaatcgccttgcgaggcgcgacccttggtgccacgcgcgtccagcaattcccacggcttggtgcgacctctggctcggcgactctcccatcgaagatggtgtttaccgatgacgaagatgattttcttgagcaatggtgggaggaagaagaatcggatgatgatgatttggttgccctgctggttcaatgcctggtcgtcaaacggtgccaagagacatgcatgctggtaacttgcgcattgttgcagattattttgcggacccaccaatttacaatgataaattctttcggaggagatttagaatgtctaaaccattgtttctgagaattgtccaaggagtcgaggcacatgatcactattttaggcaaaggccaaatgcagtaggtttgcttggagcaactgccctacagaaagtggttggagcttttaggatgttagcttatgatgttcctgcagattccatggatgaggttgtgagaattgcagagagcactatgattgaggccttcaaacactttgttcaagcagtggttgatgttttcagtgagcaatacttgagggcacccatttgtattttccaattattattt

SEQ ID NO: 24208 - DNA, 550 bp, Sorghum bicolor
  Clone ID: 30932343
ccgccgggccagaagcaagtcgggcggagagatgccgagcgatcgccctcgccgccgggccctccttccgctcaacctgccccggcaaatcccatactcccgggcgctgcagcagcgcctcttcctcgtcgcgcagcgcctcagccgctcctcgtccccatctgccatccgccgcggcctcgaccagctccacgcgcagctcctcctcaatggcttcacccacaagcgcttcctcctcgcgaagctcctctccctcgccgccgccgccgccgacctcccccgcgcagagtcgctcttcctcctctccgtaccccactccccggcgtcccccaccctcgccaaccttctcctccgcgccgccgccgcgtcaggcgccacgcccggcgccctgctcgcgttcttctcccgcctcgtgggctgccacgggctgcggcccaacgcattctctttctccaccctcctcgctgctatcgcccccgcgggcgccggagcgctcccccacggccgcgccctccacgtccgcgcgctcgcgagcgggatgctcgccccg

SEQ ID NO: 24209 - DNA, 264 bp, Sorghum bicolor
  Clone ID: 30932345
aaccaccacgccgccgccgctcgccgcccacttctctcccacctcccctccactctttgcttctcgcgcaggggttagaatagaatccccatggcgctgtcgtccgagatccgcttcggccaccagatccccctgtcccactccgacaccgacgactcctacgaggaggaggaagaagaagaggaggaagaggaagaagaagaggaggaggaggagttcgagggggaggaggaggagatggatgaggtgacggtttcgtctccg

SEQ ID NO: 24210 - DNA, 642 bp, Sorghum bicolor
  Clone ID: 30932347
aaccacctcaaaaaactcaggggcagtgcaaagcatcggcacgaagcttaactagacgtgcattgctaccaatatggcactccactccgccgccgctctctcggccctcctgctgctctccttctcaggccttacgctctccgacgagacgccgtccacgccggtgtcgccgtcggcggcttgcaacgccacgacggacccgaccttctgccggtccgtcctcccgccgcggggcaagggggacctctacacgtacggccgcttctcggtggccgggtccctggcgggcgcgcgcaagttcgccgccgtcgtggaccggtacctcgcgcgacaccggcacctctcctcgagcgccatcggcgcgctgcgggactgccagctcatggcggagctgaacgtggacttcctgacggccgccggcgcgacgatcaagagcacggacaccctcctggacccgcaggccgacgacgtgcacacgctgctgtcggcgatcctgaccaaccagcagacgtgcttcgacggcctgcaggccgcgtctgggtcgtggtccgaccgcggcggcctcgacgcgcccatcgccaacggcaccaagctctacagcctctcgctgtcgctcttcaccagggcgtgggtgccgacggc

SEQ ID NO: 24211 - DNA, 611 bp, Sorghum bicolor
  Clone ID: 30932349
tctacaatgcaagcttgaagaggagagttctgtcgagggttgagtgctttctgtcttcagatccaataaacaatggttggttgaaaccaaggaggtcagagaacttcactagtttggagagtgcatgtgtccagccagaatacaaactaccagtcagaaaacgtgctgactgtaaagcagagcagtatgaaattacaggatcacctttgagctcttcaaatgttcctgctgatgttccctggtggcaggagttcccaaggcgctggacgatcgttctcctctgcttctttgcgttccttctttgcaatatggaccgtgtcaatatgagcattgcaatccttccaatgtcgtcagagttcagctggaatccagcaaccgttggtctaatccaatcatctttcttttggggttacctcctcacacagattcttggaggtatttgggctgacaggtttggtggtaaggtcgtactaggatttggggttgtatggtggtcacttgcaacagttcttacaccccttgctgccaagattggacttccatgcttacttactgtgcgtgccttcatggggataggcgagggtgttgccatgcctgggtttctcacctct

SEQ ID NO: 24212 - DNA, 529 bp, Sorghum bicolor
  Clone ID: 30932361
aacgtctcgacactttcgttccctctccctccatccctcgtctctccctgttcccgccgccatttcgaacccacctccgatggccaccgccgaaggcgacgccgactggtccctgccctcccccaccgacctcgatgacaacgggttcccggatctaccctgctcccccgccgcctctagcagctgcttcgcggaggacttctacagcagcggcaccgactggtcctccctgcgtgcccctccgccgctgcgcccgcccggaagggcacccggtgtgaaggagaaggagatgggaggcggttcgctcgtgcagagcagcctcctccaggcgtgggggatcgagaagccgcggcgggaggctggggattcatcgcttgtgcagaggagcctcttccaggcgtgggggatcgagaggccaccgagggaggggctcggggctgggcattcatccccctccccctcccgttccggttcttggttgggaaggaagcggaggcgaggaagcaccgaggaggagcgggtggcgccc

SEQ ID NO: 24213 - DNA, 605 bp, Sorghum bicolor
  Clone ID: 30932376
ggatccctcgttcttgccccccgccccccatgccgccggcctaaccgaccagccccatggccgccgccaccgccattgccgcggcgcttctccgccgctccaactccaccacgcaccaccggctcatactccctctcctctctcacctccaccgccccttgccgcaacccccgtcttccccatggctcccaccccagcaccgcttcttctccaccggcgacacagccggcggcaatcccacccggaaaccgccgccatctcttgacccaaagcagctatggcgcgagctatccgcctgggaccccgccgccggctcctcccgcctgccgaaggccacgtgggacgccgtggtgggcctcgtccgcggcttcgccaagagcccggccatgtccgaccaggcgctcgcgctctacgtcccctcgtccgccttcccctcctacgcccggcgcttccgcgcgttcctcctcccgcggctctcccgggagtccgcggcgcacctcctctcgctcccggcggaggacgcgcacgagctcctcctcccggccttcgcggagttctgcgtcgccaacttcgcggacgagctgaggcagcacaggtcggtcatg

SEQ ID NO: 24214 - DNA, 490 bp, Sorghum bicolor
  unsure (1)..(490): unsure at all n locations
  Clone ID: 30932385
gtcgaaacctcnggacaagcccctgcaggcgcatcgcaacagtgcaaggcgcggggcgcgcagcaggcagcacgggtcgtcgaactcgtacggtgccgcgttaagaaacaacgaaagatcatggcgtgccagcagctgcgatcaaccagcctgcccgtgaggccgcacgccctggtgcaagaggtcgaggacgagctgcagcggatccggtccgacgctgcagcgtcggcgtcggcgccggcaccgtcgtcgtcgtcgtcgctcgcggtgcggctcggcgacgcgtacggccgcatcgaggagctcgtgcggctccacctccacggcggcggccgcgacgcgcacgcactgtcgagcgcgcactggagaggcgccgtggaggcggagatggacgcgtcggtggcgctgctggacctgtgccagcgcgccagggacgccgtcgcgtccgcgaagcagcacgtgcgcgcggcgcggcgcgcggtccggaggc

SEQ ID NO: 24215 - DNA, 488 bp, Sorghum bicolor
  Clone ID: 30932407
ctactggacttccatcgctccgtccgccccccattccctcctcctcctcctccgcctctccgatccctctccttctcttccttcctccagagctttccctttcctgcacctctcgctaaatcctcttcctctcctcctgtactcgccctgccatgcttcgccgtggattttaactgcttgcttctgtttggaggaacacaggcatcaggccagccagggacgacgagagtaagaggaggagggggttctgcatttctttcttccccctctcggttgatctgctggccggtcgaggaaggaaggaaggaaggaaagaaggaaggatgtttggggccacacgctgggtatccctgctccagcgccaatgtgagcgccttgccagtgagctcgcccgcaacatcgccgaccttggagtgatccgcaccccagaggcgagaacaaatatgatgaagctgtcacaacggatgataactactttctctgccaac

SEQ ID NO: 24216 - DNA, 546 bp, Sorghum bicolor
  Clone ID: 30932415
aaaaaaaaaaaaaaaaaaaaacccccatccgcgacgcgccgcctcctctgctcgcgagtcgcgactcgcacgcgctccctccgcgacgccgccgtccgctcgccggcgacgagcagccgcctgagcaggcaagcatccgtcccatccgccggcttccctgctcccatccgacgagcatcctctcagggacggcgcgaccctccctggcttccgtgctctccgtccgccggcaggcaaagcacccgtccgctcgtctccagcctgctcgccactcgccagtcgcccctgtccgcccgagcaggcgagcactcgtccgagcaggcgagcactgtccgcccgtccgcccctgctcgccactcgccagtcgccatcgccaacgccaagtctccagcctgagcctgccggatcggggtcgacctccagtgagaaattgacgtatccgcgtatccgtatccttccgataccgatacgcgtatccgtatccgtgtaacatagtacacggctctctcgaggctcgtttgctttctctcgctgtcccatggcggc

SEQ ID NO: 24217 - DNA, 667 bp, Sorghum bicolor
  Clone ID: 30932421
gcctactgaagcactactaatcaattaaccgtttcgtccacgcgcggctcccgcgcgcgcccaccttcatgatatacacggcggcggcagcagctacacatccatcatctcccgccatcctccatctcttctcatctctctccctcatttaccacgagctagccacctagctagcgtagcttagctatatccggccgtcgacattacattgacgatggcccacgccgccgtggcagcgctcgccctgctcgtcttcttcagcgcgcaagcgcgggacgctggcgtccatgtcgtggacgcggcggcggcgacgctgtcgcaggggcagtcgctgggcgccggcgacaagctggtgtcggcaggcggcaccttcgagctggccttcttcacgccgaccggggccgccgacccgtcgcggcggtacctgggcgtcatgtacgcgcagtccaacgagcagaccgtgccgtgggtggccaaccgcgacgcgcccgtcagcgccggctcgtcgtactcggccaccgtcacggacgccggcgagctgcaggtgcttgagggtgaacgcgtggtctggcgcaccaactcggcgacgacggcctccttttcctcaccggcgaacgtgacgctcaccctcctcgacacggggaacctccagctgaccgcgggcgca

SEQ ID NO: 24218 - DNA, 579 bp, Sorghum bicolor
  Clone ID: 30932431
acgcgttcccacgggtcgtttaacggcggcggctgctttggagttgcgaccgccggcggcggcggcgagcagggagcaacatatcaggcctccgccctccgccctcgctgagcgacggtaaaacctcgcgatgccggccgtcttttgtcgttgtataataaacgctgctctcctcaattctgctttcgccggcaccgctgcgaacctgtcggcgggtttggtcgccgacctcagccagggccagagcagattgaaatcgattagcaaaatcaatccacccgtatcatccacacacaacccaaacgtatccgtcggatggcggtggggcctgattccgccggcagtgcagccacatccctgatgacatactcttttgtaaaattctcatactactccctgtgaaatgtcttgtgcgcttccagtcagtatgcaagagttggcgcagaactatactcagtactcattttacccgctgccacctggagcattctaggactaggttgtcaatggtggttgttccccgagggtaccagaaggactataggaacagtagcattgagggtgtcagtttctacagtt

SEQ ID NO: 24219 - DNA, 668 bp, Sorghum bicolor
  Clone ID: 30932439
atcatccctcagtccgccctctcacagacgaccgcctctcttcccgaggccacgtaattatttctggggctcaacatcttcgcgacgccaggactccgtgaccgacggcctccacgccagggcgccgccagggatccacgccgggccaccgccagggtaacgggcacggccagggcgcgacgcgggccacgctagagggtcgcgggggctcgcggccagggttcaacatcggagcgccgccgccaggactccgcgctcggcggcctccttttcctctccccgacaccgcgactcctcctctcccagtcgacgcgcctgccactggtacatgtgccgtgcaggcgtaagaccgcgcgaggaaggccgagcgccgtgccagccggagcagtggcggtgaggtaggtagccggcgtggccagctcgacggcggcatggccagccatggcgacctccaccttctacccgcctcgcccttccagaggctttagcaagccaacacaagcaggtagtcgcgttccccttcaacccaaaccctagctcgactagcccctccctgggattccaatggatttttagattcttctctactgtcgggaagtttgtcaataagcaaggtgctagagatccattgctcttgctcgtgctcgcttgaacacctttgagtcttg

SEQ ID NO: 24220 - DNA, 637 bp, Sorghum bicolor
  Clone ID: 30932445
ggacattaaggttgcagcagttaaggccttctcttttggggaacaaaagactcagtgcttggatgacattgcaataatgacaggaggtacactagtgagggatgacatgggacatgaactagagatggcaggaaaagaggttcttggttttgcttctaaggttgtaataacgaaagattcaacgctaattgttaccgatggaagcaatcgtcaagcagttgaggaaagggttactatgataaaaggacaaattgagaactctaaggaaaggtacaacaagaagatattgggtgagaggatagcaaggttatgtggtgcaattgcaatcatccaggttggtgctcaaacaatcattgagatgaaagataagaagctgaggattgaagatgcactcaacgcaacaagggcagctattgaggaaggtgttgtagttggtggtggatgtagcctattaagactgtcagagaagattgacgcaatcaaggaatcatcattggataatatagagcaggaggttggtgctgacatcttcaaacaagccttgagttaccctacctctctaatagcaaacaatgcaggggtgaatggcgactttgtcattaaaaaggtttagtatttgcagatagccctatctgtt

SEQ ID NO: 24221 - DNA, 531 bp, Sorghum bicolor
  Clone ID: 30932472
aaaaaaaaaaccgagccaagcgcggacggcggacgcgcccacgccgccgcacgcctctcctccgatctcgcggctccgctcctgcctcctgcttccggcgaccggcgtcccgcctccggcctccctcatcttgctcggcgcctcccctgctgctcgcagcctcgcgccctcgcctctggccaggcccctgctgcctcgaccccagtccccagggccgaccgcgtcctcgccccagggcggcagggccgaccggcgaccgcgtcctcacccagacccagacgcgctcgcggctcgggcctcggctgccggagtgccggcagaggcgcagagctcggaggccagacgtgcccgcccgggtctgtccgccttcggcctgtccctgcgtgggcgtggctgtgaagccgccaggggcaggggattctgggaacgtgaagtttgtagttcgtacgggagcacaagcagaggcgaccactatttgctacctgcttgggtaggattgtgtgatggatgttcacggagaggcggatgatg

SEQ ID NO: 24222 - DNA, 572 bp, Sorghum bicolor
  Clone ID: 30932480
acaaagccccactctctgtgcctgctacccgctgcaaagtagggttcccaccgggccaccgcccgcctccacccccatggcgcgcgccgccgcctccaggctcgccgccgcggcgagctcttcctctacggtgagctccctcacttctcctcatccaatcccgaattccacggctaaccccttcacctccgttgccagcgtgagttgttcgcccgtcacctcgccggcgctgccgcctcggcatggaccgcaccatcgcggctgcctgaaccagggagggagcggcggagcccgagctggtggtgtccgagcaggtcgttccatgccacaaggcgggtgtatgcaagggatttctatgatgtgcttggagtaagcaaggatgcttctgcaccggatataaagaaggcatattatgcgctcgcaaagaagttccatcctgatactaataaagatgatgctgatgcagaaaaaaaatttcaagaagttaaccgtgcctatgaggttttgaaggatgatgataagcgtgaaatatatgatcagcttggaccagaagcatacgagcgtcaagcatc

SEQ ID NO: 24223 - DNA, 716 bp, Sorghum bicolor
  Clone ID: 30932496
gccagtccacaaccataaaacaaggtgagttacatattatacacatcattttgtttcaaagtaactaaatattaattgtaaaattttatactgggggtgcagctattcaaataaatacaggcgaaacagctctttacacagttcaaagtaactaatattaattgaaaaattatagaatgggggtgcagctatctcctacattgaaaataaaaaatttaaaacaaacgatcagttcatgttctctgttttgttttcggatcagtatatagttttgttctctataaatttgcggccaaaacagacatgctaattgctttaatttatggtcttttctttgattcttcgtttcacatgctgccacctagcagtcactattttcctttgaatcagcgggaaaactattagatttattgtattggtttttttctgttcccaaaagtatatttcctcactatgttcaagtgttctgttaacagcatgactaaaatgcgggagttggagagaaattgacagtacttattacaactcaaaaattataggatatatgcaagtgagacagttgtagcttacaactattctgtagatctccagtgacaataagcatgcaacattcttcttttgttggcctgaaaaaattagaaaaaatacttgaacatattgtttaatatcaagggatagtccgtcattgtattcactttactgtaacttgaacaaat

SEQ ID NO: 24224 - DNA, 439 bp, Sorghum bicolor
  Clone ID: 30932498
aaggcagcaaaattggttttgaatatcaatgaccccactgaggggccacagaattgcaagaaaattgacttgaatgggttcaactggccctaagaagagttagaaaagagactgcaaattaaatttgacttgatttatcaagagtgacatggttataagcttgagattggttttttttgccaagatagcagcaaagagaggaagtgaacccgaatgagtttttcagaagaacagcagcattgacatatcctccatggcaggccctagttgcccttgggaacaggggtgctgtcggcccatcacagttcagtgaaataagtgatggaattaccaataagtaggtcatgtagatcggtagagtgtatttgagagaatcgagtgttttccggctatcccttattgtgattttgtcccaacatataaatacaaagattttttc

SEQ ID NO: 24225 - DNA, 652 bp, Sorghum bicolor
  Clone ID: 30932508
tccccttagtagtccctataccggtcatgtttcttggattatttacaagcggtattcaagctcttatttttgcaacgttagccgcagcctatataggtgaatccatggaaggtcatcattgaattaactagtttttgaaatagtctttttttttagcttagcccaattcatgcatgattccggataatcctcttggttggaaaactaaatagttcgaaaggcgtatgaatatacaacctagagttgtaggagagagaatagactatattatggaagaggtaaaatatatatgcattcaggggggcggaatctggttagatctatatccttaatgcctataagacagtcatcttttgtgtggctttctaaggaatgattttagaatcggattcaatagaaaatgagaaaatacgcaaacaaaatagaagaaacaaatgtatatgggattttttttattcctaagttagattcattatctaatccgatatatagaattcccttctatatggaactggattccatatcaagttctatgcagcatattgttatcaattgtatatcttgatttgattcctattggatttggattagttcgatttcaataggggttcttcagagtaaaaaaaaggatggaataaaagagtgattggtg

SEQ ID NO: 24226 - DNA, 666 bp, Sorghum bicolor
  Clone ID: 30932516
tttggagggaaacttcatatgggttatatgcttatacgtgagagattgtctgaactgcaggaagaaaagaacaaaaaacggaagttagaccaagctgagtatgacagaaggtccagggaaaggagcggggaacgtgccagggcttcgagcagggatcgctacagaggagaccacagcagcagccgcgacagggactatgaccgcagaagaagccatgatcggtaccatgacagggagagagaacgagattccgggcggtctcgtagttatgattccagaagtcaccgcaggtcacgttcaccaaggggaagttctagggattatgatcgatctgggcgttatgaacgacgagatcggtactaggagtaaggaagcctccttgaagtttagggagctagattgcattgccccagtgtttctgttcgggaattctaacagggggcttaggtccaactggagaaaggcatcagctctttgcattataacggatagaatctgacataatctatgctaatcatattgttatgctagctggtgtttatcgtaaacagaatgttacaccatgtactccctcagttccaaattgtattttaccatgtatatgacataatgtatatttagatatatgtagcaaaagcatagtctagaaaagctagaatgacttgc

SEQ ID NO: 24227 - DNA, 465 bp, Sorghum bicolor
  Clone ID: 30932520
cctggggtaccgttgcttcccattatctctgtttttttcaacatggtcctttttgctcagctacatgaagaagcttggtatagatttgtcatccttagtttcatcgctttgggagtttatgctggctatggtcagtacaatgctgttccttccagctcagaaaactttattattggttaccacggcattcctattgaggccccatgagcagacgagttatggtcaccctccaagttttttgaaaatattgtacaataccatcgtcaccgaagttgggccctgtttaactattgcacagtgcatactctgtacttacgctttgtactcctatgtagacagtgaattttttaccctgtagaatgagatgttgtagacttgtagtgtccactataccattcgtcaaggagcattacaagtgggtagcccttgtaagaaataaatgaaaataaagaactgcagatgcat

SEQ ID NO: 24228 - DNA, 630 bp, Sorghum bicolor
  Clone ID: 30932542
aagagctttgttgttgctagttcatccaatgatcgtactatcaagacttgggatctacagacaggtttctgcaaaagcaccataatgtctgcaagcaaccccaactcactagctttcattgatggtgacatcatttgttcgggccatagggatggaaatcttcggctatgggatgtccgtagtgggaaatgcactacacagatagctgctcatctagatgtcacctcggtctgcgtgtcacggagcaaaaattttattcttacaagtgggagagataatgtgcacaacctttttgatgttagaacattggagatttgtggaacattcagggccatgggtaacaaagtggtgggcagctggagcaaaccttgtattagccctgatgaaaattgcatcgctgctggttcttctgatggatctgtttacatatggtcgagactgaagaatggaacaccaaccatcctagagggtcattcttcacctgttctcgcaagtgcatggtgcggactaggacctcttgctacctcggacaggaatcatatttatctctggtcttgagagatgtacaattttataaaggcatcccatccaagatctggacactggagggtttcacttcatcagtatgct

SEQ ID NO: 24229 - DNA, 594 bp, Sorghum bicolor
  Clone ID: 30932564
ttcagtggttcacgacaagaagtatagctcaggcttgtgggctgtcaaggcaaagcttatcgaagtaactgggaaggccctggatgctgttggctatggcacagtggttctcccagcatcatctagagttcatctcttgaagacatggcttccttatattcaaatgacaaaacctttgctagatgaaaatagcaaggatgaaacatctctgcagatggattcagacatgtgtcagaatattgagagtgcaatagtctcgatggtgttagcattgccatctgatgatcaggctgatatcctgtcagagtggatgaagaatgcagagcagttcaggtaccctgatctcaccgaggcatttgaggtgtggtgttatcgcactaaaacagcaaagagaaggcttgtgggaggactaaatggatctagcaaccccacagttagcttgtaaagctactgttaatttgatctttttgttgtagcctctgatcagctaaactagccggttggtaccaagtatatgccaactatatattcccattgttgtatgttgtaaagcaactgctcatgttttataaactttagttttattgcagtgtc

SEQ ID NO: 24230 - DNA, 639 bp, Sorghum bicolor
  Clone ID: 30932607
cgtgtgttgatgtaaaacatgtggtgatgttgcggcttctgaagatgaatggttgaacaaatgaacagtgcagctttcatgtttgtcatctctctattattttttcggatttctgacgaacggggcatcatgactgaggttagagaagcaaatccaaacagggatcaagttcactgttcaccgagggagaagcaaatcgagcagctgattggcctcggtagagcagcgcacgagtccgcggaacggaacgggcgctgttgactgttgagcgcttccgccccgcgtgggtgggcataggccatttggcttcggcactcgactgccgaatgttactactctgctggcgtctacacggttcaagcagtcggacatgtcatcaacaaaacagacattcaagctcagattgcaaagccaagagttagactgattctgtgaaacgcattactgtaattccggtttgtttacattgggggccaaaggacttgtgcttgaaactgagtaatatgtgcaatgggctagagtttgcgtaaatgtaaatgacaggagtgaattctttaaaagtttccaagggttgagacagggagaccctctttcaactctactattcaatatagcagcagatgttctaagtgttttgct

SEQ ID NO: 24231 - DNA, 619 bp, Sorghum bicolor
  Clone ID: 30932625
ttaaagttgtaagattgacaagggcattgagcaatgtcaagactctagctgtcacatcatattatattaatcttgatacggtcattgagttgatgaaatgctttccatgtctcgagaagttgtacttgtacataaagtcttgtatttcagggaaaatgaataggaatcggtggtgttggaatcgcaatatttcaggagaaatgaattggtggcgtcgtaaacatagggatttcattaaaagctctgatatacatctcaagaaaatagtgatgacatatcgaggcatcagatcacaaatcaactttgcgtcattctttctactgaatgcgagagagttagagttaatgaggctcgaagttgtagccagtgattacaatgacgctttttttgcagaacaacatagaatgcttcagatggagaaaagggcctcgagaggtgcacggttacattttacaaacaaaatttgtacccatggtatacatgttaatcatgttcgtgatttgtctgtagcagatcccttcgaatgtagatggtagaatttgattaggtctttcaccttggtgttgccactcatttggtatttgtcggagcaactatttctcatgaattgtagtgcttg

SEQ ID NO: 24232 - DNA, 458 bp, Sorghum bicolor
  Clone ID: 30932639
gtcccacctgcaaagatttcaaaccagcgagcaagaagatggagctgtggcaagcaccaccagtactcgtcgtgcacttgaaacgattcgccttcagtggcatgtggcgcagcaagctcgatgatgcgattgacttcccgctgcgtggactggacctgtcgggctacgtgcaggaccacaacgtgctgcaactgagtgctgaagctgcactgcacgaagtaccaccgatctacgacctgtttgccgtggctaatcactatggtggtatgggcggtggtcactacacagccatggcatatcattcagagttgggccagtggtaccattatgatgacgctagtgtgcagcccattgcactggaagatgttaacaagagtgttgtatctcctgctgcttatattttgttttacaaacgccgtgagatgcacgattaaatgtaaataataatgagagtttcc

SEQ ID NO: 24233 - DNA, 315 bp, Sorghum bicolor
  Clone ID: 30932647
ttgtagcagcagtgtcaatcgctgcaattggttattggtatggcaggaagccccgcaggtggtgaggatttggggcaatttcctttggtttgccgtgccgccctgttagtggaatgtttgggatgagttttattggctgttaattgaagcaaagttgtatcccccatgtatgaaagtatagtttgtggcaaatgtatacagaaacccagatcccttcatgtattatttagtgaaaccaaaggctgtttttaactcagtgccccttttgttgtaaaactgcaactttttcctgaatgagatccataattttgtggc

SEQ ID NO: 24234 - DNA, 681 bp, Sorghum bicolor
  Clone ID: 30932649
gctactggtgaaaaggacattgtgtgctatgggctgtttgcttgcatacctggtctgggtgcgttgcctgtaccaggcaacttttcagtccaccaagcaaaacaccaatatctaatgtttactgtttgtacataatgctaatgcttgggttcaacaattttattgacttctctttgaagaatatgcaagtcacttcaatttcaatgaaagatatgtggattcacagattcaactgaccatatgacaccgatacagcatgcagtagtcaactatatcatatttgtcatgatatgagaattgttaactttgccatattgttcatatgaccatattgttattcagcagttatgtggctaatatttgagttatttgttatcagcacatgttgtttttcttaccatgttgttatctggaatgaaaggaatctgtggtctttatgaaaggaaaatcaggaatatcaacccgatggtcgggaatttgacttatgatatcagtgacctgtacaacttcatcgatggcctgactgacataagtgcactggtgtgagtgcatgtttctcgactgtcaaagcttttaatcaggaaggtgggacaactaatcatattcatatgacgttcttgaatttacacgctatgctttccttgcaggtacgaagattcacttcacgctttcctgccatat

SEQ ID NO: 24235 - DNA, 583 bp, Sorghum bicolor
  Clone ID: 30932688
tcagctgttggaacaccacagctcttgtacataacactagcacagttatatatacacacccactatatacagacatggtgacgcgtacagcactgcatatagcactctgggtgttggtggtgagtcacgcggtactcaacaaaactctcacgcagatcaccctgatcgacgatgtcaagcgcggcacagagcacgtgattgagctcggtgaccaatcagcgcccagtgagcacgtgatcgaacagaacaacagcacgcaactcaatgccacagtgcttggaaatttaacttcgttgtgtattcgctgttctcctggcgcttattctactgcgaattgcaccaatacacgactgatcaaatccgctgctcgtgtagagggcacgtgtgcagcaggctattgcatgatgccgctcaactgctcgctctgtccactaggcacctataataaccagtacaatgcctctgcgtgtctcgcgtgcagtgcaggcagctatgcagatcgcgcaggttcactcaactgcaccgagtgtcgcgcagggtcctatgaatcgcgcggtggtagtgcacgctgtcagtcgtgtgg

SEQ ID NO: 24236 - DNA, 599 bp, Sorghum bicolor
  Clone ID: 30932698
ctacgtcatggcccgccgcatctaagaggcagcaagaaggggggcggatggggcgcgcgttcgtgtacgtgatcctgggcggcggcgtggccgcgggctacgccgtgctcgagttcgcccgccgcggagggtactctcgcggagagctctgcatcatctccgaagaggccgttgctccttatgaacgtcctgcactaagcaaaggctatttactcccagaaggtgctgctcgccttccaggatttcatacttgcgttggtgctaatgatgaattattgacaacaaaatggtacaaagaacaaggcattgaattagttcttggaacaaaagtaatttctgctgatgtgaggcgcaagacattgcttacaggcactggtgaaactatcagctacaaaactctaattattgcgacaggtgctcgggctttgaagctacaagaatttggaatacaaggttcagatgcttcaaacctatgttatttgcgcaacatcgatgatgcggataagttggtgagtgcgatgaaatcatgtcctggcggaaatgctgttgtcattggtggtggctacattggaatggagtgtgcagcggcattggttact

SEQ ID NO: 24237 - DNA, 662 bp, Sorghum bicolor
  Clone ID: 30932725
cccaatcccatatccatcttcctcctcggaagtccgattggccagacggccccgattcactgcggccgctccgtctcgccctcttcgcaagggaaaaccctaggcaaggggacgggagcgcagtcccacgcacgtcgacatggacgccatccggaagcagctcgaccagctcatgggcgccaaccgcaacggcgacgtgcgggaggtcagccgcaagtactacgatcgcgacgtctgccgcctctacctcgccggcctctgcccccacgacctcttccagcttaccaagatggacatggggccgtgcccgaagctgcactcgctgcaactgcgcaaagaatatgaagaagccaaagccaaaggtacagataactatgaccgtgaattggaagaaaccattgaaagactaattgtcgagtgtgaaaggaagattcagagagcccttaaacgtttggaggaggaggatgctaaggcagctattgctatttctgtcactgaggttacacagaccaaagaagtaatggagttatccaaacaaattaggcagaagatgaaggatattgatgcttttgatcttgagggtaacaccgagggaaaaatccgggccaatgaagaacttgacaagctaaaagaacaaagggcagaagagcaggcaaagatgt

SEQ ID NO: 24238 - DNA, 688 bp, Sorghum bicolor
  Clone ID: 30932730
aagtcgcgacgccaccagctccccatctcctcagacgccatggaggaagcccacggccacaggccctcttccaccgccggccgccccttcctctctggcctctgcgccgcgacgccggcccaggtgttacaatcagttttgttcttgctggagctgcgtgtgtgctcaatgcattgtgctacgctgaactcgcatctcggttccctgctgtggttgggggagcatacttgtacacatatgcagcattcaatgagatcaccgccttcttggtcttcactcagttgatggtggattaccatatcggtgcagcaagcattgctcgtagcttagcaagctactttatccaattcttggagctaatcccgttcttgaagggccaaattccaagctggataggtcatggggaggagttttttggtggtgtcatatcaattaatatattggcccccattcttctcatcatcttaacagcgattctctgccgtggtgtcaaagagtcatcagcagtgaacacgtttatgacaacattgaagataatcattgttatagtcgttgtatttgctggtgtttttgaggtggatgtatcaaactggtcaccatttatgccaaatggtttcaaatctgtagtgactggagccacagtagtcttttttgcatatgttggatttgatgcggtcgctaattctgc

SEQ ID NO: 24239 - DNA, 600 bp, Sorghum bicolor
  Clone ID: 30932745
aaaatttttctgaactaaacaaggccttagattcgtccgagaatccggccgagtatccaaccatctctgcctcctctgctcctccacgccggcagcgtcagcgacgacttcctccgcctccctcggtccctcctccctccccatctccccctccctctttggctcgctcgctttgtcacccacctcctgcctgcgacggggaggccggccgccgttccgatccccaacccatctgcgccgtcgacctcagaggaggaagagcagacatgaagctgctgccgagggaggcggacaagctggcgctgcacaatgccggcttcctcgcgcagaagcggctcgcacggggcctccgcctcaactacaccgaggccgtcgcgctcatcgccgcgcagattcttgagcttattcgcgatggagacaaaaccgtgacagacctcatggacttggggaaacagctcttgggcaggagacaagttcttccagctgttccataccttttacatactgtacaggttgaaggaacatttgtggatggaacaaaactagttactgtacatgaccctatttccttggatgacggaaatttggagctagcattgc

SEQ ID NO: 24240 - DNA, 590 bp, Sorghum bicolor
  Clone ID: 30932777
ccaccagtcctctaccccgcacgctataactgtagccagcggaggcggaggcgcgcggcggcggccgacgacaactcagccagccatggcgacggggggcggccagcaggggaaggccgcggggtactaccagtacccggcctcgtactcgtacgccggcgccgcggccgcggccgcggaggaggagcgccggtggtggccgtggctcgtgcccaccgtgctcgtcgcctgcatcgcggtcttcgcggccgagatgttcgtcaacgactgcccgcgccacgggagcgcgctcggcggcggcgccgggtccgggtgcgtcgcggccgggctcctccgccggttctccttccagccgctccgcgagaacccgctcttcgggccttcctccgccaccttggagaagatgggagctctcaactgggccaaagtagttcatgagcaccaagggtggcgcctcataagctgtatctggctccatgctggtctagttcacttggttgtcaacatgctaagcttgctcttcattggaatccgccttgagcaacaatttgggtttgtgcgcattggggttatctacttgatatctggct

SEQ ID NO: 24241 - DNA, 565 bp, Sorghum bicolor
  Clone ID: 30932813
aaaccgcacgccggcaccggtcgcaacctcccacagtcccacgtcccgcctccctttcggtctccgccgcttcgtcgccgtcgaggtcacaccaccatggcggcgctcctagcccggcaggcaggcagcgcaggtgctccgcgcgaggcagacggtacgaatccctaccactacccgcccgtgcccggccgctcgcggatcctcagatcgacccttgccattcctgggtgctggcagcagcttgggccggccgcggcggcgatgcagcgcacctccacctacgtcaacgcaagcggttcaaaggcctcctcttctattgggctgttggccagtatcggtaccacaaaaataatgcgattcatgaaactgttttgtcttgtctgtccttattgattgatgtcttgcaagtttcagtggacatggcatacccaacacaggacaggctgctgaacttgaaatcaggaaccgacgatgataattcggtgcagttctaaaagagcgtttgatctgcagttagttgtatgttaatgggtctggtaccttgggcaggatgagttttgggtta

SEQ ID NO: 24242 - DNA, 618 bp, Sorghum bicolor
  Clone ID: 30932853
acgttccgggagcggttccaggtggcgaacgggagcatgacgcccatcgacgggtcgatgaacgccgactacgcgaacgagctgatccaggcgtgcgcggcggcgaacggcgccgcggcggcggccacggccgtggactgcgactccgggtcggcggccgtgttcgacaaccgctacttcgcgaacctgctggacgggcggggcctgctgcgcacggacgccgtgctggtgcagaacgccacgacgagggccaaggtggcggagttcgcgcagagccaggacggcttcttcgcgagctgggccagctcgtacgccaggctcaccggcctcggcgtgaagaccggcgccgacggcgagatccggcggacctgctccagcgtcaatggctgacggatccgacggtgcagaaacttatatgttgtagagcaaggaaaagtgaggtgagtgaggaggatgagattggttatattccttttgttgatgtagctggtgctggctagtttgctgttgatggcccggtgatgcttcggtgagctagtgaggtgttcttgtgtaggtggcgtcaccgtttttttttagtgaaaaaaaaggagcgaaaagaaaatgcagaaaatgtgt

SEQ ID NO: 24243 - DNA, 566 bp, Sorghum bicolor
  Clone ID: 30932861
gcccagactcaagaccgcgtacgaactgctcaaggtcagcttggacctcgagcaaaacctcctacaccaggtgtcgttgccgttcctgatcgtacacggcggagcagacaaggtgacggacccgtcggtgagcgagctgctgtaccgatcggcagcgagccaggacaagaccctgaagctctacccgggcatgtggcacgccctcacctccggcgagtcgcccgacaacatccacaccgttttccaagacatcatcgcctggctcgaccacagatcatccgacgacacggatcagcaggagctgctgtcggaggtggagcagaaggctaggcacgacgaacaacatcaccagcagcaggatggcggcaacaaatagctgcttgcttgtaactcttcttcatagaacgaaccatttcatttggtgatgcatgggatgatacacatgtcagtgatacataccgactaaattatttagccgacttacctacaaatcagcagctagctatcaatatatatggaatcatatatatcatcaagtctaatataaatattgaatttgatactct

SEQ ID NO: 24244 - DNA, 635 bp, Sorghum bicolor
  Clone ID: 30932893
ttttcagtatcagtaggaaaataatttttccctcagcaacaaaactcgaagtacagaagtatgatgactttacaccattttatggcttgttggtttcaagctgcgaacattcactatctaatgcaaatggtagttacagcatgacacacaatttatatggccaaaacatttcatgaagcccatctaatgcaaatgcaaagagtgatgatatttcaggcctaatgttgtgttttgcatcgatgggcaattttgattatcatataaagtttgggcagtgtttgtaaaggcttctgctcccagattatcatccagagagcagctggagctggagcgcattccaaaacctctcctgtgaatcttggactatgactatgtgattgtctgtgttctatatgattcagaatgctgatcgtcttgcgttttgctttcccacacccttttgattgtcgttacaggtgtagcgcaaagtagcatgatcagtatagtagttataggttgattgtagagtcccctttgtagttctaaaaagttttatgaaacttggttacttccagggttgcagttatatgatctcaaactcacctttggaattgtagtctgggtgttgtggacagctcaataaaatgtctattggc

SEQ ID NO: 24245 - DNA, 675 bp, Sorghum bicolor
  Clone ID: 30932906
accctttgccagctgaacaacaggaatgggcacataagcaatatgtagcaaaacatcagcagtgggcatcacagcagtggggaaatttttactattacaggatgcacaacataagtgacatatacttcatcgggggctttggaacagttgcatggatagatgttaaggagtatgaaactattcaacctgacaagatagcagttgatggtggtgacttgcaaagtttaaaggagttgaatgctattttctctaaaccacttcgagaagtcctatcatcagaaggggaggtcgatgatgctgctcttatatcagtagatagcaaaggcatagacatacgggttcgtcagggtgcacagttcaatattcagaggctagcatttgatgtccctcataaggttgagactctggaggaagccaagaaagcactacacaagataatcaaagacaagcagcaaataaagtgaaggttgcagaagcaagctttactcatttttctaatggtgcaaggtttcattgcaaccgccaactggtgattcggtaatgtagcaggtagcatgaacaagtgaaaacgatggctgtcttttaataatgagaatctctccacatgtggtgaagattgtatatatgctcgtgttgccatattaataattattagtgtgcggttgctgctagagg

SEQ ID NO: 24246 - DNA, 218 bp, Sorghum bicolor
  Clone ID: 30932916
agaattttttcaagtagcatggtggtttacatgctttcagtttttttattaatatactagagcaaacccaaatgtgaaagtcatgtcaaataaacttgatgtaatgctgcagcggttttacgatgctagttaattaaacccctgtggcatgggggtcaaatagcaaatgtaaccatccatagttggccagcaaggggagataagtattttgtgccgtt

SEQ ID NO: 24247 - DNA, 660 bp, Sorghum bicolor
  Clone ID: 30932945
taattgtattgttaaactcaacatgcaataggcttagctctttaatcgtgaattcgtgatgccttcacactgaatattcctactaactgtgtgtaaatcctatttattgtgctagtttagttgtcatactcaaatctgacttagttctttccaaactcttgaaaaattttcccttacagaagttcttcactgattatgaaattccatttttgtttcagtactgtactctagttaagtcagtgacctgattgcttctgagggtttgttactttagagaacaggttttagttttatttggtacttaaagttggctatggtacttatatgatacatttttcttacaaatggtctgataaatttaagcattcagaactgtatgagacatgcatagaaataattttctactagtctgtgatgactacttacaactagtttgtgtgtgactgtggaatataatttcctagatacatgtactgtcacagttatctacagaccacgctgcttcattttgctttggtataagattgtcttaggtgctgtctgcatcagtctgtataaggggacacgaacacatgtatcaatacaatttactctttggtttcttatttacagtatgagatatatgatggattgtgtactaagaatctaaattggcatcac

SEQ ID NO: 24248 - DNA, 565 bp, Sorghum bicolor
  Clone ID: 30932949
ctaaggccacttcaagtggtcagggcatatggctatgtcaacatgacacgcaattcttgagtgggctactgtagggattcacgagaagctgcgaccacaataggagcagggagcgctgggattggtgcaaggacactccagtgatgttaccaaccaattgccaactgaaaacagcgtcctgggtcaatagcaggaaacttgtgcccaatagttgctcgaaacaaaactgattcttgtggggctcagccttgctgtaggctgcattattcaaaggtggtatcatatcatttcttcgtcccccaccaaaaatcttgggagatgtcacttctgatttggaagctcatcatatgagccagtgcggtgcgctttgtagggacaaagtcttttcaagggatgcttttgcgtttaattgtgatcatcattcagtgagcttcctttgcaatgacctttgtttctcaaaacccggatgtaaacgaactaactgcatggaaaatcttggaaggatgtcacttctgattttggaagctctatcatatgagagcccagtgcggtggactttgtaggg

SEQ ID NO: 24249 - DNA, 628 bp, Sorghum bicolor
  Clone ID: 30932971
gattgctttctgcttctgtgagagactatggttatgcaaagcatgggaggtggaaaaggtgaggcccttcagacaaggtgacaaggtacggattcgacctggtcttgtatcccccagatggggttgggggatggagacctacgcgagcaaaggcgaggttgtaggtgtggatgcaaatggaaagctgaggataaagtttcggtggagggatagactttggattggggaccctgctgatattgttcttgatgatgcccacttattgacagaggcttctaatggcttttgaccttatgttcataggcttgtggtattcttttgaccccatacctgatttcttgcacccatccattttgcagcatttcaaatttagcaaaatctcaacctgcagtggggttgcaagttgcacatagctatcatcgcataggcatggcagggtgtatttcatgttgataaccggggaatgagaagacagcgatagtgaaatagagttgataaccaccacctagtttttttttttcttttggtttacatgtataattatgccgcctgacaccttttgggtttcagtgtatcatataccagtgtacaggttcggacctgaacattaatttaattgatagtggtc

SEQ ID NO: 24250 - DNA, 569 bp, Sorghum bicolor
  Clone ID: 30932987
atccaaatgttgtaagtgcagacatcaaaggaaacatttctttccttcatctcatcaataattgccaacacttcattaggttccccagaatccacatagaaattcatcaacacattacaaggtaatgtatcagatgcaaatccttttttcctcatttgctcaaatgtgtcttctgttttctctttcatcatagcttgggcgtaaacattgagaagggaaccgtacgtccgcttgtccttcatggcatcagggagctcatcaaagtatttctcagccccatgcaaatccagaggttacacgagggagctccaccaaaagtttgatcaccgtctcgccatttctcaatcctgacagccttagaacgccataccttgtaaatacatgacgtgaacccatataaatcatctgaagtttagattcccctgtgccgacaaaatataaatgaaaaaaagaggcaccaaagctctgtaaccgatgtgtcacatatggtatactactcattaaagccaaagatagcatgtaaatacatgatacacagagttttagctcagggaatgtcaaatatatcg

SEQ ID NO: 24251 - DNA, 644 bp, Sorghum bicolor
  unsure (1)..(644): unsure at all n locations
  Clone ID: 30932991
ngatgtgcaaggagtttgtcaaactacaaactgtgacacaatggacaaacaccagtcttactgcatattgctgtcaagaggtgtagacaatcttataaaaaaaacatgtgtagataaatatttggataagcagtggctaggtgattgagcatgatcctgcaaatctggaatctcatagctggacatatcaaaaacaaggctacaagatattaaaacttttggttaaagggaattcagcatttttggttgtccatgcagagttccgctgtgtgctaccatatgttccttgtcttcctagtcctcatctggttaagggaattcaccatcttaccctggtctgatctgttatcatcaagctaaggataatcttctgtttcacagtaaattcagaagagcaatggaacaactttgaaggactgacatctcctttttatttttatttttatttttatcaagctcattcaatgtttcttgtttccaactagttgcatgaacttcattttttagtagtgctgtttcataacttttaacatttcagaccagaatagcattcttagaatatataaatctggctttatctctcatgagctcgcacctaatgtcatgtttcctaaagtgataatatattcaacctccttttcttg

SEQ ID NO: 24252 - DNA, 704 bp, Sorghum bicolor
  Clone ID: 30932995
tttgtaaagcaaaggatgaggtgaaggagcttattaaaaaagcacatgagaagcagttggaagctgagccaggacgcaccatgatggagtcatttgaaaacagagtgaaccaggttcttaacaaagctcgtgatgatgctgggagcagtgctcagaagagcttgtctgaaagcaacaatttgaaggctatggtcactgcaggctcaaaaggaagtttcattaacatttcacaaatgactgcttgtgtgggacagcagaatgttgagggcaagcggatcccttttggtttcattgatcggacgttgccacatttcacaaaagatgattatggtcctgaaagtcgtggatttgtggaaaattcttacctccgaggtctgacaccacaagaatttttctttcacgctatgggtggtagagaaggtcttatagatactgctgtgaagacctctgagacagggtatatccagaggagacttgtgaaagctatggaggacatcatggttaaatacgatggtactgtaagaaattctctgggagatgtcattcagttcttgtatggggaagatggcatggatgctgtttggattgaatctcaaaaattggactcattgaagatgaagaagcctgagtttgataatttgttccgttatgagctggatgacgagaactggagacctaactacatgctaccagaacatgttgac

SEQ ID NO: 24253 - DNA, 767 bp, Sorghum bicolor
  Clone ID: 30933001
cgatctcagcctcctctcgtcctccttctcctcctccggtgacggcgccaatggcaactccaactccaactcctcttcctcctcccgcctccaactcttagccgccacggcgcgcgctctcgagctcggctacgccgccgtcgctctcgaccacccccaccgaggcctcctcgccgattcccaccgctgcctcaccgagcctttcgcgcccctctcctcgctcccgctcccatcctccgccgctctccatcgccgccgcctcgcctcccccgcctccgagcccttccgccagtacacccgaatcaccctctccctcgattccgctgcagccaccgcttccgcgctcgccccctccgcctcccgcctcctccgcacctacgacctcgtcgcagcccgccccctcacccaggccgcattcgatcacctctgtcaggcacccctctcagcccagcaccttgatctcatctccatcgatttctcttcccatggtaagctgcccttccgcatcaaggcccccatgctcaagcttgccctgcaaaaggggctgcatttcgagatcgcctactccgcactcatttctactgacgccaatgccaagaggaacctcattgctgaagtcaagcttttggtggactggaccaaaggaaaaaatctcatcatctcaagcgctgctcatactgcttcccagatcagaggcccctacgatgtcatcaacctatctgcttatttacttggcattcccattgaccgagcaaaagctgctatgt

SEQ ID NO: 24254 - DNA, 725 bp, Sorghum bicolor
  Clone ID: 30933021
atgcgaaggagatgctgctggtgttagggatctacttgcaaaggctgcatcagagagaaatggtagtttaatccgttctctcttagaagcacaaaatacagatgggctcactgccttacatttagcatgccgccgaggctcaggagagcttgtggaagctattgtggcttaccaagagaatgtagatatattagataaggatgaagaccctcctatagtatttgctttggctgctggctctccacgatgtgttcgtgcacttgtaggcaggtctgccagtatcaattctaggcttagagaaggcctgggtcctactcttgcccatgtctgtgctcatcatggtcaaccggagtgcatgcaagagctgctgatggctggagctgatcctaatgcagtagatggggaaggtgaatctgtcctgcatattgctgtggccaggagatatactgattgtgctattgttatactggaaaatggaggctgcagatcgatgggcatatcaaattctcaacataaaacgccattgcatttatgtattgagacatggaacacggctgtggtaagaagatgggttgaaattgcatctttagaggatatagcagaagcaattgatgtacccagccctgttggtaccgctttatgcatggcagcagctcttaaaaaggagcacgagaaagagggtcgagagttagtaagaatattgcttgctgctggtgctgatccta

SEQ ID NO: 24255 - DNA, 675 bp, Sorghum bicolor
  Clone ID: 30933060
cccgatgcttttaccacggcgtctcggattgcctccccgatcagcttcctccggcgcagggcagcgcagccgcgggccgcgggtgagcatgatgtggaggtagtgttcattcatttattgatggcgatggcgatccgagcgagcgggccggcgcctggctgggctccatctccatcgcccggagggggctctagctaggtgcgccattaatggcggtatttacttcctacgtcgctgttagttggcggagggggagaaaaggtcggcggggcggtggtggccgtggtggacgacgcgacgagcagcgtagccgcgtaggcctgccagggggccgtcttgacaacactggcagtgctaccgccgcagcagcttgtgccgctgcccctcgtggtggctcgtggcggcgtgccgcgcgcccgcgcccttaatgccagagctagaccagcaccagctgaggcgatagattttctcccgacaccgcgtcgcagcccccgtcgctatctctcacacagacgcacagtcacgtgcccgtgagcttctcgtcgctctaggaaagacgcgctcgctcgctagctctccttgtcctcggctcggctgcaagatgggcggcgccgtcgtttgctcaatgctggtcttgtcggcgctgctggcgctcgccgcctcgcagtcgccgtc

SEQ ID NO: 24256 - DNA, 630 bp, Sorghum bicolor
  Clone ID: 30933062
agccacctcggctgtttggatttgggctactcggcaacaaacctcctccccatttaccgcggcgtgcggcggatggcaacggccgcctccgccttccccggcgcgttcggcgtcaaaaccccagccccagccccagcccgtgggctgagcgcgcacccggccctcaccccgagccccgcattcgcgaggcctccgccgcgcacccccgcctgcggcaggtgccgcgccagcctccacctcggcggcgtgggcgcggccagcagcagcagcagcgccgccgccgccgcctcaggcaacggcaccgggctccacgtgccccccacgatcgcgccgctcgccgtgcccaagatggcaggctccatgaagacgcacaagaacgtcctgctcttctactgcgaggagatgcgggacctcgcgcggcaggtggtcgcccggaatgatgacatcgagctgcgctccatctcatggaggaaatttcccgatggatacccgaatttgttcatctcgaacgcccacaacattcgtgggcagcatgttgcctttttggcctcgtttagctcgcccagtgtcatatttgagcaactatctgtcatatataatctgccaaagttgtttatttcttcatttact

SEQ ID NO: 24257 - DNA, 567 bp, Sorghum bicolor
  Clone ID: 30933070
gcattggcattcgcccgcgcccccatctatctctccatataccaatcatctagaaagtcaactcctctcctctgtttcgtcttccctgccctgccgtgaaagcagttgaagagttgaatcgcaatcgtccttctccttgtccggcaggcggcggcggcggcggcggcagcggcaggaccgtgatggggaggagcagcagcagcagcagcagcaacggcggcggcggggcagatgatggcggcgaggtgctcctggaccacgagtacaaagaggagtacgtgaggaactcgcgggggatgaacctgttcgcatgcacatggctgcctgcaggcaagaggaagactccaaaggcgctcgtcttcctctgccatggctacgccgtggagtgcggggtgacgatgcgcggcaccggcgagcgcctggcgcgtgcgggctacgccgtgtacggcctggactacgagggccacggccgctccgacgggctgcagggctacgtgccggatttcgagttgctggtccaggactgcgacgagtacttcacctccgtggtgcggtcgcagtcaattg

SEQ ID NO: 24258 - DNA, 687 bp, Sorghum bicolor
  Clone ID: 30933078
cttttttttttttttttttgagcatatccaagttaacaaacaatccttacagggggaaaaagttaacaattgatcgattacattcacagcatcttctttttctttcccaaatgcacaagaggtaatacacgcaacatgtattgatgtatacaatcgaaatatacactaaattacatgatttaaaccagacgccttagagcacctgatctaactacagcatcgaatcgtaaattatgaacaaattttaccggttggatcatgaatgcctgcttgctacagggtacaagttcagctatcttcagcgaagaagttgggttctgctggcttttgtaacagtcttgcaggtactctttcctgcaaacgggcctttctggtggcgtttctccgtaagatccgcatcatgttgccagcaaaacgtgaagcatagagcgctgcaccaagactgagcgaagtagtgccatcacttacaattgctgcttgtaacctcttctccttctcatataaagcctcttccagcttctttctgcagtatctgtgccaagctgcctgtatgaagcaagcagcccaggtcctccattgctgtgagtaaaatcggaaggtatgttggagttgtttgctgtggagcctcctgaattgtgtggcaacaaacttcaagtcatcagccctcagagcaaaagcttcaacttc

SEQ ID NO: 24259 - DNA, 591 bp, Sorghum bicolor
  Clone ID: 30933080
cttttttttttttttttttgttcaatgtgtcatactcatcatatcaatgattcaatgatatgattacgctttccatgctatgtgcccgcaaaagcataggtgttaatcagtgacttgtattcttcgtcctcagcacatcctctacttgtaagtacactcactaacctgtctgcactttctgcatcattcttctccttaaaacttgccaggagactctcaacattggtgggtcttggtttccatttatttgcacttgtaattgctgtggctttttccatacatgacagagcttcagatattttatcatccttcatgtaggctgtggcaaggatttcccacgtgtttggcttgggatttccacctttctcaacaaatcgattcagagtttgctcagcctttgtaatcaaaccttctttagcataccatgctaataaaatgttcatggtcttaggatcgaaactagagcttttggatgcccattcctcatatagaagctcagctccctcgatatctcctatccttacaagagcagacagtaactcctggtaacccaggttatgaatcatagggaaagttgccttataccagttc

SEQ ID NO: 24260 - DNA, 691 bp, Sorghum bicolor
  unsure (1)..(691): unsure at all n locations
  Clone ID: 30933106
tactggagaaaccccgcccgccacagcgctcttggccggactccgacgagatcgcgctccttgaggccgtcgcgtcgcaccggaagaagcacgggcgacttccgtcgcccgatgagctcgccgccgcgctgcggggccgcatcttctcggaggagcgcctcaccgccgagcaggtagccaagcggctgctcgcgcttcgcacgcggtacggcaacgccgctatccgcctcaaacgcggcataatccccgcgaaggatagcgacctcaccatctacaggctctccaagctcatctgggcggacacgcgcaaggggaagatggagaagaagacccgtgcgcccgacgcgcgcgaggacccaagggggtttgacgagctgaccgagctgtacccttgcctctccgcggaggcggaggcgattgatgcgaggtgcggctacgggtcgctgaagagggcgttcgggcgcatcggtgacgacacggcggcgcggctggaggcgaagctgaagaggcagcgggtggcagaggcaaggcagagcgcaaagcttgaccggctgaggaccgacgttgccaatgcgcttcagaaatttatcaagtgaatggtgatttcatcttctttctgttcatacatggattgccgtanaaagacagtaagattggctccttggcatggcttcatgattgaaatgttatc

SEQ ID NO: 24261 - DNA, 595 bp, Sorghum bicolor
  Clone ID: 30933118
cctactgggtccgctagccgcctcgccgactctcttccctccatcgctcgctcgcctgagtcgcctcgccgctttttcgctccacccctcctctctccgctccgctctctctttctctctcctaccccaaaccaaccaatggaggctctcgcgggctccgcatcctcctccattctccccgcgcgctacccgccttcccgcgtggccgcgcagtccctcgcgctccgacctagccgctgcggtcccctccgcgcggccggcgccggcggtggcaaggacgatgcccaggccgcccccgctgccaacgggtctcccgtcctcaagctgaggagcaattcgagtcaaaatggagtcctaccgatcacggctgacaagtcgcagaaggcttcatcaaccagtgttagtactgactcaagtggatccagagctggcctgtttagaacacccatatcaggtggtgtgcagagtgcaactttcgcccatggtttgcctctgccggctttggctgttcgcaatttgatggaacaggcgcggtttgcccacctgtgctctgtcatgtctggcatgcatcatcgccgtactggatatccatttg

SEQ ID NO: 24262 - DNA, 284 bp, Sorghum bicolor
  Clone ID: 30933130
gacggggccgagaggtccccgaaaaagagccatgctgggccatgtctccctctctcactcactcatgcagccctaatccggaagtgatattttcttgcgattttgtcgcgctagcggccagagctcgatcggggttggagctgtggagctcgatcgcgcacctagctagctttctgcaagtttcccggggatcgctgctagctgcaccgtgcttaatttgtcggcggcacgtacatgagcagctcgaagcacgcggcggccggcgccggcgccgtgggtggcaa

SEQ ID NO: 24263 - DNA, 573 bp, Sorghum bicolor
  Clone ID: 30933150
atgcatcgggcaatgctaggctgctagcgggcaaaagaggaattcaggtcagttggaggaaagaggcggcaaaggctgctcccggttttcccctcccctccattgccgcctcgtctcttccgccgccgacgccgagaggaagaatgcttcgttcccccctccatcttccttgcttccgagaacccagctcctcgcccctagcccttcgctgaacgctgatccgccccttgccgtgggattgcaaagatcggtaacggatagagtttggcagtgacaaaaaaaaaagtctgaattttcatcgacaagaaagccataaaatggtgaatggcattgaagatatggatgccattgccaatgacttagttgaacaagagagcactggcagcccgctgttctctggtacaaatctgaacaaaagactccggtccaaggtgtgggatgacttcatacccacctttgccgaagggaggatcgtgcgggctaaatgcatgcactgccaccaggtcttcggtggcaccaatggaactagcagcctgctacggcacctggccagttgcgtccctgcgactctca

SEQ ID NO: 24264 - DNA, 705 bp, Sorghum bicolor
  Clone ID: 30933184
ggagaatcatcacgagttaagaacctagatctggaatttatacgggaggtcaactgcgtcagttacgctattaccaagcttccttcaattgtaccacatcttgaaattctgaccttacattctggtcgtgagagggttaacacaccaatggtagcaaacaaattcctccacctcaagtacttggatattagtcttgctgatgatgatgttgatgggactgctttcggagcctatgattatttgtccttggtttcgtttctagatgcttctcctgtcttggacactttcatcttgagtgtggatcagctaagcatgcatcatgattcagttactggggatgacgcctcatatctgaggcagattcctgaacacaagcatgacaggctcaagaaggtgcagatcaatggcttccgctctgcaaagagcatggttaacatgtcatattctcgagaattcatcagcacttgaaaatcttacactggacagcatatttagtcagctggaggatgccgacgatattgttaggtgctcgggtcggaaaactggtgagtgcttttccaaaagcagggagatgatagtggaagcacataaggcactcaaggtcatcgaaagatatatcttggaaagagttccatccacggttaagttaaacatccgaagaccttgtatccgatgccatgttatagatgtctaagttttactgtg

SEQ ID NO: 24265 - DNA, 631 bp, Sorghum bicolor
  Clone ID: 30933196
gcaattaaatagacttcttattatctgaatcactaccaggtagacagatgcaagcaatagtttaactgctccaacgttacgattggaatatgcaaaaaatgaggaagaaaggtaatgcctatacaatgtggctgacctgccacagataacacagattgtaagatgcaaaaaatgtaggaagaagaaagattaagggaaaattggcccctcctaaacgttgcgcctagctccatcactgcatacgagtgtaccatcccttgatagcacagacaatttaccaaattctctgctcctttctgggaactggcacctgtcaactaaagccattgtgtcttttggtcaggcgcaacaacttgtggcaagtcatggtgcatgccacaccatcttgaagatgcaaacatgtgcaattcacgatggtaacgtcaaactgcatcggttccttttgagccacgcgttggggtagtatgcgaactcaatttagttttcctcttttttgggggaacattgtttcctactgattagacgatgacacagtttctgcatgatagagcactaggactattagataactagactttgcagtatcaccttgtatgatgtatgcttatgtactactatcagtcatcattag

SEQ ID NO: 24266 - DNA, 203 bp, Sorghum bicolor
  Clone ID: 30933202
agcagccaaccccgggataaagatcaaagtcaaccccttggtaagaaaccctgaagggaattaaaaaattttgtagaattgtggtcaggctccccccatttgtaaggattcctgtccagcaggaaaaaatgggggtatgttgtaggttgtcccatgagtacccagttttttcgtgaatggctgatgtatccggtaaaaaaacc

SEQ ID NO: 24267 - DNA, 701 bp, Sorghum bicolor
  Clone ID: 30933230
gctttgcagtaccgattgactctgtcattaaaatagtagagaactttaagaaaaatgggagagttgtaaggccatggcttggtttaaagatgcttgacctgaatcccatgatcattgcacagctcaaagaaaaatcaagtacttttccagatgtaagaaaaggggtgcttgttcctatggttacaccagcatctccagctgaacaagcaggatttcgtcctggggatgtggttgttgaatttggtggcaaaccagttgagagcatcaaagagatcattgatatcatgggggacaaggtcggagtaccatttaaagttcttgtcaaaagagcgagcaatgtgacagtgaccttaactgtgataccagaggaggcagatgccagcagatgacctaaactaatctctgctgggaaagctgagctaaatcctaagggtaggattctccattgtaactccaatttttcttaatatagatgccatggacacccatagacatactttctgttgagttctgtatgtagccagaggatgtgataggtgacaggaccacccaaagaaaggaacgaaaatatatgggaaatatatattagcgccaggttcagtcatggtacgcgttggtttttttttctgtagcatgtatttacaatcaataacggtaggttttcattttatttctttgaattggataacgctgtcaggttc

SEQ ID NO: 24268 - DNA, 641 bp, Sorghum bicolor
  Clone ID: 30933240
ttgattaagcaacaaggttcagactggagtccatacaaaattttgctaaaaagtatggttatccattgggggcatcctcttcctctgtttgatatgggtgttattgagttatcatacattttctgtttcagtttttactgtcaccattttgttttagcttgtcagattttacgtcctacttgtccagtttttactgttggcattttgctttagcatatccgctgattttacttcctggctgatgcacacttgtattttttgctcacgatttgacaattaacatatgttgatttttgaaacttaactactgcaggctttagaagcagaactttatgtatgaatttgttgcagagttatttgtgacatcaggaacccagaaatgttcagttggtagcataattgtgtcccaggatatttagttcatttatatactcagcctaaaaccaacatagatataattgttggggattttggcattatttagcatcgacgaagtacccgaccattttaactttcaagtagaactgctattgtaaacctaatcattcactgctttcatggggtggtagctgggatatttttctgtttatattaacaacttgtatggttccataggaaatgaataacgattttttgtgggg

SEQ ID NO: 24269 - DNA, 594 bp, Sorghum bicolor
  Clone ID: 30933244
cggaccaggagctcttcaacaacgaggcgctcgactcgctggtcaggctctacggcaccaacgccgacgccttctcgtcggacttcgccgcgtccatggtcaggctcggcaacatcgccccgctcacgggtgccgccggggagatcaggctcaactgcaggacagtcaattcgtgacttcagtttcagaatcacaagggatgcgaatctgtttgactcgttcattgattcgattccatgcgacgaatgaagcatgacaggaatgaaaagtagaaaaataggattcgaatgattccattccattgcatcattgaattgatactgttcttttccccgcaaccacaaaggagttgtagagttttctccatttcttcgaagatttggaatttcgaaagcgacgtacgtacattctcttggaaatatcacttaggcattttcttattttaattcttcgctcgagtattatcagtgatcagtggcaactgtagagcatacctttgaaacggcacgtggcctgtttcactatctctacttcatgttgctgtatggcatatatggccatagttcaaaccttatctattcgattgttacaggg

SEQ ID NO: 24270 - DNA, 553 bp, Sorghum bicolor
  Clone ID: 30933258
gcggcaaccaaaggccaccatacaacattaccaaacctttcgggcagaaagaccaaagatccaaggtggcccttccataccatgaacctcttgttcactttgctttggtatgtggcaccaaatctggacctgcacttaggtgttactcgccaggagatatcgataaagaactgatggaagctgcacgtgatttcctaaggaatggaggactgattgttgatcctgaagccaaaattgcatctgcaagcaagattttgaaatggtatagcacggattttggtaagaacgagacggaagtgctgaagcatgctgccaactatcttgcgcctgcagagtcagagcagctcttggaactgctcgcgagcactcaactgaaagtcatgtaccaaaactacgactggagcatcaacatttagacgtagcgtatgtctatccatatgtttttgttacattttcatacctattgcacaaagttccgtggattggaattctctttctgaagcaggacgcatgtctgacagggtgattcttataattttttttccgaattctg

SEQ ID NO: 24271 - DNA, 638 bp, Sorghum bicolor
  Clone ID: 30933262
cagatgacagcccgagaacaagagttttgaacacaatcagaaagttgaatccccatttgttcgttcatgggattgtcaacggtacttacaatgcacccttctttgtgacacggtttaaagaggctatgttttttttctcttcaatctttgatatgcttgaagcaaatgcctcacggatggatgaacataggctgctgatagaaagagaattctttggacgggaagctattaatgtgattgcttgcgagggtacagagaggattgaaaggccagagacctacaaacaatggcagatgagaaacctcagggcaggcttcaggcagctacctctggacagagagataatggcgagagcaaggtacaaggttagcaagacctatccgagggatttcctcgtggacgaagataacaagtggatgctacaaggttggaagggtcgtgtcatatatgctctttcagcatggagtacctagacttgtaaatcctagttagcttagctgacatcttcccttaatatcttgatttttcactatttcattttgttgtattatgattacgttaatgaatctgtccctcgtctaggaaccaaaattttgtaagtttgaattgactgccataaagatttttgtctgtgtgcc

SEQ ID NO: 24272 - DNA, 571 bp, Sorghum bicolor
  Clone ID: 30933270
acctcatcgacattgtacttttgacagattgtggcgaccagggtgggctacaataggtgtaccgatgtgcagctctgtgcaaatcaaaaccaagatccatggctaacttgaggccacctgagcgaacttgtccatttaacactagctgtgcaaatgacataccaaagacctaccggctgttttcaaatccctgtactcttctcgcttggtacttcaaagttttcaaacttatgtgcattctaggcctatggtgcactgggagactggtgaggaagatgtgactgcaggaaggatgtttggccaatgatgggtttgacggataattctctctttagattaaaaagatgagatggtgagctgagctcacctatgccgctttattccataatttagtcaggcttgagtgaattatggagcattgatctgattagatggttttatattaatcctagtgatagtctctgatcggtgtgtggaaagaagagcagaaaataattgtaaacaatatctagagttttgtgtttgtcacagaatttttgatatgaaaattttgagccgatacctcgaattc

SEQ ID NO: 24273 - DNA, 550 bp, Sorghum bicolor
  Clone ID: 30933272
caggggctgtaccagtacgggcctttcctcatccagctggaggactgcaccttcgtgcgcgacaccttcacgaccatcaaccagggctactgccctggcctggagcgctacagcaagtgggtgtacgtgggcctggtgatggtctcgtcagcggtgatgctgtcgctcatcttctgggtgatctacgccagggagcggcgccaccgcgtgtacagcaagcagcaccagccgtacccgctggaagacaagccggcgccaacagtcccgggcacctgatggccgttcctcccttgcctgtgccgctgtgcatactccgcgctagttgggtttcagtgatgtaggtggatgtaccctggattgttcgtttgcttgctgttgctgttgctgattttcgtagacgaagctgatgtgcattctcgtactgactgtagctgtttttgtggttcgaacttgagaggtcagacagcatgtaactcctttacgttgggattgggcattagtggtgtacagtcacgatctggaactgtaagattgcatatttgcatttctc

SEQ ID NO: 24274 - DNA, 548 bp, Sorghum bicolor
  unsure (1)..(548): unsure at all n locations
  Clone ID: 30933274
gacaggcagtcatgaaaagtcagcagcaagcataaagcgattcaaggagcctatctatggttctgcagtgattgacatcccccgaatcattgtatcgcactgcattgagagggatcttttgaagagggcccgtgaacattctgttggcgttaaacatattctaaacaattatgaccggacagaagtgattaaggggacaaggcatgtgttctctctgtatccacaggcagtggcatcctcctttgaagccaataaagtatggccagcactgaggatgacgaagaggcttcctatcccgagcatctacaattatgtttcaccataccgtatgcagaaatgatggagctgatgggctcaaatgatctgggtgttaagtcaggcttactttatgtactcgagcacaatatgtagaatgacctttttttgaaggtttatttatgtagatgatctaggtgatgccgaggtgatggtgttagactggtactccggcgttagacttatatgcctgtaatacttaagggctttcgacgtttgacttaaactttntc

SEQ ID NO: 24275 - DNA, 684 bp, Sorghum bicolor
  Clone ID: 30933294
gaaagttgagagaggtgttttgcccggttttgaaatccagagaaaaaggtgaactttcgtgaaagtttagggatgtagtgtggacattttcctttcaacaatgacatcatttgaagtgaagcgtcgaatttcttttctcatttttgtgttcctagagcctgtttcttgtatattataactccaactctaatttctacttaatgaaaaggaggaacacctacgaaagtttgctctaaaaaatattcccacgatcaacaccagaatttcttaattgttggattggatttgcatctaggggctcacacttcttacatggtcccacttctaactcttggttataaggacatgtttgtcatagctctgctttactggtggagcggtattgttgtacttcaactccattagtgaagcaaaaccgttttggtaaaacgtttagccaaaaaactccctatggtagctaaaaagaatgaaataaccataatttccttctcctatttctttagattttcctattttcctattttcaggctctctacttgtggaattgtttgaaaattatcagattggtaaaataaaagttacaaacaacttctgaaactgctagagaagttgtaccaaacaaaacataagtactctatattttcaaatcatatagggtttgctcacaaagtatattaaaaattt

SEQ ID NO: 24276 - DNA, 557 bp, Sorghum bicolor
  Clone ID: 30933304
gatcctcggctttaccactcgcgtacgcccccccgcttccgtgttcctccctccatccctttgctcccattaatctccgcttgtttctattcctcctccatctaattttgttttggtccatttgtttgaatcgcgcagctcgtggacttcggggttcagtttgggactcattgctccggcgttcttcgtcaggtgccctgctgaaggctgttttgtatcatggagagtacagacaaggatgacaaaacaattcctgtcatagaagaggcttctaatcctggacaaaattgtgaagatgaaggggatttgtcaaggaaaacagaaatgttaaatgtagaagcgccaaattcctcgaatgacaaattaaacaatgaatcagaagtgcagatccaagagggagatgatgattcagaaaagggcttaaatggacaaatgaatgaaaggacaagctcagatgtcttggaatatgcaagctcaaacgagatcacaaaagagattcttcctgaagacaaatctgaagagccagtgtttgatggaactgaggttcctgaaataga

SEQ ID NO: 24277 - DNA, 566 bp, Sorghum bicolor
  Clone ID: 30933306
gatgcaagcagtacggacactgctcttagcttgtcttcactgagtgtggaaggggcagcacccgacaaacctagcgggcctggtgaagaggcagccactacgatggagtggctcaggtctgggtttgcagaagcccaaaagaaggcttcggaggcagccggcaacgcgcgagtccttgcgctgcaggcgtccgtgcgtgcaaaagagcttgctgagcaagccagggagcaagccaaggtgcttgctgagaaggctgttgaggaagcctcccaggtgcagaccaagctgaagtctggtgcatcagcagcacaaccaagccgggaggaactggtgaagtttggcattactgatgggctactcgaatgtacaggtggcttgacctacagcatgttcagcgacctgaagagcgagatgtttcccagcccagggcagaaagacggtaacctgaccgcttggcaggagcggcatgcggtgctggtgctggggcaggcaccccatctgcaggggctgcgcttcgccctcagtcccaggcacatgagcgactaccagttctgggtcatctactt

SEQ ID NO: 24278 - DNA, 698 bp, Sorghum bicolor
  Clone ID: 30933311
cctactgggtgattctctgtcctgtggccatatcgcaattgtcacgatcgatgcgacgcgactcacatcgaatcagtatcacagtaatcgtggaaccaaaaatcaacgaggagtcgtagtggaggtgaagatggctctcgtccttggtccttgttgcagcaggcggcaggcaaaccatggcattgcccccgcggtccgcagagaatcccgcgccgttccccacgcgtcaccgagggtaaacaaatcccccagttgacaaacagagcgctgcagcagcggtcctggcccagcgcgagaaaactcttttgctcttggaatcttgctgccgctgccccccaatcggcgccgctttcttcctagtctctgcaaggttccgcgcatcaccatcggagacttgggatggagggcaccgcgtcttcttggagccgcgactagggaagccgcggctattgatgaccacagaaactcaagtgagcatctgaaacagattaggaagcattcttctgctactggagatgctggccagagattggcgcactactttgctgacgggctcgaggctcgcctagctggcactggtagcagcatctaccgttcacttgctgcaaagagaacttctactggtgatatgctgaaagcgttcaatttatatgttaaagcatgtccatttaggataatatcacactatgtttgcaata

SEQ ID NO: 24279 - DNA, 629 bp, Sorghum bicolor
  Clone ID: 30933319
gtgtttctgacctccctatcccgctcgtcttcagtcgtcactcaaattcgccctccgccgcgatcgcgatgacgacgctcctccgccgcctgctccgcgcggctccgccccccgtccccgcttccctctccagccacctccccttgtccaccagatctcgccgcacccctcaccgcttccgccgcaggcaccgcggcaccaacccggcgccgccctcccccgacgccatcaaacgcctcgccaccgccgacctctacgcggacttcgaccgcacctgcgcgctatccttctctctccttccctcgctctcttcccctggccccctcctccgcaacgcgctttacttctactgccagttcggcaggctcggcaaggccttccacgtctacaccctcatgcgcgcctccgccgaccccgcagcgcgcccttccgccgacacctaccacgcgctcttcaccgcgctgctgtcgcgcggaggcggcgacaccttggtccattacatgtacatggacaacgtgacggcgctgttcaagcagatgctcgaggaggggatcccgccggacacgcgcacgctcaatgtgctcatcaggggctacgcgcagtcactgcatctcaacgacgcgctgcgc

SEQ ID NO: 24280 - DNA, 648 bp, Sorghum bicolor
  Clone ID: 30933323
atatttggatttaggattgcatgtcatcctggcatgacttcaaatcagcatagtatctggtgtgtcagacagtcagtcaatactggtttatgaatcttcagagttatgtagatggttgttccaatcttcagagttaggtacttgctggttgcaatattcagagggaaatagttgctggttgcaatactgaatgagtagttgctgaaatcacacgtagtgcttcaatcgcttaactgaatactgctttccattgttcttcctgttgtgttgttttcttttctgaatgcagagcaaacaactgtggttgtttatgtcacctctccattgttgttttcagcaaccagctaccaccctagttcattagtctgagatcatgttaactgacatgattctgatttcagagtcacaaaaatgttgaaatctttgtttcaactatgtgagatactggtggttgaattgagattccacaaatggctggctaatggtttagtatcaaacccttccatgtgctgatgaatttgtatttcaaaaattctgcattttacttaagttgtgatataaatttcaacggtgtagtatacagttagcagtttcttcatagaatgaatgctggagtttctttttagagtggcagcggtcaagtttatc

SEQ ID NO: 24281 - DNA, 648 bp, Sorghum bicolor
  Clone ID: 30933339
acgaggtaggctttaggcggctacgatccgatttgttcgcctcgactaggagctcactcgcgccgccgccgccgccgcgccgccccctccaccgccgtcgtgcgggacggaggagggagggagctctcgatctccgtcgggcgtgggggacgcacgcacgacgtgcggggcggcctccccggtcggttgctgtatccgacctgaatcggggtgattccaggagacaggaaggaaaagttggagtgctacagaactaacttccacagttgatagaataatggctggcacttacaatgctggggatggtagatcctcatcaactgaagagatgagtgaccaacaggatcattctgagaatactctatctgagtggaggtccagtcagcaagttgagaatggaataccatccacctcaccagcttacttggacactgatgacgatgatgatgatgattatggacctaggccttctgaactttatggaaactttacatggagaattgatcatttctcccaaatcaacaggagtgagctaaggagtaattcctttgatgtcggcggatataagtggtatatcttaatttacccgcaaggatgtgatgtctgcaatcacctctcactctttctttgtgttgccaaccatgataa

SEQ ID NO: 24282 - DNA, 590 bp, Sorghum bicolor
  Clone ID: 30933365
gcatccgcccagacgccagaccacgaacgcatcaggcaggtccgccgcgccgccgccgcctaccgcagatccacgccgccggcagctgccccagccaaagccacaggctgccgctgtctccggctagtccatgcccctcacgaaagcagccggtcggcgctgtcgtctctagctggtccgtgcccctcgcaaaagcagccggccgccgccgtctcaggtggtccacgcatccgccaaagccgccggccaccgctggtccacgcatctcgcaaagccacggcccctactgtctacacatcggttgccgctgtctccaacccggcattgctgtctcctgtggttgactgcttcgtgccgttggaacagcaagaaaaagtgttttgcatatggacagaagttgggtgaattctaggccatttagcaaggcacatctagatggggtcactgaattcatgaacttcgtatctgataaattgggtgacaatcaggaaatattatgtccatgtcgtaagtgtttgaatcggatacatagacataaaggagatgtggaggatcacttactaattcatggaatgactaatacatacact

SEQ ID NO: 24283 - DNA, 495 bp, Sorghum bicolor
  Clone ID: 30933375
ctctgtgttggaccttcatatgtgaaccgtgaggaagatttttttattgtactgcatgggatattagcacaaacagaggatgtgactgaactgcagcctgtacctgatgcacatgtccctgttatgaaatttaagttccatggaatatctattgaccttctttatgccagtgtctccctcttagtagtaccagctgacttggatatctctcaaggatcagtcctttatgacgtcgatgaagctactgtccgtagtcttaatgggtgcagagttgcagaccaaattattagacttgttccaaatattgagaattttcgcacgacattaagatgtttgaagtactgggcaaaaagaagaggtgtttactccaatgttaccggttttcttggtggtgtcaactgggctttactggttgcacgtgtctgccagctctatcccaatgctgtgccaagaatgctggtctcacggttttttagagtttttacacaatggcag

SEQ ID NO: 24284 - DNA, 619 bp, Sorghum bicolor
  Clone ID: 30933381
gggggaggagacgacggttcggcccagctcgccgctccgaccgtcgtacgagctcaactggccgcccccgccccacgcgcccagctcatcgcctccccctcgcctcctccgacgcctccacagcccttgaccgctgcttctgcagtcccggcggcggccttggctatggcgctgcggggccttcgccgcacgaacccagttcgccccctccccctcgcgtccacaggctctgaggcggtttccgcggcctccgacgcctccgaaaccttcgaacgctgcctctgcagctccggtggcggcctttgtcggtggcgccgtgggtcgccgatttcttcgatccgctgtcgtcgcaagcatagatcggccatcgctgtcaccgcctcgtgccgaggccaagatgtccaagtgatgggtggctggagagctggttgtgcggggaagagggactttgctctccttggcgtggtcaaccccctcctcgcaggacagatcaaccacctcagctataatcctatattgcctcacatgatttgttgcagaaggttcatttgatacacggagaagacagatttgttctgacttttctgaggcagcaggatgtagcagaacttggcggcag

SEQ ID NO: 24285 - DNA, 689 bp, Sorghum bicolor
  Clone ID: 30933389
agggaccttggagctcggattgctcccgactcccccgctcttcccctccctgaaccctggctccccgtgccggcggcgctaattcgatttcttccctggcgccctcttcgtcatcttgagttgtttccgcttcgaatccaatatagggacggacggcttcgaatccaatatggggagatctagagacagagggctggacagatagatagattaaagggcgcatgcacccaaaaactcgcgccacgcagaggcagtttgggggagcagaggtcggtcgaccacctttgtgagttgtaacctcgataccaggttcatggggatgctatcgctaaaccgtctcttggtcaaggaggagcggaggcgtcgccgccgaatccaagcgcgcaatggatctattactcgagtgccacggaagaactcactctgccaagaaagtggccattctcagggtggtgaaatatccacatattcggggccaaaccttcctgagggaatcttgaaaactttttggatttcggggtgaactaaacacaaggggtaacagggctctggtttatggttccctttccgcattctgaattgctggatagaccacttccctatgaaacctgtgagccttccaacttttgacaaaaatctgcactgagaatttcaagttgactaataaacttttcacctccttttatttc

SEQ ID NO: 24286 - DNA, 425 bp, Sorghum bicolor
  Clone ID: 30933399
gccgcggcagcatcgacttcctgaacacctctggcggcggccgcggctcccaagttcacgaagcgggaggcgcgagcgaagtggctacctctcgccggagatgcctccggggacctctccagaggcggcggaggccgaggcatggacgtgggagaacgcagcggctggagctgccgccgggttcgccacggtcgcggccctccacccgctcgacgtcgtccgcacccgcttccaagtgagcggtgggagggggtggtctgaggtgccgccgtacaggaacaccgcgcacgctgtgtataccatcacacgatctgagggcctgcgaggactttatgcaggattttatcctgcagttcttggatcaactgtttcctggggtttatatttctttttagctaaacaaaggtacttacagaggaaggatg

SEQ ID NO: 24287 - DNA, 584 bp, Sorghum bicolor
  Clone ID: 30933407
agtctacttccatcgtcggtgacgcccagtgtgttttgcgttggtgtcctgatgcggacaaacatacctgcaaaagtgtggcacgtaaccctaataccgccgccgcagtcgtcgtcgtcgccgccgccgcccttaagtcctacctgctcgccggtactacgaccggacagatccgagtgccttggcgtcggtgccgcatccgaagttgactccggcgttttccgtcaccggactcgaggttcgttagtctctgctgcttaaccgccggcactgcacgcagctccgaccgccataatcaccaactctggccccgaaggttcatcgtcaaccagactgctcacacacagaagctgctctatagcgttctgcaactcagcaatcatggatgcataccaacatcccagccttactatcattaaaggagaggagaacatcaagatgaagattgcactgctccggtgctatatcattgctatatttccaaaaaaaaaagagccaacctacgtttccatccatagcattgctccacatgacttccttcgtaactatctacaatttaggcacaggtggtatgatttgatgca

SEQ ID NO: 24288 - DNA, 718 bp, Sorghum bicolor
  Clone ID: 30933460
attacagtttctagattcatgcatgcatagttaacatctctctgatgaacaactctgttgctcactttttgccaaacctatgatatttctgcatttgctcaggcattcatgtgtcacattgtgttatatgctaaacaatcttgaaaataaagttgtgttgttgtgctaaaccaggtaagattaccagtcttgttaattaattaagcaacacgattgagattcatgttggtaagaaagttgggtaccaattatcgtcatttcatatcatccggtatactcgtatagactgatcagatgttattgctgttttccattctggtatgtctatttcattagaggaattctagagattttcttgtgttctccattcctttatttgtagtttcttatgctgggagataggcacttgcttcaggcgatggaatcctggctagcttttgattctgcattgtacttttttttttttgctcttcaatgttgtttctatgcttgctcctccctccgtcaaacatgatgcttgttccctttttgctatctgtcatgaatgataaaactgaaaattttgaattctaacatcagcaccgcattccgcacaaagttcagcttgcatgtgttgtggctgcctatgtttgtgctgtgttcgtgctatttatatgatcctttgtgtttatacatgttatatgatgcttggaaatgtttgcattgcaattttatgtac

SEQ ID NO: 24289 - DNA, 653 bp, Sorghum bicolor
  Clone ID: 30933462
ctactgacgcacccgcctccgctccgcctggccgcgctctcccgccatgaagcagctccacaagtcctcccccacccacgcgccatcgtcggcgcacgcgccggctcccaaggccgccaagccggcgcgccccggcccgcgctcctggatcgggtatgtcctccgcgagcagcgcctcctcttcgtcctcctcggcgcgctcatcgcctccaccttcttcctcctccggccctacctctcgctctccccgtcctcccacctgccagatgcccgcccgctcttctccttcgccgcccgctccggtgtccccgctggcttccgcccgccgccgcgccgcgtcgtcgttaccggcggggcagggttcgtcgggagccacctcgtggaccggctcctggagcagggggacagcgtgatcgtggtcgacaacttcttcaccggcaggaaggagaacgtcgcgcaccacctccggaaccccaggttcgagctgctccgccacgatgtggtcgagccaatcctcctcgaggtcgaccggatctaccacctcgcgtgccccgcgtcgcccgtgcactacaagtataacccaatcaagacgatcaagacaaatgtcatgggaactttgaatatgtttgggtctggcaaagcgaattggtgca

SEQ ID NO: 24290 - DNA, 625 bp, Sorghum bicolor
  Clone ID: 30933464
agctcgagtactgtagggttgtgatggcgaggcggttgctgctcctgccggcgctgctggtcgccgccgcgctcgcgggcggcgcgggcgcgcagctctcggcggggttctactcgtcgacctgccccaccgtggaaagcgtcgtgcgccaggccatgtcgcaggccgtcacgaacaacacccgcaccggcgccgccatgctccgcctcttcttccacgactgcttcgtcaatggctgcgacgcctcgctgctgctggacgacacgcccacgacgcccggcgagaagggcgccggcgccaacgccggcgcctccacctccggcttcgacctcatcgacaccatcaagacgcaggtcgaggccgcctgccccgccaccgtctcctgcgccgacatcctcgccctcgccgcccgcgacgccgtcaacctgctcggcggcccgagctgggcggtgccgctgggccggcgggacgcgacgttcccgaacagcacgggcgccgggacggacctgcccggcccggactccgacctggacggcctggtggccgggttcgccgccaagggcctgacgtcgcgggacctggcggcgctgtcgggcgcgcacaccgtggggatggcgcggtgcgc

SEQ ID NO: 24291 - DNA, 595 bp, Sorghum bicolor
  Clone ID: 30933468
aaaaaaagaaaaaaaaaaacgccaagcggatcattggagcgaggaatttgactaacaccttacgaatctcccaatcaccacagcggaaagagcctacgtgatgaatcctaacaagttcacgcacaagacgaatgaggcgctggccttggcgcacaatatcgcctcagaggccgggcacgcccagatcacgccgctgcatctcgcggcggcgctgatcgcagacaggcccggcgtcctccgccaagccatcgcccacgcgtccggcggcaacgacgtcgctgctgccgattccttcgagcgcgtcctggcttccacgctcaagaggctgccctcgcagtcgcctccgccggatactgtcccggcttccaccgcgcttgtcaaggtcatccgccgcgcgcagtccgcgcagaaggtgcgcggggactcccacctcgccgtggaccagttgctggtaggcctcctcgaggatccccaggtctgggatgcactcaaggaggctggcgttgttgcggcgcgggtgaaggccgaggtcgacaagctccgcggcggcgacaaccgccgtgtggagtctgcatctggggacaccagcttccag

SEQ ID NO: 24292 - DNA, 504 bp, Sorghum bicolor
  Clone ID: 30933494
tcccagtgttaaccattttacagtaccatggttgttgctgttcccatgacgcatcgtacatgatgtggtctatacagtcctccatttcatgagctagctggcgcaactcttcaacggacagacgtagtatctgaccatcctgccccaagagctgctcatcaatggcactagtgatcattttaagctcactcttcagaaaagccagatctccatcaaagcccttgtagagcttgtatttctcctccgccagcgagaacaatcttgacacgaggttgtctagaaatgcgctcaacaggcccgggtcctccatcgatcacaatggttgttaggcgctgatggttcctagtgttgtggagatgaagtgcacccacctttgcacatacagacgatgtgtagaataaaactgacaagagagcacattaaacttaaggagcatcttatagcatgggagatgaccacatccttcttttcatctgacagtaaatagcatttgttagcatatct

SEQ ID NO: 24293 - DNA, 586 bp, Sorghum bicolor
  Clone ID: 30933509
gaaggctacgagaacatccccgctgaaattgttgaccctgaggccaagaagcctgaagactgggacgacgaattggacggtgaatgggaagctcctatgatccccaaccccgagttcaagggtgagtggaagcctcgccgcatccccaaccctgcttacaagggcgagtgggtccaccccaagattgccaaccctgactacaagcccaacgctgagctctacgcctacgactccttcaagaccgtcgccgttgagatctggcaagttaaggctggttccatcttcgacaacatcatcatcaccgactctgaagaggaggctcgtgagttcgccaaggaaaccctcgagaagaccaagaagggtgagaaggaaatgaaggacaagcaagacgagcaagagaagaaggagcgtgaggagcgcatggagaaggaaaagaaggaagctgaggctgctgcccccgaggaggctgaagctgctgcccctgaagacaaggacgaactttaaacagtttgttcctcgcgaatcaaacactccatgagctgtaactaatcacagcttttttgttccaataaaatcgttttaatcc

SEQ ID NO: 24294 - DNA, 610 bp, Sorghum bicolor
  Clone ID: 30933513
ggcgtcatgttcggccacgactacttcacgtccgccgacgaccgcggcgtgcgccgcgccgtcacgctgttcgccagggtcaaggggctcaccgtccggccgcacggccagcactgggtgctctccccgaagcccccgcgaggagggcgtggcggcgacgacgcccggcgacggtgagtgcctgtcgctgtcgccgccgggcccggccggggccttgtactcgatcctccggccggcaccgaacctgcctgacgtgtcccgttgcaccagcgtccgtagccgtgttcgtatcgtacttgaggtggaggcgtgcagcaccccaccacggcacacctcgatcaaaagccgacgaaaaaggttgcgccgcccccgccactgttctcttctctgacagcactctcgtctcaaccaccattgcttttgctgtaacattcttctctaactacacggggatatcatacatgtatatagaactatatataatataagaacgcatgcatttgttctcgtctgggagatgattatattcaaacacgaaacgttcatgtgtagtgtagatatatggacacggcaatttcaagtgttttatggagcatctaaagctggttag

SEQ ID NO: 24295 - DNA, 684 bp, Sorghum bicolor
  Clone ID: 30933517
tcatgaacaatgcaatcctaagatcattcatagggatgtcaaagctgcaaacatattgcttgatgaaagttttgaagcaatcgttggggattttggattggcgaaacttcttgaccgtcaggaatcacatgttactactgcagttcggggcactattgggcatattgctcctgagtatctctcgactggacagtcctcagaaaagactgatgtttatgggtttggtattctcctgttggaactgatcactggtcctaaaaccttgagcaatggacatggccagtctcagaaaggcatgattctagattgggttagggagctaaaggaggaaaagaaactggataagctggtcgacagggatctcagagattcatttgatattctcgagctggaatgttcagttgacgtgatcatccaatgtacactgacgaaccctatactgcggcctaagatgtctgaagttctgcacgctcttgaagctaacgtcacgctggcagaaagcagcgtcgagttgaatagagaacctcttcctagtggcctgccttacagtttctctataagacatgaggacccacatgattcgtcgtccttcataatagagccaattgagctatctggtcccagatgacatctgttatcggtcgggtggggacaaaaatgaaccaaaagaagtttgaaattgtc

SEQ ID NO: 24296 - DNA, 598 bp, Sorghum bicolor
  Clone ID: 30933521
gcggtacctttaggagcttgacagcagaaggcttttcgtatcttatgaagaggatcaaagagatcatagaagctcaagccaccgtccaccgttgcaccgccgtcatcgacttcatggaggaggagctccgtccatatccagcaactgtaaacgatgaagggatgtaccatcacgccagagaagtggcggagaccatgcttgggcaggagaacgtgagggtaggcgcccaattaatgggcgctgaggatttttccttctacgcgcagaactttgcaggggcgttcttctttattggagtccacaacaagagtatgaaggcaatgtatcccctccactccccttactttgtgattgatgaggatgtgctccctgtaggagctgccttccatgctgcagtagcgatggagtacctgatcaaacatacagctgccgcaaactgaactgtgatagattgcttccctgcttgtaaggattatgatagtgaagctcatgttttacaaataattgtagtttcgccttgctctgtacgtcaattgcctatatgggtttcagcatagtttaatcatcatatataaactttaatttagaacttactcgt

SEQ ID NO: 24297 - DNA, 561 bp, Sorghum bicolor
  Clone ID: 30933535
gataggaattgaaaaatctcctgacttaaccaagcagtttggcatattgatggtcttgggcatctccggaacaaaacagttcactcttatgaaaattgaatttgaaccctcaaatgcacaaggcagcaacttcatatttcgagctttcatataagataatatgtgtttatggatacattactagtgaaagctaatataatatggaagaataatatcagtagaagaatctctttgccagtaggcatctgtatcggattggtcagtcaaacgccactcatcgatcaaggcattgaggcatgcgtttttatattacgaaaaattatcaaagactctatatattattgacttgtagagactgataacttttatgggttcaggctaagcaggacgttgtagctactttctccgctccaagatataagggctacatatttcatgatgcatggctaaatttgattgattgatgttttagatggagaggtatttttttctatagattggaagaatgtgtggaaaattttgatttagaacaaaacgaaaagaccttatattgatttattt

SEQ ID NO: 24298 - DNA, 605 bp, Sorghum bicolor
  Clone ID: 30933539
gaataaaaaatggggctaatcatggcatgtaatactaatatatccacacagcttcaaagcagagctaactatctagcagtaagcatacatgaattttgcaagtttgcaaccctgttgttgctcagttccctctcagaacttgccgtccgccgcttggacatggttgggaccgccgtcgccgcccggcaccatcagcaacctcgtggtgccgtggaacgccgccgctgctggtgctggtgctggctctgcctcaagggagaaattcagcagagggccgagctacaactgatggaccgatctcactcaaaggaacgtgatcagattcacggcgtcactgaggttggtatgtgtaccactagccgatggaaaagcaggagagagtgcttctgctgagtgcgtgttcttctcagagtttagtacgtaatggttttgtcctagttcccttgctgtacaaaacttgcaggcttttagatggttgatgatagagttttgctccataagggtatggttagctgcatagcttgtgtgaggaaatagagacctggtcatgtaaatttccttgtataatatgtacatcttgtggaatgaaagcttgttacttattc

SEQ ID NO: 24299 - DNA, 595 bp, Sorghum bicolor
  Clone ID: 30933554
tcaaagagtgaagacgatgaaaatgatgttaagattgattggcttgaagatcccatttcaaaagctaaaataatcagatggaaggtgcaatccatctctgtggatatggaaaaggtgtctactagttttgctacaggtatctcggatgttgctgaagcttatgctgcagctatgcaaagtgctctcgctggcaagcaggatgacctcccaaatcaaaagtctttgcaagagaaggttaagtccatatccatccatcttaactccgatcagaccagtgctgtcagcaagctacaagatgctctgcagtacctggcctacgtcgtcgtatgcgcttcaatgccaagtgtgtaattgtggtgtgtttcctgtgctgagcattgcctcaattgttagtcatttatgtacatttgcctacgggttcccttcagggctgcagaattagggcctctagctatcatcgtaccacattaggacgtgttggttagttgtgatggttgtactccattgcacttggaaagttgttgctctctctgtttttcctctgagaacaatgaattactgatgtttaatatacatacaagtgaactgatgtgtc

SEQ ID NO: 24300 - DNA, 670 bp, Sorghum bicolor
  Clone ID: 30933556
aagacaaagctgagattgagatgtatgaaaaggaattggagaatcaagatgctcaaaagcagaaagatgagatggaattaatagagaagagaattgaaaacagacccgaaaagttggagaaatttatgaactttagtgaaggtgctacttccaacatgatcaatgaagaaaatatagagagtgaaggtgaggtgtttcccatagacaaacaagacaacatatcttctgaaaagcagaaagaaacagataaggaggggtggatgctccgagaagtcataagccaacctgcaattgcccaaagaagaagtacgagagctggcacccaaggcaacatacaggagaaggcgaccatgctcaaagcggcaagaaatgaaatcacagaaatggagcattctactgaaggagaaagaaaaaggctggatttcgaagacggtggaacgactttcaagaattttgacgtaaagcgtccaagattagtggtgtagcagagaagtggagagttaaaatgctcaagaaaaagaggcgaaagggctggtctctgaagtggagctttttgcttaagaagtgtgtcaaagttcataaagctttgatgtaatcttttgttaagttcctttccctaaactgttacagttaagaggagtgtgcaatatgcacgttcttgaaccttttt

SEQ ID NO: 24301 - DNA, 513 bp, Sorghum bicolor
  Clone ID: 30933563
ggagttcctcaccgcgggctaaggcatcgagcacggccaggccaatcaaccacgcggcgaacacgcggccgtctgcagccctgatccgtctccgcggcctccgccccgccaccttcgcccatgccagtttgacaaagcttatggccttctttaatcttggactccatcgtgaccgcgagaccggccgccgaccatgcggccgtccacagccccgatccgtctctgcgcctgtgccccgccacctccgccgatgccagtttgctctaggttattgctagggtatcctcagacagcctccatgttttttggattaatatcactttaatatcgatatttaatttcacaatattgttattttgtcatgttatccgtgtatttttagtacaaagtttagctgttttgtagcaacgcgcgggcacgaacctatcttaccagaatagagaagaggtaatttgtatgcaatacaaacaaaggcaaccaaaccacctaataccaactatatattggcttgcg

SEQ ID NO: 24302 - DNA, 169 bp, Sorghum bicolor
  Clone ID: 30933575
ccctatgatgtatcatcattatcccataatctcatcggcatgcatgcatcaatgcatatatatatgttggccgggttatcaaggccggttttatagccttatatatatggtatacatatccatatgataaatcaaccaagttatccatgcttttttgttccccaaatat

SEQ ID NO: 24303 - DNA, 601 bp, Sorghum bicolor
  Clone ID: 30933601
tttcaagggatgctgctaggaaaataaaggagcgttctaagatcttccataggccgcccttaccatcccctgtgaggggaggcagtgcaagccccagaaccctctcaccagctgcacaaaaatttgtgaggaatgccatctcaaagtcggcaaagtccacaaacaccattgatgaatctctccgtgcaagctacagaggttcaaccccatctgcaagcactcccaagacaaggttttcaagagacccaggcctcgcgtcgcgatctccatcaacaaggcagggttccacccctccctggtgatttttagtaagcctcttaatgttatttcagaaaatagataaatgacccatcctgtactgtaacaaattgtataatgatgaaagattggaagtgatgcttgtttagtgtttactttcaatatctgagcacacttaccaaatcactgtcatgagcatatctttgcgtgctaagttgcaacatgcacctcaattttcaacggcatctgggcaggcccagctcgtcctttgtcgccttgttgcctctggaacaatgggttcaacaaaaactcatggcactgaaatacaaattcatggtaattc

SEQ ID NO: 24304 - DNA, 433 bp, Sorghum bicolor
  unsure (1)..(433): unsure at all n locations
  Clone ID: 30933619
gttgtccgaaagcggttgtgggtgccctcctcgtcctttccccctcctatcacagcgtgccggccagacttgctgtgccggcccacacgcggggcacgacgacgctcccaggttgcgcccgcagcgctgcacctggtcctttttttctctttcggcaacctgtgatgaaaagtccatgcccgttgctttaggatatgatctgatgtttattcgcttgtgaggtactgggcatgacctgttctgttacttatattatgtaaattcttagagtgactaatttatcagcatgccttgaagctccaggttgatgaacaaatgatcattggcatgtttttgaggcttctaaaaatcatgttttcattgaaaacaaatttctaccttctccattactgtgatagagattttgcaaacctttaaaaganacatgttgttt

SEQ ID NO: 24305 - DNA, 700 bp, Sorghum bicolor
  Clone ID: 30933629
gcaatatttattatagacatatgcatcgacaaccgtccttttaaagtttttataaatagaaaggaagagggggttggagatctcaaatgtggttatgttggagagaccaatatattgggaagatgttgcatatgagcatggagtaaacgaagtggctatcaaataaattccatgctcattaatgttatcttcgtctccaatctgaatgttcagagtttctcctggattggtctcaactgtgtcctcttctgtagttggatgaatctcatcttcaaagggagtcaagaactcaccatttgaaattgagccaaagtcagaatccattaaggcttcttccttatccatccattctacacattctagccatttagaacttgtgatcaggaaaggggaggtgttagaattttctatatggcttagctctccttctatgacattacttgacatgtcatcctcatggtctttatgactcctatggtttgatcgtcttgatggattgctaggatcatcatgagactgaaaaggagaggggtaagaggggtctctaaggttaaggatggatttagaatttgtgaacattgaaggggagcagatagagtcttgtatatggtttagctctccttcacttgatatttcatcctcgacttcttcataacaggaaccaggacattctctaagagaaccatcattgcaaggattg

SEQ ID NO: 24306 - DNA, 595 bp, Sorghum bicolor
  Clone ID: 30933631
gacggcaagtacgcggcgcatccggtgttcgaccacggcatagcgccgccgccgccaccgtccgccacgaggctgcaggacccggcggacttcttgggtctcatacatcacgacgtcatggtgggctcccaagggccgcacgcgcacttgcacttgcacccgcgcaacggcggcgacgagctgtccggcctggtcgggggcgcgtccgtcaccgtcaccggggccggcggctgcaaggggacgtactcttcgacgcggcctctgctggagcgcaatcggcgtaacccgtcggccggcggctccacagcgacgacgacgacggccccggtggcggcggcaacggcgggcatgagaacacaagcaggcgtcgtcgactcatgggtctgcacgtcagattaaattaggatactgattaatttacttgcttatatttccaagaatccaattgagtagtacatgatgcgagcagattttgatttgtcctggtaactacttccacttgaatatagttgtttctgttcttgaatttgcatgcatatatatgctagtaaaggttattaataactagaccaaataaaaagattacttttttggt

SEQ ID NO: 24307 - DNA, 631 bp, Sorghum bicolor
  Clone ID: 30933687
ccatacgcgtgctgcagcgtgcctgcttctactctcttctcccttctctgcctcgccctcgcctcgtcgctccggtaatgacaccaagctggtgctggtcgtagcttggtgtgctgcggactgcggttgcacttgcaccacgcccctggctcggaatggactccggcaacagcggcagcctgcagtcgtccagcggcggcgacgacgagttcgactccagatgcggtgccgactcctcgccgctctccgccctgctccggcagccgccgctgccatccgtgccaggcttcggcggcggctccttgatctacggcctccaggagctccgcacgccgccgctgtcccagtcccactggtgctcgacgacgacggcgccactgccactcacggtcacggccggcgcagaggcctcgggctcggactcgccgccgtcgctgcccgggcatggtgcagctatggcggcctctgcggcggtcgaccaggctgacgcagcgccggcgccgccgccgcgggggtcgaggaagcgggcgcgtcgggcgtcgcgccgcgcgcccaccacggtgctcaccaccgacacctccaacttccgcgccatggtgcaggagttcaccggcatccccgccccgccctt

SEQ ID NO: 24308 - DNA, 594 bp, Sorghum bicolor
  unsure (1)..(594): unsure at all n locations
  Clone ID: 30933693
aaaagcttggccatggctatggctaaaaagggagcaagcagccttctcctactcagcctctcctcctacctcctctgtgttgcccatgccgccacctcgcttagcttcagctacaacttctccgacgccggcgtcctaaccggcgccgacctcacgtacatgtccaacgccactgccgccagcgatcggatcgacctgaccaaggacacgacctggagcaccggccgggtggcgtacgggcagcccgtgccgctgtggaacaacagcagcaccggcaattccatggtcgccagcttcacctccaacttcaccttcgccatcacgccacacaacagcactttcggccagggcgacggcatggcgttcttcgtggcgccgtacccgccgtctctgccgcaggactccaacggcggcttcctggggctcttcaacaaccccaacaacacggccaacgcctacttcccgccgaccgtcgccgtggagttcgacgcgttcaggaacacctgngacccggagagcaccgtgaaccacgtcggcgtcgacgtcaacagcatcgtctccgccgcgtacgcggcgctgccggacgcgagcttc

SEQ ID NO: 24309 - DNA, 590 bp, Sorghum bicolor
  unsure (1)..(590): unsure at all n locations
  Clone ID: 30933695
actgtggcccttttttttttttttttgtttcatgtatgtataataaaaatcaatcaatcaatcaatcaacacaggctgtgtgcgcgtgtatagtatgatcactgccatcacatacacactttggcacctagtgcactgccgcctcgcgcgtgctcaaaagaaacacgtctgttttcagactggatggattcgccctcttggatccttccatgtgcttaaggccaaaacctttcgttttccagttaccggagacgattagttctagtatttcagtgtcacgatgataatggtattggtagcgcggctcactttataggactttttcctcacacatgccatgccactgacggtactggattgaacgttcagattttcgtgctacctttctgctaaatccttgcccccccacccccgtttttcaatgtttttgactgctctacgacgacnaaaggtttacttgttttgtttctaagccgagctaaggaagtaaagaggaaacttcagttttcgtgcctctgccacctacttctaacttcgcccaactttctcactttattaatactgaaaaaaaaaaagaatataaatacctc

SEQ ID NO: 24310 - DNA, 634 bp, Sorghum bicolor
  Clone ID: 30933706
gaaagtcttcagagcatccgtccaaatggagtgacaaagaacgaggatcattgcttgcatccttgtcgtcatgaatgaactcctgtatggccttctgaagaatggtcaatttactactagttgcagatgactcacaccagatctttaccttccgcaattttttcatatgacccataagttctgcaaatccgtcactttcatctacaagaaatcctgccagtgtctgcactttacatttggctgaagtaagaaatttctgcagttcatcatttatggttttatctggaagcttgaattttccaaagagatgaattatatggggcagctgaataacttcagttggaagtatctttatattcgttctccttaggttgagtgtctccaaaagtttcagttgttttatctctttgggaaggatggtaacattttctcctaggctcagatatttaagaagcaataagttgcatatttctctgagatgatcattttgcaaatctgtacagtcttcgaggtccaagacccttagtagttggtacttgttgaaattcaacatagttttacctgcctccccaaatactatcagagatctgataacagagagatcaatgttcaaagtggcatcatctgtaatagt

SEQ ID NO: 24311 - DNA, 607 bp, Sorghum bicolor
  Clone ID: 30933714
atcgcgtcctcatccgggatccgccgccacccacctccaccgtacacgcccttctcccgtctgccgccacccccagccaccacacgccccacgccccccagacttctgggcatagctgctaggcggcgcatctggcggcggcgcatctggcttggctagcggcggcgcatagcagagcaaggggctaggggcgggtcagctcaacactcagcactgcgacgagcggcagcgcatcgtgctccggcatccggcgaggggcggctctccgcgtgcgcggtccgcgcgggcaccggtcggccagtgggcctagcgcatgcgagcggggtgctgggcgcgggcagtaccacggtaggcagctgtgctgggcggcaagcatctgcagctgtgcgggcgctgagcgacactgcggcagtgtggcaggtggcggtggctcctctggtcgtggccctgctccagcacctgtcctccacactggcgtctgagcagtgagcctgtgaggctctgagcctgagctacacggcagctccactgctgctactccttactgctattgctctgttagattttctatagatctctgttagtatgattagtgctggagaatatt

SEQ ID NO: 24312 - DNA, 691 bp, Sorghum bicolor
  Clone ID: 30933716
gcttggatttgaagaacagccatctgctcggagcgccgccgcgcgagatgggccccatcgccagcgaagcctcctcgtcgtcggcgaacagtgccacctcgtcctcggacgccgacgccccgggctccccctcgccgtcgccgtcccggcgggcggcgcccactctgctcctcctcgccttcctcgccgggctcctcatcctctccaccggcgacgatgccacggcgcagcagctcaatggtgttagcttggaaagtccagaggtttcatttgttccctcccctttggatggacaattttgtgagcgaatcctcctatctggagtgccaaggttacatcttgatagctatgcaagccaaattcgtgtcaaaatgaatgtctctcaatcgattcctgagaagttccattggaaaatagaggtttgctttcataggaatgcctccatggatttatgccagtgcgagacgggtgaatggcaaggttttcaagatgggatgtggactgctctaaattctccatatggaaacaaatatgttgatgtgaaattggctgataaaaaacctgctaggttcactctttccattcaggaagagtttcagaaatggcgtttggcttgccttggtattggatttgtattgctattcctctcgccaattgttagcaaatgggctcccttttactatagcagctc

SEQ ID NO: 24313 - DNA, 659 bp, Sorghum bicolor
  Clone ID: 30933722
tttgtttatttcgacaacacagacctaaacgtcgccaataacaatgagactcgcatccatttttgccatcttcgtttgcgttgttgccttcgcctctgcccacgtttacttcaaggaaacctttgacggtaaatgggaagaccgatggactgaatctgagtggaaggaagccggtactcgtggtaaattcgccgttactgccggcaagttctacaacgacgaggaagccgacaagggtttgcaaactactgaggactaccgttactacaccatctctgctgaccacgaagagttcagcaacaagggcaagaccctcgtccttcaatacagcttgaagaaccaacaaaagctcgactgcggtggtggataccttaagttcttccccgctggtgttgacaagaagaccctcaacggtgactccaagtacaacattatgttcggccctgatatttgcggtaccactacccgcaaggttcacgtcatcttcgagcacgaaggcaagaaccacttggtcaagaaggagatcccttgcgagactgatgagtttactcacttgtacaccctcattgtccgccccgacaacaccttcgaggttctcgttgacggcgtttctaaggccactggctctttggaagctgacttcgacattcttcctccta

SEQ ID NO: 24314 - DNA, 592 bp, Sorghum bicolor
  Clone ID: 30933727
agaaaaggagactctttgtggcgtgacccctgagtccgtgaccatgaagccacgtccaccggcgccggggccgtcgtctgcttccgccgcgccggccaggctccggccgcacctcgcgcggctcgcctccttcctgatcgtcttcgccgtgggctactcgctgggcctcctgtcgtcgtccacccggccgtccccgagaccgtcccagacgacgatcatacggccgcacgccgcgcacctcaccgacgcctccccggcggcggcgtcgaacggaaccgccggcgcagcggccgtgtcgagctcgagctacccaccgcggtcgcctccgcacgacctgttccggttcaaggaggagtgcggggagccggtgccgagcgacgccgtcgtgcggactctgctcgacaagctcttcgacggcgagagcccctacgcggggttccctccaaaccacacggcggctctgctgcacccggcggcggcgcgcccgcgcgggtgggggtctacgggggccgtgttcaaggagctcatcgaggcggtgcggccggaggtgatcgtggagctgggcgcgttcctgggcgcgtcggcgctgcac

SEQ ID NO: 24315 - DNA, 679 bp, Sorghum bicolor
  Clone ID: 30933733
atcgcgagagttgtcatggatctgaacgccagtttcgcggcgcctttcaaggacagggtagctgcacttgttgccgacaaggagagcggcggtgtcgactgcgtgatcaccgacgcagtatggttctcagcgcaggcagctgcgcaggagctaggcgttccgtcgctgggactcttcaccaacagcgcggcaagcttccggacgttcatggcctacccgacgctaattgagaagggctacctgcctgtacaagagtcgaagaaggacgatccggtgccggagctgcctccgttccgtgtgaaagacctggaacgcatcgacacgagtagtctttacgacttcgccagcatggtcggcaacgtcgtggccagagcgcggcaggcatctggcctcatactcaacagcttcgatgccatcgaggccaacaacgtgaataaaatcagggaggaattgtccatcccggtgttcgccgtgggtcctctcaataaactctcgccgtcagtcgtcaagaccaacctcatgccaggaggccgcgagtgcctcgactggctggacacccaggcgcctggctccgtgctctatgtcagcttcggtagcatcgccgccatggacgctcccgatttcgttgagctcgcctggggtcttgcagacagcaagcgcccgttcgtttgggcagttc

SEQ ID NO: 24316 - DNA, 744 bp, Sorghum bicolor
  unsure (1)..(744): unsure at all n locations
  Clone ID: 30933735
aaaaaaaaaaaaaaaaaaaaaaaaaaaaaaaaaaaacaccacccaccacccagcgccctcgccgccgccttccngttcgctctcgcgcttcgcgctacgcttcgctttccccagtcagtctccccctcgcccgctcgcgatggcggccgcaccgcggcggctcactcccctcgccgcggcggccgtcgcggcgtggatgctggccgccgctgctactgctggcgtggaggccggggacccgccgctctcgcccaaggggatcaactacaaagtggcggcgctcatggcggttaaaagccggctgcgggacgagaggggggtcatggcccactgggacatctactccgtcgacccctgcacctggtccatggtcgcctgctccccggacaagttcgtcgtctcgctccagatggccaacaacggcttgtccggggcactgtcgccgagcatcgggaacctcagccacctccagacaatgtcactacagaataacagaatatcaggtgaaattcctccagagatagggaagctgatcaatctgaatgctcttgacctttctagtaacgagttcattggtgatatgccaagttcattggggcaattgactcgactaaattatctacgccttgataggaataacttgtctgggccgatcccagcagatgttgctaggcttccaggtctcacattccttgatttatcattcaacaatttaagtggccaagttccaaaaatctatgcaca

SEQ ID NO: 24317 - DNA, 646 bp, Sorghum bicolor
  Clone ID: 30933743
aatttgggcagcttgacaaatgacggagcaaacttggcaaaaatgccaagttgtagacggctttgcaaacctgatcgcgcgtgcaaagtcacacgcaaggaaagcgcgcgcgcctggagacttcctatttttatcctttgccaagtccaaatgccaatttctttggagatggcctatttttatcctttgcattttgttatggaagtttgcaaacaacaacaaatgccaagtcaatttgccaaagcctttggagatgctctatgtctgatgggcccacttatattttctatattattttgatagttggctctttgtttggaaataaagatgataacaaataagttgttgatatgattttgaataggaatggaacctattcttaataaaatcaagatcagtgaatggtccaactaatcaacttagaagtgtattttgtacaagatcccctccttgatccggagccagtcttatatcttggcttgcagaccccaagtttatctattgggcagtttgttatccaatgcaatttaaataaacatggctgcgagttacacacatgttacgacacaattcctgacaagggctaccataaaattgagagagctcttgtgtcatactccctccggccaattttatctgacgcagg

SEQ ID NO: 24318 - DNA, 603 bp, Sorghum bicolor
  Clone ID: 30933757
aagtgcgtggagctgaaaccgtttgactaaaaaacgtggagcggagctgaaaacgtggatgtagtcccaaacaccatcttaatagtgtctttttcttataataaattagtgaacagtaattttatagttatggtcagctaaaggcacaagtacagcttacgttcgttctggccgctgctgtagtgcctgtctgggatggctagatgcttgcacgatgagcaatccatagttaggcctggtttagtttcatccaaaaacttttcactctatcttgaacacatatataaagtattaaatgtacataaaaaaaaactaattgtacaaattagttgaattttatgagacagatctttcaaatctaattaatttattattaaacactaattgctacagtaacacctacaacactgacaaattaattagatttaataaattcatctcacgatttctaaacagattttgtaatttttttttggtcaggtaacatatcctcaattagtatttaagcatcccatgagacactcttatatttttttttgagaatcatgagacactcttatataacacttgatacgacacaaacttttgggccttgaactaaac

SEQ ID NO: 24319 - DNA, 723 bp, Sorghum bicolor
  Clone ID: 30933762
attaggcatcaaggagtctagcagccatctacgagaccacgagtagtgagcgagcgagagctctagtccttcgtacaccttgtaagtgagtggtcccgagcaggagcgggtgcctcgcctatgccgaggtaagccggctcttgtcgtccgtgtgttcggggcctctcgaaagggaaagccatatataatcatgtttgtgaacatggagtgagtttttccttgtgtttccctgttgttctttgatccggtcgtatgagatgagtcgctatgctagggaccctataggagaaacctctgcgtgtgatcttgctctcgtcttagccgtagacaggcgtcatggagagccctgctgccgcggagaagtgttcccttcgggtggaattgcctgggtagacggtagtatcccgtcgaggtgcgccgtatctagagaatgctggggagatactgaggtggtcagctccgtaggataggctcgagataagtatggtgagtactgagtaggaccaacacacctacgtgagcaactagtggcagacttgcgggcttcgccaacctctaaggtcctgcatatacgcatatactgagaatatatcataagcgcgcgtgaatattatatccgatgagtcctaatcactcatattagcaatgcatatcggctaatcatacagtatacgggaatatctcaatacttaattatacatacactatatacatctcaatata

SEQ ID NO: 24320 - DNA, 427 bp, Sorghum bicolor
  Clone ID: 30933782
gatctggagggagggggaggtggtggggaatggcggcggcgacggcgacggcgacgctccggtgggtgctgcagctgcaccgggacgtgccgcgagcggcgcggttctacgcggagggtctcgacttcagtgtgaacgtctgcacgctccgctgggccgagctgcagtcggggccgctcaagctcgcgctcatgcacaccaatgacaggtgcggctactgctgtttgttaccgcgttctcctcgtagtattattcacagttcgtacgacttcgggcttctgttggattctaattcggagttgttcgagggaatgaggtggagagaggccactgtggtgttacgagctgcgaggctcatgtgttcgatgaaatgtgtctgtggagctcttggttttatttaagttttgaaaatcaagtcagttttcat

SEQ ID NO: 24321 - DNA, 664 bp, Sorghum bicolor
  Clone ID: 30933788
ctagtgccttcacgcagttgagcacaacttagggttcccagcatcagcggccgagatccggcgatttcgtccgtggagtcgcaaagtagtcaaggcaagacctcaaatagtggatgagcgatcttttgcagcagcagtgaaacaaggggggatggatcgcggaagggaaggagtatatcgagagcagtcagattcacggtcaagattggggggaagaactggcccaggtcgatatgctgatggaagggactggcgtggtgatgatgagaggggaaatcaagacagcttcaacaaaggtgaggatcgttttcatttcaatcctcaaagaggtgatgttcgttcaggatctggtggctagtatgctagagattatcagaggtcagagtactgggctggatcttggggtcagttcaatacagatgaggaaaggggtggatatcagggtggcaaaagaggggatgaaattgacagaggaggggcaagcaaacatcggttgaatgagagggaagactggaaaaatgagagtgacttgaggaacaaaatactgagaaaccaagatgaaagagggcgcatggatttatatagatgagataaagctgaagtgggttgggaataaaaaggcaaaggtaatattggtaaccaagatatctactgttttaattgc

SEQ ID NO: 24322 - DNA, 608 bp, Sorghum bicolor
  Clone ID: 30933794
gcactgcccttcccgcaacgtccttcctctcccgtccagctccaccacgaaactctcctaccacttcctctctgcgcgcgataaccgccgcgcagctcccctaacccttcctctccgcgattgttgccgtcgccgccgccggacggcgctatccgccgcgcagcttccccacgcacctcccgtatccctccctttctgcgcgctctgccgtcgcggccgccggacgcacgccgggctgccccacggttcaggtcaatccgctccttcgtcgtgctcatccacgccctcacgccgccgcaccgcctggagggcgcaccggtgaccaatccgcgcctgcaccggagcctcgaacccgtcgtccgcgcgctgccgtcggcgacagctgccgtccgcgcgagtctcgtcctcgagcgccgcccgtgaccgctccgcgaccgctgtgatctcggccagctgccgtccgcacgagccccgtctcgaccggccgccgtccgtccgcgcgcgccgccgtccgtgcgagccccatcctcaagcgccgatccgctgccgtcgtggatctacaggccatctccctccaccccctgattcgctgccatcgtggtctggga

SEQ ID NO: 24323 - DNA, 631 bp, Sorghum bicolor
  Clone ID: 30933812
ggagcccgtcgcggtgctgctcccggacgtgacgcacctggtgctatcggcgctcgtctcggccggcgccgtcgcggatgacgcgggcgtttggggctgggacatctccagcggtgggaaggggctgaaggtccaggagttcacgtcgtgggtgctgtccacgcctgtcggccttgggaactgcctctcgcgctatgtgcgggacagattccgcgcgctggctgctgactctgtggaggagagctctgtttcaactgttaacacaacctttgatacctctgatgtttatctgctaacacggggaagagcatgggcaatcgctctcagcctaagaaacaagttgagtgaaaagctgttgtcagcttctgtaattggaatggacacagaagaccttctttataggtcatctgttcatgggaaaggactgagccggttctggtcttgtgttgaggggtacaaagggccaatgctgattctactttcagcattctcaaagagtgctggtgagaatgttgattctgatcgaagatgggtgattggtgtattgaccgaggaaggatttgagagcaaagataccttttatggtagctctgggatcctttgtgctgcacatccaatattccgcatgcta

SEQ ID NO: 24324 - DNA, 755 bp, Sorghum bicolor
  Clone ID: 30933814
agagccccagccgcctcgccctcgccgagggattggacattggagtacaaccgcaacacggcgacgcgacgacacacagacaaggaagtcgcatcctcctctttccgtcgctctgcaatcgccccaaattcccctcttcccctcgctcgcgtcacgagagcaagcagcgcgcaggtgctgaaaccggtgagcggttgatggatgatgactgttcccatggatagtgctagcgtagccccatcctcggtacgggaccttgccgagcgtctccttattaggaataatgaactcgaagatcagctccgcaagtccgcacaatccaaagtcccatcagatcccaacatatggcttcagatgcgtgacaactttgagaagataattctcttagatcatgacctctctgaacagaaagaggtagaatatctcctgtggcagttgcactacaaaagaattgaagacttcaggaggaacattagtgctgcaagctcagttgcatctagtgggaagagcaatgctaacccagatcgagtcaagagaatcaaatcagccttcaaaagcttcctttcagaagcaactggcttctatcatgacttgatgttaaagatcaaatcaaattggggccttccactcagttactttccagagggccttgacaatgcgaacaactctgtgcgagatgacaagaaaacagttcagttgaagaaaggtttgatttcatgccatcggtgtctgatatatttgggagatcttgctcg

SEQ ID NO: 24325 - DNA, 690 bp, Sorghum bicolor
  Clone ID: 30933832
atgttttccggccagatagaagatgcattctgtatttttatacattcttgtatttcagcgaccggtggcagcttctgaacaaaatcaccttgcctgaggaatgggggtatcgatttagaggcatcataggtgctgctgagggatacttatttataaagctagatgatcctaaggagaacctcaatgatcagattgagcgacatgttgaatatttttcgcttgatgtcaagacaatgcagcttgggagtttctgtcggacaaccctttttactgtgactgatgcctacctttattgtggtttccccccatcattgtcactgccttctatatgatttggaaaaagaatggcaccacagaatgtctgttgggactagtagaaggaaaaaaagaatggcgaatgaatggcaccacagaatttgtcatttccttgaaccgctacgaggctacattcaggaaccgagaagactactctgaatctctgattgccaccttacttgcgattttgttaaaatggatactatgaaaactattgggtaatatgaccatcttgtatttcatagtttgggtcaaactcctcactggtgacgaagattgaggtggagtgatctttcttggttgccattacaagatgttgagtctatggttttgttgtaatactttgttgtctttgaaaaatttatgaaaattgct

SEQ ID NO: 24326 - DNA, 396 bp, Sorghum bicolor
  Clone ID: 30933834
tttggtggcccccaggctcagcatcccaatcaaaaccatcgtccccagagtacatcaaatggggggcagtcgcttagtggtcagtccctaaacgactccatggatttcatttgaggccaatatcagggccaatattacatcatataccaactgcagttcagccctgtaaagatagctaatgtccaatgtatgcatatgcctcattggtagtgtagttagctcttctttgtatcatcatcatcattaatctgaaagtggctcctgtatgtcaaaatgctgtttgttttcttctttgctggtttctggagtaatgtgttagattgaactaactccctttaccagtttatgtaaatgttaagcttttttctttaaatggtggatgggatggctattggt

SEQ ID NO: 24327 - DNA, 608 bp, Sorghum bicolor
  unsure (1)..(608): unsure at all n locations
  Clone ID: 30933844
gatgcaacaacccaaatgcagccctcagttccagaacttatgcagtatcaaatgcaacacatggctcctgtttatggtagcatgggacttccaggaatgcctgtggcagcagtacctggaaatgcagctagcagtatttncggttccagagacgaaaaaggaaatgaagggtttactttcaaagccacacctttggaccgatcagctaacttttacagtagtgctggtaacttagtgatgggtccatgagtgtcttgctgatggttatacctccatgaatcacattactgtcgtcatgaaaatctcttcagaagatgcatccgcacacaattggaggcggtcaaggtatacctccggagctgcagcgatgacacatgatgtctttgctgcttggatgtactcgctgtattgaacgctgcagctcaacattcgttgtacagcaaaaccagttatgattaattagattatgataatttggttatgtaaacttctttctgtactggaatatgggatagaaccaaagagccatctggtggcaaagctctgttatctcctgcatatgaacgatgctagtttgatattcatatatgaaatgaaatatatcattc

SEQ ID NO: 24328 - DNA, 654 bp, Sorghum bicolor
  Clone ID: 30933864
gaagctgccacacttgctagatgggtttgccagagttatcattaccatctaggtttggaattacttaatcaatcagatgaagctggcgaagcattgttgaaaatgctctggcatcatccagacgctgttctgtgctgctcttttaaggagaaacctatgtttacatttgcaaacaaggcagggcttgacatgttagaaacatctcttattgcgctgcaagacctgacactagacaagattttcgacgagtcaggaaggaaagcaatattctcagatatctcaaaactaatggaacagggctacgcatacctgccatcaggtgtgtgcatgtcaggaatgggtcgccatgtttctttcgaccaagctgtggcgtggaaggtgctcggtgaggacagcaacgtgcactgcctggcattctgcttcgtcaactggtccttcgtgtgaccccgacctgtcggatgggatggcgagctggtggtcggtctgtgtgatgagcaggcccatttttgtatgatgatcctgataaggaaaatcatcagctgtggcaaaatgcttatgttgcaatcactagttgtaggtcttgattccagtgtatttatgaagaaactggagattatgcaaagtcttgtcccacttccttttgactacccggcc

SEQ ID NO: 24329 - DNA, 618 bp, Sorghum bicolor
  Clone ID: 30933932
ccgaacctgtaaataaggagggggcttcctgtgtggttccgtgcaaagcagatagtggtaacatttctaggcatccttgccaaactccaaatttgcaagatgatatcgagtaccccttcgacaatgcttttgataatgctgaccttgatgacggacttgatcctgcaatgagggaagagattgatagagaagtggcggactttgcgatgaagttgaacctagcttggtccgaaagaatgattttgggacaggaccaacgaatggagtcgcatgttgatacgcggtggtaatggttctgtggcagcgattctctgttagtttttttccgcatagaattttcttgatgaggttttttgctgttagagtgggcagaaaaccttaggcaggaaggagttttgttcgagagatacaggattgtgacattgcaaggtgcaatggtcatgttctgtgaattgtatgtaccctgctcttcaagaaagtagtgtgcaaccatgtgttacccaaaaaaaaaaggtggagtgagttgtgagtgtaaaaaccagaagttttgaatctatttatgttcattaactttgacaggaactcttatatccttatgaatgaataaaagggaaaatg

SEQ ID NO: 24330 - DNA, 561 bp, Sorghum bicolor
  Clone ID: 30933947
gaggtgaagggcgcctcatgtgcttagaatgtgatggaacaggtgagccgaacattgaaccgcagttcttggagtgggtcggtgaagatacaaagtgcccatactgtgaaggacttggttccattttatgtgatgtttgtgatggaaagaaagtaatggcaagttaagtaagacttaaagcaacaacatgccttgtttgtgttcggttcccaccctgggaaacacgtctaggccaggcatcaacgccagatgttcgatttgggctcagatgaggctgcctggtgtcactccccaggcgaggattgcaaccaaacatgccaatatagcagcatgtgtagatactagcaaaatattcagttttatcacaaaactgaagaatgcgttcaaatggcaatttgagtggactgttgtcctgcagaaagcagaggcatagcaacagtgtaatatttttatggtacaatacgagatggaaacatatttagaaagaagaggaatgctttcccaaatcaggcctgtaaaattaatgtgcctattaatatttcatttgctacaactcttccc

SEQ ID NO: 24331 - DNA, 571 bp, Sorghum bicolor
  unsure (1)..(571): unsure at all n locations
  Clone ID: 30933951
ccaaggttaagaagaggtgcgaactattacctgttatcgtggaggtggatcgggtgttgaggccagaaggtcggctaattgtcagagacaacattgaaacaatnagtgngntggnnancattgtgaaatctctccactgggaggtccacatgtcttactcccaggataaagaaggcttgctgtttgtgcaaaagacgacatggcgaccaaatgaaactgaagataagctatgatggcaacactcaccctgactccagagcctttggaaggaggaaatgaagatttgatggggaaatagcacatgtattatatgtcgctgtttacaaagttgcaagttaagggagagtaatgttagaaggccctctatttttgggagggatctgtgctgtggtgtagagctctttttcgaggtgttgttgctgttccccttttctttatgtaggttttgtagagctagtgtagcatgatagcatatgattgggcaatggattcaccgaaggcagcatggtggccggtggggttgtgaaagacagtgagaattgggattgtacaactacaacaggagcacatt

SEQ ID NO: 24332 - DNA, 714 bp, Sorghum bicolor
  unsure (1)..(714): unsure at all n locations
  Clone ID: 30933977
tgtggcctttcgttctatcacctatcctcgccgccgccaccgccgccgtctggtatcccctcggagattccccgttcccgcctctccggccgccgcaggtacgcctgcctcccggcgccaatcgcttcctcccagtccgcaggttaccaaatacggtgagccgtgtgttgcagtggaattttgcacctcattgtactttgaaggcgaataaagtcattctccaatctgaaggtcaaacaaggggtgcacgtatttgtcataaagtttgctcagctgctgttggacattggagagcccagtggtggttgtatgcctgaaaggaattctttgtaaatttatcatcattattttcctggcgttaggcaatcatgtcagagagcgagttagcagtaataaaaccagaggcattgaaaacgtatatctggcttcagtgttttgatggctccatacaacaagtggaggaagaagttgccatgttctgccctatgatatgtcgggaaataatgaaaaatgggacagggtcatctaagaatcatgctatagttctaccggaaagagttaatccggcaagtttgagtttgattcttgattattgtcggtttcatcaggtcgctgggcgctcaaacaaggagcggaagtcatttgatgaaaagtttgtccggatagacacagaanaactctgcaagttggcttctgcagcccttggtctgcagt

SEQ ID NO: 24333 - DNA, 650 bp, Sorghum bicolor
  Clone ID: 30933985
ataaagtgccaaaaggtggtgccttgtctgtaaatactcagtcaacagcaaattccagtacgagtagttcacctgcaggtccacaggaagatatgtgccagtggccaacacttccagcatgggaaattcttgaagctgttccttttgtgcttgaggctgtgctaacttcatgtgctcatggcagactttcatcccgtgatttggttacaggtctaagagatcttgcaggtttcttgcctgcttcacttgctgctattgtcagctacttttctgcagaagtcactcgtggcatatggaagccggttatgttgaatggaatggactggccaagtccagctgcaactcttccagtagttgaatcggagacaaaagaagttcttgcatttgctggtgttcatatcaatatctgcccacgaccacgttttgtgatgccgatgcttccattgccaatagcagcgctaatcagtttgtcaataacagtcaagatggatgaattcagtcacctacacggcatcattggccaaggaattgaaatttgtacaacatctagttcatggcccactgcgcaaattataggtgcattgtggtcccaaaaagtacggcggtggcatgattttatcatcctggcttgttcacagtcccccttcact

SEQ ID NO: 24334 - DNA, 684 bp, Sorghum bicolor
  Clone ID: 30933991
aattatctccaccgccggccatctcccccatgcagccacgtacctgattggatcaaaggcatcacgcagcagcaggagccgtcggggcaaatatcaaccaccgcggccgagaatatccacggctagtctcctcgcacccgcccaccctgctgatcacctcgcggtcgtctccgttgacgccgtggtggcctcgcccgcgcccgcgcccccggccgcggtgcccgcgccgcagcccaggccggcgctcgtcgaggaggtcgaggtgaggaaggaggtggtggtggtcgaggagaagaaggtggcggtggcggccaaggccgaggcggggagcggcgccggtgacagcagcaagagcaggaggacgctgagggcgggggccgagggcgagggcgtgcgcgcgatgcaggaagctttgctgaagctcggtttttactcgggcgaggaagacatggagtactctagtttctcatctggcaccgagcgagctgtcaagacatggcagacttattatcctgcacactatattacattgatgctacgtgatgatacgatgatacgcactctctttcagtcaacggttggaacttcagagaacggagtgatgacgtcggagctacttgagtggctattctcagggaagactggggaagatgcgaaaacgaaagatggcacaaacggagcagc

SEQ ID NO: 24335 - DNA, 676 bp, Sorghum bicolor
  unsure (1)..(676): unsure at all n locations
  Clone ID: 30933996
gttcttggcggccgacacgcggaatctggatccagttccctgcttcaatccttcccctccactgattcattcccgcaaggaggccaggcgtgttggatgtgagcagtggactgaccgatcgatatggcgttcggccacacacggctcgatgtccggcgtgcgccgcagtcctcctacttctcctgctccacaaccaccgtcgccgtattcgtcgcgctctgcctggttgctgtgtgggtggcatcgtccatgctcgtcacccctaccgaattctctccatttcagcccaaagtccgtccattgccgcctcaagactcacctcctgacaccggaagcttaaccagtgctggtcaggatgatggcatccgtgaaatggaacgggatgtgcccgttgatccaccacctgttacacaacaattgcctcctgtaacagacagcatggatagtgaagatcagcaagaggatgccaaggagcaagttaggacgcctgaccgacagaggacctcagagcaaccagaggtgttccctgatgggagtcaggcggagcttttcaatgagaccactacagagcgcggaccatggcaaacgaaggctgcacaatctaacaaggacgctnaggagcagaccttgacgtccagtagcccagtgagctttacttgggcgctatgcaacgtgg

SEQ ID NO: 24336 - DNA, 736 bp, Sorghum bicolor
  Clone ID: 30934037
acggacgacgtcctggcggagatcctcctccgggtgccgtctccgcgggacctcgggcgagcttctgcgtcgtgctgctccttccgtcgcgtcatctccgacccgcacttcctccgccggttcgtcgccctccacgcggcgcctccgctcggcgtcttctgctgctaccccgcctggggcggcggggttggtggatcccagttccacgcagccctgccgtcgcacccgtcgggggccctcgcccgcgcgctcgatacttcagcagacttctgcttcaacttcctcccgccggccaccagcgactggctcgtccgcgactgccgtgacggtcgttttctactcgaccgcgtccgggacggctccacggccttcaccgaagtcgcaatctgcgaccccctgttccggaggtaccggctgctcccgcccatccctaacgacctcgccgcttccgtggaaaacccctacgtccagcgtggcggcgatggtcaattgcagtcacgcagcagcgaaatcttcctggtttctcgtagtgatgacagtgtcagtgaggaggacacggcgttcaccgtcatctggatggcatgctgtcgagggaagctggtagcgttcttctactcctcagagtcacagcaatggtctgcactttcaccgcctgaacactacgctttgagcaccagaagagtcatgggcgttcgactaggacagcgcaaccatgctcatgggtgcttctactgga

SEQ ID NO: 24337 - DNA, 646 bp, Sorghum bicolor
  Clone ID: 30934039
gctcaccacacagagacacagcacagacacactctttctccctctctccacgctaacgagcgagcgagaccacgcgccgcaccgcaccgccgcaagcccgccgcccgcgagggtgcgagctagtagctctctggcctagctgcaggcgcggactgagatggccccgcgcttcgcgctgccggccgcgccggcgccgtccacgggcggcggcgggggtttcgcgcgggggcaccacaggcgggcgcactcggagacgttcctccgcttcgccgacgcggacctgctcctggacccggacggcgacttctccttctccgacctcgacttcccctccctctccgacgactccccggccgcctccgaccccaccccaccgcccccgccgcttccgcagcagcagcagcagcagcaggcggccccggcccccgccccagcgcctcgcccgcccggcggcggggcccacacgaggagcctctccctcgacgccgccttcttcgagggcctatcgtttcagggacccagcgcgagcgggagcgggagcgccgggggtgggcccgggcacaagaggagcggctccatggatgggtccacctcgccgttcgagggcgagtccgcgctctccagcggcctgccggactacgccaag

SEQ ID NO: 24338 - DNA, 659 bp, Sorghum bicolor
  Clone ID: 30934054
acgctgccctcgccaccagacggggccactttccccaaactgcccttcccaccatcccctccaaaaccaccacctagctccgctccctgtcttcttcccccttcactctccgctccccacatcccggccccgccaatggccgatccgccaaaccctagcgccggggacctccccgccggcgctgggggctcgacggagaagccggtcctggcggatcgacgtgtggctgcgctcgccggcgccggcgccaggtacaaggccatgtcccccgcgcggctgccgatctcgcgggagccgtgtctcaccatccccgccggcttcagccccggcgctctcctcgagtcccccgtcctcctcaacaacttcaaggttgaaccgtctcccacaactggtactctgagcatggctgcaatcatcaacaagagcactcatcgagacatactgccttcgcctagggatagttcagctggtagtggccaggaagatggaggctctcgggattttgaattcaagcctcatctcaattctcaattggcggctcctgcggtcaacaatcaaaatcgtcatgacacccctatgcaaaatcatagctcaaatcatgcctcaccatctagcaatttgatgactgaaaataaacctctctgctcacgggaatcgag

SEQ ID NO: 24339 - DNA, 715 bp, Sorghum bicolor
  Clone ID: 30934062
aaaaagtataacaatccttaccttatattttactaaccatcacacaatatctatgggctgccgatcttctaaaaacatcaatcctcttccacttattgattccaattttccagaaactcaacgccctgaactagactctttcttccaaaaagcgactggaatccttgagcgtatcgaaattctgcgaaatcaaattcatacaacaaagcaaaagggtgcagctcttgctggtacttccaatctaggcagcgactatccctatttcagagctgtcgaagttctcttttggtctatctctgcagccaaagaaggaaacataaatagtgccaatattgtgataacagaacagtttcctccttttattgccatgaacactcaagactattgtaaagagactcttgaactcttccaaactttacaacaatacttctccattctccttgaaaccccagaatccctttcgagcatagtgcaacagttgcagaaacttaaggatgaacaaatcgaaataaagagaaatattaatgttaagggcaaccctgccaaagctgccaaaacaattgatgacaacatgaaaaaattaactgatggaatcaacacaagcgcaaaagtcttgagccaagttccagatgaacaacaaaatgccttggagctcacaagaaagatccagaaaattatcagcactgctgatgaaatgggcgctagagccttcaac

SEQ ID NO: 24340 - DNA, 295 bp, Sorghum bicolor
  Clone ID: 30934098
ttgtgcccggtaatccaaacgatgaatgtctgcagcagaagtagcaggacctagttctggtgccattcgatgggcaacggcgaagtgctcatagcttttgtttacggtactattccaggtttttgtatagtatatatatggcccttggcccccttgccttgttatggaagatgcttgccttgttttattaaatgaacttgttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 24341 - DNA, 716 bp, Sorghum bicolor
  unsure (1)..(716): unsure at all n locations
  Clone ID: 30934123
aaaaccctacccctctccaaaccctcgcggcaccgtcactcgtcgtcatcaatctccgctcgccgccccgcacgaggcccctcgtgttccagcagcctcgccccttcgcgtggttggttgaagaagcggaagatgatcggggcctctaggcgatccctcagtgccgccgccgccgccgccgccgcccgcagccgcgtggctgccagcgctgcctccgccgtctccgccgacgccgacgcctcctcagtcccgccccgccccgtgagcaatggagcgcctggggttcctcagcagcagaagaggctcctctcagtgcttgcagcacccaaggttgcaggaacaagcaatgttgtgtccctcaagctgatggatggtgcccttattgggagacgctatgaatcgagtgcggcagcagttgactctacggacctgccagctgagaagcatgagtatcaggctgaggtcaacaggctcatggatttgatcgtgcacagcttgtatagtaacaaggaagttttccttcgagaattggtcagcaatgctagtgatgcacttgataagttacgttatctgagtgtcacggatcctgagcttctgaaggatggtccccaacttgacattcgcatccnaacagacnaggataatggaataataacaattactgattctgggattggtatgacgaaacaagagctcattgattctcttgggactat

SEQ ID NO: 24342 - DNA, 589 bp, Sorghum bicolor
  Clone ID: 30934125
gactcgatctgctttgctctgctctgcttcgggtcgtcgccggcggcgggagcagagcacccacccacacgcacggtaagatgtcgtcgaccgcgggccccgtggccttcgtcggcgcggacgagctcagcgtcgagctcgccgcctccttcctccgctccggcgcccgcgtccgctccttcgtccccgaggcggaacggtcgccacctgcggcgctcgcggagctgaatggcctcctccggtgcgggagcccagtggaagccgcgcgagatgctgcgctggtcgtcgtgctaagcgatgctggtgcggttgacgagttgttcttcggggttgagggtatcgcgaaaggattacgcgcgggttctattatattgattcgttcgacattgctgcctagccagctggagaagctggagcagaagcttacagatgagaagaaggatatcttccttctggatggatacattttcagtggtttatctgatgaactaaagcaacagattgttattgttgcatctgggagacagtacatagcagaaggagctagaaagtttttccatagtctagacaataccatttactttgctga

SEQ ID NO: 24343 - DNA, 757 bp, Sorghum bicolor
  Clone ID: 30934167
tccatgacaaatttatgtgtcctgaacaatgatttccttatttccagacatgtgcctactcctctatttcctatttttgattaaatataatagtcttcttccactttcctatagttcagtttttctttttttggtcagatttgtaggttccttcaaataattattttacgcctgtgcaaaaataagcaaggaggtggctatttgtgcatatgacaacaaatcccacttgatggtacggggagcaaaaagacaaaaggaaatcatggtattttccttgcttgaggtacattcaatcggataacaagtaagagatgaaaaaggatttagcaagcattgaaactgaatggacagcttctacaatttagcagttccagtgcccatgtgtctgcaacaaccattgcttgctgctgcacctcatagaagttgtatgtgttgcttctgtgtacaaaggaactggcaacccctccacataacttgggaaaaacactcatccagcacgcaaagcacttacagtgggctttccaatcttgagccaagataatgttcaaacacaagtccttccctcaccaattaagaagaatctccagctgggaaactgaggattcattcgcggaattattagaccaccagccaaaatcattagggactgctccagcgaagttgttgctataacctaaatgtcaatgtatatagtacaactgattccatatatcccacatgtaaaatatgcttgccaatgaccacaaacctagaacct

SEQ ID NO: 24344 - DNA, 682 bp, Sorghum bicolor
  Clone ID: 30934169
gctttaacaagattggggtatcataatataggcacagtatcagatttttttttttttttaaccatgcactttctcactttgccatagagaggtgtgaatttacagctatttctttttgcttagaaaggactgcttcaagctggttccaattgtcgatttgtttacattaagaattttaaattgtgattcttagtggaagagttgatcatcgttttgtgcccattggcaagattctgaagccactgataaatgagtgtgtgacaccggtgacctgttactggagcttggcactgcttttgcgtgatgaggaagaactcctcctagttttccagagatctcgtcctcctgtcaaaatgctggttccagtatggaaagctctctgcacgttgacaaactctgaacacccaagcccttctcaaatttgtaaccgggactcttcagaaacatgagttagctggggccttgtgtagatgtatgtatcgtcagaagaggcatctgcagttgagctagactagattcagataggaactattgatggtgtgtgctgatgccatcatagacttgtaaccagtgataggggaattgattgttaggagtgatttcggctggaaatgtatacggattaacactaaccatttatgatccatagtcccgcgttcactttcatgctttatttttgtgg

SEQ ID NO: 24345 - DNA, 188 bp, Sorghum bicolor
  Clone ID: 30934175
gggggctattttcgttagggataaaagatttagttgtccgagcaaatcatacaagttatgttttgtccaagcaaatgttttagttttgtaggtacttgagtgtagcaggattattgttttagtatttcgggggaaatattgtccaagtccaaatgttgatagttttaaagaaaatgagcaatattttc

SEQ ID NO: 24346 - DNA, 231 bp, Sorghum bicolor
  Clone ID: 30934219
agattgctgctgctctggtgtgactgggtctgggacctgcggatgacctgagatttgctccggcgcgtgtagtgtcaataaatttaaaccctcgataaagagaacggcacgattccttgtgcttgtacgtactagtatccctacatttgtaaatagcttacttgtaaggtccccttgcagtgtgtaagaccctgaggtttagctttgtgaagttgtgtagctttttccggc

SEQ ID NO: 24347 - DNA, 659 bp, Sorghum bicolor
  Clone ID: 30934323
ggcttttcatggccttcgtggatgctcctgcctcccttgctagttttccaccacacaaaacaaaacaaaacaaaacaaaacaaaggagagagatcagttctcgaaactgaaatcttggccgccccgttctcccaagaaatctgctaatttccttgcgagttgcaaccttggtgctgtggatggcgctcgcagtgggcgcgctctcctgtcgccgtccattccccttcaaagataatacttgattaggttgggaactgcaaagcccggttgctacatggaaacatatgcagtctggccgacttactgaggtcataacatttgcggtaaagaacacaaagaggaaaaggagaagttttcagaacgagtcagaggattcgctgttggtaagtgaggaagcttcttcgggcagtggaggaagtgccagcacaagcgtcaaggtcaatagcgaggatgctgcttctgacgatcaaatttcaggtgcaccaaggagtgctgttcttcaggcttgcaccctgacatcgggcttgttggttgccggagggcttctgcttcgccaggcatcacacctagcagctttaaatggatggccaataactgatccttcagatgtgtcattcaattttgaaacttggcatcttgagttgattgcgggacttgta

SEQ ID NO: 24348 - DNA, 564 bp, Sorghum bicolor
  Clone ID: 30934332
acgacgctcggctcggcctactccgctcctccctctcttttctccgcaccaaagcgccgccgcgggcgattttagggtctcatcgcgggcggcaacaaccctgccggtagccctccgacgtcggcatcctggttcctttcccccggagtccagtctcctcgccatctcgtcggtgtagcccgggtgccggtcgacgcccctgcagatccggccacgacgacggccctgcagatccgcaacgacgacagcctgcatatccagtccacctccgacgacctcgaccgacctgcaactgtggacacctgcagatacagcccgtgttgaaggctacacagaaaaatctgtacccaaaagttgtaaagatcacaaagaaccttgcaggataacacaagtgctgaattttggaaatggatcatgggcgttatgctccacaacatggatgggagaacaacagtgtaattgcagtcttttcctttactaactactgaagatgaagaaatagcagaattttggccatgcggttggcctctgtgtatccagcgttagttgtaaaggagttcaaga

SEQ ID NO: 24349 - DNA, 584 bp, Sorghum bicolor
  Clone ID: 30934336
ctcgctctctaagatggccaccagaaggtgtagtagtagcaacgtgccacctgcaggcttattggccgtgccatgcttgctgctgctgctgctcgccggcgtctccaacgggcagctccaggtggggttctactccaactcctgccccggcgccgagtccaccgtcgcctccgtcgtccggcagtccgggtccgccgaccccaccatcctcccggcgctcatccgcctccagttccacgactgcttcgtccgcggctgcgacgcctcggtgctcatcaagggcggcgccggcggcaacaacgccgaggtggacaacagcaagcaccagggcctccgcggcgtggagatcatcgagggcgccaagacccagctcgaggccctgtgccccggcgtcgtctcctgcgccgacatcgtcgtcctcgccgcccgagacgccatctccttcaccggcgggccgtcgttcgacgtgccgacggggcggctcgacgggaaggtgtccaacctgcgtgacgccgacgcgctgccggacgtgcacgacggcatcgacgcgctccgttccaagttccgcgccaacggactcgacg

SEQ ID NO: 24350 - DNA, 601 bp, Sorghum bicolor
  Clone ID: 30934343
aaaaaccctacctcgctaccctactccgtacccaccccgatctccctctcccacccagatcgccggcccgcggcggcgctaaatggaggtgccgccggagatgctcgacgccctcgcgggctggttcgcgcagtcgctctcacccgacgccgccgcgcgccgcgccgccgagcagagcatctcctccgccgcctcttccccgggcttcgcgctggcggtcctcgccctcgcggcctccccgcaccacaacctccaggcccgccaagccgcctccgtccagttcaagaacctgctccgccgccggtggcccaagcccgacgccgacgccgacgacgccgccgaccacctccccgcctccgactgcgccatgatcaaggcgcacctcctccagctcctcctcaccgccccgcccctcatccaggcgcagctctccgaggcccttgccgccgccgcggcctccgatttccccgccaggtgggagtcgctcctcccgtccatcgtgtcctccctcggcactgccgtcaacgcgggggacatcgccgccaccaactccctcctcgccgccttggtgtcgctcttctcccgcttccgcaacgcattc

SEQ ID NO: 24351 - DNA, 679 bp, Sorghum bicolor
  Clone ID: 30934364
tcgcgccagccggaggccctccctctccctctcccgtccaatcgcatcgcccgcacgagcctcatcatcagtccacgaccatcaccatcaccaccaccactcgctgcagcggcccaccgcactcggccgcgactccgtcgtcgcgagatccagcgccgtcgtcgcgccgccaacgccgctgccgacgctgctgccggagatgccgagcccgacgatccggaggctggacgtggcctcgccggtgccggcggacatcgacatcgccaacgccgtcgagccgctcccgatcgccgacatcgccgcggagctcggcctccggcccgaccactacgacctctacggcaagtacaaggccaaggtcttgctgtcggttctcatgacctcaaggcgcagcaggatggatactacgtcgtggtcggcggcatcacgccgacgcccctcggggagggcaagtccaccaccaccgtcggtctgtgtcaggctcttggcgctttccttgataaaaaggttgtcacatgccttcgtcaaccatcacaagggcctacctttggaatcaagggaggtgcagctggaggtggctacagccaagttatacccatggatgagttcaatcttcatctgacaggcgatatccatgcaattacggctgcaaacaatctacttgctgctgctattgata

SEQ ID NO: 24352 - DNA, 657 bp, Sorghum bicolor
  Clone ID: 30934373
tcaatgcttccccttccatccgctgcaggatccctctccaaccttcctctctttctctctctctctctctcgtctcgctcgctcgctctcagaccactgctgggccgcagccgccgccctaggccaggtgctgaggctctcttcgccggcgacgagcacccaccgggaggaccaggtgggcgatttcttggtgtccatcacactccagctatcaccgtcattatgctcccgttgagcaatgcataaaagtcgtcgctcgcaggtctccgtctttcatacttttcccgctgttccaggcaatggccaaacttccagtacttgcacgcagtgccatcaggaagcctaacgaaagcatgaggcttattgtagtaacgatcgttggagcggtctttggtttctttatcggaatctcgctcccaacagttagcataacaaagcttcactttccatctagcatcgtctcctacatagaggacaagaactcgggcctctctgctcaagctatacttaatcatgcttggactaccgccaggaatgcaaggggaaatggctctgaaccaatctcaagtgacaacttcaagatttatgtaccaacaaatcccaggggcgccgagagcctagcacctggtattgttgtaccagagtctgattttcatc

SEQ ID NO: 24353 - DNA, 597 bp, Sorghum bicolor
  Clone ID: 30934379
catatgcctttctaaggctaccaaataataaagcaattgagcattcacagctttctgattgcagagatggaccactaaggtgcaaaaaatacctgcacttttctccttgcatcgccaccttcatctaattactgctggagttcaatcatgtgagtaaaatacctgatgcttctgtgcacctgtgactacatttgagcaggacaatagttggtcatgagtcatctttacttctttagttatctgggttatgtatagttgtgaacctgagacgctactgtatctgaactattgtagaacctgagactattatcctttatctgaaactttgcagtgacatgttttgtctctgttcattttggtcgttgtctgtgtgactacatattctatctttgtgtgtgaacctgatgcttgtgtgaaagcttcctctcatatctcatgataacaattacataatctttgcacaatccacactttgaatgagttatagacgatgtcagattccacatagaactttataggtagaactatctcagcgagtagttgttgcggaacactcttccagtgtgatcttgtagcaataatataagccaagatgag

SEQ ID NO: 24354 - DNA, 616 bp, Sorghum bicolor
  Clone ID: 30934425
aaaaaccgaaagagagagcacactgcaactgcacacgcacgctgaccctccgctctgcacgagctcgtcgagcgcaagcttcagagttcacacgcacccccaggccactcacttcacttctttccgccgccacaagtgtacagtacaggccaggtccgatcatggcgatcctgtcggaggtcgccaccgaggtgcttatccctctcgccgcggccgtcggcatcgccttcgccgtcgcgcagtgggtcctcgtctcgcgcgtcaagctggctccatcgtccggacgcgacaaggacgtgctcgccgagtcgctgatcgaggaggaagaggggctgaacgaccacaacgtggtggtgcggtgcgccgagatccagtgcgccatcgccgagggcgcgacgtcgttcctcttcgccgagtaccggtacgtgggcgccttcatgtgcgtcttcgccgccgtcatcttcgtcttcctcggctccgtcgacgggttcagcacccagagccggccctgcgcgtacagcgagggcaaacagtgcaagcccgcgctgttcaacgccgtcttcagcaccgtcgccttcctgctcggcgccgccacctccgtcgtgtcggggttcct

SEQ ID NO: 24355 - DNA, 665 bp, Sorghum bicolor
  unsure (1)..(665): unsure at all n locations
  Clone ID: 30934435
tgtggcctttttttttttttttttgcagcttaaaacaaacacaatggtcacagataaacaccaatcacacatcagatgagacccaacgtccagtgaagtaatagtggaataagcaaatgtttcactactgaaggaattcagtatcacaagagaaatccaaacacttgaaagctaaggacacattgaagccaacactttaaagctaaggagacattgaagccattgaagcagtccacagaagcagcagcaataagtgagaaatacaaaattcttcgccaaaagaatgtgcacaaccattgtttgggcacagtagggtatgagggcaaattgaaacagtgggagatggaggatgcaactttagccagtaaaggcatcagtaacccatggcaagaattccctgaaggccgccacacgaggtttatgcgaggaaggagcaagcttgatatatcagaaaataaagctgagatcatctggacacaagatgcaacaaaaaaaatctctgaagacatcanagtgaagcattcagctgcagaagcatcgggcatcacttgggtcagggagaatgatctgctaactgcatgtttgggccctgaacagccaggtcgagtacgcgctgtttcaagttataccagttggaagcatggttggcctgagtgctctggcac

SEQ ID NO: 24356 - DNA, 601 bp, Sorghum bicolor
  Clone ID: 30934439
aaaaaaaaaaaaaaaaaaaaaaaatcaagaacaccgaccgctgacctgtcaattcttctctgtgcgcgcgcgcgcgcgtggcgcccgccgcgcggcgattgacccgatgaccggcgccgcggccgcggccgtcgtcgatcccccggcggcgcctctgccgcggcggctgacggtgctgcccctgatcgcgctcatcttctacgacgtctcgggggggcccttcggcatcgaggactcggtccgcgcgggcggcggcgcgctgctcccgatcctcggcttcctcatcctcccggtcctctggtcgctcccggaggcgctcgtcaccgccgagctcgcctccgcgttccccaccaacgccgggtacgtggcctgggtgtccgccgccttcggccccgccgcggcgttcctcgtcggcttctccaagtgggcgtcgggcacgctcgacaacgcgctctacccggtgctgttcctcgactacctccgctccggcggcggggtggcgctgccgcaccccgtccgctcgctcgcggtgctcgcgctcacggccgcgctcacctacctcaactaccgggggctacacatcgtcggcctctcggcgctg

SEQ ID NO: 24357 - DNA, 654 bp, Sorghum bicolor
  unsure (1)..(654): unsure at all n locations
  Clone ID: 30934443
aaagctcatcggattcgttgttccagtggcagcagcagcagcacctgcacaagggactgggcgaaccttgtggacgggccagctggactgatcgccgagattgcccttgccagcgatgtagccgactatgtccgcttccgcgccgtgtgcaaaccgtggcggcagtgctcgccagacccgcgcgccggtggcggcctggacgctcgctttctaccccgccggtggattatgcttgacaaagcacttgcaggttcctcccaccatcgcttcctcaacgtgtctaccggcgaatgcattcggatgggcctcccggagctactggagggggagcacaggtttctcaaggtcacccccgagggcctcctgctgcttttccacaaatccacaaagattgctcgcctgcttaacccgctcacgcgccagctcattgatctaccccctttgaccgcattcgtgcaaggtggagactgtgacgagcggaaacaacggggtccttttgtgcagaccgttggcctcactgagtactctacagtggcagtctcctgctgctatcccatgaagcttgcttttgctaagcctggtgacgacnattggactgtggtaaatgaaggatacatagattcagctttgccttttgcggggcgtttctactgt

SEQ ID NO: 24358 - DNA, 555 bp, Sorghum bicolor
  Clone ID: 30934507
gaagactttccggagactgaaactgatttcagaccatggcatggacttgtattgctgctaagaaagtaccctgagcattttgtgatcaacattaggaaaggtgggggcttgagcactgagtttgtctctttggtctcactacaatcttgataatttctcaaacattactccaagggtgttgctgtatagcttggagtattctttttgctacctttgtaaaaaaaatagttagagggtaaaaggagttgagcttttattttccttttgtctgcattttggtcaagacatcggttgtggagaatattacctcagcgaattgacaaaatacagagtttaatgattattgatttagtcgtgctatatttcgtgatctgtatgctgaaatgtggaggctaggtatggtgccgtgctacttcggtggccaacttgttgataggtttgtgtgatgccctagggcatcagcaatgtactccctctgtccaacgctgtacagtgtattttactttggaaaaggtttccaatccgtagaatgtaaatcgtagccaagttaaattt

SEQ ID NO: 24359 - DNA, 545 bp, Sorghum bicolor
  Clone ID: 30934509
gccgctggccatctacttccccgtggagatgtacttcatccagcggaacgtgccccggtggtccgcccgctgggtcgtcctgcagaccttcagcgtcgtctgcctcctcgtcagcgccttcgcactcgtcggctccatcgaggggctaatcacccagaagctaggctaggctagtccagtccagtagaacatgctatgtgctttgggttgcttttcttgttgttgtaatggtataatggagaatgcagcagcagtaggctaaaagcgaatgcggggatgacgacgaacagcagcagcgtacactagtatagtagcaggtcttcagcaggatcagggaatggcagcgtgatctatttattttcagtgccttcctcctgcattggattgtaacatggaaactgtgttaccatgtatacatgtcgtgttgataccgccgtgttacctcagaagttcagaagacggtttgagggaacctgtgtcactgaatgccgcctatgtctatctagtttcagtttcaatttcagactttcagggactcctctgca

SEQ ID NO: 24360 - DNA, 678 bp, Sorghum bicolor
  Clone ID: 30934512
aagtcagaagttgcaaaggagtcaaaatcattgggatccacggaagacttaaaccttaccatggtcaaaagtgcagaaagaactgattgtcaaaaggaaccttcatgcattattggatcatcaaaatgtttgaatgcaagtttgaagaggctttacaggtcaaggaatatccctgttcctagacctctgccgccacttgtcagacttttggagtcctctaaacgggtcaaaatgcaaccaaatgctaattataattcattgaattcaagacacagcttaccctaatgacatggttgagcttatactcatatatggcatattgtgatagcaagatgttcagatttttgagtatataaatggattatttttgaagaagacccctgtgtattggttgttgtgataacccaaatactcggattttactgggatacaagtatacctggattggttccgaagaggatacctgtacagtgttgatccagctttcataagcttatacaggagctttgtacgattttcaaactgttgtacaaataaatatgaggtagttttttttttttttttgacaaaatgagctttattaattgaaaatagttacatctcttagtacaaactcataaatgaaactaggaggctcatcgtcccaaatacaatcttgcttagattgtcttgctctcc

SEQ ID NO: 24361 - DNA, 634 bp, Sorghum bicolor
  Clone ID: 30934544
ggaagtcgtcccgcccgaagaacagcgagatatgcaagaaagatgcagttgaaaccgtaaatgcaagatcatccaatgtacggctgtcagtagggacttattccactgttgaaagtggcatccaagaaataggactcagtccaccgagtgtcgagcagtggagctcgccagactcaatgaacattcaattcaaccgtggcttcaagggctgtatagagtacccgcggacgtcccagaagcacagcttgaaggcaaagctcatggaggcacggatggagagccagaaggtccagctccgccaggtgctcaagcagaagatctagagcgaccagaaaccagaaggtgaaacattgtaaacctagaatttaatccatggaataatgtcaaggagtacctagatgcttcgttttttccccctgttttagagtaacctgtaatgcatgtacaacaaggactagaaagaaaagggacagggctggcctttgtgggctgtctggaggctttgctgcttctgtatcttactttagttttggtgttatggttcgatctgataggctatggtgagatccatcatgatgtataatatagacacaaacaagcagcaacgttgagacaaattgcatcccttgtaagc

SEQ ID NO: 24362 - DNA, 613 bp, Sorghum bicolor
  unsure (1)..(613): unsure at all n locations
  Clone ID: 30934548
tcaccagttggcatgagtatcctagattnggagttgttgcgcgtttggtggtgaactcgggacagtgaccaaatatttcgaaagaaatttgaggctcccattcacccccctctggtcgccattttcggtccttcataatccaagtgccaatcaggagcatggaagttctagatcatctttgtacctcagcatgagcatgggatttgtgatgggtctttggactgtattttgcatcatgttgttcttgaaaacatggaggattgcttactttcagcttttggaccagtcatgcgaaaagatatatgtgcaactggctatcttcaaggtcgcctttcttaggaaatgtggaaacaaggatatttgaaggttcttttccaccgttcaatccatgaaaccttttatctagtagtatttccctattgtttttctgttgtgcgtcctgtaacaataagctgaagtatgtcagccttgtaagcagtaagcgagcagctgctctgctaatgtgacaaatatataatctttgttttagggaacaaatatataatcttcagtcgtgtacttcgtcagatgtagcgtgacattcgatattgtattgtatttccttttgtagtgt

SEQ ID NO: 24363 - DNA, 714 bp, Sorghum bicolor
  Clone ID: 30934576
gaaatccgaaacctggacatggtgatttgcattctgctgctgttcgtatccaaaacaagtttagaggatggaaaggaagaaaagagtttatgattatccggcagaaaattgtgaagatacaggcccatgtacgtggacatcaggtaaggaaaaactatcggaaggtagtctggtctgttggcattgtggagaaagtcatactgaggtggaggagaaagagaaggggtcttcgaggtttccaacccgagaaacaacttgaaggtccatcatggcagatccaacctgcaaaggctgaggctgaggatgaatatgatttcttgaaggatggcaggaaacaggctgaaggcaggttgcaaagagcactggctcgtgtgcattcaatgaatcagtatcctgaagcaagagaccagtaccgcaggctgcaagcctgtgttaacagcctacaagagtcccaggcgatgcaggacaggatgctggctgattcagctggcaccgatgggggtgatttcatggctgaattggaggagctatgccgggatgatggcgatgccccaatgtcgactatttcgtgacatggagcttactagatcagttaggcagtaacctgttctttaccagactagatgtaaattcttgttactaaatcgtctctactcaccgttgaacaccatatgataatgatatagctaatacatggacttctatagttcgatt

SEQ ID NO: 24364 - DNA, 574 bp, Sorghum bicolor
  Clone ID: 30934582
aagagaggaagcagtttggggctccgctggcagcctttcagctcaaccaagaaaagcttgtccgaatgctgggcaatgttcaggccatgcttctcgttggctggcgactgtgcaagctttacgaggcaggcaaattgacaccaggacagagtagtttaggaaaggcgtggacgtccagaaaggccagggaggtagtttctcttggccgggagctgttgggtggcaacggcattttagctgattttctggtcgcaaaggcgttctgtgatctggagccgattttctcgtatgagggcacctatgacattaacagcctggtggctggcagagagatcactgggatcgccagcttcaaacctgccatggtagcgaaatcacgcatgtgaattgtgaatttgaagcttctcgtttcccttatttatctacttgaggttgatgcgctgaattcatcgctggagcttaataataggataacttgtgtgactatttgttaagtatgcttaattcctccgtccttaaaaaatacaatttcagaacagtgtcatgttttagcataccaagtttaactaattat

SEQ ID NO: 24365 - DNA, 556 bp, Sorghum bicolor
  Clone ID: 30934586
ggcaaggacttggctgccctctacaagtcttactccgaaaagtaccctattgtttccatcgaagatccgttcgatcaagacgactttgagagctacaaccacttgacctctgacatcggtgctaatgttcaaatcgtcggtgacgatctcttggtcactaaccccaagcgaattcatatggccatcgagaagaaggcttgcaatgctttgttgttgaaggtcaaccagatcggttccgtgactgaagctattgatgcctgcttgttgtcgcaaaagcaaggctggggtgtcatggtctctcaccgctctggtgagactgaagacactttcattgccgatctcgttgttggtttggccactggtcagatcaagactggtgctccttgccgctctgaacgtttggccaagtacaaccaattgttgagaatcgaagaagagttgggagctaacgccaagtacgctggtgctcacttcagattccctcaattgtaaacactcttatttgttaatgtacactcatacacgtgccttggtgccgtgtataaataaatttgtt

SEQ ID NO: 24366 - DNA, 467 bp, Sorghum bicolor
  Clone ID: 30934593
ctcagttccccaccccacccccaccagcagacaggaaataagagtagtaacctgcagatttgtagtgccagcagctttagcaagtatcatactagttttttttgcttcaacagaggatatgactggggatgcatcgccgtgtgttgtggagctgaggagattgttctattgttgtacatttagccagtcagcgcgcaacagttaattttctgaactagttctggtcttggtcctggagtagaagtgtagaacctgtagatttcgagtgctagagggaatctggagttctgaggtgagagcaaatgcctgcgacagttttataattgactggtctagtatttctggtcttggtgatggagtaaaaaactgtagattccgacagcttagagagaaaatatggaatccaatagccaaagacaaatgttgtagcatgacatgttgtaactcatcacaattggttctttgct

SEQ ID NO: 24367 - DNA, 552 bp, Sorghum bicolor
  Clone ID: 30934595
tccgagacctggaccacctcaagctcctgtacgacgccgcgctccgggacggcaagctgccggggccgagctggcggccgcagggcggcatccggttcggggagatcgccggcgcgcaccgcacgctcaccgcgcgtatccagctgctacgcggccgggtcgccgccggcgaagggtgcagcgtcgactactacgccctcctcggggtgcggcgcgggtgcacgcggtcggagctggagcgcgcgcacctggtgctgacgctgaagctgaagcccgaccggtcggtgtcgttcgcggagaggctggagctggtggacgagcaccgcgacctggaggccgtgcgcgaccaggcgcgcatgtcggcgctgttcctgtaccggatgctgcagaaggggtattcgttcatcatgtcggccgtgctggacgaggaggctgcggagaggcagagggccaaggacgcggcggcggcggcggcggctgctgctgctgctgatttggctgccatggcagagtcggaacccaagcaagaagaagaagaagaagaagaagaag

SEQ ID NO: 24368 - DNA, 570 bp, Sorghum bicolor
  Clone ID: 30934614
atatatacacatcccaaaatacatgtaacatatagatagaactatcgcttgtcaaaagtccactctccttttctttaaatcttgaaaatcagaaattatatcttcgtaactgtaggctcttgcaatttcaccttctatgtgtactagcatgctgttagcaagaaattcatcttccatggagttgcgcaaccttgtcttaatgatcttcaatatagaaaagacacgctcagcactagctgttgaaacaggaagagtaagaagcaaccaaagcaatctatcaatcaggttatgagtcacatggcgtcctgtgtcaacaaggcatcgacatagctcagctatggttgtgatatttttcaattcttcatggctggaagcatcaataacaaaatggttgagctggctttctaatccaagcctttcttgttggttgaaatctgctggatagtacttctcaaccattttgcatacctcactagcattgaaagatgcaaatctgttttttggtattagtgtaacacacacagacaaaagatccatcgctttctcactgaatttcaagtttaatcagcc

SEQ ID NO: 24369 - DNA, 745 bp, Sorghum bicolor
  Clone ID: 30934620
gcagcaaatattccaatccgacggcggcgtgctcttaaatcccgtgaagggcttcgccgcgcagacaaaaatcccccaaatcccctcgagagccctgcaatttttagcctcccgagccctgcgattggagccggcggtggcggcgccagcggccgcggtcggatcgtcgcatggcggagattcgcaagtacgccatgtccaaccagcccccagatattcctcagatactactggaagctcagaataggtggttgcggcccaccgaaatctgccaaatattgtcaaactacaagaagttttccattgcgcctgagccgccgaacagacctcaaagtggttccctgtttctgtttgatcggaaaatattgagatacttcaggaaggatggacacaactggagaaagaaaaaggatggaaagacagttaaagaagctcatgagaagcttaaagttggcagtgttgatgtacttcattgctattatgcccatggcgaggagaatgagaacttccaaagacgaacatattggctgcttgaagagagtttcatgaatattgttcttgttcactaccttgaaatcaagggtgtcaaacaaagtttcaatcgtgctaaagaagctgaagagaatgcaggattatctcatgctgatagtcctgcatgttcaaactctttcgctagtcagagccaggtagcctcccaatctatggatgctgaaagcccaattagtggacagatttcggaatatga

SEQ ID NO: 24370 - DNA, 669 bp, Sorghum bicolor
  Clone ID: 30934634
ttcttttgcttgtaacacgaatacacactcgtattataacatcataacacaatgagcattaaggccgttcacgctagacagatcttcgacagcagaggcaaccctactatcgaagttgatgtgaccactgaaaagggtctcttccgtgctgccgttccctctggtgcttctactggtattcacgaggctctcgaattgagagacaatgacaagagcaagtacttgggcaagggtgtctccaaggctgttaacaacgtcaacaacgacattgctcccaaattgctcggtcaagatgttactaagcaaaaggaaatcgatcacttgatgattcaacttgatggtaccgacaacaagggcaaattgggcgccaatgctattttgggtgtctccctcgctgttgctaaggccggagctgctcaaaagggtcttcctctttacagatacctcgccgaattggctggcaagaaggacgtgatcctccccgtccctgccttcaacgttatcaacggtggttcgcacgctggtaacagattgcccttccaagagttcatgatcttgcccgtcggtgcctccactttcactgaggctatgcgcatgggtgctgaggtctaccaacacttgaagttggttattaaggaacaatacggcattgacgccactaacgtcggt

SEQ ID NO: 24371 - DNA, 649 bp, Sorghum bicolor
  Clone ID: 30934636
ctctttctcccgacctctccagaaataggcagggcggcggcgccgccagccatggccggtgcctgtcccccggcacggcggcgaccctccccctcgcatggtatctgttgcaaaaccctatctgccatttgagcgcgtttccgagcgtccacgccatccacatctcccttccttgtctaatgcttcatatcttcctgatgctttggttaactctaagaagcaatgagattagatttcgagatgcaggttctagcctttaaaatacggaaaaaaaaaatcctccgatggtgcacaggaaattttttttctagcgatggagcacaatttcatagcagcaaagtgaagacctgaaacgcaaggctactattgcttcatgaatctccaaaggtggaaaaatccttctatcagaatatgtaaaaacaggtatgtgcattatcacttaaatgcggtataagaacaggtatgtgcattatcacttaaatgcactaaacaggcatgtgcattattacagaacagctggattgttggtgctccctccctctctctcccttaccccctctcaccctctctccttggagcttcacctttggccatgaaccgattttttttcaagtattttctcaaaccagccacatttggccgccaacca

SEQ ID NO: 24372 - DNA, 592 bp, Sorghum bicolor
  Clone ID: 30934642
atttgatactcaggcacaaagcctcaaagatgactttttcaggaggttaaaggacattagaaacaagttgaaaaatacgggcaatgagctgctggagaaggttgtctctagctgcaaacatgtcctgaatgctcctatggatgaggatactctgatgcgaaaatgccaagcagctcttatcagttctgatgaactcaataaaacatatggaaataactttgttttagggtttccacaaaaccaacaaactaccatggcctgaagccataacacattgatgtttatttgggcatgggtttgttgtacctagtttgacgtagccaatgcgcaaatggtttgcatcacacctgtgttgcaactgagagatatttttgagccttgatggtttgtataaagagatgcactgtatgttcaagaccctcatttccatctttagcgtgaggaggttcagtgactagattcattgtgtttcagtcctatgccctgatggaattgtcaatgggacttctgagcaatttctacagttgcctcacaacagatacatcaattgcattcttccactacttagtttcttcagccttgactagattca

SEQ ID NO: 24373 - DNA, 629 bp, Sorghum bicolor
  Clone ID: 30934643
atgcgcgagagagacgcaatggcgccgccgtccccttcctccgctccggccaagaaacgcatcaagtggctgcgacgcaacaacaagaaggtgatcgatacgtacctcggcgaggcgcgggcggctctcgctgcggcggcccaggacaccgacgatggggacgacgcggcggtggcggcgctcgccctggtcaacgccgctctcgagatgtcgccgcgggctgaggcggcgctagagctccgggcgcgggcgctccttgcgctcaggcgctaccgcgacgtcgccgacatgctccgcgactacatccccagctgcgccaagtcgtgctctgccgacgacgccaccacctcgtcctcgtctggctccggggctgagctcctgtccccggaccgcgaccgcttcgacgccggcgccacccgcttcctctgctgcctcgacatgtccgacctcaagcgccgccttgtcgcaagcttctccaggagctccggcaccgaggcctaccagtggaggtacttggccctgggccaagcttgcttccacctcggcctgatggaggacgcggtggtgcttctccaaaccggccgccgcctggccaccgcggcgttccggcgcgagagcgtgtgctggtc

SEQ ID NO: 24374 - DNA, 733 bp, Sorghum bicolor
  Clone ID: 30934649
agacacgatgtgccagcgtcgttcgggcgctagtataaattgccgagcttgacacggtgatggaatatatatctatccccgtcccgtcacacgcagcgcaacggcagctatagcagcagcagcaccgctggttcgctccacagtcgcgccggtggtgtgccgtgtgcgtgcgtctactctacatggcggcatcgctaggactcgcccacgacgccagctgctacgccgcctacccgccggccgccgccgctgcctcctcgtacttcccatcaccaccaccacccggcgacctcgtggcggagttcccaccgaccgccgccgccacggccatggctgatgactactactactactactacttccagttcggcgaggagatgggcggcgctcgcgctcccggctgcggcggcggctactgctcgccgccggcgccggcgttcgacaatggcatgagcctgctgagctatggcggcgtcgacggcgacgggaggaggccgatgagcggaccagctgctggcactggtgggaacggcggcggcggccggccgccggcgtcacggatcgggttccggacgaggtcggaggtggacgtgctggacgacggcttcaagtggcgcaagtacggcaagaaggcggtcaagagcagccccaacccgaggtacagcacaatacaatacgactcccgcgatcacttcagttccattccatggtcacgctcatgcatgcatgcatg

SEQ ID NO: 24375 - DNA, 516 bp, Sorghum bicolor
  Clone ID: 30934662
atgcggaaaaatgggtcacacacccaatttggatgttttccaacagctgacccaaagcgagaggaggagagccctcgatgcttgcgccacccacctctgcttccctccccaccgagcaatccctgcatgcgtcgctcccttcctcctccctgtggagcaccgagccttcctccctagcgatccaatcgattgggcatggcggatccagcctctcgacccgagtgtcgagtgcccagccggcggcgtcctctccccttccggtcatctgcgacggatccagtcgattgggcatggtggcgctcctttccccgcggatctgagcgttgagcgccaagcctccctctcttcccaccaagcgcccagccatcggtgccctctcccgttccggtcctgcggcggcacccatcacatctccggtttggctaggaagggaaatcgtctggaaccctggagttgcttgagaaagggaaggtcactccagactgcacatggaaaaggtcgatgggggctgcagct

SEQ ID NO: 24376 - DNA, 550 bp, Sorghum bicolor
  Clone ID: 30934666
aacaagagaagaaaagatccctaaatcggcgctcggctcctcctttccgtgcctcggccgatccgccggaaccgcgtcgtccgccccgtccggtcgccgcctcttccccgcctcccttctcggcgtccgcatccgcgtctgcgtcctcctcttcctcgtgccccatgtctgcgcttttcaacttccactcgttcgtgacggtggtgctgttgctgatctgcacctgtacctacctcaagatgcacttcccctccctcctcatccgccggacagggtgcgcctcatacttgtctttttttaacctatatatagtatatttttaaaagtctcgacgaacattgttgcggtgaactggttatggtccgattttgggatttgagaataataatgtgcaatctgggtgattgcgtggcttttgcccaattttttcagtttgttctctagtttaccgacgctgtgcgtttcgcctatttgtttttttccctacagtcctactcttagggtttagttgaagttttaaaaatttccatagcaacttacctgtctatag

SEQ ID NO: 24377 - DNA, 655 bp, Sorghum bicolor
  Clone ID: 30934694
ctcttctttccgttcgcgcccggaggaccgggatccggtgcccgtcgacgacgcgcccatgtcgggccacctcgatcgcctcgcgcggccatgttttgaggggtgctcaagccatgatgaacgcagagaccataagtcagactttgaagtctctgaagatgaaaagaagaccagaatgggctctttgaagaaaaaggcaatagatgcatcgactaagattagacattcattaaaaaagaacaggaggaagagtggtagtcgggttctttctgtgtctattgaagatgtgcgtgatctagaggagctgcaagctgttgaggcatttagacaagcactactcttagatgagctgttgcctgcaagacatgatgactatcatatgatgctgagatttttgaaagcaaggaaatttgatatcgacaaagcaaagcaaatgtggattgatatgcttcagtggcggagggagtatggcactgatacgattgtggaggactttgaatacactgagttggacactgttttgcaatattatcctcatggttatcatggagttgacagagatgggagacctgtttatattgaaaggcttggaaaggttgaccctagcaaacttatgaatgtcacaacgatggatcggtatgtgcgataccatgtc

SEQ ID NO: 24378 - DNA, 557 bp, Sorghum bicolor
  Clone ID: 30934702
tggatcagaatcaaacggtccaaaacccaaacccctccttaaccacacatggggaacgcgcggcgcccagccgccgactcgccggcggcgtcggaccgggaggtaggattcgcgaagctgcagggcgagtgcttcgagtactacatgcagacctactccatcgtccttggtcgccatagccgccgcagcagcaagggccccgccgccccgccgaccgaggccgacgacggcgtcgacgtggacctcggcgccctcggcggaggcatgaacgtctcccgccgccacgcgcgcatcttctacgacttcccacgccgccggttcgctctcgaggtgcttggcaagaacggctgcctcgtcgagggcgtgcaccacgtccccgggtccgcccccgtcaggctcgactcccaggacctcctccagatgggggaagccaagttctacttcctcctcccctcgcgctccgtcttcgacgccggcatcgcgcgccgtgcccccgccgtccagcgcgggatcccgccgcctccgtctgacgacgacgaggatgaggatgaacaggg

SEQ ID NO: 24379 - DNA, 621 bp, Sorghum bicolor
  Clone ID: 30934704
gagaggcaggcacacgcaaaactagtccccttcaccccgttcgttcattcctccgatccgcaagaggattaggaatttattaggatcagggtcagggaccgatcggcggagcccgcccgagcgacgacctgctgctcggcccacccgcccggcgaggcgaggcgatcgatcgatatggcgctcggcgagggcagggatcacggcgccgccctgcccctcatcgcggaccaggcgaaacatggcgccggcggcatcgtccgaagcgggagcatgtggacggcggcggcgcacgtgatcacggcggtgatcgggtccggcgtgctgtcgctggcgtggagcatcgcgcagctcgggtgggtggccggccccggcgccatgctcgtcttcgcggccgtcacggcgctccagtccacgctcttcgccgactgctaccggtcgccggaccccgagcacggcccgcaccgcaaccgcacctacgccaaggccgtcgaccgcaacctatgtagcagcagctcgtgggtgtgcatgctgcttcagcacacggccctgttcggctacggcatcgcctacaccatcacgggctccatcagctgcagggcgattctgaaggcgaactgctac

SEQ ID NO: 24380 - DNA, 671 bp, Sorghum bicolor
  unsure (1)..(671): unsure at all n locations
  Clone ID: 30934735
ctttttttttttttgtcatcaacaaatatcatcagccttagagcaaaacacacaaatatagaagctagttacacagaatttgctatacaaaacatcttaagatgcccagaatgacatttgaagcaacatgaaattttatattttatttaataactagcttctatacttgatcccgccatcacggctcacatgctgacagctttccatcagggctccaggctccaggcaactgaaaggacaaacttgccactgctgtcctgtcagggcgagctccctctggacgtgggacagtaaggctggtaattggctgccatctctctgtgtcccagagcttcactaatccactgccaccaccagatgcggccagagcattacccttgtctcctgccactctctgaaaaccagggaagatgtgagctgatggccactgagaagcacaggaacaaatggtctacactagtcctcaacgagctccaagacctgaaactggagctacacctacnatccaaatgagagagcaaaacagtaaattgttgctgagagagaaactgtaaaacaaaacagatatcanactgggcataagttgctgctgctgatgtcaacacaatatcaaaagcctactagctatcgaacaaatagtaaactggattaaataaaaagcagttaacctg

SEQ ID NO: 24381 - DNA, 626 bp, Sorghum bicolor
  unsure (1)..(626): unsure at all n locations
  Clone ID: 30934745
agcgctcccatttcccaacgccaccccacccggccacccccaacgtctctctactctctccctcccctgtgccctccacgctgcgcgggcgcgggagaccaaggcgagggaggtgtcggtgcggaggctcgcggccggggtttggcggctgcgcccgccggaagccgtggccgggggcggcggcgagagcagagtccgcgtgggtgtcgagcatatcccaaggcatctgcaagtccagcttctcaagcagaacacttcaggtcatcaccagagtttgaagaatgaggtttcaagccccttatctgttttggagcggaagagcggagagctccacaaggtacaacttcatgctacttctgctatgctgcctgtcactaccatggaaaaggcaacaaaatgggagcctgaggctgcgagaggaggtagacgaggagcggaagatgctgcaaatggctgaggtgtggcgtgaagaacgggtgcagatgaagcttgttgatgcaaaacttactctcgacgcanagtacacacagctgagcaaactgcaacaggatgttgaggcgtttattgctgcatgcagtactgcaaatgcagacataacagcagtagaggaagcagagaacataata

SEQ ID NO: 24382 - DNA, 596 bp, Sorghum bicolor
  Clone ID: 30934769
aaatgatgaaatgcgtctgcttgcggagacaagaaaacttgaagattctttgacagtatgtttatgttacaatccttattttttaaccatctgggcttgttactttcattttggctgagctttattttgctgtctttcacaggaagaagagagattcaggaacaggactatgtttgacataatttatgttagagatactcacccattgtcctctcagattatgttcctgtatcagaactactaccatctatcaagaacagacccttatgttattcccattcagcctgctgttaggttggtagaaatggaagatacattgatttggatttttttccctcagcatttgtttactgtgttgctgtatgcagtggtggaatgaatggattcctatgtttatctgaaaggaactggtatattgtcactgtaacttctccagttagggggttcaatggcattgctcagaacagagttttgaatgctacctatcttaatcctcagtatcacaaacacatcccagagcctccagcgggggtcatcatacctgcgaagatactgaaacctagtgatttcaaaccctttcctgtgttgtggcatga

SEQ ID NO: 24383 - DNA, 625 bp, Sorghum bicolor
  Clone ID: 30934774
tagaccaacctaggaggaactaggtggcatttcattaagaagaaaataagcacccaaatcgtgttgacgaggacttgaacagggtggtctgggtatacatgacttacattacgcttttataatctacataacttagcaccttatatgtaaggccatccttataagttaccagtcctagatctacaggttttaaaatatagattggtatcatgagtacaaggggtttcgatgatattgttgtggccaaaagttctcagtagctagcaaggataatagattaaaatattgatggtagccagccgattagcatctggctacccttcagtggtaaaaatatcagaccgaacggtatatgagtttcatttttccctcaaacaatgcaggagtgctgtgtgccatttcattaagaagaatatgattttcaatttaagtgaggaagtctattttagtacccaaaaacatttcttgtttgctttagattgatggggggtcaaataccgagaatctgggattgcaaaatattcaagcccgaatcaggatggtgttagcctttatgatggcttctctaatgccatgggtccacaacaaatctgggttctatcttgttcttggaagctcgaacgtc

SEQ ID NO: 24384 - DNA, 539 bp, Sorghum bicolor
  Clone ID: 30934805
atgcacatcgtttggtgccaaagacattgctatcacattagaagaaagtaggtatcctccaaaactagcaactccacaaccaacatcaagaactgtacgaagcatcccctcattgtttatattgttatctttgaaatttagcatatttgcaatatttgatatatatttgtcagctccatggtgaaaatgggtcccaccacctggaaacttgatcttttcaccggcttcaaccatccaattctggtctgacttctcttttgcaaggtgagtgtgtggaatgtttgctttccacactacatcacgactttttggccattttataggaaccttatagccatgtggtggaggaatcaagcaattaaaacgcctttccggtggagggcaatgcctctcatagtgctccatcaggtttaaatccagcttcagcctcatttgatatatcaagttcctatccaagcaggggatcagctcagagtgccggtcatcacacacctaaacacccaagaaaacaaacaattaaaatcatgaacagacaatcc

SEQ ID NO: 24385 - DNA, 235 bp, Sorghum bicolor
  Clone ID: 30934808
gcagctgcagctaaggagaatgagcagcctgtgacatggtgctgatctccctgccatagactcatgctctagaaacatacaacaaaatttcttgcactggattaggtttccaagagatgcagtgtcatggtagacatgaatttctgatattaatcgaagcaaacggttactgaattgcaggatgtgtgtatctcaatgtagacaagatactaaactgtgtaccaactcatattat

SEQ ID NO: 24386 - DNA, 599 bp, Sorghum bicolor
  Clone ID: 30934854
gattactgttgtggtacataatagtatgtggtatctgctcattgaaatcttaattggcctgtagaatctgatttttttacatgacttttggataaataaaatatgttgcttgtatatccttagtcgttttttgcttgcgtgaaggaaaaaactggtgctgttgtatcctaggtttatgtgcatattgccatattctaaataaaatatctctttcgaatgtgcaggtgccattgggaagtctacagtaataataaatattgatccattgaatcatcacatgaatgtctgtttgttccttttacatgtacacggtaataatttacatttgattctatatcaagggtggagtagcaggtggcagtttcctcaagctatgtaactttttgatatctaaacatacagtaatccatatctgtgcatgaagtactttcattctgtggaagtacagttcttttgtagtgaagggagtcctgaggctgaaccagaagtgagcccaggcattgtgaatgaacttacagtttaacgcttgtgtattttgatcatgagaacttactgtgtactgtgaattgtaaactatgtgtaccatattgtgaaacatg

SEQ ID NO: 24387 - DNA, 680 bp, Sorghum bicolor
  Clone ID: 30934910
cttctttagtctctgatgctactcaagtgggctcatggattagctttattttaatttctgtccctctgctagatagttttattttacgtgttgatttggctgctacatattcacaatccttatgttatacactattaggttataacatcaagtcattgtctagcgtctcacaaaccctgttctctctaatacacaatcgacctaggattcagacttgcccaggctacagcttcaccaaacagcctaacttacagactctgacgacaaagttacatgttggggctctccctctcggccaccaggtaaattccactccatagctaagcggctacaaatatttatattagtcccggctacgatctttattattgttacaacacattcatatatcatcgtacgtgagataacaatacttttccccctgattactatattgtaactggactgtggtatatccaaaataacatctaccatgttcacctcgataggcttttgacaaacctgatgatgtgaatctgatgatgctatgttggtctatgcatccagagtaccaaggagcaccaccactcaaaaagcatcctgtccaagggacacgtgatcatttcttcatgtgctagctaatgagactatgcatgtataatgcgacatgtttttctgttctaatctacagacttttcatg

SEQ ID NO: 24388 - DNA, 698 bp, Sorghum bicolor
  Clone ID: 30934919
atcagtctcatcagaggatcatgacgaacaatgagcgagcccctgagcctccaacgatgactacaataggtataaacatttctatgcagcaactacacttgacaaacacataccatgccaacaatccagctctactccaaacaccaagatgctatgtagatgcctccactttgccggatcaaccaaacatgtctatgagacaggcgggcttaggaattttctttcttaacacgagagtacaaccagctcaaggaatctatatcaaggcaaaattggaagcctgctcatcagtcttaatggctgaagctgcaagccttgctttggcttccattatcattgacagattgaacattgatagagtcagcttcctgtcggacagtgaacttttggttcacttcttcaatcaaacacaccataatgaccccccagattggagaatcaagcatttcacccaaacattttccaaccatatcatttccagggaacccaagatcttcaaagtcaaaaggagctctaattcaatagctgatactctggcacgagaagcctttctacataggactgttcagagcaacaatatacagtattcatgctcgcatgaacaccataaaatagaatgtcctcttactcaagttctacactttgtagacttaatcaatgtaacaatcattgcagctcgttgctgctgataattaagt

SEQ ID NO: 24389 - DNA, 652 bp, Sorghum bicolor
  Clone ID: 30934931
ccatccctgccgacggcaatggcacgcggagagctggcgtgaccgccgaggtcgccaccagcagcaatcaccgcgtccggtaccgcatcaaggccggcagcagcaggcaccaccaccctgccccgccgcagcaggcacattaccagaacagcacgagccccaccggtggcgacggcgatggtaacggcagcgactcggacaacaaggaagccgcacaggaagaggatgcggaagacgaggaggaggaagagagccggtgatgattgattgctctcgccggttcttctccagcaatggaatggtaactcaatagaaacttgcatcttctgttagtaatcggtgttttgtgctagcagaagaaatttggtgctcccagactgtggagtgagatcaactaggtggggtggggtggtagtggtggtgttagcaacaacgagaagcaaaggattagcattgattgaattatggtaagtactagtagctgaatagtgtggggggtgactgtgtaacttgctgtacctgccctgtttgtgcccgtgattgtgctgctctgttgtcagggaattgtcatagagagagtttgtcatcatactgtcctatgtaacatgcttaactttgtggaaattgttagctgtatttgtgttaattctgg

SEQ ID NO: 24390 - DNA, 634 bp, Sorghum bicolor
  Clone ID: 30934960
ctgtcggccttcaggtcgtcatctcgtcggacatagtcttgagctgtgcgaggacatcggccagggtgggttcagccatggctggggactgtgcagtggacgctgtggagggggtcggggaagatggctgctgggcgaggtgggcggcggcggcggcggcggcggtaggtggagcggaggtggaggtagaggatcgccggatagctgataccaagttgtcaagagcgtcaagcccttgactggcaggaccgcggctacgaagctcgtagccgtcggccgtcttctccggtgaggttatacccctctaccgtaggcttaggttttagaaaggagacaggagacaggaaataattgttattgcctgcttatatcaatagagtctacagatatttatgtcccttctaccttactcctttttgctaaatatcctatttgggactaatataaattactagtataaagataattaaagataactgggcctgtgttagcccctggacagctcctgggactcctgggccgcgccctcgacgcgctgaacgcgctcagccgcgcgcctaacgtcccgagcccgtcgacgtctgctgtacgtattaccgtacatgacattaaggtgaactgagtatatttctgg

SEQ ID NO: 24391 - DNA, 703 bp, Sorghum bicolor
  Clone ID: 30934964
atgccttgtcaatcctcacccaaagttgtcggccgtcggctgtcaggcatgagctacgcaggcgccagcaatcgctgcagcttccaccaccggaccccctggccgcctccgctactcgatgtctcggcggagcatccgatctggttccagccgccgcgcccgcgttcccatcgatggaagcatcaaactaaccaccgattcaagcgcaatgaacccatatccatctgcaaagaacaccctccgacatcgctggtccgtgctcgatccggatcggctgacatccgccaacgccaggcccattcaccgtcgcctctgttctgcaccctcggagatttgcatcgacccccgctccagcaacgacgaacaacgtcgggtcactatgtcgacactcaggctcgactaccttcgcaatctggaggcgtacgcaccactctgcagctgcatccaactctactggcgttggatcctaatctacttcgactgactgagaggagccagatcttcatcgccaacgacctgcctccgcatcagttccatggcctccctgagattcctgtcggggggcctgcctattctggacagactcgccagcctcaagggcgtcgggtgcaccatgaatctgctctcatggaactgccagggatcagccggctccctgcgtagttcaacaatgcaacatcttgcccgtctcataacatctacc

SEQ ID NO: 24392 - DNA, 639 bp, Sorghum bicolor
  Clone ID: 30934982
acgctcccctcgccgccggacgcgacggccacaacacaccggaaccgggaaataatcggaataattccgcgttccccatccgatcccggaaatatccccaaggggagggaaaccctcgccccccgctcctcccccgccgccggccgccagatctccggccatggacgacgacggcgcggcctcccggtcgccgtcgcgctcgccgtcccggtcgccatcgcgctccccgtccccgctccccgtcgccgaccccgtcacggtcgccgccgcgccgcccggccacgtcgccgtcgctatcccgctccgcaagccttccccttcctcgggcggcggccgtgaggacgcgtggagcgacggcgccacctccacgctcatcgacgcctggggggagaggttcgtggcgctgggccgaggcagcctccggcacccgcagtggcaggaggtcgccgaggtggtctcctcccgcgacggctactccaaggcgcccaagtcggacgtgcagtgcaagaaccgcatcgacgcgctcaagaagaagtacaagatcgagaaggccaagcacgactccgactggcgctacttcgaccgcctcgacgacctgctcgcccccgtgctcaagctcaattcctcctcctcctcctc

SEQ ID NO: 24393 - DNA, 699 bp, Sorghum bicolor
  unsure (1)..(699): unsure at all n locations
  Clone ID: 30935009
gaaacagtagttcacgatcgatcgatctcacgactgtagcgccctaacatcgtagagtatatccatcatcatctctactggtgtctggatcgatgtgtccgtaattttcccatcccgtctgcatatgcgtgcttgctgcactgcaattggtaaggttgagctagctggccggcccttgattattcatgtcttccatgccatagccatacgggccggatatcgctcgcacatcgatcactgcatgcacatggatggatgttcatcagcagcagcagcacagtagcactccactaataatataagctagctagtggctctgggccatgcatgacatcccaatcccaatcccaatcccaatcccaatcagcaacaagattgaatcaaagcaattaaaccgccgtgctcccctccgacgatcctatcctatatagcaccagccaccaccgtagaccagcagccggccggcggagtagtgtctgaaatctgaatctgaccgacgactgccggcagcaggggcagccgccgcccgccttgctgcatgactgcatgctcttagcttgttcccatcgattcatccgcatccgcatccgcatctgcatcggcacagtcgctcaccacccacaccgccnccggaatagcaagcaagtagacatctgtatctagctaccaatactactgcatctatcaatggctttcaaa

SEQ ID NO: 24394 - DNA, 628 bp, Sorghum bicolor
  unsure (1)..(628): unsure at all n locations
  Clone ID: 30935043
ttttataacaaactgtctgatctgttcatgatatctaatctgtagatggctagattgaaaatcatgctagaactgtgcaagctcgatgtcatacagctgcatcctgtcaccagaggtgatttcagttcacgctaggcaacgatcaacatcggtaatgcattgttgcttatgctctttgcctgtttctgtagcatacactaatgccaatacaatggtaacattaatgccaatacaatgcgttaaataaggaagccggcacaatgtcacctgatgaatcgtactaaaccatctcatcttgttcaggacccacgtccatgggtagcttggggacagacctatgaatagaaaggaatatatatgtcatgtgtgtctatgaccgagttcctttaatggtaaagtttgttgtgttcaagcccaactgtgccagtcatcanggagtttgaaagggggtacatgtataaaagtttttttctgtcaataatgtatgtgtcatccctgtcctaggatgttatttgtgcaataaatcaatgtttacttggttttagatgcactaaatttcagcaagtaattacatttttaaaaatatatattacagtttagttattcattaataaaaaataaattcgca

SEQ ID NO: 24395 - DNA, 689 bp, Sorghum bicolor
  Clone ID: 30935049
taaatgcctctgcctgatatgattaatgcaattttggctctggacacttctgttcttgataatgaccaagtggagaatctcattaagttttgccctacaaaggaagagatcgagatgttgaagggttataatggcaacaaagaaatgcttgggaaatgtgaacagttcttcctggagttgatgaaagttccacgtgtagaggccaagctaagagtttttgctttcagaattactttctcaacacaggtagatgagctaagaactaacctaaccaccataaacgatgcaacaaaggaggtgaaagagtctctgaagttacggcagataatgcagaccattctcacattggggaatgcattaaatcaagggacagcacgaggatctgctgttggcttcagattagacagccttcttaaactgtcggatactcgagctagaaacaataaaatgacgctgatgcattatttatgcaagcttcttgctgagaaaatgcctgaacttcttgattttgacaaagacctagtttatttggaagcagcttccaagatccaactgaaattgcttgcggaagaaatgcaagcaataaacaaaggtcttgagaaggtcgagcaggagctagctgcttcagagagtgatggtgcaatttcagttggctttcgtaaggcattgaaaagctttcttgatgcagc

SEQ ID NO: 24396 - DNA, 573 bp, Sorghum bicolor
  unsure (1)..(573): unsure at all n locations
  Clone ID: 30935065
gtcagaagttgctcgattgagcccggcccgacagtgaccgtccccctcttcgttagggtttcgctcctcttctcccctccgactcccgcgtgctcctactagggttagggctccggcgaggcctcgctcgcgccggcggcatcagcagcggagatgggtgtcccggcgttctaccggtggctggcggagaagtacccgatggtggtggtggacgtggtggaggaggagcccgtagagatcgagggcgtcaaggtgcccgtcgacacctctaagcccaaccccaacggcctcgagttcgacaacctctacctcgatatgaacggaatcatacacccctgcttccacccggaggacaggccctccccaacaacatttgctgaggttttccagtgcatgtttgattatatcgacagactatttgtcatggttcgcccccggaagcttttgtacatggccattgatggtgttgctcctcgtgctaagatgaaccagcagcgctctagacgattcagagctgcaaaagatgcagctgatgcggctgcagaagaagaacggctacntgaagagtttgag

SEQ ID NO: 24397 - DNA, 518 bp, Sorghum bicolor
  Clone ID: 30935096
acggcgactgccgcagcgactgcggctcctcggcctcggtcgtcgacgacgactgcacggacgcggcggcctctccgtcgtgcccggtcccgctcccgttcgacctcaaccttccccctggcggcggcggctgcggagccggcgtcgggttgtacgctgatgaggaggatgagctcaggctcacggcgctgcggctgtgacgtcgagctcaattgagcgagccgctgcttagagaaagaggaaaaggagaaaaatatttggttcttaccttctctcgtagccgacaccaactctcccctccactacgatgttgttgttgttgtttacttgatctgatgatgattactatttgcctgaatcttggttgacttatctgcatgcttgcctgcttgttttcgggcgattgaggattatcgccaaatcttgcagcagctgttgtactgtaatatagcaacattttacttccttcctcttgtgaggaaagagacagacaaagtaacttatttcaatctttagct

SEQ ID NO: 24398 - DNA, 660 bp, Sorghum bicolor
  Clone ID: 30935111
tctgtttaaaccttggtcaatcatgatatatgccacatattaagggaactaaacatggtctacattctagatataaggcacatacaaacagggtagctacatccttttgcttggagagtgcaccttcgctgtctaagcttgtgctgcgagtcttcaaaatctgagaagttcaaattcatgccctaaacttgtgaactgtacatagcagctgttttggtatgaaatagtaatgccaatttgtggataactgatttcttaaattcttgtttttgggtaacaaaatcaattagtgctgtggtgatctcactacggccacgagcaaacatacttgcatcactcaacatcctcttggtgttgtgctggctgggtcaagcggtggaagccctccttgtgatggctttggtgtgctcctcatcttcagagactgccacaacagtggatcctttgatcagcaattgaatcaatactaattgtgggatcctattggccagttatcctttgattttatcgtcctttgggtttatttgttatagatatacttgatgctgctgttactgtaatgtactatgttgtttaaacaaacatccatgttcaactgtccctgcgaccatcttgcaccagatggagggacactagtattggttcattggtaccatcctg

SEQ ID NO: 24399 - DNA, 510 bp, Sorghum bicolor
  Clone ID: 30935113
tgttcatgcggcccgggaaggtgttcatccaggtggttccgctgggcacggactgggccgccggcgcctactacggcgagcccgcggcgcggatgggcctgcggtacgtcgggtacaagatcagccccgaggagagctcgctgtcccgcgagtaccccacgggcgaccccgtgctgacggaccccgccggcgtggcgcagcgcggctgggacgtgaccaagaaggtgtacctggaccggcagaacgtgcggctggacctggcgcgcttccgggaggagctcgtcggggcgcaccggtacctgatggccggcggcgacggcggcggacggcggcggccgagagcgcccgagtgatgatgtgatgtgcgtcgggcgggtctgaccggtctcgattaaaacaagaaccgccagctcaatgaacatctcctctgctctaagctctctgctctgctatagttttcatttcccaccatttctttttctttggttatactgacttgacctgacaatt

SEQ ID NO: 24400 - DNA, 519 bp, Sorghum bicolor
  Clone ID: 30935140
ggcagaagaaagataataggaagccattggaggaagctttgatcaaggacatcccttcgatggtggactgcttgacaaagttcggcctcgacatccctgtggatctggacaagctccccaccccacagctccaagtggcgtagcaaaagaagacgcactcggctctccagatgatgttacaactggaacagtttcagagtcttgaggaacaacatgcattttggcactgatgcaggccggaaggcaggcagcgcatattgagcgtgcagccatttagatcccatttgtttgattggtaactgtagttgtagcgctcgctcagcttctggagtggagagaataacatgtgtatgccctgtttctgttgtgcgttgaccgttgaggatttttgatagataatagcatgtttttatttgttctaagaaggaaatgccgtggtatcctggcattgtgttgttaccgcactgattgctttgaatttgtacgtatcaatcaacaatacatacttgaggtgatttc

SEQ ID NO: 24401 - DNA, 644 bp, Sorghum bicolor
  Clone ID: 30935221
gctactcatgcgttgtgtttggctggatgacaatcctggctgccaagcaaccgtcgtcaaagctgaatatttttggggttctttcactgcccatcagctttgcgccattcgagtcgctgatattcacatcaatcatggtgccacaggctagtttcatcggccacttgtcggggataattgttgggtactcaattgcctggggtctgattcatgggatgaacaactactgggcaatcacaatgcttggctggattgcacttgtatttgtcttgagcttgaagcgtacaggatctatggagttgagtttcattgagatcgagccagtgacagatccctcgctgccttctgttggtgtggttgctcccagaaatggtagaactctacaaatggatgtcttgcctggaagaagagttgcagacattgtataacacgcagagaggaaatgctcggcgaatcctgtttttgttctgcaaactgtatcatgtcgacacaatgctatgtattcagttttgaaattctggtgtcggcgtgtcgctgatgtctttaaccattgctgtgtaaaggaattcttcatctggccttccagatgcatgttcattttgaatagaaatgaattctttgcgctagttgcatagttaccatgt

SEQ ID NO: 24402 - DNA, 635 bp, Sorghum bicolor
  Clone ID: 30935225
atttacttcccattttggataatcaaagcctcgagctatcattccatcgcgttcttgaggaagctggatgaattcccaacagctttgtactacatcttgaacacaatgcttctcacattgcttgtattccatatgtactggtggaaactcatatgtttgatgataatgagacaattgaataataaaggacaagttacagatgatgttcgatctgattccgaggatgatgagtaatgggagattcattctttgacatctgcaacgtgtcatttcttcgccaatacttttctatgcctgcttccagaatttatcgttttgatcttggtaagtctcgggcatggataggaaagtttaatctctgtatattgccttatgatatcaaacatggctagaccgagagtggagcaggtcctatacatgacgggtatagctagcaagcttacttgaaggttccttcaaaaatttttggttcaccttttttgatatggggaaagacatgagagggcgtaagggctttttcctgaagcttgaagaaccccctctgtaccatgttcaatatacttcacctgtgagtagatttagttctaattgatggtaataaattgattcttttgattgggagtaaatctcacctt

SEQ ID NO: 24403 - DNA, 620 bp, Sorghum bicolor
  unsure (1)..(620): unsure at all n locations
  Clone ID: 30935227
cccccaacatatcagaactcgaaaggaaatgctccaatggacttatatgaggctccggttcttacatctgaatgcaacccaaaggtatttnagcggtatggttgcctcatatcataattgaatacacctctaactatcaccgtatctgaaaaaatagttgttggcgtaactgtcaacagtttgcctgtattacatatataaaaataagaaacctttttctacctgccatttatgctttatatatgtactgttatagctggaatatttgaccccagttctgtggatcaaagtaaatttctttttagttcatgcactatgacctcaaatatgacacaggtaaatcaattttcacattttatagtttgtactgatattgatttcatatagtatatgatatgtggtttgatgtatgccttgcatcagttttgtacattagttagctggtatactgattactgtattctttacattaaatgcaagctatgtactattacacaggcaaggttcaatctgtttgtggtttcagttttatagcatagaaaagctatccatacatttgtaacatctacttgataatgttcattcttttcgtgagaagattctaggttttctctactttt

SEQ ID NO: 24404 - DNA, 537 bp, Sorghum bicolor
  Clone ID: 30935233
ataaattcgatgtggatgaaattggtgtataagcgcatttttttatttccttagacttagatcgcgcaaggcaagaatttttcgctatttacgatttcatattcttgttactagacgttctataggaataagaagaaatcgcaactcttttccgttacacataatgaataaagggtttcaaaagtcaatttttcttttcaatatctttcttttttttttcagaatcctattctatttttgttcttccacccatgcaatagagagcgaatgagaaaagaggggttttcccttaaaaaataggctttgaaatagaaatcatggaataatgctgaattcaaatgtttatttctttatttcttttcttttatttcttttctatagtataagaaaaatgaattaaatgaaattcgtggatttagcacgaccttggttgtgaccccatagataaaaatgcaaaatttctatcttcgagacgactgaaaaagggcattgaacgagaaagaaatcgtccacagataatcaaactatcgtatgccc

SEQ ID NO: 24405 - DNA, 599 bp, Sorghum bicolor
  Clone ID: 30935277
aaatccaaaacgaggaaacgcaacggaagccggggagaacgacaggggtggtggtggtgttatgtgagactgtgtgcgcgagagagagagagatccaaatctccatcccgcagccacgctcacgctcacgcgcatcatcgtcctcctcccttcccggcttccccgctgcccccctcgcctcgcgcgtgcgcgcccctaccccgtctcctcctgcctgcctgcgcgagccaccccgcctcggccgctcgctcctcctccggttaatccccccactcgccacgccacgactcgcagccggcccttcacattatccgcgcgcgcgcgagcgagcggccgtagcgtgtgggtggcgtcgccgtgcggacggtgatctcttggtgccggtgcgggacgcgtgacggtgccggggaggaggtcgttctgttggttggttggcccgcggcgacgatggcggcggtccgcggcggagaggcggtctccgtcgcgctcctcttctccctcgccttcttctgcgcccgcctcctgctcgaccgcctcgtctacaagccattggcagtctaccttttcaacaccaaagcttctaagttgatgaatgatga

SEQ ID NO: 24406 - DNA, 565 bp, Sorghum bicolor
  Clone ID: 30935279
actactcgggcgcgcagtgcagccgccggccgggttgacttgactccggcggggacaccttcttacgtgcttctggcagcacgggttggcgtggcggtcgggctcggctcagatcctccaaagattggattctggaagagtgcgctattggtggcggagcttctggcgttgaccccggccgagttcttgcaggcgcgtgcgaggagggggttgcaccgttcctgctcctggcagctgccggcatcggggcggtccgatcggtcgatgtgtcgccggtagattggccggcggcagcgcagcgaggagatggggaactgcatggacaaggcggtgccggtggaccacaacacctcctatcaatcaaaagtagggagcaaatcaatttcatcatccaacccctcaacagttaaaagtggttcgactcggtcaacttggactgtggcctcatacaaagatagtcgagagcttcctactcctaaaacagaaggagaaatcttgtcgtcgtcaaatttgaaggcattctcatttggtgatctcaaatctgcatcgaagaactttagatcag

SEQ ID NO: 24407 - DNA, 591 bp, Sorghum bicolor
  Clone ID: 30935281
cccgattcttcttctctcttcttcctcctcctccctctctctcttcaccctctctccctcgttctcctgagcgagcaggggcgacggcaccgggggcgagtagcgcgcggcggcaggcggtggttgcggcctcttcctcctccttctcctccgttggcgccaccctccctttccttcctctccctctcaaaccgacggcggtcgcgaggcgagacggtgcccgacgcgacggcgccccctacaggaagcgtgccggagcgggtgcctagcctgctgacgcaggccgccgtccccgccttgctacgccttggatctgcgaggccgcctggtcgtgcggccgtcgggccacctgcgcccgtggcctagggttcgccgcctgctcggttgtgtgggctgccggtgtgcatgctcctgccgcagctttgccgaccacacaggtatgcgctcctacctgtgccttcatcggcgctcctacctgcttgtcttagagccggcggcgctgctcgtctttctgcatagaggacaaaggaagggcgtcgctgatggggcgccaccaatggtgccgaccacacaaccaacgagccctacggt

SEQ ID NO: 24408 - DNA, 657 bp, Sorghum bicolor
  Clone ID: 30935312
acatcagaatctcgtcatgcgctcgacccacctcgtcggcggcgaccttgcttcggcctcggcgccctcggcgatgggtgaccactccgaccgtgtgttcagggcgctggcggtcgcctccctctacatccttatccgccggtggcgcgccggcggggtcggcctcagtgagcggccggcgccggcggagatcgctgccgcggctgcgctctgcacctccgtggcgtggctgtacgtgctccccgcccttggtctccgccggagcacgcaccgacgtcggcaccaagattagttgaccagtggctgttgtcgcgttgctggtaacgatccctattcttcctcttttttaaggtttggaacccaatttgccaaatgtagcctgaggaaatgtatgtgtaagtacggatctaatggtccaatccaagattaggatgatcccaactgttcaatgattttgctggttcatatgtcagtgtatagacatggtaacctcaagcagtcaagccagttaccttgacaaaagagaaattctcaaggttgtttattaatctcctgcttttcttcaagtgattgtttctaacttacagttgaaacactttgcctgggaccttttaagtcgctaaacagtctcaactctcatctcaagacaacttacac

SEQ ID NO: 24409 - DNA, 546 bp, Sorghum bicolor
  unsure (1)..(546): unsure at all n locations
  Clone ID: 30935318
atagtcatccgagaggccttctctctctagcgacggccatggtgcagcagcaacagcagcacagaatctacatcttgcagttcaggaagggcgagccggagcaggaggtggcatgcaaggtgtcgcagcccaagggcgccgggcggcgggtcatgtactactaccaggactgcggcagcggtgggggcaagagcggcaagcaggtgcaacccagggctctcggcctgcggcgcttcttggccatgctcctgctctccttcctctgcgtggggacgctgttcgcggcgcccgtgtccttcctctctttcgtgcatagcgacgaaggcggcgcggcggcgggagcggggacgggggcggtggcgacggccgcggccgcgcgtggcgcggtgtccggaccgtgctcgtccgtggggaacgacagcttctgctgcgaccgcacgtcggagcgcgcggacatctgcttcgccaagggggacctgcgcatgcactcggcgagcgcgtcgttccagctcgtgtccgccggcaactcnacggcggcggcggcgg

SEQ ID NO: 24410 - DNA, 510 bp, Sorghum bicolor
  Clone ID: 30935344
ttataccaagcattacagaacgaattgtgccggatgaagctggatctgacacttctggataaacttgtacacgagtattgtgtatacaggggaatagttgaaggaagttcgcatgttctttctggaactgctaacttcaaatgtaaacaaaatattgatattaataacgaaacacagcttgagtgtgaaatggccaacagtcagaatggacattgtagcaccagcagtatcactcgcgatgattcttggtccaggaggttacatagggttagaaatagtacgtctgggcagcgaagacgaaagagatggagaggacggctagatgatcttgattacgcttgtgacgcgttgttggattccagtaagcatgatagtttgtctcctaccctggatatggacgaagatgctatggtagaaaaacaggacctggtggtaaattttaatttgtctgataatatacacatggaagaccagaaatatgaaatgattttggaaatgcgggacctcaca

SEQ ID NO: 24411 - DNA, 555 bp, Sorghum bicolor
  Clone ID: 30935345
ggctgccaacgcgagctgtacccaattcccctcatcccgagaaacgcccccagaaaccaggggcagccacgcaccaagaaccacccacggcgaccaccgcccaccgcccccgcgctccgtccgcccccctgcgcattgcacagaccgtgacctacctcggtgagccgtgaacgagttccccaattccctaatcccaccacctccccaccggaccggcaattcttccgcgagtgtgagttcctcgttccggattttcgttccccttgcgagccgtccacgtccacctcgcgctgttggattggatcgggtcaccgccgccgcggaaaaagctgacttttttttttcggccgagcggggacgccgagctgtgctgtgatccggcgtcgcacacctgggctctggtggttccggttcttatccggaaaggggggcgggggcggcatccgaggcgggagggagaggggtggggcgggccacgcccacgagcgccacgtgacgagcggttggcgatggcgacgatgggcgcgggaaagcgcagcggcgagggcgccgcgc

SEQ ID NO: 24412 - DNA, 586 bp, Sorghum bicolor
  Clone ID: 30935354
gctcagtccattctccccctttcccttcttctgtgctcttccccgtcgagcctcgtcggcgattcgcgacttcgcctctccgtggtcctccccgtcgaggcctctcagcaccgcggtgattgaagaggcaacatcgcctctccttgctcctgtccgtcgaggcctgtcggagcagcggcgattcaagaggcgacgtcactgctccgcccccaccccatctctgtacgtggcctccccctcaccaaatccgttgctccctcctcatctgccattgctacatctgttgaggtactcttgttcttggtggccccttgacttgctagtggtagtgcttgtttgaccggtggtgtgtgggaggtaagactaagaatcactcactctcctgctcatgtgatgtgttcatcatttgattggtaacattagtgtaaataccatgcaatggccttgctagtttcggacagagtttttgactcttaggttcacaaaattttctacgaacttgtcctcgcagcccatgtgaggcgtagaaccaaattatttttagattttggtggctgtgtgatatgcttgtctcaattgctttatt

SEQ ID NO: 24413 - DNA, 585 bp, Sorghum bicolor
  Clone ID: 30935360
attaatggggccagatatgggtgatggtgctgaagggttggacaaggataaagagaagtggcttgacgaagaaagaagagtgttcagaggacgggttgattcattcattgctcgtatgcatctagttcagggggacaggcgtttctctcgatggaaaggatcagttgtggactcagttgtgggtgtatttcttacccagaatgtttcagatcatctttctagtccttttcttttttcagttctgctttcatgggggttgctgccaaatttcctgctaagacagaggtccctgaaaaacctgtggctgagatgtgtcatacccctgaacagaagcatagttgttctggactgtttggtgattctatcaaattgcagggcaagatatccattgaagagataagtgacgttagatcattaattactacagaagataatgaagaaagtaatagtaacgaattgatcggaagctctgccgggtatggagtaaaccgtgcaactggaggatgccatgtctcttataggaaatcactaactggatcccacggaaatgggctatcaggacctgtttttccatctaccggcttt

SEQ ID NO: 24414 - DNA, 668 bp, Sorghum bicolor
  Clone ID: 30935394
ctcttcctgctcctcgcctcgctatgctgtgcggtggcggcgcagacgacggacacgctgcggcaggggcagtcgctgtccggggcggccacgctggtgtcctcgccggagggggtgttcgagttgggcttcttcgcgccggacacgaaccagccgtcccgccagtacctcggcatctggtaccacggcatctcgccgcggaccgtcgtctgggtcgccaaccgcgtcgcgccggccacctcggcgctgccgtcgctcgcgctcaccgtcacaggcgagctccgcgtgctcgacggcaccacggccaacggcactgccgacgcaccgctgctctggtcctccaacgccacctcgcgcgcggccccaaggggcggctactcggcggtgctccatgacagcggcaacctcgaggtgcgcagcgaggatgatggggtgctctgggacagcttctcgcacccgacggacaccatcctgtccgggatgcgcatcaccttgcagacgcccgggaggggtcccaaggagcggatgctgttcacgtcctgggccagcgagacggacccctcgccggggcggtacgcgctcggcctcgaccccaacgctcaggcctacatctggaaagacggcaatgttacctactggaggtcgggacagtggaatggggtgaattt

SEQ ID NO: 24415 - DNA, 626 bp, Sorghum bicolor
  Clone ID: 30935406
gcctttcgtcgtctcgctcgtctcctccctcgcgcacgctccaaaaagccactcctcctcccctctcctgctttcccctcctcgcctagggtttcccaccccgatgcgtctcccgaaaacctagccgccgccgccgccgcatccaactcactgctctcctcgccgcggcagccgttttccggccatggccgctggcgccagcgactactctttcgcggcggagtacgacggcccgccgctcccctactcgctcccgcgcgccatcccgctcgacctctcccgcatcccgctcgccgcgctgtcctcctcgcccacggcctccccctccgcctcctcgtccccgctccccgtcgttcgcccgctcaccccgtcctcactctgctccgccatccacgcgcacgcacacccggcgccccgctccgccgcccccacgcccgccgccgtgggaggagctgtggtggattcccccacctccgttatcgagaaccaccacgctgccgcgcaccactccgccgagctcccttcttccccatccgacgacgagggcgccggcgccggcgacggtgacggccccgaggcgctcccactgaagccccgccaccaccagcccgctgtcaccttcgccg

SEQ ID NO: 24416 - DNA, 511 bp, Sorghum bicolor
  Clone ID: 30935416
agatgaagcattacggatgtgttgttggtattctcagccgtgctggtcagctggagaaagcgaagaatttcatcaatgagatgtctctggctcctgaccctgtggtttggaggatattgctaggggcgtgcaagacacgtggtaacgtggctgttgccgaggtggccaccaagaagctcagtgaactagaccccagtaacagcggggactacatgttgctgagcaatatttatgcgagtgctgatcgatggagcgacgccttgaacgtcaggcaatggatggctgatactgcagtgaggaagtcgcccgcttgtagtgttgttgattcagctagctcgacgaatagttaggatccaccgtagtgtcttgcttatcaggcccaattctgtcagtgttgcagcactgtctatgtaatctcgtgagctgcaaccattgtcccaattagggtcagtacatgggtgtatattagtctcatgcatacaacttcacacgggcaatctttataatgagt

SEQ ID NO: 24417 - DNA, 644 bp, Sorghum bicolor
  Clone ID: 30935422
gaggaaggttatccaagtaaactggatgatgaaatacatgttgattccactttatgtgtactcatggctctcaatcatcaacatcttagggaaatcacagacaaggatttgggtgttatcatttgtgctgtcagttgcactggtccttgtacctgcgccactggttgaattcagatactacacaattccatttgtgatactggttcttcactctccagcaattggcaacggcaaattgcttgctatggggtcactttatgcagctgttgacttgtctactctggtgatgtttctgttccgaccattccattgggaacatgagtctggaacacaaaggtttatgtggtagtttaggataaagcacgggaagttgggaatagggcaaaagcttcattttaccatagttttgatttgaacttctaacaggaccattaagcatacctgtgtccggcctatttggatccttgagtgaatctaatggaagaaatcaaaacaatagtgctgagtattgtcgttttctttttgtcagcttttatgtacactaggcattctaatcaaccattgcacaagtcaaaaataggcagtggatacattgcttgatcacacagctttgaagggcaacagcaatttatatggattgtatg

SEQ ID NO: 24418 - DNA, 607 bp, Sorghum bicolor
  Clone ID: 30935427
cagcttgccgcagaactaccgcgtcatatacatccatcggtttgccgaggcttttgttggggtcaagaagattgcccccgcagacgacaacaacagccatgccggcaccagaacagagctgtcatcacctccttccctgaaggatggggtgctttacagtcagcaggctgagactaccaatgttgaattcaagaacatggcgaggaagctcttattactttcagacatcagtggaattccagcggcatacaaacgtagaatgttggtgaagatgctccgtcaggatcagaagaggtgattctgcatcttttatggaatgtgaaaaggctgctccttgcagtggagtaagctgttctagcttcccaatcccaggagagcagcaacagcacatcagttatgggctgaaccgactgcatacacagtgaatgcatggtagtcattgacaaagtcagtgaaccagcatgaatattcttatcagttgcagtctagtaagctatgatttgtagtacctcttagcatctggtttgttcttgctgggttttcttctcttcagttgttgtttgctatacttcacttggtaataagtctctcatcccatgtatgatgt

SEQ ID NO: 24419 - DNA, 554 bp, Sorghum bicolor
  Clone ID: 30935433
gagcaaacttaacatcagttttagtttcccccccatagaagcttaaagctgaagacggaattttctgccacttaattacattaggaaactaagcttaaagctgaagacggatcttctgccacttaattacattaggaaactaagagccacagacagctgatatcactaagaatgatgccttcttcctgtggggttgtttttatttcctccacttgttgtaccaagttaagatgatctacttgaacctgataagtttcatccgggaagcacttttcggccaattgagtaagcatcatgctgtcttttgtctctagggttgtttcccagttctacctgtgtactgccaactttgctggacctggtttaccgtgatatgctgtttcttgcaacctttcctgtgcagcttactcaaggtgcctagctgttcatttcttgttatgtgcatgtctattgccttgttcctcctagatgagacagatatgtggaccggtactaaatgcccatggattgtaactttgatgtgtaaaatggcgttcaatgatgttctgattctg

SEQ ID NO: 24420 - DNA, 535 bp, Sorghum bicolor
  unsure (1)..(535): unsure at all n locations
  Clone ID: 30935441
taatcactgccgcagacaaaacatcctccctttcccttgttgttgttgttcttcttctttttaaactatgttgtttgaatgggctnagatgtattctcttgcttgttctggtttttcttcttgttgaatttgtgaaatttctatgcaccacattagtagtagatgtctcaacacctttcctaatgtcctttgctctagccttctcctcaacatcaagagtaccaatgagctcttctacattgaactcttgtctcttgtgtttaagggaggtggcaaagtccttccaagaaggtggtaacttagcaattatactgctagccacaaacttgtcaggcaaaggacaaggaaaaagttcaggttccttagctagtgactaaaacttatgagcctatttcactacagatcggttctcaaccatcttgtagtcatacaactactctatgagatgcagctcgctaccagcattagtaactctaaacttttcaacaagtgcatccacaactctttctctgtatggagaattatatagctttct

SEQ ID NO: 24421 - DNA, 604 bp, Sorghum bicolor
  Clone ID: 30935445
gagctccagcactcgttggcttcctttgctgctgcagcccaggactgctggagcgaaatggttgggcaagggacaaggccatgagcacggtgagtgcgatgttgcaagacgcgtctgtgggcacgattgtggtgcacctggtgcaggtggtggtgcgcttttggtgcttggattgggcatcacccatgctggtgttgttgagaagcagcatgaggaccccatgtttgttggcgccaacctgaagagtgagggccagaaattgttcagctgtcagttgtgtcatcagatacatcggcatggccacagcaaaatgaaagacaggaaagcatggactgagtatttcaatcagatggatgtggcacactgccagaataataatagtacagaaaaattgtaatgtagagaactgcaagaagcagctgagaaatagagctcacatgatgtgctagtgatccatctgcagaccgcaaattgaagaagagataagctgtctaacaagttgtctgtgacgctggacaggcttaatcctgttgctcagagacaatgtgctgtgggcacgaaaactttcagatatcttgtgtcagaatgtataacaattgtactg

SEQ ID NO: 24422 - DNA, 522 bp, Sorghum bicolor
  Clone ID: 30935451
ctttgaatggtaaggaggtgattaaagcagatgatgttgttggtatgtctaagctcagcattggtgaggccagctctggctccatggaacccacagctctttcccttcagcttattggatcgacaaacggcaccagtcttcaacttcctggtgccacgttttgatgataagatgcattgatccaaggagctgctgctgcttcctctgcatttgcatatttaagggacctccatttttgctgctccaagctcagctgcaatggctgcgagtgccctggaaagcgccttgtcgtccaaacaggttgctgctgtgatggccttgatcgcctgctttgggaggtcgtttccgtgactctggacataggctttgattgccgcatttggtgccccgacttgtcattgatgaaggatagcatgtacttctgtaacaactaagttattctgttccagcttatgttccttgtcatcgacaaatgtagagatacatattcaagagaaatatcaccccatcaatgtcaggctg

SEQ ID NO: 24423 - DNA, 590 bp, Sorghum bicolor
  Clone ID: 30935471
ctgcatcactgtcataactgactgtctacaaggagttctctcaggcgtcgcccgcgggtgcgggtggcagcacctgggcgcgtacgtgaaccttggctcgttctacctgctggggatcccgatggcgatcctcctcggctttgtgctgcacatggggtcgagggggctctggatcggcatcgtctgtggctccctgtcgcagaccacgctcatgtccgccatcacattcttcaccgactggcccaagatggctgagaaggccagggagagggtgttcagcgacaaggcgcatgagtctgccgggccatgaatccatgatgtgtacccgagtagcggcagctctacatttccagaccggttttgcaggggaaggcgtttgcctgtcattcctgtcagctgttgcactcacaaagggaggtgatcaggcattcaggccatcatcccctgcaaagtttctctcaccaaggcaaatgggttcttgcattgagtttcgccttcctacgattgatttttttgtatctatcatgtaaagtggatagagaaagggaacgaacaactcgaccttatatatatgatgatgactaacaagc

SEQ ID NO: 24424 - DNA, 631 bp, Sorghum bicolor
  Clone ID: 30935489
gctgcatagagtgcaatgagaacggcttggtacgctgccccaattgctgttcttgatagcttgtttggcatatacacttttcatgctaaattgttaatagtagtatatacaagaacttaaggattgcttgattagaggtagtggagagagggaaggagccttccatgtgttcttgggctcctgtatattgtgcacacagttggagaatggggtatatattgggtatgccatcagtgttttgaaagaatagtgaatgggttcttggccttgaagttgtcacatctggagtactattgatagtgcctggcggttaaggtgccatctcatagtacttcatgtatacaaatgtgtattgataaaccttcatgtcatggaagaaggcccaaagccaaagggttagagatttagaggttgtactacacagaggcaacaaaagatggagccttcctcgattctagcctgttgtatgttgtaaatcttgtgatctggccctatagttgtgaaatctgcagggagacactcacaatatggcttctcatgtatatttgtgcttgtattaaaaaatgtatattgtacattcataaccggcgtgggtttgatcaatataagtaatggagattgtgtgctaaac

SEQ ID NO: 24425 - DNA, 647 bp, Sorghum bicolor
  Clone ID: 30935501
gttccaatgttctcccggttgcatctttcttgacagatgatggaaaaagtgctcatttgcccaatctcaacttaaacagtttgagagagctacagttactcatgttaaaaatggacgctgtcaacctagctgacctttatgtgttcctcaagacctgccaatgtcctaatctggagaggctctttgtgcagctcccgaaatctagttatggacccatggaatgttcaactgatgaggtgagggaagaaccaccagagaatggcttagacaaccttgtgattgtgaaggtcatgaacttcaattggcaccgcactgaggttgagctagtgagttttctattgaggaaagctagctccctgcgtaaactattaatagtttctcccaatatcgctccattggatttgcccggtgtacaagaagcagaccttgtgcttttcaaagaagctttaaccaatggcaagataattttgagtgagtctgacgatgctgcaactcaaccatatcattttgaagtgccaagttctagttgtcagtgacgagtctggttggagccctatggatagtaatactagacaatcatgggaattatccttttgtttgtagctcttatatactgataaaatatgaagaaaccaatgtttctccct

SEQ ID NO: 24426 - DNA, 609 bp, Sorghum bicolor
  Clone ID: 30935521
aagcaaacattggaagaagcgctagaggttctgcagatggaaaatgcaacgattcgaacagactgactcaaccgagtgttgtttgcaacgatggtgtcacccaacaaactccaattcaagcatctaataattgtataggcacacaaacacaaccgtctgtagctgacgatacctcttcaatgcctccatatagtgcacaagatcatacatcagactccatggtcgaggatgactatgacgaagatgtcatatttgaggaggacgaggaagaggatgaggcatactttttcgccggtcaagacgaggaggagggaaccgatgttggcacatatgagcaagagaatagtgagcctgatgtcccagatccatatgaccgggtctatgctaatgtcccgtcagagtcgcacatgttacccttggtgccgaactgcaagcgctgtaacgcaaagaaattcgatggcgaaccccccggattctgttgtaggggtggaaagattcatctttcaagtcccgagacaccaccagagctcatgaggttgtggtcaagctcggacgctgatgctaggcactttcgtgcaaacatcagatacttcaacgaccattctcttc

SEQ ID NO: 24427 - DNA, 553 bp, Sorghum bicolor
  Clone ID: 30935563
acgcatcgccaccgcgccatatctccaggaagcaccacatcgcctcgcccccaccatccctccccctttcatcaccaccaccaccaccaccaccgcaagccaagaggcacacggggcacgccaagggggaaagccagccagcaaatccggacaagcggtcgcggccggcaggcatgggtttcccggtgggttactcggagctggtgctcccgaagcagctgctccacctcctcctgctcctggggtacatccgccgcttcctcctctgggcgttcgacgccgtggggctcggcgacctgctggatctcggggacgaccaccaccaggcgctgctgcagcaggaccaccaccacggcgacgcgcaggggcgggaccaccacggcgcgctggcgctgccgcatcaggcggcggcgatgctgctgcagcagcaccgacggccggagttccgggcggtgccggcgatggtcatcgaggaggtcctccccgtggtgcggttcgacgagctggaggaggcgcgcgtcggcggggactgcgccgtttgcctcagcggcat

SEQ ID NO: 24428 - DNA, 558 bp, Sorghum bicolor
  Clone ID: 30935585
atatttggtggctaatatattaatattaacctaacataaggacatgtgattgttacgcatatgacacatagattgaaaacgggatagacacaagtccatcccgtatcaggatctcccaaagcaaaaacgaacagaaaaccagcctatcctaattatacacattcgaaaacagatttttgcaaatatagaaacgggacagaatttttacgtcccattttcatccgtctaggtattccgtcccgttttcttacgtctaggtacgcatgcgcgcaccatcacacatccccggcatcgagcgcgagctcatgtcttcccaccaaggccaaggtgatgtcctcgtaagcatggaaatgaacaagtactgcttatttccgagctcactagcatattatggacaattccaacctggtgagcaagctggtctccaggactaacgctgcccaccaaggtttgatgtttccattttgttttgcttgggccggtttggggaccgttccgttgcgttacagcatctttagtccttatgagcacctttggttcaatttaaacacaattatt

SEQ ID NO: 24429 - DNA, 609 bp, Sorghum bicolor
  Clone ID: 30935611
aatgctaggtagggctggacgtttgtgtgaggcagagcaaataatagaagggttgcctgtggaggttaatgtaattgtatggaggatactgttgggttgttgcagtaagtatggagaagttgagatggggaagagggcaataaagatgatatcagacttagaaagagaatccggaggtgattttgcggtgttgtccaatgtgcttaatgagcttggtaggttcagtgatgctgaacaagcgcggaagttattggatgagaggaaaattgttaaggttcctgggcttgctttggttggtgagattcaatagtcatcaaaattgttcggtctgatgaggagaagctctctaaaatttcattgcaaccttaccacgttaattatgtcccagtagcataccaacttcattaaaaaacctcccagcctattggtgggttattgcacttttttccctttttaattgttattatctcccatgtcaagaggcaaaattgaattttattcgctggggtgttttgccccacagttttaattcaaaaaagaatgtttttttttcttggttgctaaatagattgtcataaatgatatgcctgcagttccatatttgtgaac

SEQ ID NO: 24430 - DNA, 486 bp, Sorghum bicolor
  Clone ID: 30935613
accctgtcggagcgtcgctcgaccccgactcccgagtccctcggcgccgctttccttctcccgtacgtgtaccgtggcgaacaccagagcggcggaggggcggcgggacggctggcggcagctcccttccctgcggcctgcgcagctgagcctctagcctctgcccaccggacggcagaagccgccggtagccatcggccggacatgtccaagaagctcggcaagctaccgccgccggcggcggcgcatgaggaggcgagagaagagctgtttgcttcatgctcttttgccgacctcggcctccaccctaccctctgtgcccaccttcaagataagatgagtttcgaagcacccacgcgaattcaagctcaggcaattccagtcgccatttcgggacagcacatgctagtgaaggctgcaactggcactgggaaaactctcgcataccttgcacccattgtgcaccttctccagatgagggagcct

SEQ ID NO: 24431 - DNA, 578 bp, Sorghum bicolor
  Clone ID: 30935617
gtgagagtagaattagttcttctaagttcgcacaggaccgcgcgtcctgtgcgagcgccgctgcgtcgccgcgctgagagcgagcgccgccgcgcgtcctgtgcgagcgctgctgcgtcgcagcgcgtcctgagagcgagcgccgccgtgcgtcccggtgcgagcgtcgctgcgtcgccgcgcgtcctgagagagcgccgccgcgcgtcccggtgcgagcgtcgctgcgagctccgagtgtgtgccgctgcgcatctggtttccgtcggcatcattcattggtgatggcgtccccaacggctggcagtgacagcagggatgcggatgaggattcgccgtgcgagatgaaggtaatcttgtcagaaattccagacacgactaattctagtgctttgttatacaattatacacatagtgaaggaatgcacaagagattttgggttaatttgggaaagggagttcataattcggatgagattcatgaaattgagattcataaatccaaggttcatgaacagtatcagtcatatatgtttcgctctgatgaatttccgagtttgaaggatggcttgcgaatg

SEQ ID NO: 24432 - DNA, 733 bp, Sorghum bicolor
  Clone ID: 30935619
gcactccggcggcggaacacgggaccaccgcgagtccacggcgtagaagccgccccgcccgcggggtcgtgccgcggcggaaactgctccgcggtcccctaagccaccgccgcagcagggctggatctgaagaggagctcacaaatcggagggccgtgccagcctggggatgggaaggctggtcgtcgcggcggcggtggccgcgtgggcgttcccgtttgcggctttggtgaactccgtagtgccagagccctacatggatgagatcttccatgttccacaggcacagcagtattgccgtggggatttctggaaatgggatcccatgatcaccacccctcctggactgtgagtttttgacaattcctcattgcttcaagctcaaatttacccatgacggatcgttgttgaaattttgcagctttcagatcaactaatgttatcttggcaatggtctgcgctgttctttttcatgacctgcttttgtgcatccggccgggaattggggaaaggaaggcagctacttcttgcaatgtacctattctgcttgaagaaacggttctggatcagcgcaacatttggtgttttttcaatcctttttcgtcagacaaatgtaatatgggttatattttttgctgccaatggtgctatcacatacgtaaaagacttgtattccaaggacaatgtttctcatgagaacagtgaaccaacacatcagtcaaaaaaaacttct

SEQ ID NO: 24433 - DNA, 574 bp, Sorghum bicolor
  Clone ID: 30935625
gaaaccgttccaaaccattcagcggcacagccccccgcataaactcccggcgcagagccgctcgccgccgtcctccgtccccaattcccacgcggaacctcccaattccgcacccaccgacccaccggcggccaccgccgatggagacctaacagtagagccgctcctacccccaacccaaccgggcagatccacctccatggagaccgagcggatccgggagctcatcctcctcacgctccgcgcgccgcactcccgcctcgccctcgtgggtggcaaccacaccgccgcccgcttctgcacccgctaagctcgcctcctcaccctatccacgccggccttctcttcaccgccgtctcatacggcaagcgctcttgctcagctcaaccaaggcgtccgcgatgccggccgacagcgtcgtgatccgtctccccggcccgcgcgccctccgcgtgctcgcgcgctccgtgctcttcgccgtcgcgctgctctccctgccctggctccgcagtgccgaggcgcccgcccgaggccgcgccgtcgacacgtgcgccgcagccgcagcccaggcgga

SEQ ID NO: 24434 - DNA, 490 bp, Sorghum bicolor
  Clone ID: 30935631
gacgagtgcaagccccagtcccggcgacctccgccgccgctggcagccgccgatatggctccaccctagccccagtagccgcgaacaagcgctccccgcagcagctccaccccaattcgtccgcgccgccacccgcagaagccccaagctgccccgtgcccaaatctagcagctcgcccccgtcacctcctgcccgtcggaatggctgccggtaaagcgcgcaagagagcacggcaagcagctccggcgagcgacggcggcgaccgcatcggcgccctcccggacgaaaccctacaccatgtcctctccttcctccccgcgcaggaggcggtgcggacctgcgttctcgcccggcggtggctccacctctggaagtccgcgactggccttcgcatcgtcggcgccaacggggaggcgccggtgcctttcgaggaggtccgggagtttgtcgacaccctcttgctcctccgtggaagctcacctctggaga

SEQ ID NO: 24435 - DNA, 586 bp, Sorghum bicolor
  Clone ID: 30935641
atagcaaagccattcggagatagagtcgcaggcgcaggccgcaggtcgtggtggatagcgcaaggagctcgccgtgtacgaggctaagcgcaagcggttcaggtgcaccctctctcgttagcgctcttcatccttctcgtcggcatcgcaggttattcatccgctcgcatctccaagagcacggcctttacgtcccctctccgcccacagaggagaagatgcccgtgctggagttcgttgaaatgcgtaaattctagatggtgtgtgaagatagcaaactgatactaacatcgcgcgttattcagtcctgcaggtgattctgttttgtttgggaatgtttgacgcatcagtcttagagcacttgtgatgttgacaactatagcaatctgtctcgctgcctttccagtagcatcgtgatacttatattgtcactagaaaatttatgatgccaacaaaggttggatttattcttgatacctgaagaattataagtgattccatccatatttgtgatgccagatgctcaaacatgagaacttacaatttgatcttagtgagtaatgtctttcaaccctgttctggctct

SEQ ID NO: 24436 - DNA, 571 bp, Sorghum bicolor
  Clone ID: 30935649
ggaaagaagagagaaggagaagggggagagcaacacagagcacacggcgtcgcatttggaacgctcgctgctcgtcgcacgtacgaacccgtggcgtccgcacgcgttgcacgtaccagagcctccccgccggagaggatgacgcggaggtgctcgcactgcagcaacaacggccacaactcgcgcacctgccccgcccgctccggcggcggggtgaggctatttggcgtgcgcctcacaacggcgccggctccggcggcgatgaagaagagcgccagcatgagctgcattgcgtcctcgctcgggggcgggtccgggggctcgtcgccgccggcgggaggagtgggtggtggcaggggaggaggagacggcggggccggctacgtctccgatgatcccgggcacgcctcctgctcgacgaatggccgcgtcgagcggaagaaaggtacaccttggactgaagaagagcatagaatgtttctgatgggtcttcagaagcttggtaagggagattggcgcgggatatctcgaaactttgttgtttccaggaccccgactcaagtggcaagcc

SEQ ID NO: 24437 - DNA, 550 bp, Sorghum bicolor
  Clone ID: 30935663
gtttcctcgtcttctccatttcatcccagccaccgcttcccgccatgccgccaccgccgccgcagggtccagctccctcccacgctggccgcgccaacctcttctccgccccgccgcctcccctctccaaccgccgctaccccagtcagcggtccctgcccctcccgcctgtccctcctcgccgccgcgaccccaagaaccatcgcccgcagccttcccaagaggaagaacgaccgacagacagcggtccaaggagaacggctgccaccaacccggccttccgcgcgtcccacctccgtaccgcgtaccgcaagcccgtgcccccagccgcagccgccggcgaaggcgaggccctcctcgccgccgacccaaccgacgccgcctcggggcgcgccgtcgtcgtgggtccctcgggcctctccttccgcctccccggcgcgccgttcgacttccagttcagctactccgaggggccccgagccccgccgctcgccatccgggagccggccttcctgcccttcgcgccgccgaccatgccacgggcctggac

SEQ ID NO: 24438 - DNA, 538 bp, Sorghum bicolor
  unsure (1)..(538): unsure at all n locations
  Clone ID: 30935679
atcggtacggctctgagcatcggtgtggcaggcaacgcgcgccgcgcgagagaggcacctggggtggggtgaccgggagagtggccaaggcctgccgagtccgagatggccgccgcgagggaggaggatgaggccgcgcaggcgcggccgctgctgctgccgccgcggccggcgcaggaggaccagaagtggtggaggcggtgggcgcgcgaggccgggtgggtcgggtacctggccctgcccatggtggtggtgaacctgtcgcagtacgccgttcaggtctcctccaacatgatggtggggcacctccccggcgtgctcccgctctcctccgccgccatcgccacctccctcgncaacgtctccgggttcagccttctgatcggattagcaagcgcactggagacgctatgtggccaggcgtacggtgcaaaacagtaccataaactatgcctagacacttacagagcggtcgtcaccctcctggtgggctgcatccctctctcgcttctctggggtgttcatggacaagatcctg

SEQ ID NO: 24439 - DNA, 502 bp, Sorghum bicolor
  Clone ID: 30935687
gcgcgctgcaactgcaaccctccgatccgcgcacacagccgcccgccgccgccatggaggacgtcctgacaccgccgccgccgccgccgcagcagcagcagcagccggaactcgccggagagaagcgtaagagggaggagggttcggtggacgcgtccaccgaagacgctccatccgcccccgcctccaccggcagtgctgaggatgcggccggcagcggcgtcgcccggcacccgatgtggaagacgagcctgtgctctttcttccgccgccgcggcgccggcgccgaagggtgtagccacggggagtcctgccgctacgcgcacaccgaggaggagctccgcccgcggcccgacggcacctgggaccccacctccgaccgcgccaagaagctccgcaaggtcgccgcggaggcccaggaggaggctgaggaggaggtcacggtggatgagcaggcactcgacaagtgcctcgtcgggctccccagggggtggacggctga

SEQ ID NO: 24440 - DNA, 318 bp, Sorghum bicolor
  Clone ID: 30935689
ctattcattccatcttcttcctcctccctgcaccagtccttcttggaagcgagagaggagaggggagggacagggagagagggaggaggagcgaggcaccggtgagctcgcggggaagctgcgtggggctgcttgcacgccgcgcggccctaccctttccccagctcactcaccacgctctccctcttctcaccaactctttccctctctcttatctccttccaagatcccacccccccattcttccttttttttttgggtcgtccccaccattcttgctaagatcattccttgatctttcgctcgctccagtacgcc

SEQ ID NO: 24441 - DNA, 558 bp, Sorghum bicolor
  Clone ID: 30935693
gttttctcagttacagcccccgcctcgcccgccgcctcgtgctcttctcgttcacttgccttgcctcgcttcccatttccgagtgccgcccgcccgccacccggttccgcctccgccaccgccaccgcttggcgtctctcccgcggccgcgaggtgcgcgctcgagtcatcagaggggggcgcggaggaggtcggtcgagaagaggaggccccgtgcgcgaagagtgccggcgcggggaccagaccagcagaggcggcggcgtacgtgcgcgccgcgcgcgcgcgcgcgtgcgtgtacgcgtacgtgcgtatggggtcgaggcggcggcggcaccaccaccacggccggtgggtggtgcccgccgtggcgccggccgcggcggctttcgcagcggcggggttgctcttcctcgtcgtcgcgttccactgcttcctgtcgccgccgcaaaacgacggcggtggcggtggtgccagtggcagctcccgtgtcttccggcgcccgaacccgccgttcctgttgaacaagccagcggaggtgcgcagaaatgtaatcggcgc

SEQ ID NO: 24442 - DNA, 548 bp, Sorghum bicolor
  Clone ID: 30935697
gaggactggactggactggacccaagcaccaaaccggccgccttcctctcattccccaatcgcctcgcctctcgtcggagctccgaaccctaaacaacacccttcaccggccgcggctcccaggcggccgggggtgatggacgacgtcagcggcggtgcaccgggcagtgcgtgccccaagaacaagaagccccggcacttgtcccgatcgctgacctaccaccaccaccacccgtaccaggggcgccacctgccgcctccaccgtccccggcgcccaccccggcgcagcgcctgcagtcggtggtcctctacacgacgtcgctccgcggcgtgcgccgcacgttcgcggactgctgcgcggtgcgcgccgcgctgcgggggctccgcgtcgccgtggacgagcgcgacgtctccatggacgccgcgctccggcgggagctccagggggtcctcgccgcccggggccgcgggttctcgctcccgcagctcctggtcgggggcgtgctcgtcggcggcgccgacgaggtccgccggctgcacgagtccg

SEQ ID NO: 24443 - DNA, 590 bp, Sorghum bicolor
  Clone ID: 30935717
ctggcttctgcgcggggggagagaggaagggctgggttttcctccccaaattggagaacgggcaggaaatggccatcgactccggcggcggcggagcgaagcggcaaagggtggatgagcaaggggatcgatgcgaaatggtgggctcggacgcggtcccgatggaccgcatctctgcgctaccggacgagctgcggcagcgcatcctgacgcacctcccgctcaaggacgccatccgcacgggggcgctcgcgcacgggtggcgcgacctgtggaagggccggtgggcgcaccgcgcctccctcgaggtgcacctccgctcccgcgacgacccgcggagggagctggacgcgttggagcacgaaccgcgcccgcgccgacggctcgaccgctgctccctcatcgtcgacatctgcaaactcaagtcctcggagctccggcgcttcctcgactacgcctcggagtgcggcgtcgaggacctccacgtggagacgcgcaagatcacggccgcggacaagctcagcttccacctgccgctgtcgagcccggccctcgcgtgcctctcgctccgccgcatcagcgtctccagt

SEQ ID NO: 24444 - DNA, 657 bp, Sorghum bicolor
  Clone ID: 30935741
atatgactcaaatatggctggtgaccaggagtacaagatagcgcactcagtgtgcagtctacacaatgctgcagccaattcaaatgagagcttaagaagggttgctaacagtcctagtgatcacttcttcttgccaagttcaaaggatcatgatgaatctcgggaacccggttctctgattgaggatcagaggcgccacatatcccatccaccctgcatggagcctaaaggagtccttggacaaatcctgtatgatgtttgtgttccgaaaaatgttgaaggatgggacattaagccaacagtgtctccgaatggacggccaacatttgcttctgcccggcaacttggtccattcaatcccatcaggtacttccgacgctcaagactatagttttctgcaggagttgagatttttgtatatataatggaggcaaggtgtctaatggcaactctgagcaagattttacctatgtaagttccctgtaattgtttctgttttccttttgcaccgcttggcgagagaatgtacatatgctttgtatattatatgagtgtgtactagaaggaggatcgtggatatagtttctaggcgggttgtaaggtgcacgctaatattgaatagccaaagggaatgcattattatgctctgtagtttcc

SEQ ID NO: 24445 - DNA, 566 bp, Sorghum bicolor
  Clone ID: 30935794
actgccaatttacaaatgctggttttatatgtggacccccgtctcccataacaacctatgatgcgtctccacaactaaattctttgcctactcccttgaaaaatacacattcgagtacccctccaactttcttggaccgtcatttttccactgatcctatatttacggaagcaaggcaaaaaaggagaaagaaacttcatcaaaaatgtcttgctagaagaggccagcttgattttcagagtgctacctcttcgtgtggacagttcgatcaaacctacatagatgcccttaaagctacctatccacggagatcatattatggttcgccacagtacacttgcccccactgccacgcggtttattggttaagggaaggtttacgacaagttcatcacgtcgaaatggacagcctatatataataattgttgcaaagctggaagagtaaatattccgccgttttagccgcggccagaacctttagcctcattggcacagtttgatggtgactcaccctgtaatagattcatgaaaaatataaggcaatacaactgtctctttgcttttt

SEQ ID NO: 24446 - DNA, 524 bp, Sorghum bicolor
  unsure (1)..(524): unsure at all n locations
  Clone ID: 30935806
tttctggtttctgaaaacttaattggaaatgctttcaaagaaactgggaactctgtttcaattttctagtcatttttggtaaacttagcatcaattttttagttgaactttggttttttggagccaacaacttatttgctctgtttcgtgcacaggtatttagtgtttgctcttgaatgtatcccatgacatcttttatggtttttttgagctgtgaatttgaccattntctctgtacttcattttacttgaatacttagttatgaaattggttctagaataaaatgttttcagtagttttatacagttcaacacaatggtgtaaaatgttagctagttaagggtatttaaacatcagaaaagaaaatttcgtggggaggggtatgtggagtgaatcttgtcagttgtattgtgctaaactaaggaaatatcaatcatctctgtgaacacagatggtctaaaactctacagagtctctttttaagctatctttatacctttcggggcttagatggaatacattc

SEQ ID NO: 24447 - DNA, 541 bp, Sorghum bicolor
  Clone ID: 30935834
actataaatccaaagatgatattgaagatgcgggaatcttcagaggtgcagttgttgagtgtatacataaaatgtaccaagatcaacctacacaagagaaaattttgcatcaattgaatctttatagaactgcgtcacagagtttcaaaacggctcatatcattgatactaacatgaatctcgatccagtttcttggtgggaattacatggtgttgcagcaagggagttgagcacaatggcaatgagattgttgaggttaacttgtggctcactggcatatgagaaaagttggatcgagaagcttcataataagaaaccttgttgggttaaacgtaagcaattcgaggattcaatgtttgtgacagtaaacaggaggatacaagggaaagctcaaatgacaaatagagatcctatacttgcatacattcctgatgaagatgaaccttttgaatggctggtgggcaggtttcgcgagtatgctgaacaaggtgaaaatcatgctttccgtacggcacgagcaaacattagtgaggaagtagg

SEQ ID NO: 24448 - DNA, 354 bp, Sorghum bicolor
  Clone ID: 30935852
tatatatatatatatatatatatatatatatatatatatatatatatatatatatatatatatatatatatatatatatatatatatatatatatatccatggtgatggtggtggatgaatatacgcatgacaaggtaagatccaggagaactgatgaaagaagtgtgttgctcaagcccctagctagcttcccttagcttggtgaacatgtgattattatttacctggtcgttgcacaaaaacaaacccaataaccattccaggagtagggtatttattgtattgttcaggctagatatgtgaaaagtgggtctttaactaaatttggaagacgcattcatattcacatagcc

SEQ ID NO: 24449 - DNA, 563 bp, Sorghum bicolor
  Clone ID: 30935857
tcaacgcgacgacgaccacggccgcaccttcccccgtgaaagcggtgaggctttttggcgtggacttgctcacgacaccgaggccagggccagcagtggtggcggcgccggagcaggaggagattgccatggcgaacaagagagctagggacgccatcgccgcgtgtactccagtacacatggttttcaagaagcaatgcatatacttcgcgctgacctagctactattagctaacgtttttgctctccaaccctcctcgatcgatcttgcttgcttcgctcggatgacagatgcatggtggtatggtagctagctagtagcttggtgctaagctcttgcatgcttaaaccttcatctgatctcctcatccttggattgttcattttgtttagtttcttcttatctttgtacctgtcctaatctctcgcataacgatctatctgccgtaaattattagctagctaaacagcatgtgtttttttgagtggcaagtgtatactaatgaaaaaaagaagccatggagattattacatgcatgccataagaagcaatgttggaactc

SEQ ID NO: 24450 - DNA, 618 bp, Sorghum bicolor
  Clone ID: 30935865
cattgcaaagctgaagagcttcaagttgcggaggaaggactggcggatctgcctggggggtacaagggaaggagttaaggggccattaacaattggtgccgaggtatttgaactcacacctccccttgtaatggtggaggtaaaaagaaggctggggataacgaagagtacgaggacttctgcaacaaggaattggagccagggatgcagcaccttgtccaccatatggtccgagctccaagtatgcttaccgatgctgagtaggtcgaaaggctttgagtttaacaacaacacttcgcacggagctattggtaacaaaagtgacattcggaggagcggcatgagaatgagacatagttgagcatagcactgctgaccagaagagatcgtagtagtcggaacaagaatcgtgacgagttccacaccactgtggttccgcagatggttgagctccatatctcatgactgaataagctctgttctccacgagggcgaacaatatgcccgccatggaggagggagactgtatttgaggctaagttgctgctgaatgttgtatcgcgggtggtgtagtgtagttctattattggttgtaggcgcgcagcaggataataataa

SEQ ID NO: 24451 - DNA, 671 bp, Sorghum bicolor
  Clone ID: 30935893
agggatgcctattgctttgcatagcacgatggtgttcaagggatttactcagcatcactctactccacttgcacgtgcattttgctcgtcttttagggagcatttgaagagtgcgttgggggaacttaataaagtttccaactcatttgagatgaccaatattgaaaaaggagtgatcccatctttgtttgttgttgaatttttgctattcctagctgcctcaaaagacaatcgctggatgaatgcgttgctctcagaatttggcgatgccagcagggaggtcctggaagatattgggcgagttcaccgggaagtgctttggaaaatttcgctttttgaagaaaacaagatcgatgctgaaaccagttcatcttcttccacatctgaagcccagcagcctgacttgtctgccagcgacattggtgatagcagatacacttctttcaggcaatatcttgatccaattttaaggagaaggggttctgggtggaacatagagtctcaagtgtctgatctcattaatatttatcgagacattggccgtgcagctagtgactctcagagagttggttctgatagatattctagcctgggtttgtcctcaagttcccaggaccagtcttccagttcatctgatgcaaatgccagcacaagatcagaagagggcaagg

SEQ ID NO: 24452 - DNA, 594 bp, Sorghum bicolor
  Clone ID: 30935911
ccccctcaccatatttcctcccctccttgaactgaatcttccccaaagcatctccctttcgcgtggtgggtgtagtgatcggatggacagcacgagctgcctgctggacgacgcgagcagcggcgcgtccacgggcaacaagaacccggcgccggctccggctgcggcgaccggcggcaagccgctacagcgcgtgggcagcggcgccagcgcggtgatggacgcggcggagccgggcgccgaggcagactccggctcgggcggcgcgggacgcgacgccgtcaccaacttccgcccgctggccgagtccgacccggaggccgccgtggagctccggttcctcgcgtcccggaccaaggccgaggtcgtcgacatgctccgcaagcacacctacggtgaggagctcgcgcagaacaggcgcgccttcgccgcagcgtccccggcggcctcgccgccgccggccaagaataataaccccgccgcctcgtcgtcgtcgcccacggcggtcacggcgcgcgagcacctcttcgacaagacggtgacgccgagcgacgtggggaagctgaaccggctggtgataccgaagcagcacgc

SEQ ID NO: 24453 - DNA, 610 bp, Sorghum bicolor
  Clone ID: 30935918
tgtggcccccgaagtgctcggccgccgcgggtacgacggcgccaaggccgacgtgtggtcgtgcggtgtcatcctctttgtgctcatggccgggtatctccctttccatgacaagaacatcatggccatgtacaagaagatttacaagggcgagttccgctgtgcgaggtggttctccaaagaccttaccagcttgctgacgcgcattcttgacactaaccccaacactcggatcactctgccggagatcatggagtcccgctggttcaagaaaggattcaagcctgtcaagttctatatcgaggatgaccagctgcataacgttatagatgatgaggatggcctgttggatatgggacctgctggtactgttcctccaccattgccacctccaccaccacctctacctccgccaaaggttgatggtgatgaatcagggtctgactcagactcgtcgatctcatcctgccctgcttcagtgttatctggtgaaagccaaaggccccgtggctcgctcccacgtccagcaagccttaatgcatttgatatcatatcattctcaaggggatttaacttatcagggttatttgaggagaaaggggatgaagtg

SEQ ID NO: 24454 - DNA, 723 bp, Sorghum bicolor
  Clone ID: 30935945
aggccacaacaatcacaaccctctctccctctctccttcgcgtcgctgcctctgaatccccacccttcgctcctccgccggcctcctccgcggccgatgtgtgtgccccgccagcccaaaaccctagaggtgacgagcaggtaaggggttccggtcggagatggcggcagcggcggcggcgatggccgcacatagagccagcttccctctgcgcctgcagcagatccttgccgggagccgcgccgtctcacctgcgatcaaggtcgagtctgagccgcctgcaaacgtcaaagcatttattgatcgagtcatcaatattccactacatgacattgccataccgctatcaggcttccgttgggagttcaataagggaaatttccaccattggaagcctttatttattcattttgacacatatttcaagacatacatttcttatcggaaggatcttcttttatctgatgatatgactgaggctgaccctatgccaaagaatgccatcttgaaaattttaagagttacgcagattgttttggagaactgccagaacagaagttcttttactggtcttgagcatcttaagcttctcctggcatcgtcagaccctgagatagttgtagcagctttggaaactcttgttgccttggtcaaaataatccttcaaagttgcatatgaataaagctaattaactgcggatctataaacacccatcttctatc

SEQ ID NO: 24455 - DNA, 587 bp, Sorghum bicolor
  Clone ID: 30935963
ttcgcgcgggcggcgctcccggatgccgcgctcgagctcctcgcctccgcgcaggcaatcgggctcacgccgcggtccaacgcggtcaccgcgctcatttccgcgcttggctctgcggggcgcgtcgccgaggcggaggcgctgttcctcgagttcttccttgctggggagatcaagccgcggacgcgtgcctacaacgcgctgctcaaagggtatgtcaggattggttcgctcaagaatgcagagcaagttctcgacgaaatgtcacaatgcggagtagcgccagatgaggccacttacagcctgcttgtggacgcgtacacaagagctgggaggtgggaaagtgcgaggatactgctgaaggagatggaggctgatggagttaaaccaagctcgtatgtgttcagtcggatccttgcaggattccgtgacaggggggattggcaaaaggcatttgcagtgctccgagagatgcaggctagtggagtaaggccagatcggcatttctacaacgtcatgatagatacatttgggaagtacaactgccttgggcatgctatggatgcctttgacagaatgcgagaaga

SEQ ID NO: 24456 - DNA, 546 bp, Sorghum bicolor
  Clone ID: 30935981
taagtctcctcctccctgccgactcgtgcgacacgcacagagacacacaggtcaccgtcacccatggccggccgccgccgccgccaccggcgtgggcatccccgacaagcgcttccgccgccgcttccttccccaggagagcccccgccgctggaatccaacgctctcagggaagtcaccgttgcagaaagctcatccaagaaaacctgccatgccttaagctctacccgatcttccctcccactcccacctgcatttaccttcaacatcccacctctccaccttcggccaaatggccatgattctcatccccatcgcaggtacatcaagcacagccttttatccaatatcagttggcagcttgttgatcctgcgaagcaaacctcctcccttagctgttcagcgctccaaaaccttcaggtccacatgcagtatttgggttgctcatatggttatcttatcttctccaaattggagcaatgcctccttgtcgatgtgtacagtggtgctaccgtgcggcctcccaagctcaaattcactgacaac

SEQ ID NO: 24457 - DNA, 651 bp, Sorghum bicolor
  Clone ID: 30936015
ttcagaaagcaacaaagatgaggatgaaagttttagggaagagcttcatgagatgttaatccctgcagttctgagaccttcaggctgcaaactagattgctcattgaagttgcatttctattacatagaatttattcccaaaccagcagatagacgatatcagatgtttggtctttttgtgatcaatcgccttccagaggaatctgaaaagttggatgttgaattgcatcttgctcatgcgaggattgtgaaagcaggaattaaatatttgggaaagattgagtttaacaaagaagagatgatactcgcacacaattttcaagagatgtttttgaaagttcttctggacagatccgagttcacttcatcttatattttgttggggaatgatgctgcattggacatggattcaacattttaccttttacttcccatcaagcagaaattctatggtgataatatgattgattggccaacaataaagaagtgtttatcatcacctgcatttcaagatccaatgggtttgtctctgcctgattcatatttgccaaatgagtctttgaagcttctcggtggagcatacaagaaagctgatgtcattggcagtttggtctatactccccacaccgacctgtttttcttcgttgactc

SEQ ID NO: 24458 - DNA, 681 bp, Sorghum bicolor
  unsure (1)..(681): unsure at all n locations
  Clone ID: 30936025
agcaccaaggcaagcaatgtcaacttgcctgctaagaaagtgcaagttcttctgatgcagtatcttgcatttcctccggagatgcagctagtactgtgaaggaaactgaaatgaaccaagaaacttattttggggaccaagggatgtattactatggatattattatcctggttcatatggaggactggatgagaatggctactttgttggatataatggcctagaggtgcacccagcagtggttcaagctgacaatgggtcatatatgtgttatcttccggggtatgaaaatggatatgcttccataacaaaaggatatcttccatctagcaagtttgtgatgcatagtaataaccaaggaaaaatcagtgtttatcaaagcaaaggtatcaatgtgaaagaaagtggtagaagctggaacaacagtgagaagcttaagatgagaagtaagttaaatggacatggtgattctgaatctaatgagaacaaccacactgataactcanaacacagtttgagccctcaatctgatgttggattgccaagttcagggggtgctaacgctagcataccttcacatgttgcaataagcaaaaatgcatataatctttcagattttgttacaaagtatgaacaagctctattctttgtaattaagtcttatagtgaagatgatattc

SEQ ID NO: 24459 - DNA, 181 bp, Sorghum bicolor
  unsure (1)..(181): unsure at all n locations
  Clone ID: 30936066
cttataatatccagattaatgtgaaagatttctttgtcgaagagcagccaaagaattatggggatatgtacaagaattttgcaagcctcattgagactgtgaactcgnatgtgttgagcgaattgaatggagacaatgctgctgctgaggctgctaaaagctctgctgctgctgctgctgc

SEQ ID NO: 24460 - DNA, 599 bp, Sorghum bicolor
  Clone ID: 30936080
agacaagcaaaagttccaagatttccacacgactatactgaatataatggagctgatttggttagtacgtaaatcactcataaataaaaggtaagcacccactgatcataacattatttggtactacctttgtttaaactatttcaaatatatttatgtggaattgaagccttcttgttcttaatagaaggactagtccatggattaatcatggccctgtacgggctagtaatttaaacgaacatatgtattaaaaatcatgaataaaatttccacccaaagctaattaaaattgcttaatcgctatcttagtttgcttgtattcttacacggtacatgattatacaaatactcatgtctttgtctctttttcaataatcttcagttacaaattgttcaatatattttctccattcatatttacagctctttgttttccatcgcaccataactccacatgtagttgaaacctactttgacctatgtgttcgacaaccattatgacctatttttttcatctagatgcatattgaagatacatagaagtggcatgtaaatgatgacaaaaatgtatagatggcctgttgtgctaggaaact

SEQ ID NO: 24461 - DNA, 422 bp, Sorghum bicolor
  Clone ID: 30936116
tgtgggaaagtaagggaacatttggataaggagggagaatgtgagttcttggaaaagcaagtggctgaagaagttaccaagcaagttaggccactagcaagatagtggaagcggtctgaggctgaagccagtcaagaccaaaacagtgattcatctcacaattaaaaagattggcctcccattgaagttattgattcagacattaattgctgtggtcatggaaaatctgtgactcctcgattgattctgattagtctgtaaacctccattgttatttggtggtgtgcctctcagttgtatcgaaagagcagaggctctgtatgtgtcatcaacttgctccggagtgtcaggttgctatagaaacctttgtattcgtggaacttgaaagacatgtactccctccatacccagattaataaacg

SEQ ID NO: 24462 - DNA, 551 bp, Sorghum bicolor
  Clone ID: 30936128
tgataacctcatggagcgacctccagagtctggaagttgttacctgcaacaaaatcaaggatgaggaaataactcctgccctttcagagctgttctccaatctcaaagagctgaagtggcggcccgacaacaagtcacttcttgctgcgagcctcgttggcactgggatgggaaagaagggcagggtatttttcaaaaggatcttacccgcccatcaacggatcaaagggaaggtgcgcaactattcagcaggtgttgctgcttagttcgattgctagtcggaaactaggctactgcacaaagttcttattgctcagcagccaattttcttgacttgaccaaaggcaaccacgcttcttgatactcaaaactcagaaggacacgtcataactagtcaggacctggtagttttatgatgcacaatttcgggtaccaggcgccccgatcttgtgtttgtacctgtgttgtaactgacaagctgagatttgctcagaggagcctgaccgtagtatttctgtatgaggaaaagcattgcttcataaattaggaag

SEQ ID NO: 24463 - DNA, 521 bp, Sorghum bicolor
  Clone ID: 30936132
gctgtccattagtggaatggcttggagatggatcggagctggtgtttcgattggagtgccaggcgccatggatggatggatatgcttagcttgctgatgctaccttcgtccactgtgctaccgcgttaccatgcatggcgtggcattgcaagcttatcactttccgataggcctggagcctggaggcaagtcagcggtggacaaaatactggtggcgtcatgcatggatggatgagcgtgagcgcacgcggcacgctcattctgagcccattcacatgacatgacaccggaaaaaggttgcaccaccggaaaatcggtgcgagaggcggctgttctctggagcgttctcttgtgtagccaactactagccatgtcggcagtgtacgtacaaataaacaagatgtagccaggcagcaggcaggcacagagaatagtctagacccaatgcgtgcaccgtgctctgcaggtcatgcctcaagatggcaacgggtcccgaaactcaatgaattttttactctatt

SEQ ID NO: 24464 - DNA, 627 bp, Sorghum bicolor
  Clone ID: 30936146
agttcccttaccccagcagcccttacatcactctcgtcggtggtactgatgtctacaaggacgacaagggtcgttactacgagatcggttgggacggtagcagtggtggtttctcaggtgacttccctgttccctcttggcaagccgctcaagttgcagcatacctgcaacaacctaaccctccctacctcatacttcaatggttctggccgtggtctccccgacattagcgcccctgctgataacgttatgatcattatgggtggctctcaaacccctatcggcggtacctcctgtgctgctcccgtcattgcaggtttgttctcattgatcaacggagtgcgtttaaaggctggcaagacacctgttggcttcatcaaccctgccatctacactttgagctcgcaaaaccctactgcgttctacgatgttactcaaggctctaaccctgatggttgctgccctggtttccccgccactaagggatgggacgccgttactggtctcggcactcctaacttcagagagttgctcaagtacttctctcaactcccttaaatccgtttggatgcgcgatcttgaccgaagcgtctttgtatggttttgccgagtaataaaatacttggc

SEQ ID NO: 24465 - DNA, 587 bp, Sorghum bicolor
  Clone ID: 30936182
ccaacacttcagtacacaataaacacctcagcctctatttcatgctttagtttgtatagataaatattgaaacgcatttgtcagataacaaaaaaaaaagcttcccttcctccctttcagttaacccgagcactgaaatccaccatagtacattcagagattccatttcgtagtacagttgtcatttttaggctgtatgacaccatactgcgcttctaaaatttgcagaataactatgaccaatgtctttaagacctatgttgtctcaaacagcaggtatctcagcagcatcctcagcaagaggcacatcatgacaaccctgaggtgatacacatagaacctggtcatactactgcctcttctacatgccagacacctccaccaggatcaagcacccaggaaacacatccaagagaaacaccagctatgtaagatttatcttagtctttgaaatacctgtcaacactatctcttgtcaatcaataatgcaacagtttaatgttagggcctcatctatttgtttaccaatgtatgctatctttgtaacttcttacataggattacaaatacctctgaacgtcctatct

SEQ ID NO: 24466 - DNA, 592 bp, Sorghum bicolor
  Clone ID: 30936270
agcaccaagctgcccagcccaaccaaaaaaaaaaaaaaaccggcagcctgaccaaccgcgcttgctcggtcgacgctccccctcgcttcctccgccagcggccagccagccggcggccactctccacgcatctgcatccgcatggctctccacgcggcggcgccggcatgcgcggtgttctgccgcctcccgtcgtcctccccttctcacgacgccggcggcaggcgctccctccccgccgtcgcgaggccccgcggcgtcgtctctgccgcgccgctgcggacacgcgcagttcgaacaaaggcaaccttcagtgatggcgtccctgaaacgagcaattctccacatgtggtctgctttggtgaattgctaattgacttcgtcccaactgtcaatggcttgtcactgtcagaagcaccagccttcaagaaggctcctgggggtgcacctgccaatgttgcagttggaatagctcgtcttggtggctctgcagctttcattggaaaggttggtgatgatgaatttggctacatgctagctgatatattgaagcagaataatgtaaataatcaagggttactatttgatcctc

SEQ ID NO: 24467 - DNA, 567 bp, Sorghum bicolor
  Clone ID: 30936272
atgcatgcaacacagcaagagtactcctcgtgttgctgtctcgttggggggttccgagaccaggattatcatggcggccaacaaattgtctctggtggccgtgctcgtagtcgtagcgagctacgcggcgctgtcgtcggccaggacattcaccgtcggtgacgaccagggctggatgagcggcatcgactacaccgactggaccaccggcaagacgttcgcggtcggagacaaactacgtttcagctacgggagccagtaccacacggtgacggaggtgagcaagagcggctactacacctgctccgcgaacgacgcgctcagcgacgacaccagcggctggaccgtcgtcacgctcacggcgcccggcacgcgctacttcatctgcaacatcccgggcctctgcagcagcggcatgaagctgtccgtcaccgttcccgggagcggccccgtgccgtcggaagctaccaggggcggcaccctggttccggccatgggctctgtggtggtcgtcgtcgccgtggccacgggggctctgatcaagctcgcactgttctgatcgatgta

SEQ ID NO: 24468 - DNA, 624 bp, Sorghum bicolor
  Clone ID: 30936278
acgatgcggccgtagggagcagccaaaaatccggttgttgacggctccaaaaacaaccgatcctcattcacatgtgcttcgggaatatcagtagtgagtactactgaccttgggagccatggagtctgcaacgggggcgctgggcaccctgcttccaaagctcggccagctgcttcaggatgagtacaaccttcagaagggagtgaagaaagacatccagttcgtcacgaaagagctggagagtatgcatgccgcactccgcgatgtcggagaggtgccacaagagcagctcaacgaagtaatcaagatctgggctcgggatgctcgggagctctcctacgacctggaggacattgttgacaccttcctggtgcgtgtccagggctccgagcctcccagcaaaaggagtgtgaaaagattcaccaatacgatgacaagtattatgagcaacgtcaagattcgtcaagggatcaagggcatcaaggagcgtgtcaaagaggtggccgagcggcgtcacgggtacaaggttgatgatattgctcctaccaaaaccttatttgaccctcgcataacagctctatacagtaaagcagctagccttgtcggcattgatgagccaaggga

SEQ ID NO: 24469 - DNA, 678 bp, Sorghum bicolor
  Clone ID: 30936302
caatgccatcttctgttaatgatacaaaagttgaaaatgacgtagaacaaaggcttttcggttctgatgagagagctgtatatgaagaagccctgaagcatatcactcaggaaacgaaggaggaagatctctccaaaggtgttatgtcagttaaactgcttaagcatcagaaaatagcattggcatggatgctttcgaaggagaatagttcacattgtccaggtggaattttggcagatgatcagggtcttgggaagacaatatcaacgatcgcccttatactgaaggagatggttaagcagtctaggttcatgactgctggttcatacagtacaaaatttgccccaaacagtgattatgacaatgacgatgatgttgtgattgtcatgaccaagaaagaaccaaagggtgaacccttcaatgagctagatgattctgcacgattgcatgttgccagcaatctcaaggtctgtgataataagtcaaacgctgccactcataaagctgaaccttatgacaatggcgatgctgtgattgtcatagccaagaaagaactgaaggatgaacccttgaatgagctggatgattctgcacgattgcatgttgccagcagtcttaagctctgtgatagcaagtcaaacactgctactgataaagctgaacctaagaagaagacca

SEQ ID NO: 24470 - DNA, 709 bp, Sorghum bicolor
  Clone ID: 30936314
atcgccagcctcttccttcctcacaggccacagcccatccctctgccatttcgcatcgtccaaaacttcgaaaccggcgccgccgccccgccgcgtctcccgccgccgaccggatcctccggcctcccgctccccgacgcggtcgcgtcaactccacctgcaccctcacgacctcgtctccgcgggcgcacatgatcacgcggtcaaagccgagaggcacagacacccagccctccaagtactagcagcagcaacccaatgctgtgctcctcccaccacccctccacctcctcctgcgcgcacaagtcaactcccgcccgcggccgccgcgcctcacgccggcccccatggctcgttccgctcccgctctcgtcgccgtctttctcctcgtcctcgcgctcctcaccctggacgcggcgcagggccaacagcccttcccgcccaccgatccctccgatgcggaggccctgcacgctgtgttccggcagtggcgactggagggggaggcggcggcggagaatccgtgcatgaagcgcgtctggtccggatccttcgaaacaaacgcgtctatcgactgcaattgccccagctggtgccgaatcacgggcctgaatgtgactgggtacaggaatatcacggagatcccgctggctctcttcaatttgacggagctcatctctttggatctaagtaataacaacttgaatgg

SEQ ID NO: 24471 - DNA, 599 bp, Sorghum bicolor
  Clone ID: 30936331
ctctctcagaggtgggttggcttctcctccccctcttaccaagtcctcgtcctcggtttagggttcgttagggtttttgtggaggggagatatggcggcggcggacgtggagtaccgttgcttcgtcggtgggctcgcctgggccaccaacaacgagaccctcgagcatgccttcgccggcgggtgcccgacgctgcaggagctcgagctccaccgctgcaccgacctcgccctccgcccggtctccgccttcgcgcacctccagatcctccgcattgtcgcggcggcacccgcgctctacggccccgccgagggcggcggcgtcacggacatcggcctcaccatcctcgcccacggatgcaagcggctcgtcaagctggagcttcagggttgcgaggggagctacgacggtatcgcggccgtggggcgctgctgtgcgatgcttgaggagcttaccatcgtggaccacaggatggacggcgggtggcttgccgccctagccttctgtgggaacctcaagaccctgcggctgcagagttgccgcaggatcgatgacgaccctggcccggcggaacaccttggtgcttgcctcacgctcg

SEQ ID NO: 24472 - DNA, 607 bp, Sorghum bicolor
  Clone ID: 30936333
agcttctcacctcctcctctctcttcctcgttctctctctctctctctccttctcgactcttcccgtgctccctcctacgcccgacgagaggcgacgactcagtctgtcgctcctcccacagcacgccgccgccgtcgccgcccccgcccgtgccgccccttcctctccctctctcgctctcttccggcgtggtggcatattggccagcctcctccctcttcctcctttccggcggtggcggtggctagggcaggcgccttgcccggtggcgtgccacccaggcgaggccgcccctagcgcgtcagccctcggcgtggtgctgcggcaatgcggcgtccaggcgaggctgcccccaagcgcagccacaacccggtgcgacggccacagccatgggcaagcccccacagcagacgctgcacggctattagcggctgttccgacaactccgcagccggatccggtgcctccatgaccagatccagtgcctccatagccagctccatccatcctggaaagcccttctcctttcttcttgtttgtctgctgagccgggacaaaaccagcccacagcgcgatggagacctgctcgacctgcttcctcaccga

SEQ ID NO: 24473 - DNA, 614 bp, Sorghum bicolor
  Clone ID: 30936335
atgctccgttacccggccacgcatgtcagcagagtggcagttgaccaaaggcagctagaaaagtggccaacgagagggtctaccgtagtgtaggagtagctccggcgcgcgcagcacaacccacttcttccacacgggcgtgagcgtcgccatggcacgcggcgcggaaaaggtgttcgacgaaatgccgctgcgggggtgctcacacctccacggcgtcgtttggccggtcgttcgatggaatgcctccgaccgcgagggtcggcgctgggtgcgcccgccgtggtccgccgggcaggacggcacaggcgcacggtccgctcccggcgcgccgcggacgggccacggaatggcagagaagcaaacctgccatctgggacggatgaatcgtgataaaagtcgatgacacatggcttgcgcttctgcacatcagtcaatcacatcctggcaaaggcaacgcgcttttgcgcttcagcatgttttgttttgtcattttaggttgaaacaaacattcaagtacggaatgcgaaatgtaggaggactacggaaactcaccatagctcacatttgttgattctggaatatctgtcaccaacctgcatgcatgaatttct

SEQ ID NO: 24474 - DNA, 545 bp, Sorghum bicolor
  Clone ID: 30936387
acgacgccaaggagaagagcctcatcggtgccatgtcaggccacgcgagctgggtgctgagcatcgacgtgagccccgatggcttggcggtggctacgggatccagtgaccgcacagtccggctctggacatcaacatgaggacctcggtgcagaccatgagcaaccattctgaccaggtctgggctgtggccttccggccgccaggtggggcgggaatccgggctgggcgcctagctagcgcgtcggatgacaagagcatctccctgtatgattactcataggttttctttaccattgcaacgcctttgtggtactctgtttccaaccagagattcgaatttggccatgatggttggaagaattgttgtagcgtactgattgaggtgctaattgcaagcgaagctaatgtgttccgtgtttgacgtaattgtcctggggttgttgagttgcatgcttgtctcgaattttttttacaggtgatccattttcgtggttcttgtatgaagggtgattaagatgagactttatatatttgccacggtt

SEQ ID NO: 24475 - DNA, 499 bp, Sorghum bicolor
  Clone ID: 30936389
tgctgctgctgctctgaggaggggacgccgttgtcatggtggggcgttgggggaaggtggaggaacaccgacggggactgcggggaatgctcgacgaggctcaccagctcctccagggttgccgccatagttcacgaagagatggtaatggtgccgctgacaactgccgagtgaaggtatcatcttggaatcaccttggactcgttctccgccaccatccgatctatgccaagaggtgacaagctcactccttgctggctgacggaaacctcgagattgcctgctgcacacatgacaaagaaagggtctttgagaaagatgatgacagtccccctgcctctgcttcagttaagaccctgctccatcaaaggcgtcaatgacaatgatcaagtagaaaaataaaactattccacgacagatccgaggatcctgtctcttgttttcttacaggggaccttggaaatggttatactttgaattgtcacttctgggaattgcc

SEQ ID NO: 24476 - DNA, 139 bp, Sorghum bicolor
  Clone ID: 30936399
agtttaacagcaggaaagttttggatgagatgatgaattttgtgaagcaaaaatattgcccatttttgagtttgggaacccctatgcattttgtatgcaagacccccatgaatcaaaggaaagtttcagtaagatggtc

SEQ ID NO: 24477 - DNA, 265 bp, Sorghum bicolor
  Clone ID: 30936421
agctcgcgggtattactatactgcaaggtagttaggccggacctggctgcggtgagggaggaaaacactaccacatggccgggcgtgtgcccgcttagaaggccctagaaactggttgctgttcttagattttgcgttgcccgatcgttcacagttggactagggcacgtggccaatggaggtattggagacgtggccaaatgaggtgccagatttcggggtacaaaattcgtcttgtaaaagattctagttccaacataagaat

SEQ ID NO: 24478 - DNA, 612 bp, Sorghum bicolor
  Clone ID: 30936437
catggccgctaattgcaacagaagcagtcattgttgtgcgcaatgagtctgaggcgagtgaatgggtccgcaagtggcggcggcttgacgccctgacatcgatcggccaaggctgatgactgatgagaggccagatgtcaagcacatttggacgatgcctgacggctggtggagagctgaagcactgtggagaccgaataagacttgcaagcagcaagagagttactttgttgcttgtctgactgcatcaactgagactaagaactcaagttactttgatgattttctgaaacaagttgtatattgttcttttatgaattctagcctcgcaccactcgaccccaccgtagtccgcagccacgtctgtctccgcagccacgtctgtctccgcagcctgcgcccggccacatgctactatgtcatgtcttcgttggccatctcttctcccttcctgctgtgtaaggattttttttatttccaattccaagcaggtatgccaactcttctcctttcctgctgtatatggattttgattggttgtccaattttaatctgctcctcgaactcttaagtagaccgtttgtggttataggaactcttaagcaagaactt

SEQ ID NO: 24479 - DNA, 721 bp, Sorghum bicolor
  Clone ID: 30936476
ataaaagccgcgcccggcgcccgcgtcgctcggctccgtccgcctcctcgcaccccgctccaatggcaggtacggctgtgaccctgccctcctcgggcacgcccttcgctgtcgccacaaccgcttcttcttcctccgcccggcgctgcttgctcctgcgctcctcgcctcctcgccgagctctccgcgtcgtcgcctccgccgcgaccgaggcgccacccaaggccacgccgccgccgacctcgccctccggcatcgtgctcgtagacccatccgaggcccagagggtgcacaggctcaaggccgtctacgaccagaaggtcgtcccgctcatcaccgaggagttcggctacaccaatgtccaccaggttcccaagatcgagaagattgtggtgaactgcgggctgggtgcggatgcagggaactccaaggggctggaggccgccatgaaggacctcgccatgatcaccgggcagtggcccgtcaagaccaaggccaggaaatccgtggccagcttcaagatccgtgagggaaacaccatcggtatcgcagtcaccctccgtggcagggtgagccccattccattgttcattagacctcctcaaagttcatatacattctcagttgacagacagcttggtgccttggtgtatcaaactagaaatttggtggcagtttggaatgatgcattctagtatataatatgccatgcaagtggaaa

SEQ ID NO: 24480 - DNA, 563 bp, Sorghum bicolor
  Clone ID: 30936488
tgttggttgtacatgtgcaagatttatcttcttaaacgctaatacaactgcacatatagtgtccaaattttatatcatctttatatagtcaacagatgaattcaaaaagagattacagtgcatctttgcaggatggaatttaaggctttaaccaaacatcacatgattgtaaaagtcatagtgtctctcagatagatagactggtaccatataaattattcaacatggattatgcagcaccttcttgttgttcctcctcttcttctgcagtctgcaacattacttcttgcataagcatcatatcaagatgttgtagatgttcctgatcaagatagggaggcttcactgttttgacatcggcgaacacaaaagtcacttgacaatttatcaaatagaggagcatagttcataattgcaagtccggtatattgttcagtttatgacaattccacctagagagtgcaagattagaaaggtcacatagtacatgaagcgtgtgcttcttgtggttggcattcaccactttgttagcatcctccctcgggggtcatatgatgaggaat

SEQ ID NO: 24481 - DNA, 670 bp, Sorghum bicolor
  unsure (1)..(670): unsure at all n locations
  Clone ID: 30936495
agaccaccgtttactggaacaatcctccgtcgccggtctccgcccacccatggcctccgccgccagcactgccgccaccggggccccgctgcgcctcctctcctcctcttccaaccgtatctccaagcccttccttccccgcccccaccgtctcaccctctcctcccccatctccttccagcgcctcacagcccggtccgccgcctccccgtccccatccaccaccacctcctccccctctggctccggctctgtcgacccggcacaactgccccccgcgctccgcgacatcgttggcctcttccagtccgtcccggacgcgcgcacccggtacaagcagctcctcgcctacgccgcgcgcctcccgcccatggacccggcgctcaagaccgatgccaaccgcgtccggggctgcgtctcacaggtctgggtccacgccgagccggacgagggcgacggcggcggccgcagcgtcaggttccacgctgactccgacgcgcagctcaccaagggcctcgccgcgctgctcgtgctggggctctctggcgcgcccgccgcggatgtggccagggcgcccgtcgagttcattgagctgctcgggatcaggcagagcctctcgccctccaggaacagcggnctgctcaacatgctcagcctcatgaagcgcaag

SEQ ID NO: 24482 - DNA, 753 bp, Sorghum bicolor
  Clone ID: 30936548
ccttttttttttttttttttttcacctcaaaaaccaaaaactttttcataatttcccgtcacatcgaatcttgcagcacatatatgaagcattaaatatagatgaaagtaaaaaaataattacacagtttatctgtaaatcagtagttactttatgattggacaatgtttgtcaaataaaaatgaaagtgctacagtataaaaattcaaaaactttttagataaaccagacctaaataacaccagctttcctcaaaaacaaaaaaaaactaaataacaccagcaaacagatctagcttgcattacatgcacattttccgctaacagacgtactactacggtactacccccaaccaacgcatgctcaattttggaacacagtggccggcattgcatcgtagaggcaacacggacgagacgagtcgtcgtcagatgcataccttggcaggacggcagcacaggaatggcgtcgacagaacagaacaaaacagagaactggaacgaacagatgcagtagaacgcaacgcaatgcaacaggcaacagctagcagcaagctctgaaagtcgcaatggagagctcagttgagagctggtgggtgcttcccatgaccttgatcccggccatctccggtgagcagcacgagaacatggtcaccatagccagtagcttcgtctacctcgccatcttcgcatgccttgcatgggcaggcgcgtcccttctctactgggctcacccaggcggccctgcgtgggg

SEQ ID NO: 24483 - DNA, 534 bp, Sorghum bicolor
  Clone ID: 30936603
ggcccttccacccctgcagcatccatccgtcgtcgttctcgtcgatgacgaactccctgtggtagcactgctgcttcaccatctccgtcaccgcgcccaccaccgccgggtccagcggcagctgcctcagcccggcgcgccggctcctctgctgccactgcctgtaggtgtcgaatcggtccgtccggtcgtggccctcgcaggccaccacattgacgacgcaggcgcgcaggaagtctcgctccagcaccatccgctgctcgctgctccggggcagcgtgggcgtccagcatgtcgaacgccgccgagaagtagaagagcgcctcccggaaccgcgtcaggaacgagttgccgcacagcccgttgacgacgccgtgcgtgaacacggcgggcctcatcctcgcgatgccgcccaggaccatgtcccgggggctcgacctgtccaccaccaagctgtcgtcggccagcgtctccagcttgaacaggctgttcaccaccagcaccgcgccggggtccgggtcggggtcgatgcgg

SEQ ID NO: 24484 - DNA, 667 bp, Sorghum bicolor
  Clone ID: 30936639
atcggcctgtctcccccgctcgctgcgctcttcctcacgaccaaccgccgcagctcccccacgcacgtccttcctcgcagatccgtgccatcagctcgcggccgcctctctgcgagcgctgccgtcgcgcccgcctctctgcgcgcgtcacggccgcctctctgcggtcgcccttccctaccccgtgctcgcgtccgtggctcgcccttcccttccgtgtctcgcgagtccaccttcccggcggtataggcggcgcggcgtcctggtgctagaggcagcgaggcatcctagaggcagatgtggtgcaagcgtctgtacgcggtctccaaccagccaaccagcagtgatggccagccaaccagcatgcagcggccattcagggcggcgcttggtcaggctagccagcctgcggcagcacgcggccgtggctgccgcgcttccagggtgcagcccctcccgtgtgaagccgacaggatccggtctgtaagtatgggaaattcctcgatcctgcgagcggcggccgtggcaaatgtttcgcctgcgtgcttgtacacgcagttaataacagtcttaatcggtttccacagggtgagtcgatgcctacaatctactacaccatggccgctaattgcaacagaagcagtcattgttgtgcgcaatgagtctg

SEQ ID NO: 24485 - DNA, 320 bp, Sorghum bicolor
  Clone ID: 30936645
ttatgttttccatggccaaagacgtttttgaagcaagtttgaggtgaacaacattgtcagtttttttaataaaaatccaatttgtgtaaatagaaattttttgagggcttttctgtgcttttcaaatcaaaaactatataaccattttgtgtataaagaaaattcattgtcgtcctttatgctttgatattaaaatttatgcttttaactttttattaattatctaaaaataatcatgcaatcatggtttccattatttaattaatcccgagcctggttacccttccccttatttaacccataaaatcatcacccctttt

SEQ ID NO: 24486 - DNA, 655 bp, Sorghum bicolor
  unsure (1)..(655): unsure at all n locations
  Clone ID: 30936650
catgaaggtgagttcgatctcttgcatcgtacgttaacttaactgctacttgcttgctggtttgtgttctgtcatggggtagccactatcaacaaggaccctcttcatgatatgttgacagtgttttatggaagcataaatttggtatttattgcatgacatcagggataagcaaaagttggcagtaggcaacattttcgtttgtaaagtcttctgagcatgtgcttcgatagcacaacctgatgctcagattaatcataattcataagagttcagaccttggaatcaactagaatgtgcgttaggaaggacagagcattcaatcttgagccttagagtaggattgacatatcataatttcgtggttgcatggaattatctaatgtagaattgatgcttaaacccctcctcnccccaattggtagaatcacctgagagatcaagtgctctgagattgccttaatctggttagcaatgccaattgctcagatcactggttggttttcatcttagactgttagaagaacatgtaatagggtggctcaagatcagtggaacatgaggtcagtgctgtttgggttgacgtggtgccagaattcatctggtcagttgtttatcatgctctgagtgtttcagtttaacaaaaagctgccat

SEQ ID NO: 24487 - DNA, 532 bp, Sorghum bicolor
  unsure (1)..(532): unsure at all n locations
  Clone ID: 30936658
cccccagggtggctgagcggaggttcaggatttcgctgccctggcctctcagggccgcctttggtgctgctcaggcagagagcagcaatcccaacaactatgacacacctccatcttggtctggcggcaacgataatgacaatgatgcaggtggtggccctcaatctcagactggttacgatgatctngactgaggcctcaatagccattctgggaaacaaagagggcaaaggaaggaagagcaggggagatacgtgatgcaacaaaaggtcgtcgggggctgtagcctgttcacccgaatgtagagaaggcttttgcttaatttcttatggttgatactagtggatgtaaagggagaggagaatgaatgttgttgctcactctttgtctgttagggtaggagtattttatttatttcttaaccgctgcgccgtggacggaggatgaaaagagaggcccaaaaaaaaggatgatcgacattttattctgtttgttttgcagtcctattataatgtagtgagcaggacaggtg

SEQ ID NO: 24488 - DNA, 702 bp, Sorghum bicolor
  Clone ID: 30936677
actaattatgttactctgctcagcagtggcataagaagacctgaatctgttatgtactggtgcttatgctgcagagctcaatcaatatttgatttgatttcataggcttcattcctcgcaatgcaatgttttttttagcaattaaaaagtcaagcctgagtttggtgaatttcaatttgatggattttggagaagggatgttgagagaattgcaaaatgtttaagatttggagctcatgttataatgacgtcaggagcttgcaaaaacggatctaactgtttctgtgagacacttaagaagcttgagaaacactatgatattgttgccaatattcaagaagtaggaagaggaggctaccgaggccgaggagcaggctactaaggccatggaggaggaggtcagcctcttcaacctcttcgactgattgcacatcccgatagcaactaatctctggttagggtagaagaggaggtctgaactttcctaaatcagtgtgcaaaaataaagtcaaatctctctctaacttcatataaataatatgttttagattagaagatgcctgccaggttgcctcatactgtattgggaagtttcatctcagagaagtattgggaaggcgaaggggcaaccatactgtattgggaagtttgaatatgtctcgctgtgctttatgaatttgtttgatgctacacaataagatt

SEQ ID NO: 24489 - DNA, 682 bp, Sorghum bicolor
  Clone ID: 30936714
gtaattattatccaaccatggactaactaggctcaaaagattcatctcataaatttcgactaaactgtgcaattagtttttattttcgtttctatttaatactccatgcatgcgtctaaagatacgatgtgacgaggaatcttgaaaaattttggattttggtgtggaagtaaacaaggcctcagttaaatatgtctgaagagcatcagctcagcttccagcaagtgtcatatggaaaaaccttactatgacctgatctgtacgtggtcttcgacacttagtgggattggcggtatgtgtttatacattttatcttattttattcatgcctttttacagttttcctgccattaaaattcttaagacgagtggagtccacaaagccacagtgccccccttgttggctaaggtagccactacatggaggcagggcgacaaccatgtctatcagtttgagcagagtagtgctgccccctcgctggcgtggtaccagtgaactgctgcgattggagtccctagcagccacctcttcttgcttcttgtaagtattggtgttattggctagacacaaaatgtttcatcttgtaccagaagtgttagcatcaatcttgtttgggtaagaccgagaaaccaatataaaaactaagaaaccgacctgtcggtctatcctagattggtcaaa

SEQ ID NO: 24490 - DNA, 549 bp, Sorghum bicolor
  Clone ID: 30936719
cgggcttgctcgagttcttcttcagcgaggcgccgccgcggatgaggtcgcgggcgacgtcgctgtcgtgggcgtcgctggcgctcggctactacctcagctcggtgctggtgtccatcgtgaacagcgcgacggggcgcggcgatcaccggccgtggctgcagggtgctagcctgaaccactaccacctcgagaggttctactgggtcatgtgcgtgctcagcaccctcaactacctcttcttcctcgtcttggccatcaggtacaagtacagaaacgccggggtcatcaaagggtaatgccatgccagcttcatattgccattaatcgccgtggtcgcgagcaatgcaggctgggtgcaactgtttatataggtggcaagcagagatgtaggttaatttctgcaggatgtgggggggaatgggggtggtttatgaagctgtaatggatttggttgattggttcaacaagtaaatcaacaagaggtggggctcagtgaatcggatgtccatatgtttgaattaatcaggtataaagaaaaaaaaaatc

SEQ ID NO: 24491 - DNA, 176 bp, Sorghum bicolor
  Clone ID: 30936728
ttatgaattagcttacccttcatcaggtacttatttccccctatgatattccatcccttattcatcagaataatccaaaccaataagaagtcccaaaaaaagggagggagttagaagcctctgtttaaataggatggaatggatggctaatgatggagtctttttatcccctctcc

SEQ ID NO: 24492 - DNA, 605 bp, Sorghum bicolor
  Clone ID: 30936756
ttttcaaggttctgcccttcagtgttcttattgcaaaactttgccctgctggatgtgagggatcggtaatggcctttgtcatgtctgcacttgcccttgccactatcgtcagtggctatcttggagttgctcttgctgccttcatgggagtatctggagatgatttctcagcactgccagcttgcctgttgattgaggctgcgtgcacaatgctgccactatgttgctcgtctttgatcaaagagaggagagaaaaggagaagaaagaagagtagaatacatatatattatctggagatgatgtaacgctcattgttgggctttaccctcatcctttttggtctcatttcagtttcattatgtgatcatagcatggagaaacaaaataggagaagattggatttgtccagtgttaacacctctaaggcttctcaagaactatcatcaaacgagcatatatgtacatacatacatgcgtgccacgaccattcttctacagatttagtattactttatgtaactagttatgtcgttttatgtaatggtttgcctgttacatgtgttttatatggacagtttcatttgcttacactgcctcattgcca

SEQ ID NO: 24493 - DNA, 574 bp, Sorghum bicolor
  Clone ID: 30936766
atgtcagcacagaccgctttatgtgaatgtatgcacaatctatccttgcacaaaagtgttggtgtttctcttgttcgtggccacatagtttacatgttttggtggaattttgtaattcaattatgtatatagtggtgtcaacgtgtagctcaacttccggctcacctggacgctggacctaggccaagctaactatttgcatatgtgatagtttggatcatttgctagaccgatcctagctagctactaaagttagtaactcttagcacctttcaggaacattcatcttgctaaacacacctgttaatatgtggcccgtttggacctaagattattgttaagttttatttgctagctgttaacaacgtgggttagaaatatgatctatctagttgatgtatagttcgctagcttatatgtccacatatatagtggccaagttctcaacttttatttatttactctcttcatttcagattacaagacaaggttttttctaaatatagtttctttttgtaaaagaataaaattttttttttcgagaagtcgaatagtttgaattttgactaaattt

SEQ ID NO: 24494 - DNA, 613 bp, Sorghum bicolor
  Clone ID: 30936770
aggttaacttgagcggatccaccgtcaagaccactttggacttctggaacatcgctactgttagcgccaacaaacaaatcttgcccgactccaagtgcagtggtgtttgcaagaacgctgccgtcgagaccgtcactacttaccccgctacttgcactgcttcctctcaatgccaatgcgtcgccaacatcactttctgcaaggacatcgtgacttatcctactactagcctccttcacctcgaagaagttgattcattcactcagaccgcctacaactctgccgtcgatttgatgaacctcgctggtaccgtccccgactcttgcaagtctgacttgaaggtcttcttgtgcaagttctacttcccttactgcagcgctgatcagaacatcctcaagcccaccatcgatgtcttcgagtgcaaggacgccagctcttccgtcaaagacgctgctcgtgagaaccgcgctttctctgcttacaacgctgccgacggtgagaccactcaaggttcatccagcgctgcttctatcgtccctgctatcttgttggttgttgccagcttgattgtcatcaatttttaagtttatataaattacttctgcgtttattg

SEQ ID NO: 24495 - DNA, 321 bp, Sorghum bicolor
  Clone ID: 30936794
tacttttttcccggccgcctttgggcgccacaacggccggcaccaatggttgttgttgtcgtcgagagtgagggggtaaagaattcaagatccaatcaagtaaacaaaagcggcggcggtggtacgtgtccgggcggtgcaagtaaggatcgatcgagctggaggagcactgccccaacaagttttcgctggtaacccgtaaaaagctcatctctctctctctctctctctcaatttcctttagcaaaatttcagtgtgaagggggaaccaaggaaattaagaacaaagcagcaacaccaacaaaatttttctcgatggtt

SEQ ID NO: 24496 - DNA, 686 bp, Sorghum bicolor
  Clone ID: 30936804
gtggttgtcggttcggccgcggcgctcctggtcctggcactccacctttctcgacctcccgacgcgtgctcacctcccccctgcatcgtggatccgctgcaccaataatcaaattccgagcccaagtgacgggatcaagatttggatttttgaacccggacgacgggaagtggaagaggaggaggaggagccgaggaggcctaatcatggagaaggaggagaagcaagagctggagggtgctactgctgcggcggcggcggcgaggcggcggctggtgatcggggtggggttctgggtgcagggcttccggctcttcccgtggctgggcgtcaatttcttcctcaaggacggcatgggcgtcgccgcctcctcgctgcagatcctccaggcctccgccaaccttcccatggtcgccaagccgctccttggcctcctgtccgatgccgtccccatacgcggccatcgacgcctgccctacgtcgccatcggcgctctcttgcaggcaatttcatggctagcaattgcactttggcaagatatctctcttcaggttcttaccatttttctcctcttgagcaactttggtgcttccatatgtgaggttgccaatgatgccattgtggcggaggctgggaagatagtgacctcttcctcgggatcaggtcagcttcaatcgtttgcttgg

SEQ ID NO: 24497 - DNA, 664 bp, Sorghum bicolor
  Clone ID: 30936813
gtccctctcgctctccctttctcgaagcagcagcagcagcagcagcgcctctcttctcttcctcccccgtgtggccgcaagctctctcagccatggccgggcgtctgctggcgtctcggcgccgcccgcccggcggatcgaccacctcgcccgcggcctaacattaggctcggggactaatgattatcgttgtcggcaagttgttcttggctacaccgtggctcctgatcctgatgtaaggctttgtctgcggcgacatgtatacttttctccatctgatgatcgagggcaaggtcaattaaggtaatatatatcatacatattagtatttatacaacatctgttctaatcatgccaacgctttcactcgttgctctgaaatgcgctaacgaattactgttagtaagtatttattctggttaaatatttgagttattcccggccctgttacatttcgtcagctaagagttcagtgccttcttcttttcctgcgtgccttttgcgtaaagatttgcttcaatcataaatatctgtccttttttataattaaatcgaaacgtcgagcaaatatttgcgttttcttgatgaaaacgcaagtgtcagatcagcctcgccgcttaataagatgtgtcacagggagactctaacaagtcaaactggagat

SEQ ID NO: 24498 - DNA, 633 bp, Sorghum bicolor
  Clone ID: 30936819
gaaacctgtccacccattccccccctcgcctcgccgccgcggtcttgacctcccgcacccgcggccagacaccaacgcgcgtcgtccacctcgcgtcctcgcctctcaggtcccccccccccaccaaattcctcttgatccgcggaatttcccttgctaattctggtatatcctgtcgctaagccactctgctccgcctatcccctgctctcagctcacctgattggcggctccgttcggtatcttggcgtgcgcgtgcggcgtgcctgtgagggctctttcgaagcgtcggttgaggtgggcgacgcgaatcagggatgaatttcccgggaggaagcgggaggcggcagcagcaggagccggagcacctgccgccgatgacgccgctcccgctggcgcggcaggggtcggtgtactcgctcacgttcgacgagttccagagctcgctcggcagggccgccaaggacttcgggtccatgaacatggacgagctcctccgcagcatctggtccgcggaggagatacacaacgtcgcggccgccaacgcgtcggcggcggaccacgcccacgccgcgcgggcgtcgtccatccagcgccagggctcgctcaccctcccccgcacgctcagccaga

SEQ ID NO: 24499 - DNA, 617 bp, Sorghum bicolor
  Clone ID: 30936845
acatctcctcctagctagttttagccagccactccttcctcctcctcttcttcttcctcttcttcttcctccgatccctaccatgatttgagtcatctcaaggtcgctagtacacaaaccccgcgtatcctcctcccttccgtcccgcggccggggaagtagcagccacaataatccaagaaaccaagcagaaccaaaccctgcaaattcccccaattctaaattattccgatcctaagccatccgcgcgctaatataaaacaattcccaagctaggtcgtatactaactatagtcgtaacggctgcaccgccactgctcgccatccagcggcatgccataaacaaaaagtatgcagggggtcaaagtttgaagtttgaagggcagcagcagcaggagcgaggcatcgtcgatcgatcggccggctgatctaccgtacctacctaccttggcggacggacggacggctcgatctcgatcgatcgccggtcgtcggagatcgatggagttcacggctcccccgacggcggcccggtcgggcggcggcgaggagagggcggctgagcaccagcagcagcagcagcagctgggcggcggtggagaaggagcacatgttcg

SEQ ID NO: 24500 - DNA, 740 bp, Sorghum bicolor
  Clone ID: 30936847
tactggaatctttaattttctttttaattttaaaaccaaaaattcctcactctcatcacaatgaactctccctcttatggcaaactcggtgtcattggcatccgccgtgaagacaaatccaaatgggaacgtcgtactgctatcactccccaacacgtcgctcgtcttattgaacaacaccctcaccttaaattcgttgttcagccttctgacaagcgtattttccgtgacattgaatacaccaaggccggtgccactatcaacgacgacctttccgaatgttccgttatcttcggtgttaaggaagttcccattgatgaattaatggccaacagaacctatgtttacttctctcacactatcaaggctcaagactacaacatgccaatgttggaccacattcttcgtgaaaaaatccgtcttgttgattatgaaaagatcacagacgaagaaggaagaagacttgttgctttcggcaaattcgctggaaatgctggtgctctcgatttccttttcggtatcggcaagtatttcctcaatcttggcttctccactcctttccttaactgctcttatgctttcacttacaagaaccttgaaaaagcaaaggacatcatcagagattgtggtgaatctctcgctgaagaaggtatccccgcctccgctggacctttgatcttcgctattaccagttcagggatttttcatttttcttaatctctttctctaaccattcctct

SEQ ID NO: 24501 - DNA, 681 bp, Sorghum bicolor
  unsure (1)..(681): unsure at all n locations
  Clone ID: 30936849
gagcacgccgagttgccaagtccagcgcatgcatgtagaggacgacggtggcagcacccaaacctagttgtcgccctgacgattgagccattcgggaagctatctgcgcctgcatccagatctggcgtcctcgcgctgccaccgctacctactatccccgacgtggattacttgctttgtcctggaagaagaatccaattcgtccagatagttgcagtgtggaatcctgtgctatgtgcgtccgtagtttttgaagtttttagagccctatgtgcctttagctttggatccattgcaggcagccccaatctatcgtggatgtcacggatctgcaatgttctgaattttctaggatccagtgcaactcccatccatcatggatgtgcaggatctgaatttttcttgatagtaactagtatgagcaaatttgtatccnatgaaatcgttctctagctgataaatgacacttggacatcaggacttatttttagatagcttgttctactttctgtgctcattttttccttgcaaacacttgataaatatatcccatggctaaatgagttgcctgcagtgactcgatatctccnatttggtggatgtaagtttctgttggtttgcaggagcactggatgaacatgctttctgcgttctctaattggcagcacattaactgaatga

SEQ ID NO: 24502 - DNA, 499 bp, Sorghum bicolor
  Clone ID: 30936863
cctactggatccaagcgaatacaacccaaaatataaattgagggaaggagagatcggattgattccccacccgaccccaaatcccaccaagcaaaccctaatccgtcggccatgtcgtcctccccggcggcgctgggcttctactgccaccagtgcgaccgcaacgtctccatcgcccctcccgcatcccctgacgccgacgtcctctgcccccgctgcggcggcggattcgtcgaggagcttcctcccaaccctagccccccgcctccgcccccgtccgccgccttctttgcctcgccctccttcgacctccgccaccccagcgacctctccgccttcttcggccccacctcccccgagccgcttgccccaggcctcttcgacccctccaacttcctccacgaccacttcggcggcctactctccggcggtgccaccatccagatcgtcctcgagggtgggcccggcctcgccgcgcccccgggcctcaaccctgctg

SEQ ID NO: 24503 - DNA, 594 bp, Sorghum bicolor
  Clone ID: 30936875
accacgtcagtttcgccatggccacctccaccaccacgctccacccgccgctgcgcgctccccgccatctccgcccgcttccacactcgtattcctcctcgttctcccgcactcgcggccgcgctcctatacgggcctcagcggcgtccgcatccgcgccggcccagcgggaggccgccgcgggcgtcccgtggggctgcgagatcgagtccctggagagcgctgcgtcgctggagcggtggctcattgactcgggcctaccggagcaacgcttggccatccaacgtgtggacatcggcgagcgcggcctcgtcgcccttaagaacatacgcaagggagagaagctgctcttcgtgcccccttccctagtcatcaccgccgattcggagtggggccgccctgaggtgggtgaggtgatgaagaggaactccgtgccggactggccgcttatcgccacttacctcataagtgaagccagtttagagggctcatcgaggtggagcagctacatagcagcgttgccgaggcagccttactcgcttttatactggactcgtgcagagctagatgcatacttggtggcctcaccaatca

SEQ ID NO: 24504 - DNA, 675 bp, Sorghum bicolor
  Clone ID: 30936885
actataattaaaattttccaactagaaatccaacatccgacattaagatgttagaagccgcttccaactccctcccttctcccccatcgctatcctctctctcccttcgagatccgcatcggtggatctgcgccgccgacatggcaaccgcatgagggcggcgcggggttgggccgtgctgcagctgcaggtgggggctccacggcgagggtttgagttgcggcagtggtcttatccgaggtacgcaatgcgtgatttgatgatcgggtcacagaattagggggagaaccgcggctgaccgggcctccgccgtgggcgacctcgtggctaggggcgccgcccccctagccgcggctgctgttgtgctggttgggggcgcacctcccctggtcgccgctgctgccaagcgaggccacgcgggaccaccaccgagcgaggcaagaccacggcagggcatcatcctccccctgcaccctgctgccatggacgaaccaccctccacccgaggattggatcaccatccgcctaggtgtggactcatccgcctcgtgctgcccggttctggttggcagatccagcttgcaagcctatactcgcagctcagacagttactcttgaacttctatttgtgggcatagtttttgtcctgcttggccttggttgcattgcagcctt

SEQ ID NO: 24505 - DNA, 613 bp, Sorghum bicolor
  unsure (1)..(613): unsure at all n locations
  Clone ID: 30936897
tactggaaaacaacatccctcgctctctccgtctctcccaatgccggccgctccctccatcctcccgacgccacagcaggggcgatggcgcgcgggcgccagcggccctcgtcctccacctcctcttcctcttcctcttctctcccctccccttcctctctctcctgccctcccgatgcggcacggctagctcgtgcgcctggctcgacacggcgcgtcgccgcctccgtcattccctcccccactctcgcgtcctctttgatcccttcctctctctctctctcccgatgtggcggcacgacgaccacgtgaccctcagcgccggcgtcgttggctccggatgtgctccaccgaaaccctaggtgcatgtcctcgtctcttcctctctcagtctccctcttcctctcctctgcgcatgggtgcagacccagcatcagcaccccctggtgcagatgccgttggcagcttgggcacgaccggcccccggagctcgaggactctngcgcaagcagacctagagccaatgaagtcagcacatgttcgggatgcatcctatttgatttgtacaacagaactttgcctanggctgggtgcattatatctgcatttgttc

SEQ ID NO: 24506 - DNA, 666 bp, Sorghum bicolor
  Clone ID: 30936929
acagtgaactcaaccgcgaccgatctctcctgctctgctctgcctgcctccgccctcgtcttcctctgcccgtgcgcgtttccacagcacgagcacgcacggagagggcgagcagcagagcagctcggctcgcgagcaccaccatcatgggggacggcgcgcgggatgcggagcggtgggaggggtacgtggactggaggaaccggccggcgaccagggcccggcacggcggcatggtcgccgcctccttcgtgctcgatttggatgggtctgaagccgttgaggcgcacaccgcagtccgtcgtcccaaagccgggcattaaaacgcggcacgaatcacaatgcacaaatggctcgcggactttaaatttggctggccggccggtacgcatcgggaacgccacacgcacatcatgggggcgttatgtcatggtggaggtgctggagaacctggcgttcctggcgaacgcgagcaacctggtgacgtacctgatgaggttcatgcactactcgccgtcgcagtccgccaccaccgtcaccaacttcatgggcaccgcgttcctgctcgcgctcctcggcggcttcctctccgacgccttcttcaccacctacaccatctacatcctcagcgccttcatcgagttcatggggctggtgatcctgacg

SEQ ID NO: 24507 - DNA, 741 bp, Sorghum bicolor
  unsure (1)..(741): unsure at all n locations
  Clone ID: 30936947
gaaacagtattgaagcagttcccgattgctgatcctccccaactccccccgggattcgagcgacctggattggagccgccgtgtactgccgacatggcgggaacggatcgcctctaccctccgatcgagccgtacgacctggggcccccgcaggtcccagccgccgccggcgaggaggaggccggggtttgcgacgcgccggtgatgtgggacgacgaacccgacgcgtctccatccccatccccggaagcgggcccccatatatttgaggagggtgctagggatcctcctcctgaagctttcaaggaagaaaggcttggtgttgtcaattctgatgagttcagcggtgagatgaccactgtgaaggaatctggagaaaacgactatnatggttttccttcttgtgaacaaacaggcatcatatgggtgcctccttctgttccaccaatgacaaaacatgatcacgatgagtggcaaaagggctttggttacaatagtgcgggcttcctagaggaagaagataagtgggatattgacgaagaaaatttggagatgacaatgtgggatgtgctctctgagatggttgttgcagggaaggataaagtattatccattgcatcatttgatttagggacatatggcatgtccatgatctcggattttttccttgaagaggctttgaaggataaggcccaaacacttgaagatgtcagtgctggttctgaacatgctctccttgag

SEQ ID NO: 24508 - DNA, 548 bp, Sorghum bicolor
  Clone ID: 30936982
gaggaggaggagcccgcggcggccgtgcatgggctggagctggaggcgtaccggtcgacgatgcgggcgctgtacgcgtcggggccactgacgtgggagcaggaggcgctgctgacgaacctgcgcctgtcgctcaacatctccaacgaggagcatctgctccagctcaggcgcctactgtcctcgtgatcgttggcacttggcattgtcagccacccttctggtccctggccttctccgtcgtctccagcgtcgtcggccatggccatgcacgtcggcttcgccggccgagcgccgtcctgtgcggcgagcctcttgcttttactgttcttgctattacagtacatggttctccacagtctttgtctagtccaggtagaaagaatcctatgtttaccagtgtcgactccagatacggatgtatacaggggactcagagagagacgcctgcatctttgtcatgccttgtgtatccttgatatattctttgcttgtaaatgcaaacatatttacaagtttttctttgagggaccatatttacaggttct

SEQ ID NO: 24509 - DNA, 632 bp, Sorghum bicolor
  Clone ID: 30936984
gcataggacacctaggtgcatcaagattcatctccagcaggataggtttgatccaaagtccaactgaattaataagcaattacagaatgaagttagataaaagtttctttgttgaaccttagaaattagacaccttcctgttttactctttgataccgccggagcctgacaggtgtatcggagttgcaatgcagtagagactaccattgataggaatgcattgtgagaggtgggtgtccaaatgaacagcaagtggggattggtgaatgctcgttatcgatcatcaaatgctctctgtgggctagctgggggcaggcagtagggcgtgatcatgtccaacacgagatcattcatatcctcctcgtcgagtgaggtggcaggcggtgctgctggaggaggaagctttggtgctggggaggactcactgcatgggaggcgcaagaaggaggaaggggatagggagaagagcaaggcgctcgacaagggggaggaagacgtcgacaagggcaagaaagagtgagtagcatgacctagaattcttcttgagattgtaacatcgaccaaatcttgtggtatttcctttctttttttcaactacctgatagatatttccgctaatcatcaatttactt

SEQ ID NO: 24510 - DNA, 635 bp, Sorghum bicolor
  Clone ID: 30937006
gtacagccaacaaaggattagggttccattacattgatgtggaagatcatgtgggaagatttaatcactgggttggactagacaactttggtgtactgaccattgaagaaggagatattgatgaggaagaaataattgagaatctgagggatctatttgataaggagtgggcttggcgtctgaagaaatcagaggaatataagtacattgtaaggtttcctcctcacagaaaagtagagcagttggtcattggaagagcctctgtttttgatttcaacaaacctggagtagtgggttctctcagtgtctggaatggagaaattgaaccagttggcagtctagtagatgtttgggtgctcatccaaggtataccccctaaatgggtggactggcagaccatgaatcaggtggcatccagtctgggtaggatgattcagatagattggcagaccctttttgacagcttcttcagttctgtgcgagtgaagttacaatgtaaagatccatctaaaatacctaaagaaaggttgtttgtgttcaagaacaagatacatttagtcatgttcacagctgaagggtatgaacaggaggacaatacttctgatggaggttctgataaaggagatgataatagt

SEQ ID NO: 24511 - DNA, 685 bp, Sorghum bicolor
  Clone ID: 30937008
gatgcagaggatggagcaaaccggctgtgaattggattctgatacatataacttaatattgaacctttataccaactggaaatatgagaagggggtgcaacaggtatgggatgagatggagaggaatgggtcaggcccagatcaacggtcatttactattatggttcatggccttcattcccaaggcaagctcgatgaagctctgcagtactacacaacaatgaagtctagaggtatgattccagaacctaggaccaagatactggtgaaagctatgcatatgaagaaagatggggctgccactgaagatgactcaacaagtatggcagggaagcatctaaaattggatcgtcgatcaagactattcaatgttcatagatagttttgctgtcaggtcttagttctataacctgagcagaggatgctggggacataagttttatggactgaaagaaagaaaaaattcttgtctatgggtgtccatatcacaatggccgcaccttgggctaaaaagaatcatcagtaaagagtcattgacattataatttctcagaaagtcctgctcggacttacagtaccagggtatgtttttttattttagatatctgatatgaaccaattgcaagtactgttttttacatgctgtattatatgaagtacatatacggataatatgtgcaaatgt

SEQ ID NO: 24512 - DNA, 588 bp, Sorghum bicolor
  Clone ID: 30937011
cccagttacaggcagccctggaagaggacaacccccactacacaaaaacaatctagggacacaagaaatcaaggtcgaaaagctttttgctggtgatctggagaaggtgtggacatatgctggaaacctaagcgcgaggaaagatgcaggagatgcacctgagagggactgaagggtggtggaggaaggtagacaggtaccgacagtcgacagatcctgtaattgccagtagctagaattttcctgtacagaagaagcatgagtaattttttgtgcttttgtagcaagccgatcattgtgtactctgcttacaatgaatggatgttgcctgatctgaacagagaaacttgtagtttcaactgtagtttttctggattagctattagcagtgtacttgttcgtgtttatactgcaaggcagggttcagcagcaaagtgagtgaattcccgctcctgctgctgctgcttttttttgtcgcggaaggtgttggtcaacagcaaacttcggtcacagtggaatgtaagctgttgtattccgatgcctgatcttctgctggctgtcagtttttgtatatgcatttaatgaata

SEQ ID NO: 24513 - DNA, 543 bp, Sorghum bicolor
  Clone ID: 30937040
cgcaaccatatgggcaacaaccatacccgcccccgccggcagcacagtccccgtatccacctgctccttaccctggtacttatccaccaagaccctattgatatagcagcgtcagtaacgatctctggtagaggcatcaaaagcatcagataacagcattgatgctatgtgatatgcacctcagtgtggattctttactcttctagtcatttatttggttatgttcctaacaaatactaccaaccgtcactgagttgttgcacatctattacaaatcagttaaagttcagaccatcctatattgctttgcagtgggtttggcttagggaccagacccagcttccgtctgtcttggaagcacgtctgactgttctgtgaccacacaattgtacatagcaatggtaacctgtgaagtctgcttttccaaacggcaataaatttgccttcagtgaaggacaccttcttgctgaaactttgaatgtatttgtaatgtaacagtcaataaatttgtttcggtgatgaaagttgttcacgtgtggtggt

SEQ ID NO: 24514 - DNA, 648 bp, Sorghum bicolor
  Clone ID: 30937052
tgcttgtgctagaaaattatcctactcttactgtcagtgtcagtatttggtgcacatcatttacattctcatgcgttgtaggaaaccaaaacaaatgatgcagctctaggcatgcacaattaatgcactattttgaattttggcatgtgcgataagctgcattagtctgcatagttgctataaatcaaaagtcaattgtatccatgaaacatatccttaaaaatgtgaaataaatgtgcacaagttcacaattgcctcacttcttaattgaaaaaattagacaaaaaatcatcatcagaatcttctcctggagtactaaatggagggagcactccatcattaatgtaagtgtcatctgggtcttcgtcttcatcaaacaggtcatcgtgctcaggttcaggcatggctgttgcaatagcatgcttaataacagaagcatcaacagtagccccatgaaggccaaacctactccaagcggtgacatcttcattttgttgttcaacattcatatcttctactcctataacaactgagtccagatcgagctcgcccatattgtcagtgccttctgcttctggcatggcaaagagatttctaggctgcactctaaggacagtgtaccaatctggtttcttcatattcttacat

SEQ ID NO: 24515 - DNA, 676 bp, Sorghum bicolor
  Clone ID: 30937060
cgcagcatgcaagcactacatggcgggtaatgatattggctcggtagtgccagaggacgaggatgaggaagattcagaatacaaaagcggtgatgcgggagcatccagcagtagcagcactgcaccaaagccaaagccaaagccaggattgataaaggcaatccctccgaacggacgcagctcaggctcattcaatccgagcttgaaggtgctttacgaagatcttctgatggaattcaatgtgaagggtgccgacacgaggaagttcattgttgagaagttaaagaagaaccagcctgcagccacctgagaagcatggaaggctgctgcaggtagaggtagtagtaatagttcctaaggtagggacgatagagatgagtctctggaagtaagaagtaagtagtagaaacaaggaaatggcatagcttcagggaagcttttgtagatccctcgtctcggtgataattggtgcttttgtagatacctcgtctcagtgataattggtctctaggacctggaacttgcttgctcacatgaagtagagtcatgatttagggatggtattggagtggagtgctgagagattctctcacggcaccatacttcgtcaatctaaatctaatgataggtttattttggacctcataaatatatatatatataaatatatgtgtcg

SEQ ID NO: 24516 - DNA, 619 bp, Sorghum bicolor
  Clone ID: 30937066
caagttcaaaaatgttaacgaaggaaaatattttcaggcatgtttaaccaagttaaaaattgatcatataaacataatagaattgttagtgtgtcccccattaaacttgaagttctttcccccctcaccatacagcaaaaatgcaaaccacagacagtctgatgtgtttgtgaaaagtaacgaagttgctttgcattcgccaggggcatccttgcaaagacaaggcaagtacaaggaagccataaattatcactccatggtgctaaacatctccaagatgaccggagaggatgcaggtgtcactgaagcatacggagcaatagcagattgctacaccgagcttggtgagctcgagaaggcaggcaagttctatgataagtacatagcaagattggagaatgaatgagaacaacagcgctgatcggaaaaatctgtgagagcaaagacaaagataatgctaatcgtgtctctatcttttttttttttgcttgccatgtattctactgtagatgtgcagttcccagctggaactgatgtttgctatcacgactcgagtttctttttggcggaattatctaagatgtttaggtacagatcagtatcatgccgtgtacgtagt

SEQ ID NO: 24517 - DNA, 411 bp, Sorghum bicolor
  Clone ID: 30937094
gaaagaggtccaactggttgttgtagggtttgttgcatcgcttcttcctggttttcagcacaatgactaggcctcttcttgtcactgtggaaagcagtgaaatagttatggtgatataggggaaataattatatgaagcagccgaaagatttccgtttatgcaactgaatgcatctttgttgttaatattgttttgtttcatgttcaaagactttttgaaccaatcccgtcctgcttccagcaatacttgcagctcatatgtaaagagtagctgccccctaatcaaatgaactatgatttgcgtcgcagaactatgggatgctttgcccctgaatacagtatcagtccctgttgtaaaatgtttgaaccatgaaggatgagagagtttttcagtactgaatcctttgatct

SEQ ID NO: 24518 - DNA, 654 bp, Sorghum bicolor
  Clone ID: 30937150
ccatcgtctcccttcgagagatccgttcctcttcctcccctaggagcttcctctgccccccgcgatccggccagcctcgccggaaccctaaccctagcccgccatggccggctccgcgcaccccgcctcaggcgccgcgagggccgtggtgctccgcctcgacgacctatcgctgccgccgcggtacctgaccgtgccgtcccacctcccggtctccgacctcctcggctccctcccgctcccttcctcctcgtactacctcaccgccgacggccgcccgcttccgtcctccaccccggtgtcgtcgctccgcccgtcggcctccgtccagctccgcctccgcgcgctccgtggcggcggaggcgacggcggcgccacgggcgccgagtcccgcgactgctacctctccatgtacctcgccaagaagcccgacaaggcggaccccaacgaggcccgcctctcgcgcttcacctgctgcgcgctctccggggagcccctcgccgcgcccgccgtcgccgaccgcctcgggaacctctacaacaaggaggcactcgtcgaggcgctgctccacaagcgcctgcccaaggcgatgtcctacatccgggggctgcgggacatgatccccatccacctgcaccccaggccggacgccga

SEQ ID NO: 24519 - DNA, 677 bp, Sorghum bicolor
  unsure (1)..(677): unsure at all n locations
  Clone ID: 30937166
tcttccttcagttctcccttcctgccgccccgctccacctccacctccacccgcggctcccggcccgtcgccacctccccccgcagcgctcgggccgcgctcctcgaggctacgctacctgcctcgacgggccccgcgccgcacccgcccgccaactatcgctgtcgcagcaggacgagctcgccgctgccgtggactagaaggagaagaaggagaggtcgctgtcggtcgccgcccgcccgcccgcaccatcctgattcctggacctgcgccgcgtggtttcgcctcaggttgttggagtggctcgatttgtcaggacaacttgcataattgaagctttcctttgtatgatgatgatgggggcatgccgtggaccacaagtgagggggttagggtttggtatgcggtagtagctcctgcttgagcaaaagaagcaagtatcgcttagcttcttttgtcgcttgttacacggaggatctgaatcctgtcgggttggtttgggtggcgtcagctgttccgggtgggagtagtatgatgaaacagatatttgggcggcgcaagtccaaaaccgcagacnaggaattcactggcgggaggacgttcaaccagctgtcggggtctggagctgctaacctgagtggccagccgccgtttctgtcgggtactgggaacaccta

SEQ ID NO: 24520 - DNA, 563 bp, Sorghum bicolor
  Clone ID: 30937174
ctctgccccccctcaaactcctgggtgagtggcgtcccgattgcttggtaaccgcttgattaatccgtccctcctccgaggctttcacctcgcggcttaatcccaattgggttggctgcagcgcaacccaattgggggttaattgggattgctactccgcggctgcccgtccctcgtgttcttggattggcgaggcaaatcgactggtttctgcagcctcctgggtagaatcatgaagctaaaaaatagtgcagtggagacttttaaggagaacaatatgattttcacttctgaaggaaatttccactctaaaaaaatgcgagaagactatgttgctagtccaaaccaagcagatgttcagacaagatgcaaatggataattggagatgtaacggaggtcttggatcgcaacacatggaagcttggaaagatcttaaagatgctgaagaacaattactttgttatcaggcttgctgattgcatccaactgaaagagttccacatatctagcttgagaatcccacgtggtctggatgctcctcaaagcaagccttttcatgcag

SEQ ID NO: 24521 - DNA, 635 bp, Sorghum bicolor
  unsure (1)..(635): unsure at all n locations
  Clone ID: 30937176
atgctctcccgccatagcgactccgccccaacgctggctcaagccacatcaacgccacaacatggcgacgacaacggtagcgggcgcagtccacgcagaggtcaatctcgcatctggagtggaaccgacacgctgccctgtcccggctcaccctacgtcggtgcggcggtgccttagctgcgccgctgccgccaatgaagcccgccgctaccctttgcatctatgccgcacgcaggagcaggcggttcacggggaaacagcgcgagggtgcggggccatggcctgaggctgcgacgtgaccaaggggcggcagcggtgctgcgtgcccgcgggatttgcgaccggcgctcgtcagagatgaagcagccacgattggctgttgtggtcccctgctgccagctcagggccatcttcgtggacactttgtaggtcagtatctggctaacgaggtgcgacgagagctcgccgctctcaaccccatccnaggagttcagaagcataagcagagagaaaaaagcctattaatttaaagagagggcaagtgcttgtcatgttgctggagaagaacatttgcaatatattttggntattcagtttatgatggtgcgctgcaaggttcatgtacttgtcaccgc

SEQ ID NO: 24522 - DNA, 727 bp, Sorghum bicolor
  unsure (1)..(727): unsure at all n locations
  Clone ID: 30937198
cgccgtcccccgccccccacccctcgccctcgccgtcgcccagtggccagcgccgtccgcccgctcgacaactgagagtctgagaccgcacgcgccgacggcacgctgcccgagcggcggcgtggcctgctctaatctgcggaaaagcgccacgccaagtcgggaactctattcctcgaggccgccacctccgccggcacccgtgcctctggcctccatcgatttgactgtctggaagtgtgttcctctactgttcaattggccctcgccgcggcggtaccgttggtactcctgtagcgcgatgccgccgccggggctcgagtccgcgatcctcgccgccgcctgcaggttcagcaagcctctctccgctctcaggaggcttggcgtccttgcctggcactgtccaccaaccgttcgacgcaatgctgcagaggggtccgtgccttcgctgggcttgccttcaccgtttcaccaggttgtcgttcggagtggaaaccttgttgggtcaccaaggttctgccacgccactgctggcatgtcagatcatctcacagacgtctacgccagtgaagtactgaaggttctcaagtccaccagtgccgacnacgctnatctcagcgatgctcttcgtcggttcgcggtccacatggatgaggatattatcctcacggtcctccngaagcagcggtccaactggcaggtcgccctggcgttcttcaactgggcg

SEQ ID NO: 24523 - DNA, 531 bp, Sorghum bicolor
  Clone ID: 30937200
agcacggatcaaccatcaaacagctacctgaacccgcagaggcggccggcgacggcggaactgtctctgcagcagcaggcgcagggagggatgactctgaggagctctggtggaagacggtcgactccgtctacctcaacatcaagtccatctccttcttccacgaggacaagcaggagaccgccgcgtcccggtggtccagggccggcaagaggatcgccaaggtcggcaagggtctctccaaggacgacaaggcgcagaagctcgctctccagcactggctcgaagctattgacccgcgccaccggtacggccacaacctgcacctctactacgacatctggtcggccagctccagctgcgagcccttcttctactggctggatgtgggcagcggcagggacctgcaccaccacaagtgcccacggagcaagctcaactcgcagctcatcatgtacctcggaccagtggagagggcggcgtacgaggtcgtcgtggaggaaggccggctgctgtacaagcagagcggag

SEQ ID NO: 24524 - DNA, 575 bp, Sorghum bicolor
  Clone ID: 30937202
agggagctcgccctcgccctcctcctgcacctctgcagccgtgctgtgtgtgctgtgctcccatcgctttcccctcctcccatcccactcccagatgcgattccctctccaccgccacagcgcctagctaccttagcctgcccgccgccggccttcgccgccgccgccgcaatggcgagcgcgtcggaggacgaggccgcctcggaccgctgcagcgggagctacagcccaagcgccgacgtcagcgagtccgagacctccagcgactgctccgcgcccaccacccgccgcttcgcctcttcctcctcggcctccgccaccgtctcccgcctcgcgtcctcctcctcgtcgctccccaccccggcgtcggccaccgccttctacctctcctccaagccggtctccgacctctccgagatcgacatgatgaaggagcgcttcgccaagctcctgctcggcgaggacatgtccggcagcggcaagggcgtctgcaccgcgctcgccatctccaacgccatcaccaacctctccgccaccgtgttcggcgagctgtggaggctggagccgctcgcgac

SEQ ID NO: 24525 - DNA, 706 bp, Sorghum bicolor
  Clone ID: 30937264
gatcgatcgaacgccgacggccgacatggacaccgagtaccgcgccttgcagcaggggagctcctcgtcgtggtgcacggcggacgcatcgtcctggggagccgcgcagcagcagaagcgccagcgatgccaggcttcttcaagcgatcaagttggttccagctcaaatagttctctgaaaatatcagaaccacaacaaatccaagaagaagaagaagaagaagaagattattacatggaggatgattgtgatgatgatggcgatggctatgacgaagatgattatgaatttgatgaagctgactttaaccagcaccttgctgataagtttgatgatttggatcttcctccaggcgtggaggccactgtaccgtggttgcagaaaattgcacccaaggaagaagccaaggagccacctaaatcaaatactgcagatgagaatgaaaataaatatacacagttcaagcagttcgacactgttcagaatttctctgaccattactatgctaagaattcaaatggagagccaaccagagcctggtcaaagagagttcaacatgactggaaacttttggagaaggatctaccagcatatatatatgtccgggttgctgaagatagaatggatcttcttagggctgcgattattgggcccaagggaacaccctaccatgatgggcttttcttctttgatgttcacattccc

SEQ ID NO: 24526 - DNA, 621 bp, Sorghum bicolor
  Clone ID: 30937268
atcctatttcgctcatggcgcttctcctgcgcctcgctgctccgtcagcgccgccccggcggagctccggcggcagggctttgccgcgcgtcgtcctcccggaggccatttccaaacaatcatttcttcttcctttacgagttgacaacactgcaagtctgtcctgtcctattaagtgttcagcggctcggcatgccccatcactgattgatcacaccgattctaggaatggtggcatccatgcagctagtgtatatggacatgatctcatgaaatccatatctgatcttcaggaagttgtattttcttcttttagcaaagcatgtcttctcagtagttgtatcatatatggtctaccacccagttgtatagcagaaccatgtgagcaagcatactctctccctaacatgcctttgctgttcgcgatagccatggttggtgctactgttggagggctccttgcgagacagaggagaggggagcttgcacgtctaaatgatcaattacgtcagataaatgctgcactgagaagacaagccaagattgaatcttatgctcctgccttgagctatgccccagttggtagtaagataccggaatcagaagttattgttgatcctc

SEQ ID NO: 24527 - DNA, 263 bp, Sorghum bicolor
  Clone ID: 30937295
gagtagagggctgtttttggaagatgagatcgaaggtgactgttcctttgctggccatttttttgtccaagttgtaatttaccccattttttccatagtgccggataatggcgctagtatagcaagtcaaaagggaatgtcaagtttggaattgaacttttggtatgatgttgtactaaaacccatttgatatggtgcaaatgtgtagaatatcaaagctgagaattggaatacggaccatggaccattttttattattcctc

SEQ ID NO: 24528 - DNA, 647 bp, Sorghum bicolor
  Clone ID: 30937297
tgtaatacctgggttgtggactggccaggaaacgcaagggcgagggcgactccaggacctggcaaaacgcaggattgacggcttcaaggacgctgcagggctgaggtgcgacgtcctcgtcggcttcaaggacatgcgagcgagggcgaggaaaactccaagacctggcaacgcaggtcgggctcgggcgtcaggcgacggcgttgggtgagggcgagggcaacctggcaacgcaggtcagacgacagtgtcgggcgtcgggcgagggcgagggcgacctagcaacacaggtcgggcgttgggctgcggcgtcgggggtgagggcgagggtgagggcgactatctagaccaggcaacgtaggtcgggcgtcggtggcgagggcgagggcgacggcgtcaggggcgaacggcgactctccagacctggcgtcgggggcgagggcgactctccagaccttgcaacacaggtcgggcgtcggtggtcgagcgtcgggtgagggtgacgacgtcgagggggctccaggacgtcgctgattgcggtttctttccttaccgaagactacgtaggattggaaagagatgcaatttcatatcaggaatcctgtattttctacatctctgattatatattattctgtattataaat

SEQ ID NO: 24529 - DNA, 373 bp, Sorghum bicolor
  Clone ID: 30937301
cttcctgttccaaaggggttgtatgaagagctaaagagcatcccagggtttgaggaggcacatcttgagcactactatgcttatctgtgtgagaatcctccacttgcaagggcattttatgcactgcctcaacttactagcaaaattatatgggtggctaggtacatcaagaatcacaggtccgaactaatttaagtactctgatgatgtggtggtattttggtctaatcactagggatggaaaaaaagaactttgtgtaatgtgatggtttggttgtatggagggtggtagtgtgtgactctagtctgtatggaacaacctggacaggctactatggcagtatatggaatgtgattatagtagagcccgttt

SEQ ID NO: 24530 - DNA, 567 bp, Sorghum bicolor
  Clone ID: 30937307
ccggcggcagcgcatgaccacggcggcggcttggcggctgagtccaagctgcaggtgcagctcctcgccgacatgccgccgctccacaagcccctcctccgtcgacggcggcgtcgtgcagcatcatagctacaacgatcagatcgccgccgccgccgtcgctgcagagtcgacgacggtggattggaacctgctgagcagcctgctgccgcccgcgcagctcaatttccatcacacaccgccgccggaatctccgtcttcttgctccaagaacaacaatgatgcatgacaagacaacatctgatatcatctatccctcgtcagcacgactgatcgatgatgtactactgtattattattaaccactatacacacactagtaatagcgtatatttgtaggggtgtattaattcacgtacagctgagatctggaactgattgcttatttgatcaaagctagctagcacttaattagttttcatatgcattattctgatgatcgatttttatttctaaaatttgtactcacaatcaaaaaatatgaactatatattgattgatggttaa

SEQ ID NO: 24531 - DNA, 566 bp, Sorghum bicolor
  unsure (1)..(566): unsure at all n locations
  Clone ID: 30937329
caagtttttgtcagccgaaaggatggatnggaggtttggtcccgattggaagagcaccgccacaacacaggtgaattgacagagcaatcaggaataaaggaaagacccaaaagtgaaggaattgatgaaagattttataggagttgctatgtggacacagaagaggatgctaaacgcgggatgatacagatgattggaggaggtggagaccgcttgttggtgacaagagaagagacgccaggtgtggaagtgtgggagacctcccgccttgctggttctatttctctctcatagcattctcctcttgtgcacatggaatgaccgttcagtaggtctaccaagagaattgaaagtgcatgatgccattcttgttcttggctgatggcttcttacataattcggcacaacaaatatgtgttttatgtagtcttgcctcccaagatatatcatgtatcacatatcttgcttctgcatttgcatgtcatggtaaatgcatgagtatagaaagaaataatcttctttgatgtaaaactcttttcttaatatcttagcacgaaggtcttagc

SEQ ID NO: 24532 - DNA, 713 bp, Sorghum bicolor
  Clone ID: 30937331
gccagggagggcgatgttgttggggttcaccaaggaaaacttgttgtgaatggtgaggctagaaatgaagaattcattcttgagccaccttcttatgacatgaaccctgtgcaagtacccgaaaactctgtttttgtgatgggagataaccgaaacaatagctatgattcacatgtgtggggccctcttccagcaaagaacatactggggagatcaatttttcggtattggcctcctggccgaatagggggtactaccaagggttgctttaaccctgaattagattctgaaacaaaaccaggatcgcttattgatgtcaaattgacaaagtaggaaaattgataagttagttttggtggtgcctgatgtgcagtgggagcttcccactttagactattcctcttttggtagaatgtcgcagaggaatcctttgtggcatgttgctccgttagaaatcagagagtattaagacatttcgttctcatttctcattggattggaatgaatggccaaaaggcacagaaaccattttgtctcagggtttcttggccttttgccttgttgtatactagggaaacttagacgcctgacctaatcaagctggaaaaaaaatggtcccactgttgaaatctagagtttggaacatgatagatccgtgtactacatgacatgcaagtaaaatgtacatcctgtaaatggagaacattatcatc

SEQ ID NO: 24533 - DNA, 521 bp, Sorghum bicolor
  Clone ID: 30937341
ctgtgttgtgctggaaaatagagaaagcattcctctcccgattctagaagtccaaagcgggtgacagttgctctcaaagctctcatcaatctaatgagggaagcaatgagaggatggcggaaggcgagagtcaccatcaagtggatcttgaagaatgaactcatattaacaccggaagagctgatgaagttcaacaacctaaaggagagcggtttccgccatacaagcatcctcgacccaacccttgtggaccgcataggtatgagtaaagaattcaatgatattttgataccattggtttgggaggtttttggtgagtaccttaaacttggtatagaagtgctcactaaagaatttttatgcacactaaaattgactcataacatttcgcatgtgcgggcaagagtgtagctgtacttggggtcttctaactactgctctaggttgtgactttgacagtacaattgacttagacactaccatgcctaggtttaacaagagtatattttgatgattgctcc

SEQ ID NO: 24534 - DNA, 692 bp, Sorghum bicolor
  unsure (1)..(692): unsure at all n locations
  Clone ID: 30937366
gggttttcctgcttatgttcatcaaaagtgtactacatnttagatatagcaatatttaacctaaggtcttcatttccacctaatgtgtcctttgcctctgcctttacagtttccttatttattctcggctattatcttgcatatatagaaatgataccttactttaaacatagttactacttgcagcagccattgacagttagaacaattggtgtttttgtcttcctatgtgatccaacttcacaatactaactggtcttccactaaatgcaatgccccctactgttcttatgtcttgaatatgagcgcacttacttctgatgctatataatatctctgcccaatactcatggttgcgacgcttcaatatgagatcattggccacggacagctgacagcgatgagatatttggcagaatgacaccaccaggataccggccttctgagctccgagctgcttcaccaggcagatgatgatgaagcaacctcccatccccgagatatttgtagcaattcctcgatggtcattcaggataacgacaatcaaggctggaaatccgaccgcagcaacatagcccactgatcgttcctatagctacctccaagtgtatggaagaagctccaaccaatctactaataattttatgtaatatctatacattgtattatatttcagccaagtgagcaaacga

SEQ ID NO: 24535 - DNA, 453 bp, Sorghum bicolor
  Clone ID: 30937380
tcagaacccagatggcactgagcccactacccctgaccagctagcagcgactctcaccacctatttccaaaatattttctccaccaacactccaccaggcgcaaggatttctaatccctctaacaatgaagactctactctttttcaggaacagagacctcgagagatgcataatattgacagcagcgccactgaaggagatcagtcccttcacaaccaggcgagcacaacccctatgcagttcacaacctcgacaccatcaatccaagagctacatgccatcattaaggacatgagaagtaatgcatctcctggaccagatggcttgaatgcggcattttttaaatcggcatggtcctggattgcaaacgatgttcataatttggtaactaatttttactccacttgcttcatgcaacctgaaattaaccaaacttttatagttctaattcc

SEQ ID NO: 24536 - DNA, 463 bp, Sorghum bicolor
  Clone ID: 30937390
tccaaggaacttatccagcaattggagagtgtgtacacacaagatatatcaatattggatcctttcagtaaccctatcgcgaaaaaactatacgacgaatggctggggcaacctggttcagagaatgcaaagaagtatctgcacacagaatatcacccagtggtgaaaagtgtggcctcacagttacagaactggtgatagaggtttcttattgcaccgggaattcctatgttcttcaagagccaagagggactgcaaacagagcaaacatggcgacctgtccatgctaagcaaatattgaccacacaggaattaaaacatgctcaagtgtttttttggcatatagcgaagaagttttgttaagctataggttttcagctgcttctagttaatgttgtacgctgccaaagggaaacgacagctaaattgcaatgtgtaaaatgaacgaagtaggtcttgacga

SEQ ID NO: 24537 - DNA, 426 bp, Sorghum bicolor
  Clone ID: 30937400
ttagcatgtttcagagcaaaatgatgcccatgagacaggatattcgattgattggccatgaaatttgacatgactggaaaaataaaaatctagctggtccgtagatttgagcaaacgatatgaataattactttcctacaacatatatagatgatctctttgtgtacatgttcatgccctgggcattgagatatagaaggtatgactggcagtttgcttattctccttatgaatacatacgtcggtttatttccaattgtgtcaacaagggggtcattctgcttttatttttccatgggtctcattcagcttttaattttccatgaaattagcttttagcgctatgccgctagggtcatctaatatgtctttggtatctttagcatgtttttatgcatggttatgagatgaacttgtcccgatttc

SEQ ID NO: 24538 - DNA, 670 bp, Sorghum bicolor
  unsure (1)..(670): unsure at all n locations
  Clone ID: 30937412
aacattacatgggttgattccttcgtggagaagctaggcgttcctgccgtccctatcctcgccgccgccgtcgctgccgctccccggctcggatctcccctgctgctagcgctcccctctctgttctcgtctgcctggcttccggtgtcctcccctcgcctcgcctcgtttctggtttttttccctgtcttcgtcttcctcgtttcccctggatcagctccctgctcgcaatctgccctgccctgtcatcctttgtcgcattccttgtgtctcctccgttccttccggtcttggctgcttctgttctccagatcggcgggttcccctttctggaagcttcttcccccttggcgtctccttctctgttttgccgttccttttccgatccgttctggttggcttcttcctctgtgtctctcgatgcgaccccttctggtttgcatctgtggaagtcttcgcagttcttcaatggtttatcccgctcgcctccttcaatctactaaagcgcagcaccagcttgaagctccggcgctggcctcaagggcgcccaggaagccatgacgcttctatcatggaactgccggggatcgggcgggtccctgcgcagctctnagatgaaccacctcgcccgcctacttacatcaactaagtctcaggtttgcttcatctc

SEQ ID NO: 24539 - DNA, 647 bp, Sorghum bicolor
  unsure (1)..(647): unsure at all n locations
  Clone ID: 30937424
tggactacgctctctccgcaaaacaacatccgcgtctgctcttcttcctcagcacgcgtctgctcttcttcgtcccccactcaagtccacgcactgcggaccggcggagctgcgtcccgagcttgccgacgcggatctgcagacccggcatccctccgccgagcctcgtccggtctgcgctcaagaactccggcactgcggtgggacgcggctccaacgagctcaactcctcttcctatttctgccgccgccgcagccgcgatgccgacggtgagcatcggcctgcaacatgtcgtcctagatctgggagttcgaggcgctctgctctctgctcagggaggggaggacccgctcgtctccatgctccgcacccagctcggcatcatccacccgctctcggcgccccccgtcagccgctccgtcgttggcctcttcacgctcttcttctttgtcggcgccgccttcgacaagctccagcccgtcatcgacgaggtggcgcgggaggctgcgcgagccgcggccgcggtggtgcgggagcgggagacggcgccaggtgcagcaggtcaggcgtggcaggaggtgcagcccgccgctgcggcgtgtcaggcgggagctggagagcgggcggaggccgcancggaagcggg

SEQ ID NO: 24540 - DNA, 488 bp, Sorghum bicolor
  Clone ID: 30937432
ccggaaggaaagccaaagcggcggaacgcgccagacagagtagccggatagagacccacctctccctcccggagtccgtccgtcccgctcccgcaccgcctttccgccgagtaacaaggcaagaatcccgcggcgacggtcaacgattccggatggccgcagcgtcctcggtggtcaggcgtgccgccgccgcctccgcctcgcgcggcctgctcctcgcccgcgccttcgcctcgggagttggcggcggcgagaaggccaagcgggtggctggtgccggtggccgccggcacggagccgatcgaggcggcggccaccgccgacgtcctcaaccgcgccggcgcgcgggtcaccgtcgccactgccgacccgcccggggacgacggcctcgtcgtccaggccgcctacggcgtcaagttcgtcgccgacggccgcgtcgccgacctgcagggggagtccttcgacctcatcgccctgccgggaggaat

SEQ ID NO: 24541 - DNA, 670 bp, Sorghum bicolor
  Clone ID: 30937454
agcgccgtcactggaagcgaaatcccccgcgccgagccgccgatggcgtccgaatcctcaccgccgccggcggaggcgccaccgccggttccgggaaacaagctggcggtattctggcacgagggcatgctggcccacgacgccggccgcggcgtgttcgactcgggccgcgatccgggattcctggatgtgctcgaccagcacccggagaacgccgaccgcgtccgcaacatggtctccatcctccgccgcgggcccatcgcgcacttcctctcctggcactcgggccgccccccccacgcctccgagcttcgctccttccactcctcagaatgcatagaggagcttgtgcaggcgaacgccaccggagccaagaagctctgcgagggcacattcttgaacccgggctcctggggtgcggtgcttctagcggccggaaccacgctctctgctgtgaagcacatactagatgggcacgggaacctggcctacgcgttggttcggccccctggccaccacgcgcagcccggccatgcagatggttactgctttctgaacaatgccggacttgctgtgcagctggctctggattccgggcgtgcaaaggttgctgttgtggatattgatgtacactacgggaatggtactgcagagggcttctatcgcacag

SEQ ID NO: 24542 - DNA, 657 bp, Sorghum bicolor
  Clone ID: 30937460
tcgccgaccaatgttcttccgacgccccgggttggcttccctcgccggccgcggcaacttccgtgaaccttcgcgcccagtcagcaagccgccgtacgggcggccgcagcttccgggaaagctcccactcgctagatggaagggcttccggatcggcacggagacgtatggacttctgtcctgtcatactgtacttgtataagacttgccagcagttggatagcagaaaggcgtcgaagattctcggaagcgtcgccggcggcgcccggtgtcggtggagccgacggcggtctgggaggcgcaggcgcagctcgtcgtgtgcttgggattctcacgacggaaccgaccttcaggaagcgttcttgggatttcacccgtgcgaacgacggatcagatcatccatatcaagaggatgctaagagaacatcatagaaagtgaacggacctgatagaaaaaaggcgaacaggcatacagcatagtggttgcacggccttagtagcaccagtgagttcaactccctgtgggagcagattttcgaggctgggtttaagaaacaccaccgccccctgttgttccattgatgcagttgcagagatatacatggcttgcaggtgcgccctggctgatcctaaacaaatgccctctgtgagtgggga

SEQ ID NO: 24543 - DNA, 599 bp, Sorghum bicolor
  Clone ID: 30937466
aattccagtaggtcaacacgtgattgcattttgattgaattctaccatagaatgagagaagagtccttgacagcaatatcccggcacgtgaaggaacttagggaagcgcagaaggaatctacattctctgatgaaaacaacaaagcaactgcaattggaagggatattcaggaaatacacgacaaactaaaagattcttcgctgcccaaaggctttttcacagaggaacagccttggaaggatgtatatatcacagaactccttaaatgtaccaaagaggaacatctgaaggattttgaacaagaatattgtttagcagaaaagatagaacgggcattggaggacacggatattgcagttgaactttacaagctcagtgtttccaccctgcatatactgaaactagcatccaaagaggagcagggtgattatgtcggtgcatggtacagtatgcttctgtcctgtgcccaagaattgcagtgtttcaagccctgggttcttgcagatcctggaaagttgaataaaatgttgtcttgtttggacagctgcactgatgcttggactagtggtttggaaatggctcttaagatggtcattga

SEQ ID NO: 24544 - DNA, 679 bp, Sorghum bicolor
  Clone ID: 30937470
caacagtgttcaagagaaggaccgccttgttctggatgggtcgagggcatggcacctgttttctcaaagtctgcttggcaatgtgtgtggcatcttatccagaatgatcttatccatggatggggcatcgattacaagtttggatattgtgctcaggtttgataaaatgttgttcaagtaactgtggcatgccttataatttaagttaatctaaagcacaaagtattgattaagttgttcgtttgacctttctccatgcaaaaattagtgtttattttaaattatatattatgatcagtattcccaagaaaaatcatatagcactattttccatttgttcaattaatataatttttgtatggtaatctattgaaagtgatcgttttttgcccaagctgatctataaaggaatagaaacatttgtacctcccgcgcatctatcatcttttaacatagtcattctgagtttgtgacatcattgtccaagcaaactttatcttcttcttttttagtaaagacttgaaatagaagttttttttttttttcttaaactgctttcagggtgacaggacaaagaacattggcgtagttgatagtgaatttatagttcaccgaggagtgcagacattaggaggttctacaataacaaaggatggtactcgtggcaaaaatgcccagc

SEQ ID NO: 24545 - DNA, 547 bp, Sorghum bicolor
  Clone ID: 30937476
acccctcctgctccccccctccctctcggcgactcggctctccctccagcgggaaccaaccggagccgcacggactgctgctgccggcgcctggccgttctctcatggcgacgccgcctccgcaggacatggacctagagcaacatggggacaacatggcaggcaagggtggagctggacaggtctattggtccaacgcaatgtctagttttgtactcaaatatttggctaacctagttgcgagtggaactaaaaccatgagcggcttcaagcaagctcatcttaacagttgtgctagagctttgtatgagaaactaggtgtccagcgcagcggtggacaagttggtaaccatcttaggaagtggaaaaggatttatgcaaagattgagaagctgaagaacttgaatggagctgtttgggatgaacataattgcataatcggtcttgatgcagagcattacaataatcatattaaggaccaccgtgaagatgccaactacttgaacattcctattgatcactatcatgagatggcaactatatgtgg

SEQ ID NO: 24546 - DNA, 593 bp, Sorghum bicolor
  Clone ID: 30937482
acgcacgactccgagcagccgccctccgccacaatttcgccatgggcgcgccctagccccgcccttcttatccctgctcttctccgcctatggctgctgctaccgctgacgcctccgcgcagcccgtcccatggctctgttcgcgctccggctcgggccgcttctcccagccccgccccaccgccgtcggatcctgcggaaccgacgatgccagggccggatcgtcgcctccaatgccgccaaccccgtgagggacggtggcgcggccgcggtggtgtggtttaagcatgacctccgcattgacgaccacccgggcctcgccgccgccgtgtcggagccgcggcgccccgtcgtgccgctctacgtcttcgaccgacgcatcctcgccggctattcagataaaatgctgggactactgctatttgctctgaaagatcttaagatggcgttgaaatctcaagattctgatttgctcataggcctgggaaacgctgaagatgtggtgctgaaacttgtgaatgaggtcactatgcaaggtacaagcaggtctaatttttacagaagaagaagttgaatatagagtgcgtgatgtt

SEQ ID NO: 24547 - DNA, 639 bp, Sorghum bicolor
  Clone ID: 30937500
atacgcttgtgaacttgttgaagtctgaagaaaagtcgtcgcctcgtcggacagccgaacagcagctatagcagcgatgggaaccgtcggcggcggcggccggagcggcacgatgaagcagctcaacgtggggggcaagctcttctcgctggaggcaagctccctttccctctccctctccctctctctcggttccccttcccccaccccaaccttcgtggaccgcgacccagccctcctatccgccgtcctcgctgccatccgctccccgtcctccgcagcgcccgacttccccgcgcgcgtcctcctcgacgaggccagcttctacggcctccacgcccagctcctcgctgcgctatctccgccgccgctccgcggcttctcagcctccctcgcctccactctctgccccgcctccgagcccttccccaccgccctcgcgccgcaccacgacgggtcactatgcctcgcccacggcgccgggctggtcagctattactccccagcgctggatcaccacaccaccttccggacccacctccaccgcatcacctccctccggcagctgccccccagactcgccgtccttgggtccgactccgctcctgggcttcacgtgtacgactttctcgatggcga

SEQ ID NO: 24548 - DNA, 580 bp, Sorghum bicolor
  unsure (1)..(580): unsure at all n locations
  Clone ID: 30937504
tactgggtgctaccacaccgaccaaacacccacaaggccgccactagcttacgcttatcctaccttccagtcttcttccccaatcagcggctggcacggacgtcggcgagccgcgcggccggaggaccactgcctccttcataccgccggtttccgcggccatgtcatccgtccacttcttccctgcctcctcccagaccccggtccccgcccgcctcctcaaaacctccccaaagccacccctcccgtgcccccgcaccaccgctttccagagcgtcggcggcaattgcaatgcgtggcgcggcccgtacatacggctgcggcggagggtccgcaccccggcagcgccggccgacgcgccgcccgtgggccccgacggcgggagcgggggcggcggcgcggggggagggagcggaggggaggacgaggaggaggaggggggagaanaaggagaaaaggattgntgcccgagtggatgaacttgaccacggaggacgccnagacggngctggccgccgtggctatctcgctcgctttccgaaccttcgtcgccgagccgcgcttcatcccctcgctctcc

SEQ ID NO: 24549 - DNA, 748 bp, Sorghum bicolor
  unsure (1)..(748): unsure at all n locations
  Clone ID: 30937518
gggcacgtggcctcgtcgttcgtcgccaccgccggggaaatgccgccgaggaggcgagatcgccggcgaccccgcgacccgtcgccgccgtcctccgatgcaagagcaccaccctccgcctcaggcttgcgtctcacactcctcgttcccctccttctcctggtgctcgtcctcacggcccttggcttctccggcttcctctcccggtcccctccccactcccagacgctgcagactaccgcccactccgtctacgagcgcggtctcgtcaagcgcgacgtctccgcacgagagatcctcgctgagcacacaagggtttccgagaaccggtcgcagcgcaacttcccgaaccccgtcctcgcctatgtgacccactggaactccnaaggttatgtcatggcaaagttgttcagcaaaaagcttactcatgtatcaccagtgtggtacgatttgaagagtgataggaacaggctagttctggaaggagaacacaattttgatgccgaatgggtctctgaacttcaaagcaatgggtctctggtagtaccgagaattgtcttggaagcatttcctgctgttttcctattggaaaagaagcanaaagaaaaagctattgatcttatagtgagcgaatgcagggataagggctatgatggtattgtgctcgaatcctggtcaagatgggctatttatggtgtgctggatgatcaagagctacgttacatggcacttcaatttgttaagcagc

SEQ ID NO: 24550 - DNA, 112 bp, Sorghum bicolor
  Clone ID: 30937533
gcctccaggtttcaggttccacccgacggacgaggagcttgtggggtactacctcgtcaggaaggtggcctcccagaagatcgacctcgacatcatccgggaggtcgatctc

SEQ ID NO: 24551 - DNA, 561 bp, Sorghum bicolor
  Clone ID: 30937543
tggcctttttttttttttttttttttttgacgctgctgccaattcatctgactcaacttttagtcgctctgcatcttccagtgccagctggagcttgccctctgtgctttctagtgaggccttcaagttgttcacttcggtccttgcattattcaactcagcttgcaccaatgaaagcttggcctttgtttctctggcctctgtagtttgttcattcaaggctatggccaagtcatccatggccttcttgcacttctcctcagattccacagctaacttgagctcacgctgtagcgaccatgtttcaacctcgccagggtcggcaaaggagaatgacatcataccccttctcctgaaattcttcaccggctgcctacccggattagagctgtctcgtagcgaagctatctcaatcttggcctcctccagggataccttggtctgctcaagctgctttgtttgggcctccaatgacagcagcatcttcttctccgaatctcttgctgcctccagttcgccttccaggtgctgtaacatgtctgcaaggtccaagtgctcttc

SEQ ID NO: 24552 - DNA, 747 bp, Sorghum bicolor
  unsure (1)..(747): unsure at all n locations
  Clone ID: 30937549
attaaactacctacacccaccctcgtcccctcgcacccgtcgcctatctcgcgtcattctcctcgatctcgccggttgtgcaccaaggtccctgtgcattcggcggggtcctgtcgcaactaggtcccgtgcgggggcctgccaccgcatccggcaggccttcgtcgccgctgggtcccgtgtgggggctgccgctgcgcacgcccgcgttgcatcgctctttgctcctggcctcggtttgggccttccttgccttaaggccgcccgggttccgctgccctttcagctctccccgctccattgttcttcttgctcccaagggccgcaacgccgtcgatctgtgcctgttggtgtcgattcccgtctatgtgcttttgggcgaggcgctgtttccgtttggtttcctcagagaaactcacaagaagttatgtgaaagtcagaaggtccaactgctgttacggatttcccatcacacttgcacttgcggaccagctatcccaaagccctctgccgccnagcagctctttgtcaacaaggtcaaatatagatnataatacaggaacgcttaacaatgttgcttctttgttctatggtaatagaaatcagcctaaagaaaacaaaaaagctcacatactggtcaatgaattcaagcactcgctatctgtgctttccatgaatttggtaattttctcggcagatttctttgtcgttcatactattttacattttcggtaattagtttacctc

SEQ ID NO: 24553 - DNA, 519 bp, Sorghum bicolor
  Clone ID: 30937596
tcggcgccggcctcctggtccgttcgtaccagtccacctccaggaccctgaagcggcggctcatctcaaacctgctctgaaacgaccacattgtgagcacttatccggaggctgcaagacttctcctactgatgatgatgatgaaaaacacgatagtatgtagatgctgaaacattgtgcggtgtgccgaatgcacctaatttagtactcgactgctcgtagtattgtactacccttgtgcagttggtatggtgtattgttggcggcatgtgtgacagtgccatggtgatgctgccgtgctgcctcttccgacgacaacgaggcggcgcacactggcagcaagcgcctgcgttttcaggagaattacatcacgtgtggcgtgtgtgttctgttctgacttccgacggagctgccttgagacgttggcctcggccaaccgtcggagcccacaagcagagaggaatataggctcttcgtcccaaaggtttagaaatcatctaaaaaaagtactttctaaaa

SEQ ID NO: 24554 - DNA, 587 bp, Sorghum bicolor
  Clone ID: 30937606
aagcaagttgaaaagcccaagcaagtcgaacaacccaagcaagttgaaaagcccaagcaagttgaacaacctaagaaagagcttaaggaaaagaagcccgtcgagcctgttcaaaaggaacgattgcccttggatcaagctcaagaaatcatggcctcgaatgtcctgtccaagcctattgaaggccaagaaagcaagctcgacgagtctgaacagcccaaggaggttgaaaagcccgttgagaaagaagaagatctcaccgccactgacaagtactttgtgcaccacgtcgttcagcccaacattagcttcgctgacgccgtcaagatgaaccccgaggaagctgaacaaaagcgcaaacgattcgaggaacaacaggcacaaaaggaagtggcgcaagagttccaccgcgacaagcacgctattcctcaagaggtagtcttgcaagagatgaaagctgcgcccatcaagactgagaaccccttcgatattttgaaccaagctgatgctatgtctgcttaaggtgtacatttaatccgacgttaaattttgttatatagttgtaaataaaatactgaaataatcgc

SEQ ID NO: 24555 - DNA, 577 bp, Sorghum bicolor
  Clone ID: 30937608
aaagttttatccgtttacttttttttgagggtgaagctcacggacaggtcgagggcggagagggcgacgttggcagcggcgtggagcgagcggcaggacgcagcggcggagcaggcgtcgtcgaggtcgagacggcccagcacctccaccagcagcgcctcggggagcctctccgcccagtctgccgccaagccgccgctctctgtggtgctggacggctcgctgttgcagccgtctccatctctatcgccggcggtccggggcttcttctccgctattgtgtcctccatccccttcgcttctgagcctggccccgccgcctacagcggagcgcgtggactctgctggattgcgaagtgcacagatttgggtgcagggaggaggaacgggggcgagagtcacgtgatatgccgctgacacctatggccgagcacggtgtttgggtgcctggggttaaaaatcttaaaattataaaacaaattttattcattataaaacaaattttgttcattataaaacaaattttgttcaactccatgtatgtagatcatgaagtaaacaaaaaatatcataaatt

SEQ ID NO: 24556 - DNA, 575 bp, Sorghum bicolor
  Clone ID: 30937636
gctgcaggttcagaaaaggcttgagccacttaagaagaggaaggacccaagcatctttactgagcaaagcataatggctatgcataggtggctacaggacactggagcagatggttcacaagcaatgagccaatgacccaattacgataaacatacaaaggaacagtttcaaaagatgtggattttccctcatggatatatcctgttctgcatatctgcctcctttccccctttaatgtctttcggtccttaaatcttggataacatggtatgttagaaccagcttcgtagttctggtcaatgagatgtggacgcagggttcagaaattcagaagttcatgattatttagtaactcgaaaccaaaaggttgaagctggttataaaatgctatgataaatttctcttatttgcacatacagttagttttgcggtggcgtcccttagattttttggtgcaaaatgactataaatattggttgatatgcttgatcttgggtactgatgctgtggccacattacaatgactataaatacaatgtatgcatttaatattttagcgtgaccatatctaatt

SEQ ID NO: 24557 - DNA, 592 bp, Sorghum bicolor
  unsure (1)..(592): unsure at all n locations
  Clone ID: 30937638
gatgcaggacagcaagagttatcggcacaagttggcgagtccatcaccattgagcgtcagtgtgggacttctggaagcacacttgtcgctgcaatgcacataaaagaaacgaccgacacgggaccctctcgagctgtcaaagcaagcaagactatttaaaaggccaaagacacggcgtggtgtgaaatcagaccgaccggccggccggccgttgctcattgctgctgcacaatatttggaggcaggcaccagctgccactttgccactactttgtccattagctccccctttgcaactgcaaggttgcttgttggcagttagttgctcgagtggcaatgaagatcatcatcactgcaaccaatggcaggaaaaggaagatgttcaccatttcctccacttgatgtgcaaacggtagaccacacaaaatgggaaacatttgcatggttcaccacttgaggatttgactttacattcaccgtgtgattcatgcttggtcaagcactatttcactcccacttgtgatcggcaaggttgaagaaaatggaatgctgcttttttccttttaataaaanagaatttatttactagggg

SEQ ID NO: 24558 - DNA, 414 bp, Sorghum bicolor
  Clone ID: 30937643
taaggccaacttcaaagataagtttcatgaggtcaagaagaactggggtggtggtgtcatgggttccaaatcacaggtgaaaaccaagggcagggaaaagctgcttgccaaggaagctgctcagcggatgacctacgacacgccctgttaaatttttcttgtatgatcatgcgcaatcatagtgatgtgtatgtaaaaaatgctgccataggatattctcacttcgtttgctggtttgttttgcagctttacatggctgcattagtcaaatgttttgagatggacgactaggggccgacagagttttctgtaatggaaaccattttaactggcaagggaaaccatgcttgcctatatatcatttactccattcttttggacccatgtttactgcctatcaattcagactttgtc

SEQ ID NO: 24559 - DNA, 645 bp, Sorghum bicolor
  Clone ID: 30937645
ttttgattaactgtcactttaacgttggtatttaatttcacaatattgttatcttatcatgcgatccatatgtttttagtacaaaaatttagttgtcccgtagcaacgcacggacatactacctagtattaattaatatccaagagattttttaggcccattctaaggctcattcaaaaaaaaatcctgttttggcgtcccttaccgtcgagtgggtctagagcgtgacctacgcccactgccccgctccactggccaccacacacaacagtggctggctctcgctgccacttcagactccacgcaggcgcatgtgaaggtgcagccgcgcactgcaggccaccatgacggctgtcggccgccctctaactctgatctctcaagctgattttggatcaagaattgtctctagcaaggattctaaagacaggacatccctagagaaattgatttatggtggcgggtggtgttatatgctgaacgaccgaactggcaaccagagggtggtaaatgggagcattacagttttgttgtcgacttgagcaggcaaaaaattgtgtgcgctaaattacaattatccactgtttgtatctctcctctaatcaatcaatagttagctaattgatacactattacttgatagtg

SEQ ID NO: 24560 - DNA, 545 bp, Sorghum bicolor
  Clone ID: 30937665
ctcacagcccttgcagtacaacagcccgcctgagttcattgcttcacgctattggaacgcgagttgggtctctcccttcgcagcgaatgtcatgttcgtcatgtacgagtgcaatttgaacggtgacaccacacgccactacgtcaaaacactgcacaacgagcgcgaggtacttctgcctggctgtgacgacgtttactgcgagtggacccagttcgtgcagttgttctctggctacttccactgtgactttgcgggcatgtgttacgatgaaaacccgacaccactaccagtggaccctccacacgcaggtccttcatcaccgaagccaccaggcaccggtgcagcaccttttggaactcccggtcacgtgaccccacccgaggattatctttcggtcacaaccacggcagccattgccatcagtgccttcgtgctcggatttatcgtggcaggcattggtgccgtgttgttcgtgcgacgaaagatctcaacgcagcaacaatttgaaactttagttgattaatgtaataaataaattatgg

SEQ ID NO: 24561 - DNA, 457 bp, Sorghum bicolor
  Clone ID: 30937694
gataaaatcaatatgtcgttaacgttaaggcaagtggttatattggttattgttaatactaccatcgcgatcctgttcgagaagtgctgcgggttctctggcgggttccgcttgtttgacttcgcgtctatgtgcaatgcaccggtcgggttcgagagttgagctcatctcctgaaccgacacaggcatgagcatgacaggtgacgagcagacgaggtgacgaactgaatacgtgttgccatccacagtgaccggacagtcacaacttgcaagaatgttcaataccatatcgtcatcactttatggatggtatgatgcagttcattttagagggttctagcgcttttagccttttacctacccaagtttaaaatcgtgaattgaggtgctgcgtggtggggtttctcgttgtgcctatatgtgcctatgttttactcgcaaagattggtcgtgcagc

SEQ ID NO: 24562 - DNA, 540 bp, Sorghum bicolor
  Clone ID: 30937700
ctgatcaaaattttgctgatgatgaggccgaagtcgaagcagaatcagtgaaagcatgcaagaggaagagattaagtagcacttcgcactaccgtgatgaatgatcaagtaaatttgcaggatcaattagcttagcctgttgcaagaattgagatgactatcctaaacgaaggcactcagatgatgggacatgtctctcaaaatttcagctgttgtctgttggtagccaagacactttgaatccgaaggaaggtgttgaagggtagctgttagttattttgtgatatgaagagtactggagcagctagcatcggcattttagtggattaagttcttgttatgtgtatctgtttattttgcagtcttcatcagtagtgctgcttaatacctcatctctctcgtcagaaggatattaggctaggtctctctctacttggtggatatatgtattggttgatcctacgagtgtaatgttttttgctgcagcttttggggcagctagtattaaattttcaataacagtgaaatgtgcatatacat

SEQ ID NO: 24563 - DNA, 634 bp, Sorghum bicolor
  unsure (1)..(634): unsure at all n locations
  Clone ID: 30937704
aaaatgacccagctgaactgggcaacacacgtcaaatagtactatttattgaattaaatggcattaatattcaagttacatttggcattatttgccttaatattgtgttgcttgtgtcaggctgactcgaactatgactggacaaagcatctaggaaccaaaacaccttatttcccgcaacaagactaccaaaatcacaccaaaataggagcggataaggggcaatgttccgttttatatcttaattacgtgggcaggcacggctcccgttatccaacatcaggagatattgtaaaattacaacagcttaaaaaggaattatacagccatcgcgatctgctaaacaaaaccgattatctttggatggtgaactggacggatccctataaatttcaaaccgccggaaatttagataaaaacggcgagttagaacaatacggaattgcacagcgtgtacgcgaagagtataacattacagtgccgtgctgcgatactgtttatcctattcagacgacgcangttcccagagccgcacgcagcggtnatgcctttggttttggattgttcgaangcatgggcagtctcggctcctctgactacaaacattttacacgtattcgagctcgttgtctct

SEQ ID NO: 24564 - DNA, 512 bp, Sorghum bicolor
  Clone ID: 30937742
gctcttcttcctccaaccccaaaccctcgtcgctttccccacctgcggcggcggcggcggcggcacggccatggccttccggctccaggcacggccaggcttcagggaccgcagcatccagggcctagctcaccgcggaggcagggacccacaggagctggaagcgcttttcggccgcgtgctctcctacatccaccatgcgctccctaccccgcccgtctccgtcgacggtgacctctgcatcctcttcgacgccgacggtgggggtgtcgaccgcctcagccgcctccccgacaagctcctatgcgacatcgtctctcgcctccccatcaaggaagccgcgcgcacggcggtgctctcccgccgttggagccccatctggcgcgccgccccgctcgtcctcgtcgacactcacctcctcccggccggcgacgacgagatccccatcgacctcgaccacgcccactctgacgccgtgggcgccgcggtctcccgcatcctggtcgcgcacc

SEQ ID NO: 24565 - DNA, 649 bp, Sorghum bicolor
  Clone ID: 30937745
ctcactctccgacgactggtgtgagtctcacccccgctctcgctctccgacgactggtggaccgccgctgccggtgctccccgcgccaggtgccgaggccttggtcggtctattcgccggcgacgagcatccaccaggcaagcttctgctgctctgcatgcaatggtgaactaatgattattgttgataacagaaacttgctgttgggttttgttcacatattacaatgggcagtcaaagatttctacaacctgcattgcacatcttattattagagaactactcaagtggttactaacataatgtgctagccagtccatagtctaccatttctgcaacaacaccaacttctctatttgtttacatggagtgcaacagagatgaggctgctagagcgaaagctctggcagaaagaaaaatgatggacaaggattttgttggtgcaaaaaagatgattatcagggcgcagcaacttctcaaagaagtgggtgacgttgacattccaaaaatgttaactgtctgtgatgttcattgtgctgctggagctaaggtaaataatgagattgattggtatggaatactgcaagtacctgtaaatgctgatgatgcactgataaagaaacagtatcgtaagcttgcgcttttgcta

SEQ ID NO: 24566 - DNA, 616 bp, Sorghum bicolor
  Clone ID: 30937791
aaagtcaggactgaagaactgaacgagaagagggaccgaagaggacacaggagagggatccgctcaacattggagctcaatctgatgtacagatggagtactctgtgatgccccaatctctgaatgttcagagttgaaacagatggttgattctctttctctcatgtgagtgaacaacttcttagccccaaaaaaatcaattctctgaaacatgggtgacattcccgagccagaagctgccatggccgtgccggagccgtcgtccagcctcgcacttcgagtctcctgacaccatcctggacttgagcggcgccgaccgccacccaggcatcatcagcaacggcaacggcaagggcagcagcgtatccttctccctccgccgagatcgcgtggacaagagatcggaggaagccaccttcgtgtgcacggcgaccgtcagggtgtccggcagcgtgcggttcgaggtccagagcaaggacgagagaatcctcgtcgggattctggaggcgtgcgactgcgacgtggacgacagcaagggcgccggcaccaccaagagctgggtgatgaagtgccaggtgccgacgcagcgcggctcggggttcctgaggtgcggctg

SEQ ID NO: 24567 - DNA, 572 bp, Sorghum bicolor
  unsure (1)..(572): unsure at all n locations
  Clone ID: 30937799
atatataacgaagtcgtaagggatcttcttagtgcaggaagcacatcacttagactctgggatgatgcagagaagggaacatatgtagaaaaccttacagaggtgatcttgagggattcaaaccacctgaaagaacttatttctgtgtgtgaagctcaaaggaggaccggagagacatacttaaatgaaaacagctccagatcacaccaaatacttaaactggtttgcctactgcttggttgcatgtagaaaagaaaagagcttggtagattcatgttaaatagccgccgcctaattccatcacttatgatttgataaatgactctttcagactatcgaaagttctgctcgtgagttcttgggtaaggacaagtcaacaacacttgttgctagtgtgaactttgttgatttggctggaagtgaacgtgcatctcangcattatcagctggggctaggctgaaggaaggttgtcatattaatagaagtctactgaccctangaactgtgattcggaaactaagcaaggtaagaaatggacacataccataccgagattcaaagctcacacgca

SEQ ID NO: 24568 - DNA, 657 bp, Sorghum bicolor
  unsure (1)..(657): unsure at all n locations
  Clone ID: 30937817
ttttgttcttgggaccttagttgtccatctctgcacctaaaactaaaatgaaattcccttaacttgaacactttcggaagacctagatcttagttgttaagtcatcatttgttgtactgtagtcctgttctgtcttttgacactgggatatagattctaagcttcccatcacttcaaatcttttgagagacgtttttgagcctcagtattctgatactcgcttattgtctcagtgatattctgttatgatgtccagatagtgttattctgacaacttaatgactgaacattttctttgtgaacacttatgtattgttttcgtactttcgtagtaatctgaacttattggagagatcaatctgcacttatgttgtaaaaaaaaatctcgactaatttttttccccaaaaagctaattagacatttggactctttctctctgtacatacccaactgctcgcagacatgtttattcacgtctatctgagctggcaattcctctgtttgaagccatgttgtgcgctggagtctatgtttgtagcaataagatactattaaagatncaggctggaaaactgattgggagaaaaggaaatgnttttttctagtttgtgacagacttgatgcagtccctgatttgataatttgctctctttttt

SEQ ID NO: 24569 - DNA, 559 bp, Sorghum bicolor
  Clone ID: 30937841
atacccgagtgccgaggccggaactcgcgtcgctccctttctcacgctcgcgattctagcctcgcttccggtgcacgcaactcgctgccacatctgccggcgacggccccgccaccgcttgcgcttgaaaaggggtttcagtacaccgcggcggcggccggcggcggcatcggttcctgccggcttagagggagacggttgaaactccaggtcctgaggatctgcgctgctatctcatccaagacacgaccaggatttgcggtgctatctactatctcaacacggtctcgactagggcacttcagtttttaggtccggcttggtctccatccctctccattcttgatgtcatattttgtttgtgagcttgcttgggatgccaacctgcatattgtttgtgatttcctgtttccatatttttttttcatttccttgtgtagaatagcagcaggagaatgcgcttttcagtaataggcgatttagttgttttcagtaatatgcgatttagtggatttatgatctgtgatcaaaacaatgcatgcagttgtgtcgttcatag

SEQ ID NO: 24570 - DNA, 535 bp, Sorghum bicolor
  Clone ID: 30937843
gcaagtggttctggaatttcgtggctcttcccatttgtgtgttaggtgatgcttaagcgccaaaggactgcacttacgatgccacagcagacgactcgccttagatctgtgtggtgcccaccttacagttatggacaaggcgcccaaaaaatgtcagcgtccgaatcgtgctaatcgcttgtggtgtgcgccatatgagtgatttggccaggaaaaaagtgagatccatggagaatggtggcaaaaatcaggagagaacgagtgcacgggagaaagagagaggagggagggaaggacctgcgccgatgcattctgccccactgccgggagatgtttgccgcccacctgctgccgagtgagcgggagaggaacaggaagctgcagctcatccgcgctgacacattctgccccccccccaggagatgttgccgcccacctgcttccgagctgagcggccgtgccctcttccccctcaagaacggcagcagttgtcgatctaagagcactgagcaaatcagtacatctggagaggggc

SEQ ID NO: 24571 - DNA, 626 bp, Sorghum bicolor
  unsure (1)..(626): unsure at all n locations
  Clone ID: 30937847
attttcctttctccctcttctccccgccgtcgttgctgctctatcgccgcacgcactcgccaacgctcctccgcactctccaccggcgcatcatgtcggcgaagtcaagaagctctggatttctctcacgctctgtttgcttggcctttggcgtgccaatgcgctccactggagaggctcggccaccgcccagttcccacgtcgtcgccgaggtcgagtccggcggtggctgcgggagggatagactccatcagatccatgccatggagtcattcctaccttccctcgctcgaagaaccctcacgcacactcgtgatctgttgtcccgccgagcagatctggtggccgattgcagccttgatgacaacaggtgggtagtggctccatgtggcagcgcggggacagtagttctcatgctcatccagaaggaggatgaccaggccctacnatgtgccgcgcttgagaagctaccggtacaacctcatccactgtgtcattatctaggcgtctgcacagacagagctaaggcaatcggctggaaggggtaatcaacgttgacatgcttagcctcggcatgtgcggccctacgggcgttcctgcagcacattgcctttggcgttgacgaa

SEQ ID NO: 24572 - DNA, 621 bp, Sorghum bicolor
  unsure (1)..(621): unsure at all n locations
  Clone ID: 30937855
ctttttttctccaacacgagaaaacaccggcagcggctgctgcaactcatcccacgcatcctcgacgcctctcccgtagatcggactcgcgcgactcttcctctcctctcccctacggacggaccatggcagggcgccgccgctggccaccaggccaggccaggccgatggtagtccaagctcgacctttctcccccaggtgctcctgtttggtgtcatggcaaccgacggagatggaatcgccggaggcgtgctcatccgaggaggtttctcctgaatcaccggcggccgaggcgcgcccgtccgaggacgagcgctcggcggggccgtgccttccaactgggcaccggggcggtgtctcaggtgtcctctggcgcagatggctacagctgatcagcagctactcctactccactgcaccatcttgcgtctattactgatttgctaatcaattgttgtggattgattatttaatcgtctatgtgtcattgtgtgcaggtgcaggctgtgtaagtgacgcaaccgagtggtgtacagatagagatgccgattgcacatatatgtatgtaatattcaccctttaatcctgtatacnaggaaatagaacttcctgaacgcact

SEQ ID NO: 24573 - DNA, 576 bp, Sorghum bicolor
  Clone ID: 30937857
tccatctcccgtctcttccaaggtgtgcctaccctccctgacctcgcacccatggctgccctaccctacgcggctagggttttccggccaccttcccccaccccgatccaacaacgccgcaaattaaagaagccttgttactcacctccctccaggccccacatcatggaaggagcaggagagccgctgccatgcgcatatgtcagatgattgttgtaggcagtatcaccattacaaggtctgagggagtaccaacataatcttaaaggtcttggcccaactatgcatgcaaccaacattgatcaactgggcggagtagaccaagttttttctatgcagatggaacataggttggagagacatcttggggagaattctagattagtagtcgtaaagaacgttgggcatgtggccagtctagagaagtccaaagtggtgtgcaagagcatcatcagctattttcaggaaccggcttcaagtgcttcaattgggggaaaggcaccaagaccaaatgctggcaagttgaatatctcacattggtgtgtccacacgtaggccaactagctgcaggccaag

SEQ ID NO: 24574 - DNA, 509 bp, Sorghum bicolor
  Clone ID: 30937859
attcaacaattagaacaactcaaacacaaatgcaagagtcaagaagctttagtatactacgtccgattggacagagcagattgatcaacctcgctggaggtgtagtcaattttggtattaattcaagcaccaaagtcatcaagggtggtctccatctggtggatcgatctgttggtacctcagtcaatctcaccaagtctgccattggcttagtcagaaatggagtcaacttgggatgcgacctggcagtcggtgtcgtcgatgttggcaagaacttgaccacgggcgtcatcaagaatgttgaaggaaaagtcgattacgcaacagagaccactaagaagatcctgcacgtcgacctgcctcaattgatgcccgcgatgaagacgcaccctaaactccagatcgacgaagaagaaagcctcattaatcgtaatagactaaagaaggccgttaagggtcaagagaagagcgaagtcgctgatttgactcgcttggtcttgatcgccgaa

SEQ ID NO: 24575 - DNA, 560 bp, Sorghum bicolor
  Clone ID: 30937887
cacagttggtcataagtctccaatccttgtatttggcaattactacaatatgttgtttgtttgggttaccttttttccatcctttttttcccagtgcagctggggggcaactgtattagttgttgatgttttagttttcacaggtctggtattttgagaaggaatatttcctgttcttgctgttccttttttttccccgctccccaattctgtttgctttggtcttggttctcacaggattatgctgtggatgctcaatcgatgcggattacatgctcgcaggaatagagactgttcagcatcagagctgcaagtgaaccgcgtattgtgcttgctgcatcttgatttttatatcaacatgggtctcccggataatatatcttgcgagttggagtagagcactaagctaagctggggctgccttttgtttttaaatcacattttgttcttgacaaagcttattataccctttataatatgtgaaatcccttcccttccagagcgaagaaattcacctccctgctgctttcaacctttatgttaataaatataaatcgagt

SEQ ID NO: 24576 - DNA, 593 bp, Sorghum bicolor
  Clone ID: 30937893
acccgagcatccacgacgtcactgaccactacgccaacaagttccctcacctcgacgtcctcagagcgtaaatctttttgcgccattacatatgcacgcacgagaacagcacgattaaatctcaactaagaatgcttcaagaaatgaatgaacaagatgcacccatacagtttcactctctctctctctctctctctctctctctcttttttcctggtatctcgattatctttacctgagatatgatctctggcgagatcagattatttggtctgatactgatgtgtgcgatggattattgaatctatctgtgtcaggacggaggcggtggtggcaagggtgcaacctgagggggacaaattgggagagctgggattcaggtacaagtatgggatggaggagatccttgatagcagcgttgcctgcgcagcaagattgggttgtcttgacgcagccaagctcagcgtgtagaaaggatggatgtagacgaagggtgaacgtaggagcacggcactgttgtcttgttcgttggggtgttacacgttccaaaatgacagtgaatgtactagtagcaaataaactttgaatgtaat

SEQ ID NO: 24577 - DNA, 400 bp, Sorghum bicolor
  Clone ID: 30937901
ggggcaagagcaaggaccacctccaccagaagcagagtcaggagcaggcacccaaaactctggccaccaccagcaacgacgacgatgaggagaagcagcagccgccggcggcggtgcagaagcagaacacggctggcgccggcgtcgagaagcagctcaaggacttgtttgcaatggaggcatcaccactgcatcatcagtccagatgagcaaatcgatcgtctactgagctgttgagatataattgtagcagctaattagcccaagggccgagcacccaggcccagctgagatctatagatgcggtgtctcccttggcccaacttgtttccaatccaatgagcgaagaggagatcgagtggattgttcttctttatctaattaactccagtttcgcaac

SEQ ID NO: 24578 - DNA, 614 bp, Sorghum bicolor
  Clone ID: 30937903
tccaacatcaagatgacttggcacaacaccagtagggtcaacatcgcttccccctggatgatcaacgacatgagacccctctctggtcccaacacgatcaatggttatgtgatgctcaacaacaccaacttgcaaatcgaaggcaactggcagattaccccttctgccttcgttgaaggtattcaaagcggctatggcaacttgacctacctagctgcttactctggcagcactttgaccctcgctggtactttcaacaacatgttcttcttcggtaactcttctggtgttacttacctcactaccggtaccttcaacaacgtcagcgcaatcttgactgaacgttgcactggttggacctggagcagacaaaacgttactggtactgctaccttctccagtatccaaatcgcgactaatgtcaccttgatccttcgcgacggtgccttttccttcgacagcagatcaggtggtggtctcttccagttggtgaacgctatcgtgacggttgcaggtaaagccgtcttctcataaccttccctgctcgttattgcaggatgcgctcctctgcctcacttgcaatcatacataaacaagttaattatttaattaaa

SEQ ID NO: 24579 - DNA, 492 bp, Sorghum bicolor
  Clone ID: 30937915
cgatgctaccgactcattctcagaggatagaaacgttgggtggggtggttttgctaaagtttacaaggtaattataccccaaatagaatgaactaacaaaatgaatgtttgtgagcattatcttccaaataagtaatgctcaatagtctattttgacataatatagttcaagctttattattagtataaacactgcagggtgagttgcctgatggactcatgattgccatcaaaaggttgaatgaacatgcggcagtatttgatttcagcagtgaatttctacttgtgaggcttgagcataccaatctagttaggctattggggtggtgcatccatgagaaagaaagaattctggtgtatgagctcatgcacaaaggtggtctgcaccaattcatctttggtatgttttcctattttttttctcgaacaacgcaggagagctgcctgtcatttcattaagaagacggaaaaaccggtaggcactggtccaag

SEQ ID NO: 24580 - DNA, 541 bp, Sorghum bicolor
  Clone ID: 30937917
gccatttctcaagctcttgaggcccagcgatgcgcgtggggcgttgcagtgggacgacgaggacgcgtgggggtgtgctgtagcggcggaacagtgagtggagctatggttgcaggagggtgagagtgtgcggggtgagctgtagcggcatgacggcgagagctcgcagggcgagctgtagcgggtggtttgtctgacgaactgtggcgccttgtcatcagatcagccgcaccctcaccgcggccgcggccacccgctccattgaggctgccgatagcgccgtgttgaaggaacgccttgtagtagttgcagagaagcggatatgtatgcgatttgttgtctttctatcattttcttcctcgtagtagtaaactcgaatggtcctggttctgctggccactacgctgcacctgcatggccccagtagtagcagactagcagcaatgttgttcttatggagtacgtactaggctactactctagtagcacggctgtagtagtggtttttctctgaatgtcagtactggaacattaagtccaa

SEQ ID NO: 24581 - DNA, 649 bp, Sorghum bicolor
  Clone ID: 30937956
attgtgcaggcggaattctcgctgatgatcagggcctagggaagacagtgtccactattgcccttatacaaaaacaaaggaatgaacagtcaaaatttatgtctgttgattcagatcgtttgaaatctgaagcactaaaccttgatgaagatgatgagggagaacaaactcttagcaatgaacctaacaaggaccaaggtgctagttcatcatcaacagctgctggtactagtgctgaactttgtgttaatcaaccaaatagtattctgaataaaatggttgaaaccaaagcagaacgcaagaaaaaagctaaagcttccacatcatctgcatccacctcacgttccatgacaaggccagctgcaggtactctagtagtgtgccctgctagtgttcttaagcagtgggctaacgaattaactgacaaggttagcgaaagtgctaaattatctgttttagtctaccatggtggcgcaaggaccaaagatccaagtgagctagcaaaatatgatgtagttgtcactacatatacaattgtggccaatgaagtacctaaacagatggctgacgatgacgcagatcaaaagaacagtgaagaaccctctgctggcaataaaagaaagccaccagcaaatatcaaaacaaggct

SEQ ID NO: 24582 - DNA, 291 bp, Sorghum bicolor
  Clone ID: 30937958
gcccttgttcctgtaaagaagtgttttctttaaagaagctaaagccattttgaaatatgttggggaaaatagctcttgtttttttaatgtattgaagatgacaaatgtttataatgtctctgcttattatttgacttagttgtgcatgtaatagaaattcatatattgtaaaaatgcccatcttgcatcaattatcataatattagtccccatttaggtagataccaattgtagacttaaagcatgtacgttattttgggcaaaaggccaaggcccatacccgcaccctcc

SEQ ID NO: 24583 - DNA, 528 bp, Sorghum bicolor
  Clone ID: 30937978
tgagaaggattacatggctaatagtccggttcaaaaccatccaagggaattactgaccagtgcaaacagcttggaatcaatcgacaaactaagagcttctgtccctgatctggtggcaaagttcaggttcgagaacaagttggatgaaatggacaaggggaagcaatactctgatcaaaggacacgcactccaagaagtcctctgacgcctgtcaattagtcccttgagtgatgagtgaagattgtggcaaattttgggatgctcaaatgttgtaaagatggcaagatatcttgccgatctgtcacccccttaatttagcatgctcaggtgttaggatgctgcatagcaaagattctgattagggttagataaggaggagaaaccatttgttttctttttgtattatatgtaaaatcaacgtgatattctcactgttatgctttccatttctgaccaatcctgtgaggaaagtagcatgcaacgtcgaatttctttctcaaaaccatactgagaattaaaagtttgct

SEQ ID NO: 24584 - DNA, 320 bp, Sorghum bicolor
  Clone ID: 30937999
ttcatgggcagagcagaacacgcgcccaatttccccgtttttgtgggggagcaatattcatcgtgcgtggaaatacatacacacgtacgcccctgttagtagcttaatttttgtgcagtttctgatcaatacccacgttgggctcttgtttgctgcttcttgattaattcgtattatgtgatgtattctcctcatcctagcaaaaaaaattcgtccagggatgatggggggttgttgtgaatgaatgtatttggttattttttggacgggcttacaatttgtgttcgtaatgatttttccacaaggtgattggttgcttc

SEQ ID NO: 24585 - DNA, 716 bp, Sorghum bicolor
  Clone ID: 30938015
gcttaattcaatttctcctcaacggaaaatctttaatcctcacggcctccctactccgctttccccaatccaccccttgccccttccaaggagcggcgagtccgccctagaacttcgtgatttccttcaaatcactcctcggatcagagcgtcgcgggtgtcgccggggtatggcgcagacaccgaaccccagcaggaggtcgtgggtcggcccggcgcctatgccattcctcacgccgcggccggagcggcggcaccttgagatgaggtgggcggacggagtgtcccagggcgctgctcgccgtagcggcgtgggtgccattgccggcaacggtggaggcggggatggatgcgagaggaatcgggaggtgaacgttcaggtcgtgctccggtgcaggccactgagtgaggaggagcagagagtgaatgtgcagagcgccatctcttgtaatgacctgaagagggaggtcacagttctgcacagcttcttcaagcaagtagacaagacatttacctttgacaaggtatttggaccaaaatctcagcaaaggtcgatatatgaccatgctgttgcaccaatagtgactgatgtcctcgaaggctataactgcactgtcttcgcctttgggcagactggaaccggaaagacatataccatggagggagagatgagactgaaggtcagtgaactaccggatactgctggtgtcatccct

SEQ ID NO: 24586 - DNA, 601 bp, Sorghum bicolor
  Clone ID: 30938057
agcttcggcccccagccccccaacccgcattctctccgccgctcgcccgctccgcgtccggcgtcccgcgtcgccccccttccaactagcttatcgtgctcgacgagagcgaagtcgccgagaccagagtgccagtcccccctgattccccgattcgatcccaattttttctgggatttttctgttttggtacgggatctagggttttctcgtcgaattccgcctagaatttttggggtttgcttctgatcgattccgttccgggggaatttgtgcttgcgctccatggctgcggcgcggcacgggggctacaggagccacgacgtgtccaggaggcgggagcacgacctagagcgttccaggaggagcaaggagtaccgccgcccgagccgcgaccgcgactcggaacggcgccgtgatggcagcaggggccgtgaggtggacaacgggtacagccgcccccgctcgccgtatccgccaccgaggagccgaccttcgaggaggaaggacgataaggagcctggtgaggtctccagcgatagcggctcggagtctgctgggcgcccaccggtgccgaggcaggatggggttctaggggtcc

SEQ ID NO: 24587 - DNA, 562 bp, Sorghum bicolor
  Clone ID: 30938061
gcatcgtcttcctccgactcgttccccacccagctcacagcctcacacccccatacagctgcgagttcaacgcttctccttcctaatcagagcagttcccatatgcgtgcatggccagagcgagcggaagccgtcggcgtagccgccggatgcgtcgaggcggcaagatgcctggcgacggcgacgctgtaatgaaaccccatggccagggggttgtcaagcatgctggccgtgggatccgtaggcgcggcggtgatgggggcctcagacaagtcatcaacacaggcagcgccgactctgaggtcgagcacccaagcagcaccgattcggccagcgagggatggatctacgtgccgccgtcatctccctctcatctcgtcctcctcgacagccaccactcctactacactgccgtcatcgtcctcctccctccactcatacatggtaggcgctgcgccgctgcctctctgctctagatctggatggcaccgccaccctcatccagatcctccgcctgacggccgcacctatagagggggcaaggcgagcagaggaggagaga

SEQ ID NO: 24588 - DNA, 665 bp, Sorghum bicolor
  Clone ID: 30938073
aaaaaaaaactccatcgagcagggaacaaagcttgacagcaacgggaaagaacatgaagaacagcagcagtgaagtgcgggtttgcgtcaccggaggcgccgggttcatcggctcctggctcgtcaagaagctcctcgagagaggctacaccgtccacgccacgctgcggaacatcgaggacgaggagaaggccgggctgctgcggcggttggtccccgcgggcgcggcggagcggctgcggctgttccaggccgacctcttcgacgccgccaccttcgcgccggcgatcgctgggtgccggttcgtcttcctcgtcgccacgccatacgggctcgaagccgccgccgccggctccaagtacaagagcacggcggaagctgcagtggccgcggtgcgcgtgatcctccggcagtgcgaggagtccaagacggtgaagcgcgtcatccacaccgcctccatatcggccgcttcgccgctcaaggacaaggacgaggcgggcgccggcggcgctgggtacaaagatttcatcagcgaatcttgctggacgccgctcgacgttgactaccatcttcgcagcgcacacttcgataagtacattctggcgaagctgcagtcagagcaggagctcctgcgctacaacgacggcgagagcccggcgttcgag

SEQ ID NO: 24589 - DNA, 718 bp, Sorghum bicolor
  Clone ID: 30938083
gcctactgagaactaattatcaattgaataacacagcggagtaattatcccttactaccgttctatctctagcatattagcaaagcattaatttggctcttcgatacccgccctttgtattataaaaccaactacatcgaagatgcgcaccgctttactctttattgcagctttatgccttgttgctagaatcagtggccaagttgccactacatacggcagtggtatcccgaaccctaatctttcaatgagtatttggaaatttacgggctataattcaaacatggtcgagcccagaaattgggaatgcatgtccagagacgacttcggccaaattgcatgcactggtcccatgccctggaactacaccgacgagaccgttgaccatattagaacctggtactgcggttgggactatgccaacattaccgtccaaaacaacaacaactacgtctggcccggattgagtgtctacatcggcacctataaccctgctgactcatgcttcatgcttgccgttgaaggagactcctccctttcgatctacaacggtggaatgtacttcttcatgacctctgactacaaggcttcaaactgcttcagcacccagacatccaccttcgagattcgtaacgttctcacgattccgttcaaccctaagtcgttcacgacgcttacttgtcctggtaccgtcatcatgaagacctactccggcatt

SEQ ID NO: 24590 - DNA, 600 bp, Sorghum bicolor
  Clone ID: 30938106
atatacgtctgccggtactctgaatgtaccatctacatacctggagcagcagaaacattctaccacctttgtcctcagcatatcacaattgggctctctttgaggtgttgcaccgagtgcacactgcacagccatgaggaaggagatcatcattcgaatgcagccagattcggacaaaggccgtgccaaggctctgaaggtggcagcttcagtgagcggggtcgagtcggtgacggtggccggcgagagcagggacatgctgctgctgatcggcgacggcgtggacgcgggcaagctgacgaggaagctgaagaaggaggtcggggaggccgacatcctggagctgcggactctgccggccacgggcagtaccagcagcgcgctggcaccgggcagcagtaccgtcgtcacgcagtccgcgtaccagcggcacgccgccactcccggccggagcgtgcccggaggcagccgcatcgagtgcccgttcgccgccgccgccgccgcgcagtggccgggcgagcacggcaggcagcaggcggtcggctactaccaccgccggaccccgggcccgggatactaccaccagcagtcgtcgccgat

SEQ ID NO: 24591 - DNA, 624 bp, Sorghum bicolor
  Clone ID: 30938136
gactcagtatatttgaggatatggaggatgatgctgaaggtactggacaggtgcaacagtcacaggctcacagctttagtctggattggtttcactttcaattgtggcctacacaatatgcacttggaaagaagatccacttcaagcttcttgtcaagcactcaaaatgcaagaattttaagtggcattgaattcgacatggcagcatcaatgtttctgcgagtacaactgatgaagcatacattttctttaactccgtaatcttttctttaactccataattgtggttatgggaccccggtggatttcttcctagcttacaagccatggtgccctagttttggtggattgttgtggtcaagtggcaatgcacattaattggtttaacatctccacctgtgctgagttggtgttctagatacccgtgcaagtagcaaccattctgatttctgagcaataccaagtactgaatggattaccactgaccaaagatgatgtcttccagatatcattcaacatcaatgagaacatgttccatggcggtggttcactacagcaacggcttagtgacaagccgtgtttcatggggggatgaatgtcaggaactctcaatatagctttcaa

SEQ ID NO: 24592 - DNA, 699 bp, Sorghum bicolor
  Clone ID: 30938144
atcccccgaccgcaacgccgccggtctccctccctcgctccatccctcgaggcccctcgttctcctccccggccccggatcctcggccgcgccgccgctcctctccctgggccatccagcggagcggagatccgtccgtcgggggcgcggattcggtcccttcccttctcggcggttactcccacagtgagggtaacttgaataactgtgagatgtgtggtgtgctgtctctttagcttggtgatcatctgaaaaaaaaaggaagtactgtttaaatcaaaccattggttcatgaatggtttagtcatgctaaggaaaacgaagtcctgataacacatacggtgcatgtgctagcttcaatatgattgaaaacggtggcattattgacctgagttcggatagtgatgatgactcgatttttggtgatgaccaccagccagcatctgcaatcacaaggtttgatcaaaatgctgaaggacgtataatcaattttgaggatgaagattggcagaggagcgctcctggtccgtcatcggctaggcctgttgagaacaacaatggtcaatacaggattcttccagcatcccttacaaatggtagaaatgctgagactactcgctatacatttggttcaggggacaggattcatccccatccaatgcgacagggcctttctacttccagtagaattgatagcag

SEQ ID NO: 24593 - DNA, 732 bp, Sorghum bicolor
  Clone ID: 30938162
aagccttcttccccttcctctcgaatcctgctccgcctccgccatctcgcttagttgcctcgctgtcgacggctgccgctctccgtcgccatcccctgctcagcggctgcaacctccttgcctccttgcggtgccctttgaactgctttcggtcgcggtgcaggttggtcttcccgccggcgccctttccgttcttcctgtcgtcgcgcggcggcgccatagcagcgagcgcaagtgcagctccgtgcgcctagcactcccgtgggctctaccgcgggcagcagtaggtacgcagcaaggacgcccagtgcgccccggccctgccctcggggtcagcagcgccgccgccgtcgtcggggtccggctcgtcctgggcttggcggcgagcggttgtgtctgcgccgcctgtgccgcggccgtgctgggtggggaggagccgctgccgtgctgggcggggaggagcagcggacgagcggccgcctgtgctcgctcgcgtgaccgccggtgcttttcttggcctgttgctcgcttccccgcgcctcgctcccaagtcccaatcttcaatcagcccggggtcaacccagggtcgcacgctcgcttgcctgcccggcgtttccctcgacgctcgctcggtcgcaggcttgcccctcgctcgcttaccaccgtcggcgacgtgaacaacccttgccctcgcgcgtcacacgcctccacgcgcgagcgacggtccgcatc

SEQ ID NO: 24594 - DNA, 522 bp, Sorghum bicolor
  Clone ID: 30938222
ccccgccgccgccgacacggacgagaaggagaaggagcagacggcgcactacgggcggagccggtcggagccggcgcgggagcagggcaagaagaagaagcaggaggcgaagatgagcaagtcgagctcgagcggcgtcgtggaggaggaggcggcggccgcggagacggagcagtgcgtggacgcgcgcgcggacgacttcatcaacaagttcaggcagcagttgcagctgcagcggctcaactcgctgctcaattacaaggagatgctcaaccgcggtggcggcggcgccggcaagcagtagcctagtgttgccgcatgatcagtcatctgtccgtgcacggcagagaagggttgcatgcaggaattggctagctagatagtaggatccaaattccaaaacctactaaaaaatcaaactttggtcaactactagagtgtgggttatacagtgctgttcttttttggactggaactaattagtacatgtaagaattgctagtttttcatcttgttgaaaaa

SEQ ID NO: 24595 - DNA, 506 bp, Sorghum bicolor
  Clone ID: 30938226
atttagattacactttttttttctgagatcatgactcttttctttcctgtaacctggccggatcggatagagagattggggaaggaaaaccccctgtaagagtgacagagaatcagataagccccatgaacggggaagaaaaaagagcagtagtagttaaaagcaacatgttaaagacagtgtaacttgttacgctgaacaactcgtcgagtttatttgaaacgagaggtggactgaaaaaatgtaacactcagcaccaacacaggtgccgcatcaacagagatttagctggctggtgtacatgaaagcaggatccagagcatgtaggctggagacttggagttctgtatggggattggacatagagtgccaggggggtggggggggggggatcccttgtcctaaaaaaaagatggtaaagcaaaatagcaacgatacacaagttgaaagagaaggtaaatgctcaagatatttagagtcaaaagggtacaaaatatgcaggcttc

SEQ ID NO: 24596 - DNA, 488 bp, Sorghum bicolor
  Clone ID: 30938237
cggcggcgccgtcgccaggatggacgacgagctggtgcggtccgcggtcgactacctcgagctcgccgacgaggtggacagccggccgctgaggggcagcatgccggagacggagctccgggtcatcagctggcttgggatgcccgcgtatgaggcggatttcggcggcgggagtccgcaggtgatgtcacgggccgagtccgtccgcggcgggtttgtgtacgtcatgaacgacgggaggcctgcagacagcagcggcgtccgcgtggtcatgtgcaccaaggctgcggacatgaaggagttcgaacggctgctttatgcaaacattgcaaagccatcaaagctctagaaagctttgttaatttgttcatcaagaaggggtgctgcaggtatggttgatggtttcgattacaatagtgatctccgttgtcttctgcataaggcttgcatgtatctatatctattattatattaattccgttaaaaga

SEQ ID NO: 24597 - DNA, 620 bp, Sorghum bicolor
  Clone ID: 30938263
gcaatgaggactgatagtgcattgaagtttggattgttcttcttgctttacttgttccacattcttttctgcgtattttctgctgtggctcctcctgttgtatttgagggaaaatcattagcgggaattttgccagcgattgatcttatcagcgtgaatgctttggttgggatattctactttgttggatttggattgttctgtctggaatcgttgctcagcatctgggtcatccagcaagtgtacatgtacttccgtggaagtggaaaggctgcagagatgaagcgtgatgcgacaaggggtgcaatgagagccgcattttaagtgcggtgtggtatttttgtgatgataatcctagtcccagcgcatacaatacttccggtggacaggttgtgccacaaacaaaagcatgtctcttccttggttgctgactataataccaaactgccagtaggttatcgtgatgttacaagtgacatcactcgccgtcctgttttaactaatatagagaatgtgcagcttttacagctttattacttaatcgttttcttcttgctagttgaaacgcggagtggattatgaattatctttaattaagttgtacagtgctgttaagtatt

SEQ ID NO: 24598 - DNA, 660 bp, Sorghum bicolor
  Clone ID: 30938264
gaagacactggagaacacaacctaggatcatggtatgctcttgtgctgattgccatgtacaatgtgtgggacctgatcgggaggtacgtgccgctgatcacgtgcttgaagctgacctcccggaagggcatgatggtggctgtcttggcgcggttcctgttcatcccggccttgtacttcacggccaaatacggcgaccaggggtacatgatcttcctaacctccctcctggggctcaccaacgggtacctcaccgtgtgtgtgctcatggaggcgcccaacggctacaatggccccgagcagaacgcgctgggcaacgtgctcgtcgtctgcctcctcggcggcctcttctcaggcgtcgtgctcgactggctctggctcattggcaagggctggtgaagtacgtcttctgcgcgtgggtcctgtgcaggatcgattaggttttagatcactgtttcccccctcttgtttttccttaaaaaaaaggaaatttcttctgttctttaggtagttatactagtcagtgagagaacacggatactgtaatctggctacatctgaaattctcttattctctttcagatgcaatcactccctttctgttccaacttttgaatgttgtatagtattctggaatgaaatattattggagttcggaaa

SEQ ID NO: 24599 - DNA, 531 bp, Sorghum bicolor
  Clone ID: 30938350
acctctagttagtagttacttgtcatggagccatgcaactttacatactgcataacaagcaaataatctacttcatagacacatgagatgggatacatcatacaatttaaagcttgtacaactgtgtggtctgtgtggtgaagttgaagtacttcagcatagtgtcagcttgtcaggcacacttcttgttgtatttttgactttgcacacaaagaacaaccaagcgtacttcaggaaggctggtggtagagaaggagcaatatatttcgtttcttaggaaggggggctgtgctttaagcagctggcagcattttttgctgaacagctactacgcatgtggaccttgcaggtatatggcatttcagggcaagtagctagtttacagagcaaaacatagagttaatttcctagtaagcttgctcatcagtatgatagaacaaatgactaattttggatagttcgcttaatttgcaccataacttggccgcatactttcatgatttcatatgaaaacttgtctttattttggtc

SEQ ID NO: 24600 - DNA, 543 bp, Sorghum bicolor
  Clone ID: 30938422
gcaccagacgccaatccccaccaccaccaccgcctcccaagtcccagcctcccctccgtcctctaccccaagcccgtctcgtctctgttcccgtgcactcagactcagcggcggcgagatggacagcgccgacgcggcgacgccggcgacgctcgggcgtgggcgtggatccggggatacttcacgccggccacgctcttcctcgtcgtcaacctcgttatcggcaccatcgcgctcacctcccgcgccacccagcagcgccgccgcagggagcactactaccacgacgacgcccacggccgcggccaccacctccaagaggaaccgctgcacccgcagatggagcagccggggtacggacactactaccacccggagcagacgctgtacgcggcgccgcctccgcccgcgccgctcgcgcgcacgtcctctgttcttgaccggctcaggtcgctcggcctctaccgcttccgctccggcgagttcccgcccgagtacgcgcaggatgtgtccgctccggtgggggaggaagagacgaccgcg

SEQ ID NO: 24601 - DNA, 647 bp, Sorghum bicolor
  Clone ID: 30938426
aaccttattaggctaacactagcagggccaaattagggacaatggcatcgcatcaggacaagctgtctgaacagtacagactactccatcgggtagccaaagataggccaaattttcgagctcttttctgtaggcaggtgcagaaagataggcagctgcaggttagcaggtagcatgaactacgggaaatcgggttgcggataaccctcacagcatcggttgagacaatggctgagcaaatccaagggttggagtggctggctgatgatgcccatctcctcagccgccagcaggggagtcccttcccctcctctcctctccagccacaaggataaataggagactcatctccttggtacaacaagagagaacagacagatcacagttccgttgcaaagtaggaatccccatctcgtaacttcgcgcgcacggaggagcgagagggcaggtgcctccggagcccttgccgttcgagaccttgcacgggggatcggcaattaggtttttggggagcgtctacgcgactgcccaactccattgctgctgaacatctccttcccggaggtctcttggtgttgccgatcgccgtcttctccttcccggtgatgggttcgtcgtcttcaccttcgtctctactccatggcgat

SEQ ID NO: 24602 - DNA, 501 bp, Sorghum bicolor
  Clone ID: 30938436
gacaagttgaagtgctggagtcatgcttcgtcgcgccgagagaggcaacgccgacgaaggggctccggctctctcccttcgacctcgcgctggccaacagaggccacactcctcttgtctacgtctaccgttccggcgccgcctttttcgacgtggtcaggctcaaatcggcgatggccaaggccttggtagccttctacccactcgccggccgccttggcgccggcgatgatggcagggtacagatatactgcaacggcgagggccctctctttgttgtcgctcgctcttttgtcacagctaacagcatcaacttctccaaaccgtcgccggagctgaggaggatgtttgttcctcgcattgagccgccgtccctgatcctggcagtgcaggtgactttcctgaagtgtggagcggtggcgttaggagtggccgtgcaccacgccgccgtggacgccatgagcttattccacttcatgcagacatggtcggccatcacca

SEQ ID NO: 24603 - DNA, 483 bp, Sorghum bicolor
  Clone ID: 30938458
agatcccaaattgatgctgaattggttcgtatggcaactatgaccgccgaggcagctgcggctgctgctgctcatgcagttgcagaggcagaggctatcatggcagaagctgaagcagctgctagggaagcagaggctgcagaagcagaggcccgagctgcacaggccttcgctgaagcagcagttttgacactgaagaacagaaatgctgcgaaattgatggcccaagcttgatggtacccagaactgtcgcggtccagcattgctgcagggcaggccacctatgcatgtaggcatgtagctcatgtcaaactgttgttcaggtaaacacagctgtccctgtagccgtgtaaagttgtgttattggatccatctgggttccaacacaccaacagcgatgccaggcagcttggctctgtattcccccattgggacaccattttcagaactcggtgccgtgggtaaactcaacatcaacatgcc

SEQ ID NO: 24604 - DNA, 601 bp, Sorghum bicolor
  Clone ID: 30938460
tttatattaattcggttctagcttctattcctatttactacatgtcaaccattcttttttcaaaggcattcatttccaaaattactactataattcggaacttttggtgggccggtgcccaagaggacaattctacttctcctttccatttcagatcttggagcgatatttgcaagccaaagaaagagggcggtttaggaataagagatttattgatagtcaatcgtagtctcattcttcatgctgcatggaatgttgcgacaggtaaaaatccttttctctcgaatatcctcaaagctaaatattttcccaatgaatttgcaacattgctacagtatccaaaaaccaaaaattttgtgaactaaacaaggcttaagtctttgtgaggaggagggagaaaaacagcttcatccatgaagttactttgaaaataagtgtttgacaaataaaacagctcatgaatgtgagctgtaccaaacaggcccatttatagtggcttctgaagaagatcctgtttaaattcatatgagtagaggacaagggatttatccttctcacttgtaccgcaatataccgtaaaatggaagggcacatattcagc

SEQ ID NO: 24605 - DNA, 685 bp, Sorghum bicolor
  Clone ID: 30938462
acccgaagaaaagttggagctgactaaagaggaccgtctcccgatgagtaaagaaatgataatttttcttgaacgtaatggctttgctgttaaaccacaaatggttaatgaccgaactattgagatggcttacgccctatgtgagaataaacatgctaaatccttgcaagatatggaagatattagtggcgtcatgaagaaggtatcagacattaactttgatgactgggactctttaaaacgtgtgtttgttgtcaagatcataatatgttaccctgaagaaacagaaaactctaagatgttttcagataatgagctatcaaaattgctgtctatagcgcctagtctggagggtaagctctttattaagaatacttgcatggaaatctacgaagacattgtattcgctcgtgcagttagggtaaagagtgttgaagactgaagtccttggtcaagcaaggaagtacaattcagtagctagctgacctgacctgaagcggcgaagcgcactaggtgattatttgtgtacattgattacgaatctctgtgctaaacgagatccgaggaaattgactagccgatccatggatgaattgaagctttgtcatcctttcttattttgctgcgtcgtcgttaggagtacttagatcaatttaatatacatatatctatcaactcctacgaa

SEQ ID NO: 24606 - DNA, 577 bp, Sorghum bicolor
  Clone ID: 30938468
gatgattttcggggcacggcagttggtcatgaccttcactacatcgcttgggactaccctccaaagcagcatccattgatcctctccatgaaggacttcaacaagatggtcaagagcggcgcgccatttgcacggaagtttcccaaggatgacaaggtcctggacaagatagaccgcgagcttttgcatcgctcagagggccggttcaccccgggagcatggtgtgatgggagctctgaaggaggggctgatccatgtttgtctaggggtgaagactctgttttcgagcctggtcctggtgctgaaaggctgcgaggcctgatgaagaaggtgctctcatgggattaccgcaatggtagctgttcctcacttgcttatgatcagacaaagagggattggtatgttcctaaaagtaaaggatagttctgtgtcttgctatgctttcttgtaaatgcagctcttgaccccttccatggaaatgaacaatactgaggaacacaacctgttgaccaagaaaaataggtgtagtactattcttgcatgtgaaataagataaaagcagttatctgacggaaaa

SEQ ID NO: 24607 - DNA, 643 bp, Sorghum bicolor
  Clone ID: 30938470
gcgtccgcacgagttccactaccggcggacgcagtctgccatggacgtgccggaccggcacacgctgcggctgccggagcacgtcatgaaggagctcgccgcggtccgcaggcaccggcgggccgccagcctcgctgggtaccccgacggcggcgcggagcggacgcccggatggctggcatcgttctggcggtccgtttcatggcagcggccgagccggacggatcaggacgccgtcgacgagcacggcggcagcaacagcaaacgcgtcgtcccgatcactggaacaccggcagaaaatcccagcgggtcaggggctgctgctacggacggcaaggagaaacctgaccatgacgcgttaaaccaggtctgatcgatttacattttaccttcgcgtgcatgcaaggacgatgatcgttgatcgcaggtgctgcgtgcctccgtcctggaaaaattctagccttattgcgtgtcgaatttcataaatgctttactagaattccattcttttccgaaggaagagagaggcagctgcaccgttgctattggaatcgatcagcatgtcggatgctttcatcttggtactattgtacataataattttttgatctgcatatgaatgcaccccaaaaaagtttaagat

SEQ ID NO: 24608 - DNA, 585 bp, Sorghum bicolor
  Clone ID: 30938474
gacgaagacgaacgcaagtgtatataggaggaaacgagacgagtgagttcctgggcccgagggattctttggtgggctagctattgatgggccttcgcgagcctatttccaccgcggcctgggtagcatcgacgcctggtaccgaagagcgcgcggcgtgcttgcgcggagcgcgcttctagtttagtcccacctcggcggctttggctgagcggagccagaagaaggctataaaagaagaccctgggcaccagaccaactcatacctttctcggccttttggctaagatcaagtgtagtatctgttcttatcagtttgatatctgatatgtgggctatgtgtccactttgatattaaatttatttttcgtgggggagggcccgtcacagtagcttgctgctggggtcctcacgtgtcgctcgggcgttgcactgctgcccgagcctggcgcaccccaaccaaatcgaattggaattttgatcgtaggccttctctctttaccaaattggcaaaatttcctctatcctggttgttttttatactcttatatattttgaagtctattataatttatagtctaaaaa

SEQ ID NO: 24609 - DNA, 571 bp, Sorghum bicolor
  Clone ID: 30938486
tttagccactcatatcaaataatgagaagtctccagaagaactttagtgatccacaagaagggtgggaactatatgacacaatgttcgtctggaatgagttcctaactcgagggattcgtgacattctgaaaactacactttggactgttgcattagtctatggcttttttaagcaggataaacttgcgatatgtgggaaggatattatgctgacgctcattgctagacgctcgaggcattatgctggcaccaggtatctaaagaggggcgtgaatgaggagggcagagtagcaaatgatgttgagactgagcaaattgtttatgaagacatgcttggaccatggcaaataagctctgttgtgcagaacaggggttcaattccgctattctggtcccaggagacatcgaagctgaatcttaagcctgatatcatatgtaagcattggagtcattcaatgcgcaaaatactatttgaacatctgaagtttttttcttgcagtgcatgaataggataaaaaaatatgtaagcattggaatccttattcaatgcgtaaaatactattcaaacgt

SEQ ID NO: 24610 - DNA, 589 bp, Sorghum bicolor
  Clone ID: 30938488
tgcaagcgacgtttgtgctccgtccgtcgtacagtgccggtgcaaagttcgcgccaaaaaaaaaaaaaaaaagctgccgattcgtcccctgatcccctcccatggcatggcaaagccgcggcgaccgctagcggcttgcgacatgtgacgcccggcgagccacgacagcggcgcgcgtgaaccacagcgctgtcaggttttggaagcgacctctgcgtgagaggcccgtgtcgcgtggcgtgggggttagtaggacgtggggcgacagttttttgacccccggttttggttttggccgttcggacgtccggcgcggccggatcgcgcgctggatgtttctcggctcgccgctccacgccgatgcgaatccagcagagaggcaaagctgtcagccgagtcttttggcttgtcctctgctccctctgaaatgttcagttcaggagcgatggattacactaagagcaggtacaataatgggtttatagccaagctaatgctgatgtggaggagagaagagaagagagagatgatagcttggctcttagttaagcaccaagctgggcacggatgcataggtagtagtggaccc

SEQ ID NO: 24611 - DNA, 719 bp, Sorghum bicolor
  Clone ID: 30938506
aatagaagaacattgccttttttttctttattttattcttcagaagaatgacatcttttagtagaattagtggtccatactaccccacatagtggtacagaaagaggataaataatggtatgataaaatgaaaacagatagctgtgtaaatcactgctgagtaaaaaaaaatgaacacctttatgctggcttcatcattgctgttttaatgtattgcagcaagacctggattcactgaagagatcaggaggcgtgtattggatcctgttccactgacagagaggggtagactccctgatggatttgttccggaggatcctgactcccattatgtctatgtctgcaaaaagatgcaaggattaacagggacaggttccccaactgtaaaccacatagagagtcaaggtgaagaataaactgtaggctgattcacccccacaagatttgtggattgttatgatttatatacaagatcagatgacgcgatgttgccaccattgttatggccatccaaatgtgggaagcgtgccattgcatgcatgtatatttttactgatcttgtaagctgtacgaatccgggagtcaaagccaatgtatcgtgcaacagctgtcttcttttgttttcttttctgtatcatcttggaaagcaaaactgaattgtttggtgcactcgaggaagagaatttttttatggaagaaaggaattggcgtggaactga

SEQ ID NO: 24612 - DNA, 459 bp, Sorghum bicolor
  Clone ID: 30938551
agtaatggaatgctatggcaagagatgggaaaaccagatggagcaaaagctatatggagcaggcctcttcttaaatccaggaaagtactttgccataaaggaaaaggatatgagacaagctagaaagctaaggtgcatgttcaatgacattgtatggaagatggtgccagatgagagtgaagcgaggaaaataagcaaacaagctgatgattatgacagggctgggggtgaatctttctcaaagaggttagcaataatagagaggaataaaaaaaatcctgttctgtggtgggatgcttttggtgtccatgcattcgagctacagagtttagcaaaacccattgtaagtctatgctgttcggcatctggttgtgagcgcaactggagcgcatttgctcatgtaagtgcaattttctatggctgcaggactgcaggtacactaatgcatttttatatgct

SEQ ID NO: 24613 - DNA, 543 bp, Sorghum bicolor
  Clone ID: 30938561
aggaagagtaaacccattacgccaaagcacacaacaaattctgaaaaagagaccaatgaaagaagatcatcagggaaagggtcaacaagcaaaggggaatcagcagaagcagaacaagctcttcccagcaaggatgaactgcaaaagattattgttcaacttcttaagaaggccgactttgacaaagttacattcagtgacattcttaagatgctcggtaaacgctacaagatggacgtatcttcaatgaaagatactgtgaagtccataattcttgatgagctggccaagttagcggaggcagacgaggactaatttggaaatgaagaccctggcaagatgaagtcaaagcatcaaagcatagtataggatgagggctgacaagctcgagcccagtagctataatgactgtaaccatgttaactgttgttaaccgcgatgcctttggtcagtaacttgccctgttttgggaatgtaggatgctttgcagctctgatctaaccagtggaggtacataaactgctgtggttgcctgcgacgata

SEQ ID NO: 24614 - DNA, 476 bp, Sorghum bicolor
  Clone ID: 30938587
gagaggccagagctgcagccgccagcatcctgcctctgctcgtgctctcccagtctccctcagagccggcgtcctctgctccggcgtcctctgctcctgctctccctcacagccggcgtccaggacagctccgcccgcgactccagctccgcccgcgactgccatctccgcccgcgcgagttgcagccaccggacgtccgcacttccgcccacgcgagctgcagccgccggtgtctgcacgtccgcctgcgccttcacctccgcccgcgagagctgtaggcaccagtggatccgcccgcctgcatcaagatgagtcactcatctgaaggttagcagtcctctactcctctgaagcctgctacggtgctacctcatgtttgtttggctatgctgctttgcagaagatgctcgacgtcgtgcagttgtggaggtctatttacctgagaaccttgtagctgcgagtgatgctactgctg

SEQ ID NO: 24615 - DNA, 511 bp, Sorghum bicolor
  unsure (1)..(511): unsure at all n locations
  Clone ID: 30938595
ctactggagctgtcaccgcttaccgagaaggcgagaagagatcagcgccgccgcccgccaagtgattcaccggggaggagaggacccgtgctgaaggggccggccgtgcgcggcgacctcgtgagctcgccctcgttggtcggcgccggagcggggtcttgccgtcgtcgcatcgcacgtgcgcgacgccgacgcggtgcctgctcctgctcgctttccgtgcggaacaacggcggcctgcgctcctcgccagccaactcgctcgtcgcgagcgagagctccgattctttaggcggtctccttcgctgtcctccatcccctgatccggttcatcccggtgaccaatttgggcgcgcacgaggttcgatttcaccggagaaacggcggaatgctccataacattggacattttgagactcgatcgagctaaagaaggaagcgcgcttgccgagncaatgaggaagaattgggggctcagctccgggcacgcgcggccgttcggtgaccgccg

SEQ ID NO: 24616 - DNA, 364 bp, Sorghum bicolor
  Clone ID: 30938599
gaagtcaaggtgggaaataatgaggataggcaagatgccagggcatcagaaggtgatgaaatcaagatggttgaagcaaagactgatgctggacatgctgaggtagaaggaaatgagaagaaggaagacaaagctggtcagactgaagagaagaaaaataatgccactactgaaactgaggagttaaaagtgcctgacaaggaatatgcatgtgaagaggaagataacaatttaaagaatgagggtattcatgatggcaaggcagcagatggtgaggacatgaggagtgttgaaggaaagattgatgctgaaattgcagaggtaatagaaagtaggaaaaatggagaagtggagttcaaggctg

SEQ ID NO: 24617 - DNA, 590 bp, Sorghum bicolor
  Clone ID: 30938635
tatgtgtaagtcgcaacgagaactttctgggcggatgccggcttctctagctcctgtagccacgttactgtagctcttccttcccctccagatctccttaatctgtatctaaatccttcccgatttgtttccatagctgcgattcctcatctgttcttgtggttctttgggtcagatttgctttggctgttgcttttcctctgcaaatctgctagcgcctctttgtctctctgctggctcttgctttgtcactgttgtgcctgtcttggaggtctctgtgattagtccatgccaaggtaggaggcagcttgcagcagttctaacttcgttaaatctttggtcttgcggtggatttgtgttccgttgagttctgcagcctggttcctggcgtagttgactcgcggtcgcgattttctgggtctacggcttctgcgtgcgtcaatctattcgcccgcctccctccgcgcgtgtgcagtttcctgtgctctttcttgcctcccgtccatcctctctcccgtgggtgcctcttcaagtgcctggcgagttgtccgctctcgtcggtcgtgcagttcgcgctcctcctgttcgag

SEQ ID NO: 24618 - DNA, 613 bp, Sorghum bicolor
  Clone ID: 30938637
gtgcgagcggctccaactccacacgatttggatgtcgagctcgatggatcttgttacccctcctcctcctcctcctcctcctcctgagggacgtcggccgtcggcattggtaaatggttggggtattccggggggatcttggtgttgtttgagacgccctctggctttgcaatattctgttacaatggggccaaactcttcctcccaaatgccatacagaaaatatgggctgactttgccaaggattatatagcaaaacgcgttgtcatgttgggagagtttcaaacttttgaggacaaggccaacgccattaaacttgatactggtgttgatgatcggcttgctaggatgatcaagaagtggcttctttcctaagcagaagttagccgttggaaagcttgaatataaaacatgcattgaagcaagcttggctactgtaacttctctttttgtctgcttattatgcgaataattttaagcatgatatgttatggatttttccagaggattccatgcctttttaatgatgctgtgatggagttgatgtggggactcaagaatcttgggaacaatttagagggtgtttgagactgctccataaactctgctccat

SEQ ID NO: 24619 - DNA, 733 bp, Sorghum bicolor
  Clone ID: 30938649
gctactgggcgcccgcgtaattacacttgcggttccttgaaaacctctctctttctctccccgattccccacaggccacaggcaaagatttctccggtgtccggccgcccctcgccggagaccggagaggcggcaatggcccgccgacgtaccgcgccacggctcgccgccctgttcctcctgcttctatccaccgcggcgcgaccgactctggctcagccgagcaacaccacgatcgacgaccaccactcccgaaccgccgtcggcgggttcaccccgaccacggtgatcgtgctcgtggccctcatctccgccttcgtcatcctcaccgtcttctccatctacatcaaccgttgcgcgcccacccgcgctcccccgccgcggcggtcgccgtcccgttacgctccgcccgatcatcatcatgccgccgccggcggcggcgcagtcgtccatccggagcgccgcacgcgggctggcctcgacagggaggtggtcgagtcgttccccaccgcggtgtacggcgacgtgaaggcgcgcgtggcggctaagtcgggcccgccgctcgagtgcgccgtgtgcctcgccgcgttcgaggaccgcgacgacctccgggtgctccccgcctgctgccacgtcttccacccggactgcatcgacccctggctcgccggcgccgtgacgtgcccgctctgccgcgccgacctcaccgtcaccgcgccttaccctcctcccg

SEQ ID NO: 24620 - DNA, 603 bp, Sorghum bicolor
  Clone ID: 30938651
attagcaggcacggaaatgcacgatgcttacacattgtgcaattcgccaacgcgaagttgcggtttgcaaaccactggcgttcaaggtcagctttttttttttttcagcagagacagagattccgatgtgcttgctgatatgctgccatctgccatccatatgcgcgaaatctactagtttcagagaacattcagacattcagggagggattcctgccagcatgcagttgtaagaacagctagtagcgttgctccaatgaacaaaagatccacacagagttcagagttgttctcgatgcacatacctctagcttctgtgcttggctgcaatgcaagcctgctgtactcctaactatgaagtcaggttctatgttcagatgttggtttcagagttaagctgatcaaaagctgcatcgtgacatgacgcattgagactcgatgatgacagaggaccggattccatgtctattgaccggagaatacaattaagttgcgggctctgggaggcgcgcgaagaccggcgtccgcgagcgcagcggcgccggggacggacgcgaggtcgaggacgaggaggagccgaggaggaggttggagagcaggcgc

SEQ ID NO: 24621 - DNA, 735 bp, Sorghum bicolor
  Clone ID: 30938687
ggcatcgtcacctccgtcctccgtccggctggtcacgagtagtctgtattcccttcctgtatcgtccgcttggtgtggggccggcttcctgttgtgctgaagcagtctttcttcttggcactacgcccgcccgcccgcccgcagcagagtccactgtccacaggcaaaggcgactcgatagggagagacagagagcacacgggatgggttgagaaacgagagatggaggcacaaagtgggcagcctgctggtgctggatcttggcttctcgccgccgccgctcacttccgctccacctgtttggtgcagtgtgggcaagttatctactagtagacagtatcttcgggccagttcaagactaaagacttgccgctggtgctgattccgttgatcccacaactgaaaagtgggggagtcgacgaccctcctggttttgaggatataagatattgcatctctgcattgttctaagtgctgagaaaataaggcattatttattggttggagtagtctgtgttgctatctggcaccaatggcgactgtggttcgtcatgattcaaggcagtactcttggttgtgggttagccatatcagccccaagaactcaaaatggctccaggaaaatatcaccgacatggacacaaaggttaaagcaatgatcaaacttatcaatgaagatgctgattcttttgcaaggagagcagagatgtactacaagaaacgtccagagctaat

SEQ ID NO: 24622 - DNA, 602 bp, Sorghum bicolor
  Clone ID: 30938743
ttagcatatggtgcattggtgctttcaaactgcaaatggtacacttaaatcaacgcagagttttaccttgcaactagtttgaaactaggagtttgacatatgcaaagggtagcaactactggtcatccgtgccaaagctcagaatgctgagttgcttactggcttcaaaacttctagttccatatattgcgatggctattagccaggagtcaggagcattgtttgttgtaccagttccaatctctacctgcagcatatcattgaatcaagcatttcttctgtgtcaaatgcctttggcctaaccctgttctgaacaagttataatagaactgaccctgtggtggcttctctcaggcatacaccgaaatgatagcagagagaagaagaaaggtagcaagtggagctgaagatacctacgggatggagaaaatccagtgaggatctccggcagcgctgcttgtagagtacagtactctgttgtgtcttgcattttcttgctcagagtgatagttagaattgaccgcaggctgtggcacttagcacgatttgtctgtaaaaaatgtattccccagaaattgcaacaatgaatcatgctgcttgct

SEQ ID NO: 24623 - DNA, 531 bp, Sorghum bicolor
  Clone ID: 30938756
tgtaagttgggataaagagaacaatgttccacctgacaagtcattgaaggtcccttataagattgacggtgacaaagtagggggctacagggtcgtcctaggtgattttaacacgaaagagaactcgaccaaggcgctcaagaacatgctttgcgatttgaaatgggttctttactggttcatcggcactgcaatgcaagtttcgacctgcccctggatcaatgcagaggagctgggccttgtttagttcaccctgaaaaccaaaaagttttcaagattccccgtcacatcgaatcttgtggcccatgcatgaaatattaaatatagccaaaaacaaaaactaattccaatgtaaaactattttttttcacttgttgcttgctactcactccatctcacgttataaaacgttttgacttttttagatacattatttttactatgtatctagatgatagtgtatatctagatgcccaacaaaaattattgtatttaaaaaaacccaaaatatcctataatttggaacggggg

SEQ ID NO: 24624 - DNA, 622 bp, Sorghum bicolor
  Clone ID: 30938762
attcaggctcatggttctcgagttgctaattcatgcccatgctttattacattaacttaatatgcgggctgcacagcttctattctttctggttcatgatatatattgcttttggttcatcagatagaggctatattccttttggtgcatcagataagctagagattctttttgttgtttaaaggcttagccagacttcttggtctccacattagtcagctgctccacatggaaccgcttgaaaccctgtttactgaatcagctgctttacatactttaagcttggattaaacatggtgtttgctttgctcagatttactaatgttttgatgcttcagatttactaatgctttgacgcttattatgttcttatgatgtcccttaaccaagtattattcatgcacattgaccatgctatgtttgcttcacgtacgtctgctaccaaattgggtatgtgctacttctctatgatcccacacttctcattgggcatccgaggatgaatttatttttaaacaagatgaatttgtttttttacaacatgaatttgttttggttagcagtagatcaactgcgtaatataatagagatgatacttgatgaatgaaaaggatcatagttg

SEQ ID NO: 24625 - DNA, 520 bp, Sorghum bicolor
  unsure (1)..(520): unsure at all n locations
  Clone ID: 30938772
gcaaggcagccaagctcgacgacgccgtgaggattttcaggaagatgcaagggaatggagtcatccccaacgcattcagctactggctcctgatacaggggctgtacaaggggggcaggctggatgatgctgttgggttctgtgtggagatgtttgaggctgggcttgcgccgaatgctgagacgtttgtaggcttgcttgatgcagtgtgcaagacaaaaggggtggatgatggtgagaagcttgtgaggagcttccaggacaggaactttgctattgatgagaagtcaatcagggagcacctggacaagaaaggcccattctcaccagtggtgtgggaggtgatctttggcaaaagaaaatcaggccgccctttataatctctaccagaaagtagtatgttatcactctcatcattttgttagccttgtagttattatttctcaagaatttgcttgcttccatggtaaaacaaanatgtgtcccttgtcttcttatatagaatctatcattggggcga

SEQ ID NO: 24626 - DNA, 587 bp, Sorghum bicolor
  Clone ID: 30938794
gcttctgttgatgggcctccaggtttcgtcagctgttggctatcaaaagattaggttcaatcttcatgaatccagaagttcgcaatcagaaaagcaaatgctttattctcgtcagtttctgttgtgaattcagttgatcaaatcgcagtgacatgaatcttacggcattttctcactggaggataggatccatttttctgccatttagattatactaggcaggcttttatcactactcttagaatgagaggctgggattgaccaggacctgttctctgggaacttctgcctctagccaatccacttaggccttgtttagcttccaaaattttttgggtcggagcactgtagcattttcgtttgtttgtagtaaatattgtccaattatgggctaactagactcaaaagatttatctcgtgatttacaggtaaactgtgtaattagtttttgtttttgactatatttaatgctttgcatgtgccgcaagattcgatgtgacggagaatcttgaaaagtttttggtttttgggttgaactaaacaagatcttattcagtatagttcgggtatgaatggtaatctctaga

SEQ ID NO: 24627 - DNA, 484 bp, Sorghum bicolor
  Clone ID: 30938798
caatattgagttagttgtggttgatgacttgaagtccttttgtatccattgttgatgttttcccatttatgataaattcaccaaggttaacatggtcgaataaaatgggaatgtcatagtttccttcttatgttgtactctgatccactttgtgtttgaatgtgtctctaacacccttttccatttatagagcagccaaagatcccaaatcaatagaggacggttgcattgcttaatcaatggtatggctaaatagaaacatatgggcgactgagatggacatacaaaccatgctatttgcactatcagtccactgaagatatgtggttgcttcataatttgtactctgctttgattggttcgatatgccagatcataattagatgatgatggcaatgatcgtatatataaaatgattgtatttgaatcttagtgttcccatctaattataaaagcaatactcattggacatgataatagctta

SEQ ID NO: 24628 - DNA, 568 bp, Sorghum bicolor
  Clone ID: 30938800
aggtgcacaaaatgcaatggtagttttactcagaaaccacttaccctagaggaagctgttgaagcctcaaaaggtttccaggttattccctcgtgcttgttcaaccgaaatctggagttctggaagtgtaccgattgcaatcaactctattgggagggaactcagtaccacaatgcagtccaaaagttcttgtcagtgtgcaacattagtgactaagcagtgcagccttggtacgcatttgtaaggtactgagataccatcacctccgaaagaataataatcatctgatctttggcatccaatcgtgcatgatgaggcagaccatccattttagtggtttgctgttcatcaccgagttgctgtaaatagcctacacttccatttcgaaatgtgttacttttgtcagaaatagacacaaaatggaatgctcaaggccctagcatgtcaaattgagaatgcatgtacactgaaaaatcagcaggtgtaatttcacttggctgataagtcatggtagaaagtactgttggctgatttactggcagattcggctgataagacataacacagt

SEQ ID NO: 24629 - DNA, 587 bp, Sorghum bicolor
  Clone ID: 30938820
ttcttgctcttgcgctttgctcagctggcgggttttttgttttatcaagtttccctggtcgacggaagcttgcaatacagaaggttaacaaggttgccgatgaactctcgagaaaagttgatgaagctatccaaaaggatatctcacagagtgctaatgacgtaatccgctttgttgaggtcatcagcaaaccttaccaggaagcatgccagcgaaaaatagattggttacagggcgttcagggtgagctatctgctgtcgagcgtaagctccaaactttgaaagttgaaatccaaaatcttcatggatcgtgaggtctcattacaccttgtttatttgcaattaattctttggatggacgtactaatcattttttgttggtttatactgcatcgtgatgtagacgtagtgcctttgctgtatatgatagtctgcaagtgtaatgtgcgttgtaaattcagaacaagcgataaactggatatcaactgtcacgtgataattgctcgccctgagaactgagaaggatgttttaaaaaacttgcctatttgataaaatttacaacatgtcaacatcatgttcaaaacaa

SEQ ID NO: 24630 - DNA, 655 bp, Sorghum bicolor
  Clone ID: 30938822
tccccaacgcgtaccggaatgcgcagctgcttgtggatttgaagccgaagaagtgcccccagtgctacgctatcaatctggcgccgtctgatgttaagtcgaaaggtgaaggttgggagagcttggtcgccgagaagatgggtaacattggctatgccttcaatagaacagtgtggaggaagattcatgccaaggctaagcagttttgtgcgtttgacgagtacaattgggatataaccatgtgggcaacagtgtacccgtcgtttggagctcctgtttacagtctcagggggcctaggagaagtgctacgcattttggtaaatgcggtctgcaccaaggtcagggttcgagcaatgtctgtgtggataatggttcaggagctgtggaattagaggatgctgataaggtccctaatattaaaactgattggccagtccgcataattcagaggcaggagggatatcaagctggtttcaaaggatggggtggctggggtgaccggcgtgatcgtgagctatgtttgagttttgcatacatgtaccatgttaaagacccatcatcattgtaattcagagtataggcacacgtttttttgcataactagtgccactgttgtaatattgtttggcatgcgccctttgatccatacacggt

SEQ ID NO: 24631 - DNA, 609 bp, Sorghum bicolor
  Clone ID: 30938828
tattagttagtcatatatggtataattctaattcaccagtttaaaatgtagttgactatcattctacgaacatcctattatgtacagtataatgataactggcaagtgaaagtggttttctcccatgtgttcatccaatgaagaatcgtctagattatgccaatatctttacattcttattaaccaatgcagtcctttctagattactgagagactaaaaaaatgtttgcttgtagcactaatttctttgttgatcgagtttcagatttgtatcttcagtttattgaagaacaggtccacgatgttgctagatttcagaaatatcacaatcggtcatgctgccacgtgctcctgtgaaggacctgcttgaggagttcgaggtggaggcaatcgaaggcgagagcatccagagcctcatcttcattggcatttctctgtaactttcttgcaggcactaaatagaggaggcaagctgccaggtgactcctgtacatgcacaacgttggtggaatgtaactgaaacaatgttgcggcataaacgtgcatagcactcatgttcagatagttcagagtttgctcataaatctaaaaacaagacctttttttctt

SEQ ID NO: 24632 - DNA, 663 bp, Sorghum bicolor
  Clone ID: 30938834
cggatgcccgcagacatcaagaattctacgagctcagtggtgttggaggcgacaatgattgctggtgatgcttgcggcaaggtgcaggccgcaagcgcacaatcgtcggaggcctcattcatgctttgtgcggtctacctcgaggaggtgcggggctaggctatgttggcagaggcagaggtgattacaacgtcatgctcatatgcataccaccctggatgcgttcccttatggcttgtcgtgcaccgcgcctgcccctgctacaaggtggatcgtcctgtcacataaaaatggacctaaggtctggagctcgattggagcaaaagtttcccattgatgaactcaacagtctggtcttcgctgccatctcgaatcgaagtgggtaaaaagcagaggatcttttgttgcgaactggatatgctcgtgtgtttttttgacctgggattttcattacttatgttctgacaaatcgacagcaatcattacagcagcgtgaccaggaagagttcgaaatgatctcatttccttcaccacagttataccccaagttagcgaactcgagcgcttattgtattacattcttttaccctggaacatacatatgtacatatgtatattgctgtgacactatatttagataacagtgcaacacttgctcacact

SEQ ID NO: 24633 - DNA, 690 bp, Sorghum bicolor
  Clone ID: 30938864
tatttttgactagtaatgttagttgacaaatggtttgtctccatggagttccctccctctttcacaagggtaatgatgtgtttctttgaatcttgtcagtatggtggtttcaggttttgaaagctacacttaaacactagttatgcaccagtaaaaacactatctatgcttctgaattggttggttataacatccataagtcaatatgcatttggtttgttggttgaaggagtttattagtttcaccattttttccatgtaaatgtgcatatttccttggctgtcaatagatcaaaatgccagtgtgataggagctgaagaaggtggtgatcgtaagaaacctccagtagctcgtgcagccaccaagcagccagatgttcaagagcctgctgcgaatggagaggaagcagaacctgacaggagcgacactgatgagtcagagaactgaagtggccatgaatcgagtgcaactgcagtggttagttccacatttagttccagtatcttatagggatataacactttctatctaatagtttagttccacatttctttataggagtaattcataacaagaaaccccttcgcctctttatacagaaacaggggtatatgtggcattgataaaaactatgacggttgaaaattaatatctaaggattacattttgtgtcctttgtaaattaataa

SEQ ID NO: 24634 - DNA, 180 bp, Sorghum bicolor
  Clone ID: 30938870
ctactggggctagctgctgccgtacgtagtagtgtttcaccatatccaccacaccacgctcctgcaacagactgcagcgatcgaacgacatgaggctccgcggcgtgctgctcgtcctggcgctcctcctggccgccaccggcgtcgtgccggtgctgctgctgtgcgaggacggcggcg

SEQ ID NO: 24635 - DNA, 595 bp, Sorghum bicolor
  Clone ID: 30938872
gcctactccatccgcccactcacgctcgaccggacgcctcactcgcctctacccgcacggcggcacggtccactcggcttcttgcacgagcacatgttgtgctcgcccgcaggcatcgccgtcgttcctccccacgtgcagagccaccgccggcgccgctccagcgagtagagccaccaccgccgctcctgccggcacgtccggcgctcgctatccacagccccgtgtcctttcccgacgtgcccatccgtctcgacctcccggcggctggcccatctgcgtcggccgcaggcggcggtccatgaccctgctccatcctctgccgcggtgacatcgctgcttgccggacctcgcacgcgaggcgcatccgtctcggtctccccgtgtgcggacagaatcgacgtgcttctccatgatgtgttcgattcaggattggggagagactactgccaattttgcatgtctgttcacaggagagctgttgactgaactgaattttgccggggctagactcaatgaactgctcattagttcctatggctgggcaattttacccacatcctaagatccgtgcaccagtaacaggtataaacac

SEQ ID NO: 24636 - DNA, 666 bp, Sorghum bicolor
  Clone ID: 30938876
agtttccactctccccgcgggcgctcgccgccgccttcgagctcggagcggagccacgcatgccaatggccgtctccactgttaccgccacccatctcgctccctcttttccagcccgtagtcgccggagacgcgccgcgccccgcgccgcggcaggcggcctaacggcgcgcgcacggcggctgcgctgcgagttcgtcgccggcggtgggaacggggcgctctccggagaggacgaccctcgcctcgtcgaccgccaaaaagctcttgatgcagctatgaatgacataaacagctcttttggaaaaggaagtgttacaagattaggcagtgctggtggtgcttttgttgagacattcccaagtggttgtctaacactagattttgctctgggcggtggccttccaaaaggaagagtagtggaggtatatggtccagagagcagtggaaagactaccctggctttgcatgcaatagctgaagtacagaagctcggaggaaatgccatgcttgtcgatgcagagcatgcttttgatccagcttattcaaaagctcttggggtagatattgaaaatctgattgtctgccagcctgacaatggagagatggcactagaaattgcggaccgtatgtgcagatctggagcaatagatcttatctgtatcg

SEQ ID NO: 24637 - DNA, 626 bp, Sorghum bicolor
  Clone ID: 30938912
cctactggattgaaacaaagaactcccacaactcacccctagcaacactcacgactgtaccatggagcacaaagacaaggacaagaaggacaaacacaagagagacaaatccagcaacaaagacgttgcccaatcgagcccaagcgacgctggggatattctttcaaaacaaacggatatcatccacaacctcaagcttgaagatacttcttgcgactttgtgacggtttattcagatcgtgcagaaatcacgagaactttgaaagtcgccattgagcacgaaggcgtgcaacaagtcgtaatctcacgcctctctgaaagcgtcgacgaaaatagcgatcgtgtgtctggaggagcatgcaaagccacgatcctcgaagtcgcttacgaacaaaaatacatcactgaaccagcaagcactccttctcagcagaagatcgatcgaatcgcggagatcgatgctcagatcagcgaactcaataccaaccgagatcgcgttaataaagaacgagagtggctgtcgaactactctcaacacaaagctgttgtcggtgaacacaacaagctgactctcgatgaagtgagtgccttcatgaacttctatcaagagcaacttgaacgactcg

SEQ ID NO: 24638 - DNA, 628 bp, Sorghum bicolor
  unsure (1)..(628): unsure at all n locations
  Clone ID: 30938914
tttatggatctggtcttattattatgacaatcctatgttcttcaaattgtttcctttttaagtctagaaaatttcctgccttacttattgttattgttactaatcaagtgtatttgtcaacatgtcacatgtttattaaatatgtcacctgaactaaaatgcattaggtttttgtagcaacacaaattatatgtgctagtaaatagtcaatacagcactcttaaagttgtatctgatgaggctttttcaggcatttgtactggtagaatcttagaattttttctagtaatttgttatttgatctgatgatgcccgagttatcaagtaaccatgaagggttctcctggatgaaaagtaaattaagtttgtttgaagatgaaatcaaatcttgattttagaagtaactatgggaaaactagaattcctaggttgaatcagtatcattgttctcagaagaaaatagcctcccaaatgctaaccaaagaggacatgaacttaggtggtgtgtacacgcatgccttctgctaactgagctagtggttccaattttgtaggttcatccatgtggccaataccgcaagaatactgtagtcgggattctgcangctgagcatgggttaacacccct

SEQ ID NO: 24639 - DNA, 617 bp, Sorghum bicolor
  Clone ID: 30938922
agctctaggaaggggaggcatacgccattctgcgagctcaaggcaagaaatgggcgcgctctgccttctctgcccgtgcccatccacgccgccgccctgcccatgcggcacccgcgcgaccgcgccttcccctttcttctcctgtgcccccaccgctgccgccacaaggctgcagctctgcggcaggagccagaggcgcgccggcgtggcgcgtgtaggtggcggcggcgggggcaaaggggagagtggcaagaccggcgcggcggcgttctttgatgaggatggggtggtggacgacatggatgggtacctcaactacctgtctctcgagtacgactctgtttgggacaccaagcctgcctggtgcgttcctttgctcatccgtagttgtttcttgctggacattccgttgatcaaaattggcgaacattatgatggtgtagacatttaagcatgatttatttgccaacacattgtagagatgccccaaatttgttatcgtagctttgtttttgtcagatgtagctagattcgaaattgtttctcctgcttgttcgttttttaaaaggaaattcgaaattacttcaatattattgtcaacattggctctgacaaca

SEQ ID NO: 24640 - DNA, 641 bp, Sorghum bicolor
  Clone ID: 30938953
acctgcgccgccgtatcccccctctctccctctctctccccatgtggcgctgcacaatgtccagatcccgaccatgaccggagccacgacggcggcggctgctatgccttcccctatgccacacgcacctcccccatctctctctcctatcctccactccactccctatgccacacggacctctacagatgtggtggcgcaacagccggcggtggccgccgccgccacgcgctgtgcacagttcgcaatctccctaaaaaggttatgtagtctctctcaggttagctccagatgagtgcctcaccatttaaatccttacattagaacatgttcctcatctagcccatccactgtgatcttgaatgttgatcgatttgcatcaaaggtcttgaattgctacaactacgttcatatccagtattttgaagttttgccatcttcctttttttcttcatgagcctatgatgaaaagtccaatactcattgcccaaggatatgatcggaggttcattttcttgtgaggtactgggcatggatttttctgagagtaacccagttctcagcatgccttgaagctctaagttgaagaacaaatgatgattgatatgtttctgaagctgctaaaaatgttgtcttcgttg

SEQ ID NO: 24641 - DNA, 137 bp, Sorghum bicolor
  Clone ID: 30938957
aagagacacacatacgacgctcagctcctcttcctctcatccaaggcggcgtcgtcgtccggcggcgtcacctccgctcccgtcgcctccgggcagaccccgccctcgtacgtcgtccgcgcggggctgggcacccc

SEQ ID NO: 24642 - DNA, 575 bp, Sorghum bicolor
  Clone ID: 30938965
gtgctccgccgccacgacccagattagagaggagagagccagagcaagtgagagatgagtctgcagattccggtgagatcaggcgccctccgccgcctcctccttctaggtggcgctgggggtctcccgcgcccctactccaccgacgaccggcggaggcgggtgatccgcgaggcaaggcaagaggaggaggacgaggcgttcctccgcaccctcaacttcggcgccgaccccgagaacaacccccttcccccgccgccgaggcgtggcaggggattatctgacgcctccgccgggaagcagcagcagcagcccgagcgaagcgcgcagaaggtcgtcggggagacgctgctgcagaagcttaagctgggcgatggtccctccgccgccgctgccgccgctacgggaggcggcgatgagctgcggcagcctgaggacgagcctgcgcccgcgcagccggtggacgtggatgagatcttccgaaagatgaaggagaccgggctgatccccaacgccgtggccatgcttgacgggctgtgcaagaacggcctggtccaggacgccatgaagctgtt

SEQ ID NO: 24643 - DNA, 453 bp, Sorghum bicolor
  Clone ID: 30938975
ctctacccctggtggtggtggtggtggaggaggaggaagaggagcctgtaatgatggttaacaggcaatgcagacagtggataaaaggagcaaatatttatacaatggagagtcaagaaatatggcggttacacagtttgaagccgctgatgcgcggaggtgctttccatgttgggatgatcctgcatttaaggctaagttcaagctaacactagaagttccatctgacctggtagcattgtccaacatgccagtggctaaggagactgtcagcggatctatcaagactgtttattatgaggaatctccactaatgtcaacctatctcgtggctatagttgttggcatctttgattacatagagagttcaacatcagagggaaccaaagctcgtgtctatactcaagttggcaagactaatcaaggaaagtttgcactagatgttgctgtaaa

SEQ ID NO: 24644 - DNA, 629 bp, Sorghum bicolor
  Clone ID: 30938987
aaaaaacctcgcttcctctcccccgcatgccacagtcgccatgagcgacagcaaccccgccgccgccgcctcaagcaagcgaccctgtgacccctccctcgacgaccccacgccgtcggccaaggtgcagcggtcctccgagccgtcagacccaacgccggcggtgaaaccgaacggcggcgcggagacgggagaggagagcgaggtgatgaccggcgtacggaaccctagggcgcagaggtacctggtcgccgtggagtacattggcacccgcttctccggctcccagcagcagcccaaccagcgcaccgtcgtcggcgtcctcgaggaggcatttcacagatttattgggcagccagtttcgatattctgttctagcctgaacggatgcaggtgttcatgctttatcaaatgtttgtcatgttgatgtggagcggataagtaaaaggaagcctggtgaagttttaacacctcatgagcctggagttgtaaaacgtgctgtgaaccactttctactgaagaatgaaggtgacataatggtgactgatgttcgctgtgtggcaccagattttcatgctagatacaaagcactagaacgcacatatcactatcgcttgctttctggacct

SEQ ID NO: 24645 - DNA, 580 bp, Sorghum bicolor
  Clone ID: 30938993
atgtatttatcctacgactccctccatcagctgtcctaagttttcttttaagttctatacaggaaaaaaactaatatgtatgacacaattagcatagttagatataatatgaaatacatttatgctatacttttttgaggactttataggaaaaatactaatatttatgacataaaattactatatgtagatataacatgaaatatatttttatcttgcacttttttgggtgtcaggcttagcatggcgctaaccatgagtgctgctgctaactgtatagttaaggacagcccttcctttgctactttgtggaattaaaagggcaaagtgcatgataatgagacatgcacactaggctagctgcctctgcctaggccagcaaatgttggtgtcttttgttaaacaaatttgttacgccgcatttgtccccctcattctaaacttcattttttattggctgatgtgagtttattctttagtccttgaacttgctccatgatttgggaccaatatccataatgcacttgctccatgaagtagctatcgctactttgtgatgttgctccacataatagctcta

SEQ ID NO: 24646 - DNA, 626 bp, Sorghum bicolor
  Clone ID: 30939013
cctactggcaaggatcttgtttatggtgcaaacaattatgccatcaaacttaagtctgatagcaattcctggcagaaccagatttcatctcttattgagagagcaaaaggtcgagcagtaacacttatgggatctacacttcagctgtcaaatattgaccttatttttacatacacggtcaaaggaaaaacaggcagttccacgagagccacatcatttgttcagaatgatattctgagtccaacccttgacgatgctgtgaatttactaggtgactactcgacatggttgagttctagcaatacccgtgaagcaaaagtatatttggagtgtttcagtgcaagatgggatgcactggttggtccagaagaaagggctctgttagatccaaatggacttgtcaatgaaggggagaaactcaccataaaggcactggatggcttcaacgccagtgctgctgccaaggtttttgaagaggaaatcagagaagtggcttttggaacatttggagggctaggtattgctggactgtcagcttctcttttgacatctgttttgtcaactactcttgaagatcttcttgctcttgcgctttgctcagctggcgggttttttgttttatcaag

SEQ ID NO: 24647 - DNA, 616 bp, Sorghum bicolor
  Clone ID: 30939023
tactggacactcgcctctccattttgcctctgtgcgccggcgccacaggctccgctacctctcccattgacctgcgcgcggtggccgaccctcggcacggcagcgacaaccctcctcctcctcctccacgcacctctccgctcgcgccgcaagggcagggcattggaggtccctgccgagtgctacgccagtgcagcagatgggcaccccggccacgagggacccaaacggccgccatcccaagccacgacgtgtccgagcaggcctgccgatggtcgccggcgcggttgcccctgatacggcatcgtctcgtagggccgtgctttctcctgtgctccatgaaaccctaggtgtatgctcttcctctctctatcctccccctttccatactgactccccatatccaagcgctcttggaggtccctcgcagtaccacggctacctgctctggctgcacgcggaatattgctgggatgaggattatggtggatttggtcaaatccagtgcccctatggctggaaccattgtctcctcgccagatccagagcggcggcacaatagcagagggccacagacgcgctcctcatctaggttacggtgactgcctttgttggc

SEQ ID NO: 24648 - DNA, 512 bp, Sorghum bicolor
  Clone ID: 30939046
ttggttttttgaaaaggatgtgtgggattatttcctttcttatctaggtataggcaaagctgagtacaacagtgttccgagtgacggtgataaggtagagggcgaggtgaagttttcatttccatgtatgatagaagagagatgtcacatattggaagttcatagccgggttccagcattttttagggttaaggaagttgctgcacgtgcagcattgttattcatggaatcaaagttcaacgtgaagattgttgatctgaattatgttggtcgtcagactgctgagaaggaacataaatccgtggaatttataatatataggttgcttgaggtggctcatcagatgaagactcaattgggtaacatggtggagtgcattgcaggtggacgtgcagcatatagtggtgatccaagattaatgtttggaggtcctttgtttcaagaacaaatgatggctgttgagttttgctttaaaaatgtagaagttgttcgggctgattgtgccccgcgct

SEQ ID NO: 24649 - DNA, 336 bp, Sorghum bicolor
  Clone ID: 30939060
ttgaaattgatggacgtgaccctggaggaaatcaattgaatgatgattggactggatttgttagggttccctcatattgtacgggacaggacaggtggtgcttgttgagcaccagactgactggttgtggtgatgctgtgttgtaactgggagcaagtttccctcgatccctgtttcggccttttggttgggcctaacccaaggacagggatgggttttgatggaatatgcatggagtcgaaatcgggaatgaaatttgaatatggggatagatatttttaggcgcagatacaaaaggaatggattgaattctgatttatctgcttgatttggggg

SEQ ID NO: 24650 - DNA, 471 bp, Sorghum bicolor
  Clone ID: 30939070
tcacggttgctccacaacagatttgataactggatgtctctgcaaggcaagtttagaaagccagttcaagcatattttcaagttaaaaaaagccatcgagtcagtgttgatgcaggacccatgtcatcttgggaaaatttttttcttagttcatacaggtttgagttgcggcggcatacagttcagatttgttcagagcatagataggtcagtaagcattgtattctttcgtgtttctccgttgtacatgtgccgtaaattgtgtatttggggagggagataagttgtgttgtattatctcaaaaaacagtgttatactgggtataactggcagatcacgcggaatggtgatctatcatgggcctgattttgggttggccggtcagcttgtttttgtaaagtgaggtggccatcgatttattatgtaagtttataccggctgttgaaggaaggtcaagtttgtgttccctt

SEQ ID NO: 24651 - DNA, 496 bp, Sorghum bicolor
  Clone ID: 30939116
cttgttgccgaaatgcccgccggcccagtacctgttctgctgctgctgttcttgcaggaatttcctgctacggtcaccgtggattattatctttatcctgccaataattgatcggaggcaaaaaggggtgtgtgtgagcacaagaggcgcagaacaatctgacaaagaggcgatgtaccatcatctcttcatctgggtctgcttggtggttcagctgtcaattcctgacagccaatggatgattccaagatcgcccttgtgtctatctactatagttggtacgtgcagtttgtgaaaagtgatccaggaaggtagatatctcggtgtgccgaatatttgtggacagactttaggtgatccgctttgattttttaaatttgctgttttcaggtgaaaattgaagtggagccctcgtgctgaaaatgtgtcatctgctacatgcctacatggaagaagtcaaagctgattcggtactggctttgcaggtagtattgtc

SEQ ID NO: 24652 - DNA, 374 bp, Sorghum bicolor
  Clone ID: 30939132
gtagaaaacttgtgcgctggaacaagtaataaagggtatttacgtttgtgtcatcctgagctgccttgtccgttgcaaactgttttgctgttcgaaaattaccatgatagatttgcgtcgaattcatcggttatatcctgatgaggcccgtatcgcccatgtcgcacgggagaacggtaaattttgttccagtaaaggcaataactgcctgcgagttggcttccaagtgtgcgcaagtcattgtttcaaggtttgactccataattattttgcagcataatgtattatttacatgtataaaaccttaaatgcccttaaaatacaaatacatttttttaattcacatgaatatgaaatgtactaatttcactatg

SEQ ID NO: 24653 - DNA, 691 bp, Sorghum bicolor
  Clone ID: 30939138
cgtgcagggctgcttgatgaagcatgggatctgatccagacaatgcccatgcctccaaatggtgtcatatggggctccctgctagcttcctgtagggtgcatgggagcatttcgatcggaatacaagctgcagagcaccgtctaaagctggagccaagttgtgctgcaactcatgtccagctagcgaatttgtatgggagcattggctgctgggatgatgtggcaagagtgaggaaggtgatgaaggagagaggactgaaaacaaacatcgggtgcagttggatagaagttggcaataaagtttacactttcacagcagaaaacagatcaaagagccaggaaacttcagttatactgtactggtatgcgttgtacagctctacaaatttgtagagctagagctagtcatctctggctctagaaatctgtagagctggagctgtggactgatcgagggtcttttgtttagtcaccttgttcttcttttagattaaaattataagtttaagatattttattttattaaacaggcacagattctgcatagagctgtgagttagagctctgccaaacaggccatacaccataatctgacagtttgacatccaaatgaatccactgtctccatttattgtttacttgaagacatactcgtttgttgcaattggatgtacagcttattatgcgacaa

SEQ ID NO: 24654 - DNA, 606 bp, Sorghum bicolor
  Clone ID: 30939146
gatgtgaagaaagagaatagcgagagaaacaggccatcgaatcagattggatgggaacgggatgagatcctcgtaaccattggccggccattttattcccgacagcgacccgcatatgtgtgctcccatcctccgggaccaaatccacgccgtccaaatgagaccccagcatactggtaatgtttcagatacaccctcaaaagaaataatattcggtcttgagctccagtcatttgcaaagggaaattagggaaaataacaacgaagaactacaaaacccgactggagtcaaatgagcacctgagtgttcttaagaaattcgagctagtcttgtaatcaccaagtcaaattgactgatcatctgtccgtcgaatcgtagtataaataaatatagatatagacgtacaatcactcctaaacacacacaagcccactttacatgtttaactattacatagtttatgcgattctgtatttattacctttaaacgattttcttctccagccctagaatttgtagagtttttgcattgatggtccacatttttgctatggcctgaagagttccaatacaaaagaaaacctaccaattgcaatatcctaaaa

SEQ ID NO: 24655 - DNA, 609 bp, Sorghum bicolor
  Clone ID: 30939169
ctactggtttgattcataattttcggaccagatcgacaactattccaattgccgttcttttttgcaatgatatattccattataatccatggcttgcttactgcttgtgttcagaaaaagatccatatcatatctttttatgataacttcatcatctaaaaatatggtaaatgcataccttttctagtgtattctacacaacattatcataaatatatctttgcacccaaacaaatcattgctgttatagtaattttgctcgtaggaatgacatgtgtgcactgttcaagggttagtttcattctgttaattgaaagatgcaagctagttcgttcattctaattgtgtcattactaatgcagaaaaaaggtatctcaggtttggtcaaagctgctcttttgagtgcattacaaaccacattctcgtttcatccccatacaggcaagctgttactgttcattttttttttcaatgtagttctgcttagcctgcggtacatctaatttgcacctggcaccatactttattatattatatggatatggatttttagtaatcgaaattaaacttctgcccaattctgcccactctgatgggaagtttcatgct

SEQ ID NO: 24656 - DNA, 724 bp, Sorghum bicolor
  Clone ID: 30939174
tactggatgctccggccttaatcgctcttgctccgcctccgcgccgccccgcccggccgcccctccaccacgcgccaccgtggggtcgtcctctgccgtcgccgatctcctcccccacggtcctccgccgccgcctccctccgcccctatcgcgcttttccccactagctgctttgattcaacgagaggttgtcccagacaggccaatgatgccagacgagacgatgccgccccgtctttcctgatttcagcgccatctgagcgctgacgtcgcgctgcggtgccgtgggagctctactccgctgggtggtcgcaccgcacgcccccatcctccagggtggctgcgcagctgcagcgtggtcgggctgtcagcgcccctgcccaatgaccagtgccgcagtgcctgctggccgctgctgctctagtgctctgcctcttcccctgctgctatgctaatgctaagtgctactgctacgctgcatctctgttatactataaaatcaaacttgtttgcgcctgtggaatgtgcacacccatgggaatttttcttgatggtccactgctgacatgcacacacatctcttctgccactgtcatctcaaatgccatgctatgcgtaagggtaaagagagctttgctaactcaagctcaaaccaagcacagcctgaacgcagtaacattttctcaaataatacctcagtttgcccctccataactaaactca

SEQ ID NO: 24657 - DNA, 653 bp, Sorghum bicolor
  Clone ID: 30939212
ggttatgctcggtccaagtatccaaatcagagttgagaagctgctagatgcatgcatttgctgggctgaagctgaagtttttgcaagagctctgctgctctccttttttaactgcatgtatgcatgtagtgggaaagaggcagccgtcgttgctctgttttttttgaggagcgatggcatgcaactagtctcgcacacaatgcagtgccgcttctctctctcgtgtgggtctgcattaaaaagtggaaagaggcatggaggacatgcattcgtccgaaggaagcttcacggaagctcacaaggtgtactgcttgttggcttctgaccgttgctgtgcgtgtgcctccttgccgtccactccttggctggctgtttgaggcccgcacgttagtagctaaggttggtggccactaggcctctggctaagacccagcactccccttccttttcctctctcggaaccagaacagaacgctcctctcctttctttcttcgcaaaaatagagaagcaaaaactctcctctcctctctcaatccccaagctttgcaatccattcaagtgagagatcaaactccagttattgatctaagagcagcaagtacatctctgctctctcctcttcatctccatagcttggtgctcatttgacata

SEQ ID NO: 24658 - DNA, 559 bp, Sorghum bicolor
  Clone ID: 30939221
ctcattttctctctcccacaagcgccgcgccgcttgctgcaccacgccgcctgccgtccgcaccgccgccctggcccctccagcttgctgcgccgctgctccaccacgccatgccaccgagccaactcctcgccgagccacctctacatctcgccgtgccgctgtgtgtgccgccgcacctcgccgcgcggccgctctagttcgacgagccatcctccacctcgctgcgccgcaattttttttgccgctcgatcaagatgtttagtaggttttggttctatggagccctctggttctggtggcattgaagaacatctccaggagctgaaaaaatgtactcgatctgtgctttggtttgatgcgtcatcctcgtgtctagattttatggtgagtgttgcttcacaggatggactcacccaaaactgctgctgctgtccttgccatccatatcaccagttgcaaacacaacagcaaccgaagataacaacacccccccaccgcactttgatttgcgtgaagcaatagcacttggatatcagaacaccatggagctggttag

SEQ ID NO: 24659 - DNA, 602 bp, Sorghum bicolor
  Clone ID: 30939235
cctactggataaagggtggcgatgctccggctggccggctccttccctcgtctgccccctcccgttcccgtgcttctcccccgctccttctccccagccctcgccgcgtccccgctctcgcgccgccgtgctctcctcctcctcctccttcggcatcgggcccctctcctgttaccgcggcccttccttcgcagcgatggcggcggcggcgccgccggtggccaagaaggtgccgcgccagctcgtcgagcacggcgatgtccgcgtcgacaactactactggctccgcgacgactcccgatccgacccggacgtcctcgcgcacctccgcgccgagaacgactacaccgccgccgtcatgtccgatgtcaagcagcttgaggacgaaatatatgctgaaatcagaggaagaatcaaggaagacgatatagatgcgcctcttcgcaaagggcagtactactactatgaaaggacattgactggcaaggagtatgtgcaacactgcaggcgtctcgtaccgactgatgctcctgttacagtccatgatgtgatgcccacaggacctgatgcccctgatgagcatattatcatggatgagaatg

SEQ ID NO: 24660 - DNA, 527 bp, Sorghum bicolor
  unsure (1)..(527): unsure at all n locations
  Clone ID: 30939257
atcaaaccccgcgccgcgcgtcacagcagcagcagcagcaatggcgtgcgtcgccgcgctcttcgcctccccggcgctcctcccctttccctccaccacctcgtccacggcctcggcctcggcctcctgctcgtgccgcctccgcctccgccccgccgtcgtcgcccgcgcgccgcgcgagcagccgcgtggccggcgcgcgctccggcgcttcgacgaggtggagggggtgtcgaagaagcggcgcggcatcggaggaggtagcnggcgctggagggtcgccgccgtcgtcgtcgcgcagggatagggggcttgccgtagatttcaaggagtcacaggttgctgattttgatgatcttgaagaggacaaattccttaatgctgtcgtcaaggtctactgcactcatatcgcacccgattatggtcttccttggcagaagcaaaggcagcattcaagtagtgggagtgcttttatgattggggatggcaaactcttgacgaatgcacattgcgttgagcacgacacc

SEQ ID NO: 24661 - DNA, 670 bp, Sorghum bicolor
  Clone ID: 30939265
tactggaaaactcacctcacctccgccgtcgcctacccccccaacccctccaccggtccgtttgaccttgtccgcggccggcccgttcccctcctccgcctgctcctcccgtcccagtcctaggtttagtgctccacagaccacaggacccaatcaccacccccgccccgcgccgcccgaagagcagttgcctcgccgcttgctgcgggtccatatggtggcccccgcgtcggcgtgagggctgcgcgcgctcgtggtgtatatcagggaggagattgatggggcccgccgccggaagcggcgtcgtgatcagggccgctgcggtggggctcgtgctggtcggcatcgccctggccccgccgctggccgcggcgctgcggccgctccgagagcgcgtcgcgtccgtcggagccgccgcctccgccggttcgtggggcgatgagcatgccttcttcaaaagggatgagaacgatataggcccgtattcttggaatattacgggaacgtataaagggagctggacctttgctggtgccacaaatggttcgtctaggtttcttgagtttgtggaatctaaaggtgattcagttcttgaattgttgagcactccaacaaagataagcggggtgcattatgttcagggttcaattacattccatgatgtcattga

SEQ ID NO: 24662 - DNA, 506 bp, Sorghum bicolor
  Clone ID: 30939350
gagttgttttcagcaggatcaacgaggcgctgagcttctcagttaatgagaatgccctagctgggtgcggggctgctccccggcggaggaggaggtgaggaatacttggtagctaggtgttgctgcatgttcacgtgctttttgtggccatgccataatagcattgggaaatgcttagtgtggcctatcacttggagcatggtgataggtgatgtatcatgtggttgtgagccacatcacacttcactcacagtagagaggcagtagaaggaaggactgtgctgaggcacccctcatcattaaaaaaaaaacatttgatggtctgtggagcacatgatctgacggtggaagcaaataaattagtgtaggctgttgattacccccctgcctatcttgtttggaaatctgcttctggtgttggtggtgcattgctgctgtaatgtaactacctgtgttggtacaggccaggccatcctaattggaattgaaagcatcagcttctgcta

SEQ ID NO: 24663 - DNA, 424 bp, Sorghum bicolor
  Clone ID: 30939381
gatcctgggagtccagtttaactaggcgaggacgctatggtgggcggactagaggtaggaaacctcggaaaactgtagtgactgtaatcgtagaagaggaggaggttgaggttagtcccccgccaaaacctgttggcactggggacttagaagctgatgataggggtatgattggatggggcagaacaacaaggcggtgtcgcagaacgagatgtccgtcaggtaacaacatggctactgcgtcttgagagagggtattgccagcaagcattgggtttgattaggtactgggtggttcccaattgttatagagactccgatggatggactggtataaggtgatcccagtcatgagtgtacatactctgtcggcctattggcctcaccccaactttatgcttttgggtcgaaacatggtttacgt

SEQ ID NO: 24664 - DNA, 431 bp, Sorghum bicolor
  Clone ID: 30939383
cgggagcgtcctcatccgggtggtcaaccgcgtcaccgcgcgccacggcgcgggcaccgggtggctcgacggcgccagcctcagcgccggccgactcgatttgttctactggctccttgcgctcttcggactcgtcgccttgcttctctacctgttgtgcgcgtggaggtacacctacaggtaccatccgtcgaggatgcagtcggcgatggaggatcacagggtgtctccagcatcgaagaagctagatgcggcgctttgacgacgacattgtcatcaattatcagttgacgtgttctaaacgcaaatgtcataaaaatatggattttgcgcccgttactaagtctgatatactatttttccattggcactgaaaattagctagtacggatccattgacattaaaaaataactactaattttagtcgggg

SEQ ID NO: 24665 - DNA, 567 bp, Sorghum bicolor
  Clone ID: 30939430
ggatcagataggtttggtgatcgttacatggatgatcgttatgacggtggtcgttatgggtaccgtgatcaagttgatgcaagggacaggtatgctgggggccgagatcgttatgccaatgatcgctacccctctggtggcgatcactttggtggagacaggtatggaggtggcccggatcgttacgtgccaggtggctatgacagggatggtccacgtggtggtgtcgctgatcgttatggcggtggaggacctgcacgcaatgatggaggaagttacagggataggcctgggccatatgatcgccctggcagaggaggaggacgttttgatgatcgctactgatgaactgcctgtagactcaagctccttgtcttgtagtttaatgtttgcagtttttcatagctgaatgcttaatgcgctatggaagatgcttaatttatccctcttttggcactttaatgtctgctctgtatttcaaccagtacttgggcgcggtgttgccttcttgataagtctatccagctgactgtttttgcatgagatgagtcatgctctgggctataa

SEQ ID NO: 24666 - DNA, 374 bp, Sorghum bicolor
  Clone ID: 30939523
ctactggagtgtactccatgtggagaagaagagtagtagagagagacaagcactctcttctccccttcttccccaaccccgactaccccactgctccgcctcgcctcacgccaccacggggggagcggagcccgcggcctgtgccctccgcgccgccgcagtccctccccctgcgcaagcggggagatcagattgccggataggaggaggaggaggaggaggggattggaattggagcgccagcgccaccacagatgggggctctgcccaaggacggggccccggcggtggatgtctccgtggaggggaccctggtctggctgcgccgccccaatggctcctggtggcccagcatcgtcatctcgccgcaagac

SEQ ID NO: 24667 - DNA, 522 bp, Sorghum bicolor
  Clone ID: 30939531
ctactgctggctccctcgtggcctcgctatccccaaagcggcaagcgagaagaaaataatccccaattaccgacatcgaacgccgacggcgatgtccctccgcaagcgccagcgctcggcgagcagctcccgcctcgccgccttctgctcgccgccgtcccctccgcttccctcatccatttccacctctcctgactcgcttaccttccccaacgccgacgtgatcctccgcctccacctcgatccctcctctcccgacgacgtggacgccatacccgacaccgactgccacctctccgccgcctcctcgggaaccttcctcgacctgcaggtctcgtccgcgtccctcctccgcccccactacttcgctgccctcctctccgaccgctggcccaccgccgcgagtggccgtctctccctcgcggtggtggcgcccccctcttgcccccgcccgttcgacgcccacatccaggtgctccgcctcctccacactctcgatttcgcgggtgccatccgctcccc

SEQ ID NO: 24668 - DNA, 376 bp, Sorghum bicolor
  Clone ID: 30939566
tactggaaaaaggaggaaaaaaaggagagagaaaaccacgcagtcgtttgttcagacaaaacaagaacaagaacccaccagtacgcacttcctcctccccccccctctctctcctcctccctctctcccttcctccgccagtcccgcccccctggcccatcagatccaattccttccccgacccccatcccggatccgccgcaattccttcgtgcgtcgagctcgattgctccctgcccgtggaatttgctccttttctccgcaagaatcccaccttggccggcgacttgggtggggggacttgccaaggttgggggggcgtagcggggtcatgggcgtgctgctgccatctaggctgttcgtgcgcccgatactc

SEQ ID NO: 24669 - DNA, 533 bp, Sorghum bicolor
  Clone ID: 30939568
tcgttggacaagtgaagttttcttggcttgggatagctgttttgagtgctagctggagccatggctttgcaatgccttgtagactggaagggacggccggttaaccccaacagacatggtggggtaaaagccaccatgttcatctacttccttgttgtgatgacgaacattggaaacatcccgatgctgctgaacgtggtgagctacctgcatggcaagatgcacatgggcatcgccgacgcctccaccaccgccaccaacttcttcggtgcgatctgcgtcttcaccttcttcggcgctttcatctccgactcctacgtcaagcgcttctacaccatcctcatcttcgcacccatcgagattctgggctacatgctgctggcatgccaagctcactttccggcgctgcacccgccaccgtgcgacatcgtgaaccacccgagcgagtgcacggcggtgagcggccggaacctgagcctgctgacgctgggcctgtacgtgatcccgatcggcgaaggcgccgtgcgtgtctg

SEQ ID NO: 24670 - DNA, 616 bp, Sorghum bicolor
  unsure (1)..(616): unsure at all n locations
  Clone ID: 30939573
cttcttcttcctcgctcgctcgcccgcccgcatccatcccatccccaccacctcatcccatctccatccctctgtgcacggggtgaaaacacaacccacattcaccaccgagcaagctctccctcccctgctctcctccggcctccgccttgttcttcttgttgtttgcatataaatctggaactgcaagggggaaccaccaccaccaccacaccagcagcaggacagcgggagggagaaggagatccgtgaggagcgaggtgccgcccccatggctgagaaggagggcaacctaggccgtcctcaaggaggccgtcgacctggagaacatccccctcgaggaggtgtttgagaatctgagatgcagccgcgagggtctctccactcagcaggcgcagcagcgcctcgaaatctttggccccaacaagctcgaggagaaggaggagagcaaattcctcaagtttttgggcttcatgtggaatccactctcctgngtcatggaggctgcagcaatcatggccattgcccttgccaatggaggggggaagccaccagattggcaggactttgttggtatcataactctgcttgtcatcaactcaacaatcagttttat

SEQ ID NO: 24671 - DNA, 441 bp, Sorghum bicolor
  Clone ID: 30939581
tgttctttgaaactgaattttctcgtaggctacctttgatgcttcgatactaaaactgcagttttgggaggcatcgccacagagataggaattgcatctgaaattgtcggcgattgatcaggctatcctatccccacattatttgatgaatgttcatgctgttttagtgttctcatctcactatcaaatagatactcacgagagggggtggtctcgctgattgcagatctctaggtgatgcttgcacgggcacaaaaggaaccagtctcttcatatactcaaacctacaaccttgaactctcaactctcattgtgtttgttcagtgtcttctacctcaaagtagataatgatcggggtcgttgttgcaaggcttctgatattttttgcatgggcttgtcacggggaatatgtgttgggagtacttctaaccttatcaaatt

SEQ ID NO: 24672 - DNA, 576 bp, Sorghum bicolor
  Clone ID: 30939641
agatgaattggcagcatcctctgtattcacccttggtccctacgatctacctgccgatcagaagctgttatccatctgcacaagcaaccatcttgagcagctctgaaccaaatgctccttcaaattgctatcaaattgctatcatctagttcattggagttgccgcatgcatttgctatgctgttgtgcatggcacgattatagacagtcgtgacttggatatgagagatttttgtcaagtcttgccaagatcacgatcatcttcagaaaaaatctactttgctcgcttgcatgaagcaacgaagtcgggcaaggtcccttgcaagaaatctcgtttacaaggatgcaaggatgaaagcatgctcaaatgcatatgatgttctcctgtatgaatgttctccaatctccagacaattttgtgagagcaaacaaagaaactgacagttgttgatgtatgaggacagcagattatgttccttgtaatgtagttctgggagattatgcgacatgtttcagaatgtattttggcaacctttttttttctggtatgcaacataacgttcatgttctagtaaa

SEQ ID NO: 24673 - DNA, 569 bp, Sorghum bicolor
  Clone ID: 30939657
ttgcagttatgcaatggaaggaagatattctctgttagatgctctcctgagagcttcatcgttcaggttggagaggcagcagacatattgtcccaagggaaattgaaatctacacttcatgctgtgagtagacctttgagttccatggacatcagccgtgaaacttttgtagtcttcctacagccctcatgggacaaaactttagcttatcctggttactctttagatgaaggtgaatccattcttagcaaggagacttcagccatcagtgatggatcagcagggccttgtgatgaagatgcatttatgcaaggaattctgaagaaaatcccccctctgtcgtcaaggctaaaagaagggatgacatttgcagaattttttcgtcagaccacaaaacagtattatggtggcagtggcatccaacaaaacaattgagcactagcaatacaatggcagatgcatatagttgtagcacagattgaactgatgtattgacttgcatttcagaaccaatatgaaagcacaaaatgaaatcgtcctggtaaacaatgcatactgctcatcctact

SEQ ID NO: 24674 - DNA, 573 bp, Sorghum bicolor
  Clone ID: 30939660
attaggctgcagagactattgatcatctcttagtccttcctgtctttgcaagagagttctggtttcagcttttttctcagattggactccgagcctattccccacagcccacagatatatctttccataactggtgggaaagagtgagcaatgctgctggtgagatattaaaggaaaggaattaattctctcataatcttgggagcatggaccttatggacacaccggaacaaatgtgtttttgatggtgcggctccaagtgttgctggtgcacttgctgtagctgaagatgaaagaaggtcgtggtctttggctggggctcgagggctttcccttttggctaccttcgcttcgggtgcttagtgcccagtgccctgtgtgtgcgttgggtcggattcagtctttctgtcacaggcgcgttgttagcagcagtgtagtgtttttgtgaggttagagctatgtgtgtgtgtgtgtgtgtgtgtgtttgtgtggatattttttgtgtgtgttgtatgggttcttgtcccattttttatcttcttaatataatgatgcgcagctctcctgcgtttt

SEQ ID NO: 24675 - DNA, 504 bp, Sorghum bicolor
  Clone ID: 30939688
tccatcagcaccaagcgcggcgggcagttcgtcatcgacccggccacgttccccgaggccgcggcgggcgccgcgtggccgttcgccggcggcttcgtcatgggctccacggtggagggcgaggggcgcgcgagccggcccaccgtgcaggtcggcgtgcagcacgtgacgtgcatgggcgacgtcgccgtgttcgtggcgctgtccgcggccgtcgatctctgcatggacgcctgcaagctcttctcgcagcggctcaggaaggagctgtgccaggaccaggacgagtgagagaccgacccgagcgacgacgtgtattagtgctcttgggtttggctcctgtgctgtgaattgtgtgattaaatctagccgggttagctcttgctatgatgtcttgtggaggtgatggccctgtggctgtgttttagtgtaggctgggtcggatcacaagaacaggacggggtttgtacgttcatgattctttctttgcttcattcaatttat

SEQ ID NO: 24676 - DNA, 567 bp, Sorghum bicolor
  Clone ID: 30939692
agggtggtttatcggggtcagctgaccccgacgaaattttgtaaaatcctttgtaagatactgtttgaacataagaaaattcgtatcatatagtgaagttgaccccgatgaccccaacgatgttttcggctagattcgccactgctccttgggacaacaaaattgttctgtcaatgtggggatcatcttagattgaggaccagttgtgctccgaaagtgagagaagagatctgactaactaacatccacatcaagagaaacagatgaagcagctcaagtagagctagaaatggaagttgaagcagcatcttcttctaaatcttatgagtatgttcttctaatcccctgatgtagagttaactcattgttcaatgtactgaaaggagtagtttcagtgtgaagattgaacttgcctttcagtgtgaagattgaacttgggatgtcagctctagcctctgtaacttatggagtttggatattttcaatggatcaaacatgataaattctctgtaacttatggacttttgatatttccagtggatcaaacatgacaatagttttatggaa

SEQ ID NO: 24677 - DNA, 562 bp, Sorghum bicolor
  Clone ID: 30939720
ggccctcctttaatactacttagcatagctacagtcctaaaaaaatctctccagataataaataaaatataaatgaatgctaaaaggagaagcaaaactatggggacgcttgcagttacagtgcccttctccacacgacactgctacggtggccagattagtttacctgccgtcccacgttgttttccacccaaaaacacccgcacgagaaaggcgtcgcgccaccacgggcgctccgcgtggagcgcgcgcccgggtgcatccacgcggcatggcatcacgtaacctcccgtgcaccgcacagcacaaaaacaccgtcatgttgtatccatccacatgctcgcattgaactcggttttatcgcatcgaataggttcccttatttccattccctataaggtgtaggagtagcccatttgatgtgaattatggacttgtggtactcaatcctatatggtttaaaaaaaatagattttttgtcacattgaatcttgcgacgtgtgcatgaaacattaaatatagataaaaatattaattaattatacagtttatctgtaattgc

SEQ ID NO: 24678 - DNA, 741 bp, Sorghum bicolor
  Clone ID: 30939742
atctccaatccatcttctccctgagccccgagtccgtcgccggagacgtcgcgcctgcgcctgccatggacgagaaggagttccggggcatgctcgacctcttccccggggttaaggcttctgatttggccctcccaagtcccaagccacgatctgtggcgtggagttcgattgggatttcgagggtagcacagtcttcctatcgattctggtgacccgatctgctgtcgcgacacagagtgcagctccgggttccggaatcaacttgatgtttgcacacgtagttgcggtagaggggccatgtatgtagcctttggtcagatgatgtattaaagatgacagcacattagcaccctttaccagaatttacgttactactgtacttttgtaggacgcaatactgcaagtctgcaaagaaaagagtagcggattttatacatgtgccctgaactgcctagtttttctccccttcttttggttaaagggggattgctcattttctccttttattaacaaataaagcccctctagaatgcgaatggtacatatcttaaccgtactatcctcctatccaataatagccggaatgcttctaaaaaggggttccaggtttagtctgttgcttcttgcccctcaagataaacaggctaatattagtcttatactgtgcttgctgtgccgtttaagtaagtagcctattgttggcctcttaaagttggtaaatattagtgacaaactttc

SEQ ID NO: 24679 - DNA, 506 bp, Sorghum bicolor
  Clone ID: 30939749
aaaatcccaaaggctcgcgagcgagcgggcggcacaccagcgaggagagagagagagaagagagagagagagagagggaggcggaggagagagaaacccctagtctccaggctccagccgcctcgccttcccttccctctcgccgcctccgcctcgccgagaggggcgaggaaggaaagccctaaggggttcgcgccggctggtgtttcggggtccagcggcgggcgggcggcgggcggtgcttgtggtgctcggtgagtccgctcgatccccctcgccgcgggagcgtccacccgagctgccccgcccctcgaatcgagggttctggtagggggggtcggtcacctcctcctgctcccccccggcgcccgcggaataagctagcccacccccctctctcgcctcggggtggggggttagggttaggtctttttttccccggaattgcgggcggaattccgcggccaaggcggcacattgctaccgcgtctccgccccccccggct

SEQ ID NO: 24680 - DNA, 635 bp, Sorghum bicolor
  Clone ID: 30939787
cctactggattcgctttcccctccatccattccacccagccacgcctccctcgcctcgaggggaatttcggctagggtttcgcggatcgagggagaaaggagaggagcggctcggcagcggcggctagggttttccgcgggtgggcgggccccgcatggcctcgccggcggccgcggccgcgaaggggagtaagggcggggaggacggcggcgggccggtcacgggggacatggtcagcgcgggcttcgcggagctggagcggcagcagcagctgctcgccacctgcacgcgcctctaccagcagctggccgaccacttcggctcgctcgagcgcgggctcgcggcccgctccgagcagctccgcgtccgccgcagggccttccacgcccgcacccaccgcgcgctcgactcgctccaccgccgcgaggcctccgtcgacacctccgtctcacgcgcgctcgaccacctccactccatctccaaggaggcggcggcggccccggccccgacaccgtccgactccgctgcctcggaggaaggcctcgccgagagcctgcgcgcgctgtgcttgcggatggactcgtccgcgttcctgggctacgtcgtgacccaccgcaaggaggcggacgcgctg

SEQ ID NO: 24681 - DNA, 717 bp, Sorghum bicolor
  Clone ID: 30939823
tgggtggctggatcccttcttatcctagatgaattggcagcatgctctgtacataaattggttagtttatagattctttgtttaggagtttagtcctagttatttgtttatcaactctgctccttgttctgtttgtttttgtgctacttttaccttttgtgatatctaaaacagaagttaccattcttttcttctaactgtttgtcactgctacttacaggtttgagtttccattaaaatgatcacgccattactgaatgtgcatagtttactttatcttctcaactgcatttctcttcaaccttgtaactggtccaagtagagcatgattcctggtactgactggtaaagggtcagagctgatatgagcatcataatgtcaaccttgtttttgtgctacttttaccttttctgatatctaaaacagaagttaccattcttttcttataactgtttgtcactgctacttacaggtttgagtttccattaaaatgatgcatagtttactttatcttctcaactgcatttctcttcaaccttgtaactggtccaagtagagcatgattcgtggtactgactggtaaagggtcagagctgatatgagcatcataatgtcaaccttatcatgtttctgtaagtgtgaaattacttcttgtctttataatgtgtgtcatagactcatcacccttttttatgagtatcttagctgcatgagct

SEQ ID NO: 24682 - DNA, 634 bp, Sorghum bicolor
  Clone ID: 30939842
cctactgggcggcgactgcgacggcgctggacatcgcggagatccccttctccgacctagtcgtcctgctatcgcccgatacgcttgctgacgacggccgctgccgacgcgttgtggacaccgtcgcgaccgagctcggccgaggcgggtccgggctgctggccatcgccggagtgccgcgcgtgggcgctctccggcggagactcctccccttggcccgacgcctcgccctcatggaccacccgacccgctcccaactcctcaagaagcatggtttgggcagcgacgtggctctgaagaagctcgatcggtccgtatcctcgttcgcacagcttctaaggcattcaggtgaactcaccttgcttgagtctgtgaacagcaacaatgggtttaattcttcggataagatacaggattgtaaccaacctgaggaggctaacggtgatgatgatatggagaatcttggtgacctcgttatggagcttggtttgtacatgatggagcttgggattttggtcgcacgagcttgtgatattgttattggtagaggtcacctagagcagagcatcactgaccttgggacggcaaaggcgaggctcattcactaccactctgagctagataacagtattat

SEQ ID NO: 24683 - DNA, 605 bp, Sorghum bicolor
  Clone ID: 30939844
acaaccacaagggcagaatcttggcctacgctagagtttctgcagtgtatgtgtgtgctgttctcaccccttctacctgtagccatagtgagtagtgtgtgtgctggtaagcttactgtttgcttgtgtaggaatcttagggactaacaagtggtatcagagctgtacagctgtgttgccggacttaccgccggcgatggcacctggctcagagacggctgacagcagcagtgttgctggggctgcccagccacgacaggaggtcgttgtgcacaccgtgcgagaggtcagcggcataagttggccgatgctgactcgcaccaactatggcgagtgggcggtgaccatgaaggtcaagctcagagcccgacggctctagaatgccattgacaagggcaccgacaatgaagacgacatgtcaacgatggagtgccaaggaggaggtggcattccaaggaggaggtggcgctggagtgcgcgctgctgctgctagacagcagtctccaccagcagcagcgcattcacctccaccacagtcccctgtgacagcaagataggcgacaccaccactggaattcgcttctccacccactgacatcaatgag

SEQ ID NO: 24684 - DNA, 701 bp, Sorghum bicolor
  Clone ID: 30939888
tcacgctctcgatccctcagcccgccctttgccctctcgctactaccattggggcaccgcaatggaggatgtcaggtaggatttgggcgccgcgatgaaggatgtcgtgctggatctggacgccgcggtggaggatgtcgtgcaagatctggacgccgcgatggaggatgacggctacaaggctgtcgctgtcatcgagaacaggaccgaggggagggctacgtcatagtcaaggtggctgccgcggatggggagggggacccagccttctccgtcggcgatctcggggatctcgccacctcgctgaggatgtggtgttggccggatctgaggacgcctgagtcatggtgaagacggatgaggttgcggcgccggccaaggtgagtttcgtccttcctcctgtggctacctgcctttgccagagccttatgcccagatcttgccgtcatgggcgccgccattgtcctcactggcgagttcagaggtagcagtacccttggacacccacatcaaggtcaaccaattaggcctacagtttggtcgatgctgaaggtcatcagcaaccatgcttcttcctcaagcaccggtagccatcatggtgcacagatcgcgtcgtcaaatatgatccctctgtgtatcagccagtgctatggaagaaaaaacttgtgaaattgtctgaactaagtcctcaaatcgtcagg

SEQ ID NO: 24685 - DNA, 605 bp, Sorghum bicolor
  Clone ID: 30939946
tcactacccggatcatattgctagcattctgaagcttgtcaatgggaacttccgcagtcacccttgccttacgaaccagaagctgttgtatgctcctatgggtgaggtgtttatattgcaaccagatgagaagctgtccccccatcaccaccttcttccagcaggcagtggcctgtacctcatcggtggacaggcagtggattcagatacttcatcctcagtactgcgatctgcattgtctgccttcttcaactccccacatcccctcgagatcctcagggacgccggtgcctatggtcccaagggtactgtctacagagaccacgacgtgcactcgtatctcaggtcgatacgagcggtgctgcggaaggagatgagggcggagaaggagaggcgacggcggctcctgcggtggcccattgaagtgtatggtgcgctcgccaccatggaccggaggcatgtgctgaggcagctccggaggcacgcccacttgctggtcgttttcttgttgccggcaaagctactgttcctgggcgtcctgtcagtcatccgacccaactgacccagtgtgtttgtacattagattcacttcttcttttttttcc

SEQ ID NO: 24686 - DNA, 512 bp, Sorghum bicolor
  Clone ID: 30939952
tgaacaggcagaggagaaatttggctaccttttagaatgcttcgacatgggtgctcctccacatggaggcattgcttatggattggatcggttggtgatgcttttggctggtgagagctcgatccgagatgtgattgctttccccaagacgacgactgctcagtgtgcactcaccaaagcaccatcagctgtagacccacagcaactgaaggatctcgccttccccaactccacttcgtgagacagcagttcaagtgttcatgacaaaagttctgggttctcaagggatagctatagttttctagtattgcagcattctatttttgcatggtatagaatgtgcaatttttggaccctgataaatttgtacgagatgcataacacgccaaagttatgaaagagtattgttttaatagctgcgcttatgtgtttgtgcttgtgcacatcagtatcttgtaaattgtttcttgatggtactacttggtagtccccatttatttaacgcccataaa

SEQ ID NO: 24687 - DNA, 448 bp, Sorghum bicolor
  Clone ID: 30939970
ccaaagcttcattgattctcccactttcaagaaaaaggcaagctatgtcgaacacatcggaggagaaaagcccttccccggtgagaccccaagccaccaaagcatgaagaagagcgcttatgccactcccagctactcaagaacttcttcaagcaagagccccgccaccaattttactagcattgtggaatcaaattaaaaacccttactcagaacactttttccttcacagtcaaggagaaatatgggaaggaataacccactaaaaccacttctaatttaattcaaatgaaagttggtttcttcagagttgaaaaaacaaaataaaatattggctttcagtctcttttcttgaacagcatggtcattcttgccctaaccattgacgagcttataccatataaatattgcagttagtgagaacagcgagatagattgtgtgacgtcc

SEQ ID NO: 24688 - DNA, 606 bp, Sorghum bicolor
  Clone ID: 30939999
ccttaagattatgtgccacttacaaacatacctaggattttaggaatttgtgccacaacacatggaagcttctgtaatttagcatggttttctgagtgccaaaattgctatattcatttgttgttccaacgtaactgaagatcacgcttaccatttcacttgctcttttgatttgttcattgtggatcgaaggttggcgtctggattactttcttgtgtcggaatcaatcgctgaaaaagtgcatgattcatacattcttccggacatctctgccagtgatcacagcccccttggcctcgtactgaagctgtaggctgtatcacaggctatgccaaacattcaatctgaagcctgtgccgtaattctcagacagcgatgtttattcctgagggtttttttttggttcgtgcagatccgtggcaggatcagtgatttttgtatcagactattagtgaaacagttaggctttgtaatgcactgagcatattggaatatccattagtgtctagtggacgactactgttagtgatgctgcaccttttgtgatgtacgtagatatggttcatatcttgtgctgcagttgtgcagctcagtagagcagcagg

SEQ ID NO: 24689 - DNA, 554 bp, Sorghum bicolor
  Clone ID: 30940019
cagacatacgattaggacccaggagagtgaaagggagaggagcagcagccgtagtattcatgatagacatggtgacaggcactgcgatagacgtggcagccaggaaaggtacagagatgataggatagatagagacaaaattgattcactagaagctactcgtaggcacagagaaagaagcaggagtcatagtagatcggatctaagggaaagtacgcgtctttgtgatcaaagccgggagagggaaagacagagtggtagtttgaggcatagggatcatgacagcaagagcgatacaagtaaagatcggcatagagaatctggcagggttagcagtgcacatgaaagggagagagggagagatgctagggacagggaatggcacagggtcaagggaagtgaaactcatagagctaaggaagggcgggacaaagttagcgatggtgataggcacagggattcaacacgctcaaaatatagtgtttctgatggttacaaagagaggacaagatctggggagaaaggtagagatgttgaccataaaaaccgaaagt

SEQ ID NO: 24690 - DNA, 657 bp, Sorghum bicolor
  Clone ID: 30940021
atcctgacatcattcagagatacatgttacattgagattcttcctgttgttgagaaatccagaagagttatatgcttgagtttttgggctgaggtgcactacaactcgatatatccggaaggagagttgccggttttggagaacaaaaagaaaagctggtggcccttctagctagcattcccaggacgggacaaggaagaagattagagcagctagggatcccgagcagctaacagataggagcctttctgttgggctatgtgactaactcatggcgacgcggaggccatgggcagttgcggcttgcgcctttgacggcactgcattaccattgtcattgccataggggagacatgtgcagtactgtacgtagtagtagatgatactcactatcccatttgtacagagagaacgagggaagagcgagacagataatcaggccattagcatagtaatagtagtaataataatgtaatacaggagggaggagagggtcattcattcattgattcatttgctattgctagttccttttccggtcgttcgatgatgtagccagccacagagttgtgataggctcatgctcattctttattttgttcttggacatatcatgcatatttatcatcatcagacaaataatgcatgcatgaactt

SEQ ID NO: 24691 - DNA, 644 bp, Sorghum bicolor
  Clone ID: 30940051
cctactggagctgcgacgtcgccacgcacagactacagtaacaaatgccggcggcggcggcgatgcggggggacatcacgtacagcgggcgcgcgcggcgggtggccgtgctccgctgcctcgtcgccgcgctggtggtcaccatcctgctcgcgggggtggccgcgctcatcttctggctcgtggtccgcccgaaacccatcgactacaccgtcacccgcgccgtggcgcgccacttcaacgtcaccccgccgcagcccgacgacgccacggcgaacgcgacgttctacctcacgctcgccgccaacaacccgaaccgtcgcgtgtcgatcctgtacgagtgggtggagttccgcgtgctgtacggcgagggcgaggcgcagctggcgaccggggaagcgccggcgttcgcccagccgcaccgcaacgagacgcggctggacgtgcgcgccgtggcgcggtcggtgcacgtcggggagcagaccgcgcgggagctgcggcaggacctcgcggcggggcaggtgggcgtcgacgtccggatgcacgcgcgcgtccagttcaaggtcgccggcgtcaggagcaggcgctactacatagaggcgttctgctcgcccgtcgtcatcggcctcgcgccgtcgtccgca

SEQ ID NO: 24692 - DNA, 180 bp, Sorghum bicolor
  Clone ID: 30940054
ccgcaatgtcccttccatcattccccgccgtcctcatgctcctcctcctcgccaccgccgccgccgccgccgccggaagcaacaaggctgaggaggagctggacgacctccagtaccttattgacaactcccacgacatccccgccaacgaccccgatgggtggcctgagggcggcggcg

SEQ ID NO: 24693 - DNA, 506 bp, Sorghum bicolor
  Clone ID: 30940064
tactggatcggcaattcggcatcgccgtctagctcgcagggaggagagagggggagcctctaaccctaaccctacccgcccctgtcgccatcgccatggccgccggcggagagccctccccctccccctccccctccgccgtgtcccccgcatcccccaccaagcactctcgctcgcccgactacacccagcccgacacatctcctaagcgccgcaagcgccaccatcaccaccgccgccaccaccaccaccgtcggcaccgtcacgccgattccccggtacccgtggcagccgacgaagaggtagaggagggggagatactcgacgatgccgccgccgcctctgccatggaggtcgatgctgcggccgcagccccacaagcttcccttgctccgatgcaggagcactttggtaatggtgctgatacagactcaaacacagatgcaagtcttagggatggttctaatcgtgagagccatgatcggaatgggaagtctggcagacat

SEQ ID NO: 24694 - DNA, 551 bp, Sorghum bicolor
  Clone ID: 30940075
aagacccacaccgccgccgggggaggtcgagttcatctcttatcagtctcttccccatgtctagcacctgtcgacccacgtcctcggattcttgttgtacacccgcatccatccccgaagcctgagctactccatcccctgcatctcgttgtggccgcccccatcttcggtgccatcatcccgattctctgtcccatgttcgctgaaggcgcgaaaaatggccttgaattcacaatcgcgagacctttcaattggattggcccaagaatggacttaatttggggtgtcaatgaaagcagaggcaaacattcttattcccatgagttccacattgcgcacatactgaagatatcttgacaagagattaagatttgtcttcattgcaagcgtccccctccgcgtcgtgctcacaccaccacccccattgagccagtgctcgaccaaccgcttcctcagctgcaaaacccatcatcgtggtccatgtacgtggacagggttttgggtagaaggcatggtgggcaggaggccgctggcatgaaaccaggccgtgc

SEQ ID NO: 24695 - DNA, 612 bp, Sorghum bicolor
  unsure (1)..(612): unsure at all n locations
  Clone ID: 30940147
ctgggctaatttgtctcatggtctgtgcatcgcatctgaaatcatttttttcctgttatctatttgtttatcagtaattattcagctgctggagaacaattacgggcatccctcatcttcagttgtagcacttagtattgttgtaggcttagagcttttcgttaattgatgttatgtgtgtcctactgagaaatatatcctagtgaatgcgtatgcacagtttattcctacgaaaacaacatagnacattatttttatcacttcttcagaattcttagtagttactactgtacattgtaatgcactttctgagaaatataggctgcatttccttttccaactgatgtacttttgtgcaagtttcattatgtaaattgtttttactttcatattgaatattaatttaccttttgctgttatagttttatagtgcaatacattttcacccctttgaagttatattgtgatgttctttctttttgccagaagtcatctactttctgtattcacatggagtgatggaattgaacaatctatcaccatgttgcttccagtttgcagataatataaaaggttttgcgccaatgaatgcctgtgtggcactgctttgcc

SEQ ID NO: 24696 - DNA, 564 bp, Sorghum bicolor
  Clone ID: 30940151
tctgggagactcgcaacttccatttcattttcatccctttcttttaccaattcccatttcccttcccgtttgtttgggttgatctctcaccgcccaaaaagatacggacggtggacggaggcgccacccagaccggaccaccatggacgtcctgagattcgtgcccggcgtcggcgtcaggccgccgccgctgccaaccttcgccgcgcctgctcccccgccgcggcggccgaggcggcggcgggcgtcgaggaggcgaaggatcatcgccgtcgcaggcgggcggtggacgcggaggccgaggacggcaggggcggcggcagcaactgggtgctgcagatactgcgcgtgcagtcgtcgtcgccgccgccgtcgccgtcgcgcgacgagggctcggtgcctcctggctcaagcgagggcgagggggacgggagtagtagccagcggcgcgcggggaggtgcggcgccagaccggacagcgaggaaggctgctcggtggctgacgcggaggcggggctcgatcgggccgcgttttcgaggttgctgcggaaggtgtcgctcgcg

SEQ ID NO: 24697 - DNA, 575 bp, Sorghum bicolor
  Clone ID: 30940157
ctgcgcttcccctatctgctatcttctccgtctcgttcccaatggcttcctccctcctccgcgcctcgcccttctccctcctctcccgcctaaagcccaggtcatccgccttgcacctccgccgcctcctcccgctctccaccacctccacctcggcctctgtccccgcgccccagctccgaaccctagcgtccgcggcggccaccgatgcggctgctaccccgccagaggaagcggcggcgcccgccgcggcgggtgcgaaggtagagaggctgcagccgctgcagtggcctccgagggatgcgctgtgcggcgagctcggcgccggggacgccgggcgcagggtaaggctatgcggctgggttgcgctacgccgcgcgcacgccgggctcaccttcctcacccttcgagaccgctccggcatggtgcagtgtaggtgacaacgttgacagagtacccagaggtttacaacatagtaaacaagctgagagtggagtcagtggttgctgttgagggggtgatccagccacgccctgtggatgccatcaatgcagatatgaagaccggcgctatag

SEQ ID NO: 24698 - DNA, 460 bp, Sorghum bicolor
  unsure (1)..(460): unsure at all n locations
  Clone ID: 30940174
atttcacagaggggaaagagatagtaaggccaggagtgactaggtttgcttcaacttttctcacattgaatagcatactagagaagaaggaccagctaagaaagaaggtggttcttaataggtgggactcactgagggatgtaaaatcaaagaaaggaaaagatgccacggctattgtattgaatccaaccttctggaaggatgtgaagctaaccgtgagtgtttttgagccactgttcaaagttctccgcttggttgatggggatgngaaaccttccatgggtttcgtttatggagaaatactaaaggcaaagaaagagatcaaggagtccttgggcaataatgagtctcggttcaaggaggtcattgctattgttgacaagaagatgaagggaagacttgattctccactgcatttgacagcttatttgctgaatccacactacagttatgctaatcc

SEQ ID NO: 24699 - DNA, 650 bp, Sorghum bicolor
  Clone ID: 30940176
cctactggaattcatttctcttttcaactttcatcttttatatggtaacaccaacttcaatccactcaagcttcatcaaactctgtcttcaactacctccaaaaaggccaagactggaccgttgaaggctcaggtactgaacaaaccccaatcaacattgttcccaacactgccactatggctaacgaaaccatgaaaatggaatttttcttgaccgatcacactttatccaacattaaggtcaatgataccggtgttgccctgactgctttcggtcctttctcaaagctcagagccaccgatgttgatggtgatgtctatgagttcgaagccctccaattccacttccacgcccctgctgagcataccatcaatgaaggtcaatacgaattggaacttcacattgttcacaaaatgactgaagaatctgccaaaagagctaaaactaacagaaatctcgctgtcgttgcagttttcttccaacttgacaaagaccccagagctacccctaacgcttttatcgatgcccttaagctcgacaaatgtggttgtgacatcgacctcaacatgcatgagcttcttggccaagatctcggtgaaatgaccagcttctttgcttacaaaggtggttcgaccacccctccttgcag

SEQ ID NO: 24700 - DNA, 585 bp, Sorghum bicolor
  Clone ID: 30940181
ctactggattcccagcctcgacatctccagatcacactcctctcgacagcacagcacagcgatcattcgccaaccagacagatcagatcatcatccggaacccagagcgagctgcttctacttctagaagaaagaggacttcgatccatcggttcttggcctacagcctccacacaccggcatcacctagatgagcacctcgtacaccgaggcgcagttcggctccttgtttgacctgcccgccggagacgacctcacgtcctggttcacgcacctgtgcgccgaggagcaggcggcggcgctgccggcgttccaggcgccggtggcgatggcggaccccagcaggaagaggagcgccgactaccaccagctcctggaaggcgaggcgtccggtgtcaagaggcagcgctccccgaccaccagctcccgggagaacagcgccggcagcaatgacggcgaccacgagcactcgtccggtgcagcccccggtggcgccgccgccgccgcgggcaggggcggtggccgccggctctgggtcaaggagcgcgaccacgagtggtgggaccggatgagcagcccggcgtg

SEQ ID NO: 24701 - DNA, 689 bp, Sorghum bicolor
  Clone ID: 30940203
actcgctcgccgaccgatgccgctgctgctgcgcggcgcctccctcctccgcctctaccagtgtacctgtgggctacgaagtgcgaatttcagttcaagagtacctgcactagtgaatctcatcaccacgagggacagaacgcgggctacatattcgcgtagagctgcctctaagaacagtgaggtcaacaaagatgagcagccagtcatagagaaggaagatgctgctgaaagtgatttggagatagagagtgtgaggagcaaatggtgacgagggaaagtcatccattgagctggttagcccctcggagatacctttaaaaagaaaaagtggtgcttctgttgtgattgaacaaaaactagaaagttctgagattatttctgaaacacctagcaagaaaagaagtagaacaaaacaaaagtcaagcaagagtaccacccttgaggagaattctgtgactaatgtcaagctaagtaagactattgtccagaaggaaacatttgtcgtccaaggtgctgttcctaatgacgattcagagccttggactgtactcgtgcataagaaaccacaagctggctggattccatacaaccctaagactatgaggcctccacctcttagcaaggatacacgtgctctgaagattatgtcatggaatgtcaatggattgaaagcattgctcaaatca

SEQ ID NO: 24702 - DNA, 122 bp, Sorghum bicolor
  Clone ID: 30940232
gatattcagattggaagcccaagatcaagtcatcaccactcaaccccagttcagaaagtttcccagggaggcaatgttggtcatctccacagattactttctgttgcttctagttcacagat

SEQ ID NO: 24703 - DNA, 477 bp, Sorghum bicolor
  Clone ID: 30940243
actgagaatgtcattagtggcatagctccttacatcgtggaaaaccatcttgctgaaattcagtctcagaagctccctcagagttttgtgcagtgggttaatgacactgatcccttttggtattaagatcgcaattatccagtgatatgtcgccagctccctagaagacccagtttcccagggtggtattaagacggatctgagtagtagattagagagtgatggccggtagtcaaggcatttctcctgtgatatacttactccgccccatcggagtcatttagggaatcattattggttcccatgtttttactacgagcgagtagatagatatgtttcttttgaaagaaaatagagatgatagttaggcttattattgttgccctggaactgtatcattattcatgggaacatcccatttttcttgtgtaaatatatatgcttgaggttcctttggtgggttgtgaggacccccct

SEQ ID NO: 24704 - DNA, 636 bp, Sorghum bicolor
  Clone ID: 30940279
acgctgctgggcaccgtgctgtcgttcgggaacaggagcttcggcagcacgctctcccggctgccgtccccggaggtgtacggcgacacgcccctggtgatcacgcgaggcaagaactactctgcacagaacatgccggagttccttgccgcgataggcttcgccggcgacgaggtcgagaggtaccgaacgaggacgctgccggtgacgctgaatttcagggcgccactcgtgccggtgacgtctatcaatggcgttggtgtgccgacggtccacaggttgatctactgggatggcaacttcagtgccaagcctcaggtggtgaacggtgatggggatgggattgtcagcttggacaccgtgctggctctgcaaactttcgtcggggatgacccggatcaacgttacttcaagtccgttttgatccccaacatgacgcacaccggtatgatctcagatgatgttgcgctcagccgcgtggttaaagaaattctggaagcaaaccaagccacttcttcataggccacatcatgtgctccatttgcttcaagttaacatacagcttgttttttttccattgtgaaaacttgcaaatatgtatgtgtgttgcaacgaaatctaatatatttggaaata

SEQ ID NO: 24705 - DNA, 465 bp, Sorghum bicolor
  Clone ID: 30940293
gataagccagtgcataagacatgttggtgagaaactgggaattttggtgggctctggtttttgtgtcaatatcagccaagatgcatgctgcgatcggattcccatccgggttcatcgtcacttgaggcgccgaatgatgactcggtgtcaggatggtgtggtcgtcgccctgccagtattgaagatcatgttatcattatatcccatgctgtagtgattataagtgtttaagatagatacagtgtttagataggtactttgtgggcgggaagtaccctcatcatcctctcctgtttagtgagaaaaaaatgttttaggtttcgttacggtggtactttttagcaattgttttcaggagctgtatatgtcccttcgtaggtgtatccctcacgtcggagttcggtgtctagatccgtgtctcctggtaacaatgaagtgcaggttagtaatatataccaagaggct

SEQ ID NO: 24706 - DNA, 646 bp, Sorghum bicolor
  Clone ID: 30940311
gacatcaaaaacaattgagaataatttctaactgcagattggcttgtctgtatatttgctccgatagctgaatttatgtttactgtcaattgacctccccgtcacctgttagtggtgatttagtttatataaatacacataatatgttgtttgctctattatgagctttcagacagttttttgtttgtttgttttgtataccagttttagttggattagtttttgcaagttatttttctaggcactcagatcttcctttttcttttgactagaatttgacaaattttgcattttctaggtggcatgaaggttaaagctgatactgatgagtcctcacctgctgctatgcttgcctcacaggatcttgcacagagatgcaaggtattttgttactgtggaagaaatacatttgttgtcgatgagttggttctcagttgcttatttcccattcgcaggagcttggaattactacattgcatattaaactccatgctactggtggaaacaagaccaaaacccctggccctagaatatttttacactatagtttttatcatgtagagtgtaaaaaaatatatagtataattttctacgccagcaaatttgacaagaaacagaatgtcttcgagtgatctaagaaatagaa

SEQ ID NO: 24707 - DNA, 668 bp, Sorghum bicolor
  unsure (1)..(668): unsure at all n locations
  Clone ID: 30940343
aggtttcattccctccccatcctcagccgccgcacgcacgctctcgctcctcttgtccactcccgcagtgcgcggccaccgtcgcgcgcgcgagcgctaccgtgcgtctgcgccggacatcaaacgaagcccccagccgaaggcttctgctccttcgcgtgcaggcgtgcagcatgccccctgtgctcccagcgccgactcaggagaccaggagtgattgggcgtctgctgctcgtactttggtctgcagggaagatgatcttgcgtctccagtttctcaacctgattggggacaacggaaggtgcacttgtagatttttgtgagaattttttgcgatttgtttgcacatttggtatgcaagggagctgtgattgtaatctagagtttatttcattttgctgcaagatacgtcaagatgcgtcgggtatggtttgcctggtcggggacggggatgggtgaaatctgtcccctagactggggatggggacggggagcgggacaaatttgctgttccggggatgagaatgttctcctcatacccgttgggttgccatcttacccatagcgaagcgctacccgtccgcttagcgcttcagcgcgctgaagcgggcgcttantgccgccttttggaatcttgttttatttatgatagaaagaatgctatatt

SEQ ID NO: 24708 - DNA, 543 bp, Sorghum bicolor
  unsure (1)..(543): unsure at all n locations
  Clone ID: 30940415
gctcttctccaggaggcctctcgccgccgctctccacctcgcgcccctctcgcctccgctgctgctcctcttcgcgtccgcgtcctcctcctgctcgcccgccgccgccgcttcggcctccggctccagagacttcgatggttgtttccaagggatttcgtggctccactcctttcccgagcagagtttgtggatttcatcaggttgctcggatcactttggcgagncgggatggcatgcaaagaangnggannnnngnnggaatttgatggattctgcattttgtatcatcgttttgtgattcagccttaagtgcggtttatttattctcatgagatgcaggaatttcggttttacttgttctacttctggaactttgctcatatgtccttgcaatacgttgatcatctaacgttttaaccaactctgacataattcctgattgaaacgacgtgcttctccacctatcgtgaagtacggttagcatttttaagtttattagcttgtatgctcttacaatacagatgtgttggtctcctatca

SEQ ID NO: 24709 - DNA, 497 bp, Sorghum bicolor
  unsure (1)..(497): unsure at all n locations
  Clone ID: 30940428
aaatctttggtcatccagtctaccaggtgactaggacttcaatggttgagttagcaaattctaagacaagatctacttttcaaaactccaaggatgagagcagatacaggaagatcttgaatgcacttgatcttaggaaggatttctttttcagttactcataccacattatgagaagtcttcagaagaacttgactgatccacaggatggatggaccttatacgagacaatctttgtctggaatgagtatctgacacgacggatccgnaanggnctgnnnnatactttgtggactgttgcattagtccatggtttctttaggcaggataaattctcaatatctggcaaggatattattctcncactcattgctagacgatcgagacattatgctggaaccagatatttaaagaggggggtgaatgagaagggaagagtagcaaatgatgttgagactgagcaaattgtctatgaagctgtgcctggacctactgaa

SEQ ID NO: 24710 - DNA, 285 bp, Sorghum bicolor
  Clone ID: 30940436
ctggagtgatcttcaccaaccacccggggccagccacacacctcaccaccaccaccaccaccgtcctcctccacctccacgccaaaaatccatgctagcttgcatcagagctactagtagctaaattaaccacgcttcgctcgtcgctcgctcctaatgctcacgccccgcaaaataatccagcgagtctcagcccccacattgcccgcaaatccaaccttttcgggcccaatcaacctccaaatccacctttttcgtcactccatcctgtcctaaatcccctcc

SEQ ID NO: 24711 - DNA, 648 bp, Sorghum bicolor
  Clone ID: 30940444
cctactggctcgctctctggctgcacttttccctcctcacctccaccacctccgggcaccagcccgcgctgctctctgcctctctcctgtccccggcttcagcagttcagctccttcacctacacaccacacggacgacctcctcgctgcggttgctccgtccggtggccaggccgcggttcttggcgctcttggttggtcggatcccttgataccagacggctctgcgtccacctttaacttcttgggggattcttgagcgtcaccttcctgtttgtttcttgggttgatgcggacccggcggcggcaactgttcttatgactggaggggccaaggaggtggaacttttccgttgagggggagaaccgaaccgagggaatggaaggcgagccggcggcggcggcggccgaggcggtggcgcggatacggctggtgcggtgccccaagtgcgacaagttcttaccggaactgcctgcctactccgtctacgtctgcggcggatgcggcgccaccctccaagcaaagaagaagaattcagcccaatcgtcacatgacgctgacaatggaaatgtgaaataccttgaagtactggagcgtgttccagaggcatctgcaagaaaacatggagctagtactactgataggtc

SEQ ID NO: 24712 - DNA, 291 bp, Sorghum bicolor
  Clone ID: 30940457
cctactggaaaatcaccagacactcgcatgtgggagcaagcaggtagtgcagtccaccacacactcgcatcctctgcttcccagctgaagactccgccgccgccgcttcaagaactgcagcaactgccgtcgaagtgcccgccgtcggccgagccaagtggtggagacgcagatccgaaggacctccgccaccagcacctagaaggagcgctcgccatcgccgattcgcgccgtcaccagcggattcgggggcacaagcgaggctcctccaccatggcgtgctcaagccgg

SEQ ID NO: 24713 - DNA, 667 bp, Sorghum bicolor
  Clone ID: 30940461
tactggagctagcaaattcagtggacccaaatggaggcgcagcagcagcgcctgacgacgaccctcgttctcctgcttgccgccgtgctcttcgtctccgccagcgcgccgtcgtcgtcggaggcgcacgaggccactcccggcctccacccggtcatactgctcccgggctacttctgcggccagctggacgcgcggctcaccgacgagtacaagcctccgacgcccggctgcggcgtgcccaaacaggggcgccgctggttccggctgtgggagaacttcacggcgctgcaggaggaccccgcgctcctgccgtgctacgaggaccagctccggctcgtgtatgaccacgccgccggtgactaccgcaatttgcccggcgtcgagacccgtgtcgtgtccttcggcaccacccgcagcttcttcttcgacgatcccgccaaaaagaacacctgcatggagaggctcgtggaggcactggaaggcgtgggctacagagagggagccaacctgttcggcgccccgtacgacttccgatacgcgccggcggcgcccggcgtggcgtccatggcgttcgccgacttcagctcgaacctgaggctgctggtggagcgcgcgagcgtgaggaacggggacaagccggtcatcctcgtgacccacagcttcg

SEQ ID NO: 24714 - DNA, 372 bp, Sorghum bicolor
  Clone ID: 30940497
aagaatcagataatagtattgactcggtaaatcgcaatgcccataggtacatgtgctgcccttggcagtggttgggattaaactacgtggggttccctccagtggagacagatcaaacgtccaatgagatggagctatttgaccccctaataatataggccctccatatttatacagattgcagatatatacagatcctgctttttcactagaagtgggccagtagaattttgtttttggtttgcgttcttatgtagatgttttcccaatttgttgatgcatgttttgtggaaaactgactggtgctggaaggcccccgtgtaattgtaaaagtcccccttgggatatagtagtgaagatgttgagaagtcc

SEQ ID NO: 24715 - DNA, 224 bp, Sorghum bicolor
  Clone ID: 30940512
gggacagctacccccccccggagaaggcctacaaggtcctcgccgacttcgtctttgacaattacgtcaagctcatcctcgtctgattattcgatcgattgatgatcgatgatatatgatgaatatagatctccggccggcctttttggatcggaatatgctttgcattaattgcatgtttactgctagccgcggtatttaattacatttgctttcttcttctc

SEQ ID NO: 24716 - DNA, 625 bp, Sorghum bicolor
  Clone ID: 30940535
acatgttggtcatagtaatcaacatttgtcattaatcactgaaactcattaggggcctagatgcttttagcaaggaataattagctcggtatacatggggtactctccccaagctaggtgttgacatggtctgctgaggttgctgatgggcactgaaggcgtattgatcctccaagagtgtcataggtacttactgttagaaatagtgcttgactggtgcagatagtactcggacacgagacatgatattcttttgcctgttaactcttcttgatcctttaaagtctgtgaagctcaaatatgttgggaatatgccctagaggtaatcatagagatgatgaaattacaattgtatccatgacatatattatgagttgagagaatatccattatagacaaacttgtattgattaacaaatatttgaattgcttgtgaaactcttttacttgtatggttattctaaagttgtccctgatcaggttttgtgtgaggatacacatgaatattagattagcacatgtagtagttgatgactttgtttcacaagtcatagacatagagatgtcaaactaataatgtgggcacatgtatgacatggggctagactgacccaacatgagatgt

SEQ ID NO: 24717 - DNA, 406 bp, Sorghum bicolor
  Clone ID: 30940578
agttccttttattttgggaacatttagaaatcctgcagagcatccaataattgcccctccagggaaaactggatatggtattgactggaaacccccttcattgagagtacgcgccccatactgaatagctgttcccccttccaaaagttttttgacagcagggtgctgcttaaatttttggaattcatcatagggactaaggaaaggatttcgataattcaaagcaacaaccagaccaatcgctaactgtttatcatcaaggtggtataggaatgatcctccatatgttttagtgtcaaaaggccatccaccagtatgaataacagaacctggcttgtgctttcctttttcaatttcccaaacctccttaattccaagagcatatgtttgatgttgcccttgcccc

SEQ ID NO: 24718 - DNA, 645 bp, Sorghum bicolor
  Clone ID: 30940582
gcagcaaccgtaacatgcatccttacgactactagcaggcgttaacatatcaaagtgtaagatagaaatgccggcttcgattcactaacaaggaggcaggaaaagacctaaaagatcctctccacttgaagttgtaccaatggtatatgatatcgcctttccctttccgatcttttgttcaaaggtgctttaattgcgaggatatggtaagcaataacctgctcatgctcctacatctttcaatgccccctatgagtgtgagtgatggagagagctgctaaagagtctggcatgctctcataatgtttctttccggggctgtagtgcactagccatacactttgtggtgggggctgcttttttggtagtggatgtttggactaatcaaaagggattgatgtatgagtgtgtctgcggcctgcacaaatgggttgacaaagtttgaatacaagatgaaatggaagatgatgttgatagcgatgttctttcttctccatttttccaaagtggagggccgagtctttggtcaatggaggctgagcatgcgtttcagcatgctagtggatctgctatctacgtgcaatcctttatttatatggatccacactcttgataagaacattcgtataaagttgggatgagatt

SEQ ID NO: 24719 - DNA, 487 bp, Sorghum bicolor
  Clone ID: 30940594
tttcagggttttgtcagcccagcagacagaacttatgacgcattaggattagtgaagcatttaagtaagcccagtgctgctgctgcagtggaggcctgtgaggtgctagcaagtggcaacaggacttttgataaggaaaacaaggataattctgatggcaaggagccagtggcaagaaaatcacaggtcaaaatcatggccgaggcgggagtcctggatttcgacgaattttccacccctgcaaggacagcagataagaaatttggcagctgtttcgggagatttgttagctcacccatttttccctcccccaacctgagaagtttccgataggtagaattttgagagataccccagatatggtataattatacattagccgtatgtacatgtatatgttcctagagcgcattgttctttcattactctatgttaccatgatgtcagggtacagtcagcccagaaactagcatccaaaaggcagcag

SEQ ID NO: 24720 - DNA, 575 bp, Sorghum bicolor
  Clone ID: 30940626
tgggtgtttgagcagggagattgcgtcatcgtaaaaagcttcaacgagaagaggatgcgagagaacctcgacatattcggctgggagctcacggaagacgaccgtcgcaaaatcagcggcctcccagaatcgagaggaaccttcgatttcttcgtccatgagtccgggcctttcaaaaccgccgaagagttttgggatggtgagatcgttgctggccaatccactaaccaagttgctgtccgtttggatccgaccagcttacagtaaactggatttaaattaaatggatttcatcttgatcggtgacgagcttctctcagtcgagttccatcgatctaattctaattaagttggatttccagcaagaataatatggagataaatatataattgcaagaatggttctcccatgtatcaacggcatcttccttcactattacatgcggttcgcaactcctttgtacaggcggattgataaaccgccagtgactataggcctgtggaaataaatgtttccacatgcggttaaatgagaaccgtctgtaggcggttcggttatgtgaacatacatgcaa

SEQ ID NO: 24721 - DNA, 581 bp, Sorghum bicolor
  Clone ID: 30940630
ttcttttactaatttttatccatatcagtcgcatggttacagttcaatgagttgtgtctgttgccctttttattgagagcataaagattgattatgtagtaatatgtttagcagttaagaatgttgacttgctagtggtgtgcctttttttagccattgtctaactccttttctgcttcagatttgtagagttgttcctatgttggctcgttttaatttctatttctcctctattcagttctctggagaaatttcatttgaattaaaagatccagcctgcatttacgtgatcttaaagaagccagatgacttgaacgcactttcagcgaatatcataaaatgactttctgaagtagaaaattcaatggtgccctgcaagcctccttcaaatgctcccaccccttttccataagtagtgttctatttgtttcttatccaaacattaaatgaagttatttgagtatctaggatctttttttaaaaaaaattgttagccaatatacttctgaaaataatacgtgttcctagttcgtcgtaaccaatctgtggttctttgttgtacagatcagtaaactggatgc

SEQ ID NO: 24722 - DNA, 588 bp, Sorghum bicolor
  Clone ID: 30940634
cctactggctatggtgccatttgttgttgcacaggaaatgcctgtctctgtgctatcaggtgtttctagcgctgagcagaaactgcacttaatctctgatgctgaaagtttgaaatctgaactttggaaagatgtttctttgcaaactcttatttcaggagttacagttgacgctgatgcttcaagattaaatcatccagattcttccaaaatggacaccaattttttgacacaggcctacccattacacacatcaaatccatccggtgtgatggaaactgtgtatgaaccgatgccgtcggagacaatctctccctcttttatatgttcagatggtttgtctgttgcacccgaaaatagatctgagccaagagaaatgccagactgtgaagcacagatggccacatcctcaaacattttttgtgatggcgatcaatctgctatacctggcagcagtgatgacaggccagaggctttcacgatgactgagagcattacaaactgtgggggtcaacagtcaacagatgccgaagaacctatggccactacagcaaaagaacagttatcgaaagacattgagactgtgcc

SEQ ID NO: 24723 - DNA, 504 bp, Sorghum bicolor
  unsure (1)..(504): unsure at all n locations
  Clone ID: 30940640
ctactggctccccaatctccacccgttccagaattttctcccttattccagcgtgtcctcgtttcgggcccgcggttccgctgttccacttcttttgatttcggagtggggggagcttacatcttgctggataaagattggattttgagcgatttgggggcgcttgcctgattcgccccccctgcgaggtagggccgggccggggcggggggattagatttcgggtggaagntttggtggtttgattgagattcggcttggccggagccggaatgacgatcgacatgtccatgcccgggagctccgggctcctgaacgctgcggggaagagggacatgaagntcttcagcaacccctacgntcttgcgctcacgggcgctgcaggaatcggtggattcctctttggctacgacacaggtgtcatatctggggcccttctgnatatccgagatgattttccagcggncagggataattacttcttacaggaaacgattgttagca

SEQ ID NO: 24724 - DNA, 591 bp, Sorghum bicolor
  Clone ID: 30940720
attaatttaaaacttttacaacaatatcacatgtcctaatcctactgctattggtatcgatctaggaaccacatattcctgtgtaggtgtgtggatgaacgacagagtcgaaattatcgcaaatgaccaaggcaacagaacaaccccttcctatgttgcctttactgaaagcgaacgtcttattggagacgccgccaagaatcaagttgctagaaatccaacaaatactgtctttgatgcgaaaagactgattggaagaaagttcactgaagacgttgtccaaaaggacattaaattatggccatttaaggtcgaatctggtccagatggaaagcctttgattgtcgttaagcataaaggcgaggtgaagaaattccacgctgagcaaatttcttcgatggttttgactaaaatgaaggaaactgctgaagcattccttaacaaaccaatcaaggatgctgttgtcactgtccccgcatatttcaacgactcccaaagacaagccaccaaggatgctggagcaattgctggactcaatgtcttgagaatcatcaacgaacctaccgcagccgctatagcttatggtctgga

SEQ ID NO: 24725 - DNA, 598 bp, Sorghum bicolor
  Clone ID: 30940752
gaatcctcgaatcgaatcgcgaccaaatcctcgcccccacgcgctcccccatcacccccaccccgcgctcacgcaccaacacccactccgttcctcactgcggcaatccaccgcccaacccatcccgccccacgtcttcggcgcaatgacggccgtcgcggcgccgccgccgccgcggcagctgagcctggaggacctgaaggcggtgtccgtgctcgggcgcggcgccaagggcgtcgtgttccacgtcgtgcacgcccctggcggggaacaggacggcgaggccggcgccgcggccatggccctcaaggcggtctcgcgggaggccgcgcggcacaagaaggcggccggcggcgacggggacggccaccgccggatctggttcgagcgggacgtgctcctggcgctgcgccacccgctgctcccttccctgcgcggcatcctcgccaccgacgccgtcgtcggcttcgccatcgaccgctgcggcggcggggacctcaactcgctccggcggcgccagaccgagaagatgttctccgactccgttatacggttctacgcggcggagctggtgctggcgctcgagtacctgcacagc

SEQ ID NO: 24726 - DNA, 598 bp, Sorghum bicolor
  Clone ID: 30940785
tggatcttatctcttccccgtgctcctcccggaggtcaccgcgatgccgccgccgctcgcgcccccggcgccgctcgcgcctccacttcctcttctactctctccttcctctctccatcccgacgctctctctcgctgtctctcccgacagccgcagggcgagggtgcccacgacgccgtatcggctagggcaggcccctgcccctgcccctgcctgcgactgcgcgcggaccatgcccccggcacggcgccggccggcgagcgtgcccctgtcgcccggcatggaggatgccggcgtgggccggtccagtcgtggtggctcacgcacgaccgaccggcgaggactccggcgcgactagccccaggatttttattaaaaacgcaatggccagagctttgccttttaataattgagaaaagtgtatcctctcaggatcctgagagccttcttgaatcaggcttcccttgtggtttgttcgtacgtgcagtcttatatctaattaagtgttatgggggcgtccaactggctaaattactaaaaagacgcgttcacagaattacttattggccgaggaagacattagtggagtcaaatctg

SEQ ID NO: 24727 - DNA, 602 bp, Sorghum bicolor
  Clone ID: 30940787
acgaccagcaaaccaccggaccacccccgtcaaggcccacagaagaagcgaaacggatagagggaaaaaaaggaggaggaaaaaatactagtagcgggcgacgcggccgcgaggcaggcaggtagaccacgccgcacgccagccagcggccagcgctcgccccgccgcgctccggcatttcccattctcccttcctccctgccgccgctcccccgtccttcccgccgcggactcgctaccccgcctctcgtctcgcgcactaaggagccaggtgccggttgccggctcgacctctccctcatcctcgcgggggctgctgctgctgccgcgagcatggccacaggcgccatcacgccgccgccggtggccggcgcgcggcgcgtcccccgtggacggggattcctccaccggcgcctcgccgcatcgcctatatgaatccatgatgatttccacagatggtagaaatgaggagacagacactgacagcctcaatgttgccagaggattgtctcaccctgggctttcctcaagtttatccaataaggcatcagtggccccaacccctttgcttccttctggaccatctgatctccggttcaatc

SEQ ID NO: 24728 - DNA, 604 bp, Sorghum bicolor
  unsure (1)..(604): unsure at all n locations
  Clone ID: 30940793
gagagcgaagggcgagcaaccagttaccgnttgccggcgagcacagtggggccccntcggtgccaggacatgngccgggcaaccgccgcctcagggcccggaagacgatttcttcgaccagttcttctccatggcggccggcggctcctaccccgccgcgaccgcgggcggcgggcgcgcaccgggggaccagcccttctcccttgcactcagcctcgacgccgcggccgccgaggcttccggaagcgggaagcacgccgacggtggcaaggatcgggaggctgtgcagctccccgggctcttcccgccggtgttcagcggcggtgtgcagccgccccacctccgccccaacccgcctacccaggtgttccacgcgcagcagccgaagcaaggcggggcgggtgtcgggccacaaccgccggcgccgaggccaaaggtgcgggcgcggcgagggcaggcgacggacccccacagcatcgcagagaggctaagaagagagagaatagcagaaaggatgagggccctacaggaattggtgcccaatacaaacaagacagatagggcagttatgctagacgagatcctcgattatgtgaagtttctg

SEQ ID NO: 24729 - DNA, 232 bp, Sorghum bicolor
  Clone ID: 30940797
cccgagaaaagcaactgtttgccgcgggagggagggagggaggagagccccgtccgatccggcgcagccgcctacgctcgtcaaacccccccgtaaaaattccaccccttttgcctccgtttttcagatcgccgtccgccgatttaggcgcatctctcgtctcttgtctttgctcgattccgccgcggcttccgtccgtggcggtagatcgattgcgtggggggatggtggt

SEQ ID NO: 24730 - DNA, 593 bp, Sorghum bicolor
  Clone ID: 30940836
gcattggaggagagcgtccgagggcttaaggacgaactcctagccgcccaagtcaaggcccgtaatgctaaggctcagctcgaggctgaggttgttttgaaccgtcgagtgcggacggcgataagcgacctctcgacctcctgggaggtcgagcctatggatgagtcgagggaggacgctcgaggcgacgcactggtcgaccagctgtgctacataggcgcgacgctatgagatcgggtgcgggatgccctccacatcggggtgaagcgggcgatggcagttgtctgctcgggcttctcctatgacatggaggtagtatcccacggcttcatcaccgacatctccaagaccgacgcagagaacgaagagaggctccacgccttgatcgacgacgtggaggctcctggagagaggttggccaagctatttgagcctgaggtgcttcctcctgagactagctcgggcggaggcgagggtggtgaggaccgtgccacgaactgaggcctgcgagcctccttagggtgcctagggccccttgtatgatactttgttaatcctgttgttaagcgatacagtatcttttgtaatgtaaa

SEQ ID NO: 24731 - DNA, 554 bp, Sorghum bicolor
  Clone ID: 30940838
ccccaccagtgacatggctgctacctggttgatggaatggggtttgctcccgttggatgtggctacaaaagtttttgagaagaaacaaggccaaaagtttaagtcaccggtcaaaacaattgtggcgaagagaaagccttgttctccaactccaaccaaggcactgccttcatccgcaaagaagtcagttgtgtctgtaacgagtgctggaaaacagccgtctcaaaagaagaggaaggcaagtgatgacacagatgacgatgacgacgacgatttcatggctcctaaggcaaagaccaagaggcataaggcctagtcttagcaatctctatcctagtaatgaggcgtgttcttcagacaatttctagatcagggatacccttcggaggtgatgagatggttgtttcttccattggtttgctcctttggagcagaactaattctgtgaagtggcgtgctgtatcaagaagtaccacttgttgaactcaagcgtgtcgatgtgttttctcatctggaatgaagggaagttcctgcaaactgtcacttcgttacca

SEQ ID NO: 24732 - DNA, 509 bp, Sorghum bicolor
  Clone ID: 30940860
gcacaaactcaaggaatgaaggtgctgtaagctgaatcccttactactggtggtgttgtgcaaactgaggagcagtggtggcagcaaaccaaacattggagagtattcactccatcctggtttggtcagccagcttcttgactggagcatcagattggtttgtctcattcaggcacatggatgtaatttgttcgagacattattggtgacgtttgctgctgtgctaactgaccgtagttgtgatgcagacaatctggatggagtgcttattggtgcttggttaagggcaatgttgagtaggaaatcattgcaacctatgccttaaccatcgcacttgtttgcagctgtcacactatgtacatatacctagtggtcgtatctgtgttcctcttccatttcattatatttattgttaggttggcctacaaacattttattccaggcagaatcatatgtacgaattggtgtcattcctagtgtatgttgaggcaaccagattttataccaaa

SEQ ID NO: 24733 - DNA, 609 bp, Sorghum bicolor
  Clone ID: 30940872
ttgctttcattacatacgtgtatttttttgcccactacaatttcttctctaccttcatttatgctaatttgttgtatttatgctttttagtcacaccaatttctattgagtctgtgttcagcctggttaatctcagaggaggtttgctaatctcacaggattactctctatgctacatttcatagtatccctatcataacacaggaactttggttccgtttactcagtgaggttgatctcaaaggagtttgactgattttgaaggattactctatctcctatgcttcaattatcttggtcattacacgaagtttcctatttgccctgcttctcagatggccaagaacgaagcaacctaaacaacaaggcaagggcagtagccagtggactttatccaaccagaagcagataccaaggtccacgtagagtgcattgtcttcaaacaagatatatggtttacctccagctcttacatgttcacacatgacaattgctatcttgccatgtatgctattaataactggattttgtttccatcgcaagctgttattgaactctgttataaaaaaatcatggctagagttttatagtatactctttttgatgggt

SEQ ID NO: 24734 - DNA, 571 bp, Sorghum bicolor
  Clone ID: 30940873
cagttcatccaacgatgagtccttaggaatttattaatactgtagaaccatttcaatatgatgatatgttaacagagcaacgtgtctaccgtcaattacaatttcaatggtgacatgaagctagcgactaaagataggaattaccatcagtgactactgtacaccagccacaggtgacgattgttgtagggcatatcctttgtatttttctttcacgaagattaaggtctggcatcgacaacatctctaatgtgatcaaagtttattagtgtccgaattatccgatgcacaaatcatttgacattgtatagcaaactgagaatagttgcttagggaaaaccttaaaaatctcatggcaattttgatagttgtgttgatctatttatcctttctatctttaccatattgattctcctttctcttaaatatacttgattacttgtaaattcttggttaatatattatgttttggattgttatagctatgggcaagattgtcgcttgactcttaccgagtgagcctacgtcgttgcgctctctgtgactatgttaatttcatgaaatctgcttt

SEQ ID NO: 24735 - DNA, 689 bp, Sorghum bicolor
  Clone ID: 30940877
atgctgagttagagggagggaggcatgattgcatgaaaacagtcgtcaatgatgaaactattacaggcaggaaacggggaagctgtaatgttaaaatctccatcataatatgactagatgacgacgatgataacaattaccatgaatgtcttttagttgctatctaatattattgctaccacattgctatctaatatttttttcaagattcgtttactttttacacaatactccaatttttcactttgaccctttacaagcaatcaacaaatcatcaatgttttggacaccactttagcaacactacccgtgataataccaatattactaccagtatgaaatgtctagtgatcatcacgatgactaccactaagggcagtcccaatggtaatttctagttgtagtttccaagagtaataaattcttgtatagatctaactcttccaatgcttagtttcttatagcagtttctataaagaataacatttaataaggtgatgcatgtattaaaaacttagaacaattagctgtgccaaacatccatgtaggaacccatgttgccacatttcaatcacgttgataacaactctgaacatgttcaaaactgaaagttcaaaatataacaatgttgaagagcctattcgaagacaacgatatagaaaaatataggtcccacaagcttaatataa

SEQ ID NO: 24736 - DNA, 647 bp, Sorghum bicolor
  Clone ID: 30940889
ttgataaataactaagaaagtttttttttgtcaattaattgcttctccccattctcgtgggtttttcaaataggtgtagctaaatatttcacaaagtctttttaaacagtattgtaaaaaattcatgtgaactttttccaagtctagcattatgcatgataatttccatatgcatgttgtctgaaagcagcagtatctcaaagcacctgcaaattcaaaacagaactagattgtaacttccaagctgctgcatttgtgaagaatactatattagttttacttcagccgattgcacttttgtcatgtttcactgcctgcagcctgcttcacgctttggctgtattatgcattatatgttcatatccaactgccaaggctgattgtgggatgttaaatgtgtcggtgaagtaaattattctgttgttgctcaatgtttgtgcactctgtggttccaatgaactattcccatccgcaaagctaagatcaactctgattgtgcccacaaggcggagtgtcaaatcttgtggagttgagctgggcacctaatttcttgatgttgctgctcaagttctcataatctcatgttatcccttataagtgcttcccaagaaaatttgaaatgttaattattataagacttccatttc

SEQ ID NO: 24737 - DNA, 576 bp, Sorghum bicolor
  Clone ID: 30940891
cttcatttttttttctacactgactttattcaagtatattttaaatccttaactgtatggcacgtatgcatacttcaaaaagctggattacttttccacagaatgcatctattcaccaaatgcataccgtggttttgctcgtgaatttattaaagatttagaaagaatgaggcctagagctatactggacatcataaaatctggcgaaaatttcagaatctccacaacaacaaggatgcccgagcaaggaacatgtgaacgatgtggctacatttctagtcagaaattatgcaaagcatgcgtcttgctggatggattgaatcgaggcttgccgaaactaggcattggaaggaccaaatcaggtgctggagctgacagtgatggtaagcaacgcaccaaacgttcagagaggaggaatacaagtctacaagggaaacatgggaactttgatttctagatctctactgctattttgctccaaaattgtaataatttttgatagtcattggccattaagcagattttctagtcattgttttatctgacttcagtctgcattcgtgaaccaaaagaatt

SEQ ID NO: 24738 - DNA, 275 bp, Sorghum bicolor
  Clone ID: 30940892
gaaaatcccttcatccccattatcagcagaatttaccaaggtaacggtcaacaacaacaagttggaggctgtggaatgtcaggcgcaggcggtttcccaggtggaaactttgcaggatccagtggatatagtgccggtcccaaggctgatgaagttgattaagaactttaatatcgagttaaatgttgtatataattatttgttagttggtttgttgagtaattatttttaagtattatcaattttatgtgtgatatataatgaaccattttggt

SEQ ID NO: 24739 - DNA, 639 bp, Sorghum bicolor
  Clone ID: 30940913
catgacgaaggcatacccaagtattgaaaggaatgatctgattttgctccaggagattgctagctacatgcttcttgcatgtggagctgtctatgtgatctcggggatattgtgcattggtgtgctaaaacgttctaggcagcagaaagcgacatcacgggagcaagcagtcaaggatttgcatgagctggagaaacggagagaagaacttgaggcattgttacttgctgagcggtccgagttggtctgaaggctgaccaccgtgatctaacaatctttagtccagtgtagataaatggttttttcccctgatgatagcgttctgcttggtcctggccatgagtcattattcatcagaagtcacttccttgaagtgtatcttcttctttagttcttctggttacagatgttttgttgttaattatcgtcatgcttttggcggacaggccttgcagctatcctcatggtttcagctgaattgtgggattctggtttcagagcattgtattgattcgttgttcgggactgtgttgtgtttcagttaaattaggtcatgagtttgatgtagcatgctgacctggccgtttaagcctgtcttgtatgtattgctgaataattcacttgaattttactcttaat

SEQ ID NO: 24740 - DNA, 588 bp, Sorghum bicolor
  Clone ID: 30940916
tttcaaggatgttgtagcagcttttgaggttgtcaactgcaatggcgttgaggtccaatgtcagggtacggcaccgacaatatcaattgacaacacatctggatgtcaattatacttaagcaaagaatcgttgggagcttcaattacttctgctaaatctagtgaaatcaatgtgatggttccaagtggtggcactgacggtgattgggtggagcatgcattgcctcagcagtacatccatagtttcaaggatgggcaattcaccacttcaccagtttcacactcgggagcgtaaatacaattgttactgttgtgtgtgtttgtttgactcgcctttgccttgtttttcaagatgatggtatgccgagtttgtaacagttttgggtcttgcagcactggactcggtctgcgattgttgtttttgttgcccttgctcagtgcgcggtgtgtatgttctgcatgcacgtggttccatttggttggtgtatttgtgtgccaacaaaccactatacgtggtgtgtatgtctttagctgatcattctttgacacggaatctcactgtatttgaattgatgtggacgcttgctt

SEQ ID NO: 24741 - DNA, 520 bp, Sorghum bicolor
  unsure (1)..(520): unsure at all n locations
  Clone ID: 30940918
gcgctcacgaacgctgcctccagttccagccnnttccaggctcgcactcgcacgggcctggcccgcccacngctccgacccttctcggcgacaagacacgtcgtaccggcacgtccccccgccctgtcttctgcccacctggcaccagccaccagcgggtccacgcttccaagggtttcaaactatcggcggcgcgagcaatggcggcgggggcccgggagcactggtagtttctcgtatcgcggcggcttgttggcttgatgccacctcgccatcgcagattatggggatcaacggcgaggagtgggaggggacggtagtggacggcggcgttcggaggtggaagggcggtgccgagggtgcctgcttgggcgcatcgtcctcctttgcggaggggacgggggagttcgtgctgaggtccatggacgccaggttctccggatcggtcgacgacgacgagttatttgtctcgtcgcggcagccagtatttgggcatagtaaatcgacagctgctacttct

SEQ ID NO: 24742 - DNA, 326 bp, Sorghum bicolor
  unsure (1)..(326): unsure at all n locations
  Clone ID: 30940956
atccaaatcccaccggaaagcgtccgaaccctaccccatggcgaatgcggcctcctccgcgtcgtcgccgggggccgggccctccacctcctcgtcctcgccgcangccggcggagagaggggcggaggcactccgcggcagcggcagggccggcccgtgcgcgcgggctacgacccgctcctcatcgtctgcggctgcttcagcgtcgtcacggccgccaccgcgctcctctgcgtcgccgtcaacgtcgtctcggcagtccagtcgttccgcgccggctccgacgtgcgtgacccgcctcgcccccagtgcgactttccctccc

SEQ ID NO: 24743 - DNA, 244 bp, Sorghum bicolor
  Clone ID: 30940960
cctaatcgtggaaagggatcccaaatccggcgtccagtccagtccaacctgtagttgataccccacgccggcttggctgtccgtccgtccgtccttgcccccaattccgattgaccggagaggagttggatcaggagggagcattggaatggccgccgccgccgcataggatggagctggattcctccggccgctgctcggctgcccccttggatgctgtgatcaccgcgattggaggtggagg

SEQ ID NO: 24744 - DNA, 333 bp, Sorghum bicolor
  unsure (1)..(333): unsure at all n locations
  Clone ID: 30940964
ccgtgtcnaatcgtgccagcgcaaaccccgcggccgatcccctgtgctctcgccgcccgcctcccccgattctgcagcctctcgctgcgaatctgggcgcgatttcgaggctagggtttgggaagcgggggatcgcagggccgtgcggaggcaagggtttggattcggaggttgctgctgcgggtcgggggtgctggattgagctactccgcgccggcttgtgatggtggtgagcggcggtggaagacgagttgacgtcggcggcggtggcggcggtggtgagtagggtttgttgattgagttgggggcgagggcgcgccggccatggtgcgg

SEQ ID NO: 24745 - DNA, 344 bp, Sorghum bicolor
  Clone ID: 30940986
cctcttcctcgcctctgccttcgtccgagcgcgcctcccccgccgcagccgctcctggtgagttgctcgacgtaatccggatcatcttacgcgggggaagcgcctcggggagcagtagatccgaggcggccggaatctttggggggggccgcatcggtgattccttcgctgaactaccagcagccaaacaggctgcttaggagcaaccttggacttggacctcaccagcacagtcaccttcaaaccatgtcatttttggttctagactcttagctgttagcttgagtagaacgacctaccaattgatcacgattaacagcacctgtacagaggtagagtcccgg

SEQ ID NO: 24746 - DNA, 306 bp, Sorghum bicolor
  Clone ID: 30941006
tgaactctcgccacgcgagttagcgatggccggagaggacgccgccgctgccgccaatcccgcagtcgcaaggaagctcctgaaggaggaggaggaagatgatgacgtattggacgtcgttcccctggcaatttgtagggccaagaaatctggtaatccgagcgtctccaatgttaagaaggaggaggaggacgactacgactaccaggaagactaccagctgatttcgcgttcccggcaaagaaccgcagagccgacgctcatctccctcgcagcgcctctcaggctcggtccctctccctcagc

SEQ ID NO: 24747 - DNA, 576 bp, Sorghum bicolor
  Clone ID: 30941014
tactggctcctccctcggtccctctccctcctctgtctgacccgaccctacccaatccaatccgaacctccgcctctccaatctccatgaccatgaacagcggctcggcagtactactagtagattactgctagattatactagtaccccattaacggaaaagcgcaggagagagagagagagcgcgcagaatggaatcgtcctctccatgtccatgactccatcactagactagagagagaaacccttgtccccttttgttccttacttttatccccccattcctccgagtcccctccgacccatcgccgagcgtcgagctcgcgtccaaggaagcggcggagaaggggagatttgttggcttccccgtcgggggcctagcctaggggagcaggagccaggagagatgcagcggcggcgggcccacacgtgggcgggggtggggaagacggcgcaggcggcggcggcgcacgccgcgctcttctgcttcactctcctcctcgcgctcatggtcgacggacgcaccacgtactcctggtggataatattcattccactatggctctttcatggaat

SEQ ID NO: 24748 - DNA, 268 bp, Sorghum bicolor
  Clone ID: 30941038
agctcctactggcttcggcgtctactccccggcgctcaaggcctcgcagcgctacgaccagggcgcgctcgacgccgtcgccttcttcaaggacgtcggcgccaacgtcggggtcctctcgggcctgctcgccgcgtgggcgcccgcgggggggcggaggcgcccctggctcgtcctcctcgccggcgccctgctctgcgccgcgggctatctccccatgtggctcgccgtcgcgggggtcgcgcccgcgccgctcccgctcatgtgc

SEQ ID NO: 24749 - DNA, 525 bp, Sorghum bicolor
  Clone ID: 30941048
tctatggtacctgatcagcgttgttgctgctggctacgcgagctggatcaacatctcatagtttgttgtgaggaagtcataattgagaagggtggccaaaggtttcaggagcttatcaccctatacagaattgattctgttctcatgaatatcatctatcgcctgccctatcactgcagcaactaggaggagaatcggcatgccttcatttttttgctgcaacctgtttatttagtgtttttccctattgtacaactatttcagagccatacactggattgaggctatataaggagcctcttagactaaggcatagactattactcttatttcaaaatggtgagttcaactatttttagatcctatttattctttctgaatatgaatacttatattttacaaagatgggatactattcttgtttcaatggtcagctcagttatttgaaatcctacttattctttctcaatatgaatttttttaatttatattttgcaaccacggaaaaaataaagcgtactacgt

SEQ ID NO: 24750 - DNA, 435 bp, Sorghum bicolor
  Clone ID: 30941050
ttctactattttactccgttccaaactttaggagatgcaataaatcaaaggcgagatggttgtgaagaaggggggaggataggggcatgtaccttcatcgcctgctaactaaaaaaaggccaccacgggggcggagttaaagtctgaaactgtttgatggaatacatgtattggattgcatggggatttattctcaaaaaagatgaggtactgcgatataaatctttatgccaaaaccatggaactctagaagagcaggttagtgatctttcatgcgatcagattcactagataaagcttggtaattttaaatacaaatacaaaactgataaaattgacctcttagctaatgaggcatgacaaaggaaaaacaaatataacctccaaaaatctccatttagctctatcatatgctttatgcatatctaatttcac

SEQ ID NO: 24751 - DNA, 501 bp, Sorghum bicolor
  Clone ID: 30941068
catgtaacataaaaaaattcagattcagtgagttcaatgtctgctatttcacatatcttcattgcctctttgttacactttatagtctattatgctaggtaatctgtctaggcctggtgtttttttcaagaatatcgaatgatatcatatctgctgttattgttgttcaagacgagacaatgcaccacagctgtttggtttgaacttagaaccacaatagctgtttggtttcagtcacactggtggcagagatggcaactagggaggcgtgtcgagagtgctggtgctaccccaacgattgaagcttgatagaaaactggtttttgaggcctcctcttagggaaacactccaatgattagatcattctcaaaaggcctagcgaacactcagcttaggtgttgaatcatgaagcactttgtcatgtttcagtaatcagtattttgtaatttgtaatcacgatgtaccttgcaaaaaaaaaatatttaaaaaggaaattttga

SEQ ID NO: 24752 - DNA, 647 bp, Sorghum bicolor
  Clone ID: 30941082
gcccaagagggaagaaagatgctgcaacggcaatttttaatctgtgcatataccagggaaataagatacgagcagtgaaagctggaatcgttatccatctgatgaacttcttggtggaccctactgggggaatgattgatgaggcactcactcttctggctattcttgctggtaaccctgaagccaaggctgtaattgcgcaatcggatcccatcccgccacttgtggaggtgattaaaactgggtctcctcgcaacagagagaatgctgcagccgttctgtggtcactttgttgcactgctgttgagcaaacgagggctgcaaaggctgctggagcagaggatgcactcaaggaactgtcagattctggcacagagcgtgcaaagagaaaagcttctagcattctggaactcatgcgtcaagctgaagaagcatgaacctgagtatagtagatttgtgaggttgtggctttgttatattgtacacatagtcactaaattcttatgaatagtgttgacatttgagatatatctgtaggcagcagatgtgttagaattttctgtaaacatataaattggatgtataataatgaaagtcagcccaaaagtgtacttcttattgataaaaaggatagcaaatacatttgt

SEQ ID NO: 24753 - DNA, 524 bp, Sorghum bicolor
  Clone ID: 30941135
gaaaggcgccaggagctgcgtcgaatgccgcgccaccactacgcccatgtggcgcagcggcccgaccgggcccaggtcactttgcaacgcttgcgggattcggtaccgaaagaagagaaggcaagagcttggcctagaccacaagcagcagcaacaacgaaataatggtgaggcaaaggctgaagtaaaagacagctctagcaacagcagtagcagcgggagcagcaacttgcaggtggtgcagaaacggaggctcctcatgggagtggaggaggctgcttttctgctgatgaccctatcttcgcccacgttcacattgctacatggctaagagccctccaacaccaaatcaacaatgtacatacacagacacaccaacctttgcacagccactacccaacgattccagtccaaatcatacaaagttactcacacctgtatgagatagggagggagggggcctatctcaggattgtgtgatcttgtgataggcatgggttattagtgccaacctaatcactcca

SEQ ID NO: 24754 - DNA, 696 bp, Sorghum bicolor
  Clone ID: 30941147
gaaccccgggaataagtgaccttatagtacgcttcactggatatgacagatggttcaaaccttggagcctcatgatgacatttcgtgggaaccctctgagttctgccataatcagctaaaggagttggtgataattggttttcagggagcggagagacagatttactttgttaactttgttattaaagtatcaacgtcattgcagcttgtttccttgtacaaaaatggacatgttcaggacagggggcgctggaactgggacattgtgacacagcaataccaatgggttaaagaggagaaggttaaaatactgaaccagattgctgatagcgctccttgcgctgctacacccgttcaggtggttctggaataatctccaacatgcacgagttgaataaaatacataggttatgtatgcataaatactgctcccagattgatctatgtaatttataaacctgtttcaaggagttatgatgtgatctcctgtgtgttgaataaattgcataagtcatgtcttatgtatgtgtaatttgttctcccgatgtaaatgatgtagcatgcaattctcttactgctcaattgatccacttattatttctgtactatgtagcacgtgaatcaaatactgcacatgttaacctgtgtactctattctctagtgttctacagtttacattttgcattatattcaca

SEQ ID NO: 24755 - DNA, 506 bp, Sorghum bicolor
  Clone ID: 30941150
caagaatgaagatcacatggttagcagatatggaggagctagtgcccctctcattggtggaattcgattatctcatctgcaagaaaaagctggaggaggatgaagacttccttgagaatcttaacccttgcactcgacgagagaccttggcccttggagatgcaaacatgaggaatgtcaagcgcggagagatcatacagatcgagaggaaaggctactacaggtgtgatgccccattcatgaggtcgtcaaaacctgtagttctgtttgcaatcccagatggtcgacagcaggcctcgctgaactaggcagcgtgccactgatgggcacatggatgatggaactactgatttgtcagctccatggtcaatgttgtcgcattagacacttaacctgatactgcaatgaggcttacatgccatggatttttgttcagtgctagaggggcaggtgcatcctgtgccacccaaccagtaggaactaccaaattatttctatttccatac

SEQ ID NO: 24756 - DNA, 234 bp, Sorghum bicolor
  Clone ID: 30941172
tccccttcccttccccgcaactactctctactctctactacacgcttcaatctatctaagaaacagacagaccagaccacgcacgccggccgaaaaccagaattcacgaagcggtcctgtcgccaaccccggccacacggatcgggggctgtcatctattgccgccggcgccgatcgacgccgacgccgatgggctccgccgatcgcagcaagatcgatgggatcgtggtggcg

SEQ ID NO: 24757 - DNA, 533 bp, Sorghum bicolor
  unsure (1)..(533): unsure at all n locations
  Clone ID: 30941188
ctccttgacgcaggaggtcgcgagctgccgccgccgcccaacctcgccccttgctggtggccgcacgccgccgccggctgtccgctgccgaccgcccggttcagctccatccacgcaggcctcctccaccctcgagggcccctccgcctgccgcccttccctggctcgacggcctagggtttggggcggccgagcttcccaccagcggtctcctgttggcccaacgcaagcaggccgtccaccaccgggttcgtcgtcggtgacacttgcaaccgcccatcctccaaccgccgttgggacgccgtgcgatgcggatgcctccatgtagccgcaaccgcaaccgcaggcccggggcaccaggtaagcgcgccaccgccgctttccgnccaattcgccggcgccgactcagctttcccatttctaggaaagggtggtgcgggcggcgcgggttgcgcgcttcctgcagtgacgaccgcctcagcgccctcaccgacgacctactgctcctcatcttgcgccgcctcgacacccgc

SEQ ID NO: 24758 - DNA, 507 bp, Sorghum bicolor
  unsure (1)..(507): unsure at all n locations
  Clone ID: 30941190
tttctgcctccgttcttttgctttcgttgtgagcgttaagcgaacctggtgagcgccgccgccgccgcctttcgactggtcttcgcagcggacgagcaccccccaggtttgtctgtttttaaaaagggtcaatggaagcaaaggtgggattctcccaggaaagcccaccaatttccatcatttgtgcggctaaggttgcagatgtacccctgaccattgatcctagtcttcctacgggctctgcacccatcctaaagtttagttctgggttgttgaatggcttgattatgcccccactttcttttcaggctctgaatttgaaaatgcctgctcattcgttgatggattcctggcatcccggacctttctggtcggncatggtctgacagttgctgatattgcagtgtggtcaaatcttgctgggattggtcaacggtgggagagtctaaggagatccaagaaataccaaaatcttgtccgctggttcaatagcattgatgctgaata

SEQ ID NO: 24759 - DNA, 459 bp, Sorghum bicolor
  Clone ID: 30941224
cccctcgctcgggaaccacctcgacgagatccacaccgagctcctcctcctccaggagccccacgccgccctccatgccgccagcgccagtgccaccacagaccatctcctgaacgggggggggccctcgccgacgcacacgacgcgttctaagaggcgctgctcgaccttaggtgccatgccgccaaggtccagaccatactccggctctgcaaaacggccctcctcgagtccttggtcggcaccccagcacgacaccgagaaggacatcgcctgccttgcatcctccgcgtgcaccgccgcccggctcccgcaggtcaaatctgactgccgaagactaccagatctgcattatttatatttctgttccatgagaaaagcctcattcaagtggtgaaaatgctccccaataagatgccaagggaggagaagcaggccctgatcgaggtcaccattgcc

SEQ ID NO: 24760 - DNA, 331 bp, Sorghum bicolor
  Clone ID: 30941230
cccccctcaaacccacggcgccgccgcaggcgcggtcacgagcttgcggagacgagcacctccttcccgccgccgccgcctccgccgcagaggcaattgccgatccggcgactagtcgcgagtgaggaggcgatgagaggccgcgcgtctcatctccgcgcgctcctctcacgagcgctctctcccagccttcctccgcctggtcgcgctctgcctcaggtactcggcggctctcccccgtccttggcgtccgtcgaccgatggatctctgctcgcccttgtgggagtggcgctgagatgttcggaggagctgggttcctggggcgcgcgc

SEQ ID NO: 24761 - DNA, 326 bp, Sorghum bicolor
  Clone ID: 30941232
ctctttcttctctgcaagctgcacatcctcctccgactcccggacacgacagggcagcagccaagcccagagcaaacaatcccagtgcgattcgccgattcgcttccgtatcacctgggggggccaccggcggatccatcgccccgtaggccgttaaccgtaaccttccgccggccgcttccatggcggccgtggcctcggccgcgcggccgccaacgccaacaccggcgccgccgccggcgcggctggggtcgctgtggtcgacgctggaggaccagcgcggggcggcggtcccgctgctctcctcggcctggaccctgccgacc

SEQ ID NO: 24762 - DNA, 319 bp, Sorghum bicolor
  Clone ID: 30941244
tcctgcttgcccctgtcgtcctgcggttttggcctgactgcccccggcatccctcccggcggcatcgagacgaccagtcagtcgatgcttcgcgagctggaactggacgccggccgacccgctgggggaggcggcgagttcgacatggctactcccctgattgctgggttgtcagtggctgctgctgcattgggtggacgatccatgattagagcatggcaagccttccagacccgggcagcaatgccacgggtgcgccggttctatcctggtggatttcagggggaaatgaatcgaagggaggctgcattaatccttg

SEQ ID NO: 24763 - DNA, 509 bp, Sorghum bicolor
  Clone ID: 30941248
ccgtctcgttcctccggctgccccacttctcctccggcggcgccgcggcgggcaacctcccaaaatcacggccatggaagccgacatcgcttcgaggtatgagatccctcggaccgctcagttccgtggcgactgcgcctacaacagggtcgcgctccagttccccgacgagatgctcaaggacgccgcggcggtggcgagggcgctgcggcgggagcttgcctccggcggggccggtggtggggtcagggtgttcgtgatggccgacacggcgtacaactcctgctgcgtcgacgaggtgggcgcgtcccacatcgatgcgcagtgcgtcgtccattacgggcacggctgcatgagcccaacatcaagtactacagaagaaaacacaattcctcagtcgagtggcacctcttgtaacggagatatcacaagaaacagcgatgtagcaacattcctggacaatcattatggcatgaaatgttccagttctacacaaaagtacagccttg

SEQ ID NO: 24764 - DNA, 348 bp, Sorghum bicolor
  unsure (1)..(348): unsure at all n locations
  Clone ID: 30941254
cccccattgcgttcctcgccctcttcccctctctcgggtctcggctctagccgtcgccgcgagcgagatgcagggcctcgcggtagcaagcccgcttcctcccgccgcggccgcagctcggcggcggccgcgcgcgtcctgggggaccagggaagcagtttcacaatgctggaagtacgaattaagtcgagatcaatatctaggaggcttcctaaggataagtcagtctcaaggaagcttgcacagacatcgctcaacaaatttgctcagaccagctgctgcagctatttcagttgaacnagatgaactcaatacttatcttccaaaaggtgatatgtggtctgtgca

SEQ ID NO: 24765 - DNA, 336 bp, Sorghum bicolor
  Clone ID: 30941283
acactgacactaccattctttctttctccgcctcccgtctctcacctcctctgtctcttcgcaccttcttccatctttttccagcctcccctccccggacctcttcctgctcagccatggcggcggctgccgaagaagggccagagccactcaggtatcagactctggccttgagggtgagcatccactgtgagggctgcaagaagaaggtcaagaaggttctccacagcatagaaggtgtgtacaagacggacatagacacgcagcagcacaaggtggtggtgatcggcaacgtctccgtcgacgcgctcgtcaagaagctcctcaagtccggga

SEQ ID NO: 24766 - DNA, 626 bp, Sorghum bicolor
  Clone ID: 30941309
gagaagtaaaattggaacattcatcacatttgtattagtgttagggtacttactcccattaatatcctaaagctgatcgaattcaatataataattgaaagttgccatataatctaatagaagaatttgagtcagtaaccaaacagataatttcttttatgctggtgttctgaaatcttctcttattgctgagcatttgctagcatgatctgaatcaatcggagatatctgttcccattcacaatttctctacatcaaaaacaatcttttaaaggtaaaacatgtattctgtgcaactgcgtgcacacattgccagaattggttatattgtcacctgcgaagcaggtagcttctagttttaatgggaaaatcttttccaaaaaaaaggaaaaaaatgtttgcactggtgatataaggaaaggcttgtttgagccctactaaaaggtcatgataaagccatcatgtattttgcttttgcatggagctcattttcatccatccaaatggaaagataaggtttggataaacatttgaccttgtgtgcattttgaactgattatataaagcttgacatccatttctttatgtatttctctcatctgaaatcaacattaagaagacctatg

SEQ ID NO: 24767 - DNA, 583 bp, Sorghum bicolor
  Clone ID: 30941317
catcaagcttcatgggaaagagaaactgccagtagaatacctgccacagaggagaagaaatggtgaaaaggagaagaaagtaaagcctgtggaagcttctgtcactgataaatttaaaaaaggagctgagaaggaaacacaagaggagaagaaggcaagaaaggcagcagtgaaagaagaaaaaagagaggcccggaaagcaaagaaagagctcaaagttctgtataaatcagaaacacagaaggctcagaaagttgctgctgttacgggaccatcttccatacgattaatgtgatggttgatctgtggcacgtttactgatggaagtcttgaaagaccgcctggacaaatgcatcacagctaccaaagatttatgataccaggtcatctgtgccatgctcgtggattttgttgacaagatactcaatgcatagtccttgcctttgagttatgcaattctgttgcatcatagagcttttgcgtcttctggaaacacgacgcttgctatgctatccaaaacagaggcattgtagcactactatatattaattcagtttgaaggagaagatagaaatttaaaaaa

SEQ ID NO: 24768 - DNA, 567 bp, Sorghum bicolor
  Clone ID: 30941328
gatgtggtgcaatggacttgtctgtggaccttcagtactgttcttgacatatattcagggtgacctaaggaggaccgtggaatttccgtacctttactcccctgggttcatggttgtgctgctattttcgtgcatcttagcatttctactgaactacactatcttctggaacacaatcctgaattctgcactcacacaatcgatgtgtgggaacttgaaggatttcttcaccgttggaattggttgggttctatttggtgggcttccttttgatcttcttaatgttatcggacagggattaggctttttgggctctggattgtatgcctactgcaagatcaaaggaaagtagatgctgatgtctagtgggaacaactgggagtagacgttgggtgtgacttggtgtttcattcaggggccagtgtgcttaacaaaagtagcgttatttatgctgtttgctcctacatatgggagagaaattttgtaggtttcctgtattattaaacttcagccctcatgaacactacaaaactgacaaggaaatagagtataccggatttttacttt

SEQ ID NO: 24769 - DNA, 537 bp, Sorghum bicolor
  Clone ID: 30941352
accaaagctgcgcatggaggctgttgcattagagaacttccgcgcaagagcattttcattgctgtcgatcgctggactatctgggttttgccagctgagcattccactgggcgtgcgcggtggtgttccggtgtcagtctccctagtggcatgccatggtgcagaccgtttcctcctgagtgtggctcaggagctgtatgagacgctcaaagaggagaccaagaaagcctggagctcaccagactcctctctttgagccatcaatcatttgcaaagttcaggtttcatcggttctcaatcgccctgtgtcctgcacaactgcttgtggatctagtagatattgttgtggttcaggcgtactggatccgtgtgaagagaaaatatgtttttgccacatatgcacatactacaatttgctgcttctgtatacatatggtgataaaagagtatttactacaaattcaggcatgtactggaaaatgacagcagtaagtccaaaattcgtggcaaaggaatttgtgtgtggagaatttgtgc

SEQ ID NO: 24770 - DNA, 255 bp, Sorghum bicolor
  Clone ID: 30941354
aggaataaccctctagctggataggaatcgattggaatagccgtctctcccggatagtgagaacttgacagagcagcggcaaacttagcattcactaagtacaatggttcttgataatgatgttgaggatagcaaggaagaacatatgataaaccttgatatggctattatcgcttgtaataatcaagtgaagtgcttagtctaggtgctaatttagtggtaggctaatgatgattaatataatgcttttacaat

SEQ ID NO: 24771 - DNA, 619 bp, Sorghum bicolor
  Clone ID: 30941383
ggtgacggtggacagggcggcgtggaacatgctggtggaagggtactgccggctggggcaggtggagacggcgaagcaggtggtggagaggatgaaggagcgcggcgtgcagccggacgtggcgacgtacggcagcctggcgaagggcgtcgcgatggcgcgcaagccaggggaggcgctggtgctctggaacgaggtgaaggagcggtgcctggaggaggccgacgaggagctgctgggggcgctggcggacgtgtgcgtgagggcggccttcttcaagaaggcgctggagatcgtggcgtgcatggaggagaagggcatcgcgcccaacaagaccaagtacaagaagatgtacatcgagatgcactccaggatgttcaccagcaagcacgcgtcgcaggcgcgccaggaccggcgtcgggagcgcaagcgcgccgccgaggccttcaagttctggctcggcctgccaaactcctactatggcagcgagtggcggatcgagcctgtgctggatggcgatgacccaatttgacttgagccaccgtttctgctatgagcactgtaccctgctgcatgaagggaatttttctcaaacttacaaaaggaaaaatatacttca

SEQ ID NO: 24772 - DNA, 507 bp, Sorghum bicolor
  Clone ID: 30941397
agtaattttttgtctttccaaagattgctccagttattcttaacccaaaagcaatgcaaagtacaagctaaaatatgccccaccactaacatactgcatgtagtccttgtaatttcgcaagctcttaattatgtatggtcttaatttctgaagtaatgtttgctccaaaaatagtgatccaaatagcaaaataagagataacatctcactttgggtatcagatttgtgcctacaggttcttattgtggtttaaattctcttccctctcctgataatcatattatctgttgcattgggatttacctattgttaagaaattagaatacgtcgtctagacgagtggacatgcttaacttaaacattgctctgtttatttttacaggaacataatgtattaggatttgaaaaaggtcaaattcataaatgttgactaatagctactcagattatgtttatgcttagtgaataaaagttatatcaatagattcagttcaaaaatcttttaat

SEQ ID NO: 24773 - DNA, 511 bp, Sorghum bicolor
  Clone ID: 30941421
gttgcttcccctgcattttatgccatttggaaccttttttcaggatttttaataccaagaactagaattccagtttggtggagatggttttactggatttgcccaattgcatggacactcaacggactggtgacttcgcaatttggagatgtaaccgagaatttcagtaacagtggggtgggtatatttgactttgtcgaagactactttgggtaccatcacgacttgctgtggctggttgctgtggtggtggtcgcattccctgtgatttttgccttgcttttggggctttcgctcaagatattcaacttccagaagagttaaactgtgagacagcttgattaatcccgatgctcaaatagtgcaggcgttgcggaacaatgattgcattgtatgtaaatagcgtattcattagtcagagcttgtcaagctagagacaaattgtatagctgatagaggatattgtccctgttggtgtaaagttggccgataatgcccaattcctgggggg

SEQ ID NO: 24774 - DNA, 755 bp, Sorghum bicolor
  Clone ID: 30941450
cttgaaatgcaagaaagaggaaagggtcaagcagttctcagatattagatcgcagattgagaagatccgctttgagttaagtgaacataacgatcagggtggtaatgtgagcagtcttgctgctgaggaacatgatttgtcaacaaggaagcttaatagttaccaagcacagcttcgtgcccttcagaaagataagtctgagcgtcttcgcaaggttctggagtatataaatgaagtgcattccttatgtggagtccttggaattgattttggaagtactgtacatgaagttcatcccagtttacatcagaatggtattgagcagtcaagaaatatcagtaatagcacactagagggccttgctactacaatttataagctaaaagcagaacgaaagtcaagaatccacaaggtgagagagacaatggaatcattatgtcagctttggaaacttatggactctcctgaagaagaaaagagacaatttagtaaagtaatgagcattctcatattacctgaggagggaatcacatcacctggagttctctccaaggacacaattgataagatggaagctgaggttgagaggttaacaaaactaaaaaccagcagactaaaggaaattgttatgaaaaggagggcagaattagaagagatctgccaaaatgcacatatagaacctgatgtcagcacagcccctgaacaaactgatgctttgatcgattctggcctcatcgacccttctgagctcctgg

SEQ ID NO: 24775 - DNA, 312 bp, Sorghum bicolor
  Clone ID: 30941470
tactggattggtgtgggtgccttttttggatatgtgctgctattcaatatactctacactatctgcctcacattcctcaagccatttgacactaatcaaccaacaatttctgaggagacgttgaagataaaacaagcaaatctaaccggtgaagttttagaagcatcatcgagaggacgggttgccaacactacagtaacagctagaagtactttggatgagagcaatgatgaagcgacagtaaattccagtcaagtcaacaaaggaatgggccgcccttttgtacctctctccatcacttttgaagatata

SEQ ID NO: 24776 - DNA, 518 bp, Sorghum bicolor
  Clone ID: 30941478
tactgcccgactcgaccgacggctccacctccactccgctccgctcccaaacggtgaagtgagccggggcccgtgcgtgcctgccgtcccgtgaagccgtgctcgtgaccgcccgcttcttctccctctcgccatcccttctgctagcgccgcggcggaggcgcagatccatcgggggaactcgattccgccaccgcccccccctttcctaggctgggattggattggagcgtagcctcttcccagcaccacgcgaaagccatgaccattaagttgctccgctgacgactcctcggacgacagcacggctgctctgaccctctcgcccacgctgctgccctgacaggtaaaagtcaggggtcaataatcatggacagaagatccggggcgatcctagcgtgcctgctcgtcgtcgtcgtcctggtccgggacgcggcggcggtcgccgagactgagcctggcagtgtccggctagtgcaggaggcgccccataggaaggtggtggaggatgggtccgc

SEQ ID NO: 24777 - DNA, 571 bp, Sorghum bicolor
  Clone ID: 30941492
cccagcacgcacgcaccacgcgcccacgcccgcgccggcgcgccgccgcaggccgcaccagcacggccatcttctccccgcaattcaaggcggccccgaagctcctacgacctcccggaagggctgcgaggccgaggcgggcgcgggatgtgggggcggcactactggggcggcggccggcggccaagctgggcgcccggaggcgacggcgccggcggcgtggtggtgatgttcgcgtggctgtccagccaggagcggcacgtgcgggcgtacgtggagctgtacgcggcgcacgggtgggcgtgcctcgtctgccactccgacttcctcacgctgtttttccctgagaaggctgccatgctcgcatacaaggttcttcagctgattgagagaagatgtgaagggcaactaagcctggatgagtaccagcttgtacgagattgtctatgtggacaaatttatgattcaagccctgtggattttgtcagtgacttaggcactcgcttcctcctccatccaagtgtcctgaagatgtctgaacctcctcgtgtcttgtcatggatgactaagg

SEQ ID NO: 24778 - DNA, 512 bp, Sorghum bicolor
  unsure (1)..(512): unsure at all n locations
  Clone ID: 30941498
gctctgccgccgccaccatcaccgccgacgatatgggaggaagaggaggagacggcggcggccgcaaggcccgcaacttcgcgaccttccgcctcttcccgcgcgccggcgccgccgaccccaacgaccgcgtcttcgtacgcgtcgacaacaacgactacaccgtccccgggttcgccgacgaggactccttcgacccatccctgtccgacccctccgcgggcgatgccaacttccactccgcctccggctccctcccggaacacgttcgccgcgagatcctcgagntcggncncccagacgatggttacnactacctctcccacctccgcgagctccgtcccaccgccgccgccgcctcatccttcgtccccagctccaccgctcgccccgagcccctcccgctcgatgtcaaggcttacgatgcaagtagggtacgggttggtcccagcgatggtgaactggacgaggggaagacgatgtgtaaggtggctgccaagactgcaccactg

SEQ ID NO: 24779 - DNA, 558 bp, Sorghum bicolor
  Clone ID: 30941512
ctactggatcgggggcctgggacagaaatatcctcctgctgctcctcggcctcggcgtgctcgcggagtcgcgggcgggcggagcaggaggggcgaggaggcggatcggggagcggagatcccggcggccggagggatggcgaagggcggcggggagaggggcgcgctgctgccggtctcggcggacgacgacgggaagggcaacggcggagggggaggcggcgacgatgccgtgctgttcaagggctccgccatgacccgccgcggcgccgccgccgcgctctcctacatggcatgctccgtattgctagtgatgtttaacaaagcagctctgtcttcgtataatttcccttgtgcaaatgtcatcacgctccttcagatggtgtgctcaacgtgccttctttatgttctgagacggttaaagatcatctccttcacaaatagtgatccatcagggccttctgattcactattctttgtgccgtttaggttactgttgcgcaccacacctctttccttggcttatttactctacatgctgggcttcgatggaatcag

SEQ ID NO: 24780 - DNA, 588 bp, Sorghum bicolor
  Clone ID: 30941536
ggaagagcgatagccgacgggaactggcaaggcatggcgatgggcggcgactacggcgcgttcatggagaaattcgagctgctgcctccgcaatctcagcagcacctcccgcttcacggccttaccttcgctgtcaaagacatcttcgacatcagcggccgtgtcactgggtttggcaacccggattgggcgaggacgcatgcccccgccggcgccacctcccccgtcgtactggcgacgctggccgccggcgccatcagcatcggcaagaccgtcatggatgagatggcctacagcataaatggggagaacgcgcactacggcacgccgactaatccgtgcgcccccgatagagttcctggagggtcttccagtggatcagctgttgccgttggcgcaaaactcgtcgacttcgctctgggcactgacactggaggtagtgtgagggtacctgctgcctattgtggcatatttggactcaggccttcctatggattggtttcgacagaaaatgtcatcccaatgtcacagatgtttgacactgtcgggtggtttgctagagatttatctacgttatctcgtgtaagc

SEQ ID NO: 24781 - DNA, 585 bp, Sorghum bicolor
  Clone ID: 30941562
ctactgggcagatcgacatgggcttcgccgctgctgccgccgacgacgccggcaagccgcacgccgtgctggtgccgttcccggcgcagggccacgtcacgccgatgctgaagctgggaaagatcctccactgctggggcttccacgtcaccttcgtgaacagcgagtacaaccaccgccgcctgctccggtcccgcggcgcgggcgcgctcgacggcctcccgggcttccgcttcgccaccatcccggacggcctgccgccgtccgacgcggacgccacccaggacgtgccctccctctgccgctccacggaggagacctgcctcccgcatttcagggccctgctccaagctctcaacgccgcctcatcatcccctgacgacgacgtgccgccgccggtcacctgcatcgtcggcgacgtcaccatgagctttaccttggaagccgccagggagatcggcgtcccgtgcgctctcctctggactgccagcgcctgcggttacatgggctaccgttactaccgcaccctcatcgacacgggcatcttcccgttgaaagaggagcagctgacgaacgggttcttgg

SEQ ID NO: 24782 - DNA, 615 bp, Sorghum bicolor
  unsure (1)..(615): unsure at all n locations
  Clone ID: 30941564
gccgacggatcagccaagggagaaaagacgaggaaagcgacggatgggcgtgaagagccgtcagattccgggcccacaacacctttgccgaacaaaaagttgttgatcttcatcctcgacaggctacagaagaaggatacgtatggtgtattttcagagcctgttgatcctgaagagctacctgactatcatgacattataaagcatccaatggatttttcgacaatacgaaagaagctcgataagggggcctattccaacttggagcaatttgaggatgatgtgttcctgataagctccaatgcgatgtgctacaattcaccagatacnatatactatcgacaggcacggggtattcaagagatagcgaaaaaggattttgagaatcttaggcaagatagtgatgccagtgaaccagaaccggaaccagaacccgagccggagccagaactagaagaaccaaagccacagcctcgcaggggcagacctccaaacaagaacaatgccgaacagaaagttgggaagccaccagcagaacgtgctactgcagatttctctggtgcaacacttgctactgcagcaaatattggacgccatgcacaggcagattttgat

SEQ ID NO: 24783 - DNA, 591 bp, Sorghum bicolor
  Clone ID: 30941578
gccactacctaccccagggatgctatgccgcacgcgctactcgctccagcgcctccaaccccatcctgccttccccggtggcgccacctgctcttgctcatgctcttgctccccgccttcctcctcctccggcaaccagcaccagaggctccatccggcagccgccttgtccccagctacttcccgctccaccgcaccactcacccacgcacctgaccatgacgacgatggcgcctccgacgacgccctcctggcgctcctccgcgcccatgacaccgatgccgcctacagcctcttctcctcgatgccttctgccctcccttcctccccaccacggcctctcgcctcctcgcgcagctctccttcaattccaacggccccgacgcgttctcccgcgccgcccgcctcctccagagcctccgcgcccgcggtgccctcgacctcctcgacgctaactccctctccctcgcggccgcggccgctgcccgttcccgcgactcccgcctcgcccactccctcctcctatacatgctccgccagggccttctccccgaccgacgcgcgtacaccgccgccgtcgcccgcctcacg

SEQ ID NO: 24784 - DNA, 333 bp, Sorghum bicolor
  Clone ID: 30941596
ttgatggcacctgtgaacttgtagatagaccttccacgccaaaggatggcatgtttgagaacgcatcttttgatgttaaaaggcctgcgtctgataggtcattggaagagaatgaagtaacccgtggtgatgccaaaacagaaaggcattacaagagacggaagcttttggccttagagaaacaaagcagtttctccggagaaacttgtacagattagatttagcttgtgtgaggcttagttttagcttgtgctatatatacccgtctagacagacagtcctgggcaatatgctgtgatatatttatgtaatataatgtactgtcgctaatgg

SEQ ID NO: 24785 - DNA, 500 bp, Sorghum bicolor
  Clone ID: 30941624
gtcattgaggaaactccctttcctggcacatgcctctgtcaccaacccttgctgtgatgcttctactttcttgcatacattgataaagactgcgcaaagagaagtattggagtcgcgtggttagttcaaccttgagaccttggaatcttttggaagagcgaaatgttcacagttctttccaaatgccatgttccggttgtccccgatattatggtcaattgccaggtcgctacaaggataagaaagtccatcccatctctagggttagaggttagtgtttaaatgtaaagagacaagaacaaagaatgaatgaactgtcttgacgccccttcgagatgtccgtgctctacacagatgaatagtaatcaggattagatccatgattaatactaagcctagtcactacgtgtgaagatcatgagatgagatcaccggcttgtgtttggttgatctgattcttaacagttacgagctcagaatggagtaaggtgccaaaaaaa

SEQ ID NO: 24786 - DNA, 509 bp, Sorghum bicolor
  Clone ID: 30941716
gccgccgctcgccgcctctccctccagccttcctcctcctccacggacccagatctgatccctccgcaccggccggccggccggccgatcgatccggggcgcgcgcgcgcgtctccgccttcggtctcaggcccgtcgctggccgggttcgcggcgtgtcctgatgtatgtgtttttttattccttgtttttagtagagttggaaatttcgaggcggctggctgatttgtactaggttggggtggtgttgcgattggcggagtggatcggcgagtagcgattcgcttggatctgcgcggcggattgggttgggttgaccgctgtggtgggttggtgccgtcgtcgtgcagtttttggaattggaggagatgatttctgtggggctcgaatttggatttgtttcctctgtattaattcttcccgaatctttgtgccgtggtttttgtttctaggctagtgaatcggtgaagcaagatcgggcgagtgatgctaagggtggcttggtggtg

SEQ ID NO: 24787 - DNA, 388 bp, Sorghum bicolor
  Clone ID: 30941767
aaattgatccacttgaatctaacagtcaacttaatatgagatcatatgccccaaaatatgatgaaatgcttaagaaatcaaattgtatggtaacagataaggaaagtgagaagtctttgtttctttctttggacagtgaccaaaaagttcacagccaagcagaagctgaggtgcaggatattatggtttctacgagctgctcaatctctgaaactctagctcagaaaattactagcaaagaacagtcctttaaaaaaagcatagaagttggggatgagtgttttagacctcaagatatggattatgttatgatgtttgactccagcaaagatgacaatggaccaaatccagaaagaatgacagctgaaggtgattgtggcgatcctca

SEQ ID NO: 24788 - DNA, 551 bp, Sorghum bicolor
  Clone ID: 30941795
gcccctatggaggtctccttctccgcgcccccacccgctccggacgccgcgtgtgccgccaccgctgccccgttgatgccacctgccgccgccgcccagacgctgccgccccctgtcgccgcggtctcctcctcgccgccgcagcagcagcaggcggctgcggctgcggccgtggtcgctccttccccggccgacgacaaggtcctcgtgtcagttgaggtactgttgcacgccgcgagcgcggctcgccacgaggacgtccaggtggcggtcgagaggatgctagaagctcgatgcttaagctatgttgatgggcctgtgccaattcctgctgataattcttttcttcttgaaaatgtcaaaaggatacgaatatgcgacactgatgagtgggttgggaatcgcaaagttcttttattttggcaagttaagcctgttgtgcatgtgttccagctgagtgaagatggtcctggtgaggaaccaagcgaggatgatacactctctagctttaacgagtgggccttacctgccaaagaatttgatggtttgtg

SEQ ID NO: 24789 - DNA, 563 bp, Sorghum bicolor
  Clone ID: 30941825
tgctactgttaaaggagacctactgttgttaatttgttatctaacttgtgtacaattgtgactctgttaaaggagacctactgttgttattatgtactgttcactgatattcttcttcttgcaggtaaggtaaattagtcttgatgcttctcatacacacagttcttcttccagacttgaaaagtgtcttggagcagtggaacccaaccaactgaagtcaattgtgtcctactaatctactatagctttgtaaccatgtagccctccaaagagaatagtttctcgaaacacgaatcgattaatcggtctccaatctcgatgcttctaatacactcagttccggctctttgcccacatggccacatgggagggatgatctctggcactgcgcaaactcttcgattcctgaatcacagtcgttatcagcttatagaaacccagatgcacacatgtggctcagcagtctagcaatcggtgtcctgttgggctctactgaagcactgaccggaccgaaacatagtcggtggcagtggcaggtgatccatcatccgccgtggtgtggt

SEQ ID NO: 24790 - DNA, 595 bp, Sorghum bicolor
  Clone ID: 30941827
ctactgggtgcaccggccaaacatctcttgtcgtagagtaacgtaggagtagctatcatgtacagtactgtactgtagtagagtacgtgtacgttagtacgtgtgtgttctcgcgcgccacttccagttcacgaaaaatgtgtacattacagaacagtacgtgctgctagcatcgttgatcgatttttcttaatttgttaaccgtgtgaacgcatcatgttgcaggtgccttgacaaggcggcgatcgtggaggccgacctgtccgcgccggcggggaagcagcagcagcaggcgagcgcgccggcgtcgacggtgacggaggtggaggaggtgaagatggtggtgaagctgctgcccatctggtccacgtgcatcctcttctggacggtctactcccagatgaccaccttctcggtggagcaggccacgcgcatggaccgccacctccgcccgggctcctccttcgccgtcccggcgggctccctctccgggttcctcttcatctccatcctgctcttcacctccctcaacgagcgcctcctggtgccgctcgccgcgcgcctcacggggcgcccgcaggggctcacctcgctg

SEQ ID NO: 24791 - DNA, 541 bp, Sorghum bicolor
  unsure (1)..(541): unsure at all n locations
  Clone ID: 30941869
ctactgcantatgtgccaaattacttcggttatatccatccacgggtcaccttcttgtttgagaggtattcgttgcttctttgtatcggcattgtgtgggcctttgcagccattcttactgctgcgggtgcatacgaccatgtttcacttaagacacagcagcactgccgcactgataagtctcgactcatctcatcggcaccatgggttaaagttccattgccattccaatggggtcctccaatcttcactgctggtcattcatttgggatgatgggtgctgtacttgttgcagcctttgagtcaactggagcacactttgctactgctcgtctagcgggtgctacaccacctccagctcatgtccttagtcggagcgttggcttgcagggtattggaatgttcctgggggggatctttagttgtccgacaggctcatctgtatcagttgaaaatattggcctccttggtctgaccaaagtcggaagtaggagggtcatccagatatcaactgggtttatgatcttcttctccctatttg

SEQ ID NO: 24792 - DNA, 172 bp, Sorghum bicolor
  Clone ID: 30941879
acagttcctcggtagtttagtgagagtttcagcattccagtaaaccagtagataaagtagtcatcactgttaaacccccccgttgcttacatgaagcaatattagatctttaattgattaatgtatggacatctttaatgtaatggtattatgatatctatcctggagaagc

SEQ ID NO: 24793 - DNA, 576 bp, Sorghum bicolor
  Clone ID: 30941897
tggtgagcatcactatggtgtgttagaaggatggtttggaatacactggtggaatgggcgtttctttgttctccttgttacaaccctttgtgtttttactccactagcatgcttcaagcgtattgattcactgagctatacatccacaatatctgttgctttggcggttgtatttgttattattactgcaggaattgctatcatcaagttgataggtggacaaattccaatgcccaagttgtttcccactcttcctgatttggcatctgtttgggaactttttacagcagtgccggttcttgtcaccgcttatgtttgccattacaatggtatgagcaatttctaattctgtctgcacaaaacaaatctaattacaaagggaatggaaaaggtgcacaccgctatttttgtagttgcaactattaatgatgtgaattgtgtgtgtgtgtgtgtgcgcgcgcgtggtgttcgagtctatgtatgactcttttcttctattaatttaatgatacgcagctctcctgcgtgttcaagaaaaatattaatgctgtgaatgtcaggggcataaaaatgcat

SEQ ID NO: 24794 - DNA, 692 bp, Sorghum bicolor
  Clone ID: 30941902
agatgacagctttaatgctaaactttctgactttggactgtgcaagctcatcgatagggatacgagccaagtgattaccagaatgagaggcacacctgggtatttggctcctgaatggctgacgtcacaaatcacggagaaggctgatatatatagctttggtattgtggtcatggaaatcatcagcggaagaaagaacttagacacctccagatctgaagagagcacacatctcattaccttattggaagaaagggtgaagaatggtcagttagcagagttgatagacaagcataataatgatatgcaagtacacaagcaagaagtaatacaagtgatgaagctcgcaatgtggtgtttgcagattgattgcaaaagacgccctcagatgtccgatgttgtcaaggtcatggatggtaccatggatgtggaaaccaacatagatcataactttgttgcaagaaatcgaacaatctttggtgttgctggtaatgcagcctcctcatctccatatcttgcctcagatgtatcagggccaaggtgaaaatagcaaataccacaggcacaaagacagattttttttcttagcaatttgcaatgtaccaaacatgatctaattagaaagggtatattcaatttagttgatgcatgtagacgatctgtttatatcttgcagcgtagaaattattagc

SEQ ID NO: 24795 - DNA, 519 bp, Sorghum bicolor
  Clone ID: 30941936
gtttcaagacgaccgatgcctaatgtatccacccatgtctcacccccatcacacacagcatcgccacttccacgaccacctgctgccatgactcgcagttattccataccttcaaatagtcaacagactcctattattactgtggacaaattgttggaggctaggcatagcagggagagcagcgaagtttcctcacccccagtaacacctatatctctggcagatgtttctcgaagatcaacaacagaaacagttgtcgacaagaaaaggataaaggaatccttgtgagcagttgagcaactgaacatgttgataatcttaggaaattttgtatgtagttgattgtgtattctatgatccccactataatctctcgtgttcactgtgaaagaaaaaaaatgtaaataaggttagcattatattatctccttgatatgcttgtccgaactctattggatatagtgtattagtctgcaagagatcgtttgagaaatgaacgttgtcgatttagtggtttct

SEQ ID NO: 24796 - DNA, 593 bp, Sorghum bicolor
  Clone ID: 30941987
tgcaaaaagattagcccaaggtcatcatataaaggttgaaatcagtactacaatgccaattcaagttgatggagagccatggtcccaggagcccggcaccatagaggtttctcatcatagccaggccttcatgcttaagagagtctccgaagaaccactcggtcatgctgcttcggtaatggccgacatcttggaaaacgctgagaacagtggcattatctcagcctcgcaaaagaggactttgccccaggagatagcatctaggcttttgtaggacagttctgacgctagtgcttgtagttgtgtcatgtgtagctcaccctatagctttctctcatgttttctgctgccagaggcttccttccgggatactagggaatcacgtctggtcgtttgtacataccgtcatggtatcttcccgcttgattgcattgtgcttgtgtataatttgtgtgaaattttgtacaccctattgggatgatctgaccctagttgcttatggtactagcaaagcttatctgtgcgcttgttttggcaggaaagtctgataacagccgtctggatcgctgaaacttaaaacaacgttttttata

SEQ ID NO: 24797 - DNA, 526 bp, Sorghum bicolor
  Clone ID: 30941989
tcaagaacaaattgaagccatcggtctcttcgctgaggctattggtgttggtttccaaatccaagacgatttattgaacattgctggtgagaaattcgccgctaagatcgctgttcaaggtgaagacatccccgaaggcaaacgtactttgatggttatccccagcttcaagcacgctgctcccgaaaaggctgaaagattgagaactattttgaacgaaccccccgatgatcaagccaagatccaagaagctattggcattatgcgcgagactggcagcttggaataccccgctggtgtggccagagacattgtcaacaaggcttggaaagaaattgaaagcaagttccctgacaacgagggccgaaagaaattgaaggcttttgcttcttacttggtcgatcgtgactggtaaattacaaattcgaatatattttgttatctatatactctcctaatcggaacgaataattgtacgattggattttgtcctttttgttcgcggaaataaattattattccccgg

SEQ ID NO: 24798 - DNA, 572 bp, Sorghum bicolor
  Clone ID: 30941994
gcaagagttcagggaatagtattgtccgggcttatgcaaaggaccactattttgatgtgataaccaatgtcgtcggtctggtggccgctgttcttggggacaaattcttgtggtggattgaccccgtgggggctgtaatacttgctgtatataccattgtcaactggtccaaaactgtattagaaaatgcagctacccttgtgggccaatgtgctcctccggagatgctgcagatgctaacgtacctcgccatgaagcacgacccacgagtgaggcgggttgacactgttagagcttacagctttggagctctctactttgttgaggttgacattgaactctcagaggatatgctgctgagagaggcgcacactatcggtgaattgctgcaggagaaaatcgagaagttgcctgaagtcgagcgggcgtttgttcatatcgatttcgagagcactcataagcctgagcacaaagtcaggagcaggctgccgtctactgatccctgacagatttccacatgtttatggggagttactccatccattcacaaataaatacacgtctcgttttaa

SEQ ID NO: 24799 - DNA, 627 bp, Sorghum bicolor
  Clone ID: 30941996
ttcaatttgcacaatcatagtacatgaaattgagggcctaaactggatcgatagtttctatttatcagtcatttctgttacaacagttggatatggagacaaaagcttctcaacaacagcaggaaggctcactgccactgtgtgcctgttggtaagcactttagcagttgcaaaggccttcttgttcctaacagacttaaggatggacaaaagaaaccggcggactacaaaatggatcctcaagaagaaaatggacaacgagccccttgttggagacctagacaacgaccctgctgtaagcaaatcagattttgtgatctacaagctcaaggagatggggaagattgatgagaaagacatcaaattgatctctgaccagttcgatcagatagagtttggaaaatgtgaaaggatccctcttgcagatataattggaaaattatgaatctggtatctgtaacttaggaatatccatatcacgatgatagatgtcctcttagaccccgcatgctttgttaagtagcatgcacatgtatgtgtggcatatttaataccctcgcatgtcatgagtgttcaaatacattatccgttgcagttttactcaaatctgaaagttgtgtattgtgg

SEQ ID NO: 24800 - DNA, 132 bp, Sorghum bicolor
  Clone ID: 30942002
aaatgttgagtatagcatgctttgttttaaagtcatatatgctttgttataaaacattattttagccgcttcatataaaggtttataggagagtttgtaggcctgacgaaaaatacactctccgttattgtt

SEQ ID NO: 24801 - DNA, 671 bp, Sorghum bicolor
  Clone ID: 30942008
aatcaaattaaggacgaagtgcctagcagcaaagttgaaatggttgaagcccatgatcacagcagaaaggagcctagttatgtcaatgtgcctgattcagtggcaagtgaggctaaacaccgccatggatttgacgagaggcagccacttcttcctgtatgattttgtagaagagcaggcacactgtttcctcaacagagcagcatgtaccttaactgtcttacaacatggattttccatgacacggaggaaaagagagtatttttagcgggtatttgacctaattgtctttaaagccacattgctgccatgcgagtaaaggatatgcatattcggcggcagagtgacgagcttcgtgaagtagattaagtagtccattataatagagtaatggtctttggatggatgaggcgatacctttaaccagtgggtggtaaaactaatgtgataagattagtgaggaataaagtccccgccattttttttcccttttgatagagccacatcagccgtggttttatgagtgtctttttttttttttttgcggcaccaatgtaaatatcagttcgtttcagatggcgcgtgccgaccagagattttcattcctgtatctgcgtgttgcatgagatactgcgacgtgtttactgattactaagctttgcattcttccg

SEQ ID NO: 24802 - DNA, 571 bp, Sorghum bicolor
  Clone ID: 30942010
agtgccgaggcggagtaccgcgctgtcgccaacggcgtggctgaggcttcctggctccggcagctcctcgtcacagccctctctcccggagcgcactgttctactgcgacaacgtcagtgcggtgtacctctccaccaaccctgtgcagcaccagaggaccaagcatatggagatcgatctacacttcgttcgggaccgggtcgctgtcggcgatgttcgagtcctccatgtcccgaccacctcccagttcgccgacatcttcaccaagggcctcccgtcctcaaccttcgccgagtttcgctccagcctcaacatcaccggtggctagttgtgtctgtgggggggctcgtgtgtgtgattcttttcgagtccagtctgcaactccgctgcgccggaagttcagactgcgggggggtgttggagtatgtgtgtaacaggcccatgtggctaggcccatgaggcccatgtatccctaattatatggcaccctggttagggttagcccaactaatgagaaaccctaattctaacagtgtctcctcacctaatatttttattcaggttccttta

SEQ ID NO: 24803 - DNA, 461 bp, Sorghum bicolor
  Clone ID: 30942016
ttttttttttttcatttggggtgtctacaatctctcaatggaatggaataatccaacacaaactccggtacgaaatggaaatctcaacagaggttgaaagttggagtgggatgacgagcagcagcagaagcacgtgtagcgaatccaacgaccatgcaatccacaccgacgtggcgggaagctgctcgctgtcgctgctgctactccgcgcgcggcatccgtggaagcacgtgcagcgccaccacctgcttcccgggcggcgcagccacctcccacacgcggggccgaggccagggccggggcgcagcagcaacgggggcaccccaccgtcgtgagggcggcgtcgacgttgtcggccggcagggtgcgacgtcgaccacgaggaccttctcgccgccctgggccgccacgcacacccggcccccgcccgacgccatctcgggggcgcccttgagccgctc

SEQ ID NO: 24804 - DNA, 576 bp, Sorghum bicolor
  Clone ID: 30942024
caggtgctgggattttgagttctatcacaaatggggctaatgaattagcttctactgtccgagagacaattcggattcgtagtaaaaggtacaaaaagggtagcgcttctgctgattcagatagctctggggctattgagctaccatctgatgttgaaggagattcacaagaagtaaatagtgcagcaaagaggagggatgatcaggccaatggtgaactcaatgaggtacaccaaagctctgatgcagagaaagataagcaacatgtaccagacaacgcagctacaaccaatagatcacaacgtgagaattctcatgtacagaaccatcagaagtatgaaattatcgacgtgccttctgattctaggccgcttctagttttcattaacaagagaagtggtgcacagagtggtgattcattgagacagcgtctgcagattcttcttaatcctgtgcaggtttttgagttgagcaaacagcaaggtccagatgttggtttagctttatttcggaaggtaacccatttcagagttcttgtatgtggtggagatggcactgctgggtggggtttggatg

SEQ ID NO: 24805 - DNA, 584 bp, Sorghum bicolor
  Clone ID: 30942026
gattttattttttatttgcgttgagcaccagacgagcacttatattaatcacgcaatcaatatgagcgacatcaccatcgaccaagtcttcgagcaatacctgcccaaggtcaagcacatccttgaacaacaattgcctcgtactttcgataatgacactatgaagcgttatgccggcaatgctcgttatgcttatgacgtcgagactgccaccaagtctattttggaacccatctgggatatgcttgatcgcggaggcaagagatggcgtccagttttggtcttgctcgtcgctgagactttgggtggaaaggaagaactcgttgctccttgcgcctacctctgcgagatggtccacaacggtactttggctgttgatgacatcgaggatgatagcaaattgagacgcggcaagccttgcatgcacttgatttacggagttgacgttgccattaatgcaggcaatgccatgtacttcttgcccaccgttattttcaaggagttgagactcaaaggtgttgatcccgtcaaggtctgccaagctcacgaattgtacgaacaagagttgagcaacttacactttg

SEQ ID NO: 24806 - DNA, 586 bp, Sorghum bicolor
  Clone ID: 30942032
ggtttcctactgacccggtggtcgagccaccttttctggtgtttcctgcaggtactgctacgtcgcctgtcgtccgtgacacctcggggcctctaccctgcccgggtcccgaggtgtcaccttccggcccggcccctgcgcctgacgcgggtctcgggtcggcaccttcgacaccggccccaccggtacgtttcgcgcagccggtgcgtgtctaccagcgacgtgctcccgacgtggggtcggtaccttcgacaccagccccaccggcacgtttcgcccagccggtgcgcgtctaccagcggcgtgcccggctggcgccgctgcctccggcggcgccggtggccccctcttcgccagggtcccctgcgccatcggcgacgtcttccccaccggcgacaccgaccccgcctccgcaacacccagctactcgggccgtgacgccggtgtaccacccaccgctccttcaccgacacccgcgtcatgttcacccgatggtgacgcgacacgcggctgggaccctgcagccccgggctcttgcggcgatgcctggggactcgcaggtctcaccggtaccctcttccgtccg

SEQ ID NO: 24807 - DNA, 625 bp, Sorghum bicolor
  Clone ID: 30942039
gatgatgtaaaccagtccattcatcccagaaacgccagggaagtgtacacccctgcttgaatgcctagtggccaccacttccatcgtcaaggtctcagcagaaccaccatggatataaagagatgatccagcctgagaactgcaagctgcaactaagcaatccaagctccaatatgtcctccatggaagagcctctgctacctttggtccagcgcgaccagaagtacatttccaagaaagacagaagaagatcctgtgatgttccaagcaggtgtgcaacttccttttccccaaacagctatgtcaaagctaacttcagcactctcaatcatctgccacccactgatgaaagtaccaacctggtgtcctcaccaaatatccagcgggtgcactcttcaccttctatattcacatcaagcaaagaagcacactgtgtagatgagcttgatggccaaagccatgctgctactgcacaatatacaccatcaatcgcaaggcaggctattgtcagtgtcatcttatatatctcaataggggtacttgtgtacatgacaaatgttgaaggcttcaaggggaaatccacattcaagttagtggatgccctttacttcaccatcattagttt

SEQ ID NO: 24808 - DNA, 589 bp, Sorghum bicolor
  Clone ID: 30942056
ttttcagctcccctctccgctccccattgccgcattgccctccctcgccccttctccctcgcggcctcgcccaccgcgccttcgaggagcttcgaatcccgatcgcctcggtccccgcgagctcacatggtgggggcgcgcaccagagactagggttcccagttcccaccattttcctgctgattggaaccgcggggtttcggcgagcctgaggcggtggcggcggcaggaatgaacggggaggtggaatgtagcgtgtgccatgcgaaggtgcaggtgccgccggcggtgtcgaaggcgtacgatagccaccggagcaccgtgtcgtcgcggcagcgcgcgctaaacgtgctcctcgtctccggcgattgcgtcctcgccggcctccagcctatattagtgtacatgtcaaaagtggatgggaaattcaaatttagcccaatcagtgtgaatttcttgacagagattacaaaaattatctttgccattgtcatgctattcatccaggctagacgtctaaacgtgggagacaagccactcctcacagtatcaatatttatgcaggctgctcgcaataatgttcttcttg

SEQ ID NO: 24809 - DNA, 537 bp, Sorghum bicolor
  unsure (1)..(537): unsure at all n locations
  Clone ID: 30942064
gcctcctcgagcgggagccatggcggcggcggcgagggcggcgctgctgccctcgtcgtcctcctccccctcgccgctgctccgcctcccgcgccgcttcctgtcgctcaccgcgactccctaccctctctactacgacctcatcgtgcaccgccccgcggaccccaatccccccnnatcctccgcctccgactccgaccgccagccgcagccacccctcgacgagcagcctctggaccgcgccaagcgccggtacctccgcaagcgccgcagccgcctcctccctgaccctgacgccaccaccaccaccaagccttcctcctcctcgtcggagttcgtcgagctccggccggaggtcgtggacttcccgcgcctgcacgcgcgcgaggaggcgctctacttccacgacaccttcgccatgccgtgggagaaggacaagcactaccgtatgctctaccgcctcgagaagaagtacttcccccaccagtcgctcgacaacgcattcgtctctgctgatgctgccccggcctccgacgc

SEQ ID NO: 24810 - DNA, 282 bp, Sorghum bicolor
  Clone ID: 30942072
attgaggggtcttttggaacttttaatgtgaataacatccaagtgtttgctggctatgttctacatattggctcatttgcaaaaggttccaaggttttgtctcttggtgatagtgtgatatgcaaggttgattacaaccggcgcacactgattgctccaaaccatacgtgtactcacatgttgaactttgctctaagggaagtacttggtgatcatgttgaccagaagggttcaattgttctaccggagaagctgagatttgatttctctcatggaaaacct

SEQ ID NO: 24811 - DNA, 462 bp, Sorghum bicolor
  Clone ID: 30942086
aaaaaaaggacaaaaacagagcaaaaatattgggacatgtctcaacagagacgcgcagcagatttacagccactatcaccgaaaccaaatcggggcctctccgtatcaaactgcttgggtcttcctcctccccacgtccctgtcgcggttcacagggagagccgtggcagcacgtttttcctaatcctcttcctgttctacttctacccatttgttcagctaatacgctccacttccgtcgcttcaacggcacgggagataatttctacccagccaggctgccaatcgaagtcctcgcttggcttgctgtatctcccatcctgattccgcgagattcttggcgattctgctactgattttttttgagttcttgaaatttcttgtacgattgtcagtagccaactgctgatacaaagatcttagcttttctagtccctttctgtgaccttgccaaagaatttg

SEQ ID NO: 24812 - DNA, 596 bp, Sorghum bicolor
  Clone ID: 30942090
tcgccgtgcttcaccctccgccaagtcgcgatgttgagcgaccattagtggcctgcttgtgagccagatccacggctgctcgtgcaagagaggccagatccatggccgctcgtggtagggagaccggatctgccacatccccgagtacttctacctcaccggcgccgtcgtgctatgacgtacatggggaatccagctgtctaggaagaaggcaagctagggttctttgattgacaagcatccgcaagtcagcgagccacccacagagaagtgattggttcgagagcctagtggagtgtggagaagagttctgaactaagttctgcttcacaggattcaaaggctcagatcagtgcaactcacacctaataattgggacccttcagctacatgcaggagcagtacaacaaggatctcaagaacaccttacaccttgtttagttcaccccaaaatccaaaaacttttcaagatttccttgacagcatatgcagaccatcagtgcttcctgacagctgcatgaacagagtggactttgcttgccctgttgtatgagctaggcctgcttataagtgctaccggatttagtacaaccatc

SEQ ID NO: 24813 - DNA, 590 bp, Sorghum bicolor
  Clone ID: 30942109
cctactggatcctcccccccgcccctccgccttcccttcccacgtcgcccccgcgaccccccagatcggcaaatccgccagcacctacccccacgagcgtcgcgcgtcccggatggccaccgcctcctccgcccgccccggggttccgtagcatgggccactccccttcctccctctccaaatccggcacctcctcttccccgccgcgccgcagcaggtcgctcttccacatggcgccgccgccgccgccgcagcagcagcagcagctgctgcggctgaccgcgccgatgcaggtcgctgcggcgggggacagctcctcctcgttcgcgccgcccgcgcgggactacacccaggacctgcccgacgagatcctcgcgctcgtcttcgcgtcgctgtcgcccaccgaccgcaacgcctgctccctcgcctgctcccgctggatggaggtcgacgccaccacgcgccacaggctctccctcgacgcccgcgccgcgctgggcaacgcggcgcccgcgctgttcgcgcggttcacggccgtcaccaagctcgccctgcgctgcgcgcgcgggtcgggcgccgacagcctctcc

SEQ ID NO: 24814 - DNA, 606 bp, Sorghum bicolor
  Clone ID: 30942115
ctactggaagactcgcagtcggcagtcgcgtccatggcgatcttggcaggcctcgtcgccgtcctctccgccctcctcgccgccgcgctccggcgcctcctaatcccgcgccgccgccccgcggacgccgccggcttcttccacccgtacaccaacgacggaggcggcggcgagcgcgtgctctggtgcgcggtgcgcgccgtgcaggagctccgcccggacctcccctgcgccatctacaccggcgatgccgacgccgcgcccgacgccctcgccgcgcgcgcgctcgaccggttcggtgtccgtctcctccgcccgccgcaggttgttcacttgaataagagaaagtggatcgaagcaagcacctatccccacttcacaatgattgggcaaagtcttggctccgtttatcttgcatgggaggcccttactaattttacccccatgttttactttgatacaagtggctatgcttttacatatccactggctcgtctatttggttgcaaagtcatctgctatacccattaccctacaatcagttctgatatggttgaacgtgttaagcaccgcagttctatgtacaataacaactctcggatcgca

SEQ ID NO: 24815 - DNA, 560 bp, Sorghum bicolor
  unsure (1)..(560): unsure at all n locations
  Clone ID: 30942121
aaaaagcttgacccccactcccccgacgccatcntctcccccgcatgcgacttctcctcctcaatctctcccccacggtgaggcaccagcggacacggggccgccaccactggccaccagggcgcagggccctgctctctcccccatggtgaggcaccaacggacacggggctgccccaccaggcgagggcgccggccaaggacgcgaggccgcccactgccgaccactagggcgcagggccctgctctctcccccacggtgaggcaccagtggacacggggccgccccaccaggcgagggcgtcggctagccaggtgcctaggttttcgtcgggggcccttggccatgtcttcgcttggacccttcgccggcgacgagcaccaacaggtacacccaccccttccctgctctcccttctgtgtgaagccgaggacccaaaccctaacttaagctatttggtgtactcagatctgatctaatatcaagcctaccaaatttcgttaagcacattcccatagatgttgttatgtgattaaataaatttatttttgcctcgtcg

SEQ ID NO: 24816 - DNA, 470 bp, Sorghum bicolor
  Clone ID: 30942123
tgggaccgactattcttctcatcagttatcgtcccaaaaatttttatagcccgagagctgcagcaacgaaggaagaacgcccagcctcgccctcgccttcccccctctccccacctctcctactaatcgtcgtcgcgggcctgcgattcggtgttgcgattccggcctggggattcaaggcggaaggggggatgaaatcgccattgcgcaggttccggggcttcgcccaccaccaccaccaccaccaccaccaccacagggagaggaaggaccaccggccgccacccgccaagctcgacgagctcacctacgccgcccaggaaatggaagatatgaagaactgttatgatagcttgctttcagctgcagctgcaacaacaaatagtgtatatgagtttgcagaagccatggaggaaatgggaacttgcttgcttgaaaaagctgcattgaactatgatgatgatgaaagt

SEQ ID NO: 24817 - DNA, 535 bp, Sorghum bicolor
  Clone ID: 30942151
caccggcacatccatcaatcctgttatttttctcctcgtggtcgcgactcgcgagcactgccgtgccgagccggagctcggcagctgcccgccgcggtgcgccggtgccgccccccacgcaaccaaagccgtcatcccgtacgcggtaggccgcgacacgcacggcaaacagcggccctcactctccctcggtccctcgtctccaccttcgctcgcgcgccggcgccgctcacacccgatttccacctcacaaaacccacacggaaccccggcacccctccactccaccaggcgccagcgtcgtcatggcggtagcctcgacgtcgcccctttccgccaagcccaccacggccacctcgccgcctactcccgcattcggcttcctcgctccccgctcccgccgcggccgcgccaccgcgtggaggagtctcctcgtggaggcgatccggacgcagcgggagaaacaggggacggaggggcacttcgaggagtccgccgccgcgcccctggacggagtcggagtcggagccgatga

SEQ ID NO: 24818 - DNA, 546 bp, Sorghum bicolor
  Clone ID: 30942163
aaacccttacccagggagaggcgaggaagacacccctccccggctccccctgcccctcctcgtcctccgccctttctcccccctcgccgacacctaccctcaccgcatccgcggtcgcaatggcgctaacctcccaaggcatcaccctgcgttccccgccagcggggccccgcggccacggcgggaggcggtcctcttccgtgcccgccgccgcggtcccgcgcggctgggggcagcatcacgcggggcaagccttatccatctcgcccgccaggtacgaacccgccgctcgcccaccacggggtggctcctcctcctccgccatacgcgccgccgcctcggccggcgcgcagcccggcagcgacccggtccccgccgagcccagaatcgagctccccgcgatatttaccgtcttctctgaggccgctaagaccggcgctgccttcttcatcgcctcgtcgggcgcggcctttcttctcgggtcgtttggggggttcggaggcggcgctgggggtctcttcggcggcggtggcggagggggtggat

SEQ ID NO: 24819 - DNA, 147 bp, Sorghum bicolor
  Clone ID: 30942174
cttctacttcttcccctctcaagtctccagcgtcgccgcatcccgacagcctatgctgcggcgagccggcgactgaccgcagctttctgccgtctccagtggaggcagcggggatagcgcgcggcctccgctgcgacggcgacggcg

SEQ ID NO: 24820 - DNA, 545 bp, Sorghum bicolor
  Clone ID: 30942199
ccctgcgctgccgtcgtcctcgtcgtcctcgtgctcgtcgtcgtcgtcgagctcgtcagcctcctcgtcggtccggacctcgagcgagtccgacggcgcgggcccggcgctgaggaggagcagcagcgcgagctccgaggtggagaaccccatccaggggctcatcgcctactgcaagaagtcccagcagctggcctccgtcaggaagagcgccagcgacgccggcttccgcttcctgtcgtcggcggcgtccaagatcgccgccgagtcggacagccttgatgagctcaccgagatttgcaggggatgatgatatggtagtgccatgaatccctgatgattgtacaatgatgcaaatgcgttctggggattttgtgaaaaaaaaaaactaaaacttgtggtgttgaccaccctgtgtcatgatgatattgttcaaatgaatgacatctgaactttgaacattgactgtttccagtacattactctatgcaatagctgtaaaattttccatggatgagtaaaatcaatagcaaagtcttgcttcc

SEQ ID NO: 24821 - DNA, 656 bp, Sorghum bicolor
  Clone ID: 30942201
ggcacaagcatgaggacaatggaattccctctgtttcttgacagccaggagacaacaagatcagcatatgcaatattcttgttgaacaaggatatcgagcaacttctgaattacattggcgctgagagcctcgggccaagacatgtcttagcaaacctgaggcagctgacaaggatcatccagtcacaagaatacatttctgttgattagtttgacccagatacagtttttggagctatgagttagtccagaagatgtattggtgctgcttttaacaggcacctttttttttaacccccccttttgacacagaagagttggtcgctgttaccgtgctgatacgctcgttgtatatgagtaaatcgagtcatttccaggtgtacaggaagacgagatactactgtgctactatgcagcaactagaggtgcttgttcatgccaaagttactgttgttttagcgtgtttcttgacgttgatagtgtacccttggttcaactgcacatgtctgaagcaggatcgagcaatgttttttgtaccttcaactgcatgatctagttaaatgatgaggtgatcagtttagtcctcaatttttcttccctgtgataaactttgtttatatcaagaaacacttatggagaatgcaatgcaacgactg

SEQ ID NO: 24822 - DNA, 634 bp, Sorghum bicolor
  Clone ID: 30942210
atgcatcagcggtgcgcggcacaatgagggcaaggcagagcggcgcgagcagcacgggggcacagtcacggctcctccaccggtggcgctcgaccctcttctcctactagcggcaccatccacctgctggctagcggcagtgcacaacgagctacagagcactgtcaccaaccttttctccagtttggatttgaaccaggcgagtccctttcttctaggaactccaacgaaggtggagcagcaagtcaccttggggagcattccagctgacacaacaacgacagggagctgacgctgagggacttcaggaagatgactacctctcaaagttaacatatatttacagatgcactgaaagttcaaaactgtatggacaagtttcattgagtttgttgtactattttgccaagaagtttcatgctttcttatgggacctttgcagatgttgtaagtttagttctaaatactcctggtgatcttgccattatccttactgctagcaactcaataagttgagaagacatgctcaaattttatttggttacttggcatgtttacctgatggttgtaagtgtaaatcagccttgtattaatagcttttgtaagtgcagatcaaacataattaagaattgag

SEQ ID NO: 24823 - DNA, 606 bp, Sorghum bicolor
  Clone ID: 30942247
cgatcggtttggccaggtccagggatggcatccggtggaagaagacggggaaggtgcttgaggccgggcgtgctggatcctttgatgaatgcggggtacgacatggacatgtggtccgtgaccgtgctgccgggcggtatgtcatggtgtttgagggtgttgatgcagatgggagagtgagcattggaatggccgtttcagaggacgggcttaaagactggaggcgctccagcgagattccagtgctgtgcccttctgacgatgatgacgggtgggatggcgctggggttggttcaccatgcttggtgcaaatggatggggcctatgattggaggctgtattacatgggtgttgggagggacggcgaggcttccattaggatggcgcattcagagggtcaggctcttctgaaattcgagaagtgtgatgctattctcatgtaagatgtaaggtgaggtcttagtagtttcaggggatgtacatgtggatatgttttgacctttctgggggtgttcaattcacattcacttgaaacaaaacaaaatgttacgatttaaaaacttttacctcagcttattgcattagtattgtactgttcttattgct

SEQ ID NO: 24824 - DNA, 717 bp, Sorghum bicolor
  unsure (1)..(717): unsure at all n locations
  Clone ID: 30942269
catcgccacgcacngtatggcagcgcgcaagggcaacgcgggtgccaggctggtgtgggaaggcagggagccgcggctccggagtgctggagcgacacgagggtgacgaggctctgcatctaagtttcgcccggtcggagtgttgcgggatggcggaattattccagaaagagctgaaaatatagatttaagtgataatcgaccacgaaacttatccgcgacggaaggatgacactagagggatcaggaatactctagaagacacaagacgcaacgggagagccagcagccaccaggtggggccggccggccgccccctatggttagggtttgctccctccttccgaaagcttcctccctcgcctttgagaagccatctcggccgcttgttaagtcggtttgatccaacggcacatgtccatcccaccaggctataaatagaaggctagaccctccctggaagaggtcagatcaagagatgaagagtcagagcattagatagagatccactagatctaagctagcgatcaagatagagattagagagatagagtagaggagtagattctaaggagttccggcctgtcggagcatcctcaggagctgtattcgtctggattcggctccctcgccgggagctgcgttctgaggtacttttgtatttacccttctgattcaagtaagcaacttgttgtattcgttctttggttgcaactc

SEQ ID NO: 24825 - DNA, 616 bp, Sorghum bicolor
  Clone ID: 30942275
cccccaccacagcagccacatccttctcagacacttcaacaacttggtgctatccaattaccacaccaagatcagcagctgccatatccccagagtgctatcttgccacaagttccattgcaatttcctaaccagctacccattcctcaactacaattgtatcatcaaagccagcaggaatctgggcaaacactgaggcaagttggcgaacaatcacagcttcagaaccagggtatgcaagctgatagtttctcacaacagcagcaagactcagggatcaacttaaatcagttcttttcatctccagaagccattcagagtctacttagtgatcgtgagaagctctgccaacttttagagcagaatccaaaactcatgcaaatgctccaggatcgcattggccagttgtagccgccactggaggtgctattgtgagtgaaatctgatgctgggtctattgctaggttcctagagtctggtggtgtttcgtttttggctatggatgtagctagatgaaatcaactgctggcttgctattgcagcaatagtattgctagtcgctgaaatgtattcctatgtacattatctgtaactttgttctgtgtaatgtcaatat

SEQ ID NO: 24826 - DNA, 549 bp, Sorghum bicolor
  Clone ID: 30942279
tgcgacccggccgtaagcgagtgccgcagcctggccgtcctcgaggaggaggagcttggcgagttcgtgccgttcgaggacgcgccggtctacgccaccagcggcttctgggacttcgagcccgacgccgggttcctctacgccgagccgtcgtcgccggagctgtcgtggaacgccgccggcgccggcgccgagcccgcctcgtctgatgacgcgcccagctgggccgcgtcggcgtcgccgatgcaggagaacaacgactacttccaggacctgcgcgacctcttcccgctcaacccgcttcccgcgattttctgaacaggcggagtgtggcggacggggaacgccggaaccggaacggagacccctcgttgattcgtctaccggatcgtttttttggacgtcgagaagtgtgtggtgtgtcctgtgtcgtgcctgcgttgcgtgcactgtgtacttgtacgcctcttccttgccgtacgtgtttttatttttcgagtcgatgagaaatgtaacatgctgccgatgagtacgtagagttttgaggtg

SEQ ID NO: 24827 - DNA, 534 bp, Sorghum bicolor
  Clone ID: 30942301
atggcgacctccactccaccgcctgcctcccgcgcctccctcccttcctccactgaccagtgatcccttcctctccctccctctgtctctagcttcgacattgccagccacccctgtccacggccgccgcgccaactgtctcagtgtcagacccacgccacgatggctctctccccgccttcccctcctcacgccaccaccgccctgctcctcctcctcctcctgctcacctgcaccgccgccagcattgccaccctggcgtccgcgcagccgcagccgcagccgctggcgtcgtcgcaggccaaggctctcctccgtgtgcgccgcctgctgttctacccacccgctctcgagccgctgcgcggggcgccggacccctgcgctttgccgccgactccatccctcgccgtggcgtgcgagggcggccaggtcacggcgctctcggtccggggcgaccgcgacccggacgcggcgtggcgcgccgcgctcccggccaccttctcctccgaggcgctcttcaccacgctcacccgg

SEQ ID NO: 24828 - DNA, 701 bp, Sorghum bicolor
  Clone ID: 30942325
gttgcgaatcattgtctattaaatcggcacacctcatccgccacccgatgctcgcgggctcgcggctgctttcctcggccgtcgattcgccgcgcccgtgccttttccaactccagcgacgcttagggttccagtaagccacaccgctccttcttctccaactctaacgaatatagaaggggccgatcgaaggagttaggccaccaggcggtggggatggcctgtgagcggtttaggggagctggcggcggcggcggcagcagcgccaagtcgggcgggggcgccatggtcggacttcggaggagctcgctgaagttcgccatgacgttgtaactttcgccacatctccaccgttgacgcaagatcaaagggcttcacttgtcttcagcagggcttggcttctctcccgtgaagacaacgcaggtggagctagccttcagagctgctgcgagcgtgtccggactctgcgggcggcaagcgcggagggcgacacgacgagctcgcggttggtgcagactgcagaggacgacgcggacctgggatgaggcgagcaagcgtcgccgccgcgcgagctcgccactgtcacgcgccttagccatggggacacgccccagccgagcaccgccacagcggggacactcacctggccgcgcaagcgcgcctgctctgccatcgccacgcaccgtatggcagcgcgcaag

SEQ ID NO: 24829 - DNA, 727 bp, Sorghum bicolor
  Clone ID: 30942332
tattgaagacccgtcaccagtggctactgctagaagattatttaagtctgaacatttggaaggcttgctttcgtacaaagcaacaattgatcttataagttcgtctaaatacagttttttgcagtatgatactgatccatacttattgtctctcatccaggaacgaagtttttttcctctgtcagccgccttattgtcatcacctatattgcattcagccagtggccctgctgccgaaattttgatggggatagcatcatcaattgaatctcttatcctctccctcctcttttgtcgttcagggttatcattcttgctcagccaacctgaagcaactgagcttatagttctttctcttcaagatgcagaaaatatgaataaagcagaatgcataactcttcgacaggcttttgttcttttatcaaaagggtttttctgccgcccaaaagaagttggaatgatcacagaattacatcttaaagtgggaagtgctgccaataggatactctcagttcctccaaactctgatgaacttttgtgggttctttgggaactctgtgccatttcaaggtctgattctggtcggcaagcattattagctcttgggtattttcctgaggcgatatcagttctactgagatctctctcttcgtataaggatcttgattcagtcatggctaagaatggagggtcgccattgggtcttgcaatgttccattcagctgca

SEQ ID NO: 24830 - DNA, 401 bp, Sorghum bicolor
  Clone ID: 30942336
ccttccccttccttcctcgccccggtctgccttccttcctgctcgcatcgccttcgcctccctccctccccgaccctttgctctttattcccctgccgatccgcagagcaggagggaatccacccggccgtccgttccgatcgcccctgcagcttcttttcctgctggggtcagggttgctgcagcttgcgcggggggctggttttggttggggtttcttgtgtcatctctccttccttgtagctagcttgggtttaactcccggcgtgccatgtcgcgcgcgcgcacggagcggatcttctgggacgatcctgacctgacggactcctccggcgaggaggacggctgcggggcccggcaggtcggcaggatggtgcgggagctgccgcccatggcgggac

SEQ ID NO: 24831 - DNA, 537 bp, Sorghum bicolor
  Clone ID: 30942354
aaaagcccaagctttagcacaaggcaaaccaaccaaacactaataaaccaacgcaattctctagagcactctaggtcgccaacaagcgccatcgccatggctcccaacctcagcaagacgacgcctgctgctggcctccctctcggcgacgaggtggccccggtggagggcctcaagccgtcacggttcaccctcaagggcaaggacctggccgtggacggccacccgtccctgctggacgtgcctgccaacatccggctcaccccggcgtcgacgctcgtgcccgccgcccccgcgccggccggcgacggcagcttccttggcttcgacgcggcggaggctaagagccggcacgtggtgcccgtcggcaggctccgtgacatccggttcatgagcatcttccgcttcaaggtgtggtggaccacccactgggtgggcgacaacggccgtgacgtggagaacgagacgcagatgatggtgctcgaccgctccgccgccgccggcgagcctggcagcggccgtccctacgtgctgctg

SEQ ID NO: 24832 - DNA, 612 bp, Sorghum bicolor
  Clone ID: 30942369
aagctataggattatcattcatatggatccccttttagatttgttgagaaattgaagaagaagaaaacatgggaatcgtactttgatccgcagaatcgctagcaggaaaaacacaggacatcacccaatctgctgtagtgtgacggcgcccaatctcgccggcggggggctaattcgggctgtagtaaggcagcacggtgtagaccgtctgcacgacggtgaggacgagcaggaagacggcggcggcggcggacatgctggtccacgggttgctgaagtagtcgtgcaccagcacggcgcggtgccggttccagctgcgtccgcagtagtccctgacgtcgcgcagcagcgcggcgtagcagttgtcgacgaactcgggcggcgggcacagctccccgaggttcgcgtagaacgccgccgtctcctcgtccccgcgcgccagcacgccggcgcgctgcagtgcctccacgtcgcgccgcgcgtccaccaccgacgccatcagcagcacgtagctcaccagccgctgcagctcccaccggccccggctctgctcgtacgccagcaggttcgcgaacacggcgtggttcgtgtagctctccacggcggggatct

SEQ ID NO: 24833 - DNA, 333 bp, Sorghum bicolor
  Clone ID: 30942379
cctactgggttttagcaccgaaaatcatccctagacagacagacagacgcagcgcgcgggcacgccacaaccaaagaacacgcggcaatggcgggaaggcgagaggagggggatggaggagaggtgcagcggcaggtggaagaagaggaggaggaggattacatcgacatggacctgagcagctctgccggggcgcgggagttcgagttcatgtcggcgccgctggaccggtggggggagccactggcgtcgccggcggacgagctcttctacaacgggaagctgctgccgctgcacctgccgccgcgcatccagatggtggaggagctcctg

SEQ ID NO: 24834 - DNA, 602 bp, Sorghum bicolor
  Clone ID: 30942381
acccaaccgaaagcagtcgccgccgctcgccggagaaggaacaaccgacggcgcactcgtgctcctgcttcccagagcgcccccaagaccttaccacaaggccacgtgcccccttggctccctccgcccgcccgcccgcccgcccatgcgaagctcgcgccttcccccgacccctcgcccgcgggcatgatccgcggcgatggaggacccggcgccgtcgtccgccgcacctgaccctcccctttcgccttccccgcacccgcagccgccggtggaggagggggacggctgggtggtcgtgccggccagcgaggtcgagggggtccacgcgcccaaggtcatccactgggacgacctgcagcaggagctcgcccgcctctggagcctctccgccgcgctccagcccgctggggaccgcaaggcgcacctcgccgcgcgcctcgagtccacgctacaggttcgccaggagtttctcgagcaggacaatgagttggctgaaatgaggcggagactgcaagagcatactgatcgtcttggggatctgaagatgcgcacgaacaaattgtcggaggatgttgtggatcaaagggaacagctttgtg

SEQ ID NO: 24835 - DNA, 685 bp, Sorghum bicolor
  Clone ID: 30942395
ctactggagtccacatccactcccctcgccaccggccaaatcgtcacacatccactcccctcgctcccgcattagaaaggcgaagacttcgaaaacggccgacggcgcacatccgcctctcccgcactgcatcccgcaccgtctcccctcgcatcgtagccccgcctctctccatcgttcctggccgttggccttcttctccgacgccggatacactcgtgaagagggaggaggacccgcagcggcgtccgtcccaacgccccgcacctacccttcaatccggtgagcgacgatgcgcgcgaatctgcctctccgacaccggctacgctcttgatgagggaggagccgcaactcgtggatccaggggcagcggtgtccgtcccaccgccccacacctcccaccgccctgcacctcccgtccagtcctctaaagttcaagcggcgtccgagtggaggaggcgacgtaggcagagcgtccgagcagaggtggcggcggaggggcgtcagctagcctgcgtcacgaacaaatgctgctgaggtgccctgcccccgtgtctaattttatacagacttctaagcagtgtcacggaggcagatgcggcacggcatacccatgatggaggcagcaagggcaagacgtcgcggctcttcctcacgtctctgatcgatgcatcagcggtgcgcg

SEQ ID NO: 24836 - DNA, 593 bp, Sorghum bicolor
  Clone ID: 30942398
agaacgggcagagggagcgaacgcatggagaacagagaagaggagaggaagggcagcggtggcgccgccgccgtcggcggctcgactcctggggcgaacctaagggacctggtgtcgagggaatactacggccacaagaagaaggtgcactctgtagcatggaactgcctaggcacaaagcttgcttcaggatcgatcgatcataccgcacgtgtctggagcattgatccacatggccattctaaggttaaagatattgaactgaaaggccacactgatagcgtagatcagctttgctgggatccaaatcatcctgatacagttgctactgcagctgcagacaagtctattcgtctttgggatgctcgaagtggaaaatgtcaaactgttgaacttagcggagaaaacatcaacatcacgtataaacatgatgggactcagatagctgttggaaacaaggaggacgagctgactatattggatgttaggacacttaaagttgctaagaaacacaagtctacttacgaggtgaatgagattgcttggaataaagctggagatctattcttcattactactgggttaggacacgt

SEQ ID NO: 24837 - DNA, 598 bp, Sorghum bicolor
  Clone ID: 30942400
ccgttctctcctcgcgccgcctccgtcttcccctcgcctgctcggcctccgccccccgtagtgcaccgactcctccaccaccgcctacgcctcctccgcgtggccggattccgccaccctggtgctgctcgccaccgccgaaaagcaaccctgtggccgcctggcctgcagctctctctctctctctctctctctctctctctctctcttccggcgttcaaatcccatgggcgagcccaccgtcgggttcgtccagatccgccgccgccgccacctctaacctctctctcagccagatccgccaccaccgccgtccagctccccacgtgccagtccccaattttttctactttccgctgcccacaacttgtcgcccaattcaccgattcgtcgtcgagcaacctattactctcgagctcgtcgccgctcgcccctgctacgcctagcggtcgggattgatagcgaacggagttgctggtcggaattcctgttgcggatgccgcgatttatccgctcccgctggcgtaatcgcaagccctggaaaccgggtgagcgcgccatcgccgctctcagcccggttcaccgctcccgcctcagc

SEQ ID NO: 24838 - DNA, 475 bp, Sorghum bicolor
  Clone ID: 30942411
aagcagctctccactccacgccccgtctgctctcacccaggacaggacagtcccgtcagcagccagccagttccccggccctttcccccctcccgctcgccggaggccgcgggccggcggcgatggggcacggcgcgagctgcggccgcccaagcgacgaggtagacttcttcggcgcggcgcaggccggggacacggcccgcctcgccgccgcgcttcgctcccgccccaccttgctcacccgcaccacgctcttcgaccgcctctccgcgctccacatcgccgccgcgcacggccacctccaggtggtctctctggcattggatctttgcgtgcaccccgacgtcgttaaccgccacaagcagacggcgttgatgctcgcggcgatgcacgggaagaccgactgcgtccggcggctgctcgacgccggcgccaatatcgtgatgttcgattcctcgcacgggcggacgtgcct

SEQ ID NO: 24839 - DNA, 536 bp, Sorghum bicolor
  Clone ID: 30942415
ttactatcacagctatgcatggttgcaacagagccaatgaatggttatagtttctcacctatgataatcagttacttcaatgattacagaaactatattgtttctacaactactgaagctatcattgttgataaaggtacatctaggagagggaggaagagaaaagaagttttagcttctcctgaggtagagacaacggaccatatgcaggactcgtactggtccggattgagcttgcataatcacccaattaatgacctcagaaaagagagtcccaatacaaggccaagacgtaggcggagatcctcaagacatgcatatgaacctttgtcggagcttggggatccggttcctaaaaaacaaatacaagttatggaaagatctatcatccatgttgatgagaagatggttgatgagttgaagcccactgcacttgttttgagctttggcagatcagctgctcttccttcagggctggatcttgttaagatgtttagtcgctatgggccactgaaagaaggggagacagaagtaca

SEQ ID NO: 24840 - DNA, 283 bp, Sorghum bicolor
  Clone ID: 30942420
gtaggtccgtcgaggtggacttcttctccgaccagaagatcgctgccgatgcagctaacaacaacacctgcggcaggaccaccgtctcgccgggatcgggatcaggagccagctgcctcgccatcaagaaggaggatctcaccattaacctccttcccggcaccggcagcaacgccaacgacgactaggcggccacccggctccggctgctggaccaagacaagcagagcacgaacaccaacgagatgcaggcggagcttgcgcgcatgaacgacgagaacca

SEQ ID NO: 24841 - DNA, 613 bp, Sorghum bicolor
  unsure (1)..(613): unsure at all n locations
  Clone ID: 30942422
ctactggactacagaaaaaagaaacgagaaatatcacggccatggccctcgcaagtcaagggtcccgactcccgagtcccgacgaggacgaaggcaagcggccgcccgcgcttgacgattccgccgctcaggacaccagccgaacacaggtgaggtgactagcgcggcatccccgcgcatatatcaacccacatcgatttgcaacttgctttagccaccagtccaccaccaccaccaccaacccgcgcgtcccgtgccgcgcctatccacagcgaaaagccacgatgcggcggccgccgccgccgccagcgctgaggctgagcgcgctgttgctgctgctgttcttcctctgcctgtgcgcgttccccgcgccggcgcggtcgcagaacacgaccgcggccacggcggcgccggcgtccgtcgaggggttcaactgctccgccaaccgcacgtacccgtgccaggcgtacgcgctctaccgcgccggcttcgcgagcgtgccgctcgatctggccgccatcggcgacctcttcgccgtcagccgcttcatggtcgcgcacgccaacaacctctccaccgccgccgtgccggncaacggggagccgctgctcgt

SEQ ID NO: 24842 - DNA, 634 bp, Sorghum bicolor
  Clone ID: 30942437
gcagccctcccggctctccgtccagccgtcaggcctaggcaaggccacgcaggcgagtcgtctgccacctccgtcctccgtgcacgcagctgccgagatcgcgtcgtcccaggccgccccctcgcaccggcctcttccatgcgggcgccgccagagagtgattgggatttcaaggaatgagttcttcatcacatcgtgccgaatataaccgaagttacatggctatggtgcctagtgatttttcataccatggggttgtggacaatggccccactggatttacccaaggttcgcgtgaggaagccagtaaacttggtccatcatggtatttcagtagaaaggaattagaggaaaattctccatccagaagggatggcattgattggaagaaagagtcgaaccttcgaaagtcatattgcaagtttctacaagaattggggaagaagcttaaattgcctcaactgacgattgctacagctatggtattctgtcatcgtttttaccttcgccagtcccttgtaaaaaatgatagacgaataatcgccacagtttgtatgttcttagctggaaaagttgaagaaacacccatacctttgaaggatgtcatcctgatttcttacgagtttattcataa

SEQ ID NO: 24843 - DNA, 609 bp, Sorghum bicolor
  Clone ID: 30942448
aagtgcaactgccaagtgctcaacaccacgcgaagaacccccgtcccaatccggcacggcacactcgccgccatgctccccgccgccctccttccctctccgccggggcgcctcctcgcttccatccctctccgctgccacgctccgacccagcagccctccaccgccgccgccgccgccgcccgcggcctcctcctcggcggcgcgcgctccccggtcgtcaagcgcgtcccggacggtggcgggtggctcctctggcaccagtccggcccccgtgtcgcgctctccacctctatggacggcctccgctggagcgcccccgtatcccccgacccactgctgcccacagaggactggtgggcgttcgacaccgcctctgttcgcccctccgacgtcctcctcatctccggccccgcggcgtcatcccgccgcttcccgtcctccgccgtgtactggctctactacacgggctccaccgacgagcggttcggctccccgtttccggacgccgacgtccccgcgctccccggcctcgctatcagccaggacggccgccactgggcgcgcatcgagggggaccaccacactggcgcgctgttcagcgtcgcg

SEQ ID NO: 24844 - DNA, 234 bp, Sorghum bicolor
  Clone ID: 30942453
agcttctttcccttctgctccgtgacgcttcctcttctttcttctcttggtttgctccgtcgcttcctttgccccttcctgctccattgtttcctcgcacaaacctcgaacgcattgcgaactcctgcaatttctggccctagctctgattcgcggcgtcggccaccctgcccgtcgcgttcggtgggggggccctgctgctcctctgccgttcgcggggggtgggggttgggg

SEQ ID NO: 24845 - DNA, 657 bp, Sorghum bicolor
  Clone ID: 30942486
taaattgatgacaccatgggccatggagaagcaatgtagagggatatatacacatgaagtttttagtaaatttcaggaacaactcatagctgcaagagaccattgcatttttcaaggtacttcagagtgtgaagatataagatctttcaccatcagcagcctaactggaaaagatcgagttgttcatatgaacaagtcaaacatgtttggtatgtgctcgtgtaaattttatgagtcatatggtatcccgtgtcgtcatatcatacaagtgcttcgagtcgagaagcaaaatgagataccatcactttatattatgaagagatggaagacaagatgcaaaagggaactattctttgatgaggaagggaacctactagatgaaaagcctaaggatcctatggaggtggcaatgcgaaaaaagatttcagaatcacgcaacaagtttgaagatcttattcaaatggccaagacctcagaacaagggatggattttttatattctagtttatccaacctcgtagaacctctccaacaaatcacgcctgcaatgagaattgataaaaaggaggagtatgaaacttttctgggtaataaaattccaaatgaggtcgatatacatccaccaactgatatcacatcaaaagggagaagcaaaag

SEQ ID NO: 24846 - DNA, 455 bp, Sorghum bicolor
  Clone ID: 30942521
gctacaactcatgggaaaaactcatattgaggcaatcttctgatattggcaagactgctgtgcagtacaagtcagagagaagagcagcaatggaagcagaaggtttcaagatacttgggatctcaggggatcagtggagtgatttgataggatcgccaatggcaaggagatccttcaagctaccaaacccaatgtacttcatcagctgattttattgtgaacagtggaggaaagagcaggttttcgtagggcgttcatagcattgttatggtctcgctctgaatcttcaagcatgttgaaattcaacttgggcttggggccattgaatctgccctttgatgatttgtaattacacatcttttcccacactattggaagcatttgtggtaatgcaaattgtaaagaatcttggttcaaatctgaaacagatgaaatttcagttatgttcaaaaaaa

SEQ ID NO: 24847 - DNA, 409 bp, Sorghum bicolor
  Clone ID: 30942554
aataattgaaacatcttcaaaagatgacttactggtgaagattgatgaaatatctgtgaaacaacatcagttattgtgcctcctagaccaagccaaatggttagacgatgatgggagtctcctaatgattatacaatttttcccgttattaatattaattttaatgtattttaaactatttgtaggggatctgtgcttatatatgttgcataattgatcaagtatatttgcaaaatatggataatgctaagatatatttcccgatgcccgcccttgttgaacttcatcggatatatattttaggtgaggtgtcaacattccacgtttaagggcagcgggccttataatttgtttgatttatttaaggtcggattaaatcaaaataataaatttgaaaaaataatttttt

SEQ ID NO: 24848 - DNA, 480 bp, Sorghum bicolor
  Clone ID: 30942583
ctaccaggcactttgcaatatgtgatggctgacccctacttggagcagaatgaacaactaaaggagatggctttgactatccaagtcatgcatcaaaagctagaagatagtcaactggaattggtagaagtaaggcaacactatgaggaagcccttgatgagattgatgagtggagaagtcgtgctggattacctaagataaatgaggtggaggagatacctcgcttaactccatgcaagagatgctaccctggatgccgctgtagtcacaccgtgtttaagaagtaggaagtccccctttgtaataaacgttagtggcaaaagttgagtttagtcatatatgtgtgctttgtgaacctttaatgtttggttggtttgtcttagtgcttatgtttgagttggatttttgtaatgagtgcaatgatcttgtgggtttctccacaatttcatttaggttacaagcctaaggtataaggatta

SEQ ID NO: 24849 - DNA, 620 bp, Sorghum bicolor
  Clone ID: 30942610
catcaagatggtcttcctttccgctactatgtcgaatgcgactgagtttgctgagtggatatgcagcctgcacaagcagccttgtcatgttgtgtatacggacttcagaccgacaccattgcagcactatgtgtttccaataggcggttctggtctgtaccttgtagtagatgaaaatggccagtttagagaagataacttttcaaagctacaagactcgtttgcgaagcaaaataatcaactggatggaaggaaaggtggtggacctaaagcgagtggccgaattgcgaaaggtggaagtgcctctgggaattctgacatatacagaattgtcaaggtagacagacattcacattcttctattctgtgcatgatatctttggcttagtgtcctttctgaatttagcagttcatatgtgcatggaactttctaatgtaaagtacgttgtgtttcaggagccttaaagttgacatctctctagtaaatatttatggttcagttgttgatatatcatttgtatttcagtgttgttatcttatttggacctgagacactcatatccctgcttaattttgagtgcatcttaattttcagatgattatggagcgcaagttcaacc

SEQ ID NO: 24850 - DNA, 534 bp, Sorghum bicolor
  Clone ID: 30942635
atggatgcggcggcacgacatcgctgtggactgtacagcggcgactgggcgagcacagccatcggcctggcctctgcaactccaggagaccaaaacgcaaagcagcagccgagtagcaaggaatgagccatcctccaatcgaaagctaaactagcagctggactgcagttagctagctcaggcattttgaaatctttcaccagtacgtgcccagccaaaggaagggaagcctaacatggccaaagatatgcttgtgtggtgctttgtgatcatgtccagtcggtgagctttacgtggtgatcaagaaacagatcattgaagatggttcgtaacgaaaatattgctcgcaacaactctagaagaccatgcttgactcggggaatctatggattaacggaaccggagtatgagaaagctcgccctgtcccatcaagacatatttgttggcgaaaggagtactttaccacatcctttaatgggggaagatttcttccaccctcggcttgtgcgtatactacaagaccactatcctga

SEQ ID NO: 24851 - DNA, 622 bp, Sorghum bicolor
  Clone ID: 30942658
ctactggtcggcattcccccgccggccgccgccaaccccaacccaccgccgcgcgcgctgtctccctctctcgtggagacgactgtgcgacagccgctgccgacaaacgccaggtgcccaggtcttcttcaggcccttcgccggcgacgagcaccgccaggtttgggtcgagcgggggccgatgggggaagaggcggagagcacctgcaagcgcaaggcgccggactcgagcgcggaggagcagccgagttccgcgcctgcgcagtcgcagtcgcaggcggacccggcggccaagcgccggaacctctcccgctcgtgcgtccacgaggtcgccgtcccgaaagggtacgagtcggccaaggacgaggcggtgcacgggacgctcgccaacccggacttcaatggggagatggccaagcagtacccgttcaatctcgaccccttccagagcacctccatcgcgtgcctggagcggaacgagtccgtgcttgtttctgcgcacacttctgcggggaagaccgttgttgctgaatacgccattgcaatggcgttcagggacaagcagagggtcatctacacctccccgctcaaggccctgagcaaccagaagtacagggagctc

SEQ ID NO: 24852 - DNA, 575 bp, Sorghum bicolor
  Clone ID: 30942663
gtcctcttctcccctccctccttcgaaacatagggcacgacgcagcgcctcaacacgcagtccacgccgctgccgccatagcgccgcaatccacacagctcctccgcacggccgcatccgccgcatccacccatcccaccgccgcacctccgctccgccgcatccacgaatcggtggtgacgaaatagagcagagctcgttggcctccacggtgcacatccacagccgggctcccactcgcgatgagaagcatagactcgccttcctccagatccggcggcaccacctcctccgaatctgccatggcggatgccacagctgcttacctgttcacgatgaggtttacactgcatcagtcttgaactcatcggcaatggccaggtgccgtggagttgaaggggcggcgttcatctcagttgcattaacggtataggatagatctagtggtgaggaacaggattataagctaggacaggtgagttcaagtttttgcgtgggtgccttatggatgagcactacgagagatgagacaaatggcttctcgatgaggcagaagtgtatcgattatttctgta

SEQ ID NO: 24853 - DNA, 196 bp, Sorghum bicolor
  Clone ID: 30942690
ctactggactgtccctggtagggtggggtggcggcgcagccgacgcgaatcctttctcgcccctccacctccgtcgttccagacgaaaaggccaaaggagacgccgtgagccggaggcggaggctggaggggatttgaagcaggcaggaagagaccgccgtgccgtgggtctggattttgattgaaattccactgg

SEQ ID NO: 24854 - DNA, 674 bp, Sorghum bicolor
  Clone ID: 30942698
atgctttctctcagtcctaggtgctacctccctcactagaattcccggccgtacgtcccctcactagaaagaattcttgttgcaagtactacaccatcaccatgatctgtctctacacgctgtggctagcggcatgctgcctcctcctcctcttgtacagcgtccgattcaggtccggcttcagccatggcagcgggcccaggagctacccgatgattgggtgcctgatcgccttctaccagaaccggtggcggctgctggactggtacaccgagctgctggcggcgtcgccgacgcagacgatcgtggtggaccgtctcggcgcgcggcggaccgtggtgaccgcgaacccggccaacgtggagcacatcctcaagagcaacttcggcaactaccccaaggggaagcccttcaccgacatcctcggcgacctgctcggtacaggcatcttcaacgttgacggcgagctgtggtacgcgcagcggaagctggtgagccacgagttctcggcgcgcgcgctccgggacctggagtttgccgtgctcgaggacgaggcgcgggagcggctcgtcccggcgctgtccctggccgcggcgcgcggcggcgtggttgacatgcaggacttgctccgccgcttctccttcgacgtcatctggcgcgtgtcgctgggcgtt

SEQ ID NO: 24855 - DNA, 672 bp, Sorghum bicolor
  Clone ID: 30942700
tttatgaatttatggtggatgaacaaggacgacttgttcgtgtattttgggcagatgctatatgcagaaaaaactatagtgtttttggtgatgtcatttcagtagatgcaacatataccaccaaccagtataacatgaaatttgtgccgtttactggagtcaatcatcacttgcaaagtgttttccttggggcagcattcttagcaaatgaaaagatcgattcatatgtatggttgtttcaaacctttcttaaggccatgggtggagtagcacctcagctaatcacaacagatgaagatgcgagcatgacggctgctattgcacatattctaccagatacagctcatagattttgtatgtggcatatcatggaaaaggtacctgagaaggtcgggccatctataagaaatgatgaaaatttttgggaaagactaaataaatgtgtttgggggactgagaattcagaggactttgtgtcacagtggagatctatcatgactgattatgaactcatggaaaatgagtggttttccactaggtatgccattcgcgaatcttggattccggtatactttctggacatacctctagcaggaatgcttaggactacatcgcgatcagagagtgcaaattctttttttaaccgtttcattcatagaaaattgacctttg

SEQ ID NO: 24856 - DNA, 637 bp, Sorghum bicolor
  Clone ID: 30942726
ctggatgcagtactagtacctgatacgacttggcttatctattttttcttcatccaaagaaatttctttgatgatatgtctgtactgcccgtgtactgcgtggtacacggatgggatactcacgtgtactgtacctgaaccgactccgtggaatggccaggaattcatgaaggaatggcggcgtcacagggaagaagccaccctgctggaccctgtggtggtggaagcggcgccggactccctggacgcgctcatggcggagatggccaccatgctggcgtcctacgaccggcggattgacatggaagccgtggcgatcaagatgatggccatgctgttgaagatggaccggaaggtaaagacctcaaggatccgggctctgttcaaccggcacctggcgtcgctgggcgtccccaagagcgtgcactgcctcaccctgcgtctcgccgaggagttcgcggttaactccgcggcgcgctccccggtgccgccgccggagcacgccacgcgcctgaccgacgcctcgtgcctccacgtcgcgctcgtgaccgacaacgtgctcgcggccgccgtcgcggtggcctccgcagtgcgcagcgccgacgaccctgccaggctggtgttccacgtggtcacg

SEQ ID NO: 24857 - DNA, 648 bp, Sorghum bicolor
  Clone ID: 30942750
gggcgaacagactctgtctctcacaagacttaattgacttgggtagagctggtcttggtacctgtttgcttgctggtttgcctggatggcttgttgcttacacggctaacctggtgcggtttatataccttgagaggcagaaacttcctgatgagatcttaaggcacaatgtggatgagaagcgccagttccttatagaaataaacatggactctgagaagaatgatgctgaggttcaggcagagggagtattaaattcaagattacagcaaatagtgcatacacttgacaaggtgagatatgttatgagatgcgtatttggagacccaaagaatgctcctcctcctctggtaaggttgtctgggaaaagtctggtatctgccatctggaaaggggacagttcgatagttgctgaactccttcagtcgatggaacctcatgttgaagaagaggtacttagtgatctgaaggtcaaaatccgtgctcatgacccgccagactctgaagatattgagggaggcatccggaattctctcttgtggttgcgtgatgaattgcgaactcttccatgcacttacaagtgccgtcatgatgctgctgcagatttgattcatttgtatgcgtatacaaagtgcttcttccgtgtcc

SEQ ID NO: 24858 - DNA, 434 bp, Sorghum bicolor
  Clone ID: 30942756
ctatgcttgccaaaccaatgatgatctcaagggttggtacattgtgcacaaggtatcgccacacggccgactacctataccaaacgatcaagattacaacttcaacccaaacacatatgaaggagacttctttcaagaagaggagctagaagggaggttggtgatagacttaactgaagcgataggaatggatgtggttgtggttgatgatgatgatgatgcgggtgatgaggtgtgaaatgcaaaggacttacaaatgcttgatcgattacgtgaaggcaatgacaacgatgacacttctccttcggataatgatgattacttcgataatgttgatagtggtaatgagagttatgatgatacatgtcattgaacgaagatggtgggcggccgtcagaggagcgtggcgtcgctcttccgaaggacgcgtcctg

SEQ ID NO: 24859 - DNA, 305 bp, Sorghum bicolor
  Clone ID: 30942772
gggcgcggcgcggcgagactgcttggcccgaggaaacgggcggagaggagagaagcagaacgaagctcgcaaccgcgacggagagggatggccttcagcgtcctgctctccccgccgccccttccgctcccgagcgccaccggtacggccgccccgtacctaatcttcggcggccacgatcgccgccgccgccgcccgctggagcacggctgccgctgcggccgcccgccggagacggcgctcggcggcagctcaggccgccgcggctcatacggtgacgaggtggaggaggaggaggaggctcc

SEQ ID NO: 24860 - DNA, 595 bp, Sorghum bicolor
  Clone ID: 30942773
aactcgccggccaccagtagttccctgcttccccatcccatccacacacaccgcacaccaacccaccccaccacgccaacgtccgggaccaaactctgatccccaccatgcaggcggacggggacgcgccggcgccggtgccggccgtccacttctggggcgagcgcccggccacggaggcggagttctacgcggcgcacggcgcggagggcgagccctcctacttcaccacgcccgacgcgggcgcccggcggctcttcacgcgcgcgtggaggccccgcgcgcccgagcggcccagggcgctcgtcttcatggtccacggctacggcaacgacgtcagctggacgttccagtccacggcggtcttcctcgcgcggtccgggttcgcctgcttcgcggccgacctcccgggccacggccgctcccacggcctccgcgccttcgtgcccgacctcgacgccgccgtcgccgacctcctcgccttcttccgcgccgtcagggcgagggaggagcacgcgggcctgccctgcttcctcttcggggagtccatgggcggggccatctgcctgctcatccacctccgcacgcggccgga

SEQ ID NO: 24861 - DNA, 565 bp, Sorghum bicolor
  Clone ID: 30942775
tggcagatgaagcgtcgccgttcgtcgcccacaccacgtgcgctcgtcatccgctcgcccaagcgcttgcccgtccgctcgcccacacgtgctcgctgcctgctcgctgtcgtccgcatctacgcgctcgccgtcgtgaaaagtccggcgaggtgcagggacgtcgacgccgcggctgcgcccacacgcgcttgccgcccactcgtttctgtccgctcgcccaggcgcgctcgctgcccactcttgctgtcgtccgcatctacgcgctcgccatcacgaaagggccggcgaggtgcagggatgtcgacgccgcggctgcgcccacacgcgcttgccgcccgctcgtttccgtccgctcgcccacgcgtgcgcgcagcccgctcgacgctgtctgctcgccgccgtctgcacctaagcagacgccaagaccgacgaggtgttgagacatcaggacggactcgggagcagcgtataaacctcaaatccaagttcgacacgaacttcccttcctcaatgtctttctatgagtccagtcgtattggccaacatagttggaggacgaacg

SEQ ID NO: 24862 - DNA, 513 bp, Sorghum bicolor
  Clone ID: 30942786
tatggtacctaaccattctcgcggagccgccgctgtctcttcgccattgccttcgtggtcacctatggtacctaaccattctcgcggagccgccgctgtctcttcgccattgccttcgtcctcacctatggtacctaaccattctcgcggagccgccgctgtctcttcgccattgccttcgtcctcccctttggtgccctagctctactgaactcaccctcagagacccaccatgaacatgaacaatttgcatcctcccctgtcctggccgccgcaatctcatcaccaggcgggtaggttttccaaactttcttcaaattaaaacaccatatataaacccaatgcataacatctgtgtacgtatgacaagaccaacgcaaagttaatttacctgtgcaaaaaaagttagtgtatgtgcaagtctgtttgtatacttgtgttctcaaagaaataaaggtgtgtgtgtacttgtggttatacaaaaataaagttctaagtttatatatgaatgat

SEQ ID NO: 24863 - DNA, 565 bp, Sorghum bicolor
  Clone ID: 30942800
ccaactgaagcagccaccaattaatgccacgaattgtttagggtaaattcattagtgcatgcatgcacgcacgcgccgccaggaaacatcgggtacggccagcgtgctgcagagccgccactgttttctgtggttagggtgggtggtggtggctggattcgatcgatctcggtcgtcgtctctctcacctccggctagcggctggttaccaccattgatttgtttatttccatggttgggagtcgcctactactgaaccaagtagtgctgattctttgagttgttaattatgcgatggagaagggcactcggtatgattaatcttgttgttgtgcaaacatgtaggactccattagcggtgtggtgtagtgtaggaagcgaaaaggctcttgagttaggtcattattcaggtgctcgcgatcaatcataaataaacccccagtagtacccgaccaactgtatgtagtcgactacttgctactgttcgatgcatctgatgatcatcatgtgtgtatatatatatatatatgattaattgtacgaatgtaatgccctcttcaccacc

SEQ ID NO: 24864 - DNA, 537 bp, Sorghum bicolor
  Clone ID: 30942818
tgacgagcccggcaggagagaacgaggaggaggaggagggtcctcggatgagcatggccagcaggagctggacctcagcatcaacggcaggagcaatccaccaaagccacgcgacagccaaaggatcgacctgaacgggtccagctggaattgattatcgtcgttcagcaaggagtttcagaaaagacaggtcttcttcctcgtagcttagctgcagtactgaaaatggccaggggtcacagatgtgctgttctgtgcacttccatgccttgcagccgtttgcagtaacagtaagatctggggtactagcaccgacagcctgcgcgttgtcgtccatgcatccgccatggatccatggtgcagcaaataactaagaagtgactgatgatgatggattattggcggtgaaatttagtttatatgagggcatgcgagaaagagaacccagatgttctcctctgccgtctgattagttaactctgtagatctatgtgtatgatatatgctacgtagtacattttttttcatattcgcttc

SEQ ID NO: 24865 - DNA, 658 bp, Sorghum bicolor
  Clone ID: 30942845
caaggtgttgttcaagatagaaatggtcgaactgttgctaccctatttggaaaatgggatgaaagcatgcactatgtaatgggtgattgttttgggaaaggcaaaggaactgaacagttttcagaggctcatttgttgtggaaaagaagcaaaccacctaagtttcccactagatacaatctcactcgctttgcaattacattgaatgaacttacccctggattgaaggaaaaacttccaccaacagactcaagattacgaccagaccagagatgtttggagaatggtgaatatgaaagggcaaatgctgagaagttgaggcttgaacagagacagcggcaggcacgaaagatgcaggagagcggatggaagcctcggtggtttgcaaaggataaagatactgacacataccgttacctcggtgggtactgggaatccagagaaaagagcagctgggaaggctgccccgacatcttcggacaagtccctaacgatctgatgataactgactagtgtctcagatttctactgagcattgtgaagaggatccaaccaagttgctcatgagctagctcggtgcgtttatgtcaaaagtttcatgtatttgggttaatgaaccctctaattgtattatcctcttttattaaaagatgtaaca

SEQ ID NO: 24866 - DNA, 603 bp, Sorghum bicolor
  Clone ID: 30942849
gccaagccggacttcgtgagcatcgccgaggtcatcgagcacgacgtccccggatgcaacagggacctcatccacatcgcctacagcctcagcttgccgcgccggggagctgcttcgcacctcgccatctccagccccttggcgttgctgtcgtcgccgcagtcgcccatggtccacgccagctaagtcaccgagcattcggcaagactggctgtagggtgcgtgtgcccgtacatccgtacgtgcaccttttttttccagtcacatgactacaagcaagtctatgtgatcgttgagaaaaagattagacaagagtaaatgggcgtacgtagctagtttgacgttatacagagacgttctgcaggtatcggtagtcaagcaggacacattgtcctcgattcattcgtgcatatgttttttttttggcgaaaaaatcgcgtatatggtttggtttgacgttagtataaagcatggtagaataacgatcggatatggtaatttaatcctgccgatcaattgttgttgtaaacctctgaaggaagtttataacagaagcacagtaccacaaagcgtgaataaaagacaagtttactaatcataatt

SEQ ID NO: 24867 - DNA, 600 bp, Sorghum bicolor
  Clone ID: 30942851
gggaccaacgagcttgaggagggtagtaacgtcaccagctatgccaaggctagggtttggggggagaagtatttcaatggcaatttcaagagactggcggccgtgaagagcaaggtggatcctcatgacttcttcaggaatgagcagagcatccctcctcttcctgctgctgcaaaatgaatgaatgcatgcctggtagggatcggatcggacggagctcctcctccgatccatcaatttggtggaacgtcgtccagtgctgttcgtgcagatcgtcagtcaatccgtgccaaggaatttcgcctccctacgtggctactatatcctagctagttactactgaatctatctatatcgtttcccaatttatttcttgggtggaatttgtgtctgtgaagggcgtgtgccttgttcgcctgttcaaaatagtatattatccattgcatttttttcaaacatgagaacagcaagcacaaaataacactagggaaggtataagcgtccatataaataaatcttattgaccacctagggcgccgtgaaggcctattgtattgaacaatttctctaccttaatataaagatgtgcaaaccttttgc

SEQ ID NO: 24868 - DNA, 675 bp, Sorghum bicolor
  Clone ID: 30942878
ttcatccaaggcactctttacaaaactgccatggaatccaagaagcaatcatatctggcaaatcttgctctgtatcctgggaggtctgaattgccgttcttgcctgctaacacacaggcactgatattgcagccaattggtgataaagggattgcaattgttggtggcgacactataagaggtttcactaatattgatcaggcttggatcgcaatgatcgcagacaagctggatgccacattgtctaagtcttaaaacgctggactacttttgatgttggttcgccatctcctgtctcctgcaactagtgagcgcatcatcgtccttctcatgtggacgctgaaccagagcctgcaaatccatccctcatagtcgtgcaactgtcaacagtggatgtctgggtactggtgaattgccagtggatgtctgggtactctcatagtcgtgcaactgtcaacagtggatgtctgggtactggcgaattgctgagaccatcatgttctattggatttcggccgtttagccaggtccagcagagtttgatcacaacagtagtaaccgattctgaaaagcagatggttatctgaagcctgaatatctgacaacacagccacagtacatggcttcaataccttttttttagtatgtacaaccaaatatgaaaacggatagtac

SEQ ID NO: 24869 - DNA, 272 bp, Sorghum bicolor
  Clone ID: 30942886
ttgagctgctgctgctgctgctgtttgccaggcgtcgtatcgtgtccgtgtcgtgtacgagtactcgtgtagtctagtcgtgtcgtgtgacagtgtgggagcgccggggcaaaaggatggattggccgtgagctcccccgtcagtcgtgccgggtctgggtatgggtgtacgtgtatttcgctgattctgccggtggtagtgggacggatttggggatggacctatgctcgtacgtatttatttcattgaactatttatcacgttgtcccgt

SEQ ID NO: 24870 - DNA, 619 bp, Sorghum bicolor
  Clone ID: 30942920
gtttgcttagtgggccatgccatttacaggggctggaagagaatcaaactacggagagaggctaggcaggcacaacagatgtttgaggatgctgaagatgctattcgggaagataactctagtgatgatgatgatgatgatgtaggagacggccaactatgtgttgtgtgcttaaggaagagaaggaaagcagcttttattccatgtgggcatcttgtctgctgttgcaaatgcgcattaagaatggagcgtgaggttgaaccgttgtgccctatgtgccgtcaagacatcagatacatgataaggatttatgactcttgaggtaccttgctgataagatctacacgcttcctagctgacccatgcaagcctgaggagcacaactgttcatcctgctgggcattttcctagtctagtctgctagatgactgcccgattttggatttgtgaatataatgtcttgaccctccaaattatgctcttgattgcctgggaaaaaatagcttagctgaaatcgtgaactaacgcagagttattttttgtttgctttgcgcatatctttatccattatgtaaatcaatcatatagtttgcgacaattgattttagagatttggcca

SEQ ID NO: 24871 - DNA, 612 bp, Sorghum bicolor
  Clone ID: 30942922
aaaatacacgttccacattactttgagagatgattcctatgacgagattgaccacaaaatatactttgtgaaagcagttttaacagattaccacctacaaccacaacagcaaaaagttagtttcagatacagtcactcagtggtactcaaacacttggtggaccttgcttaccaaatgtacaggcttcgcagcatttgcttgacgctgtgacaacttcatcacctcaggccatcatacaccctacttcctctatggtaacaccaccgccaacgctacaaatagataatacaccgacaacaagtgacattgtaagtgaaaaaggaagcccagacagaaacattgaacgagtcaagcgcccattattccagcaagatactacaatggacaatgatcagtcaacgaaaaccatacatgaaactatacaaaaagatggagtggcatcgaaccaaatgaagctgcatccaaacattcatgaagctgctataaaacccaatgatgtctcaatcaatgaagcaacaaatgcatccaatttgtctgacgatcacaatctgaaaaggcacgccagtgaagattccatctacgaaccaaaaaagaaatcccgggagttagcc

SEQ ID NO: 24872 - DNA, 599 bp, Sorghum bicolor
  Clone ID: 30942928
ggactctgctcgggagacccaccactaccacccacactacccccaactgtcacaagccagccatggagcagccccggagcaggctgctcagcgtctgcgccgtcgtcctgctcctcctcctcctcctcctcctagccccgggcctcgccgccgccttcaactacgccgacgcgctcgccaagtccatcatctacttcgagggccagcgctccggcaagctgccccccggcaaccgcatgccctggcgcggcgactccggcctcaccgacggcgcccagcacaacgtggatctggtgggcggctactacgacgccggcgacaacatgaagttcggcctcccaatggcgttcaccacaacaatgctcgcatggagcgtagccgacttcggcaagtacatgggcgccaacctcccgcacgcccgcgccgccgtgcggtggggcgccgactacctcctcaaggccgcgacctccaccccggggacactctacgtccaggtaggcgacccggcgcaggaccacaagtgctgggagcggccggaggacatggacacgccgcgggcggtctacgccgtcacctcctccaaccccggttccgacgtg

SEQ ID NO: 24873 - DNA, 599 bp, Sorghum bicolor
  Clone ID: 30942932
ctactggcgatgcatgctactgatcattccctttcatatctccttaatgtatcccaaggagacaattcagaaagtggatcgcatgtagagaaactgaattcagggcctgttactaaagattatggaactactggttatgtgcatggaactgataaagttgctccagagcctcacattttgttgcctataaagtcttctgaagcttttgtcacgcaaagatcaatgggcaatggagaacctggtgtatatcagaatgataatttgcacaagtcatcagtgcatagccctggcttggctacctctctacatactgggctgattgatactgatctgaatatgaacttgcatagtaatggtggcctctctctgtcttcgcttcatattccagttgtggatggtgtttctaggagagaggatccccttcgtgattggggcaatatctcgtgcagtaaaggaataattggatttgaccataccaccaccaataatgaacacataaagctagcacacaggctgcacgataatgttcaaatgaatgtacctgtcatagttgaggacgtgactgataatgtgccttcaggcattccatcatcgagacc

SEQ ID NO: 24874 - DNA, 693 bp, Sorghum bicolor
  Clone ID: 30942972
ctactggcccttttgcttgtttgctctcgtctccgcctccgattctgcgatgataacccaccatccctccctgctccgcccatctatcctcacccaccgtgccggcgtcctcggtcggcgcccaacactgaacgccttcctgtccacaaccgtcgcctccgctacgccgcctctccgcttgcggtctctgcgcgccaccgccggtggaacttcgccggtcagtggcgatggaggcaaacgcgcggtgccgcctcccacgcttggggccgccctgctcggcttcgtgcgtagcaacttcctcccgcttgctctcattggtgggatcatattgggtctcctagatcctactcttggatgccttgctcacaaatactccctgtcaaagtacggcacttttgggatatttgttatctcagggatctattttgctgtttacaccctttcttgctcagtttattatgcaagttcagttcttccctcgtgaatttatcactgggttagctatattttgctgcatgccaacaacactatcaagtggagtcacactaacacagcttgttggcggtaactctgcacttgctcttgcaatgacagttgcatccaatttacttggtattataattgtacctctttctcttgcaaaatacattggcactggtgttggggtttccttgcctactgagcaattattca

SEQ ID NO: 24875 - DNA, 545 bp, Sorghum bicolor
  Clone ID: 30942984
ctactggctcgcaagatggacatgatcctggcgctcgacctgtcggcgaacaggctcgccggcacgaccccgtcgcagctcggcagctgcgtcgcgctcgagtacctcaacctctcgggcaacgcgctgcgcggcgcgctcccggcgtccgtcgcggcgctgccgttcctgcaggtgctcgacgtgtcgcgcaacgccctgtccggacccctgccgggatccctgctgctgtccacgtcgctccgggaggcgaacttctcgtacaacaacttctccggcgtggtaccacacgccggcgtgctcgcgaacctctcggcggaggcgttccgaggcaaccccggcctttgcggctacgttccaggcatcgccacgtgcgagccgccgaagcgtgcgcgtcgccggcggcgtccgatggtactcgccgtcgctggcatcgtcgccgccgtgtccttcatgctatgcgcggtctggtgccggtccatggtggccgcgagggcgaagcggtcggggcgtcagtcggtgcgcctcgtcgacgtcgaagacca

SEQ ID NO: 24876 - DNA, 656 bp, Sorghum bicolor
  Clone ID: 30943010
tactggattctaatagttttttttaaagtgttcacagagttacttattggccgaggaagacattagtggagtcaaatctgaaaaagcaaaagatctggggtatcatataccattcttaatgtaaacaatatgtggtgtatttcttttacttcgtcatttctatacgtgtttacccttatttgcagtgtcacattctcacctcaagatggtttatttggtttcatcccaaaatcaaaacctgcaaaggctcctgtagacaaatatcaaagcaacaacaattctgataaacttcagcaatcacagacaaataactctccagctaaagtcggaaaaaccatgtgcactgccactcttcagatgattcgatatttggatagcttgccatggagtcatgctcaacataacctattacataatttggtcatgatcatagttgcttcgatcttattaccgaagacatgatgattggtgctatctgagacaactcagtactcgagcaaggcagtttattgcctaacagtgccactgtaataccaaggtattttgattgaacatctttctttgaccctttgctccctttgattttgaccaatttattctttttattcccaagctttgtgttgcgcgtgggtcctgtgtcggccctagcggtcgct

SEQ ID NO: 24877 - DNA, 512 bp, Sorghum bicolor
  Clone ID: 30943034
ctactggaaaaacaaaatcatcatcacaaatataatccgctacctcgccggcgacaggggcgaccgcgcgctcgccccggccgggtgctgatcccgacttccccatgcacccattctgctgcgcgccgctcgtgcccgtatcgcccgcggcctctgccgcctccgccggggccgcgtcctccgcggtggcgggcgccccggccatgatgccgccaccgcagcccccgccggtgccgcctccgccggctcgaagcaactccgcccccatcggtgagaggcgcgcgcgcggcgggggtcagcggtggcggcggaggaggcggtacctcgccgcccgagggggtgaagctgaacgagatcgtcggcggcggcatctcgggaatcctgtacaagtgggtcaactacgggcgcgggtggaggccgcgctggttcgctctccacgacggcgtgctctcctactacaagatccacgggcctgaccgcatcatcctatcgcgcgagaccgagcggggcgc

SEQ ID NO: 24878 - DNA, 519 bp, Sorghum bicolor
  Clone ID: 30943040
ctactggatcccagaagctgcaagctctccttacaaagcctccaaggcctcttctccagccgcccaaccacagccagctagtagtgatctctctctcgggagcacacagctaaggcacagcacctgtgctaagctcctgtttcgtcgcggccaagctttctgatcctcggtaggaacaaccgacgtcaaatggccggtggtagaagtgccgagcatcagctcctctccaggattgccgccggcgatggccacggcgagaactcgtcctacttcgacggctggaaggcctacgacatgaaccctttcgacctgcaccgcaaccgcgacggcgtcatccagatgggcctcgccgagaaccaactgtcgcttgacctgatcgagcaatggagcatggagcacccggaggcgtccatctgcacggcgcagggcgcgtcggagttccggaggatagccaacttccaggactaccacggcctgccggagttcagagaggcgatggctaagttcatggggcaggtg

SEQ ID NO: 24879 - DNA, 612 bp, Sorghum bicolor
  Clone ID: 30943056
gagtttctctcccgtcccgtcccgtcccttcccttctctctgtgatgtgttgtcattagtaagctgttaagctaaagggctcctcctcctctctgctttgcgctgcccggtgtgctcctgctgtgctgcggtgtctggtcaagtacgcttccgaattaaaagcgcttccggcctgcaacctgcttgctgcctctctgctcccacggccggccgcctgcccgcgtcttcttcctcacccctctccctcctgcggtcccgtccctgcatttcttgattccttccttcaccggaaccaagcaatgtctccggcgccgacttcgcatcactcgcagatcaattcgaggaaggagaagcggatgaggaaggtggacaccttcgcgccgcacaacgacggccaccaatggaggaagtacggcgagaagaagatcaacaacaccaacttccccaggtattactacagatgcacgtacaaggacaacatgaactgcccggccacgaagcaggtgcagcagaaggaccacagcgacccgccattgtacgcggtcacctactacaacgagcactcgtgcaacagcgccttcctcccgctctccccctccgagttccagctgc

SEQ ID NO: 24880 - DNA, 531 bp, Sorghum bicolor
  Clone ID: 30943074
aaaaaaaaaaaaaaaaaaaaaaagtgtcctccactcggagcctcgggctgtcccgtcccgtgtcttccggacctccgctcatcgccctgccctgcgggctgcggctgctccgggctcgtccctcgacgacatggagctcagcagaggcattgtttctgccccgcgccggccggtttactccctccacggccgctgctgtcctctctccggagcgttctctccgccgccgtcgtcttctaccatggaagtgcgccggcgctgcatcagcagggcgctccggccgccgcagcaggagtgggtggagggctgggtccggcgcaacgacacgctcgtccgcggcctgcccattctagttggtggcgcatccctcgtcgctgtactcctcaaccgcgctgtttctggaatcgccgctgtcgccgacgcctccagttcgcagtcgagggccgacatattgacgcttgctctctccatgaacttctttggacatgggattccctcactaccgcaacttgttgcaaatcattggttatt

SEQ ID NO: 24881 - DNA, 453 bp, Sorghum bicolor
  Clone ID: 30943082
cgagcggaggcgaagagggagcccgcggaggtgaggaggaaccaggaagccgcgagaacggaggagcaggcagcccagatccgagaaaccgggcatacgccttcctccttctcctgctggtgctggtgcctgtgattctcattccttctctgaatcgccagctttagtcacccgccttgtaacatagcatgatccgtgtaatctttgggcgtggtagaaaaattgctcactgtacgactcatagtgtagtgccctgatctcacggtatttcgtcttctcaggaaggaatgcagcagtgttttcacttttcagttttcaccacgaggtaattgtaggccatagccgctggccctttgcacatgccaccggaaaaaaaaaataaaatcgttggagagagttgtcatggacaagcatgaacacctatcgcgaattcacgaaatgcaagcatcagga

SEQ ID NO: 24882 - DNA, 549 bp, Sorghum bicolor
  Clone ID: 30943122
catgacgctgccagtggcctctttgttaccagcaacagtggaaccgcttataaataaaaaggttgtcacgagatggaggcctctcaagctggtgtacgaccacgacattaggcttgggcaggttccagagaaatgcagcttccgtacacttcgggagtttgtagccaagaggttcccatcatccaaggcagtgttgattaagtataaggatgctgatggtgatctagttaccatcacatcgaccggagagcttcggttagctgaatcattcattgataaagttggccacgaggttgtagaaaatgggagggagggtgacaataagctcccggtgttgaggctgcatcttgttgaagtgagcccagaacaggaaccaactttgtcatcagaagaggagaagttggaggaggatgaggagttgctgatcaatggtgaatatagcactttgaatacttctgcagtggtaaccaatgctgaggtggtgaagcaatgtctcccagctcacattgtttaaaacatcggacacgtacttagtaaacacggaatgtt

SEQ ID NO: 24883 - DNA, 265 bp, Sorghum bicolor
  Clone ID: 30943163
cggcaggccagcacgcggcgtcgccgccggatgccagtaccacgacgccctccgatgatcgacatcgttgggtcgggtccggctccggcagggttgttgaactgggactttcgatgtgggtccattgggtctgatgatggattcatgacaggaaaatgaacccattttaatgtaacggggccgtcgacattctgggtgtagcttggttagtgtgacagtatattgcattataattaattcctctgccgaaaccatgaagacccgc

SEQ ID NO: 24884 - DNA, 575 bp, Sorghum bicolor
  Clone ID: 30943179
gaatgagaaagctcgtgagggaagggactatgtgcacaagaacttcaactgtgaggacttgctcatgaattttctgtatgcgaatgcaagctccacaaggaccgtggagtatgtccaccctgcatgggctatcgatacatccaagctttcttctgtcgccattagccggaacacccagaaacactatgatatcagaacagattgcttggcaaagttttcctccatatatggtcccctccctcagaaatgggagttcggcatgcgtgaagatcattgggacaaataggatggcaatggtggtacacaacggacaaacacatgctggtgaaaccttttttgttaatccccccgtaaagttttgtagcttggggtgaacggtgaagttataggtcctttgggcagaagtgcccctggtttgcaatgtacctattagattcggctagaagcttagacctaatcaggatagaccattgttcaaaagtttttgatattaatgctgaaatagaccaaaggcagggcagtgtacgtgaattgtgaaaggcaaagagggaacctggaaaatgcatagtgggggg

SEQ ID NO: 24885 - DNA, 698 bp, Sorghum bicolor
  Clone ID: 30943183
acatgtttgcatatagcatgagggaaaagactcatgctcaccggaattacgaggacgatgtccctgaagatgtcaagcagaggagactcatggaactaatcaacaccttccgcgagaccacaaagaagaactacgattctcagattggtacagtgcatcttgttcttgtcgagggacccaataagcgtgctcccaaaacagagctgatagggaagactgatagggggcataaggtgtcatttgccagtgtccctataccacacacattcgaaggtgaagaagcacgtaagccagtggttggtgacttcgttgaggtgaaaattctcaggtcatcgacagcaacattatttggggagccaattgcacgcacaagcttgagtgtgttccacaaaaatgttgcatctgaagcgcaggctgtcgctgcataagtagtagttacatttgtagtagttatggattatacgtagtgatatttcaaatgactacaatttttgatatagagaagaaactcggtacgtgcatgtcagcctcatggttaagcgttggtggttcagtttttgatacggtagcatggtgcactgcttttatcagcagaagcccaaaaaatttttagcataaaagtctgctggtcttgtgaattactcctcttttttgaggttgtattgccatgtaaaggtcaaacaatactgacaaagttt

SEQ ID NO: 24886 - DNA, 688 bp, Sorghum bicolor
  Clone ID: 30943193
gaatggtgactccagtggttaataaacatgctttgggcttataccatctgttcctaggaaagattttttatctattgagatcatgcttatagttacctgagcttgtgttggaagtatcaaggagagggaggatggaagccacagaattacactggactatgtgagaagattcttgggaaaagtcagactgtggctggatttttcctgattcaatatgcgcacctgtggaaagatcatcttgaaaaattgcttaacctttatgcctctggaaagctaaaggttttcgttgaccccaagaaattcatgggtgtttcttccgtggcagatgcagtagaatatctccactctggcaggagtgttggcaaggtcgttgtttgcatggatccatcctatggccagacccttgctaagctataatgtgtactttggagcatatgggctgcaatttcagcagaagattcttcttcaggtttactgtgtactgaattactgatgcgtagagttacgccgtatgttgggaattggcagcacgtagctcgcttgtccaagtttgcagtgcacggactaggacgggtgaaaattggaaggaaatcgaataagccaggtggctgtttgtttaaataaagtgctctgctctattgtgaactcttttggataaataaatgaaacttcagtggatattattatc

SEQ ID NO: 24887 - DNA, 539 bp, Sorghum bicolor
  Clone ID: 30943207
ggagcttcaaaccatcatcaaacacccgttgcggcttgcgccagcgggcagcccgctctcctcacctcggctcctctcccgcagtcccactcccacgcgcattccgccgcgcggctcccgagagaaagaaagagagagaggagatggccaggcacgccaagacggactccgacgtgacgagcctggcggcgtccacgccgccgcggtccccgcgtggccgcccggcctactacgtgctcagccccgccgcctcccacccggacgtccacgtcggcggcgtcgcggggaccaccccggccgagtcgccgctccactaccacttccaccaccaccaccgtggctcgagcggcggagccggcgccggaggcatgcaccactcccgggagtcctccacggggcggctcctcttctccgaccagctccgctccggcggcgacgtcgccgccgtggtgagcgtcccctggcgccggctcgggcacggcggcagcggggcgggcagcgtcggggacgacgacgacgacggcggcggcgcgtccctg

SEQ ID NO: 24888 - DNA, 309 bp, Sorghum bicolor
  unsure (1)..(309): unsure at all n locations
  Clone ID: 30943221
gagatcccccgtgccgtccgtccactttggtcgtcggtcgtcacaccccaccaggccaccactacctcccccacaaagcagctcgtcgctaggacagcgaggcagctctggcttattgcaagctaagctgcccgcctgattgattaatcgcgcgttaattgcccgctaatcccctgccggccgccgccgcctcctccgcgcatttcctcgcttgattaattgcctagtgaagttgatccagctcggcaggccgcgggcgggctgacagagagagagagagagagagagagagagnagaggcagaggcag

SEQ ID NO: 24889 - DNA, 585 bp, Sorghum bicolor
  Clone ID: 30943225
gacccacaccacgccccgaacgaacgcgatggcggcgccgctcgcccccctcactgccgccgctccccaaccccatcgttccgccatcccggccgccgctgcacgccggctcccaacgcccccgccgccggctcctcgccgcctcgcccgcactcttgctgcctctgcggccacggtcgtctccaaaggccagacagatttagtacctggttcaacaacttcaagcaagggacgcatctaccacgagacatatggttgccaaatgaatataaatgacatggagattgcgctttctatcatgaaaaatgatggttatgatgaaattgtccctgaccctgagagtgcagagataatatttatcaacacctgtgccattcgtgacaatgcagagcagaaagtctggcagcgtctcaattacttttggtttttgaaaagggaatggaaagctaatgttgctgaaggtagatcaaaatctctgcggcctcccaagattgctgtcctggggtgcatggcagagcgactgaaggagaaaatacttgattctgataagatggttgatgttgtttgtggacctgatgcatatag

SEQ ID NO: 24890 - DNA, 537 bp, Sorghum bicolor
  Clone ID: 30943235
gaagcctcgctcgcagcggctgggctgttgcttagtttgttcaaaggtttgtgttggaggctaagagggttgcatgcgatggcccttgcggcaaaacaggctgctctgtgtttcaagaaagttttgaggttgtccattaggaaaagctatacatttgtgtccgaacaccctgtccttttcggtttgggtgttttgctctacctattgtacagatcatcaccaaggctctttgtgttcctgctttcttcttcacctgtaattatatgcactgctcttcttcttggaatcctactgagttatggagaaattaatcttcctgaggctagtgaagatcacaagggcactccagaagtttcaacttccaacgttggaaattcgtccagtgatatccactttgaagaaaatcagaaaccttcagtgcttgaatttagggataatgcaccaaacttcaaagagagggaagctaaacagacagtttccttcagagagagggctagtgagcatgttgatgttgatgattatgtccctcttctgaag

SEQ ID NO: 24891 - DNA, 589 bp, Sorghum bicolor
  Clone ID: 30943237
gagacccttgtatcagcagaacatatggagggaggtaaactgcaggcgagctgtaggttgcaggaaaaacatagccaattaatctgagacacatgcacttgaaaacaacaagctggaggtgccgattaatctgaaggccagtggctgccggcgcggtgatacaatgtaacaaattcttgcgtacagagatgctgctacagcgaactgctaggtggaggagcttcccagtttgatggggaggcgactgtaggcctctggctgtcaccccattcaacccacagaactggaagcatacaaactgaagctgctgcgtcaaggccgcacagagccgtcagagccttcacaacggcgtcggtgagtggccccttgaacaaatagaagtagcgcagcagcaggtcgtcgtggctgagtccttcattgtcgaggatgcccagccttttcatgagcacctgtcgagccttggcttgagtgtcgccccttggccaatttctggctgctatgcgcacactcctgcgtgctggagccgccgccctcttgcatcgctgcgacgggctggctctgcgtggtgggacctgcaagatgggtgggg

SEQ ID NO: 24892 - DNA, 623 bp, Sorghum bicolor
  Clone ID: 30943253
gagcgcagccgtcgtctcctctctcctttcttgccccgaggcgccgccactccaccgctcgcgggcatgccgtcccagcccgcgccggactccaccggcggaagcccccggatcccggtggcgtccgccgaggctgtccgccgcgtagtcgattttttcaaaacaaatggaaaactccgctcagtcacaggcgcagccgtctcctctcctttgttgccccgcggcgctgccactccgccgctcgcgggaatgccgtcccagcccccgcagggctcagccggcggaagcccccgtatctcggcgccgttccagcccgcgccggactataccggcggaagccacaggaccccggcgccgggctccatcggcgtagtgccccggatcccggagctctccgcccaggccgtcgaccgcatcgcgcggaaatgcattatactcgtcgattggtggctggagagagtggagggcgaggagggcaagatccgcgtcgctggaaccacgttcaccccgcgaatggccgagcaaatgaggaaaggagcatcgtcctcaaacatgagaatggcagtccgagtgttcagatcttctgccattgtgaagcgccatgattacacctcaattgagtc

SEQ ID NO: 24893 - DNA, 501 bp, Sorghum bicolor
  Clone ID: 30943279
gttcttcttccgttgcggaaccgcatctccgtctctcacggccctgcgctcccaacgccgtggccgtgcgcccgagcctcgcccccgcactcgctaccggtggtcgtcgagctccgactggccgcacgcctcctcctcgttccgagcttacccgcgtgactcctccgcctcctccctcggtggcgtcgagggtgcgctcgcccgctcattggccgggcggatctcgtcgggcggccgagctccccggtctagaggtcgcccgcttcttccccaattccggccggacctgattttgggcgggcgcagttgcggagatgcagaggctgggggatttcaggctccctcccttcttcaactacccgccttacttcactttgcagcctgtgcgtgaaacgcgggaaaagcaagtgcagttatggaaagatctgatactcgattactgtagaagtcagaagatacatacaatatccctggacgaagatttccccttgttctccaatc

SEQ ID NO: 24894 - DNA, 555 bp, Sorghum bicolor
  Clone ID: 30943281
ctgggtgcgagacttgacggttgactcggccactacacccaagcctgtatactcggcggtgagtgtcgtacacaggagggagacgattgattcatgctccgcggcctgcaaattcatccttaacaggaggaatcctccagaaacaaagtgatggaacttatccaagaagctgatagatctaaatggatggtgcccagtaatcatagcataagatgctttatacaaggcgacatagaaagaatgaccaacaactatagaactagtctcggaagaggtgccttcggagaagtatacgaaggggttctggaggatggaagcatggttgcagtgaagaggttgataggcagtgtgaaagaaaagtttgctaaagagcttatcattcatcgtgaaatcaaccacaagaatgtagtgaggctcattggttactgtgtagaggaaaatgcccttgtgctggtcatggagtatattgctaatggaaatctgaatgatgttcttcacgatgacaaccgtcccatcctgttggatatacggcttagaatcgccattgagtgtgcg

SEQ ID NO: 24895 - DNA, 669 bp, Sorghum bicolor
  Clone ID: 30943300
catgatgctgttccgatacctccaggagaaggatgtgtttgaaaagtactataagcagcatttggctaaaaggctcctgtctggcaaaactgtttctgatgatgctgagagaagtatgatagttaaactgaagacagaatgtggataccagttcacttccaagctagaaggcatgttcactgatatgaaaacctcccaggacaccatgcaagacttctatgccaagaagtctgaggaactcggggatggccctacacttgatgtccacattttgacaactggttcttggccaacgcagcccagccctccttgcaaccttccaactgaaattcttacagtatgtgagaaattccgggcatattatcttgggactcacaatggccggagattgacatggcaaacaaacatgggtacagctgacataaaagccacatttggaaaaggccagaagcatgaactgaatgtatccacttatcagatgtgtgttctcatgctgtttaacaatgctgatggattgacctacaaagacattgaacgggatactgagatacctgcctcagactaaagagatgtctgcagtcccttgcttgtgtcaaggggaagaatgttctccgtaaggagcccatgagcaaggacatttcggaggatgatacattctactttaatgat

SEQ ID NO: 24896 - DNA, 347 bp, Sorghum bicolor
  Clone ID: 30943324
gcaaatcaaccagccagctgcctcgcccgaagagtactcgagggctaacaaggaattccgcaagctggagagcaccatggagttgatcaacgagctgagatcgaaacgggaggaaattgagggtctcaaatctttggtaacaaatgctcgtgaagagaaagacatgcgtgaaatggcagctgaggagcttcttgaggctgttgaggtggagaaacgattgcagcatgagctgtttatatcgttgcttccaaaagatgaagcagatgaaagggattgcatattggaggtgcgggcaggtaaaccagatcttgcccttgcacacacatgagcacaattcacctgccagt

SEQ ID NO: 24897 - DNA, 727 bp, Sorghum bicolor
  Clone ID: 30943367
gggacaatattagggggctcttgcagtccggccgttcgtaccagtgccacgcgccggcagagcgtgggaaaaataattttcgcggtaataacagtagctttgtaggcgggaatcatagaggcgtacggggtacggcggtaatagcagtagctttgcaggcgggaatcatagaggcgtacggcatcaagcgaaagtagatcacataatgatttattttgcaataaaaaagtcataaatgctaaaccggatatctaaattaaattccgattgcaccatcgtatttcttgtaataaatccttcgaaacaagatcccacatgaatatatttagataaatttttattaataaatatttatcctataaagatagaacatttctcttagaacatcttatatatatcacgtgaacatcatcaaatatactataaaacatcactgactacattatagaacattgcaatatatatagtatatgaacatcactaaatatatcatagaacatcatacttatactaattgaacatcacaaaagacatcattgcacattacttgtatactacatgaacatcacatggaaattttttaattattctaaagtatattatagaacatcacacaaaacattatagaacattacatgtatattacataaagatcacatgtattctatgcgaacaagaaaaaatcatatacgaaacataacactagaacattaaatatataccacat

SEQ ID NO: 24898 - DNA, 338 bp, Sorghum bicolor
  Clone ID: 30943377
attccccccactattttcaatcgttgctcccgagcaacaaccgaatgttcagccccagtcccagcaacctcaaacccaaaatcagccccaggcccaaaatcaaccccaagggcaacaacaacctcaagttcaacagccgcaagttcaacaacaaccccaagttcagcagcaacctcaggtttcatcaacgaccaacgaaccaatggtttttggtgttagtgtcaaagagatctgtggtactactgttgccgctttagcgcttggttggttactggcttgtttttaaacttattttgtcaaattagttgttgggatattataaagataaaattttccgt

SEQ ID NO: 24899 - DNA, 628 bp, Sorghum bicolor
  Clone ID: 30943385
caacacaaacaattttcagaacagtgtaaccaaaagcaatgcaatactgtatggaaactatccagggtgttggtgctcggctgcagaaatatgcagctgctggtgctgccactgcagtgatttttagagaagacaaagatacatctgtatccactgacaatgccgctcaaatactattgatgggcatggcttgagttccaggatcccttctctgtgtcatgttgacagactgatttggttgtcccactgaattggcgagcacaatctccaagattgaaccattcagcccacaaggtcagaaaaaggtttgccgaattatattagtagggcgattctaacagccaagaagagactggccatgtttggtacaacttcttgagaaacgttttcctaagaaactgcacaaatggaagaaaagctaagtgctttcccgagaagaaagaggccgaggaacgtcgtgttatgtacttctgtattcagttcatcgatgcaaagacacttcaacaaacctctgccccaaatgaacagctctattttggtacaagaaattactagtagcatctatacacgaatatatgatgtatgtatgtatgcatgttttcctttactataataataaactactagt

SEQ ID NO: 24900 - DNA, 454 bp, Sorghum bicolor
  Clone ID: 30943387
gcaataaacattcaaagactgaagcttacaaaatactacttatactgttttctagactacatttggtggaaactatcatggattatgaggcttcaaactatcatggatgacttaattaccagtgctgcctgcacatctgctactatgtcttgacagaaccaaacacggtctgtctacaattgcttatattcgttgaaaatgttaatggtctacaatgtgttcttatctgtggcttacatgaattggccagttctgtgttaacgcacaaaacctcatcgttgtaaatatagttatcatgttcaagaattatttctcctttttagtactcttaacctatagctgttttgcctcggcacgcaagggcacgccattcctactagtagcaaataaaacggatgatggatttgtcttatggtgtatagattcgtactatatgggtgtgattggttgctcc

SEQ ID NO: 24901 - DNA, 410 bp, Sorghum bicolor
  Clone ID: 30943405
ggaacgattgtggatgtggaggctgaagtcaaggacgtcgagtgatgtttccacatgatccttcatcagtgctcatcagtaccagctcttatcagtcagttcaagaaggcattatttctgaaggctaacacactgtagcgccgtcttatcatcatatatgttcacatccaatgggaagaaactggaaactgtgagctagatcgtgttttggtaaatatatatagatggccactgcgtagtaaagtagggtagggtgaggatgataagatcgcatatgttatttgctgggataggcgctgtagggacatggtgtgtgtgtgtgtgtgtgtgttttgatcagggagatggtgtgtttactactagttgtattttgtttgtgcccgcgcgcatgaaaaactggatgagggggg

SEQ ID NO: 24902 - DNA, 496 bp, Sorghum bicolor
  Clone ID: 30943412
cggtgcggggggaagccccggcgtggacaccaaggtgctgcacgcgttccagacgagcttcgtgcaggtgcagacgctgctggaccagaaccggctgctcatcaacgagatcaaccagaaccacgagtccaaggtgcccggcgacctctcccgcaacgtgggcctcatcagggagctcaacaacaacatccgccgcgtcgtcgacctctacgccgacctctcctcgctcttcgccgcctccgacgccggccgcgccgcgtccgagggcggctccgtcggcaccgtccgccaggcgcccggcgccgggcacaagcggatcaggtccggcctcgactgacttgactagtcaaattccaaattccttcttcttagctagtacagtagctagccaccaccagggggacctccccttttctttaacttgagctcttcttgtatctatcgacgtacgccactcctgcctatctataatatctattagtatctatttatctcc

SEQ ID NO: 24903 - DNA, 618 bp, Sorghum bicolor
  Clone ID: 30943445
aattgcagtgacacagacctttgtaaaccagtctaattttcagcatgtatgtttggatatggcacctggtcacagacacaaaggagtttgccgtgctggcttacttgctgttccaggaaaattcattaaagataatgaaaatcatccatctgtcacaatgagtggatggaaccaccctgatatgagtcgtaaggaaaaaaggcttaaaagttctgaaccactaagaacctcaaatagcataaatcattgttctgcatttgagttctcaggtgttcaggagagtttggagaatcaagatttctcatatgatattgatttcttgtcacaattccttgagaaagaaagggatcattattcttctctctggagtccaactaattcattagggcagagagaagcaagagaatggctgcgcaggctttgggttcttaaacctgaactgagagaactaatatggaagggtgcgtgccttgcaataaatgttgacaaatggtattcatattttcctgggcagtaggcagataattctgcagtatgtaaactgttaaattatactctatatgtaaaactggcagagaactgcccttttatattaactaggtgatacccgctcgttcc

SEQ ID NO: 24904 - DNA, 661 bp, Sorghum bicolor
  Clone ID: 30943447
cgccgccgacctgtacggcctcgacgtgctcgcgcacgggctccaggacgagtcctggaacgtcacgcgcttcctgctcctctcaaggccgtcggccgtcgccgcgctgcccgtggacgccgccgccggcggtgccaccaagaccagcatggtggtggcgcaccggggcggctccatgatggtggtgctcaaggtgctctccgccttctcctcccgcggcatcaacctcaccaagctggaggtcatcaacaacgacggcgccgcggctgccgacgccggatctggcgcgcgcccgcccgtggtgatcctggacacgagcgccaggggcaagccgacgctgcgcgcgttcccgcacgtcctgtacgtggactgcgagggcgccgcgcacgacccgcgcgtccgcgaggccatccaggagatcgagacgttcgccgtcttcgtgcgcgtgctcggctgctacgccgccgactccaccgtctacgacctgcagtgacgaatttagcttagccagtctgccgtgatttcctcgctgttaattgcacgaagctgtctgtcagattctagctagtactagcattcagaaagcagcttcagttaggtagattagttgcttgcttatgcgtaatttttgtacagatgcaataagaatgttcctattgct

SEQ ID NO: 24905 - DNA, 657 bp, Sorghum bicolor
  Clone ID: 30943473
ctgctagttatcatttactatagtctagatatttatgttccacatgaaaacactattttttttgtttttcattattatttttcacctggctattcccatgtatgctactactattgccattggtacttctcttctccatacacatctaccacttccagattttgaaagtagaaaggcacttatcaacattaatcttagaacagttcagatagctgcggatgttaacatcgatgaggttgctcggaggacagaaggctatagtggagatgatctgacaaatgtttgccgtgatgcttcaatgaacggtatgaggcgcaagatagcaggcaagacccgcgatgagatcaagaacatgtcaaaggacgagatagccaaggacccagtggccacgtgcgactttgtggaggccctggtgaaggtccagaagaatgtgtcgcctgcagacatagaaaagcatgagaagtggatgactgagtttgggtccgcctgatacctcggtcatccccttagatcttcttcaacattgtttgtgtggttgacacggtatttcgtagcaatgatatgctgttatccgctggtggtcttgttgcatagaccagaggcacgaactatattgtctattttcagtgatgctaggaattaatttcacgattattc

SEQ ID NO: 24906 - DNA, 711 bp, Sorghum bicolor
  Clone ID: 30943560
atagtttaggtagtcgctcgctccactcgagtcgttggctcgttgccttgtactaggctactagcagctcgattgtgcaagaaaagctgatcatcgtcgagttgcagagcatgcagcccgccgtgcgcacgaggcggcggcgcaccaccaccgtcgtcgtcccgctcccctccgccgtccgccgcgtgccgctgtcccctctggacacgcgctgggtcgcgctgccacccatgtgccatgtcttcctcttccccgctgctgctgctcaggtccctttctccgacatcgtcagcgtcctccgctcctcactcgcggcggtcctcccggcgttccacccgttggccggtgaggtcgcctactcgccacagctgggcacggtctccatcgtctacggcgaggatgatgcgggcggcgttgcgttcgtcgagtctgagacggatctcgacttcgccaggctcgtcgcggaccgggacgacgacgacgacgcgcttctgcagctcgtgccggatatcgcccaggaggagctgccggcgccggtgtttgcggcgcaggtgacggagttcgtccaagggagccggggaatagcgctaggcgtggccttcaaccacgtcgccatggacgggatcggcttctttcggttcatggagatgtggggcgcgtcggcgatggctgccgccggtgccagctctcatgcgaccgaaccaccactac

SEQ ID NO: 24907 - DNA, 652 bp, Sorghum bicolor
  Clone ID: 30943564
gtcctcccgcgtcccccacctcggcccctcctcctcacgccggcgacccaccgacacaccgacaaaccgaggcaggtcccccccgatggcgtcggctcgacttcgcctacgcctcctcgacggctacggtctcctcatgtcgccggcgctctccgcgacggcgctgcggtcctcgcgaggcctgcgcgcgctctgcacgctctccaccacgctgcggtcgggcgccggcgaggacgagatcgagcgcatccgccgcgagttcgaggacgccaagcgcaactacctcagcatccccgccgccatcaaggacatgcccaagatgaacccgcaaggcatttacgtcaacaagaacgtcaagctggacgacctccaggtctacggcttcgactacgactacacgctgtcgcactactccgagcacctgcagtgcctcatttacaatcttgcaaaaaaacacttggtcaatgagttgaagtatccggagagttgcttcagtacgagtatgacggcaccttccctatcaggggtctgtactatgacagacttaaagggtgccttctcaagctcgatttcttcggctcgattgaaccagatggttgcttctttgggcggcagaggctgagtttgagtgagataaaagagctctatggca

SEQ ID NO: 24908 - DNA, 647 bp, Sorghum bicolor
  Clone ID: 30943581
aaaactcaatgccggccattcgggcgtgttgacgtgttgccggagaacgccggcgagatcggatctctactctgtagtacttgctactgacatcgtatgcggcgcggtgcaggtgctcgcagttgtgctcgcgacggtggacggtggccactggccagggaccaatagcctgtagatctagtccgggacgagggtggggactggggagttgcccctcggcggcggtcggcggccgacggagcccgagacgctcgactgtttcagtaagaaattcagtcccatactccactactcctcttcgggtatactaatctacccttgtaccgtgcttgctactcgtctcccctattggttcctaatctaaaactcagctcacaagtcacacctactgggtggtcttcgttcttctcccgatagtagtaacattttaaatccttattagatttttttggtataaacatctccatgaaactcaagtaaataaattccttcaaaatttgccgtgacattcaaaaagtcattttttttgccccctcggacacgcaggaggggagccatggtatgacattgacacggggaaactggaaaaaaaaacagggagacatgtcgagaagcagcacctgcgttcatacacagaaagttggaaa

SEQ ID NO: 24909 - DNA, 612 bp, Sorghum bicolor
  Clone ID: 30943604
aagataatcatctccacgcgctcgctccctcgcgtccatggccgtgctccagtctcctcatctcactcctcccccgctctgctgctgctcgcacgcctgcctctacccaaggttcctgaaaccgcctccgaaattctcaaatggggtctgttccacttccacggcgaggccgtcggaccggagcgagctattagtgggtaaaagcggggccttggtttggagagcggcggggagacagcggcggcggcggcttggccttggcgtgaccggagctgggagaggccccttctttggcggcggcgggaggcgtatggacaagggcaccacccgggtcgtggggaacctcaccttcgccgccgtcgtgacgtacctcgccgtcaccggccagctccggtgggttattgacgccatcgtctccctctggctcctcacaatactgctgcctgttctggctctgggtgcatttttcttctttgcaggacaagatatactgcagggcgattgtccgaactgtggaaaaagcttccagatactgaagtcagctttgaaggatggcccacaactttgtccttattgcactcaacctttctctgttcagggcaacaaatttgt

SEQ ID NO: 24910 - DNA, 451 bp, Sorghum bicolor
  Clone ID: 30943614
agtccatcctgcccgtttcgtgtgtctgaggatctcctgatctccttcctcccttgtcctcctcctcctcccccctcccacatcgtcatccacccccctctccagctcccctcctcctcgccccctcccctccctcccctcctcctactcctccgatgatgatgatccgagcatctgaaggatagatagcaagcaaaggacgctgctcacctccccggagctgctgctgctgctgctacggcggaggaggactgcagctgctactgctactgctacgaggtaagcaccgccacccccgccgccgccgccgcctcctgcagctggattgtcctgctgctgagttgactggagctggattcatcccttggttgctctcgctcgtcgtgttcggccacggggaccgatgctccgatccgcccgcgcctcaattcctccccgcccgtctccgtct

SEQ ID NO: 24911 - DNA, 258 bp, Sorghum bicolor
  Clone ID: 30943644
ttggactactgggcgcgtttaatttcttgtttcttatatttgtgctggtgcttttcttcagcaactggattatatggatggattggagcctgagtttgatttctctcctgcatgagcaataaccaagttctgaactgttcagggttccgttcaataacaatcctctcttgtcaatgttctttgaaaattgaattttcccgtaggctaccattaatgcttctatagtaaatctgacagttccgggagacatcgctacag

SEQ ID NO: 24912 - DNA, 702 bp, Sorghum bicolor
  Clone ID: 30943646
aaaaaaagacccaccaaccagcgaccagacgtccagaccggggggcgcgatggaagcggcgggcaacggccggagggacgcggcgctgggcgcccttgccgtgctccccgacgaggtgctctgcgccgtcgtcgacctactcccgcccgccgacatcggacgcctcgcgtgcgtcagcagtgtcatgtacatactttgtaatgaagaacctctctggatgaccaaatgtctttcaattgggggccctcttgaatacaaaggttcgtggaagaagacgacgttatgtaggcttggtctatgttcagaaaacatggagattttgcagaagcctcgtcagttcgatggattcaattctttgcatctatacaggagatggtatagatgttttactactttgagtagtttttcctttgacgatggacatgtggaaaggaaagatgaccttttattggatcaatttcgttctcagtatgatggaaaaggcccagttttgcttacaaagttggctgaaacctggcctgcaaggacaaaatggacactgcagcaactgactaaggattttggtgaagttccattcaggatatcacaaagaagtcctcagaagataacaatgaaactgaaggattatgtttcttacatggaactccagcatgatgaagaccctctatacatatttgatgataagtttggagaatcagcacc

SEQ ID NO: 24913 - DNA, 580 bp, Sorghum bicolor
  Clone ID: 30943656
agcaagtagtggcattggtaaagatattaagatttgggaacctggtgaaggtgaaaacctcaccatcactcaagctcacgaggatgatgaagatatttggatctccagtgattatgattctgatgactttattatcagcgacggctttggttatgtgattgacttggatcctgcccatttatacgaaaacggtgatcatgaatctgaggaggatgaagaagaagattttgatggtggaaacagtgctggagatgagggcgatgattgatgatgatatgataggtgagggagattgcattcagccattagatcaagaatagctgattctgttgccgttgtagttgtagctttgtaggttatcttgggaggagcaaaggcttacaaaaaaacgaaaaacatgcttagctaggattatcaagagtttatttacgatgcctcctaggttactgtttaatgttcctcttcattgcgtaatatttaacctgtatatatctttcgtcaggattgagataatctagcatagtcatgtaaatgtattgtgaaaacaattattccaatgagagactgacatcagagcaaa

SEQ ID NO: 24914 - DNA, 636 bp, Sorghum bicolor
  Clone ID: 30943698
gaaagggcggtggactaggaggcggtattggtcatggcatcggtggaggctatggcaagggcggcggccttggcggcgggcatggcatgggtggcggctttggcaagggtggtggtatcggctccggcggtggctacggcggcggctttggcaagggtggtggcctcggctccggcggtggctacggcggcggctttggcaagggtggtggtcttggcagcggcggtggatatggtggcggcgctggcggtggctccggcggtggtttcggcaagggatttggctttgggtttggcaagggcggcgggttcggcggcggtggcggtggcggtggcggtggcggtggcggtggcggaggcggcattggcatcggtggcaagcactgatacgtcagcagcatacatttccctgcagttcttctatatatcggatggtgggtgacaggttgtgatttgtgaaagtttgcagttccggcaggttgttggttgtgtgtcctctggtttccgagatttgttcgtgctcatgtattagtttctgtgatggtgatatcaatcacaatggtatgtacctactccatgtaatgctcgctccctgaaagattcgagaaatataaatgaagtcaaaatctcgttgaaa

SEQ ID NO: 24915 - DNA, 523 bp, Sorghum bicolor
  Clone ID: 30943706
atccccggcgaggtgaaggccggctactcccccattggcttcgtgcgctgcggccgctccgcctgccgcatgaagaacatcaactggaaggtgggcaaggagactggtggcaagaagatggagggcgcgcacagcctgaaggccaacgagatggcggaggtggtgtttgagccctgccagcccctggtggtggacagcttcaagaactgcgagggcctgtcccgcatcgcgttcctggacggcaacaccgccgtcatgctgggcaagatcacggccgtgaccggcaagtgaggcttactgcccgcccctcgcccctgtgccagcttgaggctgccagcaaggggggtgctgacgatctccgggtgtgtttccaaggcccctgccctgcacgtgttgttcaacagcggcaggtcccgtagcctcatctcttgcggccgcaacaagacggcgtttcggataggtgcccatcccggtgttgtgtgtgtggctggagtgtgagcttctgtttgctgtgtaaggtcat

SEQ ID NO: 24916 - DNA, 621 bp, Sorghum bicolor
  Clone ID: 30943716
cgagaatggggaaaattggagtgttgggcagaggcaactattttgccttggaagggttctcctaaagcgaagtaatgttcttgttcttgatgaggcaactgcttcagttgactcctccactgatgcgattatccaaaaaacgatccgcgaggaattcggggaatgcacggtattgacaatagctcacagaatccacactgtaattgacagtgatctcattcttgttttcagtgaaggaagaattatagaatatgacacgccctcaaaattactagagaacgagagctctgaattctccagactgataaaggagtactcacggcgatcccatggctttggtggaacagcaaacaattgaatggcgacaagagaatgaatccaagatggtgaaagtcgatacaaaagttgattaccacacaatatatctacatatgacaagtacgcaccaaaccgcacggccaggatttactagggttgtgctcgtaatagctctgattaagattattcaaaaaaattggagtgatgcaatgtactatagtttactgcagatacaggacatgatgaaaatagggaaacaataacttggtagctattccgtataaattgtgcactgaaggaacc

SEQ ID NO: 24917 - DNA, 362 bp, Sorghum bicolor
  Clone ID: 30943720
tgtgatgggtagtgaaggcactggtttgagcccccttgttgagcgatcctgcccccatttggtcagaatacctggaaatgttgatgtatttgttgaaggagcaggagcagatgcagatccaggggaagaaggtgccagtttttttagtaatcaagatttgagatcattccttgcggtggagagtttgaatgttagtgttgcagcaggcgtgttgctttatcatctggctgcaaaagatccctgtttcagaagcgataaccctagtgttactttaatgtaaggatactgtgtgatccatgcatgtcaaagttactccaattccctttaatgcttctgctaatgaattctttatttcccctttc

SEQ ID NO: 24918 - DNA, 553 bp, Sorghum bicolor
  Clone ID: 30943744
taaaggaactgagcatccaggagtgcccaaacattgagtcactgccgcaactaccccgcttcctcaagacgcttgtactttctcaatgcaaccgctctcttacagatagctgtcggaccaaagggcacccaaattggcaaaagataagacatatcactgagaaaataatttcttaggaagcccatattccaactgcaattgtggcacactggcactagttctcagtgacatgcaagttgggcttgtatggtttctggctttctgctccatcctttgttttcaccagtagtttttcatttaagccatgttccataatcatttgtgaatggtaacacaagaaagtgaaagatattgaattgaacagttcaacattgcccatgttcataactcaaaatgaacaatccagaggccacaagtgatgaggtaggattaggaacgagcaaggcaacaatgtgttcgcctactcatggactgatgacaacctaacaaaaccccagaactggttcaaggatcccactctgtcttactgatgcctgatggagaaaattgacta

SEQ ID NO: 24919 - DNA, 585 bp, Sorghum bicolor
  Clone ID: 30943758
ggattttggagtgttgggtgtagcgtaggatgtatgtaaactagcaagcacttatcatcatcactcactgtaatttacgcaaatactacatagttatattgatatatgctcctagctagttgtcaaggaaatgaatggagggaagaaaaaaaaaaaacatgagctgtcggcatcctgggctgctggattcctccactgcgcatacatttcagttttcagtggaattgtcaaggcacatttggtggagatttgagaagccaaacttttcttcatcagtcagtgacatgttcctaccttggactgaagcaataccaggcaatagcacagtctcaacactgaaagcaaagcgagcaataggatcggtgtcggagctccacaagtagacatcagcttttcggcggccgccgccgccgatgcaatccattcaacttcttctccttcttcttctgctcgattctttattctccacagatagcaatagcaacaggtagcaacagaatactagactgcatttgcatgcctttcttcctccttaagtcacaactcacaaggttgatagataaagcagcatctcaatcaagaatc

SEQ ID NO: 24920 - DNA, 581 bp, Sorghum bicolor
  Clone ID: 30943774
caggatcgacgcgcactgcatgtgctcgccggggttctcctgcgactccgcctaccaggtcacctacatcgtgcgcggcagtggccgcgtccaggtcgttgggatcgacggcacgcgggtgctggagactcgcgccgagggaggctgcctcttcatcgtgcccaggttcttcgttgtctccaagatcgccgacgaaactggcatggagtgattctccatcatcaccacccccaacccaatctttagccacttggcgggcaggacatcggtgtggaaggcaatatctcctgcggtcctggaggcgtcgttcaacaccacgccggagaaggagaagctgttccgttccaagaggcttgactcggagatcttcttcgcgcctgcttcaaactaataatacattcgccgatggaacagtgctgctgctgcctagatatatagctcccatccttgcgtctttagtttattactagcttcgatcgatcagtttaaaatcatcaactgcttatcccctagtggccgctttgcattgagcagttttatagcacttcgtgtaataattagcttgagatggtagagagagt

SEQ ID NO: 24921 - DNA, 699 bp, Sorghum bicolor
  Clone ID: 30943782
aagcttgataagttggatgatttaagtcagaaatgggcaaacttgggcgtcatgggtgaaagagagaattgatttaaggcgaacccgagtattcttccgtacatatgaaccgtctcattggagtggcttgaatcaaaaggtgtgtgaagtaacagaacaacctacaactgaggccaatggaaatgacaggagagaatttggtgatatacttgctggtgttgtggcaaatatgggtgtccctgtgaccatactaaatgtgactttgatgggggcctttagaagtgatgctcatattggcctttggagtcatcctaacaccatacttgattgcagccactggtgccttccaggagttccagatgcttggaatgagcttgtattttcccaccttttgacgaatggttggcgagtgccggctagctgactattgacatggtataccttttttccccgcttcgtaatttcctttttctttgctgcaagaatccttgtgggcagcagcatcttcccccaagttgtgttatgttcacctttttccccccctcggtcacataggtctgcacatctcctgaggcatagaattttgtgacatttcctgttttggctctttttaggcatagaagcatatcacaagtggcaacctgtatgtaacaacagttcatttgcaaaacttcggaaattcaatttttatgcacatga

SEQ ID NO: 24922 - DNA, 488 bp, Sorghum bicolor
  Clone ID: 30943804
agctaaaagtgaaagttaaagatcgaagtgtaattgttacaacagatgcagagacaaaagttagtcagccttctagtttgcaagaattaatagataaggagactgccaactacaccaacgggcgatgctttgtgcgtccatctggtacagaagatgtggtacgggtgtatgcagaggcgtctacacaggtggaagctgacagtcttgcaaaatctgtggcacaccatgtggaacgccttcttggataaccatttgcaatttcgtttgcgatcttgagtagactacattttttaattcctaggatcatgccttgtgcattttgatttgtaacttacacatcctgtgagtccaaacttttgaactttgtggttgacacatgcactgaacagaaatcaattggttcttgtatctaaacatgatagtagagatttgaacgactgtaaaatcattccgttgtagtactcattcttcctgatttgtttgcactc

SEQ ID NO: 24923 - DNA, 660 bp, Sorghum bicolor
  Clone ID: 30943810
gtcattactctgcatttgtcttcagcaagcactcagcagtcagcactcagcacacaccgtgtccacactccatacccagcgatagccgagagatcaacatggtgcagcggacttccaccgcccaagtgatgtccatggacctcagcccaaagaaacccaacaaggcctacggcagcgatggcggcgcctactacgactggtcccccgccgacctgcccatgctcggcgctgcctccattggcgccgccaagctctgcctctccgccggaggccttgctctgcctagctactccgactctgccaaggtcgcctacgtcctccaaggtaagggtacgtgcggcgtggttctgccggaggcgaccaaggagaaggtgatccccgtgaaggagggtgactcgctcgcgctccctttcggcgtcgtcacctggtggcacaacgcgcacgccgcctgcagcagctccgactccgacgacctcgtggtcctcttcctcggcgacacgtccacgggccacaagcggggccagttcaccaacttccagctcaccggctccacgggcatcttcacgggcctgtccaccgagttcgtcgcccgcgcatgggacctcaccccggacgccgccgccgagctcgtctcctcccagcccggcgccggcatcatca

SEQ ID NO: 24924 - DNA, 747 bp, Sorghum bicolor
  unsure (1)..(747): unsure at all n locations
  Clone ID: 30943818
aaatatttaaaatcatccacttcacaaccaccgcgagagtcgccgcctcgcctcgcttcacctcctcggacttggccgcgccgcgcgtaacctcacctcacgtcctcacctcaccaccgctccaaacgcgggtcgcaacgcgccgcgcggcgctgccgcatcgagagctctgtttttgcggccagcttttttagggtcttagcgcggcccgccccggcgatcgcgggagaaaggaccgccggtcgccggagttcggtgagtgcctgatctgccctggtgccctgcatcgcctgtcgttgtcgttgtctttgtcttccgacgaccgggctcagagctccctgatctcgaggcttcgagagctgcgcgcgggctttggattggagccgtgcggatcgatccgagtcgatccgccggacaaatttgaatccggaggcaggatatccatcggccctcctgaattgtggcgaagccgcgggtacgagattcgaagagattttggttggacacagttttgccctgaattggttacaagccgatttggcaacagggaagctctggaatgggagatcgggcggctgcggcggagaacgggagatggtgagcggaagctttagccggagcacatccgcgcggctcacagcgaggggcggcgtcgggagcccgcgggtgtcgacgcccggagccgcgcaccggaactggtactgggcggcggcggcgccgtcggggccgtcgntcgatcgcgtcgtc

SEQ ID NO: 24925 - DNA, 626 bp, Sorghum bicolor
  Clone ID: 30943825
aaatccgcctcctctgctcatctctccctcctgcctattatcgccggctgccgtgccgcagcgtcctgctcctccctccccgtcgcccgaagcaccgccgcggcctcgcgccaccgcccagaaaccatcttccccttgccgcgccgccgagcctatccccggggcctcgttccaccgaagcgcgttgtgtcaaatttctgcgacctagccgctgccgccgccgtcgtcatcatcctcgctggtggtgctgagcgcagatccattccagctcggattgatttcttcctttgctgtgctgtcataactgaactagaacagtttctgagagcaagcatcacgattgttatggaagctgggagagtggatcagccttgcatggctgctaccaatagccaacctttcgtggctgatattgagccagtgaagaaagccagtggggacatgcctgtgacaacaggaagcggatgctttgactgcaacatctggcttgattttgcagcagaaccagtggttactctctgtggccatctatactgctggccttgtatctatgagtggctgtgccctggggtggagtcaactgccagcgacaacagcagttcggcaaggcggcaatgtcctgtatg

SEQ ID NO: 24926 - DNA, 596 bp, Sorghum bicolor
  Clone ID: 30943846
accgaacgcgccaagtcccggcggaggcggtggtctttgttcgtctcctcacctcacctctcctctccttcccttgtcccgcgggcgggcggcgaggcaatggcggccaccgcgcggcttcttcctgccttcgccgatgctgctgcggcggcggcggcgctgctggtggtggtgctctgcctcgcgggcggcgcgcgggcgaccaacgtgacgtacgaccaccgcgcgctggtcatcgacggcgtgcggcgcgtgctcgtctccggctccatccactacccacggagcacgcccgacatgtggccggggatcatccagaaggccaaggacggcggcctggacgtcatcgagacctacgtcttctgggacatccacgagcccgtcaggggacagtacgacttcgagggccgcaaggacctggccgcgttcgtcaagaccgtcgccgacgccggcctctacgtgcacctccgcatcggtccctacgtctgcgccgagtggaactacggaggcttcccgctgtggctgcacttcatccccggcatcaagttccgcaccgacaacgagcctttcaagacggagatgcagcgcttcaccgc

SEQ ID NO: 24927 - DNA, 671 bp, Sorghum bicolor
  Clone ID: 30943854
tggcctacgggggggggccaagacacagcgcaagttctgcttggtagagataccagacccacaggagcttatctgcttgatgctgcactgcaggggataaatgctatagttggcgcacgcgcaattgacatgggaattttgaccacccctcaactgcattggatggtccggagcaaaaacagaggtgtcaaggcttccgagtcagattattttatgcaacttatcggatcgttcaggcgtatgttggaattagtgccaaaagataaaggtggggatgaggctgccaagaaactaattgtggatggagcaaatggcattggtggggtgaagctcgaacaaataaaggcggagctttcaggcctagatattagtgtgaggaattcgggcaaggaaggagaagggatactaaatcacatgtgtggtgcagactttgttcaaaaggagcgagttactccacatgggtttagccctgaagatgttggtgtaaggtgtgcaagtttggatggtgatgctgatcgactcgtctacttccgtttgtcatcagctagtgacaataggattgatcttgttgatggagataagatactatctctatttgccctatttatcagagagcagctagatattattaataacaatggtggtcaagcaaacaaatcattgtctgcaag

SEQ ID NO: 24928 - DNA, 565 bp, Sorghum bicolor
  Clone ID: 30943908
cctttcacgtttgctttgactgcctgtggctcacgcccgtcaacagcaacagaaccgttcaagatggccaccgacggcaagcagcatctgtccattgtgatttgcgggcatgtcgactccggcaagtccaccaccaccggccgcctgctgttcgagctgggcggtatccctgagcgtgagctggagaagctgaaggaggaggctgctcgcctgggcaagtcttccttcgccttcgccttctacatggacacccagaaggaggagcgcgcccgtggtgtgaccattgcctgcaccaccaaggagttctacaccgagaagtaccactacaccatcattgatgcccccggccatcgcgacttcatcaagaacatgatttccggtgccgcccaggctgatgtgtgcctgctgatggtgcccgctgacggtaacttcaccaccgccatccagaagggcgaccacaaggccggtgagatccagggccagacccgccagcacgcgcgcctgatcaacctgctgggcgtgaagcagctgattgtgggcgtgaacaagatggactccgacaccg

SEQ ID NO: 24929 - DNA, 578 bp, Sorghum bicolor
  Clone ID: 30943914
ctctctctctcctccctccctcactttctctctcatctactactagtagtaactcctctccgcttcttccgaagcggcgcgggcggaagcgagctcacaccaccgtagcgcgcgcgcgcgctccacccaccaccaaattccgccgctgagctcgccgcgaacgccgacgcggccaccctcgatcgggcattggaaccccgtcgccgctcgccgccagcacggcggctcgccgcgggaaattttctcgaggccgtctgtgacccccctccctcggccgcgagatcacgcccagccgaatggcgcagagcaactgggaagcggataagatgctcgacgtgtatatctatgactatctgctgaagaggaacctgcagacgacggccaaggctttcatggctgagggaaaggttgctgctgatccagtcgcaattgatgctcctggagggtttctctttgagtggtggtctgtcttttgggatatattcatcgcaaggacaaatgaaaagcattctgaagttgcagcggcatacctagaggcacagcaaataaaagcaagagagcaccagcagcagatgcag

SEQ ID NO: 24930 - DNA, 455 bp, Sorghum bicolor
  Clone ID: 30943916
cagattcctcgttcgcctgcttgccacacgctcatcaccttcctcgatggctgatgaagccatcagcgcagcgtgctcgtgcctggagcccctgttcggatgtctgctccaggcagcggaccgggaggtggccgcgttccttcgcatcaagtcgaattggggcgacctcggaagggctcgggacagcctgcgagccgtcgagacgacggtcagggcggcagtcgccgcggaggaggacaagctgaacgtctgtgaccctgaggtggaggtgtggttcaagcgcgtcgacgagcttcgcccggacaccatcgatgaggattacagcagtttgttagggttctcttgcctctgccagtgcaccgtgcacgctcgtcgccgcgcctcgatcggcaagcgtgttgtggaggcgctggaggaggtgaaagaactgaccgagcaagggaggaagttcagga

SEQ ID NO: 24931 - DNA, 665 bp, Sorghum bicolor
  Clone ID: 30943920
cttttcccctcttcgttatataaaccctagactaaaacccccgagtcccgccggatccctctcgccacaaccaccgtgccgcgtgatcccatttcgaaactaaaaggaggagcgcgctcgtactgagctccccggagcccgaaccctagcggcgccagcggttcagatggaggcgcacggtgaccagcggtggctggtggagtgcctgacggccacgctcgacaccgcgcgcgacgtccgcgccttcgccgaggagtcgctccgccaggcctcgcttctccctggatatggagctgcccttacaaaagtcaccatcaacaaagagatcccatttggtttacgtcagctggctgctgtcttactaaagcagttcatcaagcagcattggcaggaagatgaagagaattttgtgcctcctgttgtttccgcttcagaaaaggtggtcatacggcagctcctgcttacctcattggatgattctaatgggaaaattcgcactgctattagcatggctgtagcagctattggacagcaagactggcctgaagactggcctgagttgcttccagttctcttaaagttaattggtgatcaaagcaatgggaatggagttcgtggagcattaagatgcctagcccttctatcggatgatctagatgatacgt

SEQ ID NO: 24932 - DNA, 637 bp, Sorghum bicolor
  Clone ID: 30943924
caggatgaaggacaaggtaccgattaaggatgatgatgataatgaggcaattggtaatcctgaacggggaaggattaagggcaggtatcaacgaagagaggtgctgggaaacaggatgccaaacaacgtggcgattagggaacaagaggatgatgatgagaatgagccaattgacaatcccaaatggggaaagattaaggacaggtaccagcgagttgtggggagggatggagggtcccgtggtgagaggtttaggagggagggatttgacaagccagatgtgaggcagtggaacaagcaggagaattggggaaggaaaacagggaaggaagcaggggaatcatcggtgccaaacatagtggggcaaggagtttatggtgttgggccggtccttgcagcactcatggctcggaggagggaattttatgcattgtatatacaggaaagtatggatttgagcgggaacaacaagaaaaggaaagataagaaggcagttgagaaagtgctacggatggcagaggagattgggctgaaggtaattgagacttcaaagcacgatcttaacatggtggtggataaccgaccacaccaaggtgtggtgcttgatgcatcacccttggaaatggttaatataaag

SEQ ID NO: 24933 - DNA, 690 bp, Sorghum bicolor
  unsure (1)..(690): unsure at all n locations
  Clone ID: 30943948
tggtcctatgacgtcattgttggcatcacatattaccaggtggatggcattgctgtagattctttcatgcctactattgcgagatggcacttgaggaaaagaatagaggagctagaaaatgttgtcaccgatgcgcggaaatgtcctctgttgaagcaacaaagcagtagtggatggaatgatattggcaaaatgaacaggagaagcattacatcaagtactacaaggaaagtgtttggtcgtgatagggagcgtcgtatgatacagagtatgcttcgtgaggaaccagatgatcacgcaccaggcaccagtagcagtaaatgttgctctgtgatttgcatacatggcattgcaggttctggaaagactacactggcacaatatgtttgtgaccatgaaaacgaaaatagagagaaatatttcaacccaatcatgctcattcatgtttctgagactttcagagtgagtgatatacttcatgatatgcttgaggcgatcactgaagatcggcactctgatattagcggttgtaaaggtctgcaagcaaagttggtcgataaattgagcggcaagcgtttcttattggtactggatgatctctgggtcaacgatgagaatcaccaggacctggaggagatactttctcccttncatgttggaaagagaggaagcagaatcctggtgactgct

SEQ ID NO: 24934 - DNA, 601 bp, Sorghum bicolor
  Clone ID: 30943962
agcgccacctccagtccagtcgtcctccgctccacctgccccccctcccaagtccggcgaggagaaccaaccgacagaccaaccagccaatccgtcgtcgctgtcgcccgcccgatggacggtagccgccggagcccccggatccaatccacggccctcgccgcgggcgcggggatggattacgacctcgccattggtgatcagggtgagttgtgggaatggcaaagtcaggagtatgatctgcagaatgatctgttagctgatccatgtagcagcttgtgggctgaaacaagcaacaatgtgggtgacgaatggagcatgttcgatgagcaaacaccaattaaacattgtacagacttcgaatttcagttctgtgatataggggaaatcattgtcaaggactttgaagaagggaaagaaacttcacaggcaaaacgcagacgcatgctgcagttctgtccagaaaatgctgagatgacatgttctatgactgaagatggcctttccgaaagtcttcaagagatggatttttcaggtaccgactgtttgctgaactcggatgggattgatgaactgccagaagaatggctagttgattgct

SEQ ID NO: 24935 - DNA, 592 bp, Sorghum bicolor
  Clone ID: 30944041
aaaaccaagttcaacgctacacatcatttgctaaaattttgcattttagtatgactgatcattgatgaatggagaaaattcaaatttgtgcgggagtttttgtgtccagcctgatgccgaaccatttatcatccgagttctcaatttgtgcatgctattccatgaattatttcggtgcgtaacttattcttcgtttgtgcagaagcttgcaagggcatcacctgagcttgcattaattggttttcatacccatagaccttacaacagtatgcctttataacgtcgtccatgcatatggaaatatagttaattgtgcattctatcaaatatgcaatatgtgaatattttgcaatgcagtttttcgtgtgccgcgaagtagatggacaaaagatattgatgctttcctatcatagttatctggaatatcattcagtagtggaggatttagtgaagttcctacttgtgaaggttttgctgaagcactgatggtattgacctgttatagttgattaaagtctctagtttcattcatgcagccaaaagctagcatgttggagttttgttaacctttcaagatatcttcttgatcttt

SEQ ID NO: 24936 - DNA, 612 bp, Sorghum bicolor
  Clone ID: 30944048
attgaagttgtacgttggtggagcacttactggatcagtattcttcttgctggagaaggcttttctagctcatcggaaacaggattatgaaggatgggatacttcaagagttgctggacttggtgcaagtgccgcagttaatgcaactatcctccttcagatttttctgtatcccaagggactagtgtatctttatttcctcattcctgttccagctgcacttatgggtgcagccataattggtgctgatttacttaggttgaagaggcatggcgaggtatcaggttcagctcatttagggggtgccctggttgctgctcttatgtgggctcgaattaggaaaggctggatctgatcttctagcgtcatgttatatgtgtatggaaagaaagtgtaaaggcaaccatctgcctccaccttgtggcccatcgggttgaaatttgcatttgttatcagataatttgcttagagttgaggggatgtgccttctaatacatgctactttctgtcctggataatgttgtgggcttgtggcggatattgtcaactttggcagctgaaattttaagaatgttatcctgtcaaagacaatgtgggttcactgtttcaaaa

SEQ ID NO: 24937 - DNA, 588 bp, Sorghum bicolor
  Clone ID: 30944060
cactgacgacatacacgtcctgcctccttgacagtaattctccagtcgatgtgatgagctgtggtgacactcacaataatttcagtagctgcatcataggtagtgcccttgagagcacacggactgtcgacgatggattcgtcatggatcagatttggagggagatggagacaccactgcaggcgccttccttgccgcaggtcattcatcaagcagacgagaaaacatgcagcagtattgttcccttgtgcactccggcaacaacagctgccatgtgggatgatcaatgccctgaggtgttctggaacatggatgctgaagaaataaggatgttggctccacaatttgactgcgctgaatcgtgaatgaataagtctgcaactctacatacccccggcccgtccgtcatttattgaagttcttatattatagcaccctgttgattcctcgaaaaaaaagtgtatgcaactacgctgtgcgaaaaacaatgtgtctgactgtcagtttgtggcatatagtgtgcaagatgtatttgtcgtgaatctgtggttattttcaccatgaactaacactataacagcattatat

SEQ ID NO: 24938 - DNA, 699 bp, Sorghum bicolor
  Clone ID: 30944063
gaatagtacatgagtttgactttgacagagaaaggttgtttcttcaagtacactgacatgatccactattttttggagagtacaaggtgagtctgctattggttggagagtaatagttgaatagatcactttagttttcaaatgtggttatgttgaggaatacctgcttgatgcgactaaatcattctacctatatcatgggatgacaaaaaattgtggatgcagggaatttctatgcattttgtgttgcaaagcttctttggcactttttgtcatgatgcaaggcctaactattttgttctttgctggggttttgttaacatgcattcaagtcatttttatgagatttgactacgagatcctgactttgttggttggccgttgtagattactttgacgaaggagttgagtagctctttgtatggctctcctgaaacatgctccgtgtcagtggtggctttcttgccagctgtggctgcaattttgcagctgagatcataaaatagaagtaaaacatgtttgccaagaagaggatataaacattttggagttgcgaacaaggaccaaaagcaaccataatactgtgctggaaggaatttcaaaatagttctgaagttggagttatacaaatggacatggttaatttaaccaattttgtacatatttagttagttattaatagaaagtttaaaattacct

SEQ ID NO: 24939 - DNA, 629 bp, Sorghum bicolor
  Clone ID: 30944067
agttgaatgttgaggtagcctgttaatggtgaaacgaatgattgggtgtaatctagaaacagaaccttgtcccttggagtctgatcgcacccgcagggtttgaggtctttgaggcagatttgagcaccaaaccaggccaatggatatctgtccgtgagttgggtagccaagctctctttgttgggaagcactgctccaagtcttttcctgctggggagtttactggagttgaagagaactgcatatatttcatgcgtgactattttccggcgaacctagctgctaatcctcttggtgacagtggtgtgtacaacatgaaaagtgggaatatcaaacccttgttatcagagactgcagctgtgccacagcatcatggtggtcggtggtgtccaacttggatattcccaactgatgctatgtaatcgctcagcttagcttgctgttctgggattaagtatgcacttttaaacttatgttagtcgctcagttatctattattgaaccatattagctactcaataagactaaagtatcatctatttgcggtatgttcttaagctagtttttcattgtactgaacttagtttcaataataatgtttacttatggtgatgatgagaccaaggaga

SEQ ID NO: 24940 - DNA, 588 bp, Sorghum bicolor
  Clone ID: 30944099
agtcaacgatttactgaaagaggcggctgctaatgcacgggcacaacttgagaaggaacgaaacagcatagagcaatctttatcaaacatagtagatgtccagatgatggaaatccaagataaaatatgccggtttgaacagaaggagatgctgatggagaaagagcgacagcagctgaattgtctaagggatatacttttcacagatcaattggcagttatgcaacatcaacaaaggactccagctgtagtcacagagtgcaaaggtgatgagaagccaaagcccctggcaaacatgagttgattcgagtatatcctcggcatagcatgattctgatgtattatttcagcggcgttcatcctcatctgccgttggtaggattggaactaatttgaaatgctacatgtaagtcgatactagttctctatagggtggtggttccgttaattttggcatccctttccgtttttgcacaatgagctcagctccaaataggcctgaagtgcgagggcaagtgtatgtatgatgatgactaccggttggtgcaagacagcttattaagggcccgtttagattggcaatgaaaa

SEQ ID NO: 24941 - DNA, 576 bp, Sorghum bicolor
  Clone ID: 30944147
ctactggccgcctctccttctccccttcccctccgatggccacaacggcgacaacgacggcgacggtgacggcgccggcggccacagccaacttcgtacctacaccaacgcctccgcatccacgccccgccgcgccacctgctctccgggcgccttccaccttgggtcctgtcaagtcagaggcccctcccaccccctcgtcctctaccgccaccaccgccgcggccgcagccgccgtagcggaggatccatcctacatcatcaccgtccctagttattcagcgtggttctcgttcgactccatccacgacacggagcgccgcctcctgccggagttcttcgagggagaggccgcggcggcgtccgggtgccggggcccgcacgcgtacaagtattaccgcgactccctgatacggaggttccgggcgcggccgggtcgacggctcacactcacggaggccaggagggggcttgttggtgacgtcggctcagtccgccgcgtcttcgacttccttgaggaatgggggctcatcaactacggtgctttgccatcggggtcaaagcaagcgaaagaga

SEQ ID NO: 24942 - DNA, 426 bp, Sorghum bicolor
  Clone ID: 30944211
acttcccggcagcgagccggagactccgtggagcccctatccccgcgccggcgtgggcggagggaggaggaggagcagcagcagaagcagcagcagaaggataaagggggctctgggagcctctgagaagaagcttctagaagctgcctgaggcgagggcgagcgcgccgcgggcagagtgatctcggtggaataagtcgcgcggggccggcgccgtgagggacgcgcctctggatgccggcaccctccgggatttgaatggtgtccagatctcgagggggaggggagcttctcgaagcggggtgaggcgcgcgggccggccggcggttagggtttggtgtgaggcgggatggtggggagctcggtggagggaggagcggacggagatggaggctgctgcggcgtcggggacacctctcccgggga

SEQ ID NO: 24943 - DNA, 646 bp, Sorghum bicolor
  Clone ID: 30944215
aaacaatggcggcgcttccccccctccgccgcctcctggccctccgcggccaccgccgcctcctctccaccaccactcccgccgcctcatccagcaacccccctaccccagaggccgtgctctacgacatccacagcctctccaaggacccctcccaagcgctcgccgtcttccgccgctccgccgccgccggccagcccgtcagctccgcggcatacaacctcacgctccgcaccctcgcatcccacccctcctccgcccagcgccatttctggcccttcctccgggagatgcaagaggctggccactccgtcgaccagggcacctacctcgccgccctcgcctccttcaagaaggccagcctcaccgccgactacgcctccctcaccgcgcactacaacaagttccggaagggggccaactccgccgccgccgccgccgccgccgcggaggctgtccgggaccacgacgccgcgggcctcgatagcaggctcgctgacatcggtctccttccgctcacggaaaccaccgtcatcacggtgctccgggagctgagggagtatccgatcaaggctctcgccttcttcagatgggctgagcagcagcaggggtacacgcacagctcggtggcctacaatgccatggc

SEQ ID NO: 24944 - DNA, 648 bp, Sorghum bicolor
  unsure (1)..(648): unsure at all n locations
  Clone ID: 30944237
gagactcgagagtagttcgaaacccccccttctcggagttggaaacgaaacaccgaggagcccccgcgcgagccggcggcgacggcggccggagcagctttgcagagcttttcgaggttgaggagcccccgcgcgagccggcggcgacggcggccggagcagctttgcagagcttttcgaggttgccaggcggattcaccatgcggaggaagctgctggagttcccgtccctcatcgcgcagcacgccctccgcggggccccaaaacccagaccccaaccccagccccaccaccaccgcttcgtgcactccccctcagcgcccacatccgcatccccttccccctccccgtcggcccacctcctatggaatcgcctctccggcgctaccgggctctctctcctgccgaggacggctgcggacgtcgcagcggtcgcgcggaccgccgcgtcccggtggctggccgccgcgcgcggctccggctctctcgatctcttctcgttgcagcggcgacgcagggcctcgtggtggcagttatcgtcttcccctttcctccaaggcgcgccctgngcgtactggatggagtctcccgacagtgcggtgtggatgcttatcggtgcgaatgtagctgtctttatgctgtggcgtg

SEQ ID NO: 24945 - DNA, 464 bp, Sorghum bicolor
  Clone ID: 30944245
attattatcgggctctattatcggacgagtaaccatccaatcaaacaacactcaaatcgacgcaaggacgcatcgcatcgggcaaatttaccgaaccatctctctctcttctcttcctccctagcgtacgtgtagccgagctacgctagcgtctgaggaaagacgaaggaagctacagcggccgaggtcccccattcgcgcccaccgaggcggcgaggcgtcgcgcatgcggccacccgcacccaggcgccgtcgcgggggagtgaggcgtgcaggcggagcaatggcgagcggtctgggccgatccgtggatctgtaggcgcggggggtgttggctggtgctggtgcgtgatgggatctgggagcagcaaggccaccacctcctcctcctcctcctcctcctcgtcatcgcgcacgtcggcggaggcggcgggcggcgaggttaagaggccgaatgggagcgg

SEQ ID NO: 24946 - DNA, 602 bp, Sorghum bicolor
  Clone ID: 30944257
aaaaaaaaaaacacaagtacacaactcctatcaagctggaccttgttcatcaaagatgtaaaccatctgaaactggagcgttaatccacaaccacaaagggaaagaagagcagccagactggttccccttctcagtgaccaccgctgaaactggaatacaaggttgaaggacttgaagcaagcaaagttagcatggtgacagtgagagaggagatgcgcaaggggccatggacagaggaggaggacatgcaactggtatgtactgtccgccttctcggtgaccgccgctgggactccattgcccaggtctcaggtttgaggggtggttgtggaactacagcaaattaggtagctactctattttatatatttgaaatccttcaacagattaagctagcaatcaattaaacagcaacacgtataccatgcatgtgtctgaacaagaacaaccctcttcacacttcacaagttcacagtagttgcttcacgctctctgtgtatgctcatgctcatacaggcctcaaccgttcgggcaagagctgccgcatgcggtgggtaaactacctccaccctagccgcaagcatggacgcttgtcgccgca

SEQ ID NO: 24947 - DNA, 724 bp, Sorghum bicolor
  Clone ID: 30944265
agtgccctctccgccgtgcgccgagtccacctcgccctcatctgtttcgccccatcccgccctcgcttactctgtcgatcttcgccgtcaccactgggtccactggcaacagaaactccgcacggaatgaccgccgctccgacccgtcctcgcctcctcaagccctcgccaccgccgccaaaacggcccatggctctataccaccaacgggatgaacctagcatagctcccgctgaccggctagcaagaggaaccacggtcccgcttcacttgactgtataactccagcgagaccgctcaacgcgtctccaagcgccacgcttccatcctcgagctcgagaccgagagcgtcgttgcagccggcgggccgagggcttcggagatctcgacatcatgcatcgcctccaggcgctgctcctctggctgcgtcgcctccacccgctcgtacatcccggcaaccctatccaaggacgctaccaccttcgtgcagttcctcccgacgtctccagggtgctcctcggtcactaactaatgggcctcagggtcactctggaatcattgtcaaggtagcacatgaatttcctaaaacaagccccaatatccatctacattttcagactatcatttttgccaatctttctggaacctacctgcttcaactgcactaccgagtagctgttggggttgaaaaaattatgtatgcattggtatttctatgaatttt

SEQ ID NO: 24948 - DNA, 597 bp, Sorghum bicolor
  Clone ID: 30944271
cctcagctttttattaacggatccggacgaggcgctggtgtcatccttaacgccgccaacctccgctcccccgtcgtcatcacccctcacgcctagcagtaccagtagacctcggcctccatctcgcctgcattttcatgatgaaggaggcacgatcttcatcttggtcagacctactgccagaaatattggggcttgttctcaggcggctaccctctttagctgatcgtgttcgactaagggcagtgtgccgcccatggcgttccaacgctcagctagatgccctgctcccactgcttccttggctcaccctccttgacgggactttcttgagtattccggatggtaaaattatcagattgccgataccttttaaggctttttgcagaggttctgttgacaactggatgttcttcgtcatggtgatggtgggtgctcactgatgaaccctttttccaaggccacacgggacatttctaagctagtcaccacgtggttcaattcaaactccagatgttacagttatcatttctttaagctggtggcaccctcgcccttggaatcatcaccaggttcccttgttgcgctgatcttgga

SEQ ID NO: 24949 - DNA, 672 bp, Sorghum bicolor
  Clone ID: 30944283
atctacatgctcaccagcgcaaagcaaacgttcggcgcttccactgttcagatcctgcactccatatacacctacaggtaggtagtaaacaaaggcctctgctacattactaatattacacaatgcacatctactcgctcagttattggctttcgctgcaattttaactttgttcatccttcagggactacgaggtgctgaaccatgggctgctccagacgctggtcgagaaggtccaggcgctggaggaaaacgccggcgggagggcgctgtcgtatggctcggagtcggaggaggagagcttgagagactactcgtgggtcttcgacgagttggcggacgaggcggacagcgagatggacccaacatacgtgctgccgccggagagatcgcctctgattcgaaggcgcaaccaggtcgtcatggcggaggagatcggcgagaactccatcacgacgtcggtctcccggaagtacaatctgcggccacggaaataggcacagcggtctggttttttagttcggaggaaggagctattttaattgtgtgtcgcatcaatgttgatgaaaattttatttacacgatgttctagcacattttcatggaagctacggttgtgaaataaaattacgcttcagaaatcttgtatgatgttcagcattttgcaaattt

SEQ ID NO: 24950 - DNA, 539 bp, Sorghum bicolor
  Clone ID: 30944285
tcatggtgtggagactaggacaagttctcccttacaaatttcacgacatggagaaacatacgaaagtacatcactgcgaggattatatccaattggggaaggtgctggctatgctgggggcatattaagtgctgctgtggatggtatgtattgtggttttgctttagctaaacagctatctctattccacggtgatatagagtcatttcttggcaaagcacaaaaacaaacaggttttgtaaagtattgaatggcagtgcctagtattttattggtccaaaattttggggaatgattctcgccatggcagctttatatcataggacaattttgtcatgtttagagcagctgtgattgccttactgaattcatcaactaatttgtgcacggttgatgtagaagggcagagcaaagcagtgacgctgtaggtgaatgttctggtatagatatagctatgtaacaaataatttgtagcttcctatgtggatgccaccttaatttggtgaggacaattcaccaagcataatctgagttctctt

SEQ ID NO: 24951 - DNA, 475 bp, Sorghum bicolor
  Clone ID: 30944301
taaggcagttcatccacgaaaatagctccaaatttggtcgccatccatatgatctaataagccagaataaacctgtacagttttggagaatgcccatcccatctgaagatgttgtcccttatgctccgtatcaacgctcttcacatgaggaggtcccagatataacaatccaagatgtgttgtatggaaacagtaagcttcatgggaaatttgaggtcctatcatggaggtctcagatccctcctttctatagctatgttctctcttgtgagattcgaaagaaaaaaactgcaggtaccaagaggtagcgttttaaaaattaaataaaagttgaaacagatttgttgaatattttctgttgtggggcttaattatgcggtgaaacatctgagtatcttttgatagggtgtcacatgcaagctaactgtactactgctaaaggttgtaactgtattactgttctgccttaatgaaa

SEQ ID NO: 24952 - DNA, 698 bp, Sorghum bicolor
  unsure (1)..(698): unsure at all n locations
  Clone ID: 30944331
atttatacagcgctagctacttcaaattagtagccaactatcccttccctgtgacttactgatgggatttggagcccttttttataaggggccctgggttgaagtaaagttatacttgccaaagaccttgtctgcttgtcatgcatttttcatgtatcttttcaggtgttgctggagcaagtgacatcttctccatggaataacatattgttcttgttctattanggatatgttgctgagaggaggcctttgaaggaggtgacgaccagggtcaagaaacaatatccttctgtgcaattgagcgcttggatgttttggccgatagttggttggataaaccatcagtacatgcctttacagttccgtgtgatcttccacagcgttgtcgcatgctgttgggggatatttctgaaccttcgtgcaagggccatgtctctgaagcaggcgtagatggtttagaaggaagaaatagcagcatagctccaacccggtaccagatgaaatgaatatcaaggaagctggatgctgttatcctgtagtgttctgcacccaaatcgttgctgaatccattcaagtagttgggtttttttttactgttaattatctggtactggtagtagatttatttgattgtcaacgcgtgcaaagtacagatgacccttacgtggattgtgaattgtgatggaagcaaagtatgg

SEQ ID NO: 24953 - DNA, 612 bp, Sorghum bicolor
  Clone ID: 30944388
ttactacaagaaataggtatggacactgaattcgacttaattttccagatgcttggttggacaaatttttggaatataattgagctaggttctcgtcttctcaccctcgaatttctttgcactttacaatactatgaggggggaattgtttttcggatgttcaaacaggaaattatgttgtcttggagagagctgagcgaccatcttggtttttcttcaagatgcatcctaaacattgactccgacctacctaattttgagagacaccagttttggagagaaatatctagagataatttttatagtcaagcccgaaccagtgacatggaacaccccactcttaggatgttgtacaaatggcttgggtacaatcttttctatcgtgatgatattaggaaagtaagagtaggagatttgcaacttttatatgctgctattaataaagtacccacttcacctgttacacttttagtttctcattggcttagtatacctagtcttcagggaccagtaggatgtacttcacttatcactcgtctagcctctaaccttcatttactagaaaactcgtcattggacttcataaatgagttaagaatttatcatggctag

SEQ ID NO: 24954 - DNA, 598 bp, Sorghum bicolor
  Clone ID: 30944394
gagcccggacatctggtgcaaagagggggagctgctaaaacgcacaagaaaagggggtttgcacaaaataagagtatctatctacatcaacaagaggtcacaggtgatactgaagctgaaaagcaaacacataggaggtgccctgtcaaagaacaacaagagcgtggtttacggtgtatacagcgagctgccaacctgggctgagccagggaagaattctacggaggagacatgctgcttcggccttagcacggcgcaaggtctagtggagttcgagtgtgagggcaacgcgagcaagcagaagtgggttgacgatgtgcagaacctgcttcgtcaggcggctttgcatgatcaagtagggaacaaactgggattagtaaaactcagctagtgcagcctcagtatatccactttcatggtagcagattgctgtgtcctgcatcagcgatgtgaggagtacataacatattgctcgtgctcttatcactgatgacttacatgctataccacataaggaatatatattatatgttttgtaaaggaccggtgcgacaaccaaaatcgtcggaaggatgctgatcgctggttttcgggaaaa

SEQ ID NO: 24955 - DNA, 679 bp, Sorghum bicolor
  unsure (1)..(679): unsure at all n locations
  Clone ID: 30944429
gcagagccatcactagtgacctgcaaagacatcacacgcgaggcgcgccaactgcagcagctggttggtctgaattaggaaattaggatggcgatggagaagaagagctggaaggccaccagagacgttgctgctggtgctttcagcatggactgcttggagttggtgggcgaggaggacgacgacgacgccgtgccggcgataccgccaccgcagacgccgatggagcccatggagtacctctcccggtcgtggagcgtgtcggcgtcggagatctccaagatcctcgtcggtggaggtggcaagaagagcagcgctggtgttgccgcggcgagccggcttcggccggaggtgactataccggagctgtctgtgctcgccaccacgtcctcctccatcgtgcctctcccgtgtcatcatcagcagcatagggatgcaagaagatcttccatgagcagcggccactactaccaccaccaccaatcgatcggcaaatggttccaggttcaccacagggagacatgccgggcgaagcagagcggcaaggagaagcagcgcgccgacnaggcccacgtgcacgccatggtgtccgtggcccgagtcgcggccgcggtcgccgccgtcgcggcgtccacggccacgagctctgacagtacccaggcggctaccaagatggcca

SEQ ID NO: 24956 - DNA, 198 bp, Sorghum bicolor
  Clone ID: 30944440
agaaccaaaaacctatcatcctcatttaagaccagcatatgtcagtgtacaacagctatggaagtccacaagcccaaagaaatgtagcctgaatctatacaaatcaacagccctaacaaacaactgaccaaacaaaagattaagcaaaaaataaactactacctagacaaaagaagagctcaaaaactcaaattaaca

SEQ ID NO: 24957 - DNA, 684 bp, Sorghum bicolor
  Clone ID: 30944448
agcacaacttattgcttgcgccgcaacgcaattacctttcgttcttgaatcttgattggagaatttcgtctagttcttgtccattcttgtctgaattttgcagcaacgacggctcagtttaggttgtcactcgtttcatcatactttttcgtttgaaatgacttgttctttgaggaacatcacaaataacccgatatcaagagaactctcttgatgacccgattgggtgttttaatccagaacaatatgaacataacaatctgtatgaaatcgacggttttttatgatacccttctctgttcctggcaggggctgctgacctcctgattttaagctgccaagatataaagatcacttattgctggctccaggatcagtttttaacagaatgatgtcaagaaacccttggctcgtgctgctgattttgatctgcttcttggtttgccctgtgaggatccatggattctcatggaacatcttctcctcctcgtctgcgcccaagggcggcgaccgcgctccggtgatggagctcgagggcgcggtggctgacttcgccctggatggaaccaacgaccctagagggctgaagctgctggagaacgcgcggaacaagctcgccgggccgaggaactgctggcaggaggcgtaccggaagctgttcgccagctgcagcgagatcatggc

SEQ ID NO: 24958 - DNA, 676 bp, Sorghum bicolor
  Clone ID: 30944450
gcacgcgcatgcgctctgccttcttccatccagcccaccatccgcgccatggcgatggcgttcgcgaccgcctccgcctccgcctcgagcctcagtctcacagccttctccctcccgctgctccagtctctgcgcccgagccctagccacgccctccatggcgcgaccagctcgttcccgcggccacgccgatgcgggtggggcgccgtggtgcgctgcgcgaagcgcacggggaagcggcggtacccgtcggagaagaagcggttgaacaggcgacaacaggagctgctacgccaggccgccccggaggaggggagcaaggggcgggagtccgggtactggcggctgtcgaagctcgccgtccccgcccgcgacgacccaggcaaggacttcatcggcatctccctgccgctactccaggccatcgccaaagctatcaagttcccggttccttctatgcttcctgacgaggctttcactgtcatccgcaagtcattcgacgcacgaaaggttttgaaagaacctcagttcacttacattgttgatatggatgttaagaagattcttgatatagagccaagggcatgggattttattgctcggttggagcccaaacttggagctgtagaatacatgcctggagagaagtcagcagctgatctggtcagcatgctca

SEQ ID NO: 24959 - DNA, 482 bp, Sorghum bicolor
  Clone ID: 30944472
agccaggttgctgaagaagactcgggtaggtcaggtacctggaaccatttggcggcgacggcgagcgcggaggacaggcggcacctcttggagtcctcgcaggcgtggagcgactcgaagtcgtcggcggggagcttgcgcgtgatccacccgatgtcgatgtagacgtagcgcggcggcgggggcaggtcgaccttgatgcggaccacgttgtaccagatgaggaagcggcggacctggacgccctggaggtcggagagggagccgtagcggagcacccccgtgatgtgggcgtcaaagtaggtgaggtactcgaagtggacgtagcaggggcccgcgaggtcgacggtgaggctgccgttgctagcgagcgagaaggcggtgacggtcgaggggaagatgcccgggggcaggccgtacttcgggaggagctcggcgagggtcggcggacgcggaggcggaggagggggaggcgttggggg

SEQ ID NO: 24960 - DNA, 706 bp, Sorghum bicolor
  Clone ID: 30944502
gtgcgcagtgctaggagtagtaggtgggcagattggtcgaacttcgaaggggttggaggccttcaaggcttcagctatggcatcagtgggaggtgcaggacgaggagaagggaaacgagatggagggaagggagaagaagggtcgctggctcgcagggcgtggaggcagtacctgctgcagctccagcaacatccgctccgcacaaagatgatcacggcggggtgcctcgccggcgtcagtgacaccgtcgcgcagaagctctccgggtaccagaagattgagaagcgcagactcctgctcaagatggtaaggacgctgccttgcatttagttttcttgtacatacagatgcagtcaccgggggcaactggatctttccttgttcattctttgggggaatagagcgtttagtaatattagattaggaccagttgatggtgatatactgatttgtaatgtattggcaattacctaaatcagttcaactttagtttcgttgttgtaggagttagtagttctatcaaactgattctgggggaaaatcttgggaggacgtggaggtgcagttgaaagatggattgcttgaattctaggcatttagtaactaatttcagactttcagttcatctgttgaattgcaacaatgtggatgtcatattcttgggcttggtattattgcgtgatttatgctgccataagttgaaat

SEQ ID NO: 24961 - DNA, 646 bp, Sorghum bicolor
  unsure (1)..(646): unsure at all n locations
  Clone ID: 30944536
gttattctcgacggccgtgtcccgcatgatttcgatcggctgctggagcgaatcggttcgattccccgtctgccgagctttggcccggctcgttccttgccttcgctcgtcgtattttttctccaccacttccttcgtatttttctctcttcctccctacacggccactgccagtccaccacaaccacgtccccgccgtcgtcgtcgcgcttcccccgcgcgtgtcccggtgccgctgctgggtgcgcccgcgcccgcgcccgcgcgttgccgtgaagctgcttgcgcgcgccgccgccaccacctgcccgcgtgggttgcaaggcaagcggcaggctaggacgggggccggagggaagccgacgacgcgggaggaagcaggataagggcggccgcggcacgcgctcgagcggcataagcgaagcaggctgcgtctagttcgagcggtggactgctgccaggggatcgctcgcttcggaggaggatgtcgcagacaggggaggcgcaggtgccgctgttgcagaccgaggaggcggacgtcgagtggagctccaagccgcgccgcattgctctcttcgtcgagccgtcgccttttgcttacatttccggctacnagaatcggtttcagaacttcatcaagcatcta

SEQ ID NO: 24962 - DNA, 185 bp, Sorghum bicolor
  Clone ID: 30944564
cccccccccccccggctggttcgttagcttaaataattgcggcgaaggaacaggataggttattctcatagttgatctttgctgcggaagtggagtttggctggaataaagataacggcagaatgtttttttttttattaagctgatttgtacagttattctttatatcgatctgcactaaatga

SEQ ID NO: 24963 - DNA, 464 bp, Sorghum bicolor
  Clone ID: 30944582
ggcgccaccgctaacgccaacgacgacgacgacttcttcctgcccctccccgcttcggcggaggtggacagcctcgccgcggtgctcggcccgccggccgcgggccgccctgggatcctctcccccgcggcgctgcctccggcggcctccacggggctgttctcgccgatgccgttcgacccgagctgcctgtcgtggctgagcgagctgagcccgttcctcccctccgccggcacccgcgccaccgccgccgcggctgggctcctggaccaggcgccgttcgcgcccagcccgcgcagcagcagcagcctgctgctgtccacgcccaccatgccgtcgccggccaccttctccgtgctcgagttcttcagcagcaacaacttccccgacctgtaaatcaatctctggatgattattgacctcacaacaatcaattctactgatcgattccatttcattactaa

SEQ ID NO: 24964 - DNA, 413 bp, Sorghum bicolor
  Clone ID: 30944602
agcaggcaacggccgggatgtcggagggagtcggagccagagctttgggctcgtggtgccggagggaagggtgcacggtggagggctgatgtccatgtttggagttggaggcaacctgggaaacaatcctgattgttcgaaaccctgaaacaccaagtatgtgatgtagtgagcacaaacagagaattcaggctatcttgcatgcctctgttatgatcattgcaatgtaatatatacatgatttttcaaatggccattgtataactgtagtacttgccaattggccattgtgtaactatagtatttgctatgtacaagagtggttttagcatttagtcaatgttgtgcacagagttgagaactgcatagttacttgggttcagaaattatatgaaagcttgtaagtttttctc

SEQ ID NO: 24965 - DNA, 616 bp, Sorghum bicolor
  Clone ID: 30944638
caaaagacggttcagtgaacaacttcgtgttgaaggtgaatccttcagggcagtttttgacaagacaaagcagcgtgttggagtttttgagaatggagatgtggaataatccttgactagaggtccttttagttgtttgcccttcagcgttttggatgcccaagatgacttgggaggagactagtgcaggcagctttgaagtcactgttttgtcgcttgtcatcctgcagcaagtcacaatttgagccatccagtgaattatgggatccatattccgtagtccaatcgcctttgtcaagggcgatgagcaacagcatagttccaatgtgccgttcagtgaaagcaatgcggtcctgtaagtagctagttgagaaattttgtttcaggggcttgtccttacaacctgcaagggcaacccccacatgccacaaggatgtactgtacctacgtatcagccacactgaatagttgccagtagttttacatgtttctgttaggaaggttgatactattagaaactagtcggccctcttttctactactgtaacaagtaaactgtctgaacaattgttgttttaaaagagaaatggtgtcacgtcccggatcagaacgcaac

SEQ ID NO: 24966 - DNA, 626 bp, Sorghum bicolor
  Clone ID: 30944648
acaagatcagcgacgtggaggggcttcaccggctgctgaagctggccgtcctggacgtgagcttcaacaagatcaccacggccaagtccctgggccagctcgtggccaactacggctcgctgcgggcgatcaacctgctgggcaacccggtgcaggccaacaccggcgacgacacgctccgcaaggccgtgtcgggcctgctcccgcggatcgagtacctcaacaagcaggccgtcaagccgcagcgcgcgcgggaggtggccaaggacagcgtcgcgcaggcggcgctcgggaacgccggctggaactcgcggaggcggctcacgcggcgcctcagccagagccccgggtcggcggggaagggcggccggggcagggacggcaacggcaacggcagccgcaggggcagcaggagcaggtccatgaccaggccccagagctcgagcttgccaaggagatgagaggcaaaacgtgcgacgtacgtactgataaaaaaaaatggtcttcggcttgaagagggagaagaaacaactctatgcgtttaaactgcatgcaatgcaatgttgtgatgagcttgagtttgacgcattttcccgaaccttttttgacagcacaatctgttgcca

SEQ ID NO: 24967 - DNA, 564 bp, Sorghum bicolor
  Clone ID: 30944664
tggttcatcttagggatcttcttgctgtatgtgaaggcgtggagctgaacttgatgacaaagagagaggtgccaaatttttcccacgttatctgattcaattttttttgtgctccagctcaagggcagattggagaagctggtttgagtgaaacaagttctagatccaaattctcagattgaggtatgacagaaagaaaggccctggagccagtgcatcaaaagagtgaagaccggcgggtctgggaagctcaagagcaaatgcccgtgttatctgaggcatccttgaatgcacaccatacttacaagtatggaatatagctagtaaatcaaatttggatcaactggagcacttgtctcgagagttcaagaaaaaattgatgatgcagaagattatatgacatttgctgatttagtacttcatttacaagactagttttactatgaagtctagctgctcttattcccatgttagtagtattgcatgtttttatgagggacatattcaatatttccagttagacatgtatcatatggatctttatatgagggacacatttcggtt

SEQ ID NO: 24968 - DNA, 747 bp, Sorghum bicolor
  Clone ID: 30944668
cttgtcaattaatctactgtttcatggcttgtgaggatgttgtatcagagatgctgtgaggatgttgtatcagagatgctttctggcaaggtgcatatacaagctttttttactcaatcattattgctgatttttgttccttgctgagggtagaatgggtgatgccgatcatgtttcatttttatagggatggttcttgtgatagttatacaagttcttttatggcaagtttttactaattatgttgctctcttactttagagataataattcttgcttgagttgttgattcaacagttgccctatcttttttttgtagaaagtgaaaaggactcttctttggttaaagttagagtttgtttaactatatagttcaatttcagggttcgttcctgatcccagattggtgcatatattatatatatactataactcttgtttcatgcaccgtggtccattgagtgtttacactctagattaggcaacgccaagttgtgtgtgtgatatcaatttttaattctgcctggatccgagatgcatgacttgaaggctcggtatggagatgtggcggtcgtgaatttattggcgtacaaaagaaatagacttcagagatttcttcttgctgatctaaaacattatcttatcgtgggtctgtacaatagagtttatttgtgaagtgtggcgccatgactttgctttttgaactaaatgttgctttaatattggtatttaatttcatagttttat

SEQ ID NO: 24969 - DNA, 696 bp, Sorghum bicolor
  Clone ID: 30944670
tcagtaactctttttgatcaattcagtttggtggtttcttctataaaaacatggagagcttgatttatactataagggttacattctcaagttctggtggttttagataagttgctttcagtgggagtgagaacagttcatttagagctaatatagacatggttatggagatgattctacaattctcaacaatatcattttcgatcaattcaattcggaggttccttttaagattaccacatgggtgccgagttcgatttgcttctgtaaggtgtgatttaatgctaggatgtggaaccaagattatataagtttgtcagtttgaagcttcatttgagtaagccatggaagaatacttcagttgtggctgctttcctaattttctgtcggtatttgtttctctggtggtatcaattatcataaggccttatatgtggttgcgggacattgatttacctggatcttttatttctcagacattgtcttcagtattggattggacacgactttttagcttctgttactggattatgtggtcattcaaatgttgtggtgatttttaattttgttggttcaatagtattgtaatatatttgtatatatatagtatgtatgatgttaaaattattttcgcctggagctgtaatttattatatgatatggatattggtaatagaaaacggcacgacccggacc

SEQ ID NO: 24970 - DNA, 529 bp, Sorghum bicolor
  Clone ID: 30944686
tgtatgatattgaagaagaggagaaggagaggattttgcttggccacagtgagaagttggctgttgctttcgggcttatcaacacgggcagtggagaggttatcaggatcacaaagaacctcaggctttgtgaggactgtcattcagtcaccaagttcatctccaaattcacaaatcgggagattgttgtgagggacgtgaatcgatttcaccacttcagggatggagtttgctcgtgcagggattactggtgaagatgctgcaaactcgttttagttacctttactgattatactggatgataactgaagtaggagctgttgttccttcaaaccattatgtacagcctaacatatttcattagactaggcgtggttatagcttttcaggaggggcctcaatcgattaccgagtctggagaaaagtgggaactcatacctgacaaacaattttgacacgcttgtgatgatgccccatgtttaaatgtaaagagatcgaactcgagacaagaatgagaatcaatgattaa

SEQ ID NO: 24971 - DNA, 543 bp, Sorghum bicolor
  Clone ID: 30944695
ctactggatcctccgcccctcgccaaaaaccaccctcgtccttgtccaccctcgccgcctccgcccatttcacttcacctcgtcttcttctgtcacgcctctccccccgccgcctctcacgaaagcactagaatccatctccactcgccgccaccacgcaccccacggtcatgtccctctcggcggcttcggcggcggtcgccagtagcgccgccgccgccgacaggtacgacacgatccggccggtttctaggctccgcttctgcggcctcaggcgcgaggccctccggctacaatcgccccggtccacgccgcagttggtggctgctaggcggagcgttgtgtatgcggcaacggctggcaatggcgcggctgcgagcagcgagttcgactacgacctcgtgatcatcggagccggcgtcggcggtcatggcgccgccctcaacgcagtcgagaagggtttaaaaactgccataattgagggagacgtcgtgggtggaacttgtgtgaacagaggctgtgttccgtcaaaggctctccttg

SEQ ID NO: 24972 - DNA, 663 bp, Sorghum bicolor
  Clone ID: 30944706
atgaccctagccactcatctctcttttctcggttctcagatattcggtgctgcagcggcgccggctgccaaggcgagggcgagcgcgagggcaaggctgcggggcgagattgggcctgacggtgttcatgctcccgtttttaggcagcggcggccatccttgttgccgaagggtgcggatggcgaggtgcgctcgcggacgtgacggtcggaggtggcgcagctgtcggcggccttagcatccccgctcctgctccgcatgctgctgctcttgtgctctgtggccgcctcgctccgcttcgccaggccgcccgcagcagccatggcggggattgacaccgtggaggaagacgagaaggaggtgcagccctgcaaggccgattcacatcagagacgacggagcagctccgcggccatgcgctcgctaccgccgctgagcccgcgacgtgcagcgtgctgcctgctgcggcctgcgttcggcatgaccgtggtgctcctactctaacagtgcaagctaggggcaaggccgagcagggagaggaggacgtggccggcgacgctgtagacgctgctgggtagtgcttcgtgccccacacctgctgttgctggcgctcgctaggccatgccggcgggggtctgccttcgtgctgctgctgccatgctc

SEQ ID NO: 24973 - DNA, 705 bp, Sorghum bicolor
  Clone ID: 30944714
gttgcgacctgtgttggtagcatgctgtgttgggtcagatctgtttgattggttagcgtggatgttttttgacatatcggaataagacagtggcgaagccagaagatttcaggagcccgggcaattctcattaagtaaaaatatttaactataaaatcacagaattctatataaatataaagaagatttcttttgcattttagcgaggagcccggccggccgcccggggtggccgggcggtggctccgccagtggaataagatgaattgaagattcgtccatgctgtgtgatctgttcagtcggaggttgttgattggctggttgtatcttccttaggatgctgatttcgtggagaaaaccagtgcctgttggttgttataggaaactactggactgctcagaattatgcactgtttgctcctgatccctcgtgatattgtcagtctagtcagaagatttcttatgtcgattcaattttttttatagagctatagcatgttatattctggggcaagttatattaatcagattgtttgatttgattgaaagccttggtaatggtcacatctgaagttctggtgattttagtagataagttgctttgtttggaagccaggacagttcatttagagctaataatatacatgatcatggagatgattctacaattatactcttcagtaactctttttgatcaattcagt

SEQ ID NO: 24974 - DNA, 730 bp, Sorghum bicolor
  Clone ID: 30944720
aaaaaaaaaagttcgacttaagaaaaataatacaccacactgctttaatggggcgatcaccatgctgtgagaagattggactgaagaaaggtccatggacgccggaagaggatcagaagctgcttgccttcattgaggagcacggacatgggagttggcgagcattgcctgcgaaggcaggtgagtatggacaaacctgaattctaccatcttccaaatgaacaaagtctgtgagatctcgaccaacatcctgcaggcttgcagaggtgtggtaagagcttcattgaggtggacaaactacctgaggccggacatcaagaggggcaagttcagcttgcaagaagagcagaccatcatccagcttcatgctcttttaggcaacaggtggtcggccattgcaacacatctaccaaatcgcacagacaatgagatcaagaactactggaacacacacctcaagaaaaggctggccaagatggggatcgatcctgtcacccacaaatctctcagtggcactctcactggcaccacaaacaacaaatcagccaaggctgcggcaagcctcagccacatggcacaatgggagagtgcccgcctcgaggctgaggcacggctggctcgagaatcgaagattcgaacagcaacgcccacaccaactgcactacatgcgcagccaacgaatgtacctgcctctgctgcttctccatgccttgacgtgctgcatggatgg

SEQ ID NO: 24975 - DNA, 584 bp, Sorghum bicolor
  Clone ID: 30944730
gcccgcgccgcctcacggcgacgcccctcctcgccttccgccgcctccgcctccgcgttcgcccccgcgccgcccccatccccatgtccgccactgcctccccgcacacctccctcctccacctcccccaccgcccgttcgggcccaggcgaccgaggctgacccgcctaaggtgcctcgcgtcgctcgcgccggcgtcgtcgggcgcttcgccggagaacgaggaccacctcatacaaacgctctgcgcccacgggcgcctcgcccgggccgcggcgctcttgcaggggcttcccgcgccaacgcagcgcacctacgagtcgctcctgctcgcggccgcgcgggcgggggacaccgcgctcgccgcggccgtgcaccgcaggctcgaggcggacccggtgttccgctcggaccccttcctgtcgacccgcctcatcgacgcctatgctgcgctcagagcgctcccggccgcgcgccaggtgttcgacgaggcgcctgtgaagaacatcttcgtgtggaacgcgatgctcaaggcgctcgcgctcgccgaccatggagaggaggctctcgcgtgcctttctgac

SEQ ID NO: 24976 - DNA, 270 bp, Sorghum bicolor
  Clone ID: 30944761
tctcccctcgctcctcggctcttcctcttggcgttgaaccattccacccgcctctcccctcccctcccatcccctcccctcctccgcaccgcacaccgcagctactacaaagccccgtacggcgtgcgacatctagctccggcacgccgtctcctcatccagcttccctcagctgccggccgcctgctgcgaacccccgtacgtacatggacgcgtcggccggcgaccgctcgtcgccgcggagccggcagcagctccagggcccgcgtc

SEQ ID NO: 24977 - DNA, 670 bp, Sorghum bicolor
  Clone ID: 30944765
gcaatattgttattttactgttattttctggccctttattaagcttgttgatactattaagtttagaattggctgttgttttttcagtttgtatcatccttatagtttcttgttatgggtatagcagacaagtcgttctgagagccctataaaggtccctgcctggtcaaagttcttcagcatctagtctattgtgcttcatctgtgtatttcctgctgattaaatcaagcatcaaaacactgattagcagaaaaaacattgcagatggcagatttgtcgaaaatgcgcgatctgtgcaacgttctggggcttaacttgctacagcaaattcgagatgaagtcgatgaatctgctactgacattaattcttggttggcgagcgacctgggagaggctctgtggagaggctcaacagctctgtggagaggctctctaagctaaaggcggacaggtttactgagatcaagaaaaaggctttggctattatatcattctggaatactttgttggtgccttatgagaaaaagcaggaacttctaagcctgatgtactatgtggaagtggaatcagataaggagatgactgaagtcagtgctttgtcggtagagtttctcaatagagttgtgcaagagtatgatgaactttgtgaacaaatgaatggattggttt

SEQ ID NO: 24978 - DNA, 279 bp, Sorghum bicolor
  Clone ID: 30944785
ttgatgcataagatagtgtgcatgtgatttgcccatagtttcaacagcctcatcgttttccatttgggatcaataaaacttcatgctcatggacagggctgatacatcaggttttgtcagtggtggcatacattacatgaacatccatgtgtatttccattttgtgtatactatgtgcttcctcagtggtgaagttgtaaagctggggttctgatctctgttggttggattgagcatctggtctctgaacagcatataaatttcttcctatcataatcc

SEQ ID NO: 24979 - DNA, 635 bp, Sorghum bicolor
  Clone ID: 30944835
ctactgggaaactcactcggtccctccttgggccaaaccccagatcccgaagccccaaatcagcaccgctccgcatggaccatccgtggcgcttccccgcgggcgccggcaccggcgccgacctctgcccggtctgttgcgcgcgccacttacccttctgcccgccgccgcctctcccgccgcatcccttcccctacgacctccagccgccgccaccaccccccccgccgaacccctacccatacgacttccacccgcctccgccaccaccgccgccgatgtggggccctccacctcccgggccgcatgacccgcgtccctacgagctccccggcagggaggggcctcacaagcggatgcgcgtgggcgaggcaccaccgttcgatccgtacgactttgtgcctccaccgcctccgggaagggcttctgtgcagggcgatcggctgctcggcctcatccgggatcatggccgcaatccacttcctggttgcccacctgacggtggctttggttacggaggaggtagattctgtccccggcaaggaggtgatttcgcggatttcgaccaaatgttgccacctcccatgccgattgaagattggcataatggcttcggtcaaggttttgtgcccgaa

SEQ ID NO: 24980 - DNA, 627 bp, Sorghum bicolor
  Clone ID: 30944847
gtgacgtcggaagctgccgtgcggccgcagtgtcgtttcccgcaacgcaacgaccagcggcagcgtggcgatccgcccccaccgctcttccctccgctccgccctcgcactatttctagcaccgccggagccgggctggacacttctcatctcccgtctcctctgcttcccagtccccgcccgccgtgagagcccgccactgctgcatctcaagggtcagaggttgtaccgatcatcgctgtggccttcgccgccggccgccggcgcatcaaccaccgcgccggcacgggcgcatgcaggtgacattccgctctccggctctctccgccggacgtgggtgctcccccggaacaaaacgcctacctactctctcggcaacgtttctggaagttcgttgaggcatcaaagaattgcctgccctgcgccgtgcgcgtgtgccgtgtgacggcgcggccgggatgggcaagatgaactgcttctccggcctgctcagcggcaagaggaaggcatccaagggtaagaacaagggcgcttacgtcaagaagggtagtggcaatgattgtcccaaggtgaagccggtggagttcatggacatggcggacactgttgtcgacgacgtcgtcagca

SEQ ID NO: 24981 - DNA, 579 bp, Sorghum bicolor
  unsure (1)..(579): unsure at all n locations
  Clone ID: 30944874
taacccatatatcttcttgattagcataaaagaaaaaagggtatggacaccaaaacccgtatttcaatcttgctattccctcgggtatgtgtacattaatgtgtttcaggaaagaacacccttaatctattggagaagaggttttcaagtgaccattattgcatctccaatagcccctagctcatcaatgtaatacccgattttaaggacaaacccagatatgccccatatgtgagtttttagaagtcaaatctcacatatagctacaaataaggggtaatatcaaaagccaatgcccaaatatataatgtacttagtataaaagagataccctttattagcgaacagcggatagacaactccgaacttggagtattaacttctctttacaagatccaactgattggttgatcacaaggttaagcttctcctgaagggtgtggggaaatagcaagagtgagtccatgtcgaactccccaagtatagcaactagattgtatagctcccccaatctcatgatcaatgtgacataaataatgtaaagcattaaataataaataatgagcatatttncccccc

SEQ ID NO: 24982 - DNA, 545 bp, Sorghum bicolor
  Clone ID: 30944901
cgcggaatgcagctcttcgcacccaatgccagggctggctccacacgtaaagcaggcttgcagggtgaacgggacctgcatgggcgaagctgacgtgaagttagtgacgcttgccgtcgtcccgagaaagcagaaggggaacggcagcctgctgaagaggatcctgacgggcaggaggaaggaggccatggccaagccacaggtggtgctgagttcttagctgacagacagaatggaggttttggacatggcaagtctttgtttggtgtgtagatggagtgtgtgcgtttgtgtgtggagccgtgttcatgtgaggttagtaataaagatgcagtgtgctgcgtagatgctgtatgtattagtgtggtttgtgtgtgaggtagtggtgctctgtcatgaactcatgaccctgttttctttgactacctcattgtgtgttctggggaggtccctgtacctgtttgatagtggctagttgcctagtttgttggcaatgtgttagtgtgctccctctgatgaaagaaccttgttctgaatgaccgcag

SEQ ID NO: 24983 - DNA, 636 bp, Sorghum bicolor
  Clone ID: 30944919
ttttatgcaatgttgatgcttctatttacagaaaaaattgtttttgtgcttgcatatatgagtttctatgcatagtaattatgttttggcaatctgactaaataaatttctatgtattattagagcacatttctatacattatctaagcacattatttgacctgagtagaataaaaatttgtatcattcattatccagaccaaggaggccatcaccacggtccttaaggatgtcctcctcaatgacaacaacgctgaggatcaattcaacaactgtagcaaggcactgcgtccaggtcattgtcgtgaagcaatctttcactgcatatcactagttattcattcttctttttatatattattagaacaaatttctactttataatttagctatatcagagcccttgtgatgaaatatttttagctatatcaggcactgcatctctagttcctagctttagcctagttagattataagtagaatagttctagttcttcagcgggatctggagcccctggcgtctgtggagcgtggagttcggtatagttctagtacatttctcttattgtattcaatattatgattccgacaacattgttctagagatgctctaatgattgttctagaggtgctctg

SEQ ID NO: 24984 - DNA, 681 bp, Sorghum bicolor
  Clone ID: 30944941
ccaaaaaccacgcaacgacacacgccagtccccagatgctgttgatgctaaagcgaggaggctgggcaggagctcgtcagacatcaacaacaaccatcaggacacgaggataaccacgctgatcaggaggaacatggcgctggaagagcaactctcagccgcgctcgcgagcaaggacgaagcggagaagaacctctccctggtcatcgacagcaaggatgagctggagaagaggttggccgagaaggacagggaggtcgaggcgctgaaggagaaggcaaccgggctagaactggcacaggaggagtccaacaacctctccaacaccgtccatgccgacaacgtgcggctggagcgcgaagtggccttcctaaaggccgtcatggacgagacccagaaggaattgcactcgactcgcggagttcttgcaggagaacgcgcaagggcatttcagcttcaggttgaagtgttccatctgaagcaacgcttgcagacgatggagggaaggtcacctacaccacgaaagcctcagaatcagtagagtgcaggagtgtacagtttttgaacaatctgttgtagattcaatgttgtactataactataactggtgccagagccacattgtgatttgtaatattcgatacaaatgtatttcgccactgggacgtaatcgtgtagaat

SEQ ID NO: 24985 - DNA, 631 bp, Sorghum bicolor
  Clone ID: 30944949
ctaaattataaatcattccaagaatcttggagagtcaaagtttttcaagtttgaccaaatttatgtagcaaaataataacatttttggtaccaaccaagtatcattagattctttgttagttatattttcatagtttacctattttatgacataaatctttatatttctctttatatttttggtcaaacttaaagatgcttttactttccaagattcttggaatgtaatataatttggaacggagggagtaactaattacacagtttgtctgtaatttacaagatgaatcttttaaggctaaatagtctataattatataatatttatcaaatacaaacgcaagtgctacaatgtttattttgcaaaaaaaaaaaaactaaacaaggcctaagcaaaagccgtaccgccagggttctcaattttgtgcatgatgacagcgtgagtattgggttcacgggaatggtaaactatttacgaaactatttacaaaatagagagtaatttatattgttagtttcgtaaaatagagagtaaactatttacgaaactatttacgaaactaaaaatataaatagagggtaatttatgatacgaaccttttaaacttaattagtccataattagacatta

SEQ ID NO: 24986 - DNA, 622 bp, Sorghum bicolor
  Clone ID: 30944951
aggcccgtgcacgcagctgtgtgctggctcccattgcaagccgcagcagtggttgtgcactgcgtggtgcatgtgcatgcgtacatggcggctgtgcatcccactgcccactggcctacccaccttgggcctgagcatggggagttgtaggaggcaagtgagactgagcttcatgccaacacgcagtggtgaaacagctgattcttgtcctgcaacaactcttcatgcaacaggggcagtgctgtgcatgggttggggccttgatgccgcgcttcaggggctggtgcgtgcctgtgctgtgcatgaggggcattcctcgtgttgtcaggcaccccaactcgagcggtcagggccgcttgcgggtcagcagacgccggggttgcacctcttgttgtcaggcgtggtggcccgcccaatcgtcaagctggtttgtatttcacattcatgcagtagaccagggcaggggtgggtgcaattgtggcctgcctgcctgcccatcccgcttcagttgctacccacatgccatggccgccagtttaccgcagcggctggcacttcatgatgcaggcaatgatttgtgctgcggctggagctgaggtggaagcaacatgtaaatgcgtgg

SEQ ID NO: 24987 - DNA, 667 bp, Sorghum bicolor
  Clone ID: 30944955
tccatggagagtgcatccgcccgtggcttgccatcaggaacacttgccctgtgtgccgatttgagctcccaacgggtgatgctgatcatgattggcgacggagcaggactggtgtggtgtctgtggcgcaacagagcgcaccagcgcagagtggaggcccaggcgctggcagtggatccacagtaggtgcaggagatgatgcaactgaatgctcgggagaaaatcgacctgagcaaggcacatcttgatgaggcggcagactgactgatgccggcaaacaggattgcaaactaaccaactgaaggcgacttcctgtcagcggcactaagaagataacgtgccagtgtttaacatctggccactgatcattaacttgtttttatggcagtgttgtgaatttgttcaacctctgtagctttgatctactcagtttctagtccaaattcagtagccttttcaccttctcttaatttatgtttggaatgctgtgctctaatgggatgggatgggatcccccggtgatgccagtgcccagtaggctctgcagaactgagtgagagatctctcataagggagtaggagcctcccatcatctcagactcttcatggcatccaatgaactgataaatttctggagtttcaattgtataaactcagcccattcagg

SEQ ID NO: 24988 - DNA, 376 bp, Sorghum bicolor
  Clone ID: 30944983
agtagatcgcgccacaatgttggtataatccaccccacgatagcaacgaaatgatccgcgaagacaatctagggtccagatgtctgagcacaaacttgtacacttagatgatcgtgcagacagttaacattaaacaaaaatgtcgcataccagtgaaattcctacaggagatgtacttcatggtctgtctctgctgtagtctagtagatgtagcgcttctattgtgctatgttttggcagccttacaatcgatatactacagttaccctgcctatgtattatatataccgcccttgtatatccttttgctgtaacccagaggctgttaagtacaaagttcataatttgccacagatacagatctgagtggagaaag

SEQ ID NO: 24989 - DNA, 691 bp, Sorghum bicolor
  Clone ID: 30944992
ttgctagttgggaattgggaaactcctctcccttgttgtagtctgtgcttatacaatcagcgatcagaatccatggaagcgccgagcgcggctctggtgtactttattttatatatatggttcttgttagatgaacgctcatctcaatcttttttgctcatttttgtgggtttgcacgtcggcaaatacgagtgaccgaccgcagtatctcaggagtccaggatagagtagcaaactacatactggactacatacctctgtgaactgtgatcagacaagcaatgctgtttgcgtcaactcatagagggatcactacaaagcatttccatgggatgtaaagcagcgaacgtcattgccaaccagaaagtaagcttttatctctctttttttattaataaagtggaaggccagctttgttctggactccttgaaggtgtggatgctgcagaggattagatagggacgcgccgtccaatcaactcgttagggtcaggcgaaatgctttgggctttctcgactgttgtctgatgctttattttttctttttttttctgaacgccaccaccgagcgctttcgtgtgcaatagtcccttttggaaccgtagggctgtcccgtcctaataaaattaaaactatggatggttttcctaatcataatattaataagtgctataaaaacttaacgtgacat

SEQ ID NO: 24990 - DNA, 622 bp, Sorghum bicolor
  Clone ID: 30944994
acacgcgcgcgtccattctaggcgagggagctccgggcccttggcgacagcccgattgacatcagcaagcacgcccctgccttgtcagcaagcaaggaggagttccccatcgtgcactgcacggcactcttggagcggcccacactgcaggcctctggagcacgtgcccaaccaggagcagccaggcgtcactgacgcggttgacgtgcctccaggtggtgaagcctggcctgcagcgcaggcctggcagtcgccatgagcactccggcatgccctgatatgagcagcatacagcagtccacagcagacgacgcggtgacctcagtgcaggagggctcagacctgcagcggcacgagggctcagacctgcagcggcatgaacacagctcgccaggctccatccagctgtcgtttgattgtgccatctgccatgacacactcttggacccggtggtgggaccctgcgggcacgacatgtgcaaggtgtgctatgacaagtggtgtgaggcctgttcaccggctggcttcccagcctgtccactgtgcagagcccctctcccgcgcctcagcgtatgtatgcgcatgaaacgcaccgtggagcagctcctgccagctgcagtga

SEQ ID NO: 24991 - DNA, 617 bp, Sorghum bicolor
  unsure (1)..(617): unsure at all n locations
  Clone ID: 30944998
ctactggaaactacaaaaaaggtctcttccgccatcgcctccttgccaatggcgggtttcaccggcgacgaccccttcggcttcgactacgacttcggggacgacggcgacaacggcccgttctgctacgacccattcgaagactacggtgtcggtggggacgaaggcgaggggctaatcggcggccccttcgcgctcgactacggagacggcggggagtactgcatctcaggtttcgccttccgcgacggcgatgaagacgacggaggccacgtcctcgtgggagaggaacaggggcaggcgcgcctgccctcccacgacgaacccattctcgaaaccctaggccgctcattcgactccgacggaggcctcagccaattctacccccaccttgtttccgcattggaactcgtcgaggatacctccgaggaggaggaggaggaggcgatgatctccggaaatgcccggggcggtggagggtctgaattcgagcggggggcggtcgttgaggagcctgccgacgacgacgacggtgggatcgggctcgtgcttggccgcctgggcgggttgaccctcgatccgcggncggtcgttggtggcttcgagggcctggtgga

SEQ ID NO: 24992 - DNA, 495 bp, Sorghum bicolor
  Clone ID: 30945028
cccagtagctcctagaaccaatgtttatctactgcaacaaaggctcctcaatcatctgttgtattgggttgtacacttgaacagggtatgaaaccttatgagagtacacagcacacaatggcgattcccaagatggctgaagaaaggccagctactggacaagactacatgaacagcactcagatagaatatttggatacgtcctcttcagcgacttcagtttgcctttctcaggctgacggatcactgcaacaaaattttccaccatccttcaatcagcatcaaacattgagagaaactgttccagatagcgagtttgaggttacagatccaggaactaactttctattcggggcaaacatcgatggccatatggagcctcttaatgaagacgctttgcttggaaatacctttgaaactgacaagtacatggatcagatgccaggaaatggcatctctaactacatttcatcaaaggatgctcaacaagagttg

SEQ ID NO: 24993 - DNA, 598 bp, Sorghum bicolor
  Clone ID: 30945030
tttaattaaaagaaaaaaatagtaaaaaaaaaacttaaaagaaaaaattaagatagataagaaagatttaacaagttagtaaataatgttataaataaatagattaagcgatgttaaaaaataagaatgtctgataaacaaaaaaaaaagcaaaagaaaaatttttgactaattaaaaaaaaataaaaaaagtatagtatacaattcagaaaaaagtgaataaaagatgaaagtcgctttgtagggatagaaaattttgtactaggaaagattaatataagataaaccactaataaagtattggaaaaaattataaagaacaatatttaaaatataaaattagggaggagaaaaaagcgtgagacaaaacgctgaaaagttatatttaaatgtagattataagatagtataaaaaataaaaaaaaatgattgatataagaagaaagagaaaagaagaaaaaaatgtagaaataaaaaaggaaagaaaaaaattaaaaagatggtaataaaagaccttcaggccttgcaagctttccgcgcctcctcacgcatccctctcacatacaaaatggccaccatgattgctcgcaacagcacc

SEQ ID NO: 24994 - DNA, 670 bp, Sorghum bicolor
  Clone ID: 30945032
gagcagagagcagccggcttcccgcctggggcaggtcctcccaagctgcagcagccgtcgccgcccctcccatccggccggtccttctctccatcttcttcttgttcaacccacttgagttcatacttcataagctgccacaccaatgagatctgtggaggagaccaagagatctctgacagttgccccctttgagtgcgcgtgggccgaggagcttcgcttcggggagccataggaacaaacggctcaagatcgaagtagatggaatcactgctgttgatgttactgccgtcggcctctgctgctcctcgtctttccagagctactggatcagcatctatgacggatgcataagcatcggccaaggaaagcatccaagcaacaatctccttttccaatggcttgatcctgatcccaacccacatgttcagtatgttggcctatccagctgggacaagcatgttgggtacagaaacataagccttcttccatcagctcccccaaatagcatattttggactcagattgagtatgccaacgtccactgggttgctgacgctggagactatgtgaggaaacaactgtcaagagatgattgtcatcaaagggtacttgcagactttctagagaactgggatttctctgatgctgtatttgtcgttggcactga

SEQ ID NO: 24995 - DNA, 620 bp, Sorghum bicolor
  Clone ID: 30945090
gatgctttccttgcttcgtcaatgcctaccacggcagtactacgagtagatccgaatctgacaaagcgccgttggcacatccaagcgtcctgctgcacctcaattcgtccatagcagtatagagctgccgcgggcgacactcccaaagtcaaagccacgccggccggcacaccgccgcctccccttgaccagcctcgccgccggagcggcagccatggccaccgctgcccgctccctccaccaccagggtccgacgccctctaacccctctccgcatcgcctccctgtcccctcccacctccgtccccaacgccacggctgctgcagccgccgcctggccgcctcgtcctccgacctcacctccttccccgagccggaccccgccccgaacggcgtccacgtgccgtgggcggcggcctcctccgtggccacggccgcggccgcggccgccttcgacgtagacgccgccaccgaggcggagctgcgggagaacgggttccggagcacgcgccgcaccaagctcgtctgcaccgtgggccccgccacctgcggcgccgccgagctcgaggcgctcgctgtcggcggcatgaacgtcgcgcgggtcaacatgtgccacggcg

SEQ ID NO: 24996 - DNA, 551 bp, Sorghum bicolor
  Clone ID: 30945102
aaaaaaaaaaaaaaaaaactcgtgttttcacttcaaaatctctgaaaatttccacctctcctccctccctctgtcgcgccctgcccccgctccatccgcgcgctcgcgccggcgggctcgctgaagcggccgccagcgtgctcgctccggcgctaaagggtcctgcgtcggcgctcctcttcggttcccctccgccctctgcgtcttgctctgtggcggacgaggccgacgctccggccgtgtctcgtcgggcggagctagggtttcgttgcttcaggggcggctcaggatcggcgagatctagggtcaggagaagtgtttcgaattttgaagaggggattagttgtcttgaacccaagcatcagcttgaccgttgctctgctaaagaaggctcaaaaaatgtcgccaagaatgaagataaacatcttcagatggagtttgagatctcaacagcatcagagaagctgattgagtgccgggaaacaatcataaacctggggaaacaactgaaagcccttgcatcgccaaaggacgccatccttttcgaccag

SEQ ID NO: 24997 - DNA, 595 bp, Sorghum bicolor
  Clone ID: 30945118
ctggaagcagaagtgagctcccacctccctctccctctccctctccctctctgtctctccgctcggcgctcgcaccaccgcccaaccctccgatccaaaccctcctggcgtcgcgccgcatgcgtccgcgcgcgacgaggcggcggcgctgcagctgagagctgaccaccccacttgacccgccggggagagagatagagagagagagaccgacgggcaggcatgggcggcgtgacgtccaacatcgccgcgcgcttcgccttcttcccgcccacgccgccgtcctacaccgtcgtggtcgcggacgccgccaccggccgcctcgccatcccggagatctcccggggcccctcgcgccgccggaggcgggacggcgccgggggctcctcctcctcctcggcctcctccgtcgcggcggccggtgccgaggaggaggacggcgcggaggtggtgcgcctccggacccgccgcgggaacgagatcgtgggggtgtacgtgcgccacgcgcgggcctcagccacgatgctctactcccacggcaacgccgccgacctcggccagatgtacgggctcttcgtcgagctcagccgccgcc

SEQ ID NO: 24998 - DNA, 668 bp, Sorghum bicolor
  Clone ID: 30945176
caggcaaccaaagtccgtgaaactgatggttacatcgatccagaatacttgcacaccgatctgcgtactgagaaattagatgtctattgttttggccttgtgctactcgaagtcctctttggtcgccctgttatcaagcaccaacgtcttgaggaacaagttgcgtggttggtaagctgggcagttcagtggccgacgatggactaccttgatcagaatgttgacccattcctaaggggagaaattaatccacagtgtctgaagaaattcttcgaaactgccgtgaagtgcctcgctgagaagggcattcaccgtccatcgatgcgagatgtgctgtccgacctggattatgcgcttgagttgaatgagaggctggagagcattgaggaagactatggcggttgcatgtcagacgatgacatgaatgaggggagatgattgtggaatctgaattctgatgaccaggcaccattagcatgattccacgagtttgttctgtcattactctcccttgtttgcagtataggagtagattggttggttgccttgtatcctgtcttgcttgtcatctcctactctgttgtacgagtactggtaatctccgactggctggcttgtactagtgtatcgctgatttgctgctatttacacaacgaacacgtagctcc

SEQ ID NO: 24999 - DNA, 663 bp, Sorghum bicolor
  Clone ID: 30945190
tgagaacataaagaagaagctccggttcttcctggatgacttgaagtttgaactaagcgaagtaatggagcgacctgtgcttatagattatagcttggagaagaccatcatacccaaggtgtgccgtgataagcgttttgatgagggagagaaagattgaccccaacatcaagttaccttcagcattgcttggtagtgccaagggtttctccaaaaggtatgtcttgaggcatgctcaggatgtgccagatgttgttaaggcatatgagggtaaaattgcatttgaaggatttagggatggagatgttttagttccactgaagccatgaggcttgtctagcagggttagatcataaggttagacaataagtggcatgtttccaatgccattgaggtgaaggcatgcaatgactctaatgctgtttcattgtgtgatgttatttctggcttttcactgaagcatctgctagcttttccattttgtaacctgtggcctaacaagtcttgaaatgtggatcttgtgatgatgtcgtggtatctggtatgctcaactggttcattcagtttttttttttcattattattttgatgaaggctcttccaataatgttgggatcttgaaatatgtcactggaatgacttaagtgcttcttttacttccgg

SEQ ID NO: 25000 - DNA, 706 bp, Sorghum bicolor
  Clone ID: 30945222
tcaaggatagcatctgatgttcattcgcttgtgaggtactcggcatgacctactacatactctagttgtcggcatgccttgaagctccaagttgataaacaaatgatgattggtatgtttctgaggcctctaaaaaatcctacctgctttgaaacaaataccttctttgttgctgcagcagaaattttatggacctttaaaacaacgtgttggtttgcgggacagaaatgtcagtgggatttactattatttatgttgcaattttctttggtctatataggtgctacaactagatgacgagcaaagcagcttttcatttattaggaacattttttttgcaactatccatttgttatgaagattttttgcctaatttgttagcaatttttatttaactcagctgtttttgtttcaggaatgcctgttcaaacaccaactaattattttagggaattctcactgtgcctttctttgtttattcaaccgttaaaattgtatgacaattttccctatcttatttccaatgctttgtacataacaaaaaaatgcatcgctttatcttaacagtacttggttcgttcaccaacattaggatgctactgcattgagtaatacattttcctgttatacatgtacgtaccgacacaactcatttgccagtcatttagcattttgtaataaagatatcgctgttaggcggctgtta

SEQ ID NO: 25001 - DNA, 297 bp, Sorghum bicolor
  Clone ID: 30945249
ggtttcaaacctcaacatggaagcatacaacaaattgtgcattcagaggtttagggagtccagttcccatctaacgagagagcaagatgcgctgcctcatgatcggtctcttgaggagcactacttgtattttgtatgtaacgacacgggctgtgatgagatgtagtgatatgcgatttttgccacaggtgtccttgttcccttgtactatgctgcaatttttgccacaggtgtccttgttcccttgtactatgcatgcgtggaatggtaaaaggatagaaacatccatttgcaata

SEQ ID NO: 25002 - DNA, 519 bp, Sorghum bicolor
  Clone ID: 30945267
acctggtggagtggctgaagcgcatggtgcccgagcggagggtggaggaggtgctggacccgaggctgccggagccgccgccgtccaaggcgctgaagcgggcggtgctcgccgcgctccggtgcgtcgacccggacggcagccagagacccaccatgccgcatgtggttcatatgctggaagacgaccagattctcagagacgtacgtacgccgtatcgatccccgtgtaatatacacgcaagattgagcttcacggcgttctcgttcttgatagtaaccactgtgaaaatgtgcgtggcctgcaggagttcaagctcgcgcgggacctgtcgcctcgggagtcagatagctacgaagaacgcgaacgcagcaggtgatgggagactactgggacactgggatgggatgctaataatagcaaaatgttttggtactagttgtaatctcttgcactgtaaagattatgtattcgttctgtgacagcgatggtacggttaataactggtatacggtgttc

SEQ ID NO: 25003 - DNA, 587 bp, Sorghum bicolor
  Clone ID: 30945282
aacgcaataatcacctgctgctttgctactggtggagggctcgctcccttctcccccgcgcccgcccgccctcgcttcgcttgctcggggcgccaccgtggggtcctcctgctcctccacccacatccaccctgtccctgtcgtccgctctgctcaaccaaaccggcgaaaccgctcccctccccctctcctcctccagatccatccacctctcctcgaaaccgtccgagtccggagcagcaaggcggagaggtggcggcgggggagatggagagcctggcgcagcgcgccgcgctgctgcgggagtcgctgcagaagagccagcaggtcaccgacgccgtcgtctccatcctaggctccttcgacagccgcctcaccgcgctcgactccgccatgcgccccatccaggtgaggacgcacgccgtgcgcaccgcgcacgagaacatcgaccgcacgctgcgctccgcggatgtgatccttacccagttcgaccgaactcgagaggcagagcgtgaaatacagaagggtccgcatgagaaccttcaaggcttcctagatgcggttgatcggttgagaagtattgagcg

SEQ ID NO: 25004 - DNA, 649 bp, Sorghum bicolor
  Clone ID: 30945348
tgtttccttctgtttggaaataaactatcagtttgtccaggtcgtacatacaaggaggtgcagttttgctccacctcagagcactgccgctgcagagactaaccccactgaatttatcctggaaactttggaacaaagtgattcacgatcattgatacaatatcttgcttaccaagatttgtgtgtggtgtctgagtgtaatgtggaaccgtggcgcagagctgctttcttcgaggaatctggtgaaacttataaaagaattgtgacagcttgtctgaagccacttgaggagtttacttcaaaaattgctgaagcccttgaaggtttatctagtgataagccagaactgatgctccaacagtccaaactctttagtgcatttgatgattcccagatatgcacatggtgtgctcggacattggcagtattaactgcacgctcacgccaggaggatcgatatggtgttgctcaactcactggctgcaatgctgctgtgatgacaacgttgctgtctgccctagtagcaattgagacatgtttaggaaagaaaacaaacccacagcctgtgcactcactgggtcctgaaaacattaggtgggctagcttgtccacaggacgaaaaggcactggagtttcaattgcaagcaca

SEQ ID NO: 25005 - DNA, 679 bp, Sorghum bicolor
  Clone ID: 30945354
atgttcagaaaatcatcagcattactaaatctcactgcaagcttggtcttactgctacccttgtgagagaggacgaacgtattactgatctgaattttctaattggaccaaaactgtatgaagcgaattggttggatttagtgaaaggtggatttattgcaaatgtgcagtgtgcggaagtatggtgtcctatgaccaaagagttttttgctgagtatttgaaaaaggaaaattcaaagaagaagcaggtactgtatgtcatgaatccgaacaagttcagggcttgtgaattcctgattcgattccatgagcaacaacgcggagacaagataattgtgtttgctgataatctatttgcactaactgcttatgcaatgaaactacgcaagccaatgatttttggtgctacaagccatgctgagaggacaagaattctctaccaattcaagaacagtccagaagtcaatacaattttcctttcaaaggtcggtgataactcgattgatatcccagaagctaatgttatcatacaaatatcgtctcacgctggttcgagacgtcaagaagctcagcgtctgggacgtattctcagggcaaagggtaagcaccaagataggatggctggaggaaaagaagaatacaatgcttttttctattcccttgtatcaactgatacaca

SEQ ID NO: 25006 - DNA, 621 bp, Sorghum bicolor
  Clone ID: 30945356
gaaatgtaggcataagtaacgataatgcgggcgagaaacccgcacaccgaaaaactaaggtttccacagctatgctaatcagctgtgggttagtctggtcctaaggcgaacccgaaagggacagtcgatggccgacgggttaatattcccgtactactgattactgtgatggggtgacggagtgatgaaagcgccgcggactgacggaatagttcgttgaagtacctagctataggtcctgcagtcaaatgcgcaggaactggcgaaatacgatagtactcggagtctccggacaaagagatagtgcgcctaagggcttccaagaaaaacctctaaacttcaggtaatcagtaccagtaccgtaaaccgacacaggtagttgaggagagaatcctaaggtgctcgagagattcatggctaaggaattaggcaaaatagacctgtaacttcgggagaaaggtcgccccgagcaatcggggccgcagtgaaaaggtccaggcgactgtttatcaaaaacacagggctctgcaaaatcgcaagatgacgtatagggcctgacacctgcccggtgctggaaggttaagaggagatgttatcttcggagaagcattgaattgaagc

SEQ ID NO: 25007 - DNA, 693 bp, Sorghum bicolor
  Clone ID: 30945364
gcggaaatctgcatgaccagctccacggggagcagaagccgccacttacctggaggcagcgtatagagatctgcattggtgcagctcgtggtctgcactatcttcacgaacaacatatcatccaccgtgacctgaccatgaaaaagatcttgctggatgaggaatgggttgctaagattacagatctttctctttctaggactgggacatcagtcgagacactggtggctggaacagtaggttacctcgatcctgagtactgccatacttctgtggttactgagaaatcagatgtctattcatttggggttgtgttattggagaccctctctgctcagcatccttatgattcaatttgtcaagttgaacaagggttgtcacgttgggcattgggatgcaaggaggggaatcttgatcagattgttgacccatacctgatgggaaaagttaatctgtggtctcttaacaagttcgtcgaaattgttctcagatgtgttgctcctaaaggcattgatcgtccttcgatgggagatgtgatttcagacctggagcatgccctacagtggcaggagagggcagatgcaagcgaatgtgcctccattttgccatcacgtctgtgccgccagttctggcttgcagagatggaggccgcgacaaacaactttgataagtcactccttattgatagtggtt

SEQ ID NO: 25008 - DNA, 581 bp, Sorghum bicolor
  Clone ID: 30945368
accagctcgcccccatggccgtccgcctcctcctcgccgttgccgtcgctctcctcctccgccccggggatgcgtccgtgcacgagtaccgcgggctcagcttcgccaacaagggcaacgccttcatcctccacgccggcagcgagggcctctacgcagcctcccacgccaacaccaccgccgaggacgatgaggacgccgccgcggtggccgacgccttcatccggtttgacaagattacttttaggcgaccagaagatactaacaattctgtgaaggagactagttcagctaaggttcaggtacttgtttttgagatagaagaccgtgaaatgattggtggatcagcctatggaggtcagaaggctatttgttgtacttcagatcttgcgaaattaggagcttgcacagaaggttctgtcatctaccgcccatcccaggtaaatcctggttggccaaagttgtttgttgcatcttttgatggaagtgatctgatcgcaacgctaccgtcaaggaccattccaattaccaaaactgggatgtacaatatgtactttatacactgcgatccttcacttgct

SEQ ID NO: 25009 - DNA, 681 bp, Sorghum bicolor
  Clone ID: 30945380
aaggcacgccaggcatgatcgcttctatctgccggcggcagctcctccgccttcgccaaatcccctccgccgccggcataaaccccagccggcccaaccccagcgatgccctcctctcccacgcctgctcctcagctgccctcgtgggtgtccccgtctccgagccctgcccaaccaccatctcctacctcatctcctgcgggctcccccccgccgccgcgtccgcctgcaagcgccgcatccgctccaccgccaaggccgacgccgtccgcgctctcttccgcacctacggcttcactgatgcggacatcaccgaggtggtccgcagaaaggcatggatcctcaccctcgaccctgaccggatcctccggcccaagctcgatcttttcgcttccctccgcatcaagccgcggaggctcgccaccgcgccgaacctcctcgatcgcagcctcgacaagcacctcctgccccgcatccagttcctccgcggcataatcggcagcgacggcgacgtcggttccgcgatctaccgcgccccacgcgccctccaggtcgacctggacaagaggatgcgcccggtcgtggacgccctccgccgactcggcctccccgacaagtccatctcgaagctcctcaccatcgagatgagcgtgctcacactttcagtcgaccgcataaccc

SEQ ID NO: 25010 - DNA, 570 bp, Sorghum bicolor
  Clone ID: 30945382
cctgcctgccgtgccgtcgccgtctccgcacttctctcgccccaccagtcagttcacctccaccgccgcgcgccgcgccgcgccgccccgctcctccgcctccggaagcaaggtcgcccttcctcgcgcaccagcggcaatggcggcctcgccggaccagtttcggggccaggcgcgcctcccgcgcttcgcggccccgctccgctacgacctccgcctccgcccggacctcgccgcctgcaccttcacgggcgccgcggccgtcgccgtcgccgtgtccgcgaccacccgcttcctcgtcctcaacgccgccgagctcgacgtcgatcgcgcctccatccgcttccaggatttggcgccgacagatgtggcgcagttcgaggaggatgagatcctggtcatcggctttgaccgggacctgcccctcggcgagggagtgctcaccatggacttcaccgggacgctcaacgatcagatgaggggattctacaggaggtatacgctgcctcttactgtactagtttcttgtgcatgccagactccaattattcctagttgcaaatatttata

SEQ ID NO: 25011 - DNA, 554 bp, Sorghum bicolor
  Clone ID: 30945418
gatgccgaccgcaggctgctccctcctccatcctcccgacgccacaataggggcaacgacaacgacgtcgggtgccagccgcgcgccgcggctgccctcgtcctcctctaccacctcgtcctcctcttcctcctctctcccctccccttcctttatctctctctcccctgccctcccgatgcggcggtgggcggcgtggccagctcgtgcggctggcccgaggcggcgcgacggcggctctgctgctcctcctccccctgcatcctctccctttctctctccccacgaccacagccacgtttgctctgcagaaaccctaggtgccatggtgggctcggatctggccgcggtgattcctggcatgcgctgcaccgccatggctgcctccgacatttctgatggtggtgtctcctctgctcaattcatttcttagcgtctcccaggttgatgaattgtaatgtctctgctcctcccctctctcctactgcccaaaacccagccaccaggggtgatggacaagtttgtgtcttggttcctaatagttcgcgtaaaag

SEQ ID NO: 25012 - DNA, 306 bp, Sorghum bicolor
  Clone ID: 30945420
atctgtctgtggcttggctgggactgggtggcgtggaaacgcttgcaggcgcgcggggtgtttcacgtttgaccctcccggcgcccggctgtggcgcctgccagattagccgcaccgcagcggtggcgttcacgtcaaaaccgaagcgggcgcaagcagactctggcagaggcagctgaagcggcggcagcgtcagaggcgggggggggctggggggtgggacaccgacacctgccgcgttacgagggtgtgaggtgggggagagagagagagagagagagagagagagagaggggactgggagag

SEQ ID NO: 25013 - DNA, 673 bp, Sorghum bicolor
  Clone ID: 30945485
gaaggtatccgtcaattcttcatcaacgtcgagaaggaagagtggaagttggacactttgtgcgatctgtacgacactttgaacatcacccaagctgtcatcttctgcaacacccgtaagagagtcacttggctcaccgaccaattgaaggctcgcgacttcaccgtctcctcgactcacggtatgatcgaccaaaaggaacgtgacgtcattttgaacgaattcagaactggcagcagcagagtgttgatcacgactgatttgatggcccgtggtatcgatgtgcaccaagtctcgttggtcatcaactacgacatccccaagcagaacttcgacaagtacattcacagaattggccgttttggtcgtttcggtcgtaagggagttgccatcaacttcgtgaccaacgaagatttccacatcctcaaggaaattgaacgtttctacaacacccaaattgaagaaatgcctgctcacgttgcggaccttctttaaacccaccctaccccctatgcccgttaatccccctcttgtcctattacatagtactccctatggcgaatttatccacacctgacccactttgtattttttttggtgtaaaaagccaagcaattttgtgttccttataatatcgacggattgtaaaggattaaaataaatcggaatttat

SEQ ID NO: 25014 - DNA, 661 bp, Sorghum bicolor
  Clone ID: 30945505
aagaaacaaaagtatgacaaaattagtgaaaagaaaatgcttacctcagcagaggtcctgtgcaaatcttacccatcggagttcatctcatatttccactattgtcgctccctgcgatttgaagacaggccagattactcttttctgaagaaactctttcgtgatgtatttatccgggaaggcagttactaggctgagaacttttgcgggatcgttgttctctgcagctgaagcaaatcggcaaatggatggatggatgggattgcagcacaatgacctcgagtatggacctcgttacaagggtgccatgaaaatgctttctccaaacctcaacgtataacgctttctccaaactccgagaggcaagataactctgaagtacaatgcaatcctgcttcacggcaagctttcactgttgttcactttctgattctgccgttctggtactagtttgtaaagtgttattgcagaatccctccatttgaccataaatcttttttaagaaaacgtatataagcacctgaattaattttatttatggggcatttggatcgaagaatggagtgatctgtcactttctcactacacattttctttgtgggtccgaagaagggttatttgtattggtaccgttaaaattttcgaagttgtgagaattacc

SEQ ID NO: 25015 - DNA, 692 bp, Sorghum bicolor
  Clone ID: 30945525
tatttcttgattgagaagcttacctctattaggtatagattgtggcttgtgatgttgtcatttcattattgcttgaattctttatggtatacaaaattcttactttctgtaatgtagttgttttggaatgtcatttggcattgtcttctgttcaggaaatcaatagtcttttcagtgtattgtgactacaatttatccactgattgatagaattcatggccctgtagtggcagattagttactagttagcttatcgtggtgcatggatgatccaatatcacttgattatttccttggtttaatgcctcggcaggccggttgaggcctcatgtttgcatttgagacaggtaagtacgaaatgcatacattcccgggtccaaatgatgcatgtagctgttgcatttgagacaggtaagtacgaaatgcatacattcccaggtcaagtgatgcatgtagcggcagaaagctctctcctgtaagttgtacaatggcggcaatctgttcaattctcggagaagggagtggcaaggtgggggtggaacgtgggagcccgctagctccctgctcccaccaggctttgcagctagggaccgtaaccagatggtgtatatgcccgctcaaaaacgatgatgtatatgttgaatatacttgaattagaaacctattatatataattacatgaaattgagcag

SEQ ID NO: 25016 - DNA, 536 bp, Sorghum bicolor
  Clone ID: 30945541
gattaagtgattatgcacgagtagcgggctgcttccacggaggttccagtgaggaggtttcattgttcgtggtggttgatgtgctacctgtgtgaccaattagcgaagtgtggtgcttcacgtgcaccctatgcaaccaaccaaatggtcattcaggatttcttctggttggttctggtgatggatgccctcattgtatcaccaatcgtcagtggatttcttatgatgattagtcggggtggtccatgtgctcttggtttggattgaatgttatctgtcaggctagccttgttgctattggaggctcttcgcctgcttcagctatccatttgcctgggatcagtttcggacgtaatctggttgtcacttggttgatacatatggttgcatgatttgcaagggaatcttcagagattgcagctgtctcattagtggatatgcatttatgtaaaaaataacaatgagaaaaaacaaagtaaagaatagaaaaaaaaaacatagttagagatatgtggcagtatatccaagagaggagg

SEQ ID NO: 25017 - DNA, 704 bp, Sorghum bicolor
  Clone ID: 30945564
gctattgcgtacggcatggaccagaagggcaaagagaagaacattctcgtcttcgatctcggtggcggtactttcgacgtctctgccttgaccatcgacaacggtgtgttcgaagtgatggccaccaacggtgacacgcacttgggtggtgaggactttgatcagcgcgtgatggagtacctgctcaagaccttcaagaagaagactggtctcgatgccagcggtgacaagaaggctcttcaaaagctgcgtcgtgccgtcgagaacgccaagaagtcgctcagcaaccaacatcaagtgcgcgtggagattgaggccttcttcgacggtcaggactttagcgagcctttgagccgcgccaagtttgaggagctcaatatggacctcttcaagaagactttggtgcctctcgaacgcgtgctcaaggatgccaagctcgacaagcacgagattgacgtcaacggtatcttgagtgtgcgcgccactgacaaggcctccgacaagtccgaacagatcaccatcactagcgagaagggtcgtttgagcgaagaagagattcaacgcatggtgaaagaggccgaagactttgaagaagaggacaagaaggcccgcgagaaggtggaggccaagaacagcctcgagaactacgtgtacagctgctcaaggacttcttcaacggcaaagagccccaacagggtgtcaac

SEQ ID NO: 25018 - DNA, 629 bp, Sorghum bicolor
  Clone ID: 30945586
acgatcgcgactctcgacaaccgcctccacctccgctcgcctccatcgcgctcttcctcttccccactatagacgcctagcgccgcctagccctagccgcgcgaccggcaactgccagccaccgatatgccgatctcctcctccctcgccgcgcgcctccgcaccggccactccccggcgcccgcgcccgggcgcgcgcggtggagcccctacgccagaccctctgtgcctgagccctgcggcggcggcaaggcctcccgcccgacccttcgcctcgatccggtgacgacgaggcttctcggccctgttcagaaggcggtgctgtccggatcgagtcgccgtgccgagcccgatgcgcccgaagcatccgcacggcggcgacgcggaaacgacatgacaagcccgaagcctgagccgaagccgaaaccggctaatggagacgataggacgcccgttgaggagaagcgccgcagcagcggtgagggcggtttcgtctttctctgcgcccttgctggacacacggaggtgcgagcttccccgtcactctgaaaattcgctctatcgcaacgcgatcgccagtttctgtctagcagttgtgatgggctcttacagtaatcataaaaatctga

SEQ ID NO: 25019 - DNA, 743 bp, Sorghum bicolor
  unsure (1)..(743): unsure at all n locations
  Clone ID: 30945671
ttttaccatcgaataataatttaaccacttaagaaaatgagcgctgacaataagcaaacctcggctaacaccgtcggagagaaaatgaccgtgactgctgagaatggcttcgaactcgaaagcaactgggaagaacgttgcgattcgttcgacaacatgggtctcaaggaagacttactccgtggtatttacggctacggttttgagagaccctctatgattcaacaaaaggccatcgttcctttgatcaagggtaaagacttgatcgctcaggcccaatccggtactggtaagaccgctacctttaccatcggtgtcttgcaacaattggactacacccaaccgaccgctcaagccctcatcttggcccctactcgtgagttggctcaacaaatccaaaaggtcgtgactatgttgggtgactacttgggcgttaagtgccacgcctgcattggtggtactcgtatccgaagtgacatccaaatcctccaaggcggtgctcaagtcatcgtcggaactccgggaagagttttggacatgatcgaccgtcgcgccctcaagcccgacaccatcaaggtcttcgtgttggacgaggccgacgagatgttgtccaagggtttcaaggaccaaatctacnacatcttccaaactttgccccacaacgtccaagttggcttgttctctgccaccatggatgctgatactttggaaatcacccgccgattcatgaacaaccctgttcg

SEQ ID NO: 25020 - DNA, 757 bp, Sorghum bicolor
  Clone ID: 30945689
aaacgaaacctggttttccggcaatccagagccaaaaaaggaccgccaccaaccgctcgctttcccgcacctcccccacctctcgctctctccctccctccaattgcaggatcagcaccgatgcgattcgaccgcggcctcgcgtccggtgcggaggtctgcaattggggggaggctcctctccgccgctggaaccgctgcggcgtcgcggcctgtgcgagttcctgctggttcctcatccctcggggagagattttgcgtgccttggcattactgtttgatggcagacagtagtgctgcttctctaaggaggcattggggcaataggcagttgaactgaaccgcagcagaaatccattcgcaggagagagagacagagagagaaatcaaagaggagagtgatcatggagcatgtgattggagggaagtataagcttgggaggaagattgggagcggatccttcggggagctatatctcggtgttaatatacagaatggagaggaagtaggaataaagttggagcctgtgaaaacaaaacatccacagctgcactatgaatctaaagtttatatgctactgcagggtggaaacggtatcccacacctcaagtggtatggtgtcgaaggggagtacaatgttatggtgatcgatcttcttggcccaagtttggaagatttgtttaattgttgcaacaggaaattttctatgaaaacagtgcttatgcttgctgatcaactgataaaccgagtggaata

SEQ ID NO: 25021 - DNA, 763 bp, Sorghum bicolor
  unsure (1)..(763): unsure at all n locations
  Clone ID: 30945733
tagaggttacctactttgtttagtagatgatatcagtagttacaatgtttcacaactggagctggatttagagtagtctggagttgtgtttcctaatttccattgtggtctcattnggcggtgtgtgcttcctttggttaagcaagattttttgttaattcagattttttaaggcccacatgtcttggaacaggtgacaaatcggtcatcatgtggttacagccttctgcaatataggttgtgtgcggtgactctttctgattaggccaaatttgtggactacatggatagcaatgtcagattattgcggtcagatcctaatcatttttcacaaaagcatcaccgtgttgttagagaaacactacaaataagaaggaaatggaaatagaggagtggcatctcagtgaataactttaacaaatgaagttaatgtctcattggaagaactatttcttgatgtaggcaacagatgaagttaatgtggcctatgcctgcttcctggaccgtaccgtgggcagccttgaatcatggtcttactgaatatgtatgtatattgttagtgaatagcttctctaattgaatcattgttttcctgagtttgtaaaaatatgtatctgtgctgttagtgccatctcataatttctctccttccaagagtctggctaagtgatccatctgtctctgaaattgctatgttggctaccaactgaatactgtatgtacagatattgttccttgcaatcttggaagaggatgaaatctg

SEQ ID NO: 25022 - DNA, 741 bp, Sorghum bicolor
  unsure (1)..(741): unsure at all n locations
  Clone ID: 30945737
cttcacgttcgagcagacggcggcggtgcgcaacccgaaccggtccccgctcgcgcacttngacagctccctccgcgtcgcctacgcgggcggggaactcggcgccgtctacatccccgcgggcctcatcgatggtggaaccaccaagcacgtgtccgccgtcttcgacgtacccgccatccccgtcgccgcccagccgcccatgctcgggggggccgtcgacgcagcgtccgccgctcagtcacagcagcagccgccggcggtcatcgaggtccactcgttgctcgttgtcaagggcagagtcaacgtcctccgcgtcctcacgcaccgtgtccaggccgccaagctctgccgcgtcggcgtctcgccgctcgacggcaccgtgatcggcttccgctgctgattctctcatcagtagcatactagtagtagatagccatagctgctctcttcccgctgttttagttacgttacgatatcctcctattcctcatttcctccctcgatcgtcggtggttttggattcttgttgcattgcagcccccagtcgtcgccttcttcttcaaggagatgtgtacggaattccacgtttcctttgcaaacaagcaaacaaactactcgactcgtagtagtaatactggatttgtgtagtaccgatccaattaacgatagtgttgtcttgattaattccggtgaaactgtgtatgtacatattaactcgcttataacttgtagaaattc

SEQ ID NO: 25023 - DNA, 698 bp, Sorghum bicolor
  unsure (1)..(698): unsure at all n locations
  Clone ID: 30945741
aaaaataatattaagtaattccatgagaactttgtttctttgtttgtttgcttttaatgtcctgctgcatgaaggaataaataactaaccatgtattgatggatttcccagctcatttatcttgacaaaaataatattaagtagttcccagctgcattaagtagttccttgagaattttgtttctctgtttgtttgcttttaatgtcctgcttcatgaaggaataattaactaaccatgtattgatggatttcccagctcatttatcttgacaaaaataatattaagttgttccttgagaactttgtttctctgtttgtttgcttttaatgtcctcttttctggcagatgtcgctacctctaccaaatctgtaggttttctgtccaagtggcaatgggtgtcaacaacctggcaaaacaatggggcatccctccatacaaaactaatggattcatcattagagcatggactatttgtttcccaaataatttcacaagattggttttgcgcggagttagctctagtagatggtatttaacctcaagtcttctatcgatctagctgaaaattaggtgttcggccattgtggttcttgtgccaaaacttgtcatcgtgtattgttctagaaatatatagatcttgtgtaagtgagtattttttccagtaaanaattaagtgtatagataaatatttttttg

SEQ ID NO: 25024 - DNA, 519 bp, Sorghum bicolor
  Clone ID: 30945743
ggtgggcgcgtgcctgacgacggccgggtggctgagccgcgcgctggacgaggacggcgccgcggacacgtccccttcgccggttctcggcgctggtcccgcggctgaagcagtgcctggcgcccggccgccccgcccggcacagggtcctcgcggccgtgtcgctgcaccactttagcagaatcccagactgcagggagctgctgatgctgctggctgacggcctgcgtgaccacctcgcggatctctcgcagcagacctggacggccggacagctatccgccgaactccgcggccacgaatgacatttgacttgcaggtgccgtaggagggccgccggcgacggagcctctcatcagcggaagtgtgtgaagaataccagctgcttttcttgacccgttcgtgagaaccctttgatgtgaattctcaacagtttcgccgagagcgacaaaggctgtgcagtctactatcttctttagagtgtatagactacagtaataacttttatctctttttctt

SEQ ID NO: 25025 - DNA, 755 bp, Sorghum bicolor
  Clone ID: 30945803
aaggaaagcatgggcgaagataagattgcattctgtggtagtgaactattctatgtgccccggcggtttgttgaggacttcgttgatcttgtgggtcttgttggtgatttggatttgcatcacaagattgcggtcccaatgttcttcttggcaatggacccgcctcaaaattttgactccgatgctctggctggaacagtgttcaagaaccagttgccagccaatgcgacgttctcatctatttatacagctcaagcacctgctgttttccctgtgaaagttatgaatgagattgatttcataaaggtgattcggctaatgtccataggagacccacttctgatggagttggtataaagagataatgtgtagttggaagtgcaagcttatccttgtggccatgaggacagagtagacaagcatagttttgtgttttctgggagggtttgtaatttcatttattttgttcattctgtagctgtttatttctctgctgttgtatattggtgtatcattagtgacaaggttacttgggatcagctcggtccagctgtcctgctgaaagaaaggacggcctgtcagatacgagtcacggagaagagcttcaacctggccagctgctgttttgcaagatttttgtgttgccaatagtaaaaggtccacacttgagcaatttgttgtaccattcaaatttgacaaacaaaactgatacaaactctcagaggaatatcttgtgctcattacagaaagcattg

SEQ ID NO: 25026 - DNA, 681 bp, Sorghum bicolor
  Clone ID: 30945823
tagatgacaacttaagcgcaaagctttctgatttcgggctatctaagatgattgacagggataagagccaagtgattacaagaatgagaggcactcctggatatttagctcctgagtggttgacatcacaaatcactgagaaagttgacatatacagctttggggtagtagtcatggaaattatcagcgggagaaagaatcttgattattctcgacctcaagaaagtgttcatctcattagcatattgcaggaaaaggcaagaaatgatcagttggaagatctgattgatattcatagtgaggaaatgcaaattcacaaggaagaagtgattcagatgatgaggctcgcgatgtggtgtttgcagattgactacaacaagaggcctcaaatgtcagttgctgtgaaagtgctagaaggtacagtgaatgtagaaactaatatagaattcaacttcgtagctatggttccaaacaaccttgccaatgatgggaaattggcttcatcagctccacttctagcctcccatttatcaggtcctaggtgaacaaggaaatctgagcaaagatcgcagggaatatttgtatgcacagaataaccatgtttctgttgcacataataatatattctgatgtactagatctctcaaaaacatcaaaatagcataaagtatttttaatgcc

SEQ ID NO: 25027 - DNA, 509 bp, Sorghum bicolor
  Clone ID: 30945838
ctgtgaagagtttataatgtccataactaagttagtagtggacccaatgctttcttttgttactaaggtaactgccgtcaaagttgcattgtcctctggtagccagggtcagaaattagattcagttctagcaaaactcttgaagactcaagcttttgcttctcctgataaagttgctgagctggttcagaaggttgctgctgctattcaacaagatttgcccaaagtaatgtccaagatgaggttgtatttgcaaaatccatctacccggatgatcttattcaaacctatcaagacaaatatagttgaggcccatatacagctgcaatcccttctgaagtcagaatactccactgaagaaatgcaatcaatcggtatgttgccgatacctgatctgcagtctcagcttgacagccttttgtagcttgcatacagttgcaaattgctcctatagtccttgttgaggttgcagtgcagttctttcaagtaaccaaagtaaagttcttttc

SEQ ID NO: 25028 - DNA, 659 bp, Sorghum bicolor
  Clone ID: 30945856
gtatgggtaacaaagtcttttccttccactcccggcctcctccctccactcccggcgacctcgccgccgccccgccaaaacgctcgccgttccacgggtcaacgcgatccttttcacgggtgaccgcgtccgcggcaccggcgatccggcgatcgaacggctctcggacgccgcccacctggctggggtcctcgctgcgaagctccctgtggagaccaatgcgtgggtggtcgacgccgcatgctttgctgggccatttgcggtgtaccgggaacttgttccgaccgtggacggcgccggagaccccaatgggtatgaccccactggccttccggccgctgccggtgttgccaacatccttgcacacagcatccgtgagatacaaaatcggttcttggggttctcagcaaaggattcggcagccaatcagcatccttcagaatcattatcatcctactctcctcctaggactatcatccttggcttcagcaagggtggagttgttgtcaaccaacttgtgacagaactttctcattgggcatcagagtcaatgaaaaacacagttgatatttcaagaccaaacccatcgcatttgaccgagaatctcttggttcctacctcaaatagtgatgtgttatcaagtatttctgaattccact

SEQ ID NO: 25029 - DNA, 696 bp, Sorghum bicolor
  Clone ID: 30945863
cctactggaacaaaaccaaaacccaaacaccaccaccaccacctccaccactcatacacagcagcagagcccccgagagctgcattgccaaaccgggcgggcgagccgcagtgctgcaatcgcccccacaccgcgcacgcgccgcgccgcaccggcgccaccaccctacgcgctttggcgtggcgctagcaggctagcagcgggcgggaggagggaggcgagattccaaaggaaaaaaaaaaggccccggagcaaaaggaggggaggcgaggtgcggaggggggaaaagcggcagggcagtgcgcagtggagaggggggagtccagtccagtccaatccaatccaatccaatctagccggaccacggccgacgcggcagcagcgcagctgtgactggctggaaggcaagtgtgctcggcaagcgacgcacgccaccgacaccggcaacccccctcgcggcgatcggagccgcgcgccagatccaacacccccccgccggaatcgcggcggagtccggcgcccgcggccccgccccggatctgcattccgcgcagggggctcccctcctgaccgcctcgcgccctcgtctccccagatactctgcaagcaatggatcgacccaactgggcttggaagaagaaatcatctgataaatcatcaaatgcagatgcgttgcataattctaatcatgcagaa

SEQ ID NO: 25030 - DNA, 668 bp, Sorghum bicolor
  Clone ID: 30945872
gcaatctcaatgcagtcgtcttgcagtcttcctcatgtgagctttccaaatcgcttcgccgatcccgacacgcccaatgcctccctcacacctcctctcgctgcttctggccgtcaccgtcgctgccaccgtcgacgtcgtccatgcgcagggcatccccttcccgacgccagcatccacgaacctctccaccagctggaccatcagcctcaaggcggacggccacggcgcccagtccttcgactacatggacagcacgtccgtgagcgtcttcctcctccagtccatccaatcgcctccgcaggaaggcctctgcttcgccgcgtgcttctactgcgtcgccccgtgcgaggccttcctcttcggcgtctgcatcgtctacgtcgacggcggcggcttcctcagctggccgaacgcgggcagcccgcaggtggtctggtccgcaaaccgggaccgcctcgttcgtgagaacgccaccctcaccttcacggccggcggcgacctacagctccggaacaccgccggaggcctcgtctggtccaccggcacctcgggccagtctgttgccgggatgaccgtgaccaagtccggcaacctggtgctgttcgatcgcaagaatgcagcggtgcggcagtcattcgaccatccgacggattgtctgctcccag

SEQ ID NO: 25031 - DNA, 191 bp, Sorghum bicolor
  unsure (1)..(191): unsure at all n locations
  Clone ID: 30945916
gttccgtcggtccgcttctccctgcgatccacngcttcgtcgcaagtacgataggaaggcgccggcaagtgggaccaattcaccgtctcgctccctcactccgccctcctcctcgtgcgatgcccaccagatcgcgacaccatggcctcctcgcgatggctcctcctcctcgtgtgacaccctcgccagat

SEQ ID NO: 25032 - DNA, 656 bp, Sorghum bicolor
  Clone ID: 30945920
gctgctgtgattaaaagccttccatatccgattcttccaaccacccttaccttagcttagcttccacacactgacacggcgacacgcatgcacccacccacagccacaggccgccgccgcgacctccccggcgccgccgccagaggaggtggcgaattcaccaggcagcacccaccaccagcggggccgggccgcctcttcttcatgccgccgccgccgccggcgacaccggggcacaaccaccgcccacgaccaccggatcgcgaccgccccttcttcatgccgccgcccgcgccaccaggccgctcgcacagcaaccaaccgtcgccagcggacccgcccaccgccagcaccaggcctcctcctcctccgccgccgccgccgccacacccacacgcgtacgccaactacgaccccgccggcagcgccgccgacgagctcccccgccgtccccctcaccctccgccgccgccgccgccgctcccacccccacgccgcccgtcaacatccccgtgctcctccgcgctatcctcctgcctcgtcgcgacggcgttcctgcttctgtcagcgggcgtcgcaggcaccgcgctgttcctgctctaccgccctcggccccccgacatcgcggtggccgccgtgcgcctgccgtccttctc

SEQ ID NO: 25033 - DNA, 719 bp, Sorghum bicolor
  Clone ID: 30945923
ggcgatgctgacgacgaagaccccgcggccgcgcagcgacaatgcgcgccatgccactgcgaccccggcgggacggcggtgaaggcgaaggtcgcgacagcagtggggagctcgccgtcgggtgagcccccgatgcagctggagcacgtctccctcatctgcttcctatccgactgccgctccgacgccacagccgctgggctcacgcccttcgaggcgttcctaggcaaggaggatagctcacagatggacacggatgagcccatggaggagtcgtcccagccaggatttcttctgggttcctaatcgtgctctgcgctaaactaccgacactatggtctctgtcagattaatcctattcctcttctcattgttttgcagcaccccagcctacatcacgcccagagagaaagggaccatcgggcagttgcataatcaggtgagtttttgagaaggcaacatcacgttatgtttggactttggatcatcgaacagtagagttggatgcataaggttagtgacctctcttttattcatgacattgtggcctatacaaatcatcaactctataggaactgtccatttcagtcatctgtctcctgccttatattcattctgattttgatatgttgcattgcttgagatctaccaccttaagtgttcttctatgagagtactggagaaaatgctaaaggaaaactccaaaactgatatgcatc

SEQ ID NO: 25034 - DNA, 505 bp, Sorghum bicolor
  Clone ID: 30945925
aaccgaggatgctgctgctgcaccactgccaccacggggcgtagcagagccagctcctttgtcgactcggtcaagtcacccgctacatccacgccaatggcgccgcccccgccgtccttgctccgagagctcctggcagctgacgggttcaagaaccgtcgcagaccgcccgacagctctgcgccggcggcctcgagagccgcgagcatgccactccagcaccggcgcccgggcaagccgccctcgcggtcacagtccgacgtgctcacccgcagccgcctgaggcagatgaacgtcgacgcggacgatggcagcagggacgccggtgccgagcggcggcgggccgcgaccgcgacgcgcgggtcgtcggcgtcgctgacgagcgcgaggggccacagcaacaagggagacgccggtgccaggaggggctccgagtctgacccttccgcggtgccggccctcgacgagtccgcgctcaccgcgctcatctccctggccgcgggtc

SEQ ID NO: 25035 - DNA, 647 bp, Sorghum bicolor
  Clone ID: 30945930
aggcgtttaggaacaagaatgtggagaaggggtgcgaatcttgaaggcgccacagcaaattttgtagaaacagaacagttggttgagtatgaaggtctcacatcctcatttatacaggttcgaggatcaattccacttctctgggagcaaatagtggatttaagctacaaaccacgacttagcattattgaacatgaagaaactcccaaggttgttcaacgccacttccatgatctttcacaacgatatggcgaggcaattgttattgacttgactgataaacgaggtgatgagggagatttgagtaatgcatttgctgctgaaatgggcagaattcctggtgtcaggtatatacattttgatttccatcatgtttgtcgtggaggtaactttgacaatttgcaagctctctacaatcaaattgaggaagctattcataagcaaggatattttcttatgaacactaaaggagagattttgttggagcaaagtggtgtagttaggtccaattgcatcgattgcctggaccgtacaaatgtgacacagagtttccttgcaagagaatcattggattctcaattgcagcggatgggggcattattgtcatctgaaagcatttctctctctgataacattaatgatatatt

SEQ ID NO: 25036 - DNA, 661 bp, Sorghum bicolor
  Clone ID: 30946001
aatttattggactctcaaagttaggcatgcaacaagatcgacaacgcacacatgcatgctgctcatctatatggaaattacatgtggttttggtttcatcatcagtggtcgaaacgcaagctttgcctagggcttggcaaagacggcctttgccgagagccaagacatcctctcggcaaagagcctttgccgacggccagactctcggcaaagaggggttttaggcaaaggtcagctttgccgagagcttagctctcggcaaaggctagccctcggcaaagacatcgcgcgacgtggctctcggcaaagaggtggcctttgccgagggcaacggcaggcactcggcaaaggcctcgttgtctgaaacttaggcccagaccaacaacctttgccgagggtaggccatcctggctctcggcaaagagctcctttgcaaagggccagaattggccctcggcaaagatggaagatttttttttttgaattttggacctagagtttttctgtagcccttgcatattgtatacaagcacatgttcaaagtttagatatttttataacattttgctatatttcatcaattaatttattttctttgtatttttctcgaaaaagtaaatttgaactagaggtgcatgaaatagtaaaatatagccattcg

SEQ ID NO: 25037 - DNA, 185 bp, Sorghum bicolor
  Clone ID: 30946003
ggctgtagctgtagaatgcccagttcagctcggcatgttggtttcgactgaactatcccctgtcctgattcaagatcccgctatttgtagctgttgtgctctcattttacgttaggcaaataaggaagctgcatatgtgtcaatgggtgtgtccctgttgatgacgtttgtttgcccaattgccc

SEQ ID NO: 25038 - DNA, 572 bp, Sorghum bicolor
  Clone ID: 30946013
aatgagagcacagggttggatgagatcagtgaattaaactaacttatggtttctaccaatttttgttcagcaatgtttgtcataggcttgttctgttacaaccttttttcattattgtatgctcatctttaccatgcttgaaccctccatgtctaagtgatagccaagtgatctgattaaaaatgcccttttgctatattgcgcatttcctattttagatgggacggataagtgcttggttaagatttgcattttaggtgtatttttatgcttctcgattgattggctaacactattatacttttgcttggtatgatggtttaccttttcaaactgcagtcacaagttttagaaggatagtgaggcatacttcatctcctaaaagcaggagagactaggatgtgttcatcgacttgcctgcaaagggagcatgatgcttctgtggtaattcttgttagctacatgatccattcaagaacggtcaagaattgcatgccgcataaatatttttgtgcaacactactttgactgaactgcattcacatacaagaagttgcatgttgctttcagtc

SEQ ID NO: 25039 - DNA, 670 bp, Sorghum bicolor
  Clone ID: 30946072
agaattggtactgctacgcgaagacgatcgcggagcagggtgcgtgggaggcggcgcgggcgcggaggctggacctggcggtggtcatcccggtggtggtgctcggcgagctgctgcagcccagcatgaacaccagcaccctgcacatcctcaagtacctcactgggcagaccaaggagtacgtcaacgaatcgcatgcctacgtgcacgtcaaggacgctgccgaggcgcacgtcagggtgctcgaggcgcccggcgccggcgggcggcggtatgtctgcgctgagcgcactctgcaccgcggcgagctctgccgtatcctcgccggactcttcccggagtaccctattccgacaaggtgcaaggatcaggtgaatccaccaaagaagggttacaagtttacaaaccagcctctgaaggacctaggaatcaagttcacgccagtgcatgaatacctgtatgaagcagtgaaatccctgcaagaaaagggattcctccagaagacctctaacaccaaggtgcctgaacgacgcagccgcctgcctgaacaatcacaaccacccgtattgatttcaaaactttgatagatttttgcacaacgtggccatgttttgtctgaacaagtcgttcatttgattggttattaaattttggcagtctgttcttatat

SEQ ID NO: 25040 - DNA, 604 bp, Sorghum bicolor
  Clone ID: 30946078
atgctgcaaaatcgtgatgaagaggtgctggagctactacaacatggtgcggaccgaaggccacaaagagctgatgaacaggcacagtcaagttcttgtgtagaactacagagagacaggcgcaagaagcggaaggtcccagacgtccagcagatcatggagacctacttgaatttcagaatgaagcaagctcgcgtcaaagaacaaagagcaaaggatgttgatcagttcacgatttctagctgtatcaaggctctgcaccctatgccagatgtgtcggatgaggtcaaggtattagcctctgatgttttcaaggaccctgagaacagggagatctttctttcctatgaacctaggctgcgcaccttgtggctgaagagagaagttggcaagctactctcctgatagtggtcttagcctcttaggttggtctgttggtgtggagaagtggcagcccttgcttgttcttgtttgttgtcagtcagaattcgattctggaggttgctattttaggcctaggcttcattataacaaactctgttagtaattttaacttgttccatgtgcagtgcgtcactgtgcttcctgagatgtagtcattcag

SEQ ID NO: 25041 - DNA, 620 bp, Sorghum bicolor
  Clone ID: 30946080
gatggagtggagactgcggaaggcatttcggtgctccgtaggtctaatggagttgcacctatatttgccatcttgaaggaaaatccgacaggcagccttcagcacagggtgacatgggctgtggagaggattctgcgggcagaggatatcgcccaagctgcttcaaccgatcacagtctgggatctgcacttgttcatgcttttcaacatggagattccagaacacggcgtattgcagaggcagcattgaagcatgtccgaaagctacccaccttttccataatcattgataagagtccctcgatacgaggttcgtccttgggaagcatggagcgctttatcaagtttgatcgctaggttgttatgaaacgtaaaagatttacatggcctgtttatgccttgtggccaacatatcccaaggtctagtttggatgttgccgtattcatcttaatttaaattccactctaatccaccctagcatatgtggattggtgtaaatccaattacatccaaacaagaccgcaatatatgtttaacagcaggaacacagtttattctggggtgggggcggtagacaagagtcataagctgtcactgaatctactatttttataagggc

SEQ ID NO: 25042 - DNA, 645 bp, Sorghum bicolor
  Clone ID: 30946094
agcgatgatgaggccctccggagtggaggatgcagttggggcatggctctagcaacatcagcttccctactcccttgaacaaagaggtattggagagcttaccggtgaagctgagccctcacatcttgaaccattgccaccaccaactccaaacaatgatgctgaagcaaccggtgatgaaggaccgccagtcatatccgcaccatggaaattaccatggaaaggaatgccttgctgatatcctgaacttgggagctgctggaaacttggatgacctccaaatgaatggaaactttgtgggtacaagggagtttgaaagttgggaccaaactgatagggtggaaagttcatggaaacagagagctgcaggccatgctgttggttgtttgtgttctgttgatttgaacttgccaatgcagagttcatcatatttgtgaaactaggtctagatgagttgtccatgtttcagatgtagtgtatgaattggtatgtgtccaaagttcttgtatatatgtaggagtaggcggaagcaggagcctgcctgggccaacggctccttggccaacggccatgtgccctgtagacatataatattttattgaacaggagaaggaatcgcaacggccatatgctgccaatattttt

SEQ ID NO: 25043 - DNA, 537 bp, Sorghum bicolor
  Clone ID: 30946110
cagggtttgagactttgagtttgagatgagtggctccagaacagggctcttcctgtccattgttaatcatttgtagaattccttctgacgtttacccactgtgtaaaagggaaaatacccggtacggttattctttctgcaattgctgggtttaatgtttacccatgcgtgtttcttcttgatggcagcagaacgatgcagctgggaagtcggcgtccaagaggagccctgctgggaggaagtaggctgcggcgtataaagtaaagccgcattgtagctcgatcgccctgaaacagataagctacgaggtaccgataccgggccaggacagtgacctgcgactgcgaggctgctgctgccagtcctggacactgaagttcatgctccgagttgcagctactactgtagatcggtattggccaaattggtatcataagataagatggccacatacagcaacatctttgtacgcgcgcacgctatgtatcatctcaggttaacgagacacgctgaaaaatttccaacgctcgaggctgc

SEQ ID NO: 25044 - DNA, 631 bp, Sorghum bicolor
  Clone ID: 30946124
gcacaactgtcactcctcgagaatgagatgcgtagagtagagagggtgaatgttggtttgatgcttgctggtatgggagtttcagtcgatgttttccggatggcaagtgctcgctgggaaaagaggcaagcaaaagtcttgggaaaagtcagaacacggatggtgaaacaagagaattcagacacgagaagctcttggagtgacatttggggatccccaccacaagatcaaagcaacgaggaggaagtatcagagagggccaagagagcggcagctgcagctagacggtggcgagagttctccagacgaggcgcagacaggcctccgacacacaagctcccggagtcagtaggcagcaaagattaattagtccgtggaacagagaaacatctggcatcattaatttgaccatatctggcatattggctaaaatgtacagtgtcgttgtttgatacgtacggaggattgcagtgccttcccagattgcactcggctccatttgtaaacctaaatctaggtaagtagatatagtggtgctgatcaacctgtatagaggtcaagcaccaagtgtagaacataggtcaaacatgtacgtattacaaaataaaacaagtatatacacattttcgcc

SEQ ID NO: 25045 - DNA, 535 bp, Sorghum bicolor
  Clone ID: 30946128
cgtgctcaacttccccgtggagcgcgtgcaggagtcgctgcgcgcgctcgcgctctcctccgccgccgcctctgccccgggcggctcccctgtcctggcgctcaagcgccgccactccatacgcaagcgctccccgaacaagaacaagaggcagcaggagcagcagcagcagcaccaacaggtggccgtggccgccgcaccacagcagcagccgccgccgtgccccggcggcaacgttgtggagctggaggacctcggcgccgattaccttgacgagctcctccgggtgtcgtccgagttcgattggcaataatccatggtaaatggcggccctgcaagtgcaacgtgcaagcgaagcgaggctttagttgtagtggatcgagttcagttgccatcagaattcagaaagcatgcagattgcagagcactcctgctgccctgccctgtcttcgctcgccaattgcgagatcgacgacgacttgtgctcatctttttcttggacatatactcgcttgtgtttaatctgtgcaggccc

SEQ ID NO: 25046 - DNA, 628 bp, Sorghum bicolor
  Clone ID: 30946146
ggtcaaaggtaggattagttgtctatgactcaaccatttcagctggtgctactactgaatatatggctggacattacatgaaacaaggtgcaagttctttcttaccagtgatggcacttgctccacaggagaaggagcgaattgttgatatggctgctgctccaggcggtaagactacgtacattggcgcccttatgaagaatactggaatcatctatgcaaatgagttcaatgagaaaaggttgcatggacttttgggaaacatccatcgcatgggcgtgacaaataccatagttagtaactatgatggtaaagagctacccaaagttctcggcatgaattcggttgacagagtattgctggatgctccttgcacaggaactgggaccatctggaaggatctacaaatcaaaacatcaaaggacattgaagatatcaggaactgtgcctttgtccaaaagcaattgctgctagctgctattgatttggttgatgccaactccaaaactggtggttacattgtttactcaacttgttcgataatgatcccagagaacgaggcagtaattgactatgcacttaaaaagagaaacgtgaagcttgtgccttgtgggttggattttgggcg

SEQ ID NO: 25047 - DNA, 586 bp, Sorghum bicolor
  Clone ID: 30946148
aagaaggaaaacccttccctcttgcccagccatgggcaaggcccccggccggcctcctctcgccctcgcagccctcgccgccaccacaacataccgtgtgaacagtacccgcgggtactgtagcatgcaagcagtcgctgcttccccatctcacccctctcgatcctagccgccacataacatctggtatcggcaatgtcaggcccccttccatcttccacgcagccgccagcctcctccgtagccccagccgtcacagctgcgccaccgccttcaacttcgttggagctctcctccgcgtttttttttccggccaactgcttacgcttgactctcttgcaggggtggttgctgagctgtcgcgcaacatggcggcgatgcagattttcatggcggcaatgcaggccaccgtggcggggctggtccagtcgtttcagcccacggccacagcgccatcaggtgcgggtgatgcgtgatctacagctgattcaaccctgcaccccttcgcagctcctccaagttgctcttcactgcgcggaggaccttgatcttgtccgctgcgtcggggatcttgggcctgtggttg

SEQ ID NO: 25048 - DNA, 517 bp, Sorghum bicolor
  Clone ID: 30946150
aacacagcacggctcgagctcgcggcgactcgatcggggacagacagacaggcagcaagtcgtcggcgggggttgcaggttaatttcgtcctcgacctcgaacgttggttgctttgcgagttgcgatggccggacgcggaggaggaggaggaggaggaggaggaggaggcagcaagagcagcagcctgtacgcggtgctgggcgtggccagcgactgctccgacgccgacctgcgcagcgcctaccgcaagctcgccatgaaatggcacccggacaagtgcgctgggagctccgccggcagcgccgacgcggccaaagccaggtttcagaagatccagggagcctacgccgttctgtcggaccccaacaagaggatcctgtatgacgtcggggcctacgatggcgaaggcgacgatgacggcgccggggagatcctcggagatattctggaggccatgagccaggcaggccctgccgacaacggcgagggggagagcctggaggacctgcagcggca

SEQ ID NO: 25049 - DNA, 672 bp, Sorghum bicolor
  Clone ID: 30946178
atgccgcaggtggccgcccctctccgccgcctcctccccctctcccaaccctagcgtcggcccccgcgcctctcctccacctctcgcgccgccttctctcctcctgctcccccgcctccttcggccgcgccgccagcctccgcgccctcgcctaccgccgccgccggcaccccgagcctcgccgtgggagcagcactctcgggaaggcgcccgccaaggaggagatggacagggaggtggcgttaataggaagcgggccgaggggaaggacggcgggaagcgcggcaccatggagctcaaggcccgcaggctcaaccccgtcaacaccacatgctacgtgcagatacttggtacaggaatggacacacaggacacttcaccttctattttactcttctttgacaagcaaaggtttatttttaatgcgggcgagggtcttcaacgtttctgtactgaacacaagataaaactatcaaaaattgaccatatctttttgactcgcgtgtgctcagaaactgcagacatactttgaagtctagtgttgaggcctttctcagtgaaaatgattctgaaccagccatacctcaactggcgaacacaatatttgcccctggaagtagaatggagaactacaacaggaaggctgcaagtccaagggataccacagctctt

SEQ ID NO: 25050 - DNA, 585 bp, Sorghum bicolor
  Clone ID: 30946202
aaaccagagaccgtcatcccctccaccatcccctccaccttccctatcttgtccgcgcgggcgtcctgcgaacgcacgcgcctcgcctcacctcgcccacgagcctcgcccgccgagcgccgtccgccgccgagcgcctcgccctccagcgccgtccgccgcctcgcatcgcccgcgagcctcacccaccgagtgccgtccgccgtcgagcgcttcgcccaccgagcaccgtccgccgctgtcgcctcgcccgccgagcaccgtccgccgccgagcgcctcgcccggtctcgcatagtccccacggaatccccctctctccatgcaccgctcgtggagtcctcgtctcccctgacccgcgccgactcctcttctcccccacacgccgatggatttctctccatcatgcactgatggccaccaggtcgcgcacgtccaggacgaacacccagcctgatccgaccactatggtgatgacgcacgcagccgagcgcgactacaccgccttgtccccgtcgccgtccacgtccctctccacgccggcccctcacaccctacgcccgctggatcctccgtccacccgtcg

SEQ ID NO: 25051 - DNA, 552 bp, Sorghum bicolor
  Clone ID: 30946233
ctgctccatccaccactccactccaagtcacacgggcagccgtctcagcctcgcccgactccgctccccctgtgcgttcgagacatggagctgatcacaaatgtcaccgagtatgagaagctcgccaaggagaagctgcccaagatggtgtacgactactatgcctccggcgcagaagatcagtggacgctcaaggagaacagggaggccttctccagaattctgtttcgaccacgggtactgattgacgtctcccgtatcgacatggccacaaacgtcctgggcttcaacatttccatgcctatcatgatcgctccttcagccatgcagaaaatggctcatcctgatggagagcttgctacggcaagagcagcagcctctgcaggaacaataatgacactgtcctcatggtctacttccagcgttgacgaggtcaactcagttgggccagggatacgtttcttccagctctatgtctacaaggacaggaatatagtacggcaactcgtgaaaagggccgaaatggctggctttaaggctattgcactcact

SEQ ID NO: 25052 - DNA, 114 bp, Sorghum bicolor
  Clone ID: 30946247
tatttgcccagcggaagaaaacccgagcaaaccgagcgctggaagcttcacccggcgaagcacaatccaatcggagccgctcgcagcgccgggatggggattcccctccggcct

SEQ ID NO: 25053 - DNA, 634 bp, Sorghum bicolor
  Clone ID: 30946263
gcgttcgggattagcctctctgtcatgtcgccagtacagcgcgacgctccgcatccacccaaatcggagtagggctgccttgccgcccccacaccctcaaggcgtcactcagtagccgccgcatccggccgccggtcccgctcccgcgcgaggggaggagaagatcacggcggcggcgtcttctgctggtttgaggatttggggacatcagctgccgccaggctccatcatggacacggcgtttctgcgccctccgctcgctcgtaatctggtttatgacgagtttgccgttctgcaccccacaagctacccttttcacactcttcggtatttgagatgcaatccgatgtattcaagaccgctgttaacaacatcaccagcttcaccatcaaggggcttgactcagagaatggccgcactacctgatgttgatgatttcttctgggagaaggatcctactccgatcctggacacaattgatgcacccatccatttgaaaaatttatctagtaaggagctcaagcagttagccgacgaagttcgttctgaaatagctttcataatgtccagaaaatgccaaccatgtggtcctggtcgctcagttgtggagctgacaattgctatacattatgtg

SEQ ID NO: 25054 - DNA, 607 bp, Sorghum bicolor
  Clone ID: 30946265
ctactggagtcaggactagtcttcgtcgccgtcaaggtcgtggcacttggcgtttcacatgaccgtgcgagcgcgaccgccttgacgccggccgcttcttctgctcgcgttctctgccatttccgccaccttaccggaccatttctttccgcttccaccgataaatccttgcgttgcccctgttgctgctctcttggacgggaggaaacaactccttcacgaatccatctttccattcgcccgtccgtgcgtaagcgcacccaccaccggcaccgccgctcgcccgttgttccgctcgggggagagggagaagtgcgcgatggccgccgtcgtgtgcgtcaccggcgccggcggcttcatcgggtcgtggattgtcaagatcctcctcgcccgcgggtacgccgtccggggcacctcccgccgcgcagatgaccctaagaacgcgcacctgtgggcgctcgacggcgcagcggagcgcctcaccatgctgcaggtggacctgctcgaccgtgccagcctccgcgccgcattccacggctgcgacggcgtcatccacaccgcctcgccgatgcacgacaatcccgaggagatcatcgagccgattatc

SEQ ID NO: 25055 - DNA, 579 bp, Sorghum bicolor
  Clone ID: 30946271
cctactggatcccgccgaatcaccacccccggccacaatgcccagtcgcaggctctcgcttccacatcccccgcttccccgcggccgcgggccaccaccgtcagccttgcctccgagctgcccacgcacgccgcacgtctccaaccgctcctcctcgcgcgtcatcatcgccaccgtgagacgccggcctttccgtgtgcgctgcgccattccgccaacccgcaccattcccacttcaactcgtctttaaactacgcccccaacccaatggcgcccgcccagtcaacttcactgacgcctgctgctgcttcctcttcctcctccccgagccccaccgagccatggagcggcaccgccaaggatcgtggcgccaacaagaagacggtctcgacgggcacgaggaggaggacggggagctgtcggcgttcgtctgcccgatcaccatgcagttgatgcgggacccggtggtgatcgagaccggccacgccttcgagcgggaggccatcgcccggtggttctctgagtgccgcgacctcggcaggggcccgtgctgcccgatcacgatgctggaggtgcaca

SEQ ID NO: 25056 - DNA, 681 bp, Sorghum bicolor
  Clone ID: 30946295
caaaaggagcttttgcagcacttccagttaaggtgcagaccatatcaaacaggatacttgagcacatcacggagcaatgccttgtgtgctacgacagcggcgtaccttgtgctgctagacaagcttgtgatgacccgctgtcccttatattcccatttcaggaggatgaagctacaaagtgtagtttgtgtatgtcaatcttccacaagcaatgctttagaaagatcagtgtttgcccttgtggtaaggcttctaatggcaggaagatcgtggcgcttgagcaagctgtacatgatggcacgggcatgccatcaacggagtctcttcagcctccacgtttctcttcatcttctgggtttttctctgatattctctccaaagcaaggccagataagctttggaggccgagaaatagcagtcctgtgatccttatgggttctttgccagatatgtctatatgagctgagttgtatttttctgctccattgattgtgattttgcccccaacaagcccatactgtacagtagagaggaggttcctcctagttttgaatgaatgaatgtaataaaatgcaatgtaatcctgcagtgttattacttgcagtatgccatactgatacagaaacgtcctccaaacaaacaaaaattacatgaggtgcgcgtgtagatttattttttctg

SEQ ID NO: 25057 - DNA, 605 bp, Sorghum bicolor
  Clone ID: 30946305
accatgtccatgtccacaaggataccatgccagggcccgggggtgccaacgttgtcaggctgacagtagacgaggacgtcaagttccaagaggcggtcaagaagcaggacgccattggtgaatcctcgagcaccgcagcagcggggaagacggcgcatcaccacctcccttggacctggcacaagaaacatgagagcagagaagataagaagacagaggtcatcaacgtcacaaagcacaagcatgtcgacgagaagatcatacctgggccacatggcgaaaagattgaggtcctttcagaagatgaagatatcagatttgaagaggctggcgagaacgaagaagagtatgaaaattccaaggcacgcataaccaagtcctaagatggatgatgccatattcagatatattgtctgcccacactgaaggcccttcaacttggggcaattaccatacccatacacacatatacatactaccctcgcatgcatttgagtattttgataagattctatgttctttcatgtgaaagaaataagggtgtcacagacccacctgattggattcaaagtgtaattatatgccagtatttgtatatgagcagt

SEQ ID NO: 25058 - DNA, 655 bp, Sorghum bicolor
  Clone ID: 30946327
gtgatgtgaacctaattaaatggcatagttctcctcatgtaggtcactataagtttcatcctgaggaatacagagctgctgtgacagagctactaaaaaaagcctcggtgctctacatgagcagaagacaacttaatggatatgatgtgggcacgagtgaacacagtgacactcctccatcgacctccaatctacccagaactgctgcaagctcagttggtagcaggctgagacgagcaccaatcgatccaaccgaccagttcttcctaccgagctccatggagtaccatgaaagcagcgaaggaccgcaaccagagctgtttaacatgccaagcctggagagcttgagtctgcatggggttctggggcaggtgctgtatgatgtatgcgttccgaagaatgtagaaggctgggacctcaagccttccgcgtcgatgaatgggaggcacatccatactgctgcgtctcggcatggtagcttcaatccaatgaaatgtgtacggcgctcgagattgtgaaaagttttgactggaacatgtggatgcatataggtgacttgtgtatactatacgagagaatgctgtttggtggatgctggtgaaacttgggatagctaattagctatcatccatcgaataaaaagcgaagcttattt

SEQ ID NO: 25059 - DNA, 581 bp, Sorghum bicolor
  Clone ID: 30946330
cccaaaacgaacaaaacagtacttataacttcaagtactccttctctgttgaaatccccaaaatttgcaaagacgatttagtcatattgaagccaaaactcgctaaccaacttggtggctgcggaaagatcctcctctgtaccaaggttgcttcagtcattcaatttatcgatgtcatcaatttgaaagtcgtagaactcaccggctctcaatatttccaatatgaaacagaactcatgattgttccctccaaggaaaatctcagagaattcatggtctttgatgttgaattgcctgaatccaagaaccaaagttcatcttttattggtactaaattcaagtgttctactgcaatgattggaagagtctctgattgggaaaactttgaagtaaagacccatatgggagacgtcttgaatgaaggaagctcagttctggcttatgagatgaccagtatcaatttaacaggagacaatgatgacttggcatatcttggaaatattcctgaagttattattgtcaagaaaatttatcctgagaaaaagaagaataagaagaaggtctttaagcttaaacatttc

SEQ ID NO: 25060 - DNA, 713 bp, Sorghum bicolor
  Clone ID: 30946334
ccacccaatgcttcaatctagctgttgtattagttgttacatattattgtaggagtcgttcgttgttgctgtaatactaggtttcatggtgtttcagctgctccatccaatgcttcaatctgtatgttgtagtagttgtttgtatgctgttgtagtagttgttcggtgtttgttataatactatattttatggtcattcagctacttcaacctattattgtaggagtatgtctatgttcttgtactattatgcgtattgtgttgcagcgttaagtctatggggtaggctgtcgggacaagttgacgacggacagatgtgctagggaccggtgagacgaggagcgaggtggatcccgtgctcgtcggggcaggtggggacgggctccttgcgtggggagtggacgaagagcaatcctccgtccgaggcaagtagagcaggggcaagatggttgcggacagacgggtttccttttccttttttttcttaatgtggtgcgggtggggtcttgatgtgcggacgtgttgttgacgcttttttatattttctccgtgtggctcgggttggtggcttggcgtccgaacacgctactggcgccggacgtcccagctctagcaatcctgtttatgaattcatgcacatccgatagtgataggtccaaatagattttgtggtatgtagcagtcttacggcccaaaatattatggatggtatt

SEQ ID NO: 25061 - DNA, 644 bp, Sorghum bicolor
  Clone ID: 30946350
tttttgggcgccaagggacccgggcaaccagtcgagcaggtgccgcagcaggcgtcgcgtcgcgccaatccagcggcggcacggctgcttcttctttgcctccggtggccatcattgaggcaggcagggaggctgctgctttacaacgaagatacgtgagagacgagacgcatggatggtgtgaatgaatgctcgccctgcacgccggcacgagacgacgcgacgcaacgcaactcatcgatccaacaacaaatgcagggacggccatcggtgctcctgatattcctattttcggggaaggggcaaaggcgaaggcaaagggaaacagcgagagcgccttaaaacctgcttctgctgttgatcgaaaggcaaagatggtctggcttgacaactacaagaggcgatcgacgagtttggcgtgtgaaataactaatattcatcttgaaaaaaggtgagacggtgagtaaccaattgcatggttgaaaatttcaggtcctgcaccctgcagtcctttgcgtactagtaggattattaatggtgaggaatgatgtaaaaaaaacatgacgtttggctgataagccatgatagaaaatattgtaagttgatttcttgtgagatgaatgacatattaggttgataaactc

SEQ ID NO: 25062 - DNA, 588 bp, Sorghum bicolor
  Clone ID: 30946360
gaaaagagattgagctgctattgagcattattccaagctatgagccgcaacgccatatgaacatagccacgatgctaaatattgtcgtaagagggatgttaaatctcttcttaatgatggtgggtatggcccaccgccgcaagcaacatatccaaaatggagtctatgcgacaataaaggtaattctcctagtcatttactcgttaattccttgcttgaatatcttatttttaatcaggctagaattaatgagaaattacatgttatgcttcttcaacatgataaaatcctaggagaagttcatgttaaacttgatagttttactatgtctttaaaataacaacttagttttaatagaagactataaaatcaagtagccaactttaaatcccaagttgcttatcatgagaaagttaatgttgtgaccacgagaggtggtaacgccactcgtgatccaccatttcctgagcctgcaccccacaaaggtaagaactaaccgtcatgagttatatgatacacatattttgccatttctagagcgaaacaggaaagcaatggaggatgaacaattcaagaaattgtagaggt

SEQ ID NO: 25063 - DNA, 653 bp, Sorghum bicolor
  Clone ID: 30946369
cgccaattgggcatgttggccttactgaagatgaggctactgaaacatatggtgatattgacatctacatatcaaatttcaaacctctcagggcaactctttctggtctacctgatcatgtgtttatgaaggttattgtgtgtgccaaaacaaacaaagtccttggagtgcacatgtgtggtgaagattcacctgagattattcagggtattgcaattgctgttaaggctgggttgacaaagcaaaattttgattccactattggtgttcatccaacaaccgctgaggaatttgtcacaatgagaaacccaactaggaagctccgaagacgcactactgctgaggcaaagactaaagacaaggctgcaagtcagaaatagctatcactcgttttacagtgagttttgcttgcaggcatccaaacttggtcagtttctagctttgggaacaagaggtgggtaactgtatagcagtagcatttggtgaagaatccacaattgcagctgctgaagaatgaaaatgtattgtaacattgatcaactgtctcatattgcattactttgacaacacgttgttgaaatacctagtgtagaaattgcattacttttgcagcgctttgttgaaatacatactgaagaagtggagatcttggt

SEQ ID NO: 25064 - DNA, 653 bp, Sorghum bicolor
  Clone ID: 30946372
tactcatgaactccaagaagacaatgatgtagtgcctagtgacatcatcattgccgttggggtagaagcgggtggaccaattgaagccaccaacagtgaaggtggatgaccttatgaatttaccaacatatgtgctgcccatcttttgactgtagtcatctatctcaaagatgtgcgtgcctgtatgggcctccatggtgtgacttgatgccgttcttttgggtatctgtgtcatccttgaagtaccttctccttccaaacaataatacccttaacaaagcacacaacataatatgtactgtacacattggaatccattcatatgtatatcttgtctattcaagctacttatgtttgaaatttcttggtacgtggtagtgatgttcctttaactataattttccatatgatgtatagattggtcggattctggacgcggtggatggaatgagggacctgggaatagttgtagatacatatataaatctgaattggctttgtgtactcttttttactttctgaggaacaacacttgtcaagattgtcatggttttcactaatcactataatatttttcttgaacacgcaagatagctgtgtttcattgcattgtagaaggaataataggtttccaccaaaaatagaaagaagag

SEQ ID NO: 25065 - DNA, 546 bp, Sorghum bicolor
  Clone ID: 30946385
acaagaatttgcgctctgttggagtatctgcgatttctggtgctggagtcaatacattttttgaagctatagaagcaagcgccaaggaatacatggaaacctacagggctgatcttgacaagaggattgctgaaaaggaaagattggaggaagaacgcaggaaggagaatatggaaaaattgcagaaagatatgatgagatccaaaggacaaactgtggttctcagcactgggttgaaggacaaaaattctgtttctgacatgatggatgatgccgatgaggaggaagaagaggaagcattggaagattttgggttttctgaggaagatgaagatgaaggagaagacgaggaagtggctcattttggtttttgaggagatccaataggaactttggtgtgccttacgttgaatccatatggggctactagttgtttatcgtttaactgaagtggaatgaaaaactgtcaatatcagtaggttgttgactttgttattagtctacttgtttaaattctgatgtcctgctgctggcagtttatgccgt

SEQ ID NO: 25066 - DNA, 481 bp, Sorghum bicolor
  Clone ID: 30946387
gtttagttttaaaatttttggcaaaatgaataccgtagcactttcgtttatatttgacaaatattgttccaatcatggtctatataggcttaaaagattcgtctcgcaaattaccgggaactgtgtaattagttattttttatctatatttaatgctctatgcatatcccgcaagattcgatgtgatgggtaattaaaaaattgcaaaagtttttgggagctaaacaaggtcttagttctcaaaaattttcttttcgtctcgtcacatcgaatctttggacgcatatatgagcattaattatagataaaaaaaataggtaattacataatttacatataatttacgagacgtatcttttaaacctaattagtccacagttgaacactacttgccaaataaaataaaaatgttagagtagctaaatccaaaaaaattcaaaaactcaacaagatcccaatcaagagtttgtcagcatatctc

SEQ ID NO: 25067 - DNA, 570 bp, Sorghum bicolor
  Clone ID: 30946391
tcggggacgccgaggtgacgacgggcgtggcgggcgacctgcagcaggtgacgcaggtggcgcggcagatggtgaccacgttcgggatgtcggagatcgggccgtgggcgctcatggagccggccgcgcagagcggcgacgtcgtgctgcggatgctggcccggaactccatgtcggagaagctcgccgcggacatcgacagcgccgtgaagcacatcatcgaccaggcgtacgaggtcgccaaggagcatgtcaggaggaaccgcgcggccatcgaccagctggtggacgtgctcatggagaaggagacgctcaccggcgacgagttcagggccatcttgtcggagcacgtcgacattggcaaggagcagagggaaacagcagcccggacagagctggtcaccgcttgaagctagagaagactagcactgtagtatagaaaggagtatatataggagaagcatagcttagtgcaaaaatgcaatagtagactgtagacacttgatagtatcggtactgtacatggtaaaatcttttcacgtaacaataacgaaacacatgaatttcact

SEQ ID NO: 25068 - DNA, 609 bp, Sorghum bicolor
  Clone ID: 30946396
taacatgagcaaccagtgccgaatgagctcgcaacaatcaagcatcgcccgtgggcctcctccatggccgtccttcctctgcacgctttttgtcgcgctcagccccatccagttggacttcaccaacggcttctccttcctgacccagaacgccatggttcaggtcctcaacctctccatgtttgagttttcaacatttggcttggtgtccaacatcgccacatcggtgccatggtcggggcgatcgccagcgggcagatggctggcacattcgtcgtaaaggggtgagaaatttgatcctctttctttcttggcagttgtcatttgtccttccagtttatgatgcatttgttgcttgtaagctgacaatgaaggagagtcaacatcacttctttatcgacagagaggaggctgcgtttagacttagactaaccaaaaaaaaagccatcatttttctgggatagataacccaagtaaaaataggatactggtatttcataaattaggtgggaggactttttcttcagaaaaatgcatgtggaattttgaaaatagccaataactttgcaagaattaatggctgtggaccgtgttcttttttttgcagtt

SEQ ID NO: 25069 - DNA, 551 bp, Sorghum bicolor
  Clone ID: 30946434
aaaaccgcaaggacgactgaaacttgacacggctcgcgcgcgtacgacgctgcattgcaattttgcatcactcatcagtataaccacttaaccagtaggtagtcgatctagcccgattagttgccgatgtcgccgacgaccatgtccctgaccacgacgagccgcctgcccatctgccgggcgcaggacgtgtccaagcaggcgcctggacagaagcgtgcgcctccgtcgtcgtcgaagtcgtcgtcagacacagccggtttcagcaggaggaggctgctgcagtccgcggggatgggtctcggcgggctcggtctcgccgtgagagacccagcgcgggcgcgtgccgggacagcgccggcgctggctccggaggaggtgacgtcgaaccggatgtcctactcgcggttcctggattacctcaacgccagcgcggtgcggaaggtggacttcttcgagaacggcacggtggccgtcgtcgagcttgacgacccggcgctggcgccgtcgagggtgcaccgggtgcgggtgcagctcccgggcctctccgc

SEQ ID NO: 25070 - DNA, 637 bp, Sorghum bicolor
  Clone ID: 30946444
actgctcacttgctcagtggttggaaacagaagccgccccctctcggctctcgctcctctactaccctactatggagtcagttgccgtcgtggccatcccgttcccggcgcagggccacctgaaccagctgctgcacctgtccctgcagctcgccgcgcgcgggctgcccgtgcactacgcggcgcccgcggagcacgtccgccaggcccgcgcgcgcgtgcacggctggggcgacgacgcgctccgccgcatcgacttccacgagctcgccatctccgactacgcctccccgccgcccgaccccgccgcgagctcgccctacccttcccacctcatgcccctgttcgaggcgttcatcgccgacgcgcccgcgccggtcgcggcgctcctccgcgggctctccgcgtccaccgccgcgtcgtcgtcctgtacgacgtcatcaacgccttcgccgccgaggaggccgcgcgcctgcccaacggcgaggggttcgcgttccactgcaccgccgcgtcgtccatggtcccgcacatggacggtggcgcccggctcctgcgcgacgtgcacggcctcgacgaccaacccgtccacgccttcgtgacggaggagttcctcgagttcatcggcaagcgcgcg

SEQ ID NO: 25071 - DNA, 457 bp, Sorghum bicolor
  Clone ID: 30946452
cctactgggatttgtaccaaaccagctgagctcctcgtcgtcgtcctcctcggaccaggagctcatgaaagcactcgaacctcttatccggagtgcttcttcacccacctcctccacctccaccaccacctctcccttctcctactcgtacccctactgctctgctctgcctcaagattcgtactacctccccgccacatcctcttacaccttcccgccaccacctcctgctcccaccgccgccacctccttctcccagctcccgcctctgccgcagtcctcgtcgtcgtacgcctctccggcggcggcgtcgtacccgacgtcgtcgtcggcggacgccgcgtcggggctggcggcgctgaaccacctgggcccggcggcgcaaatccaccagatccaggcgcagctcttggcgcagcatcaagagcagcagcagcagcagaggggcctgctggcg

SEQ ID NO: 25072 - DNA, 606 bp, Sorghum bicolor
  Clone ID: 30946474
agcagacacagctacggcgtgcgggccgggatccagtccggcatggagccaccctggcgatccgcgggcggcgctgcctccgaggcctcctcggcggccggatcggacgccgaggacgacaggtactgcagcgccaactccgccctcggcacgcccagctcgatcgctacccttctcccctcctccgacttctgggaccaccagatggacctcctcgatgaccatcccgccaccgccggattccccaagaaacaccagctcagccgcctccaaacgctggcatcggtgcagtcgcggcaggaaacgggtcctcctccggcgactgccggagtcgacgccctcgcgcggcaggggtcgagtcctgcttcaccatatattcctccgcgccccgatcacaaccaggcgcatgaatttggtgacaatgatttatttgatgatatggtccaagagatggaacagattcttctcaattcaggggagccacatgaaaatggatcttttatggataatcgcaggagtaatgctcgccaggctcaccatttcagagatggcagcactactgcctctacttctggtacagatgacgcctatgtatgtcctgttcct

SEQ ID NO: 25073 - DNA, 431 bp, Sorghum bicolor
  Clone ID: 30946484
cagatgtcaacatggcaaatgcagatgcagcacagcggaaagagaagaggtcactatgccttgtggtttggttccaatctcgaaaaaactccatgagaactctactgcatgcatgaaaatgggtgctgctacaagttacttaggccgcccggccgtctcccccctactctgcctcgctacgaacgaagctgatgtgctccgggctccggctctgctcgcttctgctcacgagatggagtttctccacctccgcggcttcctcggcgtctctccgggcacgtggccgtcctgccccgccccgtcgccgccgctcatcttggccagcctgcccagcttcttccacccgctgctccacgccgagggcccctggctctggttctttccaacgacaccaaccccgccggtggccttggcccccaccgcgggcgacg

SEQ ID NO: 25074 - DNA, 454 bp, Sorghum bicolor
  Clone ID: 30946487
cctactgggcgccgcgctctcggcctcttgcccgcccgcccggccggccggcccccgccgcctgtcagcgcgccggtcgtcccgcctccgcctccaatcaagcaaagccaactaaaccgcgacacagaaaatacccactgcatttggcggccgaattcgaactctgctcctcccagcctccgtcccccatggcgacgcctccgctctcctccgtttccactcaccaccgtgccccaccaccatggccgcttcccaagactaccaccagcccgcgaacaaacctccgttgtggcgtgctggcgccaccggccggccaagttctagaggcggccgccgctgctccaagtccaagaaacccgcccagtccggtcctgagctccggcgtgaacctgcaaatccaacgcctctgtcaggcgggtgacctcgcggccgctctgaggttgctgggctctga

SEQ ID NO: 25075 - DNA, 651 bp, Sorghum bicolor
  Clone ID: 30946513
aattttaaagttttacgaaaaaaagttaaagaagaatggaaatcgcagataaacagcaacaaattggaatccaaagtgctcctgatggcactagaaccactactattctctgctgccattgtggggccgcttttgctccttcctctacaggaaccaacatctgtgttaagtgtatatctaaccaagtcgatatcaccactggaatcaccaaagaaggcgttctcgaattctgtaaaaagtgtgaacgttacctcagacctccatggattcgtgctgaacttgaatcaaaagaactcatggatatctgcttaaagaaaattagaggtctcaataaggtgaaactcgttgatgttaacttcatttggactgagccccattccagaagagtcaagctcaaattgactgtccaacaagaagtgatgaataataccagcattcaacaaagtgttgttgttgagtttgttatcaactacttacaatgcccagattgtaaaaaggaattcactcctcacaaatggagagctcaagtccaactcagacaaagagtcgaccataaaagaactttcttcttcattgaacaattgatccttaaacacaacatgcatcaaaaaatgctcaatgtcgaagaagtccacggtggtatcgatttct

SEQ ID NO: 25076 - DNA, 563 bp, Sorghum bicolor
  Clone ID: 30946517
ctactggagatcaagagatgaagagccagagcagtagatagagatccactacatctaggctagcaaccaagatagagattagagagagatagaggagaggagtagagattctggaggagtcccggcctgtcagtgcctcttcgtggctatattcttcgggattcggctctctcgcccgaaactacgttctgaggtacttttgtatttacccttctgattcaagtaagcaacttgtttgtattcgttttttgtttgcaactcatatcatatgagtactacgatttgggtagctcctaggtcggaggagtgattcgtagtgtagacatgatgtctggactatggttgcttgtgaatgtctcctgatcagtcggacagtggtagttcacgtaggtgactttatagctgcattgattcctctgtagttcacttctggcccgttggtaggattgataggcttataggtgcctagtaggggattactctgactttttccctatttgggttacttgcctgataagatgatactatacaaagtttgctggttattggaacaagagtacatt

SEQ ID NO: 25077 - DNA, 652 bp, Sorghum bicolor
  Clone ID: 30946525
ccttttttttttttttttttttctcaaatggttaagtcctggcatttgggaagcactctttcagataagtgttacacatttcacaagaagcttataatgagtccacagtagaccagaaggctagttcaggcaataaactaaacagcacgtaacattccgggccctaccaagttctacaacaacacaactgttttaagacccaaacaaccgttctcccagtatgaagaaactcagttacaccgtgtatattactgtaataacatcacaaagccctgagaccaagccaccagccaccagactccaagtggattctggtgatcttcagaaaggggccaggtacccttaatgccgtcacatccagggggatccccagatatatactgcattacttctgatagggcagtttacctatacactgccagttcattttctcctatgatgatggcgatgtttattgtgccgatcaaagtctgagtaatcagaggcactagaatcagggtagtgctgtttctcccgagatctccttgaatgtctactggtttcgtaatggctgcattcagtatagtcttgcttaccacttaatctctttgaatgcctgttggtatgacgtggatttgtatcagaatggcgctgtttctccactgatctcctt

SEQ ID NO: 25078 - DNA, 499 bp, Sorghum bicolor
  Clone ID: 30946535
aatgcatacgtgtgtagacgagacgtaccgaggtcagcggcggcgagccggaagtagagatcctggccgaaggacgggtacacgcggaggtcctcgagtccgccggtccacatgacgcagccgcggtggcccgccgcgccggtgaggttggcgctggcgtacgccgtgcaggagcagttcctgaggcaccgctgccggcactggtccaggctggagccgtagtccaccaccgcccgcgtcgtgtcgggcaccttggcgtgcggcagcggcgcgaacccgtcggtgctgctgctgcggttggcgttgccgccgcagtcgagcggcgtggcgcggacgcagccgtcgcggccgtcccgcatcgcccacgacgccggcgaccgcggcgtgaacccggggaggcaggagcaggcgggcaccttgttggtgtcgcacaccccgttgggtccgcacggggacacggcgtcgcactggtccttgggcgcgtaccagtagagccccc

SEQ ID NO: 25079 - DNA, 709 bp, Sorghum bicolor
  Clone ID: 30946544
acgatgtcgccacctccactctttctcctccactatcacagctgctctccctccatcacgagggttccatggacgccggatctggtgaggaggcgcccgctcggccgatctagcgaggtggtggcttggccgatggcagatctaggtggtgcggtgccctagtccctggtagtctagtggatgctgcctccccagatggacccgtgtggtgcggcgcccccgtccccagtgtcaacaccagaccaccacccaactgcagcgagccaagggggaggagggaccagcgcactccggccggagatgagtggcggatctagaccggccttggtctgcgcccagttcaccacagggtgttgaatgagcccttggagaaagcacttggagagcattttcactgaccttggcttcaccggcaataccattgttaggccagggtgcctaatggcttcatcttgcaggcaaactgccactgggacaacaatagtagtagttaaaatactaggctgtataggcatcaattatttgcagcatatactaggcttttttatagccaattttctggtgctattcatgagtaacaattatcagccattaaagtccctatagtatggtaacagttctagaaaatattgtctgatcacaaattaataaatattagtgaactgatagtaaaggccactctaactcttacgattatcttgcaaaagca

SEQ ID NO: 25080 - DNA, 356 bp, Sorghum bicolor
  Clone ID: 30946548
atcttaggaagagagactacattagtagctttgttgtgagaatagagggaagggagtgaggagctttcaaggaggagtcccggcctatcgggagtcttctctgcggagcacctcagcggatgcgactcttcttgtgtgtattagagttttgtttgtgtgtgattgtttaagctaggatggctggatttaatctttcagaagattatcaagatgatcctgaggactattcttagaagagcaagagataatcttactcctccaagaagaacttctggagctcatccaagggatcgacctcttgatgaacctccatcagatccaactagtcgcccgagtagctcaaccaatccaccgat

SEQ ID NO: 25081 - DNA, 561 bp, Sorghum bicolor
  Clone ID: 30946561
gggcatgatcattcgtcacccggacatgttttatgtatcgttcaaaggggatagggactcggtcttcctccgtgaggcgtacaaggactcacagctggttgagaagaaccagctggtgctgcttaaggagaaaatgagggctcttgtggctgtaccacgcttcccacgaagaggtgcagctaggattggcgaggagggtgagggagtcaatggatcactgcaattgtcggatgaagaaagtgatgaggaatatgatgaagatgagggactctcagatatggaagatttgattagtgagctttctggtggcaaatcggatgctgactaccagtggggtgatggctggtttggcgagaatgatgacgcgccaccagactttggagatgatgacacaagtccacaagaagtcaaggttgcactgaaaaatgctgatggttctgccaacggtgtggcacctgttcctgtatttcctgatggcagaccaagggaagcggtggtaaattgagctgtttgaacttttggttgatagaaattattaatcccctaatgttagttcttttt

SEQ ID NO: 25082 - DNA, 665 bp, Sorghum bicolor
  Clone ID: 30946566
tgaaaacaagttgcactatgttcatgcaatggcagatttcaagcttaaccgacagatacttccatttgcaaacgcattttatagaggactcagtgatctcatttcaccatattggctgagtctgtttaatgcaaatgaatttaatcagttactttcaggcgggctgcgggattttgatgttgatgatttgcggaacaacaccaagtatactggtggttatactgagtcaagtcgaactgttaaactcttctgggaggttatcaaaggatttaagccaacagagcgttgtttgctcctaaagtttgtgacaagctgttcacgagctccattgcttggattcaagtacctgcaaccttctttcacgatacacaaggttccatgtgatgtaacactttgggcatcaattggaggccaagacgttgaccgtcttccatctgcttccacatgctacaatacgctcaagcttcctacatacaagcgctcaagcacgctaagaagcaagctgctttacgccatcagctcaaatactgggtttgaactctcatagaggtatatttagtggcggtggtgttgtgaattgtgatcatgtcttggctttgctgtgaatagaggtatagcaaaattcgatcggatgtacaagtgccgcaattgcatcttgatgttcg

SEQ ID NO: 25083 - DNA, 184 bp, Sorghum bicolor
  Clone ID: 30946574
tgaaccctttttgaactcatgtagatcagttgtagatgttttttgaagctgcttgctagttccctgatggggagtggtagggtactcccattatttttgggtagtatacttttgggcagtataagaaatgcccctttcccctgtaatcacccaatcatatgcccatttgttttttttatggggc

SEQ ID NO: 25084 - DNA, 725 bp, Sorghum bicolor
  Clone ID: 30946588
gtaacatcgttcaatgctaccccgccactgagtacgacttcactcccaacaacttgcaagtcaaccaaggtgactacatccacttccaatggactggttgcgacttcaaccaaggcaatgctgctggtgaaggtactgacaagactgatcgtcacaacttcgtcatcttgaagggtaaccaaggtcgtcgtaactaccctgccaccctcgacgagcaaaccttcttgcctcgtgacgtcatggagcgcttcgctcacgttggtcaacccaccgtgtggtgcgacactctcgactcccaagactgctgcttgacccaagaccaaatcactagcggtcaagtcgatgccaaccaagacgttcgtaactgcaacaagttgaacgctggttctgcttacttcgacggtggtgtcatccaaatgtccaacactggcacttggaactactactccacccgtaacaacaacttcaccaacagatctcaaaaggctcaattgactgtcaaccctctcattccttggtggggtgttgctttcgttggtgttggtggtgctggtttcatcggtggtgccgtcgttgccgtgctcgtctggtacgccaaggctcatcctggctcagctgctgccaactacaacctcaagatctaagcctgcttcgtggctgatgacgacaagtgttcttgctcgtcttaatgtgtagttgatagtggtaagaataaaagtaactgt

SEQ ID NO: 25085 - DNA, 611 bp, Sorghum bicolor
  Clone ID: 30946620
aaaacagtattgtgaatgaacgcttgacagagtaccagatgaccgaggaggaaggtgaaagctctgtggcttcagtggaggaacaacttaagaaagaaatgacagtttacgagaaattcatcgtcggaatgctaaccaattttgggagtatgtcgctggacaggatacataacactttaaagatgttctgtattgccgagccatcatatgacaagtcactgcagcagctgcaaagttttctttctggtctagtagcggatgaaaagctagaaacgagggatgggctgtacttgctaaagaggtagcagtcattctatatactaggatagtgagttgttagactagggttgtactacttgctaatgagttgtttagactagagatgtcgggtaatcagacacaacatactagttcattatcaacgctgtgttatcgtgttcctcgaaatgtcttggtgtcttgcagtatatatcctaggaactgaagaagtcgagtaagtgtcagcgtccttgatgccccactgttgtgtatttcactctctgaacaccttcgatattctgagattttccaaagcttgttgagaatcagtggaagcaactgttctctcctgt

SEQ ID NO: 25086 - DNA, 699 bp, Sorghum bicolor
  Clone ID: 30946644
gcgaccagtgagtcgatggctatcgccgccgttcgccggcgcttgtggcgcgggctggggactgcggccgccgccgtggcctcggggacggacgggaatctgctcgctcgcctggtctcggagccggagtgccgcgtcaaggcgaccatggaggaggctgcctcctcggggacccaccgagacggcgccttctgggaacccctcgctgccgcgctcctccgcgcgtcgtctccgaccaaggctcacctcatattggagtgggaactagagaagctgctgaaggaaaacattcaagattgcgagccctactcgaggataatccatttctgtggtcagacaaggaatgcaacgcttgcaatgagagttttcgaatgcgtggaggcgaagggaatccagctgaacactaacattttcaatgcccttattaatgctttcttgtcagccggtgacctcctttctgcaatgaccttatatgagagtatggaagacatggatggttgcaatcccaactcagctacatatgatgcattcatctgtgcattttcgctgcttggaagtggccatgctatgatgagctggtatgtagctgcaaagaatgctgggtttacgccaagtattcaaacttttgaatctttgatcacagggtttgttcagttgaacatgctagatgatgccaaaacaatttttgaggaaatgatt

SEQ ID NO: 25087 - DNA, 451 bp, Sorghum bicolor
  Clone ID: 30946654
cccatcacgcacctccagcggaatcggcaccggggcgggtgctctccgtcgtcgccatggccgtggccgccgtcgtcgagcaggcggccaccatggacacgcgcgtggggagcctcaccgtgccgcccgcgtcgctcccggtcttccccgtcaccttcatcatcatcctcgcgcccgtctacgaccacgccatcgtcccgttcgcgcgccgcgtcacggggtcgaggatgtaccggaacaaggtgcccacggggagcccgctcaccaccatcgccaaggtcctcgtcgccgccgcgctcgctgggcgcaggcgcggcggatgcggctacggcgcgcagagcgccatcagcaacggcgccgtcatcgaccgcgcgcccagccccacggggagcaccgacatgaaggagtacgactgcaagcccggggccggggacatggtggaggacgctgc

SEQ ID NO: 25088 - DNA, 672 bp, Sorghum bicolor
  Clone ID: 30946699
ccccgctccttccttcctgcgcaagcgttgcgtcattgcgtgcgcctccccgcctacctgcatccgctaccagccggcgatgtcggtgccccccgccggcaaccgccaggtgtccctgcgggggtcgagcgcgagggagatcacacgcgacgcgctgctgcagaaggtctccgaggagcgccagctccgcagccacctccgccgcgccgctgtggctgccctctccatccagcgaatatggagaaggtaccatgtgataagaacggtttcagaacagctccatgaagactgggagctattaatgaaccagcctaacattgacttgactactcaatggatatctagaaagatgcttaggccgtttcttttcttcattactcaaccttctagctggtacaatggacaacggagcaagactgtggaatctatcttaacatgtttcaagattctcttgaatagtataaactcaatggatgcaagcaaaaacttctgctcctttgctgtgggtatgccagaagagaggtctatttggctttatcaggccaaaaagctgatttcactgtgctctttcattcttgccaggtgtgaccattcctgttgcaaggatggaaacatagttgacatgactgctattgctatgagattggctgtgtctttaactgatttcaaaca

SEQ ID NO: 25089 - DNA, 638 bp, Sorghum bicolor
  unsure (1)..(638): unsure at all n locations
  Clone ID: 30946719
cttgtaatctccttttcggatagggcatcgtttccgcgcttgaacaacacacggcaacgcgcgccggaaggccggaccggacccagcgccaccactcgggcccctcgcactcgcagcatgggggccgccgttgggaagccagcgttcggtgtcgccgtcgcgccgaagtcgcaggcggaggagcggctcgccctcgcggagcacgccctgctccagtggactcgctcccccggcgccgacgccggcatctgggacgccgacgcgagctacaccaacagaggcctcctggcggcggtggacgaggtgctcctcctggcggcggaagaccctttcccgttccccgcggccgcggccgcctccgcgcgcctccgcctggacagcgccgtcggcgccgccgcgtcgcgcatggtggaggagttcctgcgcgtcagggtctggaacgcctcccggctccgcggcgccgttcacaggctctcgctcgcctccactggcctctcactgctggtcttccccagcgccggtgagagggccagctcggcgggcaccggcggggaagggggaggtcnacncgtccgacgggagccggtcgcgggcgagctcgggcgtgccttacgatgtcgcggacctcttggacgccg

SEQ ID NO: 25090 - DNA, 403 bp, Sorghum bicolor
  unsure (1)..(403): unsure at all n locations
  Clone ID: 30946725
acgcagtatcagtagttagtttacaacaagaccactcataatgcagctcaagaacatcttagttttgtccgttctcttgtcagtcgtctgcttcatcgcagccgaatctgatgtagttgagttgactacggccaacttcaacgaggtcgtccaaaacactcctaacattttggttgaattctacgccccctggtgtggtcactgcaaaaacttggcccctgaatacgagaaggccgctactgagttgaaggctaagggtgttaccttggnnctaagnnaaaatcgaacggttcagctgagcaagccattgcccaggaatacggcatcaagggcttccccactttgttctacttcaagtccttcgagcaaggcaagattgagtacgacggtgagcgtaacgctg

SEQ ID NO: 25091 - DNA, 769 bp, Sorghum bicolor
  Clone ID: 30946733
acccgcacccagacctcgacgaacggcgagcagcaggagggcgtcgcgaacccttgggcggcggatcggtactcgtaggcggcggaggaggacatggctgcggcggcggtgatggtgagctcggcgggctccctgctggcgatgctgcaagagccggcgccggagctcaagctgcacgcgctctccagcctcaactccctcgtccacgccttctggcacgagatctccaccagcgtctcctccattgagagtttgtatgaaggcgaggagtttgtccagaggcaacttgcagcactagttgcctctaaggtgtttttctacttgggcgagctaaatgatgctctctcgtatgcacttggcgctggacccttgtttgatgtatcagatgactctgattacgctcaaacactgttagcaaaagctttggatgaatatgctgccatccaatccaggcccactggggaagaaaaaactatggaccctaggctggaggccattgtggaaaagatgctggacaagtgcattcttgatggaaaatatcaacaggccatgggtatgtctgttgagtgccggagactggataaactggagggagcaatttctcgatgtgataaccttcatggagctctttcatattgcatcaatctgtctcaccaatatgttagtcaccgcgaatatcgattggagattctacaatgtcttgtcaaaatatatcagacattgccaaatccagattatttaagcatttgccaatgtcttatgttcttgg

SEQ ID NO: 25092 - DNA, 742 bp, Sorghum bicolor
  Clone ID: 30946739
actttccagatagatccaacacaaccatgttgaaggctgtcctgttagtcacctgtcttttcttggccagcactctggctgacgtctacggtcacaaccctagaatgtctaacaacagactcaatacttcttccagaaatactgttactcaaaacagacttatggactcgcaaaacaatgccgctggtggctactgctggggtgaggcattgacctactactacggaagtattcttcaagtcgaatggaccgcccaacacggttgcggtaccggtcacaacaacgtggattgcaactttgttttgcaatacatgtgcggcgctgaacttcgtgacggtgttgttgacgagcgtatccccttggatgacacccgcgacgacaagaacgccaacggagagtacaagtacggtatgcacgagtcttacgagttctacatgaactgctctactcgtcaacgcaacaacggtctcttcgccgctgatcgcattatccgtggtaacttgaaccccaacggtcctgctaccaacactcgtcaaaacaacaacggtgctcgttctggctacgaatgccctgaggagcgtgactactatccttactggcaccctgccccatggaaggatattgccgtcatcacttccaacattgctcgttgcaacttctacaagaccgagtctcaaaacgttaagccccgcaacttgtgctccatccctgactggaacaaccctgttgactgcgctaccgc

SEQ ID NO: 25093 - DNA, 700 bp, Sorghum bicolor
  Clone ID: 30946765
cagcaatcaggctacccatagcattatatctacccatcctattatgagtaatcaagatgacattcttagatggattcctgccaaagatggtcgctgctctacaaaagccatctacaagcacctaacttcccaacagaatacacctctgcccaatttcggttctagaagtatatctactgaggccaaccgaattcttcagaaagtttggaagagtaagaaaattcctcctattcttaaaacctttgcttggaggcttataagacatgcccttgccacaggtgagagagcaggcaggtattcaattcacattgatcaacattgttcgcactgtggtgccattgagaatgacttccatttattctttcaatgtgagcttcctaaatcggttcgggctactactaacccaccttttttagtacataacatccttcctgaacaaaatggggtgcaggtaactctgccaatattacttacaaccaacccttctgatgatcttttatgcaaattcctttttattttatggtatatatggaaggctagaaatgataacaggttccaaagaaggacttggacatcttggcaggttcaccagcgcggctagtgcacacttaaattctcatttgcaggcactaactgagacggcaggacgacacctactcgatattggccaaaatacatcagttcagcgcatgcagccacc

SEQ ID NO: 25094 - DNA, 590 bp, Sorghum bicolor
  Clone ID: 30946773
aataggtgatattgttccatggagctaataagcacaaccactgccttcttgtccgccctgatgctaatccttgtgtcattcctagcccacaaagctagaggcaaatccatgaagaagaggaggcctccaggtcctttggccctccccttcgtcggatgcatccaccacctgctcacctcgcagccgcaggccgccctacgtgacctggctcagaagcatggcccggtgatgtacctgaagctggggcaggtggacaccgtcgtcatctcctcgccgacggcggcgcaggaggcgctccgggagaaggacctaagcctggcgtcgcggccgagcttgctgggctcggagatcatctgctacggcaaccgcgacatcgccttcgcgccctacggcgactactggcgctcgctgcgcaagatgtgcaccgtcgagctcctcaacgcttccaaggtgaggcagttcgcggccatcagggacagcgagaccatgtccctggtcagggagatacgctgtgctgctgctgccaccggcggcggcggcggcggagagcccgtgaacctcggcggcctgctcctgtcgtgctccaactc

SEQ ID NO: 25095 - DNA, 540 bp, Sorghum bicolor
  Clone ID: 30946781
ttttttacatcttctttcttaagttgttttagttattgttgggataaccacactaatgcagcttgctagtgacaacaaaagtactaatttcaccataatttgaaatcagcccaagataatcacctattcactgaaggatatgcatcgcacatataaatgaagaaatgacaacactcacaactgccaagcagttattatcataagaaccttagttgcaattggttgcaattagttacaagcagcactaacaacaatcacaactagttacagttggtcactccaagtctccaacaatagttgcaactagttgcagccacgcgtcatctcaacagcaagacaccggatttaatgtggaaacccccaaataggggtaaaatccgtgagaccaagccaaccaaatcttcttccactatgtgcttatggagttacaagaaatttatctctagattgcactagaggcaaccatacataaaaaattatagattttggacaacaacaataagatttggggctgctagagaagaaagaccttaccaaatg

SEQ ID NO: 25096 - DNA, 660 bp, Sorghum bicolor
  Clone ID: 30946787
caaggctgttcgcgaaactgcaaatgaggctatagctgcaattttctccacagaggaccctaaacctgctgtcgcaaccgaaagtcttggcaagcgcatacagggctttggaaatactaattacgagccatctagagatgacaagaagtctttccttagtgaactaaccgaggtagtgggtattggaagtgcatccatcaagcagggtttgagcaactttgctgcagcgcatgcaatgatgacaaatgacaatggtagcacgtacaagagccctaatctccgtagatctttgaccacaggatctgaaagatatggtcggtatgatccaagtgaaattcaaagtgagagccgtgcctcatctggtgcttcaaagaatgcagcctctggttcttggggtccaacttccagttctgtaccaactgatgatactagctcaagtcaaccagggattaaaactcgtgaagaaagacttctggagacaatagttactgcaagtggcgtgagactgcaaccaacgcgagatgctttgcaaatttttttaacagaagcttccaaattggatgcagttgccttgagccgtgcacttgagaacaagctgaattctccattatggcaggttcgcatgaaggctatttgtgtgttggaagccattgtaaggaa

SEQ ID NO: 25097 - DNA, 768 bp, Sorghum bicolor
  Clone ID: 30946791
agccttcggttcaactttcccactctcaatctcccttcgctgaatgaaaacccactcaccttcccaccgaggaagaccctcctcgctctagcttcgtggattgtaaccacactagccaaagtgtttctgcacataatccaatccggggcatggctgagtgtaatgttcctagcactggtggagaaggactctactacaacctttgtgtggagactccgagctccactacccaagcatctaatcttcaacatcatactgatgctcctcaatcaaccaacggtaaatgtgaatcggctctggcgccagccgttaaggcgccacaggcgcgatgacttccttcctttcctggaactgtcgtggttcaggcgggagcctaggcagttctaaaataagtcatctcgccaaactcatctcttctaccaatgcgtagatgtcttggaaatgcaggaaatacatgacatagtgaagaacatgagaaataatgctgctcccggaccggatggcctaaacgctgctttctacaaagctacttgggcctggacagatctgcttctatcgatttctgatgaacaggctactagagaaattactatcttccaactgttccctctgaggaaagcgacgttctacgttggaaacctgccagaaaaggtaattgcacagctaaagaagcctttcaccttctaccaatgcgtagatgtcttggaaatgcaggaaatacatgacatagtgaagaacatgagaaataatgctgctcccggaccggat

SEQ ID NO: 25098 - DNA, 709 bp, Sorghum bicolor
  Clone ID: 30946793
caccaccatgacaacacattacaaattctccatgtagatgtctctatgtaattggtgacagctgggacaaaaaataatgccatcccaaccacattgcttgcaaggtacaatgcgacaaccaccatatattttgacaagcagaacattcccaaaaaggctttagaccgtttagttgaacaagccttataattttgagaattggcataaaatataggaagaataatcgcccatgccaccgcaagagaaagttttatagtaaatcttagtatctgatcaactctcattgttcccttggttctccatgagaaagcaatgtcaaggatgactgcaagaaaaagtacgtacatcaaccattaatgaagatgatgaaaaaaggaattaggtatttcagtttactaagcactagataacataataactgataatatatacacacaatacaagactcatgacaaccttgaataactcgaagtactgcattggtgatgaaaatactcagaatatcctcaaaaattattggatcaagtaactgagtagggcttcctaatccatgccatgccattattatcagaacctggaaataaaatgaataaggaaatgtgccaaaaggtctgacagaattatgaaagtaatcctaaatgcatcgacccattcattaaagacagaaagtaaacctgaagcccaagaacaaggagtgtccacatcctat

SEQ ID NO: 25099 - DNA, 640 bp, Sorghum bicolor
  Clone ID: 30946811
aggcggcggcagcgacactcgcactttcggggccggggtagttggtagtaccaacggaggggaggtagggcggcctacctcgtcctattggtcggtcggcctctgggtgcatttcccgctcgcttagcggtgcccgtcaggccatggaacgggaggacgccgacggcgctctcgattcgtgggcccaattctgctctctctccaacgagcttctcgccggcgacggtgatctcaccgtcggcccacgcctagctcccgtcgttgccgacctctgcacacgcggcctcgccacgctcgtccgtgactacttcctctactccctcgaggaaacatttcgaaacaacgcagtcaagaagttctggcagcactttcatccttattgcagtgcctcggccgtagacagaattaagttctgtgttaaggaaaattggcctgaggaaatcttaagtaaagcactggaggacatatgcttggaaaagggttaccaggaaaaatgtgttcttgttcttgtccaagcttttcaatcatatgaggatagggcgccgcaaaaaaaattcaaagcagtggactgtatttccagcttaatggctagtctaaggtttatgaactagctggtgatgattatagagttcctgtcctt

SEQ ID NO: 25100 - DNA, 680 bp, Sorghum bicolor
  Clone ID: 30946815
agccagatccggagttctgcagtccgcaccgctctctctcactcgtcgacgccaaaaatcccaaatccgctgcgaaaacctcagcgatggcggcatcgccgtatttcctcctcctcctcctcttcctcttccatccattagctgcactcgcccccctcgctccttcgccttcgccttcgccttcgcagccatcgccgccgcgttctcagccaccgccgccgcgggtgcctcagcaagtgcaggtgtggcccaaaccggtgtccatctcgtggccgctgccggtatacgcgccgctctccccgtcgttcagcatccgcgcctcgccgtcgcacccgtcgctccgtcacgccatcgcgtactacacccgcctcatccgcaccgagcggcacgcgccgattatgccccccgtcaactacacaatcgccggcgtccccatccgcctgctcgcgctctccgtctccgaccccgacaccaagctcggccccggcgttgacgagtcctacacgctctccgtgccacccaattccagctccgctgacatctccgccgccacgccctggggcgtcatccgcggtctcgagaccttctcccggctcgcctggagcagcagcgccgccgccgcgggcgggcagccgatcgtccccagcgacctcgaaatctccgaccaccccctcttcacc

SEQ ID NO: 25101 - DNA, 566 bp, Sorghum bicolor
  Clone ID: 30946835
ggaccattagtgaggatgggcgtgaggaatgataggttgatccacagctgctatggaatgaaggggtgttctgggtccccactaatccacaaagggtcatcccttggagttttctttgcgtcaaggaagcaaattcacatggcgattccttcaaggacgatcaaggaagcagtgaggatatggttggcgggcaaagctccgattggagaagatgattccctgaacacgatgctaaagagattgtagctgggtgttatcttatgatagaacatagaaggctgggcaacgctgatggataaagctgttgttttattagattggcctgtgctgttatatttagttgcaaactgcaattagtctttacaatcatgggaagctcttaaacctttgatttaggatccgtagatttaaatctttgcacgctagtatcaagtaagtatccataacagtgcatgtggaggattcttgtatttttacttgctgcacctgcacttgattggaacatataagttgggagctcaatgtcttccttttcctactctgttctaatagatgtaataattcgt

SEQ ID NO: 25102 - DNA, 600 bp, Sorghum bicolor
  Clone ID: 30946841
ccggcttgctcgcctaggcgcccattctgcaaggcgatgggggggcgcctggacgcctaggcgacgccttgagaactatgatgtggagagaaatggagtcctcaacacaaatgtccctcaatagtttcactaaatgccatagaagatttctagaaatgcttctctaattctaatgagctcactagtctcacaccagagattgaatccaactctgatgatgaactcatggttgtctctattcaagctgttaatggcacagaaggtgctaaaactataaggctgagaggtcacctaggtggacaagaggtatttatgcttgttgactctagaagtactcacagtttcatcactgagtttgtggcacagaagacccatccttggacagaattagcagttcttgtacaagttcaagtggcaaatggtgaaaaacttgtttgtactcatgagttgccaaattaaatttggggtatacaagggaactctttccttagaaccttcaaaattttgcctctgggaagctatgatatcattctgggcatggactggctgagttctgttagtcctatggaaattcattggactcaaaggtggcttaagttt

SEQ ID NO: 25103 - DNA, 403 bp, Sorghum bicolor
  Clone ID: 30946879
acgcgaactggagcgcgatgtgacacgactgtggtaccgcaactgtggccgcgatgatcgcttggtgagtgatcacggtcgtgaactgcgcattccttttttggacgagcacgtgatgagctacttgccctccctgcccgtgaaggcccgcatgaatatgagcgaggggccaggtgtgggggacaagaagctgctgcgacaattggcactctcactgggcctgcaccatgctgcacagctggccaagcgagcgatacagtttggctccaatattgctcggttgaataaagagcaaaagggaggcaataagagacccatcaagggggatgataaaatccagtaaacatgtaaataagttgtagtgtatttaactgcactgtgtaatttaaagtcaaagttcccc

SEQ ID NO: 25104 - DNA, 687 bp, Sorghum bicolor
  Clone ID: 30946885
atagatggtgtaaccattttagacgacaaagacactgaggattgccatgtattcatagcgcgaatcagtggcgaatgtggcataatcgacatgactgtatcacgcctgaactttgcagttgaggcaaccatagaggttctcatatctgaagtgtatagcaatttctatttgtgtgtcggttgttttaccagtgggttgcgtgaagaaacccagctctttgatggtgtcattggcaagccacagaacttgaagagatctgtggttgctgtaaggattgatactaatttggatttgaagttgaaggtaggctcagagtcattcatatctgctgagcatctctgttccttcatagcgaatgaatatgggtatgttagtcaagagataaagactggtcctgcattgttttcagtaaaagtgacttggtcgactatgccgccctcggtagatgctgttatgaggaaagttgaccactcagcttcaggttaagatcatcaaaatgtcgcctctgttatgagaggccaatagagattagcaatgtagagttgtaaggttgtggcagctaaggcaaacattaagttttaggtgtggcgactttgggttgtaataatatgactattgtgagtgtaactgtctactgtttacttacatgttcggttcaaaggctgtggctggtgcatgcagttattc

SEQ ID NO: 25105 - DNA, 663 bp, Sorghum bicolor
  Clone ID: 30946887
ggaagatgttaaaagatgcagttcaaagcaagtccaacattgatgttgtaaaacttcacaaatcagagggtgttgtcctcagaaatacaaaatatcggcaaaaaacgagaagcttccgaatcagggaatatttttatgggattgcaaatgatcttgcaccgcactcaaacattgtcaatttcagtcatgtctcggtgtacaaaatcggtggtggccatcaagctccccgttcagcattacctatcggtgcagagcctgtggcagatcctactcgacttgttgctgtcaacatcagcacggatatgatccatacagtgcttgccatttcctatgctaaggaacctgatgaaataatttctagcaatattgccggattcattcatgttactgatgttgacatccaaaggaagaagctgacgtacattgccccttgcccgggggacttaccaagcaggctgttgatcgcgagttcactgacatggtacgaagcctgatcaatcgaagttagatgtgcactgacatgcccatttgcatgttgtaaagccaggacatgtgacgctggaactgaactgagcgttcgatgtcccactgctaaccaagagaaacgatgcaaggccaaacatcctgttcacgcttatgatttcatgtgttctgatttcttct

SEQ ID NO: 25106 - DNA, 567 bp, Sorghum bicolor
  Clone ID: 30946901
catgctggtgaagtcacttttttacagcaataataatactatcaacccctcgcagcgcatacctccttggatggctctactgccaaaaatgaacaaaaatatgtgtctttgcagctaatagatgaaggaatctcacgcactcacagctgcgcactagtcatcaagcaatacaatttgcagagcctggctgggaagcacggcaagatgtttgcgcagcttgtcctcggatggggtctgtagcgtaacactgtggtgatccccatgacctccaaggcatagtaatacattagcacaccactcaaccttcactcattgggacatgtttggtttcaagtgggaacaattgccaagttggccggtgtagatgattatagcttctactgtcaaggtgcgacaagaagtttgcagggcggaacaggagaaaccatgcagaaccagaggacccaacgcatgagcagagtggctgaacgacacatacgtctttgcagctcgagatcatgggtgtctctgcatcggtttgttaaactcggatttagataatttcctggttcagttggactcttagag

SEQ ID NO: 25107 - DNA, 573 bp, Sorghum bicolor
  Clone ID: 30946929
cctccacgccctcacggatggggccaacacagttcgtatcgctctggaattgccttgggcaatggcggggaattttcgacagatacgatagggaccggagtgggaaaattgactcccgtgagttgaccgaagctcttcgtagccttggatatgctgttccaccttctgtcatcgagcttcttatagcgaattacaacaatggtgtgcctagcaatggcgccctagattttgacaactttgtggaatgtgggatgattgtcaagggtttaactgagaaattcaaggagaaggacacccgctacaccggctcggccactcttacatacgatggattcttgtccatggtcatccccttcatcgtcccttagcttgtgctgtagttttgtaacttcatagtcatcagtcatgattctagtaggagtgttttcccctagtttgtgcaaatggattttcttctttgttttttattttggagagtggtggtggggctgttaactagtgagtcttgttgttcagtgctccctttatcttgcaaattgacttgttggtaacgcataccttgttcgtttttac

SEQ ID NO: 25108 - DNA, 609 bp, Sorghum bicolor
  Clone ID: 30946975
aaccgagtgttttcttcccctcttcctcgtcgttgctcctctcgctcgcgcggttcgtcttcaactagtctcggctcacaaaaaactccacgccgcttcttccatggcgacgcgtgcgccccgtgcagtagttgcatgaggttggcatgaccaacaacacggagaagaaaatcgatcgcgccaacattcatatatactccatcacatcgcatgagcagcatcttctgcttctgaattcctcctccattcctgcaccagcagagaatttttttttgttttctgttgctcggcatccgtcccacccaccaggccaccaccaaccagcccacgacaggccagcgcaagaacgacgaagcaagtcgccagccgccacgccacgccacctcccccgctcccgtaccatggccgactacaaccgctacggccacagctacagctacggcggcggcggtgggtacggccaagggccaccgccgtcagccccgccggcgccgcacatgcccaccaccaccaccaccacctccgccgccccgccctcctcctcttcctccttctcctacggcgggtacccgcccccgcccgcggccgcctaccctccgccgcccgcgc

SEQ ID NO: 25109 - DNA, 554 bp, Sorghum bicolor
  Clone ID: 30946981
aaagacgaaggaagcgcagcgggagcgccagacagacgagccgagcaccaccgccactagaaaaggcagcccaaaaccctagctcccgcgcgccaccgcgcagatccgggctcccgcgcgatggcggaggcggaagtggcggggtcgttgtcgaggcggcggatggagggcgaggagggggcggcggcgatggaggcggatgcggggcacagggggaggggcgaggcggaggaggcggaggatgaggaggtcgagagcagcgactacacgtcggaggacgagggcaccgaggactaccgccgtggcggataccactccgtccgcgtcggagactccttcaagcagggcacctacgttgtgcagtccaagctcggatggggccacttctccaccgtctggcttgcctgggacacagcccactccagatatgtggcgctgaaggtgcagaagagcgctcaacactacacagaagcagccatggatgagatcaagatcttgaagcagattgctgatggtgatcctgacgactcaaaatgtgttgttaagcttcttga

SEQ ID NO: 25110 - DNA, 614 bp, Sorghum bicolor
  Clone ID: 30946983
aattagcactgaaatttagaggattggtgaggaaatgtgtgagcttaattgagtatagtatcaaccatgttgagtctaatttagagagatccttgtgtatctttttttaatgtgtgaatgattgcataaattgttattattcaggtttacaatacaatgtttgatcctcattcaggtcattattttgctcatcaaagtagtgcagctgatgttaaaaggagaattcatgtcttccttttcttaaattattaagtcagcggacttccatctacaattttggattgtcggccttcatctactgatctgttgtcaaatttatatggacatatgctgaccagctgcttaaaaaacacaaaccaattcttcaaaaaactgaagttataaacattttcggattaaggtgccattagatgcctacattctacttttccatttataatttcatatgtccaacttaggcatttggatatgacctgcttggtcatcaaaactttttcataataaatttgttcatactttggaatttctttgtctatattgttagtgtactagcaagaaatagtactaaactgcagggtttatacttcagtgtagtcatcaagttctttagaatg

SEQ ID NO: 25111 - DNA, 671 bp, Sorghum bicolor
  Clone ID: 30947036
gtcgtcctcccctcacgccgcgcattcgacttggcgggttcggtcggaggcggcgcgggagcggcggcgaagcctaaggcgaaggcgggggaccgtggtctccttcactggagacggcgctgatctgctacctcttcgtccccgacgtgacctgctacctcttcgtcctcgagcagatctgcttcgtcttcttcctgtacgcgttctccagcgaccccagcgagcggagctacttcctcttcttccccaggtcgatctacttcttcgccgctgagtctgtcagtagcatgaggaaggtgagatcagtccgaaggcgttttgaggctgcagcacaaaaggctttatctgatcactgtttttcgactgcaagtatcctggctggagtgaacaatgatccttcgtcaaagtggtttgttggttcaggtttcatcgttcagcttaaatcgagagagtgcaaagtcatgacatgtctccatgtggtccaagattttatcccaggtcctatgcagcaccttgtaggcctgcatggtattcctctttgggttcgattgtatggagctaaagcagattcgaaggtcactgaaatcaaacaggatgaagctcgggatctagcagttctgaccctgaagttacctcctgatcattcatctgctaaagcattggagttttct

SEQ ID NO: 25112 - DNA, 641 bp, Sorghum bicolor
  Clone ID: 30947040
agactctgaaccatgcccggtgagcgacggcgacggcgagtgcggcggttccggtgtctcgagactctgttccatttatcaaacctatattcgtgattgatacggcggcgccatcctagcaccgctaccaacacagactccatccagcagccaccaccaccagcacctcactcgccagcaatttgtgatgactcaagaggagcagttcgggcagatcctcactctcctgagccagaattccaagaggatcactgatctccaggacaccataacggagatgaaggtggcaaaggctgacctcgatgcttggaagccagaggtcaaccaccgcatggccgatctggagaacgctgtcaaccgactcaacgaccgtgtcaaactcctcatcaacgggaacaattccttcaagatgaaggaggtgctggagccttccacgtccatccctaggacaagtgagaaggcggaggagctggattgcgctcatctgggatcgaccccaaccggggcggcttctgggccatgtggccacagcgacgacaacccccaccagagtgctggatttggaatggtgtatgccactctgaacccgcctccggtcacaggtgcgtagaacaatccccaattcacttgggattctatag

SEQ ID NO: 25113 - DNA, 451 bp, Sorghum bicolor
  unsure (1)..(451): unsure at all n locations
  Clone ID: 30947056
aaaaaaaaaaaaaaaaaaaaaaaaaaaaaggggaaggtgggaggggcntggatggccgggccggcatgcgccgggcggtgtncnccaccgccaccgccattcccaccatggnggagaggaagcgggagaaatagcatgcccttgccttgagctggcatagcataggtgaatccgggcaagggcgagggcgagggcgagggcgaaggcgagggcagaggatagagggggctggacggaggctccccaattctccctccaccctagctcctccctctcccttcccttcccttccagctccaggagccacggcggcatcgaggggaatgtttcaaaatcccgtcgaatcctcaagggcgtagcgtaactgctgctgctgcttcttgttcttgttcccagcggatcgaggagtgcgggcctcctccaaatctgaaacagggaccggaggggggca

SEQ ID NO: 25114 - DNA, 695 bp, Sorghum bicolor
  Clone ID: 30947079
aaacaccaacacgagcaacaacacactcgtgcgattataatagcgaactccgacgcatatatatgtgcgggataggtgctttaatacgggccatcaacgccgcggaatgcaagataccgcgcgatgagtggctcaccatgttgcgtcgtcgaggaccagacagttgtcaagagttgcacctcaccgcggaacacgccacgctcgatctgttcggcagcgtgctctccatgcgcggtgcattgactgcgcaaccaatcagcgatcagcacggtaattgcctaatttggaacggtgaactgttcggactgcgcgaggagaacagcgcggaggtccagtcgacactagatgtgagtgaccctcacgtgaccacccgcaacaggaattgttccgcttgctgtccgatgcagtgcggcgtcgagtgcgcgtgccagtagtgcgatgctgatcacgtgatgcgcgtactggcacgcattgaaggcccctatgcactcatctactatcatcgggcctcgcagcggatctactttgcgcgcgatccactcggacgacgcagtctgctgctgagtgcgggggacatccaccagggcactgatcacgtgcctgaaacgaccgaagatggcgagggagatattccgcctcccttgatcgatcgactggccaacaccgcactaaatatggtcatgctgtcatctgtc

SEQ ID NO: 25115 - DNA, 660 bp, Sorghum bicolor
  Clone ID: 30947089
aaaagtaaaaccagcgattggccccaacctcgccgccgctgtcgtcaaaaggaaaaacctcgccgccgctgcgtgctccgctcagctcggaaggaaccacaaactagagtgaggtgcgaggtaacaccagatgcagttttctcgcctcttgggacgccctgatgtctccaccgctctgcaccacctctcccgtcactcgcgggctctcatctgcttcatggcctctgcacctccaccgctcgcgcgacgagtttccccacccatggcgactcccaatccacctgtccgtcgtcttccccgatgtccacatggatatcagaacatgcccatcagcactagagtaaaaggcgacaggttggataaaccaatacaaggcgacagggcagcacagagacctcgtcaccctgtataccctctaaggggtcttccaaggagtaggcaccgagatggttccatatacaggggcacagagagatggaaggaaagattccatttatcagaccgtcgtgagactcggttggagccaatgagtttatcagatccttcacgtaccataatccatggacctcgtacaatgttgcaaattttctcaatagaattggctaaaattcatgttgagggcttggtagagttgtatggatatatagcagtgagggatgc

SEQ ID NO: 25116 - DNA, 536 bp, Sorghum bicolor
  Clone ID: 30947101
ccccttcacctgttgagatagggtttcgcgacgcggctgcgtccagcgtcgccgtgaggatggcgcggctgcacagaggtggcgtggctgcatcgggcggcgcgagaagggatggcgcgactgcgacgaggaggcagcacagctacgtcgggcggcgcggggagggacgacacagctgctaggaggcagggcagcgagattgttgggttcgtgagctcgccaaggaggacgtcctccactacatctcggcctgaggcggccacgagttctcgcgagctcgccgacaacgaggttctccactacaccatcccatcagtaccagtgtaccaccatcgcgcctccgttatcaattgccgccatcgcccttcgccgaggtcaccgtgcctttactactatgactactaaggctcctcatccccctggctcatgcgcaggtcaggaactacatcaagttccgtttttgcacttaatctgtttcactttattgaatatatgaatgctaatgtctcatgctcaccacctgtttgtgaaaatgc

SEQ ID NO: 25117 - DNA, 595 bp, Sorghum bicolor
  Clone ID: 30947107
tttctgtatctatacatgctgtagagaccgttccctagtctttctttcatttaactgaagtaacatggtccctcttttttctgcatctatatactgtagagacctagctccatattctttgtgttcgttaaacgtaatatgaagctttatatttcaatatctacatggtgtggagctttgtgttaatttcagtgcatccttgacttaatgcaatgtggttttgttctcgttagtttgagttcttccgttgcttggcttatgttattacaccatttcttggtatgtttattctagcgccaatgagtctttgacctttgtactgtgctgtaatttatgttgcatactagttatgatcgtaaatcattcaggaactgccggtcatgtggaagttgttgtagaagcatgtctgctgtgttctctcaattctattgtcttgcatgttcaattttcatcctcacatgggtactaggctctttagtcttctttttgagtaagctaaaccagggctagattttgccgtatatttgtgtagttgcatcctttgtctcctttctgatagtactaatcacgtatgatttattttgaatacaaacaa

SEQ ID NO: 25118 - DNA, 272 bp, Sorghum bicolor
  Clone ID: 30947142
cgctcctcaatggactactgcccctcagtccactactgagcctcaagctccccccagcatggagtttccttttgcagtcaccactccctcagtgattttgactcctacacgcaacaacaacaataacaacgacgtgtttgcctcggacagcattcacggcaaaattttgatgagccttgtctcggctctttgcttcatcattttgaggtaaatttttgtatagcagttgatataattaaactagtttaataaattcccattatttataaagt

SEQ ID NO: 25119 - DNA, 682 bp, Sorghum bicolor
  Clone ID: 30947174
gccccagccggagcccgccgccgcaggctgcggctggagtgaccgaccaaccaatcaaccaaccaatgttttttcaggactggacctggacgacattgatcaagagtctaatgctgattgaattcactgatgacgattgacgacgacgacgacggcggcggccacttcacccttgcataggaagctgtttctttgctaatctgctgctgatctcatcaatctagctatagcttagctgcattgcattccacatttccactgttccatccatatccatcaaccaaactactgatgctgagtctccatggatttctgtttcttcttcttcttcttcttgatttcggtagctgctcttgttcttggtgccccctgacttgctagtgctagtgcttgagtgactggtagtgtgtgggaggtgagactgagaatcactcactctcccgctctcatgtcatgtgttgttcctttcatcatgctcctgttgttgttgttgttgttgcggtggtgtttctctagtgatttagtcagtcagccagtgagtgagtactagtgattgatcagcacctgttgctgatgatctgatatgcctgcctgcctgcctgctgtgcatggttgttagtgttacttaatattagcaggtctgtaactgaaagaatctagtaatttatgaccggattaggct

SEQ ID NO: 25120 - DNA, 689 bp, Sorghum bicolor
  Clone ID: 30947183
atcaagtatttaccagtttttttgtaaaagaggttaaacccacattcaaagtcgctataaaccatggtggggaagtaaatggtattagaagtttagaaggtaagatgtctgattttagattcgatgagggaaatcagactacgaccatagctcagatagaatggacttcttctttacttgtactgttgttcgtctttctcgtgggccaacatggcttatcattgtcgtggtctcgtagacaccgtgtcaatcgggcccagcccaatagagagaaaggccaccctgtgaggcccatgtggcacaaggaaaatgttgctaaaaaaatgtggcacaaggaaaatgccacctcggccataggactacaggaagtcaggactcacaatcacaaagcgcccacggattctgcggcaaccttggatggttgggtgcatggttgatgaggatgaggactgcaggaggcaggactcacaaagcgccacgcctgcttgattttgatgcagctctgcgaagtgcaaacaatttcctttgtacaaggtggaaaacgtaaagcatctgtggcagcatttctaggatcagtgtaacattgacattgatacagaatcaagcaatgcattcataccagcaacctattgcttggcaagaaaacaagaattatcattccaaataatcagagatactaaggtatggtg

SEQ ID NO: 25121 - DNA, 738 bp, Sorghum bicolor
  Clone ID: 30947214
ccaacagatcacattcatttgttcactgatccatcaattattccatacaacgtgtcatcatgtcgcctgatctttgtccctatctatgaggtagcacattatgctttatatgcatttgacatggagaaaaaaatggtcaacatcctcgaccctgtcagggatacctccatggcagggaaagacatcgagcataggcacagtacaacaaagattcaagtctccaaagctttacaggaatgtatgaagttagccttcccagattggaatgagcatattcaaaattgggaggccaagtaccccacaaacaccattccagaatgccacaagggggactctgcataccatgttctgaactacatgaggaactgggatggcacacgcttggtcaatagtgttcctaaggaatcactcaacatgcggaaggaatttctgttcaacttgttgtcatttagaagtaatgaggccatacttccagagcatgtggagcgtatcataaaaatggcatcacgtagatgaaagaataccaagctctgtgaaaagaaaagcctaaccaatcccaattcatggagtcactagtttaatttgtttttttccccattttaattatcgcaatgtttcattgtgtttcaagtacttgtgagacatatttttaaaggaacaaatagtcaccagaataaagcaaccaggttgcacattgtgagacatttttcagttccaaagttatatgctctttctatt

SEQ ID NO: 25122 - DNA, 703 bp, Sorghum bicolor
  Clone ID: 30947242
tagcatacacagttctgtacttttggcatgtgttgtggatcactcctctccggcattcacatgcagagtgaaatgtttcaggttttcagcgaaggatcgacaaagctttggactgtgaagaatagataattgctgcaacagatctgaggatcacgaaagcctcgagtaattaattcattccaggatctggatctaggtaacacttagcactgacaatagtagatccttcttctagtagactagattactgacaaagagcaggtgaaaaactatttgcaatcaagtgaatgtttgccgtgttgtatctagaacccgtgattctgggtcccaattccagaacatcctggtgaatctgcagcaggtttacaggaagtcagtcaggaccctggcatgatttgctcactggaaagcattacagtaagctagcagcagtgcatctactgatgcagactaacactgtggagtgtgagaacaagaagcccccacatgcagaaggcgtgatactttctggaggtcatgtgagcagtggctgcaattgtcctgcagcttccactcacacatgtatgactcccaaaccacatgcatgcatgattagtgtagtgtgtggctactgtggctacactagaaataaagggagatttagactgatgccttgtacatctacatatgatggtcaaatggggaatcttatggccagtcagcc

SEQ ID NO: 25123 - DNA, 774 bp, Sorghum bicolor
  Clone ID: 30947248
gttagaggataagtcagaaggaacgacgaggaactttctggaatttttaggaatctgaaatcgattttggatgtacctggattcaatttgcagcaatagaactcgattttggagacatccgtggttcagttttccattccataaaacttatttggagagcgaaacaaggacgtgtgacgactcaagccaaaggcgggctctcctgcgtgggcaaggaaaaccttgctcatccaggtaagattgctaggcagggtaagatgtatgagcactaccaaacacctggccttgccaagcaaggtgaggtgagtgcttgctcagaaaccaagcatgccctttattttagtgctttggttgtcctttgctgccatcttagtgattgacccacttaggcacataagggtgtcgttttgaacattttgtgatgtcttcatcactaatctttgacagttttcttaggttgtaatgtattgttatggaaccaaataaaattatagcattatggaagtggtttttgagtcaaatcttagcatatcattttcaccccttatttataaggatatcaaaaccacatataagttggacacatccctaacttcaattctgctcacaggcgcaggagcttgcttcaacattactttgtttttgatggttcaaatacctgggggttaatgtggcatggacatcaatacgatatatacatctgtttccataatgttgaaatgtaaagtgtcgagagggcgtagttcttggcagcattttatatcaaggattctc

SEQ ID NO: 25124 - DNA, 569 bp, Sorghum bicolor
  Clone ID: 30947287
aaaaaaaaaaaaaaaaacccttttccccctattattaataaaaattcggtcgaaaaaagccttcccttttggtctgcgcgattcgagattccggagcaccgcggcggcggccggatcggggtggcggcgcggttcggtcgccgctggagcggagcggatgcgccgcgccccctgtgagactgtgatcacttctcccaaaaactcctagaagaccttagaggggtttaacattgggatgaatctttgggcccttaccttgcttttaagtggagattcagttttctattttcatttatgatgacgggtgaaaatcaaatgacttcgaagggcacagagtcttcatcttcttctgttcctcctgatggagtagtcagcagggaacctcaaaaaggggggagattacccaatgggaggacaactggtccagcacgtcgctcatccaagggaaattggactccagaagaggatgacatacttcgcgaagctgttgaaacttacaagggaaaaaattggaaaaagatagctgaatcttttccaggtaggactgatgttcaatgtttgcataggtg

SEQ ID NO: 25125 - DNA, 666 bp, Sorghum bicolor
  Clone ID: 30947317
agtgacgactcggtaatattcaagctcaacagaccgaatcacaggtctctctctactcgaggttgatctgtatgccgattttcccgctgaaccgagccatctaactcatctctttgcgtctcgtttatctgctcgaaatgttttctccgtgcgatttctttttttttttcgtttgattatttttttttccattggagcgtgggatggactgttgcgatgaggatactaagctccctcttctgaaagcactgaggacactcgctggcagaatcgaaccaataacctattgccaccactgagtaactacagatcccctccaatctttttttttgctgttgtttttcctgctcagtaatttgattttggatagtgaagatcaactgatgcataatccaacacttgatccgaggacggcttctgccgagcgagtgatgcacatacatctctgcatctgaatccttaacatcttgctgtaatggttttcattttttttgtgttgttgaactgtatctgtctttttctttgtatcagatgatgaaaccacgaaacaatcttaggacaccttctgacacagtgctgttagctctgtgagtgagaaggcaattcttttctgatgatactgcaattactctttgatttagcctttttattttcgtttttttatcg

SEQ ID NO: 25126 - DNA, 560 bp, Sorghum bicolor
  Clone ID: 30947342
caaagacaaaaataatcccagaaataaaattcgccgtggagacgagtcgccgccggcagcgccggcccggccttcttctccggcgacggcgtagcccttacgggggggattccgcatccaaatcgatcccaccggagcccccaccgccccccacgggccgagccgcgccgcggcgcgcgcgcgcgggcaggccgagatgcggaagaggatggagagcgtcgacgatctgatcgaggaggccaagctgcgcaccgtctggtgggcgctctgcatcttcgccatctcctacatactcacacagtccagtcctggcttggaccttgtggaaccatcgaaatgcttgtgtgtttgacagagattcaccaagtgtctcaacctctataagaaacttgcagctggagggtcatctctgtgttctggctggggcaagaaacctccagaacctagaactcgggcatctcggattatagatacaagtaaatcaatgtggacaaatgtgcccatgtcaatccttatacttgcatttctccgctatctctcattcaaagtggagttccgtt

SEQ ID NO: 25127 - DNA, 752 bp, Sorghum bicolor
  Clone ID: 30947374
acagctctgacacaccacacaaggccactgcccccctctctctctctctctctgaaacaagcttggattcctgacagtgcaagcaaagcaaagcaagcagcagaagcttggaggagtatttctgctgcatccatcccctcacacagcaccacatgtgagaggcatacagcaagctctcccccccattggccatgcatatctagctcatagcctatactgcctctaaaccttgacatttcccctgtattttccttaccactttgcagtagtagtttgtagtaggccgcaaccacaagaaggtggtttccttccagcaatggcggccatcaaggtttgacaaggcatgagcttgctccctccttgccgtcctgattaagcccctcgctgcaaccacaacaaggtttgtttactccctattctattcatttctgtttgtttcttttgctgttccatctcttcttcagccttcacctttgtgttttttgtccctcccctcttgtttctacgctgttcttctcacaacaaaagcaaagaatgtttaacatactagagcaggagtagaggtcaaaggctggtccatgcctacacaggggaaagcaataccacacacaccaaccaagtagccaagccaagtaggaggagtgatgtgaatgcaaagcctttgcacagagcagccactgtatctgtagtattatccatcctcctctaccattctactagtcctactactgctgatcttcttctgcatgggc

SEQ ID NO: 25128 - DNA, 704 bp, Sorghum bicolor
  Clone ID: 30947380
gctcgtagtcgtagggcagtgctcccatgctgcatgcatatatatgctccccacctttccgccgccgcgccgcttgtcgtcagcgtcggcggcgcggcgccactcgccgccgcttggagcgatactagagcggcggtttcgggtccaggtggatgcatgcgtgcaggaaagcgcgcgtacgtgccgacagagaacagagagaaagagggtacccacgctgtgtatctagcgctcgtacgcgccgccgtcacgtactatgtctgtgctgggatatgctactagagtcagagaaccaagtcaagaggggagcccaagtcaagttaacagggcgtggactacttactaaccgcgaggcccaagacaattgtgagactcacgtcaaccgatcctgagtcctgacggcgccgaactcccctcaacctcaaggctgccacctcctctccctcatcaagaacaacaggaattcttgaattttggagaattgtggtcatgctaaaatgaggttattcgacatcctcataggcttcgactccctagcttgtaaagaggtcgaaggtctgattcttccctactaggtaaacaattgactgcataaacatcttgttggtgttttcttttgtcatttttagagttgatactactaagagatcatcattaatgtatattctctaagctcttgaaatcccccaaaaatatagacttta

SEQ ID NO: 25129 - DNA, 480 bp, Sorghum bicolor
  Clone ID: 30947401
ggaccgaccggacggtggctgctcgcgccatctctgtcagctccggtggctcgccggcgcaaattaaccctatccccgtggcatcctcgcgtgggactgtaagtcttgaggcctccggcctcccgctcctccgcctagtcgcttgcttcgccacaacacttgcttaattagggcggtgttcgaggggtgggtgcagagtactactctcactgcctcgagggcttgactggtggaggcgggagcagggagtagctgcggaggcgcggggatccgggcgggcggcgggcatggggaacgcgagcgccaaggagggggagaacggccacatggcggcgtcgccggagctggcggcggctcacaacggcggcggaggcagcagctcgacgggaggccccgccgcgcggcccccgccgccgccgctctcgccgccagacgctgtgatgctggagcgtccaccgcccgtgccctatctcttcgcgc

SEQ ID NO: 25130 - DNA, 703 bp, Sorghum bicolor
  Clone ID: 30947407
taactagcgtggaacctgaacgagctgcaggccttccgctcttccgtattcccccacgccgctgagttccgtgctggagttccgtcttcccccacgccgctgagctccgattcatccatggagcgcaagctctaccccgacgagcacgatttggtcgccacagccaacatcctccctgcggaccagttccccatctcgccccaccgctcgacatccactatcgtcccaattcggccagccccaaatcggagtccaagctccaccccgacgagcctgaagcgttcgccggagccaagatcttcccccgccgagcagttccccaactcgccccaccgctcaagatctgctatcgtctttggcgccggcttatacgcggctgcgagagtgcgggtggcgtgatgtcgacccgccgctcaggatcgacggcgtctacatcgtcctcggcaccggctgaatggatcccctgtttttcggcgaactctggctgtttgttcaggagcccttatctgcactctccctcacgacgctgctcctagttctccaagaaattatgttgcatcgcccttgatggccaaaacaccatcaactgtgaatggatcaggtggttcaacctccaacagatcagcattcaccaaagcattgcaacacgttcgccggaaacatgggatcaaccttgcacagaacacaacaatcaatgctagtt

SEQ ID NO: 25131 - DNA, 726 bp, Sorghum bicolor
  Clone ID: 30947427
aagtccttgagcatgacaatcgactgtaaacccggcctcagtgcgtggtcagcagtagttatcaactcagtgaaccagtcggtcatagttgggctgattttccagtttgctggcagcagagacggcactaacaaaacagatgttggcaaaaatactcgttaggccacgttgcaagcgcgcggcagtccatattctgtccttcagcatcagccatacaaaaaacatgcgttttgttggagccttgggttttcacgtctcggctgcaaccaaattggggtgtttggtttctccaacttttttttaatgcctttcacatttggtagttagacacatgcataaatatagactcttatgaaacttaatatatagatctatactttattaataaagaggtaaaattttaggctttttttttttttgtccatctattctttttgtctcctctatctatatactgttgataaggaaaccaggataaagttgtttatttgtagagagtccaattaggagattgtcgctgcatgcagagtccatataaaaaggaaatatggagggaagcagaaaactaggacagagttgttaaccgatagcaagctaaatagaagatcatcgctgcatgccagagtgcatataaaaacgaaaatacagaggcaagcaagtgtatgtcagcttcgtagggattcaactcttaactttttttagttattagtaaataaatattttgac

SEQ ID NO: 25132 - DNA, 685 bp, Sorghum bicolor
  Clone ID: 30947447
catccgagatgtgcactacaatgggtacgacataccacgggggtggaaaatcctgccggttttagcggcagtgcatctggattcgtcgttgtacgaggaccccaaccggttcaacccttggagatggaagagcaacgcgccgagcagtttcatgccgtacggcggcgggccgcggctgtgcgccgggtcggagctggccaagctggagatcgccatcttcctgcaccacctggtgctcaacttccggtgggagctggcggaggcggaccaggccttcgtctaccccttcgtcgacttccccaagggcctgccgatcagggtccagcggatcgccgacgaccaagggcatcgcagcgttttgaccgagagcacaatgtagcggtgtacgggtacggaggcagtacaaattttcgttgcattttgggggtggctggtgtaatgtagattgtgatatataatatactgatgaaacaagatagaaggatgtatagacagagagcaaagaggatgctggtccaaaaagtgtttgggtaggtaaaatgtgtactcagtagggttgtaataaggccggcccatggcccatggcaagtaataatagagatatagactagtggatgtccaacatgttcttttttttttttttgaacatatgttccttttttttgtcttaaggataattgctctc

SEQ ID NO: 25133 - DNA, 636 bp, Sorghum bicolor
  Clone ID: 30947491
gatagaaagagaggcccaaagggcattagatttattgctggagagtgagaagaccacgaaagcacctgaggttcaaaggatgagcgatgagatcactgttacaagagatcatgacgaggagcagcaggaagcactgaggcgtgcaatcacgctaggggttgctgatgtaaaaatgccatctgcatatggtacgttcgatgaaaatcctacttctgaagcagaagaggccccactgctatcagacagcggaaggcgcagggcagtatgggaggagtggatcgcaaggatatttgagaaggatgaatcagggcaaatggttccacggagatgatcatggcaacagctcaagacatgcttgatgggtcggttttgttgatgctgttttccactctgtttcaaggcctattttgaaactttgaaacggtgatggaaggggagtaggagttagggattagagcaggtatttaggggtgaagtagtgtgtagcaatgaataatttgccctctggctaataaaaaggtggctgcctattgtacttccacatcattaatgtggtagtcttaacaaatgtggatgtgcagagctgtaacttgtatatatatcattggataagatagtgtagaatcttgggcatac

SEQ ID NO: 25134 - DNA, 113 bp, Sorghum bicolor
  Clone ID: 30947493
gtagtaggcactgatgaaaggacaagaaatccgctcaaagcatagtatcttccatattggtcaaggatgatttccagtagcaaggaaaaggaaatggcagtcgtggcatatta

SEQ ID NO: 25135 - DNA, 767 bp, Sorghum bicolor
  Clone ID: 30947546
taaggggaaagcatgtgatcgaccaagcttgcatgctgcgcagtcatggaccaacgcagcacagccacatgatttactgacttgcattcaccccataaggtacgattgtactcagtacgaagttgctgacagtagtggacagcgggcagctggacttggacaccatgccatgtgcttctgcagctcgctcctcctgtgtgcttctgcagctcgctctattatcgtgtgtttggttggagagcgggcgagccgggtcggagcgaacccattcccgtggctgtttggttggagtatgggagggttgggttgtctttagagtgaaatattcctctcagatgcgggttggactacgtccatcaaaatctggcggacggagccgctccagcagggttgatgttcaccaaacactgaattccttcaaccaaacaccgaacggagccgctccgtctccaatccttcaaccaaacactgaaacgggttgggtctgtctccaaaatcgaagtgcaaccaaacactcttttgggttggatccaactcaactcacccaaccgccaaccaaacacacggttaaggtacgattgtatgaagttgctgacagtggacagggaaagctggactggacaccatgccatgtgctagtgcagctcgctctccaggcctgccacactgcccggtgtctcctgtgtgctctgctcgccaagcttcagtagctcactggtcactagtaaactgtaatctagtgaaattgtaaaagatattttcttaat

SEQ ID NO: 25136 - DNA, 759 bp, Sorghum bicolor
  Clone ID: 30947562
gttgcataaacaaatatgttacctggtcaggcaggatgtgctgttggatcttggaatagctgcattgatattgaacattgaagatggttgttctgcttgcagtttgacttcttttagatagttgtaatttcattttactaaaaactaaatggatttaagtgggtgaggtttgcctatgcttgaggaatcttttactgctcctaaagaggaaggttgttccttaaatgaaatgatccatgaaacttcataaatgaataagaagtttgaactcttttaataaaaatgaacatctgtttggttttatagttgaacaagaacatatctgatgtcgcagctctaatatcttttcagagtgagtatgtgcgggagcaacggagtgagtgatatgatttatggagattttttgtataatttgtaacatcattagtcgttactacgcaagtttcacccggaacagcctagtttggctgtcccagagtttctgatgaatctggtagcctgaacttaggaatatcttccataaattgtttttacagcattgtcggtgtctttgggaaactaaaccatagctggattaaagaatcattcatggcaatcatttgtactgctatagtgtattcttttatgaaactaaaggcttatagcagtaacagtgtttcctattattggagtgtttagtgactttttactgcacgtatcgttctgaaccttacaaattgttaccagtcagctatctaaatcaatacctcagcctttttc

SEQ ID NO: 25137 - DNA, 608 bp, Sorghum bicolor
  Clone ID: 30947570
acagtgcctggtcttggttcaattcctggggcaactcttccaattactaccccgtctattgatttggctccacctagtgaatgcctattgctcaagaatatgtttgatccagctttggagacggatcctgattttgatttggacattagagatgatgttcaggaggaatgttccaagtttggtcaattgaaacatatttttgtagacaaaaatactgctggttttgtgtacctgcggtttgatagtataacagcagctatgagcgcacagaaagcacttcatggaagatggttcgcagggaagatgataacagcaacttttatgacccctcaacagtatgaaatgaagtttccgagctagtggacagatcacagatgcttggttaacatggacatagttgcttgggctcagtactggcatttctacattttagcgttttgagcttgtgtcaactattagtggaggaaaatgcttgggctcagtaccggcatttctacattttagtgttttgatttgagcttgtgtcaactattagtggaggaaaatgtagtggctttctcgtaacattttgtcattaatcggtttgtaacatggtttatgtatcacct

SEQ ID NO: 25138 - DNA, 657 bp, Sorghum bicolor
  Clone ID: 30947578
ggaggaagagaaggtccaggtcccttcttggatctgcttcagctccgtggacggcaagaacctgtgctctggggagagtttcgcagactgccttaagatcctcgacacgagcgataaggtggccgttgtaggggtgaactgcacaccacctcagttcatcgagggcatcatatgcgagttcaagaagcaaaccaagaaggcgattgcagtgtacccgaacagcggcgaagtctgggacgggagagcgaagaggtggctgccggtggagtgcttaggtcacaagagcttcgacgcgctcgcgaagagatggcaggaggctggggccagcctcatcggagggtgctgccggaccacgccttcaactattagggccgtttccaagatcctcaaaggaaagacgggacattgatttattcagaattgagctgttgttgcattatgtcagtagccagaataacattcagaatatgcatcctgctgctctttcttttccctttcaatttgagctcattaaaagcgggtatcaatataattttgcagtgtaaaacgtaatactagtttgcagtgttaactcacagtagtgcttagtcaccgcttcaggtatggattttaacagtcaatgttgtttgggcatgtttaccatattaagtacgtatt

SEQ ID NO: 25139 - DNA, 617 bp, Sorghum bicolor
  Clone ID: 30947579
atccaaaattgctgccgtccgtggcggtgcaggatggcactgccgtcctcgcctgcaagcacaatccatcacccgcctcgcatctcctcctgctgctgctgcccgccgtcgccatgcccgtgccccgtccagattcagactaccagccgcgccactccctccgcagcatatcttcttcctcttcgtgttgccactgcttctcccactgccatcagcacaagaagtccaggtccaggtcgacggcgtctgccgcctctggctgccctcccggacccccaatccgccgcggcgcttctcgtcgtcgccgccgggacagtcggtgccgccagcctcctgctccgctccacctcctcatcatccgccgcctcacaacagcagcagcggcggcaggacgaacaagaagaggtagagggagaggagtgcccggactgcggcgggaccgggctctgcgaccgctgcaaaggagagggcttcgtcttcaagcagctctccgatgagacggccaccaaggcacgcaaggccgccaagaacatggccactagatacaccgccgggctgcccaccaagtggacctactgcaacaagtgctcctccacccgcacctgcacgacctgcgg

SEQ ID NO: 25140 - DNA, 513 bp, Sorghum bicolor
  Clone ID: 30947580
gtcactcgcgagcgagtcgcgccactccactgcaggtctccactctccagccacccatggcgtccgaggccgagccacgggtggtggacgagtgccggggcgtgctgttcgtgtacagcgacggctcggtggtgcggcgcgcgcagcccgggttctcgacgccggtgcgggacgacggcaccgtggagtggaaggacgtgacgttcgacgacgcccacgggctggggctccgcctctaccttccccgggagcgcgccgccggcgggcggaggaggctgccggtgttcttctactaccacggcggcggcttctgcatcgggtcccgcacctggcccaacgtccagaactactgcctccgcctagcttccgacctcggcgcgctcgtggtggcgccggactaccgcctcgcgcccgagcaccggctccccgccgcgctcgacgacgccgcggccgcggtcctgtggctggccgcgcaggcgaaggaaggggacccgtgggtcaccgaggcggccg

SEQ ID NO: 25141 - DNA, 606 bp, Sorghum bicolor
  Clone ID: 30947586
gcgctctctccctcagagcctcacaactcggcgacgactacgccaagtgcccaggtcttctccaggcccggtcgctgctgctctacaccagtttcccgggtcttcttcggagttcggactcgtcttcgccggcgacgagcaccaccagggcagcagacggatggcttcgtcggtgccggcgccatcggggtcggtgatcaccgtggcatcgtcttcttcctcagcagccgcggccgcggtgtgtggcacgggctcgccatgcgctgcgtgcaagttcctgcgccgcaagtgccagccggactgcgtgttcgcaccctacttcccaccggacaacccgcagaagttcgtgcacgtgcaccgtgtcttcggcgccagcaacgtgaccaagctgctgaacgagctccaccctttccagcgcgaggacgccgtgaactcgctcgcctacgaggccgacatgcgcctccgcgaccccgtctacggctgcgttggcgtcatctccatcctccagcacaacctacgccagctccagcaggacctcgcccgcgccaagtacgagctctccaagtaccaggcggcagcggcagcttctgcgtccacggcggcgcc

SEQ ID NO: 25142 - DNA, 733 bp, Sorghum bicolor
  unsure (1)..(733): unsure at all n locations
  Clone ID: 30947588
aaaaatccatgtaggtattgtttcaaaaaaaaagatccatgtaggtaaatcgtatacaaagtacattcttagttttctgactttactcgactaaatatcatcgacaaataatgttagtcaatgtttgaacagtaaacatcaaagttgtcttaagtattttggaatgtaggttataattaagaaaagatgttccttgtatattcatcgaaagtgcaacactgataattcataattacaggattgacataggaggtcccataccatgctgaagtggctgtagtggaagatgtcagtgtcgctaatgatatatgctcgatcttgtattccttttggttgtccgagatttgattgagcctgctgttgattttcttgagtcggccagacaattcatgtcggagaaggatttgggtccagcagccaagcaagtattctttgagccatttaatccagcgttggtaacccatgctttccaggtcaacctgttgttcaccagaaattcatgtagatgttacaaaaacaaagaaagcctgaacagataaaattttcataacaatgttggtaacgaccggctgtaatataagatgtagctaaatcttgcatgccaatatatatgcagctcanaattagcagtatgcgatgagaaatgacccagcatagcaagcaacttaagtctctattttgattctttttttagtgtttttacttttatctgtctagataatctcaactttgt

SEQ ID NO: 25143 - DNA, 610 bp, Sorghum bicolor
  Clone ID: 30947604
atctcactcaaacactctctagtggtagctcacaatggcaggcacaaagctaatatcagtggggctcattgtcctgatgagcataggattagccaatgctgcaagggtggctagatactctagttcttatgggactggcacaggagggggagatggtggtgcacttgggaatgctgggggatcagggtcagggtctggcaccggatctggtgatagcggtccttatggtgcacatgcaagtgctggagggggaggtgcaggtggtggaactagctatgctaacaggttttggtccggatcaagtgatgcaggtgcaagtgctagtggcaatggtggtggcacaggaaatactcaaaatgctggggctggcggtggctcaagtgctggatccggatacggcaatgcctacccctgagttgcatatgagccaatctaaagttggagcccatcgtccttctttgttacacttctgttagaaattaattaataaagggtccaactattctagcaacacagtagcaatcttgtaaggtccagcttataagatgatgttgtaatactctgattctgtaaccttgtgttgtaagaaatggttttgatgttttattcc

SEQ ID NO: 25144 - DNA, 774 bp, Sorghum bicolor
  Clone ID: 30947606
catacttatggttacgattctctttccttaaaatcctgccttttctagtgatttcaacttggaacctggatcatgttactatggaccaacatatcaagttggatttgatgcatctaagattcctgacctgggtagatatcgatgcatagattccttgtttttttggttgggatgcccaagcatactcggatgaattgctcatttagtcattttgttctaaagaatgttttcttttcccataaactcatatttaacaactttcattcttccaacaatactttgggcagccagtcttggcattaatggtcctaaatcctaattgcacgccatggccttgatgaatcttggttgatcaagcaaatggatagacatgctcaattactatgagcgtggttgtactttttggtcatgtgtgaaaacttctcgatgtgtgtgcagttcacatgggaacagctgaacaggctatttcttatcatgtgcaacatagcctacatgtttaggtcatgcctcataagttcggccgcaaaggctaagattagttaggagtcaatactatactttatcagggatataatcactaacctgtgaaacagcacaaggtcaacttatcagaaccgctgctgcttgctgctctcccactgatttgaactacatgagctctcatgaagttgttgccttgcatccttcttaggtaaccatccttctcaggtaaccatcccagatagtcgctcctctcctggtttggtaattgatctgagctgctgagttttgcct

SEQ ID NO: 25145 - DNA, 486 bp, Sorghum bicolor
  Clone ID: 30947608
ttattgtcttcgtggctgttttagctcagaaatcagaactgtgccgccttgattagttttttgtgaaggaatggagtacttaattacaagtggacatgatccttaccatgagcaacgattaaaggaaggtgaggcgacatccaagcaaagacaaaatctgtagaaggaatagcaactgaattttcttttgcagtcgataattgaccatgcataatgtgttgggcctcccaaaacttacaaagtttgcgctgcatgtatgccgagggatgtcctacttgcttcagaaagacattatccaccgaaatataaagcctgccaaccttttgctgagtaatttgtagccagtgggtgtggaaaatatttgttgacacggattatatctgcacgcaagcctgctatgcagagcacaatgacaaggagagagtacacggccgtgggcgagacaagcgcctagatattttgctcagatgtcatgcctgatgaaac

SEQ ID NO: 25146 - DNA, 467 bp, Sorghum bicolor
  Clone ID: 30947614
aacaaatcgctgggtttagccgcggtgcctctgtttctctcttctcgcttattagggtttccggatctgctcggcgtcgccgccgaccaacctccgccgcgcgacgccatggacttcgacgagtacgagtatctggagaagacggtggaagcgtccggagcgccggccaacggttcgtcgggccccgggtcgggggacaaggacaaggagcgcagctcacgccgccgctcatcgggcggtgacgaagagcgtgacgacgtaaagcgcagatcgaagcgttctcgctccgaggaaggccgcgaccgcgatagggagcggcacagggatcgcgaccggcaccgcagcagtcgggagcggcgggaccgtgaccgtgacggcaaggagaaagagcgggacagggagaaggacaaggacatgaggagccgcgaccgtgacctcgaacgggagagggagagggagagggagag

SEQ ID NO: 25147 - DNA, 624 bp, Sorghum bicolor
  Clone ID: 30947622
gatcacgaagcattaggcattagcagcaggtctcccatctcccattgctgcgtgcggcgggccgagtgtcgtagtcgcgcgcgcttgactgaacctgaaccggcgggggatgggggcgctggaggagctcgtggcgaaggcgggcgggtgcgcggtcatcgacggcggcttcgccacgcagctggaggcgctcggcgccgacatcaacgacccgctctggagcgccgcctgcctcatcaccaggccgcacctcgtcaaggaggttcatatgcagtatcttgaagcaggcgccgacatcattatttcatcatcttaccaggcaacgatcccaggtttcctggctagaggaatgtctgttgatgaagccgaagatttactgcgaacaagtgtaaaactggccgttgaagctcgagatgaattctggaagtcagcactgagaaaggccaagcctatatacaaccgtgccctggttgctgcatccgttgggagctatggagcctatcttgccgatggatcagagtacagtggatcatacggagctgacatcacagccgaaaagctgaaggacttccacaggcgccggctgcaggtccttgcaagtgccggtcctgatctgattgcgtt

SEQ ID NO: 25148 - DNA, 641 bp, Sorghum bicolor
  Clone ID: 30947639
ggttcctccccccactcttttgggtttccctcccacacaaacccccaaaagggcaaaaccccatccctctcctccccgatcgcaggccgatcggcggcgatggagcggatcaaaatcaaaatcgattgggaggaggtctttcgcggctcaccgtcccgcgacctcgacgccgaagtctgcttcgcctccccctcgtcggcgccgcgcgcctccggggcgaaggcggcgacgaaggcgcgggcgttgggcgtcgcgagggcgttatcgggcgacgagcggaggcgggggtccccagacagcagcagccaccggaggacgttccggacgcgccgcgacgatgtcggctggtgcgtggccgagcgccgcaccgccgcgaacgtggatgttggggcgcgccgaccagtgacccgcgcggccgccaaggctgctggtggtcgggaacaggatgctcattccacttctaaggatgtgtttgctttcagcctggaagatgagcaggtgggacatgagggcaacaggttcctttcaaggtcacctcccattcagaaaactaaatattgccagttacctttgaatacactgaaaagccaagggcgtgcggggaaaaggaatcctatatcggtggataagatgtactcgag

SEQ ID NO: 25149 - DNA, 366 bp, Sorghum bicolor
  Clone ID: 30947640
atcaggcagagaggcaggctaggcaggaaataaatttgaagaaagctagacctgtgctctgatcagtaggaggggtgtgaggggggaggtcatgggcgccatgatggcctccataaccagggagctcctcttcttcctccccttcatcctgctggccctcctcgccctgtacaccaccaccgtcgccaaatgccacgccacccaccaccagtggcgccggccgaagaagaagcggccgaacctgcccccgggcgccctcggatggcctttcgtcggcgagaccttcggctacctccgcgcccacccggccacctccgtcggccgcttcatggagcagcacgtcgcacggtacggcaagatataccg

SEQ ID NO: 25150 - DNA, 691 bp, Sorghum bicolor
  Clone ID: 30947664
ggcccattccaagccccaccttgcgtacgcgagccaaacgctcctgacaggctccgtctccacctagggttccggcgatggcgcacggcggctacccgcgccgcggcgccgccgtccgccggcccaagtcctcggcctccgcaccagttgccgaccgcaagcggaagcggaccgccgccgccaagaccacctcccttaagaaccagatccgctccactgagcgcttcctccgcaaggaccttcctgatgacattagggttgcccaagagaagaaactagaagaactgaagaggcaacaagagcttcagaatcaactcgctgttcagcgaacattacagttgagagatagaaagataaaattcttcgagaggcggaagattgagaggatgataaggcgccttgagaagcagcaacgttcaaatggtgatggtttcagcaataatctctcaacattgcgagaagatcttgaatatgttaggttcttcccaaagaatgagaaatatgtctcgctgttctctggagggaatagccaagatattgttcaagagaggaataaatggcgtaaacagatcaaggataatctcatggctgcagcagcaaacggaaaagatttagaagagacagcaagtgatgacgataccttggacgtgagtgatgatgacttctttgtgtctgggagttcaagcgatga

SEQ ID NO: 25151 - DNA, 527 bp, Sorghum bicolor
  Clone ID: 30947712
acgcgaagaaaatactacctgcgatgcgagactgggagccgacagccgagcacccagctctgcggggcttgccgccgcgactatctcctgcctcgcctcgcctgcacctctctccctctccccgtgatcccgtctcagcagatgcctcccttcctgcagcttcaacttcagggtgcttatctgatagtcagtaccagtactgcaacagcgatttctgaaggtcgactaatgtgatgtcaatcgcgtgctgcttgccggtcgtggagtgcgtgtactgcctggcttgtgcgcggtgggtgtggcagcgctgcctccactctggagcctacgacagtgagacctggggtgttgcatcggctgaagagtttgagcccgtgccacggttgtgccggatcatcctctcggtctatgaggatgaccttgagaacccccaatgggcgcctccaggtggttatggcatggagccacgttgggtggtgcaccggaggacatatgaagacactcatggtcatgcaccaacttacctt

SEQ ID NO: 25152 - DNA, 654 bp, Sorghum bicolor
  Clone ID: 30947731
aaacccaagtccagacgtatcgaccctgcatccaaatctaggttttcgattcccctccacaggatgtccgaccccgccgccggaggcaccatggtccacgctgccggaggcggcggcgcttgggcgaacggcggcccccgctttggcgacatggtctgggccaaggtgaagtcccacccgtggtggccgggccacatctacagcgtcaacctcaccgacgacgaggaggtacaccgcggctaccgcgacgggctcgtcctcgtcgccttcttcggcgactcgagctacgggtggttcgagcccagcgagctcgtccccttcgaggaccacttcaccgagaaggcggcccagggcggcagctcccgcagcagcttcgccgccgccgtggccgaggccgtcgacgaggtagcccgccgcagcgcgctggcgctgctctgcccgtgcaacaaccccgacgccttccgcccccaccccatcgacggcaacttcttcctggtcgatgtcccggcattcgacaccgacgctgactaccaccgcgaccagatccgggccgcgcggcagcgattcgtgccgcggaaggcgctcgactacctgctggacgccgccgtgactcagcacgacgctgcggaaaaagccgcgcggaccgtgcctggg

SEQ ID NO: 25153 - DNA, 674 bp, Sorghum bicolor
  Clone ID: 30947747
aattatgatatcttatccagatagatggtctgagtctgatgttgacatgtcgtgataccatcatcaggcaaaaacaagttgcctaacacaagttgcctgctttctgaattgcctctccgttggttcatgtgtgacaattaactgctaatgctggattaccatgtttttgctaaaaacagctcttgtttgttttatggtaataccattagcgtatatggaacctcaggttcttaaaagaatgtttcatttattcaagttcttaatttaacctatattttcttttgcagggagcgtgaagctgagccaacttgtaagtattttgacctaaacttcaacctcttaaagttctttcttttttactgcattgatatttcccttttatgaagatcacacaactggagaccactcaagtgctgcaagcagttcacttgtttgcccatatcttgccctgcgtggttttctccatcctgttcacgtgccttctacttccaattctggtgctgaaagcacttcatttcatcgacattcaactggcttggaaggccatgccactcctgatttgaataatgctccagttttccatgctaccgagtcaagaaatcatgacagtgagcacagacatttgagtaatcttcctgtatcaggaattcctgaatattctatgactccatttg

SEQ ID NO: 25154 - DNA, 605 bp, Sorghum bicolor
  Clone ID: 30947764
gaagaggaaaccaactgctggaggctgtgttgatcttgaactggaaattgatgaggacaccagattcggggcctggattgagcttgacaagaagccaaactcacgtttactgagatgggccgtcacactatcagatacaccccagggtgaccttggatggggcgtaagcttgcgtagaggcactgaggccaaaccacaactgtttcaggtggagggatttctgaacctgcatctggggaagactgctgccgtgcagcctggcattgtgttcaacgttgatgggaggaggtgcagacctggtcttgtattccactcgagttggtcgttgtgagtctagtgcaggaacttttggttgaacagataatgctgctggaattgtcaggtggaaagaaaacgattcattgacaagcgcacggtgcattgcaccgattattttgacgtgttataacttgtaattttagttttgatatccctttaccttcacgtagagttttctagatatgatgaaccatgttgggacagagcttgtgaagaggcaccgaggccaaacagcaactgtttcagctcaacgtggatgtgacttgtgaggaggtgcagacctggtc

SEQ ID NO: 25155 - DNA, 557 bp, Sorghum bicolor
  Clone ID: 30947818
cgacccagacccgtccaagaggccttcgatgcagatcatcacgggcgtgctggagaacggcatcgacctgtcggcggccgccatcctcaaggagtcatcgctggcgtgggccgagctcgccctcgccttgtgacacgccgctccctccctcccaccaccgtgtgtaaatccatcgccgcgcacgctgctactaacattctcggatgcgggcgctgatgctgtctgctgtctgcttggcgtatagacaggactctagaggggcaggcgagcgagcggcgtaacgcatggacgggcggcgcctgctccgctggttccgggcatgcttgcttgatagttgacactgatttccttgactggtggtgtaactgtaactgaactggtgtaatacggacatacgtagagttcatagctgatgtgtaggaggcatattgctgtgttgccggtctgatggaggccttggcgacttgtctgtcttggtttgcccctgtgacggtgtgatgaaaacctgtgtgtctgtgtgtgtggttttctctgaaacagaaggagagcagaagcaa

SEQ ID NO: 25156 - DNA, 478 bp, Sorghum bicolor
  Clone ID: 30947828
gatgggcaggacacctgcaccgtgccgaggcgcgggggctacggcggccgcgacgccaactacgacgcgctcgtgccgccttccttcgccttcaccggcgctggcggccggccggccgcgccggtccacaccttcgggttcgggacggaccacgatgcggcggcgatgcacaccatcgccgaggccacgggcgggggagcgtggtgtggcgttggccacggcaggcctcacgacgtcgtacatgacgccggcgatgctggacatgctgggccggtcgcggagggcgcgtgagctgctgcagcaacgccaacaacagaccaaggagcggaggagaacgttttgaccaagcaggcaaaggagtgtggtgtaggcaatccttctgaaaaattgttcgtgtaattagtgtagctgtgtatggttatctattgatattttgactaaggccctgtttagtttgccaccaaaattttttcatcca

SEQ ID NO: 25157 - DNA, 500 bp, Sorghum bicolor
  Clone ID: 30947873
cagcagcgggacgggcagcacgcgtggcaggaggccacggtggacgacctggtcccgcccaactacgtgtggcacgtcgcggaccccgccggcgacgagtcgctgcccttggcgaacgagctcaagcggtactacggcaaggcccccgctgtggtggagctgtgcgtgcaggctggcgcgcccgtgcccgcggcgtaccggagcatgatgcggctcgacgtcgtgccgccagcgcgcgacgagtatgacctcgtcgcctgaggctgtagcgcgttgtgtggcctcgtttgatcgcggatgatctcccgtgtgcttcaaatgtgagaagtccggccgggtttgaattgtgagaatgtggggtggttgtattgtgtgtcgaacgaacagttttgcagatgtgtttagaattttagatgaacgctgtcacagtctgtcacgatgcagaacaaatttcttgatgttttcctgccacaagtgggcttactcatagatgcagctgt

SEQ ID NO: 25158 - DNA, 602 bp, Sorghum bicolor
  Clone ID: 30947881
gggacggtgacgggcgtggacggcgggaaggtgacgcggtccgtgtcgtgccaccagagcctgttcccgtacctggtgtactactgccactcggtgcccaaggtgcgggtgtacgaggccgacatcatggccgccgccgccgccgccgatgatgatggtggctcggacgccggcgagaaggagatcatcaaccacggggtggccatctgccacctggacacgtcggactggagcccgacccacggcgcgttcgtggcgctgggcgggaagcccggcgaggtggaggtgtgccactggatcttcgagggcgacatgacgtggacagtcgcggattgagtgacgacgttcgttctcctgcctgctgctagcgggctttgcaagatcacaacaagactgaactactaagaagaattattttctctctcgcaattaattttttttattttcactcctttcttgatctaccttatataacgaacgaaggtggtaagaattgtgcgattggtgcaggaggagaaaaaaaaggtttggtgatgatgaaaactgtaaaactgtaaaaatcttgggtgggggatggaatggaatagctggcgatgtgattg

SEQ ID NO: 25159 - DNA, 420 bp, Sorghum bicolor
  Clone ID: 30947898
aattctgtccccactccgcttcggccctcccctgttcctcgcgttcccgtcacggcttcgcctgccatcgctcgcggcatcgccgcctgccctccccttccccacgcgaataaagcgccggtaccggaagcgcgcgcgcgccaagcaaagccgcccccccccccccccccgcgccgcgctcgggatcgggagccaccacacctaggggtaggggtcgggttcgcctcgttccgggcgtcgaccgatgcgcggcgcatggcggcggtgaactgcctctacgtcgcgggcgcctccacggggggcagcgccgccgcgctgcagtggtgggcgtcctcgctcctcgacggagacgctggggccggcggggatggggactggcttggagccgtgctgcgggcgaggggcaccgtcgcgctcctg

SEQ ID NO: 25160 - DNA, 553 bp, Sorghum bicolor
  Clone ID: 30947926
cctactgggtcagtcgtcacccacggactcgggcgcttggcggcgggggcggcgctccaaggcggcaaggccgaaaggcgggcagtcgccgatcggcacaggcacgcggtgccgcggcggcttcccgctcagccggtctcggtcggcagtaggcagcagcagcctcggctcggcggctggccggctgcgctcggtggccagcgcgcggtgcgcctgcgcctgcgccagcttgccgaattgagctcgcccgcgcctgcctctacgcctacgcgcggcctgagctcgcccgcgcctgcctctgcctttacgcgcggccgcgccgaacgctgctcgcgtgagggtgttccccaactgcgcggtcgcgtccctcaggtgcttgacagaatgccgtttcagtcctagcgcccgctgcgcacgtctgaggagatgcaggggaccctcggcgtccgatccagagcgccgcgcgcgtcgccgcgtgttctcttcccgcagcagcagctgaccgcgcgggcgagatggctgcagggcggcggcggcgggtggacaggggctt

SEQ ID NO: 25161 - DNA, 594 bp, Sorghum bicolor
  Clone ID: 30947931
ggatccccaaatctcccatggcttcttcccctcccccaccgcccatccgcaccgtcctcgccgccaccctgctcctcctcctcgtgtacctcctcccgcacaatgccgccgccgccgccgccgtagccgacgcgtcgtctgcggtgaacccgttcacggcgaaggcggcattcatccggtactggaaccgcaaggtgcccaacaaccgcccgcacccggccttcttcgtcgccaagctctccccgctcccggccgccgactccgcctccttccccaccgcgctgcccgacatccgcgcccgcctccccgagctctgcaccaaggccgcgctcctctgccccggcccggctaccaccgacgcggcatcgctggcggcatcgggccccagaggcgggggcccgttcaagggctacagcaacgccaacttctccaactacggcaccggcggcgtagcgggggccgactcgttccggaactactccccggacctcaacatcgccgccgacagcttccgccgctacggccgggactcgtcgggacgcgccgacagcttcgcctcctacgagtccgacggcaacgtcgtgaccgccaact

SEQ ID NO: 25162 - DNA, 570 bp, Sorghum bicolor
  Clone ID: 30947943
cctactggagcgtgcaccagctccgccagccaatcggactcggtgattcacatccccgtctggccgttcctctccctgtccggccggtgctgcttaaccctagctgtcgcgccgcagtcgtccgctgcggcaccggcgcaccgcccatcgcgtcaccagctccgccactggccatggccaacgggcttccgaaccctccctgcgccgtcctcaccgccgacgctgcccgatccctcgtcgattccgtcgacgccttcctcttcgactgcgatggggtcatttggaagggcgataagctcatcgaaggggtcccagagacgatggagctactgaggaaaatgggaaagaaattagtttttgtaacaaacaactctagaaagtcaagaagacaatactcaaagaaattcaggtcacttggacttgaagttactgaggaagagatttttacatcatcgtttgcggctgccatgttcttgaagttaaataatttttctccagaaaagaaggtttatgttgttggtgaagatggaatcttggaagagctcaagttagctggttttgaatgttttg

SEQ ID NO: 25163 - DNA, 617 bp, Sorghum bicolor
  Clone ID: 30947956
agacgtaaccccattctcgtcatctctctctcgcctcctttcccccatggcatccagcgccgccggctgccggtcgccccttcttctccaccagccaccgccacgccacctctcgaatctcttcctctgcctccaccgctcctcttccaccaccaccatctctctcttccttcccctaatctagctggagcctccacctaccttgtgccatggacaatagcgcaggtgggtactgctccaggcggtgcaggcggggttcgctccggctggcgcacgcaggggtccatgccgatgacaacacatttcctcccagcctgtgtcagtgacggtttgcaacctcgacggcgcacaccctaccagcgacggcgagtgggcccccatgcaccggtggcggtgagcaccctccccatccccaaccccatccctgcagaaccttcttctcatgcagggtctgggagaccaccgacgcagagtactttcttcgagccagacgatgtcttcagtgcccatgcctagcaggtgttcgaggcaatgccggcaagaccacctgacttggcctcacaattttttctaagatttaaatttgtttgatctgcaatctctatgctagcttatat

SEQ ID NO: 25164 - DNA, 599 bp, Sorghum bicolor
  Clone ID: 30947962
ctactgggtctcttccctggtcgagtcgcgacgccatcgaggccatggcgcggggcgacctcggcggtggcctgcccgccacgcggcagcggcctcccttgtcctcctcatcctcctcctccacgtcccttcctcctcacgacgcaaggcaacgggggcacaatacgaacggtggcctagggttggcccctccatcgccggttctctccacgggtgcgcatccaggtcggcggcgcgagcagcggtggtcagcgcgtgggttggatggcggcgacccaccctcgcccccaggagtggatgagccggctatcgtggccgaggtttcaagatggagatgagccggagcaacaccagctatctatgccatgaggtatacttattcatggcttgatctccagttatggcaaagtgtcaccatccaaccacgtcgcaactctccaagtgccccaccacattagtgcttctactaacaaactaatctattggcgtggcctcaatattacgttccccatttgcttatggataaggtacctctccatttggtttagtacctttcatgcttccggtttgatccggttagtatttttgccacttctttt

SEQ ID NO: 25165 - DNA, 398 bp, Sorghum bicolor
  unsure (1)..(398): unsure at all n locations
  Clone ID: 30947966
tactggaaaaaaaaaacgagaactttccattctcttccccgctgttgggggtgctgcgctgcctttcccccgcctcgacctcgactcgaatcatccatccatccgccagcgagccagccagcctcctgacgcacgctctctctccagtgttgcggagcgaagcgtggccgagggggaagaagaggatggaggcggcgtggaccggngcggngaatngagccnccgacatggctgactccgccaagcgcttcctcctctccttccgccgcccgccgccgccgtcgtgtccggtccccgaccccaaccccgtacggatcttgaagcgtttgcagcaacaagcattttatgacattatgcagctgagggagagacaagagaaagttgaaagagtgatctcg

SEQ ID NO: 25166 - DNA, 584 bp, Sorghum bicolor
  Clone ID: 30948000
cctactggttaagcagataggttcccttccatcacctccaccaccaaatcctgcaaacttggatttgaaggaaaggttcaaggagcttaaagcacagaaaagtctgaacacaataagcccaagctcagatgaagcaagggcatatttccagcgtgaggaatttttgaggtactcaatacctgatagagcattttgctatactgctgctgatggggagaagtctatagttgctcccttgagaagaggaggtggaaagccaacagcgaaagcgaggggtcaccccatgctcttacctgatcgaccgccacatgtcactatcctctgtcttgtaagggatgctgcgtctaggttgcctgcaagaactggaactagagccgatgtctgcacactactcagggattcacaatacctaaaccatgaagaagccaataaagaggctgcaattaatcaagttgtcagtggagctctggatcggttgcattatggacgtgacccttgtgtgctatatgataatgacaaaaaattgtggacctatctgcacaggggcagggaggaggaagattttgaggatgatggcacatcat

SEQ ID NO: 25167 - DNA, 613 bp, Sorghum bicolor
  Clone ID: 30948008
aagcagcaaatcagtagctcctgttcttcgttcttttttccccacgcggttgttctagtctgaagtgttgacacacatcgatccctgtagtactttcgaggagaatgttggttgctgtaataatcaattggttaaattcttcaagacaaatcgatttaagatttacggctagtagagcagaaggaattgttgagaacattttaagattgaactgcaatcaatagtgttccattcttcccctgaggtcatgttttaatagttgacaatgagttcatctgcatatggtcccaagtatgaccatgaggtcgatattttactgcttttacacagaatgttcaccttcatagactccaaatcatgatttttcccaagtattctaagactttcaatcatgtaggcttgtagagtatgcctcaactttgcgatgatggcttaaaaaattacctgaggtaatcttctaatggtggaatgctatgcaggcacgagaccagggaaagggtgcgcgtgcagatcaccgatgcagataagcagaggtgggaggtcccttacaacctgctcccaagggagccagcgccacccgtgaccggcagcaaggtcacgggcgcgcccttca

SEQ ID NO: 25168 - DNA, 614 bp, Sorghum bicolor
  Clone ID: 30948025
ctctctcccctcccctcccgcgtcggcagcgggcaccaagcggcggcacagcctgcagcgacgcgagtggggctcctccctcgtcctcccaacgccaggggcgacggcgacggcaccggccgcgagcagcacgccgtggctgccctattcctcctcctgtgcctcctcctctctcccctccctcccacaccggcggcggcacaacctgcagcggcgcgacgacgcgagtggcccttgtgttttgctcctccatgaaaccctacctacctacttttgatttggtttttgctttttgttttacgatgttaatatttcagctttcttcctactcttccttagggttcctctacgaacaccagatttgttgccttcattcgatgcatgcttactgtgaagctcctgcatagtattggcacaggtggtacgatttaacacactgagggccaatagcagttttgattgcttgggagcttgcagcgtctccgtccctctcttccccggacgcgggcaccggcgatggtacccttgtggtgcatgtccccacggctgcccttctcagtgcctccctctccactcgccgtttgccagtgccttcttttctctccctctctccc

SEQ ID NO: 25169 - DNA, 645 bp, Sorghum bicolor
  Clone ID: 30948027
ttaccgacattcctctctactcacatcctctgctttcttccctctcctgtctcctctgccgcttgcgcggttgtgcctggccccggcggcgtctgcttcccttgctcgccccggcgccgctcctcgctctctctttactccaactgctcccactcactccccaaccaccttgccgctccttccacctccgtctcctctccatccccccacgtggccgtgctgaagcggcggtttgtggccgggcagcccagcagcagcagcagcagctctgagccatggctccgtgaattcggtcgctcgctcaccgtgatcaatccgggtcaatttgttgcgggtttggcacgagctcggtgccgccgctcagacttggccatgacgaggcgctgtgctgaggcggcgccgagcctcctgcaggtcctccttgccttgcactgcggggtggtgttcctgcaatgctcggcagcatctgccatgggcagcgacgtgtcggcgctcatggcattcaagcgcgccatcattgaggaccctcactccgtgctctcggactggactgacgcggacggcaacgcctgcgactggcgcggcgtgatctgctccgcgccccagggctccgtcatctccctgaagctatcaaactcatctctc

SEQ ID NO: 25170 - DNA, 569 bp, Sorghum bicolor
  Clone ID: 30948042
tttcttcatcttttttttttttaaaaaaaaaacagcagcagcagcagaagcattacggcaatggagagcagcccgtggtccaactgccatggcgacatgcgccgcacctgcacccgcagcggcggcggcggcggcagcgggagcgggcacgtggtcttcccgctgcagtgctcccaccaggaccagtcccattcccgccgcgtctccgggtccggtatcgtggaggcgaacggccgccccgtatgccagctctgcagcgcccggtggcgcgagttgccgtccctacgctccacgaacccgtcgccgccatcgcccgtgccgtcgtcccagccgttcttccggcccatggagccgcgcgtgttcgacgacgacgaccccgtggaacggacgccacggccgcttcgtgatgatcaccaccgcggtgcaagcgcggacggaggagcggtcgcgctcaccacgcactgcgagtgctcggctctcgcgagggacgcgtcagccgacgacttcgccgtgctcgtgcacgccagggcaccggggatgatggccggggctggtggcggcgcggcggc

SEQ ID NO: 25171 - DNA, 379 bp, Sorghum bicolor
  unsure (1)..(379): unsure at all n locations
  Clone ID: 30948058
tccactattactggcgcaagtttgacgacggtttcatgcggccggtttttggcggccgtggcttcgtccccttccaccctggttcaccgactgagagcagtgtgccgctgcttgctggcaatgggaactgaaaccagcataccgtggtgactgggttcagcaaaagttttgtaaattaacttcgcttattaggaataatgaattggtgtaaatataggtagtagattcacttgctaagcttgtacatgctgatgtaggctagttgcctgaccagagaccacacggctcttgatgaatttgtatttatgaattacgtactctacatattggatcacanaaatatgtatcatctccaaattaatagatatattaaattatc

SEQ ID NO: 25172 - DNA, 359 bp, Sorghum bicolor
  Clone ID: 30948061
caggactcctccatggggtcggcaaggagcagttggcttcctgcctcggctagtttagtttgtgcagtcttggtcatgctagtgacgcagttgtagatacacaggtttataatacacaaaaaggacaaggacagaaacagaatgaaaaaaaaaaggttaggtaccatgatcctgctacaggagagaaaaacttctcttcttgtgggttatcttcacattagtttttgcacacaaattgtgtgggagagacgtgtgtctctcttcttaggtttgtatttgcacagtgaagttgttacagaaatggcccatgtaactgtacataatcttatatatcagtcaaaagtatggacaagtgttta

SEQ ID NO: 25173 - DNA, 398 bp, Sorghum bicolor
  Clone ID: 30948091
tagcttcaagattgatcagtgctgattcatctactttgatggcagggctgatcaatgctggattgatgtgcatctatggatccagatcagttgccaggccaaatctatctttttgaagtctagcaagggatgatgctacaaccaccaacagacagatgcaagtcagccaacatttggtgcctacgacaaatgcagctagccctttttttgaacgattccaatttctaccttatttgaatataccatccatttatcttttttacacaccagtttattcatggatttttagatctgtagaaagagttgaacttgtggatttgacaaacttgtggaactagttatgatagaacttttgaatttgtaaatttgacgatgaaacttgaagttgatgtttgtgc

SEQ ID NO: 25174 - DNA, 388 bp, Sorghum bicolor
  Clone ID: 30948096
attataggttgaaaatcatcagctcatgcttgttactgaaaatataaaacaatcaccctgggggagagtaaattatgtgggacctagttgtgaacttgtgatttgattattccactggtgccgagatgcagaagacatgccaaaaggatcaattgaccttgtactagtgactcatatctgatcagacagatgcaactgcttataattggaaccctgcagcaatccatcaggaagttatgaactagcagtggacttacagttttgtataggattcctttgcctcttctcgcactttttttgttgttgtatctcagaatttcatcaactggagtgtatctgaacccataaggtcttcctatttgattttaattgacaaacatttgggcct

SEQ ID NO: 25175 - DNA, 424 bp, Sorghum bicolor
  Clone ID: 30948098
acgacgctgccgaggaagtccgaggcgattcaagcgacaccaaccatgcaagtgcgattatgatgacaccacgcagagttcggcaccgacaaggcgaacgacgcaggcgggcatggctgatattccagtcatgttgtaccggctcatggaccgacgaggccctcacgccaacgccacctacatctacaccaacaccacgcatggagaagtgaagcgaagatcgacgacgacgacaacagcagcttaatcggaggtactctgcgagtcagctcgcgggggtaattaactgggagccttccgaggcctcaggaaccatgaagaccacatcgcctttgtcagattgctgctagcaagttgtgtagcgcgcattaggaatttgtatttattaaacctgatggttaataaaagtgcatgttcctatatt

SEQ ID NO: 25176 - DNA, 444 bp, Sorghum bicolor
  unsure (1)..(444): unsure at all n locations
  Clone ID: 30948101
ctgccaacttttcagttaatattcgtgcatgtcatcgaatcattggtttttgttccggtaatgggaaatattctttggcgttttgaaatatttgaagtttgtgatgaaaatgtattcgctgcaggattcaccaaacttctacattagctcactcattattttgttctgatctttgtagattatgattgggatcctcttttttctatttgagttctacgatgatcaattgcttgcgtttcttgttttgactcttgtatggttatgtgagctattcacgatgatcaggtaatattttacatggaagtattactggaatttttattattactccactcccnaatgtgaaacatctacccttttagagaagtcaccgtttcgtccaaactcctgttgggtatggttggggttgggttggcttcatttgtgatccaggggcacccaaag

SEQ ID NO: 25177 - DNA, 384 bp, Sorghum bicolor
  Clone ID: 30948109
caaagaacatattcttgcagagctcacgaagattgcgaaggaaaagaagctgaaaggttttgagttcataaaagctatccatcttgacccgttgccatttgatatcgaacgcgatctcatcaccccaacatacaagaagaaacggccacaaatgctcaaatactaccagggagtaattgatgcactctacaagagcatgaagtaatacgacatatttacagagtcacaggggtattattatgaattttgatgcacatatttgtcttcatgttatttcagtagttacttgtatgatgtatcttattatagtgtgtggaatcacttggagagttgtgtattattgtactgagataaggggaacaaaaataaaaacaatttgggtac

SEQ ID NO: 25178 - DNA, 407 bp, Sorghum bicolor
  Clone ID: 30948111
gagcacggcggttgggaaccctgccaggctgattggtgggaagaaggccgagggcgagaatgatgaggacatgccgggggagtccatggatcatacgtccttcatacgtcaatggtcggactacaccatttgagagcaattttccaaggtcgattactcttcttctgtatcgctagtaatggtgatgtaccaaatagtgacgtgcccttctttgttgtgtgctatggtttgtctgcgatgaactgtattttagaagcctagtgtttatgatcaatcattttgttagctaagtgtgccatgcttggatactggtacattatcactgatgaataaatctgtatatccataggggagttggttggaatttgtcacattccttatgaatcaaactccaaggtcagagttaa

SEQ ID NO: 25179 - DNA, 417 bp, Sorghum bicolor
  Clone ID: 30948113
atgtgtgaagatagcttaaagtggattgaaagcaacccagaagccgaacctgagtcctatgagcaaaaacaaaaagaaatggaaagtatcttcaatcccatcataagcagaatttatcaaggtgatggtcaacaacaacaagctggaggttgtggaatgtctggagcaggcggattcccaggtggaaactttgcaggctcttctggatatagtgctggtcccaaagctgatgaagttgattaagtaaacttatgacaaaacattatttgtatataaatgagataaatttatagatttgttatgtgtgtgacagagtttattttgaatatatagtttagtttatatactgatgtgatgatattttatcgagttattatttaataacaaaatcaagtatatttatgaatactcacttaa

SEQ ID NO: 25180 - DNA, 375 bp, Sorghum bicolor
  Clone ID: 30948127
tccttatggaaaataagtgacaagttcaatcaatttttctgggtctcgggagttcctctggtctcctagaagttcagttttcatgccatgtccacctaaacagcggcattggaacatagttgggttgaactcaagtcaccgctagaacaactgtgtaactgcagctgctgagcctgcccgcctgcttgcccgcctttgtaagctacacatgaaacctgtgttgtattctttagtttggtatgcagagtttagaaccctgagaacaagcattttatggtaggaacagtatttggtgcggtagaactatattctgtgctgtaacattgccgttgcaagatttaactgttggcacatgtggcgattataactaggaac

SEQ ID NO: 25181 - DNA, 380 bp, Sorghum bicolor
  Clone ID: 30948135
gacaaaaggacttgatcatcttaacaagttaacccttccaatgacacttctatcagaagctaacttggaagaacttagcaaattgaaggcattgttttctctcaccttcacaagttctgcagcacagctagatcaagaaacggtgaccattattgagaataacaggtcaggcctcaatggagaaatcattgttcctgctggtggattttcaaatcttaagcttcttcgctttactgctcctcggatgccattactgtgttttgccaaaactgctatgcaatgtctagaaaggcttgagctgaatttcagcatgttggaaggccttctgggcactgaaaaccttcagtgtcttaaagagctgcatctaagaatccaaagaa

SEQ ID NO: 25182 - DNA, 413 bp, Sorghum bicolor
  Clone ID: 30948143
gatttgctccgcgctactcgatgcaagacttgaacgtcgctgataagctcgtgattcctaaggattggtaccttatcttcccatatggcctaatctcgcaaaacaattccatctactccgcacctgactcccacaacccggatcgatttttgactgaggccaaggagccctatcaaaatgtcagctttggtgctggtcgtcacccgtgcaccggagttaaattcgcgacaatgaacattaagacactcatcttctctttcttggagcgatacgacgctgaaatgagcgataacgtgcacgatttgatgcctaaagagcaagtgatgggtgtgttcagacctattaagccttgcatcgccgagcttactccgaaggtgagcattatgtaataaacgctcaatggcggaatattc

SEQ ID NO: 25183 - DNA, 403 bp, Sorghum bicolor
  Clone ID: 30948155
agccaagaggagtgcatggtggagatggaattggctgactccaagaaggaccttaaagactacgatttttgatgaggatgattaacaaatgggtgcacagggcatgaaggtgttgccagtcggtttttgtttctgaggaagcgagtagtgaggacacatgatcgttttctgatgctgtatagtgaagcagtgaacctagttttgtgagatgcaaggaattgctagaatgagatggtttagccacattgttgaactgcaaccaacttggatggctttgtatagtagccggtgaacttggtagtggcacttgggtgctcgttgggcgttggttgttctttaactacatcctatgccgccagaaactttgcttgttatgatggatcaagctaatacgacctatccg

SEQ ID NO: 25184 - DNA, 663 bp, Sorghum bicolor
  Clone ID: 30948189
actttactataagcatacacgatgctattgtacatactttttaccgtcgctgccgtcttagcagcgtggatttggttcaagcatcccgcgccaaagagcaaggattttcctcatctcgctattcctcctcgtcttacgtggggcgagatattctccattatgaagaacgctcctaacactaagaacagcttttttgaagcagtccaaaagaagtacggagatctggtctggattagagtcccgttttggagcgatattgctttatttaccagccccgaatacgccaagactttctttgctgctaaagaagctgattttatgcgtggatattacatcttccacaaacttgcttcgcctccacttttctacgaatcaaaatcatatttgaccgatgtatttgctaaggcattttcagcagaaagatattcgtactttgccaagcttttgaaacgacaagtcgacgagtacttcaacgagcattggagtggatcgagccgtagcatcaatttattcgaagaagtcgatcatttaacactcaatggcatgatcagatctttccttggcgacgatttgcaaggcgcagaattagaggaattcgttcatttagtaaaagaacttgatatcgaagaccgaatgaagaatttgaaagcgagtatgtactac

SEQ ID NO: 25185 - DNA, 561 bp, Sorghum bicolor
  Clone ID: 30948191
tggagcgagcagccatggcaggccgcagacccgcagtgggacgaggtggcactagcccccagccatagcggggcatacctggcgccaccgcacggtggcctaggccatcgtccatggcagggcggacccacccccatggccccatcgtgccagagcagtgcccctggccctcggccaccggcacagcggcgaggtggctatggcgtggctgttccttggcaagggcgcgaccaactcccaacacgggacgcggccgtctccacgtgcgtggctgagccccaggagcacacgacttcgctgaagcgaactctgccattgccttttcgccgacctcggcttcctgcacagttgtcgcgctgccggcgcaggattctagcacttcagcatctcctcggaggcagactttattactagacctcgatgatacgctcaatccaagtctagcagccatagctacaatcccaaccaccaatcccagctgcaatccatggccagctcctcaagttctactcaacatcttcctgttctcgccactgatggcaagcgctgcaggcaccacgc

SEQ ID NO: 25186 - DNA, 576 bp, Sorghum bicolor
  Clone ID: 30948201
cctactggctagacgccccgccgccgcacgcgcactccgccgccggccctagccccctaatcccattccgtcggggccgggcgagtccccaatcctcctcctccttcttcctcccccacgctcccgtctccgccgcgctaggaacttccaactcccaagccgggttagggtcgcttggttcgtgtccggcagggggcatcgcggccgccggaagagatgtcgcggacgctggtgcagccggtggggcagaagcgcctcaccaacgtggcggtggtgcggctgcgcaagcacggccagcgcttcgagatcgcctgcttccccaacaaggtgctctcctggcgatcccgcgtcgagaaggacaccgacgaggtgctccagtcccacaccgtctactccaacgtctccaagggcgtcctcgccaagtccaaggacctcaccaaggccttcggcaccgatgacctcacccaaatctgcatcgagattttggagaaaggggagctccaggtctccggcaaggagagggaggcgcagctctccagccagttccgcgacatcgccaccatcgtcatggagaag

SEQ ID NO: 25187 - DNA, 414 bp, Sorghum bicolor
  Clone ID: 30948205
aggatgatgtcatagaggcggatagctagtcactgcttttgtgttggttgatcatcattggttagcgaatatgtttgaattgtaacctctatgcaaatgaattagatgaatataattaaccgagcacacattccacttttagctttccctaagagtattcctaagtttatattgataagaacatctattttctaggtcctaggttttactattggtaaaagctttgggcgagctatatgttttttcctagtatgagtgaaaaggaagggacacaaatgtagggtgagaataatctagagtttctaccaaggataaaatcagtcccctaggctaaaagctcattgcatagcacagatctactcgaactatataattcatgtcaatgacaccacgaggggcgaaggtacactgctt

SEQ ID NO: 25188 - DNA, 516 bp, Sorghum bicolor
  Clone ID: 30948209
ttcggcccatcccaagctctctccgtcagcctggcggacacatggttggcaggggcggcgtggcgagagacgccgcggctgcggatgcggaagccgacgcgccttccgcggggtgcctccgccccggccgcaggcaggcgtcgcggtctcagggtcgcgtcaccggtgccgccgttgtccgtctgtcggtttgtgcgccgccggcctgctcgttttctttttgattggagtttcattccaagcagtctcacaccagaaagcagattgcactccttaatagtcaaaagttcgccttcaaaataccttcgtgacagaatgatggaaaggctttcagcgctggttctggatagtgacccaacatccttgtcgaccatctctgagacgctcgcaaaatttaacttcaaagttttccccttccaaacagcagaagcggccctggatttcattgaaggtggggctgctaaagaagcggagcttgatttggtcttggtggatgttaatcttaacaatatggcg

SEQ ID NO: 25189 - DNA, 538 bp, Sorghum bicolor
  Clone ID: 30948238
acgactacgacgccgtggcgcgccacccgccaccaggcccgccgaaccctacgccccgtccccgaatcggaggagcaaccgcctcgcggagattccctccgatacccgcccgcccacgccgggatctccgcatccggatccgacttgcgtcattgcccccctgatatctcctccacgcacacagtccaccccggcttccagagtccagagtcctgaccacgggcgagcgcacgagctctcgcgcgcgtagaggcgccggatttcgtcgattccggcgacatagcagatccattgcctttcctcggatacagtccgggctgggtggggggactccttttccgcctagcagggttgcgtgcgggcggcggggttgcttggaaggcaagccgaggtgggaatcgggtgtttagggggcggcggtggtggtaaaggtactagggttgggggcggtgattagtggagctgcgaggaggtcgatagagaggtggggaacgatggggctgatggcgctgggcgacccgccggcggactacgcgtc

SEQ ID NO: 25190 - DNA, 595 bp, Sorghum bicolor
  Clone ID: 30948240
aaaaaaaaagttggccccctcggcatcatctcctgcgtccacgtagggaccgccgacgggcccgtgacggcgacggtgcaccggcaggacggcggcaccgcgtggcgctccttcgagcagctgctggacgcccgccgaggcagccacgtcgcgggcctcgccgagctcaagcgctacctggcgaggttcggctacatgcccatgcccggggcggcggcggcggagcgcgagccgacggacgcgttcgacgcgcacatggaggccgccgtgcggcggtaccagtccaagcttagcctgccggtcacggggcagctcgacgccaccacgctggaccggatcatggcgccgcgctgcggcgtcggcgacgacgtgccggtatccctttcgggatcgtcgacggcgagccgggacggcgcggccgtcagccggttcacgttcttcaagggcgagccgcggtggacgcagccggacccgctcgtgctctcgtacgccatctcgccgaccgccaccgtcgactacctgcctgccgagaccgtgcgcgcggtgttccggcgcgcgttcgcgcggtgggcgcgggtcatccccgtgggcttcg

SEQ ID NO: 25191 - DNA, 453 bp, Sorghum bicolor
  Clone ID: 30948258
gcctactgatcgcctggcatacatctccctagctacttccctgccgtcgctctctcctgatctcgtcggagaagatgaagcacctggtggaggtggagccggcgacggcgaccacgggtccggcgtaccggaacgcgcgggccaaggacggcctcctgcaggccccgccggggctccacagctgctgggacatcttccggacgtccgtggagaagtaccccaacaaccagatgctaggtcgtcggcgagtggtcgatggcaaggcgggcgaatacacctgggtgacttacaaggaagtctatgatgttgtgatgaagcttgcagcctccattgacaaatccggaatcaaacagggtgaaagctgcggtatatacggcgcaaactgccccgaatggatcatcagcatggaggcttgcaacgcgcttggggtttgctgcgttcccctctacgatt

SEQ ID NO: 25192 - DNA, 580 bp, Sorghum bicolor
  Clone ID: 30948260
cctactggcttaccaaagtaatattgaagatatcgtgctttctggaacagaaattgagatggagtcttacggacaagaatcatctgactcgagtgatgaagagtggtccgcatttagcacaccacgaaaaacaagattacaagacaatgaaaaagcatcacttactgaatcactacgttcttcaaaacggtgttccagaagagcagcagctagggagcagaataatgaacatactcagagcgagcagcaaactagagagcagcttcatggttctgcaagggagcagcaaactgaagttcttcgctccaatgtcagcactggcaaagtctcaaaatatcattttggccctatagttagtcagaaactgaaggaacattttgaaaaagatccatatccttgtcgcgcaacgaaagagagtctggcacgagagctaggactgacatgtaatcagatcagtaagtggttctctgctactcgtcattattcaagagatgctgttgccaagaaccaaaaacatctgggagaaaatactacggagaataataatagcacaacctttgatggcatacaagtacttgaa

SEQ ID NO: 25193 - DNA, 658 bp, Sorghum bicolor
  Clone ID: 30948287
cctactggattatctgaatccaatatcttactgtccttgaattgcaagactcagaagtcaccacattacctgcatcaattggtcatctgtttaatctacgctacattggtctgagaaatacaggaataagcgtactgccagaatctatagagaatctcatcaatcttcagactcttgatgtcaagtcaaccaatattagaaatctgccacatgggattgtgaagctcactaagcttaggcacattcttgctgacagatatgctgatgtgaagcagtcagagttccggtactttgttggagtcgaggcacctatagggctttcaaatcttgaagaacttcaaactcttgagactgtgcaatcaagcatttacttggcagagcagcttgagaatatgatgcaactaaggagcgtgtggattgaaaacataagtactgcccattgtagcaagatttgtaaggttttgtcaatgatgccgtttcttgatagcttgcttctctctgctagtaatgtgaatgagccactttcttttgaggatctcaaaccaacttccacaaagcgtcacatgccccgcacctgtcctatctaagactcaacaacataaacagtaaacacgaattagttgttccggctgactccttcactcaccttaagacactt

SEQ ID NO: 25194 - DNA, 671 bp, Sorghum bicolor
  Clone ID: 30948290
aggcctcacagcccacagcccccgcctcattcgctccgccgctggcgattggtgaagagagctccgaggtggtatcccttgtatcgcatcgcatagattccgggctctactcgtcgcggttccggcgaggtccgcctagttctgcaaggtggtatggcccgaaacttgactgagaacaggaccagaaatacattaattgtgattgtgattttgggcctctgttccttcttctatctcttgggtgcttggcagaaaagtggttctggaggaggagacaaaacacatcagtgggtcattgagcagatgaaatgtgcacagctcccaaatctgagtttcgagacccatcatagtgcatccaaccttccgaatgatactggtagttccaaaatcgaacctttcaagccatgtgatgagcagtacactgattacactccttgtgaggagcaaaagcgtgcgatgaccttccctagagataacatgatctatcgggagaggcattgtccactggataaggagaagcttcattgcctgatcccagcaccaaagggttatgttactccttttcgatggccaaagagccgtgattttgttccttatgccaatgtaccacacaagagccttactgttgagaaggctatccagaactgggtgcactatgagggcaatgtttt

SEQ ID NO: 25195 - DNA, 555 bp, Sorghum bicolor
  Clone ID: 30948294
cctactggactttttggcattcacgcgccgcccggctgctcatcagcaagaagcgcgtgctcgtgaggacgatccccatccatagttcacgaagggctgccagactgcttgcgcgcttggccgtcggcaaggagggtatacatacgtcttcatctccatctgagaggactagcaaacaacaggagatgtcatcgtccacgacatccatgggtaagaaattaatctagtcaatctagtattgtttctttcaatctttgcatatcagtatctacatcggccggcgtcaaggctggctgatgactggatgacgcggctgccgagtgtacactggcggacgttaaagcctggaagatgagctcggtacgaccaccctctgtgcgtgcgtatagctgtcggccaagttacgacggcggcggcgaggcacatgccatacgtacaccgttagcatatgtatatgtgcaacgattcagaagacatgcaagtgcaagaggcaaacacgttcgagcgggtgtattctggccatgcatgcatctacacatgcacgtgcaagcaaag

SEQ ID NO: 25196 - DNA, 541 bp, Sorghum bicolor
  Clone ID: 30948300
gctgctgatgcgcactgccccggataaattcaaatcccaaaccccgcaagcaaattcccccagcaccaaattcgcggccggccggccggccggcagctctccgtcgatccacagcggcttccagtcccgaataatctcaattcccaatcgattcgaagcttccttccctcgaggggagggggagggccctgcttagggtttggaggtggtggccggcgccgcaggccgcagcggcagcggcagcggcagggggatggatccggagcagacgttcctgcgggtgcacgcgcgcctatcggggacgctgtcccagctgctcacgccgcggatccgcctcgcgctcgagtacctctacctcgcaggcgccgtcgcgctcttctgcctgctcgtcgtcatgcacaccaacttcgtgcagcagcctggctgctcaagtgagttttctggaattaaatttggagaagcacaacttgtccaaatcaagattatcagtgggggattatggtccagcagaggtgcttcttacatcatggatcttcagaac

SEQ ID NO: 25197 - DNA, 503 bp, Sorghum bicolor
  Clone ID: 30948302
ccggtcggtcgcggccttccctttgtcccccgcgatcttggctcgtctctgattccgggtctgacccagatttgctcggtggcctcgtgccagcgatgaaggagaagcgtgggctcgaggacgccgccggcagcagtggcggcgccggcgacgggggtcctgatgccaagagggcgcggcctccggctctagccagtgttattgttgaagctttaaagatggatagtctgcagaggctctgctcatcattggaaccaattcttcgtagagtagtcagtgaagaagtggagcgcgcactggtcagacttggccctgcagcaatcggtggaaggtcttccccgaagcgaattgaaggtccagatggaagaactctgcagctccaattccggacaaggctgtcacttccccttttcaccggaggaaaagttgaaggggagcagggagctgtaattcatgttgttttgcttgatgctggcactggttgtgttgtatcctctggacca

SEQ ID NO: 25198 - DNA, 513 bp, Sorghum bicolor
  Clone ID: 30948336
ccactggaaaccgaacctcgccgccgcctcctccgtctctctttcatctccttcctcctgcaaccccgcctcgccctctaaacccgcacccgcagcagcgccgctagggtttgctcaggccgcgaaccccaccgtctgattgctccgaatccgaggcggcggttgcgcggaagtttgcggcatggcggggtacccggaggacaaccagcacgcgctgaacgggtacgacgaggaggaggttgacgaggaggaggggcaccccgggaggcggggaggccgggatggggcctctgggtacggcgatgctggcggagaggatgggaggggggcgggcggcgactcgtcggggacgatttttgttggtggcgttgcttgggagacaactgaagaatcattctccaagcattttgagaagtatggggcaataactgattctgtaattatgaaggacaagcatactaagatgcctcgtggatttggatttgttacattttctgatccatctgttataga

SEQ ID NO: 25199 - DNA, 587 bp, Sorghum bicolor
  Clone ID: 30948345
cctgaagaatctaaaaacttgtttaagcaagcagtattagaatctggaatgaaagaggaagaatacagaaaaatagatcgggtcacaaagaaagtggtgaacatatgtggagggcttcctttggccttagttagcatggctggttatgtaggctgcaacaaaaagcctgaggaattgttaaagcattttcaatatctgggtccagagtcaaccaaagatcatcgggaaggtctgaatcaggaagaagagtcaaccaaagatcatcggggaggtctcaaccaggaagaagagccaactaaagatcatccgggaggtctcaaccaggaagaagagccaactaaagatcatcgggaaggtctcaaccaggaagaagcaggtagaatcatcagttactgctacaatgacatgcctgctgaaatcaagacttgctcactatacctgagcatattccctaaaggtagcaggattagcaggaagcgtttgacaaggcgatggatagctgaaggttttgtcagtgagaagcaggggatgagcatggaggatgttgctgacacatatttcagtcaccttgtgaggaggaagatcat

SEQ ID NO: 25200 - DNA, 673 bp, Sorghum bicolor
  Clone ID: 30948347
gagagctatacgctcgattcggccgcttgctgcatcaacggggacaagaggaacaaccgaacacgccgccgccgccgcctactcccagctgcccccgtctttgccggaccctttgccggcgacgagcacccaccgcaccagattgacatcctataccatggcttctctgctttgtccacaaataaagttaagcaaagtatttgttaggaggaggtttcatgagagtggacagaccaatttgccaaggtctcttcactggaaacccttgcgaccaggccatcttgaaaatcttgtgctgcgatgcaccgagaatttgtcatgggaaacctctcttccatatgcctctgtcgaggatggtgccagtatcatcaagggaacaggtgttgttgaacctattgatacagaagaagctccacagattccaatcctccagagtgatgaagatgttgtggaggtgaataatgaaccttcttggcagctaaaggcatttaaactgccattgtggctactagggccttcggttctgttggttacgggtatagttccaactttatggttgccactgtcttcagtgtttcatggtcccaacattgctggccttctatctctagttggacttgatttcatttttaatatgggagcgatgttgtttttccttatggctgatgcatgc

SEQ ID NO: 25201 - DNA, 352 bp, Sorghum bicolor
  Clone ID: 30948387
aaccctttgtgcgataggaatagatgtgagagaaattgattcctacagagctttagggcagtgtgttgccccaaaagacaaacaagagaccattcagttttgaggtaaagaaagctgtcagtatatataaaattgtcacccgtagatttctcagcatgtaggggtatctgatgttgttttttgggtttgaagtacttatgatgcatccatacatagaggggaattttgatatggttgccgtcccattttattattgggagggtcccctccatatataatccagaattggagaatgtgtatcaatacatgatttcatgtgaaatacaaggatactgttgcaaactgcttgctt

SEQ ID NO: 25202 - DNA, 569 bp, Sorghum bicolor
  Clone ID: 30948457
agttgaagttctcatgacgggtttgagcctggattttgaaaggaaaccaactgacaaggcattgaggtaacctctgctatggttggttcagttcttttggtttggaagtgaggaccatccctgaagaaagttgctacagaaaaaggtaaaaagaaaatgcccaaggcaagatgaaatttgttaggctagaagaagagagtttgctagcagtttagactactggctactgcacagcatgggcaagatactcaaaaggcggtgccctttttattttgttggatcctgcattttatttcgaacctgccaatgttgtgacggtagtagaagctgcacggtatgcgtgatatacctagggatgggcatgaattaatccatcgatcctttggtgcaacttagttatctttttttttactaactcggaagttgaaccagagtggatccagaggtatccatcaatataatgtgctcgtttccgtccatccattttggtatgatcaaacagcgctgctcggctgaagatctttaataaacgcaaaaaaaaagtgattattaacatggctcggcctttc

SEQ ID NO: 25203 - DNA, 652 bp, Sorghum bicolor
  Clone ID: 30948465
ttttacaaaatcgacactgtagcactttcgtttgtatttgacaaatattatccaatcatgaaataactagactcaaaagactcgtctcgtcaattccgatcaaactgtgcaattaatttttattttcatctatatttaatacttcatgcatgcgtctaaagattcgagatgtgatggagagtctgaaaaattttgcaaaattttttggaactaaacaaggccttgattgatttgattttaattcgagtggtgctttgcattttgcatacttatttacatacatccttgtttacctttgattcactggcatttttttagccgtggtggtttgctgcagctagctttctctcctcactgtcaaaaaccggcacggttcgttagtgcagccgcgtgttggcgccgtccatgtcatggcatggaatgggacgccgtgtttgtacaaattggggtacatgtttggttgtccctttggcctccaaccagtgcacatgctatacacgaccttcgtgactagggtagtggcgtcagtcactgtcataatagactcgacttagggaaaagattcatgcctaacgtcggttgatttgctaagactttgttcacttgacaaaaattttgaattttgaggactagcactttcgtttgtacttgg

SEQ ID NO: 25204 - DNA, 603 bp, Sorghum bicolor
  Clone ID: 30948469
tgaaagattcgtccagttgcagcaacgagatgatggtgaggaactccaccaagttcgacgtcgagaagcggggcaacgggagcacgaggatcgagatctgctgcccgacaaaccccggggtgctgctgtccacagtaagcgcgctggaggtgctcggcctggagatcgagcagtgcgtcgtgagctgcttcagcgactttgccatgcaggcctcttgctcacaagaggacgggaagaggcaagttctgagcaccgacgagataaagcaggcattgtttaggagtgctggctacggagggaggtgcctctagctagcaaacagctccaaaaaccaacccagcaaatataagctagtaagttgcatgattgttattgttgttgatgctttgcttcattgatatattattccatggctttgctccatgaattagtgtagagctagtgtgtagtagtatgaggtacgtatctgaagaatcccagcagcaaattaacaatttgttgctcaggtattgtaaggtgatcatttcttgcggtttgtataattggatcatgtggtgtgtatgcgggttgatatatattgtggtgtaccacgcggcatgggtt

SEQ ID NO: 25205 - DNA, 705 bp, Sorghum bicolor
  Clone ID: 30948509
tgatagatgatacggacggacttttgcttgcttgcttggcattgccgccgccggcgccgccgccttggagtgcctgcctgtgggctggctgtgcgtgcctttcttttggtccttgtcgtgcacgcatgtgagtgtgtgtgtgtgcgcgcgcgcgctctggcgtcgtcgtcctcggctgtcgcgtgtcgctggaaccgtcggatccaaatcgagtgatccagtaactatcacgggtgtgtttaggccccatttagttacaagcggcaaattttaactcctatcgtatctaatggttggatacatacaaactatttatacgaaactaaaaacataactcgagagtattttcttttaaagaaccagaggagtctaggtatgattagatactaattacttccgactaaacacgtccttaatcggagctacagttatccgtggccggtcgttaacgaagagacgcgcgatgcggcatcagtagtactgtacgtaggagtactgtttagggcaggtgcgtggggccggtctgtcagagcggcggccaatgagagagcactagtgttacgtagtactactgtacggggctggtactgtgctgcaccaggggagtggcccagcgagcatcgcagtgcgggcgatctgcgttgaatgcttttgatgaacagaccaccgcatcatgattgacatggctatactataataatacgg

SEQ ID NO: 25206 - DNA, 546 bp, Sorghum bicolor
  Clone ID: 30948511
gggcattagagctcggctaacggcatttgggacataagagagagggagacgggggccggggcggtatggagcttgacgaggaggcgttcttggacgagctcatgtcgctgcggcgggaggcggcggcgtcgtccgcgccgtggcagcaagctgatccctgtagtgcctacccgggcgcaggcggaggcggcggcggcatgatgatgagcgacctcctcttctacggcgggacgacggagggcgccgccgccgacgccaccagcatggacctctcgccgttccaccaggagccgctgcaggcgcccatgccgcccgcggcggcccggaccccgctcccgcccccgcacccgcacgaggagttcaactttgactgcctgagcgaggtctgcaacccgtacaggagcggcggcggcggcgtcgccgtcccgggggccgaggccgtagcggtgcccggacacaaacaggcgcttgctgcactccacgacgccatggtggaggaggagacgagcggtgaccttgacctgcagggacagcagcactatggag

SEQ ID NO: 25207 - DNA, 634 bp, Sorghum bicolor
  Clone ID: 30948527
accaccgtccccaaatgtcccgtcaccaccaccaccaccacgccgccgccgccgccatagctgccgtgttctttctcctcacggcacctccttgcgctgccgaccctaacgacgagcgttgcctgtcccacctgcaccagtccctctacgatccctccggcggtctcaactggaccaaggcggcgatctcggcgccgtgcgatggctttttctcgcacctccaaggcgtgacctgcaacaacgggcgggtgtacaagctagccctcccggagctctcgctcgggggcaccatcccgccggagctctccaactgcaccaacctccagtcgctggacctctccgcgaacgcgctgtccggcgccatcccgacggagctctccgcgctgctgaacctcgccgtgctcaacctctccgcgaacgcgctctccggcgccatcccgcgggagctcgccagctgcgcctacctcaacgtcatagatctccatggcaaccagctgtccggccccatccccgacgagctcggcctcctcgtcaggctctcgaccttcgacgtctcctacaaccgcctctcgggccccatccccgtgctcctcgccaaccgcaccggcgctggcagcacggcagccgtcgggac

SEQ ID NO: 25208 - DNA, 663 bp, Sorghum bicolor
  Clone ID: 30948529
acaaccccccctcctcctcggcttctcccaacaccgccgccgccgccggccgccgcatcctccttctcgggctccggccaggtggagactggagaaggatgctgatgaacttcagggactggatctcgtaccgcctcgggtcctcgctgctgtccgccaggccgttcgcgctctcccccggcgccgatgacgccgtcgcctccgagggtgatgctcatggtacaacacacaatgactatgtagatactgttactgccagcccattttcttctaatgatacacgggtgtcagatgtcacaaccaactctaatagtggtgcaacttattctggtactgttcgacaagatgacgataacaagaagtcagatccattgatgaaagtcgaggcgcttcaaatcaagtttctgcggttagtatacagaactggagtgtctcccagtgctgatgtagttgcacaggttctgtacaggttgcagcttgcaaacttgattaaagctggtgaagcagttgccaggagaccaaaccttgctatcaacaaagccagagttatagctgcacagcaagaagcaccgggtgggcctgatctggacgtctcgttgcgaatccttcttctgagaaagactggtgtgggaaagagtgccacgataaattcaattttcgatg

SEQ ID NO: 25209 - DNA, 674 bp, Sorghum bicolor
  Clone ID: 30948537
ggctctgggtcgtcggcgagctcgcacgcgacgcgaccgccgcagcgatcccgccccgcccgtcggcgccggcggacctagaccgcctccgctccgcagcttctcgctcaggcctcagcaactctcgctgacccaccccccgtggctccagccatggaagccgccagcggcggaggccagctcttctccgtggaccccttggagcgccaggccgcgcggggccacggcgtcgtgacctccatggctgccggcagcgacgtcatcgtcctcggcacctcccgcggctggctcgtccgccacgacttctcctttgaggacgcccacgatctcgacctcgggagcggccgctccggcgaccactccgtgcaccgggtgttcctggaccccggcggcaagcactgcgtcgccacggtggtccacccggggggcgtcgagacgtactaccaccacgcgaggtggccgcgacccaagccgctcccccgcctccggggcctcctcgtcaatgccgtcgcctggaaccgccagtccatcacggaagcgtcgaccaaggaggtgatcctgggcaccgagagcggccagatcttcgagatggccgtcgatgaggctgacaagagggagaagtatgtcaagccgctcttcgagctcactgagcaaagggagggcatcaaggacct

SEQ ID NO: 25210 - DNA, 672 bp, Sorghum bicolor
  Clone ID: 30948563
gtcgagtctccaatgccacttgccacatctcgtcgccgctcctacctctcaccgccactccaccaccatggctgccccaagggttgcccctagcgtcgcgcatgaccacgccagccccgtcgcggtggcctcggctctggtgaacccctgcgcgggtgggcgcctgacgcggaaaccgcaccaccggcgacgttgatcgagccggcctacgcgagcagcacccggcaacttggtgtcctcagcacaggcgagcatgaccatttcagcttgtgccggtagcccttgaaccggtgactgtacggatctctgtccaggcttcgcctctgcactggatttcgtccccgctccgcctttgcatcggatctcctccccttctggttcgtatgtgcatcgtcgtctgcatcgagacgagaacaaggttacaaagaggttatatttcttttgctcttctacactgtgaattgccagaatgccagcagtttagaagatcgtattatatatataataagtttgtttgtgcgatggaggggaggacttggctaagcagcagccagtaggctatattaaggaaccacagctgggtattagagcacgacactatgacattgcaactagaccacaaaaaaattagtaagtcagcattgttactggtagtctatgacagcacgtctg

SEQ ID NO: 25211 - DNA, 289 bp, Sorghum bicolor
  Clone ID: 30948569
gtgtttggcacccttcacgtcgtcaacctcgagcttggactcgatcgtagcctccgcatcggttgatcgtgtcgagatgacgatcgagtctataagctgcaaccattgcagctagcgagaaagcacagaggcgagcagtggataggtgggcagcagcaatggcggggcttcacttcttgctcgtgccgctggtggcacagggccacatcatcccgatggtggacctggcccgcctcctcgccggccggggcgcgcgagtcaccgtggtgaccacgcccgtcacgccgcg

SEQ ID NO: 25212 - DNA, 415 bp, Sorghum bicolor
  Clone ID: 30948571
gcaacagcgcaagcacgcagctttgcctcccttcccttcccttcccttccactccccgcctccactcctcactcactgcgcgcggccactccactgcatgccccgcctccccaaaccctagtaactcccaaccctccgagcggagcgataccctggtctgtggtctcgccagtgccgcgctgcacccgggcatgccgccgccattgggtggcgcgggcgaggcccactgatccgtccgccggggagccgccgccgccgccgctgttcctccctcggtgtccactggggaggagtggagatcccgccggaagcggagggaggaaccacctctgctgtcgcaagttctgcggacgctgacattggtgaaagatgaggatcaagcttgcctgtttgcttctcatctttgtgcaagtgc

SEQ ID NO: 25213 - DNA, 490 bp, Sorghum bicolor
  unsure (1)..(490): unsure at all n locations
  Clone ID: 30948617
gtggtcctcccgctcgcctcgtccgcgtcggcgtcggacgcccaccccccgcatccagcttccgccgtcggccctgcgaggtccgaggtccgactccggctccgaggctccccgtcgctggctctctgccccttgcccgccagtgccaggtcgccggtcacccggctcccgccccccggctggcaggcctcgctcaggcgcccagcggcctaggccaggccgccagttgcccaggccaggtcgtcggatgcctggctagtagaattgatccccgcccagacggnatcggcgacgacgagggaaacgctagtggtggcggacattgcgcgcgctaccttttcaacgttttgacgcagaggaggttgcttcgtttgaaagcgcaccgggcacctgctggtcctgctccgctcctgcgccgcttgggtttcggaatccggcttgtgccatagcgtgcatatcacgcgaaacgcacaaggacgaaccctataca

SEQ ID NO: 25214 - DNA, 495 bp, Sorghum bicolor
  Clone ID: 30948631
gactaggaaatttagtaaaagcaacatataatttattgggattaagaacttatttcccacccggagagaaggaaacaaaagcatggactattttttcaggcatgactgcaccacaggcagctggagttattcatagtgactttcagaaaggattcatcagagctgaaactgtatcctatgatgattttgttgcagctggtttttttggagtagcaagggagaaagggctgttgaggttggaagggaaggattatgttgtgcaggaaggagatgtcatgcttttcagattcaatgtgtgacaacaatagtagcaaaaagcttcaaaaccccggaatttgtcctaggcagaatatagtttgcccatactgtgacatttttttggccttttgacccccgattaatttaccagcattatttttttttttatgaggaaaaatacaatggttcattctgtatgagtatcatatgttaaagaaaggcccctttgcaatagtt

SEQ ID NO: 25215 - DNA, 589 bp, Sorghum bicolor
  Clone ID: 30948639
atgcagcaagcctttccatcagcaaggaatgcaggttaagaaattagtttaagattgtaattccaatgtcttttacagaacccaaagtagttaattccttgcataattggctgagcttgtgttagaacaaaattgtcttaatcctcatgcaaattgttcgtcgactttgtccaggttcttcactattcatggttcagctgataagatcatacctgtggaagatgcccatgagtttgcaaggcttataccaaaccacaaactatgtgtcatcaagagagcaaatcatgggtatacttctcatcgtagacaactttgtgacgctgtcatagactcgatcacatccaacgtggtatagagaaactgcagttcgcccgttggtaacaagtgcttctgctcttctacaatctgtggataaacattaggccaagtgcatctgcaatctgtagcagaacactaggccaggtaaaggagcgagttcagatgctgaaatgaaaaagagcttgaattcccaacatacgtcctgtttcagtaggaggatgattgtaacttgtaagcatgcctttcacatagatgaatatgaattcctgcc

SEQ ID NO: 25216 - DNA, 515 bp, Sorghum bicolor
  Clone ID: 30948657
atgagctggggcctgaaaatggcatggctggtgctggacgggagcctgccgaaccagaagctgccgcctccgccattggatctgcctcagtgctaggcgcgcgtcagagactcaagaacaatggccaatgttggtttcctcgatcagttccactgcattattatattacccatcatcaatgcgcagcttcgtttgctcgatcagttgccgttttgcatggtattgtacctcgatttttctgcagcttacgtcgcgacaatttcttttcctagttggtgtgattctttttgttaatggattattcctgatttcccatcgtttctgttgtgcttcgttcggcggccatgtttcttgtaatctttcttgtagctcaaagcttgcctgtagctttttgtgtgtgtgtgtgtgtgtgtgtgtgtgtgttatgggtgcaatgtacccttgcgcttggcctggtatgactaataaaaagtgtaacgtgactgatttctctgaattaagatagagtttgtgtc

SEQ ID NO: 25217 - DNA, 125 bp, Sorghum bicolor
  Clone ID: 30948751
gttgtttccttgatgttactacatactgtactatcatgcataggcatcgtttgtagagtgtagactagtgaaactgtatctgtagtggacagttcagcttcagcatggttcgtttccttgccctt

SEQ ID NO: 25218 - DNA, 431 bp, Sorghum bicolor
  Clone ID: 30948803
aaaaaaaaaaaaaaggctactggatacatggaataaggcactaaccacctttgcgtttgtctgccattttgccacggaaatgcggtggcgcccagggcagttcaaagcaaaggggaagcagaccagagtccggagctccgcagcctgctgcttgtattggaaagcatgcgctgatcagtgatgttccggccggccgaagcgccaacacaacaacgccttgtcctgattgcctccctgcgttgtcttccaccatcgcggtggttggcaagtcacgacgcggcgccgtttggtaggaacaggaccagcgttttctcttactcattcaaacactactagcagtagttactactgctgatgtgcttcatggtcaggagatggaggatgatccatccatgtggatgtggtggtccgtggtcggcagcgatcggacg

SEQ ID NO: 25219 - DNA, 616 bp, Sorghum bicolor
  Clone ID: 30948829
accccgactcgataaacccttctctcgtccgcctccgctcctctcccgcttctctcccgcttcgtcttccccacccgcggcgcgccgcacccccaaaaccctaaccctagattgcgagaggacatggccagcaagtttgggctcgccggcggcatcccggagaggcgagtgaggccgatctgggacgcagtcgactcgcgccagtacaaggccgcgctcaagctctgcaccgggctcctcgccaagcatcccacatccccctacgcgctagccctcaaggctcttattctggaaaggatgggaaagcctgatgaagcattgagcgtgtccctgaatgccaaggagctattgtattctgacaacatttttcattttgatgatcttacacttagcactctacagatagtatttcaaaggcttgaccgattggatctggctacttcgtgctatgagtatgcctgtacaaagtatccaagtaacttggaattaatgatgggactttttaattgctatgttagagagtactcatacgtgaaacaacagcagacagctctcaaaatgtacaaaactgtaggagaagaaaggtttttgctttgggcagtttgcagcattcagc

SEQ ID NO: 25220 - DNA, 530 bp, Sorghum bicolor
  unsure (1)..(530): unsure at all n locations
  Clone ID: 30948843
gagccttctgcgtctcgacccttctcctcctcgctcgctcggtctccctctccctcccgataggagcagcggcgacaacgcccttgcggcacgcacccccacggtggccatccccggccaccacggagcggtgcgaccgggccccgctggtcgccgccggcttggctcccggcgctgcctccttttttccggtgggcatgcgctcgacgaaaccctagctgcatcttcatcgctgctggtggcgacggcgaagctccgcggctgcttcatgcggtctccataatacatagacgtgaaaatgactccatgcctgatgacacggtccggtccttgcatgatgttttgtgcattgtgaagagaaccccgaaagacaaaatcctggatacattaatctggatctcactgtatagaccctaaccatgcggactttcnggaagttggagcactacttactctgctgtgaacttatttgattttgataggctgaagtttagtacctagccttctgcagctaactgagttctttggtg

SEQ ID NO: 25221 - DNA, 541 bp, Sorghum bicolor
  Clone ID: 30948847
actcgcagcacaacagaacaagcagtgagttcgtttgtcaacaaagggcctacctctagctaaagagaaatggcgtcctcatctgctctccgttccagcgcctctgtcgtagtcgtcgtcgttgtggcagtggtgctgctcgccaccatgggagccgaggccgagacaagaaagtaccagttcgatgtgcaaatgaccagcgtgacgcggctgtgcggcacgaagagcattgtgacggtgaacggacagtacccaggtcccacgctgttcgcgagggagggcgaccacgtggaggtcaacgtggtcaaccgctccccctacaacatcagcatccactggcacggcgtgcggcagctgctgagcgggtgggcggacgggccctcctacatcacgcagtgcccaatccaacccggccagagctacgtgtaccggtaccagatcgtcggacagcgcggcacgctgtggtggcacgcgcacatctcctggctccgcgccaccgtctacgggcccatcgtcatcctgccccccgccggcgtgccgt

SEQ ID NO: 25222 - DNA, 553 bp, Sorghum bicolor
  Clone ID: 30948863
gcctactaccgccctctgcctcggcttcttccatggtttgctcttagccaccaacatcccgcagtcatggtcaccaacttcctgcggaaatatcagctccagaaccaccacctcgtacttccaaagaagcagttcgtcacctacgccctctacgcgctcatcgccctcgccttcttgcaccaccttatcttctaccccgcacccgcatctgagaaatcagtggtggtggcgcaggtacaagacgaggttgcagcgggtgtctcagctgctcgggtgaatgcgcgtgagcacctgcttcctccgcctcctcctcctcagcaaggagatgaagtattgaggaatcaacgagctcaaggagtagtagccaaagaagtgccatcgccggcgccggcgccgccgtgcgactactccgacggcgagtgggtgccggacgcgcgctcgccgctgtacattggcacgagctgtggcaccatcaaggacgggcagaactgcatggcgcacggccggccggacaccggctacctttactggcgttggcggccacggcgctgcg

SEQ ID NO: 25223 - DNA, 447 bp, Sorghum bicolor
  Clone ID: 30948901
gctcattttgggatggttgcagctgctaggtggattgcgaagctctcagggccttgtctggcacaagcattgcacatgtacccagactttaaaataaaggttgttggacattcactgggaggcggtacagctgctctgttgacatacattctgagggagcagaaggagtttgcttctactacttgtctggcgtttgctccagctgcatgtatgacatgggaactggcagagtctggagtgcattttatcactacagtcatcaatggaactgatctggttccaacattttctgctgcgtcagtagatgatcttcgttcagaggttacagcatctgcttggctaaatgatctccgtcaccaaattgaacaaaccagaatcctaagcaccttttatcgttcagcatcagccttgggatcacgacttccttctatggcaaatgctaaagca

SEQ ID NO: 25224 - DNA, 728 bp, Sorghum bicolor
  Clone ID: 30948933
agaaattataaaaaccaaaatgcatgactctgatacataattaatatatactttttctaaaatcagtgaaaatacttagcatttgaactcactctccaatccttataggattgcttgacaatttagtttgaagacctactgctctttaagctttggacttatcgtttggtaatcagcctatgaactctaacctgaaatggtatgtatataattttttttaagcctggtctacctactgcaactaatactagtgtcactagtgtttttctagacttgtcagtatttttctttcatagagatataactttgatgtttcattggcaatttggcacttctttgcacgagatgtataagttctttggtgcttttcatgcttaaataagcttttaactgtatccttatacgcagaaggattaaactatctggttaatgtgagtatattcattgatgcataaatgattgcagcgtgactgtctactagtgtgttaatgttgagatgtaattcaactcttgcttggctgaaaggatggagatgagaagtgaggaaggacgtaacaagattctgttgaatgagccttgagagagaagattgcaaaatcagacatgtttaatcgacaatcgttatgtattgtacaatatatttagatggttccaacttagttgattgtagtagcaaaatatgtatggccatgatataatatttattaatgaaatggccattcaagaga

SEQ ID NO: 25225 - DNA, 580 bp, Sorghum bicolor
  Clone ID: 30948956
ccgccgggggtgtccgggagcgggaggatgtcgacgagggaggcgcccactatgccggtgcagccgacgacgagggccacgctctggaacggacgtcgctccgccgtcgccgtcgcgtgctcgtcctggcgcctccgggtggcaccgatggctcccctccaccaccagctcatgctcatctcggcgccggccggcctggagatagtgtaaacgtcgtctccggtttgctatgtggggagcttgaggcttgtgctggtggcgccctcggatgtcctaccagtcgttgactccgatggccgctgatgccgactgagaacctaccactcgatcgacccgctgagcaatcaggtgaaagaaacaagcacggcaaagcgctcagggtgaaggtgaatcattgctctgctccaaccgcaatatagtggcactagcgtctttgcactggcttgaatccacatcaggcttccttcctgaggtcttgtttagtttaaaaaatttacaaaataaacactgtagcacttttatttctatttgataaatattgtctaatcatagactaactaggatcaaaaaaatgtctcgc

SEQ ID NO: 25226 - DNA, 634 bp, Sorghum bicolor
  Clone ID: 30948958
ctcaatcaaaagttggccttcaaatattttggacccttccgcattcttgaacgtgttggtgccgtggcctacaagttggagcttccgccatccacatcaatccacccggtatttcacgtatcccagttaaagggtgctgttctggactcttcccaagtaattcatactgttcctaatgatctgtctagtccaagagttcctcagtgttttcttcagcgtcgccttatcactcggggtgtgactgctgttcaccaagtattggtgcattggtccggatggcctgaggcactcgcaacttgggaagatgtggattacatgaagcaggtgttcccttatgcacccgcttgggggcaagtggtgactcaagaaggggagaatgttaccactgctgatgcacagcatgaagatacaaggcgcagcatgaggacaacaaggcccaacccgcgctgcgtcggcaaggaatggtccaagtaaaggaggcccaactcatctcgacaagattgcttagactaatgtaacgattacgttttctagtattcttttgcgtattcgacagcctgcctgcgtgcggcatatattgctggacatccagccagatgggaacttagctggtaacagaacaaatcaactctag

SEQ ID NO: 25227 - DNA, 605 bp, Sorghum bicolor
  Clone ID: 30948964
tttgcaagcttgttcgctgtgggagaaagttgatgtcccagtcatgctcaggaaatttgatagtggagtgaaggtgatccagaccaagacacatagtgatgaagaggtatttgcgagaatctcatcacttgcacagaagccggatgctcttcagaaagggattagcccaagtgatgctgcattcacactgggaattgctccagcattagcaaaggagcatcttctaaatgcagaaaacaaaggcctgttgtgcagagatgttagtccagatggattccgcttttttatcaatttatttaatgaaattgatgcccaaaatatttactcgcaaaaaccccatgggctgtacaacgcgtggatctccgttgcgatggcatctcactgacactggttagatcgactgggatatatgaagacactggttgatcaagctggacattatagtatattctttgaaaaagttcgatcaagcctgatattggtgcgatcataatgtatcctttgaaaacgttagtctgcatatctcgccattatgtaccatagcaccaaaagatgtcatataacaaatccatttattctgtttaatgaaatagcatttgagtgcg

SEQ ID NO: 25228 - DNA, 666 bp, Sorghum bicolor
  Clone ID: 30949031
acgagtcagatcattgccatcattctcatcgctctcgtgctcggtcaagatcgcatctccctcagtgcgcgcagagaacaagtgattcaagagctgaaacgattgccgcagttgatacacgaggcactgcagctcgaagaacagatcaagaagctggccctcgagttgtccaatgtcaagagcttgtttctgattggtcgcggctttcaacgcgccacgtgtctggaagcagcgctgaagatcaaagagattgcctacatccactcggaggctattctcgcgggtgaattgaagcacggtcccctcgccctgatcgacgagcacgcgacagtcatcttcttcctggcccaggacagtgtgcacagcaaggctcagaatgcactgcatcagatcacggcacgcaagggtcgaccagtggtggtgtgcagcgaggtcgacgaacacctcgccaagactggactgcccatcatcaaggtgccgcacacggtggactgtctgcagaccatcgtcaatatcgtgcccatgcagctcttggcctatcacctcgccgtgttgaagggcttcaatgtggatcaaccgcgcaatctcgccaagtctgtcaccgtcgagtaacaacaatgtacatagttcaataatagtaatagtggtaataaatgcgtcaatatc

SEQ ID NO: 25229 - DNA, 680 bp, Sorghum bicolor
  Clone ID: 30949040
caatggtcacgttgttagacaaccatgacttggaacgtcgcattatgagtcatgcccgaaccaagcacacaggtgttggcagtggtcttagcatggccatcaaagtggcgaagttgtgcttaggcgccttgttcacaatccgtggcattcctcaactttactatggcaccgaacttggacttgaaggatggaagaccgagcaaactgactgcgatctccgtcgagattttccgtgggaaatgattggtcagaacaaccaaccaatgaatcagtaccagaaagagcgtgagatatatgactggaccaaggctcttatcactatgcgcaagaataatgcagcgttcagatacggcactacgatcactttatgggccgacgcacttgtctacgcttttctgagaatttcgacgcacgatgttgccctggtgatcatcaacaacgggtacttaccaatgcccgagccaattgggttgagattgaaccacgatcaaatccctcaatgggtcatcagccacattcgcaatggtaatttgaagcactggcagactggtcaagttttgacggtcaactccaacgacatggttcatttgacggtcaatggcaagactattgacatttactgtacaaactagcaagcgcagggctttatctccgactaggcaaataaatcaatttcactc

SEQ ID NO: 25230 - DNA, 618 bp, Sorghum bicolor
  Clone ID: 30949076
gatttcctcaaaaataaatatgagtcgcacgtctagccatagtagtggtgttcaacctgtcgaacatcacgaagaaagaatcatgaccaaacagatcacgcaagacgacataatctactttatcgtcactgatcgattctttggcgtaaataagaggcataataatggctacgtctctgacaaaagcatgcacggtggcacgctcgacggcgtcattgacaagttggactacctgagagaactgggcgtcacagctatctgggtcactcctgcataccaaaacatccagaagtttggtgacacggagccttatcattactactggccattggacttcaaacaaatggattctcgattgctcgacggatcgcatctaagtagatctacggacctcagcactttcaaagatttcgttactcaatgcgagaaaagaggctttaaaatcattctcgatatgatcgtgaatcactgtggctacggcgctgaaaagaacttcccacccaactggtttaatcctcctggcaacaactctaatattttcactaaatgggttggaggcttgccagacttcgatcaagacaagcccgaagtgttgcactaccacatcgatcaaatgga

SEQ ID NO: 25231 - DNA, 615 bp, Sorghum bicolor
  Clone ID: 30949097
aaatggccgaacaaaaaaaagagaaaaggaacgagccagacaccggcggggctgcatgcgagctcaccccgttgccccgtgcctgagcgactgaacggggcaacgaggtgagcatgcacgaacgcacgggcggcggcagtgcggcacggaggctgggagctgtcgccggcctacggcgctgcgctgtgctacatgcggcatgcctgcacagcagagggcagaggcgcgtggatggacgtaggtcttatgcacttgtgtttgcaatatgcaataaggggaaaaaacatatgtaataccttctcgccaagagcatcctgaatcacgagggtatcactggacatcctagaaactgcttggcctgttgtcaattctgtgtcgaagaatgcaatatcctgtctcaagacagcattgaggtataaagaacggattcgagctgactgcctttctcctgccatcgtccaacatgacacctctgggacaagtgaaaagccgagccttttaattcaactgtacaatcagaagtagattctagcaaagaaataggtggaggaagaatatgcagcaaattccttttgagactgctaatgccttaaagcatgacgatacatatgattc

SEQ ID NO: 25232 - DNA, 654 bp, Sorghum bicolor
  unsure (1)..(654): unsure at all n locations
  Clone ID: 30949123
gcctactgaagtgcgttgctgtctctcgcatcacaccgcccacttctccacacatccatcttagaaaaactacccccagtcaatgcgcaagatctcaagaccgattcttcccacacatcacgcgcatgtccgccgccgccgccccacctcatctttgggatgcgccggcacccaccaccgcgccactatctgcacatggcctcctctgctgtctgcatctcgagtcccaacacgcatcccaccgcaatcgtcagtccgcgcccacaatgtcgatgcgctatcgaggacgagcagctcgagaagtcgccaccagcaagctgtggtttcaacacccctgcccaacttttcatctccgtcttgcagggatgacagactgaaggactcatcgtcaaccgtcccgatgcctggcccctacttcgtgagcttcggatctagagcctgcaatccggcctcgatcttgatccagtctgcatcatcatcttccctgcagtggcactcccctccaatctcagaatcgcgaggaggtccgaggaggaggtggttggatccaatggaggataatcgcattctcatcccatatgcaatgtgaacgcccacgaaacagtgccgtctattatatattcccnggcatgcacttcgcctctctgcatcaca

SEQ ID NO: 25233 - DNA, 625 bp, Sorghum bicolor
  Clone ID: 30949143
ccattctggtattccttctacatatattcgaatgaaaaagctatttgcatggactggtatgaaggctgcagtcacttcctttgtgcgtgcttgcctggtatgtcaacaggccaagtctgatcgtgctcgtctacctggcttacttcagccgttacctgttccaaccactgcctggcacactatatcgatggatttcatcgaaggattgcctacttcaggtaatgccaattgcattctggtgattgtggattcctttacaaaatatggtcatttcctaccgcttcatcacccatatactgcaagttcagtcaccaaggtttttctgtcaaacatttactgtcagcatggcttgccatcagcaattgtttctgaccgtgaccgggtctttacttcaaaattttggcaagagctttttcgtctggccgatgtgcaactctgtatgagtaccagttaccatccacagtctaacggtcaaaccgaacgtctcaatcagacattggagacattccttaggtgctttgtacacgcttgcccatccaaatggagcaattggttaccccttgcagcttattggtataacacttgtactcactcggcgctcggtcgaagcccctttgaagctttg

SEQ ID NO: 25234 - DNA, 683 bp, Sorghum bicolor
  Clone ID: 30949151
ggcttagtcatttcacaagtagcactgacgttgtatctgtcatcagagcagtctgggtttctgttcatgaaccatggcatcccgagaacttctacattggatgttctttcttcttgttcattctcggcatgaggttcataggtagaaagaataagaagcttttctgggtttcagcgattgcacctgtgctctcagttgcattgtctactctcatggtctatatgacaagagctgataagcatggtgtaaagatcatacaaaaagtggatgccggcatcaatgcgagctcaatcaagcagataaatttcaatggatcctatgtttctgaatgtgcaaagatagctcttatttgtgctgttattgctctaacggaagctatcgctgttggccgctctttttcagtcataaatggttataaattggatggaaataaggaaatgcttgcaatgggcttcatgaatgtagcaggatccatgtcgtcttgctatgtggcaactgggtctttctcccgcacagctgtgaacttcaccgctggctgtaagacaacaatgtcaaatgttgtcatggctgtcactgttatggttgccttggagctgctcaccaagctcctgtactatacgccagtgtctatacttgcatcaatcattctatcagccctcccagggctaatcaatttccaggaa

SEQ ID NO: 25235 - DNA, 594 bp, Sorghum bicolor
  Clone ID: 30949153
gtgctgtgcccgcacggaggccggagcggtacgcagcccctccaaagtccaaacagctctagtttagcacaggaaaaacccaaacacaccacagcaccgtcgccatgtccgccgccgcagccgactggctcccgtcagcgtccgtgacggcgtccggccgcccggtgctttccactggcgaggtggagcggaatctcctcccgctcgtcgacctcgagcccgaggagaacccgggcctcgcgccgctccgcgcctgcctcctcgcgctcacttcccaccgcctcatcttcctccacgagccgtcccgctccgcgcggggcctcccgctcgccaccgccgtccatgcctatcctccccaccgcaggcacagccacaaccccctccgctccctcttctcctcctcgtcctcgtcttcctcgtcgcagcatcaccgcatccgcctccagatctccatgccgcccgcgcgatcggaggtcgtcgccatcgtcgtgacctgtaaggctgacgttgatgtgttcttcgggaggcttctcgaggcgatccgcgcctgcggagggcatcgcgatccggatgcccgttgttggggtctcgggg

SEQ ID NO: 25236 - DNA, 571 bp, Sorghum bicolor
  Clone ID: 30949172
atacgtatttttctgggttgcggcgggagactgtactgaggaaaaagtactccccgccttggcaaagtccctcctcagtcctcaccaatccccttcctccattcctctccccgtaccatggctcgcggggccgcgcttagcccgcctttgcacgtctcctccgtttaaaacaccccacctttgctggtggggtgaggaaccctagattggttggagttggatggatgattgcttgttttgttagtttctttgctgtccctgaaatccaaacattccttcctgggatcagtgctccaattatctgaagtagtttgccttttgggtacttgtttgtgttttttttcccgaaactgcctggggttctgtttcagctgaaacggctgtccacacgttctgtgtttgagacctcttcggatttagtgttacagtgaaatttggttgcccggtgttcagtcagtgtacccctggattttagcagagcatcaagcgttctgttccaaggaattttaattgatcctatgctcattgatttatcttaactttggagtaccagtgatgcaaggggacacta

SEQ ID NO: 25237 - DNA, 529 bp, Sorghum bicolor
  Clone ID: 30949183
gatgcttctcctgcaagattgaagccaaatctctactccgcgccgccaggccaccgctcttagcggcgccagagcgccgcgcggtctcgctgccctcccccgccggcggacaccctccgcgccgccccgggcgcctccatcccgaccgcggccgctcggagcggagtccggccgcctacctccaggacgtccattccacccgccggccgccgcgagtccgcctcgccatccgcatcttggacctcctgtactcgatccatggcacctttccccaatcagcagctacgacctcgcctctgcagtacacgtcccctcctaggtgcctggcggagagggaggtggtccgagacgaagccgggacgctgtagaggagaggggaggtcaggtgcactgccgctcgccccaagtcacagctaccctccgctgctcgacgccggacgagtggtgcagttcggctacggggcatgatgcaagtcgatttcaaccagcaccaggatcttgtcagactgcattccaattaagcagagga

SEQ ID NO: 25238 - DNA, 606 bp, Sorghum bicolor
  Clone ID: 30949202
gacgttagacctcccgcaagcgtaattttttctttcccgaagtgactccgactcctcgtctcctcctcccctcgcgtaccctccatctctctctcaaggaggacgcggccacagcagcatcctcctcctcacctgctccctcgcccttctgttcgccgtcatcggccctcctccctcatccctgacccgccctagatctgccgctgccggtgcccatactgaaggtcctcgccgccatccgcaccacctgaacgccctcgatccgcaccaaggttaactccatcaacgcagttcaaggtcgtcccaccaaggaagagccgcaacagcaggcacagtggtagaggcgggtagtgtttcggtaggtgacgtcgcaaccggcggaggagcgccaagctggtggggtcaagtcgcagccggcggccagcgcgctgccgctcgccgctcgctgctcagccgctcccggcttccccccatgctcgcaagcgcccagccccggcggcggtggtgcgacgcccagccttgagccgggactccctagccccggcgtcccgttcgagctccgcgtcccggctggccacagcagcatcctcctcctcacctgctccc

SEQ ID NO: 25239 - DNA, 643 bp, Sorghum bicolor
  Clone ID: 30949211
agccgccctcttccttgcggaggccgaaaaccctctcttccgccgacctctcgagacgcatcagaagtcgccgccgccgccgccgcctgccgactgccgtggagagcgcgagggagctgcgggtgctaaggtttggctcgagatggggaaggcaaagggcaagggccctaaattcgcggcggtgaagaagattatcaccaagaaaaccatcaacaagtacaaggaggatgtgctgaaccacaagaagaaggacgcggacaaggagaagctcggccggaatgtgccgcaggtttcgtcggcgttgttcttcagctacaacacggcgctggggccgccgtaccgggtgatagtggataccaacttcatcaacttctccatacagaataagctggatttggagaagggaatgatggattgcctttatgcaaaatgcaccccgtgtatcactgattgcgttatggctgagcttgaaaaacttggacagaagtatcgtgtggccttgagaatcgccaaggacccaaggttccaaagattagcatgcacacataagggaacttatgctgatgactgcattgtggagagggtcactcagcacaaatgctacatagttgctacttgtgatacagatttgaaaaggaggata

SEQ ID NO: 25240 - DNA, 571 bp, Sorghum bicolor
  Clone ID: 30949240
ttcatttaatgtaacttgagctgcaccacgacataaatagaggaaatttagcatgtgtggaatatttgcctatttaaattaccacgcgccacagacgatgcaggtcatcttgcagaccttgctcacaggtctgcgtcgactcgaataccgcggctatgattctgctggtctggccgtcactgagcccaagactaacaagatcatggtgctgcgcgaggtcggcaatgtagacaagctcgcagcactcgtgcaacagaccatcgatgcacaacagttgcagtccgctgtgttctccaatcacgtgggcattgcacacacgcgctgggccacgcacggtgaagtggcagtgcgcaacagtcacccgcagagctccacgcccgagcacgaattcgtcgtgattcacaacggcatcatcaccaactacgcgcagatacgcacctcgttggagaaagagggctacagcttccaatccgagaccgacactgaagtcgtggccaagctcgcgctctatttttatcgccatcagctcggcaagttgaatcacgtgcctgaattccgtgcggtgatcagc

SEQ ID NO: 25241 - DNA, 567 bp, Sorghum bicolor
  Clone ID: 30949246
tgttccacgcagaaaagctcgattccggcggaaggatttggactccgccaccaacgctgagtagtcgggtccgctgtccacaggaggagaagggctgatccaacgtgcggacccatccagcccaccaccatctcgaatgagtaggcgaggtcgccgccgaccaggaggatgaaacggagggaggcgttgcgtaggggtccagttcagggcggcagggcacggcaaggtcaaaggtggagggcctggaggctgtctgtctcccaccccaaagctccctgcacaacgccgttagggaccacgccatccacctcctggctccttccgagccccgatccctgaccaaagtgcagcggatgtcaagaagcaacaaaggagtatctatgagctaaggatgtttaggagagaaaccctgctctggactaatatcctgaacagatgtcctgctccgctctcaagatctccaatgctggactctaacgcctgtaactggtcctcctcgcaaacaactgcttttcttttgtaaaatgccttcaagacaagtgactgcttaggcatgtcgatttgctt

SEQ ID NO: 25242 - DNA, 541 bp, Sorghum bicolor
  Clone ID: 30949255
agccatggcggagcccggcaaagaaactgctgctacaccccctccactgccgcaagaaacggttccccatgcgctggccggcgccgccgtggcggagcccaacttgaaatttgacacgccgttttcagcctcacaagacaccgaaaccgccggcggcggtgctgccacactcgactccgctctgcctaaagcagagtcggcccaccggcctccgccgccgccgcaagagaccgtagccatggctgcggttggcgcgccggagcaaaccacgacggaggcagacgctcagcaacctgtgacaaccatgccacagaaagctgccgcattgcctccgccagctgagacacccgcgcaagagagtgcggcgccggccgcacctacgccgccgccacagaagcaagaaagcggcgttccggaacgagcctcctcggtccacgaggaggagaaggacgtggaaaaggcaagagaggagaaaggagaagagaagcccgcgcgtcgtcggtggcgatgcctccgcgccgccgtgtgcttgctgttcctc

SEQ ID NO: 25243 - DNA, 575 bp, Sorghum bicolor
  Clone ID: 30949259
cagcagttgtagtccccagtactaaattattggagaatccatgactgctgactcacactgctaggtactaaaatattggagaatctatcacggctgacttgggccactaggaaagatgatggattcttgggtttaaaagcaaccagcatagactctcaaggacatttgcctcttaacacgttttggagatttacctaacattttctttagttgtcacacttgttcagtttattcggatagactccccaggacaggatgatgtggtgtgggcctaaatgctgcttattacatggacccccctatttagttcaattgttattgtctgtacacttggctccacctcttcctcagaattcagcatatattaaaaactagaaatgtggtttgtggtttgctttgttgcttccagtctcctttcttgtacttctttagtccacacggttaggcaggcgttcgaatatcatgaacattttcaatgcttagactcccttatcattttgtgcaatgagctctgggcctctagcgtgttgctttatcaattgtatgtatattcctactgacctcctttcgtttct

SEQ ID NO: 25244 - DNA, 351 bp, Sorghum bicolor
  Clone ID: 30949261
cgctgccgtgccgcacctttccacacctaattgcacgagcacgaccttcacaccgccgtcgctcaggcatgtaagtcggatatggcctctacaggatggggcgcacaagatccataggtgcgtaatcaggtagacctcggcggcccctccctaccctctcctccatgcgctgcctccatgccggcatgagcgccatcctttcttggaaggcatcctcggtgaggtagcggccccaaatctgcccttgtcggtccattcgtgaaggagggatctctgccttcctcggtgcatgtccatgaccccaacaacacactgcggtcttgcccacctcttctcaagcgggcttgtctt

SEQ ID NO: 25245 - DNA, 458 bp, Sorghum bicolor
  Clone ID: 30949265
gtcaccggaggcactcaccgccgtcgaattattctcgtcacgctgcaagacacgccaccaggaataatatggaccggtgcaggatcctattctgccactagaattagaacccaggtttcaaattcctttggattggatgggagtcgaacctatgcatccacgggcctatttaagcatacccgctgcgctaatcctgttctcctgctccagctgctgaccgaattagttgctagaatcgtctgtttcagttccaagacttcgtgaccactagctagatgatgaacgccaagaagattaagctgcacgactaccaccgctacggatcgccgctgtgtgacccgcagctgtttccggccaccgccgcggcggggctccccttccacccggctccggggctcgtgggctccctgccgcagccgcatggcggcggctgggttcacgaggagcacaccacgacg

SEQ ID NO: 25246 - DNA, 595 bp, Sorghum bicolor
  Clone ID: 30949286
gaattgcctcgcgatgaacagacaggtctgttgcatcaagtgggcaagaagacttacatagaaagcaatattagtgcacgtatggatcggctaccatggagcagatggcacacgttgattgcagtgtcattaggcatatcgtggattatggacggactgatcgtatcgtcgctctcattggtaggctcgaagctgctagcaccagacacactagccctcacccctggcgaggtgggttggtccggcacgacgtatctgatcggtgccgtgctcggtgcgcttatatttggctatttggccgacagatatggcagacagaagctattcatcgtcactcctaccatctacttgctcgcctcgcagggagcagcattcagctgggacttttggtcgttcattgcctgcacttttgtgatcggcctcggcattggcggtgaatactctgcgatgaactcagccatcaacgagtttattccagcgaagatccgcggtacggtggacctggcgatcaacggcagttattggctgggtgtcggcatgggctgcggactgtccctcatatttctgcgcgacgatctcttcgagcccaagctag

SEQ ID NO: 25247 - DNA, 662 bp, Sorghum bicolor
  Clone ID: 30949291
tgcgacgctgccccctgccagcaccgatcccgccggcacggccactgtgggcttcaatttgtttcttacttcacccagtgggggttcaacgggaggaagcttcccacagtcccgcgcagccgccgctcctccgtcctccgcgccggggttcggcccacgcttcggccaccatccacggatttccccaccaggccatcgctggtgcttgtgcaggttgatggcgatgccgctcatcaaaggtggccccacctcccccacctccctcgccggcgatctccgtgccgttgccgagatcctgctccgtctcccgtcgcctgccgccctcgtccgcgccgcgctcgcctcgaggcgctggctccaggtcgcatcctcccccgggttcctccgcaggtaccgctcccgccacgcctcgtcggccctgctcggcctctacgttcccagggcgcacaccgggcttccctcattccagctcgcggattcagtccgctccgaccgcgccctcgccaaattcgtgcgcgggggcgacttcggtctcaccggtctcgagagccatccggagtggcgcctccttgactgccacaatggccgcctcctactctccaggggcgaatcacgcgccgtgttcgacccagcttccgcccgcgaacctgtatggcttccgc

SEQ ID NO: 25248 - DNA, 532 bp, Sorghum bicolor
  Clone ID: 30949301
attgtacaattagtttttattttcatttatatttaatgctccatacatgtgtcgagaaatcttaaaaaagtttttggtttttgaggtgaactaaataaggccttaccttgcttcttcctgatctagtcagaataatggcaccatcagccacatttggaaagtgcctttgcttcatcctgatctagtcaagaatctaacttgccactgatatacagtaggctggagccttgctgctccatcttctagaaacttcgtagtccgacgagcttcctgaacattccttggcaaccggccaaccgcaacttttgcaacttgcacacagcccgcgacaaaaagtcaggcgccggataaaaaactatcgcctacttgcagtgcccactgggagcttccatagaccatagtgggttctggaatatggaacgttctggaactttcacttcccactggggctgcccgggttcgggttcaagtggtagatgctctgcaccagcacatccacgtcgtcgtccacgtcagctccgctcccctcctc

SEQ ID NO: 25249 - DNA, 595 bp, Sorghum bicolor
  Clone ID: 30949310
cccccaaccagatcagcagcacgggccacggcggcggcagattggatcggcgctgaccttctttcttggcccggccggagcagcggaaccaatccgccgccggtcgatccttgtttatttacctaatcttgagttatctggcctggcgttgaatattgtactaggcacagcacgcattcctgagctggtccaagaaacagaggagggaagagagtctgactacgtaagctgcagtgcgtcgcgtcgtcgtctcaagagaagcgagagtgaggaggagaggagaggaggagcagagcagagacagcagcgggatggccggcgggtttggcggcggcggggcggccgccgggagggccgagttctacgagggaaagatcaccggctacttcatcctcgcctgcatcgtcggctccttcggcggatccctcttcggctatgacctcggagtctccagcggcgtgacttccatggacgacttcctgaagaagttcttcccggacgtgtaccatcgtaagcaggcgcaccttcacgagacggactactgcaagtacgacaaccaggtgcttgacgctcttcacctcgtcgctctacttcg

SEQ ID NO: 25250 - DNA, 389 bp, Sorghum bicolor
  Clone ID: 30949336
gcccccctccatctccgtcgtggtgagcttcccttccctcccctccaccgcacccccggatccttacttccttcccggcgcctgattctggagaaaaactcaacactttcggtttccttggccgtccggatctgggctccccctcggcgccggcgcgcatagttctcgcggcggatctccttcccccactcgcgctcaggctcggtcccagggattggatcttccgcgcgtcggcggcttcccctcggcggcgtccagcaacggaggggcagtcccaggctcggcggctgcgacggcggctccccctcccgcctcgcgccctcgcctccgtcctccgcgcaccggccggcgaccctgcgtcattctaggtactgcgcatgcccgcactg

SEQ ID NO: 25251 - DNA, 641 bp, Sorghum bicolor
  Clone ID: 30949368
tctaacaaattcttctgccaccttaagccagtcaacttcaagatatgcaaccacatcatcattgtaattgccaacagcgccagcaaatttccctagtatcttcacctctgagaaactctttcctatatcagataatctggccgcaaagtttgccatctcctttcccacggttgttggtgatgctggctacaagcaggaattggaaacaatttaagacagggttccaaatcatgtctttcttggcaaagcaagcgcattccactaacatacaagcaattgagcaagacaattatgttaactaataactattgtatcaaaagagctacagagctgaactccacaaagcaacactgctgaagaacaatttttttacatatagaaatatttttccgatttcctgtacaaatggaaaggttgaagattatctgccagaacagtacaataatctttttattaaatctcctagactatgttgataaatagtgcaggtttgtatttcctccacccatgttgacttggaaaaagctgaatgagttgataagtcattcaattccattcttttcattatgaacttatcaatttactatcactcaaaatcaccttgctgcatcaaccaggcaaacttacaaaacattaagccc

SEQ ID NO: 25252 - DNA, 537 bp, Sorghum bicolor
  Clone ID: 30949377
aagtatgacggagcccgcattgaagaagcgcaagctcgatcccgtcgaagcaacttacgtgttttcgcccttaaaatttagtaccctcaaggaagatttggatgacgtgccccagtcaatattaaaggatgcactgctatcaattgttaaaaatgatgcaaagcttttggtcgaattaaacaaggccattccggcagcgatggctaactggaagaaagagtcgagcgaaatagaattcatcgctgagaagccccctcagacagacctacgcagcagtctgggtgttcaaagtgctctgacagcaccgctagtcacgcaatacaaaattgacgagaaattgaacgttgaagagttacgaagctacatcagaggcttgtttctcgtcaacccatgggtctcagaccgagatgagcacgaggaaaggaggaggagacgccgtcgcaaaaactacgacagcgatgacgatagtgacagtgacaatgatagcagtgacagtagcagtagtagtgatagcgacgatgatgatagcgatgagtc

SEQ ID NO: 25253 - DNA, 576 bp, Sorghum bicolor
  unsure (1)..(576): unsure at all n locations
  Clone ID: 30949381
gcgcaccgtcacgccgccgccccgcccgcgccaccgaatcccgctcaccacctgggacgtctccatgctctccgccgactacatccagaagggcctcctctactccagaccgccattccgtctgctcgaccacctcgaggccgcgctcgcccaggcactcgtctcctattaccccgtcgccggccgcttcgccacggaccagcaccgcgacgccgacggcaacgtcgttggctgctccgtctccatcgactgcgacggccagggcgtcgacgtcatccacgccgtcgccgacggcgtctccatcgccgacgtcatccctgccgacgccgacgtcccgcgcctcgtgcgttctttcttccccctcgacggcgccgtcaaccacgacggccaccacctacctctcttcgtcgtccaggtcaccgacctcaccgacggtgtcttcctcgccttcgtctacaaccacgtgctctccgatggcactgccttctggcacttcctcaacgcctgggcgggcattgcgcgcggccgcagcctctctgtctcccctcctncgcccttgttggagcgctggtcgcc

SEQ ID NO: 25254 - DNA, 501 bp, Sorghum bicolor
  Clone ID: 30949400
gccaagcaagcacgttatcacaacggacctgccacaggaggccctgatggtccaggaattcgcgaggctcgtgcaggagatccgggatgctgggtgtaagcctgaggggaagtggccggccatcacccggaagacgcagctggttttggatgctgtgaaagcctcgattgacaaaggatctgagccagttgaggtggctagttaaatccaacaaacgagtcacttccgatcctgggtaaggccttgtttggatgttgttggattcacctcaatccatatgtgttggagtggattggggtgaaatttagttcaagttccactccaacccatcctaacatatgtggattgatgcgaatccgactacatccaaacaaggcctttgtttacacagcatggcctggtttgtgcttgcgtgatatatttacacattatgtacttctgtactgtacatgaaaccagtaaaccattattcgtgataattaaagaagtggcatcaaactc

SEQ ID NO: 25255 - DNA, 583 bp, Sorghum bicolor
  Clone ID: 30949417
agaaatctgaggatagcagactctgtttatttcttacttaattatcgagagtctctattgtaggttcaacaacaggttcaggcagaggatgagcaaggaaaaagaaaggtctagacacatagcaaggatcttcataaacaaacaccagttgaacactacactgagtggtgatcagagatggatacttctacccagtgactcgagagatcacatcagaattagctatccatttgccatcaccactgttatacacatccagggctaatcttcataaacctgaaaaaggttctacaacaggttagatgtgaaaatcacatacacacttggctcactgaaattttcagaagctgcaaaatcttgtcccatattcaaatattttacaagctgtaaaatcttgttccatcttcaaatttagaattagctagtaacctacagcatatcatgtgcacacatatgcagagagttctgaacctgcaactaactgtaagttggagagagatctgcacaatttttcgatctcttgtagcccaatctaagagcaaattctcctttgcatatatacatctgaacttgcagtcaattg

SEQ ID NO: 25256 - DNA, 578 bp, Sorghum bicolor
  Clone ID: 30949423
aaggataagggtactggaaaagatcaatccattactattcaaggctctggaggattgtctcaagctgatattgaaaagatggtgaaacaagcagaagaactgagagaagaagataaaaagagaagagaaggaattgaaatcagaaatcaagctgatactaccatctatgaaactgagaaatcactcaatgaacataaggccaaactttctgaagatgttgtgagtgagattgaaagagatatgcaagaacttagagatgctatcgcacaaaatgatagtcaaaaaatgaaggaaggtgttgaaaaggttagaaatggtgctatgaaaattggtcaagccatgtatgctaatgctaatcaaaatagtggttcatcgggatctcaagaagctaaccaaagtgaatccaatcaacaacaacaatctcaataaaagattgaatttttattttagataagaaaaaaatgttatttgtttcaaaatatttctatgatagacgattatttgtttgtgagtttgtaaaataaaataaataaattttgaggtatttcaatttgtaagattcccttccattcacttcg

SEQ ID NO: 25257 - DNA, 636 bp, Sorghum bicolor
  Clone ID: 30949438
aaaaaggtttttcatgagagttatttcaagaggcaatacttatagtatgtcgtcatatttttctcctgattttcccactgggtttttataggagttttagcgacatatctcttaatatggctcctcacatttttcctaaacggtttttagaggagttatctttatgtcgtatctccaatatttttccccactggggtttttaattggaatgccaatgacatagtggtttgtttaaatcacacaagtatatgctaccttctccttgttttcctataaaggtttaaaggagttttacaacatatccgtacatacatattcctcagatttttcccacagggtttttcgaggaatctaagcttacagctacattgatctcaaaggaagattcgatcaggggggagtgttgcgaaacggtgtctgttggtgaatagacaccttatcactaatgatctcatccgttgatacaacaagattagagaagtggattagcagttaatcataggattagcagttagtaatctccgaaggggcatgtcccttcggtggttttgtaaactgaacggttgtgtccgtacggacatgccccccttcacttgtatatattctatgagatcaatgaaagacactagttttccc

SEQ ID NO: 25258 - DNA, 669 bp, Sorghum bicolor
  Clone ID: 30949452
gatatacatgacgatcagcttaagagcttgttggatgaagctgtttcccagctgaaggcaaacactcgcagattagttcgacgtcaaagacgaagactgcaccgactgggtaaagattttgggtggaatttgcatcactttgatgcaactgaagcattctgctgtgccactggggactcatggcaaaagaaagttgttgaaccttgtgtggatgtcgtaaaaaggttcttgtccgatgattcaactgttttaccaagcacgagcgcctcagatggtgtggttgggagcgtaaggggcccgtcaagagagctgtggacacaatatgtgtgcgaggcctgtgacaaccgggtgcttcgaggggcgcacgagtgggagcagcacaagcaagggcgaggtcaccggaagcgagtgcagcgcctgaagcagaagagcctgaggccacggccattgctgtcgcaagactgcaactgatggagtgatggtgatggcagctgcaggtggccattggttttgttcccaatcgagtgatggggcatgcagttccaggtcttgagcagtagacgagctgaaaagcgttttaacatgatgaatcacatgtatgtatgtatgtatgtatgtggatggggttattggtcttgctaatgagttcagtgaagaattttttttatt

SEQ ID NO: 25259 - DNA, 519 bp, Sorghum bicolor
  Clone ID: 30949458
attcattgagaaatttccctgaggaggcaacagatccagatgtattattgccacttgccttctcatttaaggtatcgactcgtcttgaggagcttcataaggagtatcagaatccaggggcaggcaccagtgaaacttcaagtagcaagcggcttcagcccctcatagcaaaaacaatgagcagggttggcagccgtgtggtgtcaaacttaactgcagtgtcaaacttaactgcggtgtcaaacttaactgctgacagaaaatgacagacatgtttttttgttaaacgagccacaccttgttgtaacttccatgtacattgtatagaaagaaaggcctttattcccatgcttcgttctttgtttttgttaccattacattgcttttataaaccaaagtggtagaaccgcccgtcgaactaggtggggcatgggggttcctgatgtactcatttctgaagaactgtaaatacttgtggatcaatgcaatgaagtgatgttccaatgctttatttgtggg

SEQ ID NO: 25260 - DNA, 624 bp, Sorghum bicolor
  Clone ID: 30949488
ggattggtttatctttggctgaagcgtgcattaaatgggccagatccggtcactcttctgatgtcaagcattgcaaaagtcgtgacctggccagtaagatttgctcagaatcttctatggtctgcccattcacagggacgctttacaggtcggggcagggttgggcgacggcaatcagcaagagatgctcctcgacggttatggagatgctcaacctgcacctatgacaattcagcttccacagatatatgtgagatgtgcaacactgcacgagaggacaatgctttttcacagagacaggatcatcaagctggtggtaatggagaactctcagtcaatgagatacgccgaaggaggctgcaaagatttgatagatgatgtaaatcattgttatcagcgcacacattgcaccatgctaaacaaaggtctatgtatgtatgatacttgcattcctctaatagatagtgcaggcacatttggttcttctcatgatgaggaatgtttacataattgaatttgtcctcattttttgaaggagactgttactgatataattttaggttgttcaaagccttggaagtaagcaattattgcctaataatacaaattttcccagggcactcg

SEQ ID NO: 25261 - DNA, 575 bp, Sorghum bicolor
  Clone ID: 30949527
gagaacaggcgccgagcatgggagatgcaccgagttcaatcgcttgagcgggagaactatctacagggtcagattgaggctggtcttgtggagattcaccgtctcaacaacttgctacaccctattcctcgccctatacccgtgtatccagaggtgggacctcaggtgattgtggccgatgatgatggtatggaggttgatggaccagcagcggctgcaccacctttacacgaggacgtggaggacgaggagcttgagccggttagcgacgaggatggagaggcgatcttcgacgctgattcggacgacgagcctggagtgtagggagtagtgagtagttgctgccaggatcttttgttgtatgccaatcgctgtggtgcttttgtaaccatgttgtaatccgaaactttgaccttgactcatggcatgtactgtaagggtgtaataacttcacggaccctatgtgcagtctttatgatcgttatgttatgtcgatgttttccgttgtggtgcgtattgcggatatctatgtcgtgtgttggattggtgatgttgttttgtggaatggaattgtt

SEQ ID NO: 25262 - DNA, 591 bp, Sorghum bicolor
  Clone ID: 30949531
aagcggacgcagacggtgaagaatcagatcgccgccgggcagttcgcggcgtctcagggatcgtggaacgacctgctggccttcatagacaccaagagtggcagcgtcgacgtgtacaatttccttcttgacagcggcatggacccagtgtcggcagacacgccggcggcaggctcgtcgtcgtcgtcggcggcggcggccagcaacgtgcaggcgttgaggtactcgacgtacctcggcagccaggactctgctggctcctccaacaccatctccggcatcatgaacggggtcatcaaggagaagctcaagatcgtccccaaggacctcaagtgggtggaggtctccaacgccgtctactatgcgctggtcaacgatttcatgaagccaagaatcgatgaggccagtaacctcgcacgtcgtctctatatgaataagaagttgaagagatagtgccatagtggagtttgcttaactatgtttccttttatttcacagattgatgagctactatcttatggtgtgaatgtcacggtgtacaatgggcaggtcagtagtgctctgccaaacttactatctccagactccagc

SEQ ID NO: 25263 - DNA, 473 bp, Sorghum bicolor
  Clone ID: 30949533
gggtcccacggctctccgtgttggtctgtcccttggaggaatggtctccatctctttttctgtttttccccctctttgcgccctcccatgggctccatcattctttcgttggcattattgtgcagctacaatatactcctcctggtgtatcagaaatccagagctctgcgtctcaaaaaattaaaaggaaattgagagctactagtgtgagaccacgggtgctgcagtaaagcgttccagatggttggagtggcgggcatcggtcgcgagcggccggcgcaccacaactcccaaggcgagatggtcaactggaccggccaaccactgttgcctgattgatgctgctaggtggaaatgccattgttgcccgccgcagattaatgctttgttgactgactaattcttatcagcctttgtctctttaaaaaaaatggaaattgttctactactgaaacataaacaaaattctatag

SEQ ID NO: 25264 - DNA, 761 bp, Sorghum bicolor
  Clone ID: 30949549
caagttcatttgaggagctatcggttagcacatacgcaagtgaaaacatgcctattattcatgaatctaatacggatcataccatgactgcaaaaggcaaagataagtcgatcacatcaaataattcatcatcaagttctccatcttctgagatgggcagtactccagctgtacgaaggaagaaagtcaaagatgtctctgagtatatgattagtgctgcaaaagagaaccctcagatagcagaaaagatccatgctgtattacttgaaagtggagttgtgccaccacctgacttgttttcagaagaatctaaggaacaaccaaaggacctgattgtttacgacacatctatgtttcaaacaaaggatgaaatgataaggacaatgaatgagcttgagtccacagcacaagatggttgtgctggccttggtccttcattaccacatcatcctggacaggagctccaaacaaagattgttccttatcggccgcctcccgacctcaagcctgtccagggattaggtgtttaccatcagatcgatttccgggataacgtcaatccctctatacctctatatgaaccatctgcacctcaggaaaatccgttacaacttataaagcaaatgcctgttacagctgcggctgttgcaacagctgcagtggtttcatcttcaatggtcgttgctgccgcgaaatctaacggcgacattaaactagatgtgccagttgcagcagctgccactgctgctgcagttgttgct

SEQ ID NO: 25265 - DNA, 657 bp, Sorghum bicolor
  Clone ID: 30949556
agtatataggagcagatgacctagctagatggagatcgtgtggcatcatctttctgtgatctttctgggggaaacaaggcacgcacaacacaatcctttcagggtgatagcttccagagggcagtgatgggacgtccttctacttcttagcttgacagtctcttgataggaaaccaaagcggccagcgacactgattttgacactgtttaaatctatctaattttcttatgcatcaaatctggtggaacttgatgttaacttcttgggttgctgatgtgactatggagtataatggggctataactgatgaaaaactataggtagaaaacttatatacaattctatggaatctgataagcttgtgcattgctcttgtgaggttgcacagctcatgtagcatgttattgcggttgatacgttttcttaaactatcagtttgtcaaaactgaacagtacatactgacaaccattttgccaggtctttgatctttctgttgtgaagccttcagattttgttcactatggtttgagttgtttggagaagttagctgaccaaggcgataaccatgcgaaggccgttcgtgagagaatgagaattgtggttgctgggggtgacggcacagttggttgggtgcttggatgtctctcggatcttt

SEQ ID NO: 25266 - DNA, 582 bp, Sorghum bicolor
  Clone ID: 30949560
atataaattcgatgcagtctccggtgagtagggacgagggaactttccgttccggtacactcctctgcagcttgaagccggaacagctgactcctgataatattctcgtccccatcgatctcgtcggagggagggagagacatgacagccagcgcacagggtccgatctggtctcggtgctctcgttgctgcaggccctccagggaggcagggatgcgtcgggcgcgtctacgacggagttcatcgcccagttcttgacaatctggcatatgataagcaccgtccatctacagccctcggtgcaagatcagctactgtggagatggacggcgaatggacattactcgagcgccttggcatacagggcgtttttcatagggcgaatgccgttgtgtggggccaaggacgtctgggcggcctcgacaccgcccaaggccaagttcttcttttggctggctctccacgggcgcctttggacagcctaacgcagacgacgtcatggcctacaggcaattgatgactgcgcgctgtgtgaccagcagccggagacgaccgaccacttgctggtggcatgtgtgttca

SEQ ID NO: 25267 - DNA, 589 bp, Sorghum bicolor
  Clone ID: 30949578
atgtatcttaggagtaaactactttagtagcttagtgctatcatagtgagtagagagtgaggagttccaaggaggagtcccggcctgtcgggagtcttcttcgcggagcacctcagcggaagcaggtcttcttatggacgcacccgcttcacctcgtcccagtgacactttcttgcacgagtttggcactcctaccctgctctggagagtgttacagactattgggtacactgagccacctcagtattcttggtgggagatggagagcacaggagggatccagtggtttgctgtgcagggagttgtccctccacatgggggcaagcctgcatggacaggctggacgtgcagctcagatgggcagactccctgggaggcagctcaggttgcagcccagactatcctgctagatatatgtcagaggtgtggtgacgagctgacgggaggaccagcggcctccattcctagtgctgacccagcagccgcggagtggaaacaggctgatggttgtgctttggttcgaggtagaggggagagagctgagagctctagtcccgctatgagtgctatgatggctgtactcaagctg

SEQ ID NO: 25268 - DNA, 624 bp, Sorghum bicolor
  Clone ID: 30949579
tccgcagtccggcaccagcaccgtagccactgggcagacgaggagaagcttcgcggacgccatgtcctcgccgtcgccgctgtgcgccgcctcctgctccaccgctctccgcgcgccgccgcctctccttcgcttccgtcgctcttccgctccggtatccgcctccgtggcgcgcgcggcgcccgccgtctccgacgacctcgtcctccgcatcgccgagcagctcgaggactcggtgacctccacctcccagctcctcgaccccctccgctccgcctccgcgctctccctcctctccacgccctggccgacccgccgctccagcgaggccttccgcttcactgacatctcctatctccgctccctccccatctccctcccctcccgggagcccgacctcgcgctgccgtcctcccctttctcttcgcacgtcctcttctcggatgggatcctcctatcctcctctggtgcccatgtcagcaccctcgccgatcttccccctggccgcacccgggaccgcgccgccgccgcgctcgccgcctccgctgaattcgcccacaaggacctcttctacgacttcaacgccgttggggcgagggacgtcgttgtcgtgcacgtgcctga

SEQ ID NO: 25269 - DNA, 638 bp, Sorghum bicolor
  Clone ID: 30949581
agaggaggcacacacacctatttaaactttaaccgcatcccggctacaccgggcgacgcacgcgcgctcaatttcagcagaccacacgctctcttggacatggacaggtcctactgcgcgcttgtgctcctctgcctgtgcctcggcacgctccgctccggttccgccgcgtcggtcaccaccggcacccccgacggctcggagctctgggggtacgtcgaagtccggccaaaggctcacctgttctggtggtactacaagagcccgcagaggacgtcgacgccggggaagccatggccgaccatcctctggctgcagggtggcccgggcgcgtccggcgtcgggctcggcaacttcatggaggtcgggccgctggacgtggacctgaagccgcggaattcgacgtggctgcagaaggccgacctcatcttcgtggataacccggtgggcgtcgggtacagctacgtggaggacgacagcctgctggtgaccaccgactggcagcaggcggaggacatgaccacggtggtcagggcgctcgtcaaggaggtgcccacgctgcagagcagcccgctgttcctggtcgccgagtcctacggcggcaagtacgccgccacgctgggcgtgtccgtcgcccg

SEQ ID NO: 25270 - DNA, 655 bp, Sorghum bicolor
  Clone ID: 30949582
gtgatgaaattaaacacgcatatgagagagaaagaaattaggcgatgcgtttcttttggtatgcatgtgttcggatatgccagtgcaggttgctgatcttggcagcttcagctagcggctagctagctcaagtcaatggcaccaaggcagcgttcaagatcactgcctcggcgtcgccagtgtccaagttccccacattgtacatgtcacgatcagatcaataattgtaacgacgattccttccttatcttcggtcctgacgttgccctattggcctgcgcgtgtgcagccttagctgaccattgcaagaacgttcagagctcccatctatcaatccatcggttaaccaaccaaaacgctccatggattggattcacttgtgctcaacttgacccagattatggccgatcgccgctgtcgctgtcatcggagaacgaagaagccagacgagctgcgagccatttcctacattcgctctcggactagctcagaggagctagcgacaggacaaacacaaactagcgtatttactggctctcgcgtccatctactttttccgcgcgaagttcgttcctgacaaggaaaggttgtagtagaacaattgaacaggaaggtgatggcttacaaaaaaagtcggatggatggatgcaagtgt

SEQ ID NO: 25271 - DNA, 446 bp, Sorghum bicolor
  Clone ID: 30949603
aagataggacccgacgcggcgtccctctccccgacgccccgacgcggcctccctctcccccgacgcctcgacgccaccgccggccgcggccaccctctcccccgacggcccggctccaccgcgccccgacgccccggctccaccgcgacccgacgccccggctccaccgtgccccgacgccctagcaccgccggccaaccctagcgcaagaaacaaattcggaaggaggaggaggacaaggtggtcgacaccgtcctcaccggcgagctcgccaagccgctcaccgcctactgccgatatttctatggacggcagcgcgtcatcaggaggattctccggagccgggctgcctccccgtccgacggtgtctaccatgcgacgtcgtccgttcgtcgcgccgcattcccgtgctgcgacatcgtcttctctcgatgccaacctacctc

SEQ ID NO: 25272 - DNA, 610 bp, Sorghum bicolor
  Clone ID: 30949616
ctttttttttttttttttttggcaaactcttagagatgctctcacttgaactgttccaaatagtaattaaccaaaacttacatgactagtataatgcccgtgctaacgctacggattatattaaattcaaaactaattctatcaaatttgaaatacttagcttactgagctttgtcaaagctgtttcttagcactgaactaaacacatcctacctcaagtatcatcaatgtccctagactcctccggtcaaataacaaaagaagaactatattatatagggagaacattggtgtgtaggtgcagctcgaagcacatttgtcatcctcagtccaggtacatatcttggcctaccttgcctacagtggattcagcacccgcctctctcagcttcatccattcacccagctgagtacatgaactgatccaattcggagccaactccactaagttacccagagtcaaaccttgcatgatcaaggaccatccatctcaattatctcaggtcttagagtttgctgcttcctaagaaaaacttttatacaaaaaaagctcatatggatggccttgagcttgttcgttaaaaaagggactggcatttaaatgacataa

SEQ ID NO: 25273 - DNA, 652 bp, Sorghum bicolor
  Clone ID: 30949624
aaattataatcattaaacatccaccagaacaaaatctctcaatatgttaaaagttctctcttctaaatcactttccaagacaattgctgctcaatcttcgagatttttctcaagtactggaggagcccctaaaaatgtcattggtatcgatttaggaactaccaattcttgtgtttccattatggaaggttcacaacccaaagtcattgaaaactctgaaggtctgaggaccactccttcagttgttgctttcactaatgatggccaaaaacttgttggtacacccgcaaaaagacaagctgtcacaaatcctgaaaataccctttatgctaccaagagacttattggaagaagattcgatgacccagatgttcaaaaagacatgaaacatttatcttacaaagttgttcgggataaaaatggtgatgctgctgttgaagctcgaggtcaaacttattctcctgctcaaatcggaagtttcgtcctcaataaaatgaaagaaaccgctgaagcttatcttggtaaaggtgtcaagcaagccgttgttacagtccctgcttatttcaacgatcaacagagacaagctactaaagatgctggtaaaattgccggccttgatgtcctcagaattatcaatgagcccactgctgct

SEQ ID NO: 25274 - DNA, 557 bp, Sorghum bicolor
  unsure (1)..(557): unsure at all n locations
  Clone ID: 30949632
cacagatgctgagatgctgagaacatatgcgatcgggttgctcgctatggctttgtgcagcggtgggcaattggtagaggatgtcttgactttgggggtatcagcgaagctcatgcgttttttgcgcataagagtccttggggattcctcatcttctcagagagatgctaatcatccacaagacaccaagtatcctcgaggcagagacgatagtaggggtaaatctcgtctggcccaagatggttctcgattggatggaacaagggttgggtatggagtattattaaccaacccaacagcagagaaggacaatgagcctggtgttggaatgaggcaagcatatggagaaaggtcattggatgacactgttgcttcattggataattctgatgtccccgaggctgattggaccaatgatcggtgttatggcacaagtgtttgtgacacaaagtcaaaatatgggaaaaaaaattctgtgacgaggcttcttaaagatgaagagatcagtgaanatggcgaagtgttgaaaagaaagctgggtcgagcgccctcgcgac

SEQ ID NO: 25275 - DNA, 721 bp, Sorghum bicolor
  Clone ID: 30949645
atgctcaagcaagcgtccgaggataccgaggactagatcctccaaatcagtaaatccaagccaacctcatgttgctagacacccaaattctgatccacaacccggatcaacggtgcatccaaattctgatcctgggacatcggaacaccctgactccatagttttgggaaatgttgagtcaaataatggggtgaaagaaatttccatcaattatattgattctggtgaatcatacgatcgtaagactactgttgtagacatgtatttctccgcagcaattgcagaaatctttctcaatgatccagatcctaagaccatggcagagtgcaaaaagcgctcagactgggctcaatggaaagaagcaattcaagctgagatagcctcgctcactaaaagaggggtattcacaaaagctatgcctacaccctccaaagtctttcctgtaggctttaaatgggttttcgttcggaaacggaatgagaacaatgaggtggtgagatataaagcaaggctcgtagcacaagggttcacgcagagacccggcattgattataatgaaacttattctccagtaatgagtggaattactttccgatacttaatatcattggcagttcaaaatcatctatctatgcagttgatggatgtggtgacagcatatttatatgggtcacttgattcggacatatatatgaaggttcccgatggaatccaaattccg

SEQ ID NO: 25276 - DNA, 660 bp, Sorghum bicolor
  Clone ID: 30949658
agttccccgcctccccacctccgccgccggttagggatggccgacccctccgccgccgccgccgctgcaaaccctagccctggcgccggcgaggaaggagccgcctgctctccgccgtcgccgtctcaaagggggcggggcaaggtggttatcgttatgggcgccacgggagccggcaagtcgcggctggccgtcgacctcgcgacccacttcgccggcgtcgaggtggtcagcgccgactccatgcagctctaccgcggcctcgacgtcctcaccaacaaggtccccctccacgagcagaacggtgttcctcatcatctccttagcgtgattgatccctccgttgagttcacttgccatgatttccgcgaccatgccgttccgattatacaggaaatattggatcgcggtggcctccctgtgattgtcggcggcacaaacttctacatccagagtcttgttagcccattcctctttgatgatatggcagaagaaatgcacgactgtactttgagagaacacatagatgatgatagaggccttaccaatgatgatgaaggcagtgggtatgaacgcttgaaggatattgatcctgtggctgcgcaaaggatccatccaaacgaccatagaaaaatcaaacgctacctcgagttgtatgca

SEQ ID NO: 25277 - DNA, 670 bp, Sorghum bicolor
  Clone ID: 30949671
atagaaaagacattgaacaattacttgtaaagcactctcccgttctaagatatatctgtgcttccgatcctaactctgtgctatcctacccataatccttctgcttacatccggtatcaaagatctggcgattccttccgccatgattcttatttcgatctgttgattgtttgcacagcctcgggttgggactcggatcgatatttcgatcctcgacttccgtaattcccagcacgcatccgatccagatcgagatcgcgctctggcgcagccaccgccaccgccaccgccgccgccgcatccccatttcacccgactcgcacgtagccgcggcgccatgtctccggagtccaagcagcttctcgacgagatgaatcggctcttcaccgaccaaaaggctcagttcgacgcccgcatcgctgaatcggagcgcaagctggatgcgcgcctctctgacagcgacatcatgctcgagcggcgtttcggcgccatcgacacgcgcttcaccgagttcgacgcttccatcacccagcgtctgctcgagtctgaccttgatctggagcggcgcgtcaccgattcagagctgcgccagatcaatcgcttcaccgagttcgagcagcgccaggacagccgcttcatcgccctcgagaactcagcaggcgtcttcgag

SEQ ID NO: 25278 - DNA, 734 bp, Sorghum bicolor
  Clone ID: 30949702
tttatataccacggcatatcattgtgctgttgcttttcaacgtgcacgccagttcagtttgatgtttatgtaaggtcaggagctgtgctactaatcagttatatagtagagagaattgagttacaggggagtttattattgctatggaaggccattcttttgcttggtaataattgtggacagtgcatatcagcgtatatgtttgtgaaaagtttgtagtttctgcatggccattctgcaagtaatatctcctataccatcacttgaggtgaacttgtcattgccaatggcctgttgcaaatgacatgcaggatcagaccccaaatgccattggctagcttagtggtatagatgaaaagtatgcttcaaattaggatggaaattccattatgtaaatgtcttccatttgatacatgtgaatttgtattagagggaatgcattaatttagtattgatcaaaacacatatttgatgtcattgtagcaaatattcttgttctcttttttttgtgaattgcgagtctgtattgatgaatagcttagttagttatttatgatagtatttatgatagtatttatgatagatgaattgattgctgaaaagaactgagtagcataccagtcactatgaattagcagcaaaattggctgttaaaaggattttatatctgctatatagcatggtgtgcgcacaactcaaactatgaagggacataatagctcatcaatttgtct

SEQ ID NO: 25279 - DNA, 599 bp, Sorghum bicolor
  Clone ID: 30949707
cagttgaatttctagtagtgtttgcgtgtgaaggcagctgcagctttagttcctcgatcggcggtctcggagatggggtccggcatgagccgtggccggcggcgcagcttcggtgccggggcgtcgggagggatgctgccactgctggcgcttcaggttctcatcgagtacggccgcgcgggcgcctcccggccgcccgtgacggcggcgttgctcgccgccaacgcgctcatctacctccgccccggcgcgctcgacgggatcctgccctcgctcacgcgcgtctccttcaacccgtggctcatcatcgagtatggtgacctggtgcgcttcttcttgtcaccattctaccacctgagtgaaagccacctcttttacaacatgacgtcgctcctatggaagggcattcagcttgaaacatccatgggtagtgtcgagtttgcttccatggttgctgcattgcttggcctgtcacagggtatcacgctgctcttgtccaaaggcttgctcttgcttggtgattatactgcgtactacaatcagtacgctgttggattctctggtgttctgtttgccatgaaggttgtactgaacgcctg

SEQ ID NO: 25280 - DNA, 572 bp, Sorghum bicolor
  Clone ID: 30949719
catcattcaactctgtgatgaataaaaagaagggaaatgcaagaacaaagccactccctccttctaaaagacttcgactagaagcacagagggtcctgaaggagcgtgttcaggacattgcagataagaaaggcatcaagctgagattttgcaatctcaaagaatgtgaaagccacatccagtcgttggatagtccatgtgagaacactagaactgaaattggatggccacaaggggttccatttgtccatccacatgacctcccaaacaaggcaaaacttggttttttggaagcttacgaacctggatggacagcctcccaacatgaaatggagttaagttttactgaatcatcatgagtgcattctcattttaacattataattggtaaaggagccagcctcagtaaattttgatgtattaccaaccttggatatgttttgaatttcagggttggtcaacaattcattcctttacatgttgcagaagtagcaatgtatactgacaccaaaataatgtggatacatacatgtagtactaagaacgtgtaaatgcaactacctgctgtttag

SEQ ID NO: 25281 - DNA, 456 bp, Sorghum bicolor
  Clone ID: 30949737
gtcagggagcagcacgacgccgccgccggggccggggccggcgccggtgccgggcccaagtcgccggtgggcggctgcggcggcaggcgctcgctcgggaacatgatcaggtcccgctccgagaagttcctctacaacctggggctcatccggtcgtgctcgtagccggccaccgacgacgctagctagctgacgtcgtcgctcgccgcgggtcgaccgtcggccaattaggctgccactactacttctagttaagctagcattagtcgtcactaagctactagtagtagtagttaagctagcattagcatttgctagaaaaaaggtcttggctcccatcaacgccccgttgatcgatccatgtcaaaatttcatggacgaacgtatgcaggaaccgtgatcgaaatctgctgctgctgtgtaaatacgctgatcttcgaatcgtctcgctccttc

SEQ ID NO: 25282 - DNA, 289 bp, Sorghum bicolor
  Clone ID: 30949747
gagttatggcactcccgccttggtcatcctgcacctgcaatcgtcacaactttcaataagctatcagctatccagtgtaataaagcagctcgccacacttgtcatgcctgtcaacttggcaagcacgttaggctgccattcgctagttcggtttctagtacatcagctccctttgaacttgttcactgtgatgtctggacctctccagttttgagtatttctggctttaaattttatcttgtcatggttgatgattatacacattattgctggatgtttcctcttcgcc

SEQ ID NO: 25283 - DNA, 605 bp, Sorghum bicolor
  Clone ID: 30949803
cccatcagcagcggctgcgagcatggcaacaccactgagctccaggagttgctccgaccaattcttgaggcacgcggggttgacatgtacgtgaacggccatgaccactgcttgcagcacatcagcagcagaaacagtccagttcagttcatgacaagcggcggtgggtccaaggcatgggctggcaagttcaagaccacatctgacaagatagagttcatttacgacggccagggattcatgtcgatgcagttgagcaacacggaggcgcacctagtcttttacgacgtcgctggcaatgtcctccacacctatgacagcaccaagagcgatgaagaagaagaagaggaagaagaagaagaagatgttgactaattagctgcgttaagctatagatggctggggtatactggacaacaacctgtgcgtgtgggtccattattcagggcagctgaatgtgtgtgtgagctggaagcagtgtagttcgtttgtgtggtttattatgtgtcggtgtaagtttaaaaatttgcgtggggtggagaagagaggattgtatctcctagttgggtcacatgagggcctcacgactagaaatcactataaaa

SEQ ID NO: 25284 - DNA, 510 bp, Sorghum bicolor
  Clone ID: 30949809
tcactgtaatcccctcaatggatcccggcaaaacgaggaccatgaattggtacctaattctggcaaggagagtccggattctcaatctggtggcatcattggccaaggtggtgcaagccttgcaacctcaggtgctgtaagtcctgttgcaagcagcctaccaaccgttgaagaactctctgcagaagattctggggagaaggcgagcagtgaccaccctgccaattgaactcttcatttcctgtatatcacgtttttgtgaagtattgtttaggatatgagtcggggagtctgaatttttgtacttaccatgtagtatatggagtaccatgcttactgcatgagttgtctagcaactggtagctcttggtggtctcatcgtggtttcgttcatagggtaccaggacaacgcccatttgctggcatcttgtcgcaacaaagggcctgaacggtgatgggatgtattgttctttgtttattgagtgtatagtctttgaaaggctttagaca

SEQ ID NO: 25285 - DNA, 553 bp, Sorghum bicolor
  Clone ID: 30949825
gggcgagagtcctagggtcagggctccatacaaacaggccctgccaactgctgagatggggatatttaattatttgccacttttatgtttggcatgagctcaattgctatctttgtatgtctataattttgccaccgctacaataaaaactccatggatttaggcattgcacgtgtggctatccaagtcatgggcacgggcatgtgaaaagacctcctgcccttgccgccggcctgcacgcagctacactagccaacaccactcttgggtctcatcgttcacatgcgcacgaaatggctgagtgtccgttaccgcacgcacctctgcacctgctcggaggatcgagcatgggctagctcgacacaaggcgcgtcatagacggccagtgcgtggaccatgcacagctcgcgtcagtatcctagttgatgttgtcgacgagtgtacacaggctatctaaggccgtgttcagttcccgaagcgaaaaatttcgcgacactgtagcactttcatttgtttgtggtaattattattcaaccatggattaactaggctc

SEQ ID NO: 25286 - DNA, 685 bp, Sorghum bicolor
  Clone ID: 30949877
ctctctcttcctctcccatccgacccagacgaggcaacagcgcagctcactcggcggcggcggcggcccagcacgggcggcacggcggccccggcgcaaccctcaccccaccccgccgccgaggtggcactcggccgcggcagccccggcgcggcggcccaccacggtggacacggctgaggtaacgacggctggcgcgaccaggccacgaccggtgcggccatcctcttccttttttcttcctcctcctcccctccctcgcgtcgtggtgttgcagccaggcccatgctgtcggggatcgactcctccggtcggtccatctctgctagtactatagaaaatagctggtacgacctttgaattgcacatccccaatgaatataaacacgcgtttccaattgcacgcgcggtgcgtcggtgtggcgctgcagcccagccgggacgggagaatctttatccaaacaggtttccgtgcgcacacagattgctgttccggccccaactctacctctcagtaccttcacgcatcatcccaccgcctgtctcgttccacttccagtcttcttttgcccccgatcccctttcatttcaactcgcatctcccgcgccgcgcagcccctgcgccagcccccatggacctgccagtggaggatctcgcgccgtatcttcgggccgccgccggcga

SEQ ID NO: 25287 - DNA, 599 bp, Sorghum bicolor
  Clone ID: 30949908
aggataattggataagggacatgcgcgccaagctcgccgtgctcgccaccggcgcccctccgccaccacggccgccccgcctccacccctcgcggcaccagcggcacatcccgcgccgtcggtctttcaagccaccccactctctgctcgacggcggacagccgtcgcccccgcccccggtcccagcttcgagttcgaggaggcgcgcctggccggccgtctcggcagcgctcttcggtgcggggttcctcctaggcccgctcctcgacggaatccactcccgcgtcgacctccaggtctacggaaacggcgccctcgacgccggccccctccacacccacgtcctggtgccgccgctgctcggcgcgttctacctcaccgtcggcctgctccacctgttcttggaccagagggcgccggcgcccccaagatccaaggccaccgggaccgcgaggaagacggcgacgtcgctactcgttcttgctctgttcatcgagctgagcgcggagctgtacagagcagggttgcccagcaacgtggaggcctacatcctgttcgccgccgccgagttcgtgtgggtgttcctggatgcctcctgg

SEQ ID NO: 25288 - DNA, 568 bp, Sorghum bicolor
  Clone ID: 30949916
tccacgagttggcatgctgctgctgtcctccctcctcccaaccccatgaggccatggccaagatatatataactaggactagctgagagctttgcttcttcagagttcagagaactcactcacaggggaacggagagggtatccctgttgcctccccatctcctcccttgtgcaagcaagcaagcaaggcaaggcaagctaggcttggacaatgatggcgtgtgggtctcgcactcggagtcgaaccaataacgagatagtcgatgagtaccagaagctggttctcagaatgaaccctccaagggtcaccgtggacaacgactccgacatgactgccaccttggtgaaggtggacagcgtcaacaagtatgggaccttgctggaggtggttcaggtgctgaccgatctcaagctcaccatcaatcgggcctacatttcctccgacggcgagtggttcatggacgtgttccatgtcgaggatcatgacgggaataaactttatgatggccaagtcatcgacagaattgaacagtctctgggagcgggatcgctgagcttccgcggtccg

SEQ ID NO: 25289 - DNA, 440 bp, Sorghum bicolor
  Clone ID: 30949928
tgaacaatacccgttgctactgtagcgcaggtactgttcatgccttcagctgccgctccctcaatcccaatcaatctccctcaaccctagcagccacataacacaaacagtagcatctgcattctgcagtagtatagttgcattttcatagccctccatgggacactcttgattgaaacttgggcactcctcttcaggggttgaaagtgaaacatgatggtagtttgcctatcagcatgagataaaaatgtttgctttcatggcaatcataacttttcttttgccctttttgcttggctctgactatatatgataagcttccatatattatcttttgctttaattaacctgattcacttaaagatgaattctgataaatatgactttatgcaaatgcatgtttttctttttgcagcattccaattgtactgctatatcct

SEQ ID NO: 25290 - DNA, 658 bp, Sorghum bicolor
  Clone ID: 30949946
ctcgatcaggcagctagcaggaagggatgatggaggtggagtggccgccgccgttggagctcaaggaggagcagcagccacacctgctcctactcatggaggccgaggccgaggaggaagacacctcctccgccctcctgcacaccagggacagggagaagaagaagaagatgacgacgacgatggacctggacccctcccactccagcttcagctccagctccgactccgactccgacgcagcagcagcagcagcagcaaccgagaatgaagaggatgcggcccctcaccaccagagcatcttcttggatccaacccaagtctctgatcatgctgaaaaccaagttacagaagttggtggccacaaagaaaacgcaaacggaacttcaggtgaacaaggtaaagagattgacaaacaggacaacgtcagcgctcaggaaactaaccacagttcaaacaatggcaaattagaaaatggttcacactctaatggggtgcatgagatctccagcagcagtgaaaccgtgactattgcagatggactgaaactgattacaaccatccgtgatgctagacacatcttgccaaactggagtggttctgttgacgtttccactgccaccgcgagtacatctgaagttcatgaaatcgaagtgga

SEQ ID NO: 25291 - DNA, 675 bp, Sorghum bicolor
  Clone ID: 30949956
accaaacaaaccagagggaagcgagagggacagcggcgggcgtgcgcatgtgagggagggagacacggtggtggtgccgatgagctgtgcgtgggagggcaagcagtagcagtagcgcctagcgcgtcgcattttgttgcttgccccttcggcctccctcctccgtccgtcctctcctcccaggcgccagccagccagccccacccccacccaccagtccaccgagaaggaagagccaaaagccccacacgggaacgggaggggacacgggcagcgaagcgcgccgcgcgcaacgcaacaaaggaaaaagcccccccagccggagcacaacaagctagcacaagcccgccctcttcgcttcactcccgttccattcccttcccccaagcacccgccgccgccgccgccgcacgcgcccgcggcccgccccgagatctggagatctggtagggcgagggggatggaggccagcgccgggctggtcgccggctcgcacaaccggaacgagctcgtcgtcatccgccgcgatggcgagccagggccgaagccgatggaccagcggaacggccaggtgtgccagatttgcggcgacgacgtggggcgcaacccggacggggagcccttcgtggcctgcaacgagtgcgccttccccatctgccgggactgctacgagta

SEQ ID NO: 25292 - DNA, 295 bp, Sorghum bicolor
  Clone ID: 30949991
accgctcgaccggccgtatacatcatctccatcatatgtgctcctctccatccacctagagctatcaatcggcgatacattctccgcgatggttcctgccgcgccccggctgctcgccggcattgtcgccgcggcggcggcgctgctgttgctgctagttgcgccgacggctgcagagctgacgcgggtggagcacccgcccaagaccgagggctccctcgccatccttgccgttggcgactgggggcgcaaggggcagttcaaccagaccctggtggcccagcagatgggagtg

SEQ ID NO: 25293 - DNA, 620 bp, Sorghum bicolor
  Clone ID: 30950015
gacatgggaggacctcggcaggatgcggtacacctgggcggcggcgctggagacgctgcggatggtgcctccagtgttcaccatgatgaggaagacggtggacgacgtcgagtacggcggctacctcataccaaagggctggcaggtgatccacgcggccaacatgacgcagtgggacccggccatcttcccggagcccggcaggttcgacccggctcggttcgagaacgcgtcggctgtgccgcccttcgccttcgtgccgttcggtggcggcgcgcgtgtctgccccgggaacgagttcgccagggtcgagacgctggtggccatgcaccacatcgtaacgcgcttcaggtggaagctcgccgccggctgcgaccgcagcttctccaggttcccgttgccatacccgtctcagggcctcctcatcgacatcgagcctattcagaaatgaatgcgcgctcgattgccttgtaaagttcagtagcagccatagttcagtttgctggctgtgaatttgcagtaaattttgggttgtttcacttgcttgtcagtaattaagccactaacctgaaactgaaccatcgaccaatctacagtttatatttcgggtttgcttgagt

SEQ ID NO: 25294 - DNA, 505 bp, Sorghum bicolor
  Clone ID: 30950035
gtcagaactgacaggctcctggaaagtatacgaagtcagtgcaacaccgattttcagtgatgaaaggcaagaactagagggcggttctcctttcgtatacttgtgcatggagacagtgaagaagagaaccctgccagagagttcagttctctttggggaggaagagatgctcgacatgcaggatgtccccgtgctttggttacctggtggtgtcactgcctatgttgacatcagtgaagacggcatactctgtatcggagttgggtggtactcagaagaagggatcaacctggtgatggagagagactatggaactgatgggaggctcagggaggttcggtcaaaaactgaagtaaagcgccggtggtatcaatcagttccataataacccaaatatttttttattattttctgcttcaattaatctttatttccaaatagcagcgtaggatcaatatttgataccccaaacctgctcgtttgacaagcttgatgtacttcatag

SEQ ID NO: 25295 - DNA, 558 bp, Sorghum bicolor
  unsure (1)..(558): unsure at all n locations
  Clone ID: 30950037
agggaggtggtcgaggggctgaggcaggcgacgcggcacacggagatggacggcgtngtcgtcgtcgtgggtgcggcggcggcggcggagtgccagcgctcgcctcctcgtgcggaggaggaggaggcgccgggcgcagaggatgccagtgccgtggcggtggcggtggcagcggaggcgaggaagaggcggatgcttcatctggctgctcttgggggtgctgccgctgatgctcacgccaggaggcggctcatgctcatgagggctgctaccactgccgccgctgctccgacgtgatctcctgccgttgttgttgatgccattgacttcgttcatgtacagtctgaacctatgacttctgaaatatcctttctctctgttgttgtgtgcggcttagaagattgacattgatttttccattgcctgatctgatggatcagtatttgagtaggcagtaggcactagccaaagatgacggaaaaaacgggaggtgtgaaatgcagtcctgccattttcttctcaacctaaataatatacgatgctgaagttgcaatgttg

SEQ ID NO: 25296 - DNA, 349 bp, Sorghum bicolor
  Clone ID: 30950039
tttgggtcacgggtgtttttgggagtttggttggttcccttggtgggaacaagtcagacaaagatgcattcctggaccagcagttttgatttttgatgcttgcttcgcctagggggtatgctcctaatgtacatacaactaatgttttaccaagtttttgttattagggaatcgatgtgttccgggggaatttgtcatacggttttgctccgtttttactccattgaataatagtataaaaagttttataagacttgggagtatactcaagataccattatgaagagataaacatgtattcaggtattggggtttcatccttcgttgggaatttgtgttccatgtcctc

SEQ ID NO: 25297 - DNA, 617 bp, Sorghum bicolor
  Clone ID: 30950045
ccggacgggtacatggagatccgcgaccggtccaaggacgtgatcatcagcggcggggagaacatcagcagcgtggaggtggagtccgtgctctacagccacccggcggtgaacgaggccgcggtggtggcgcggccggacggcttctggggagagacgccgtgcgcgttcgtgggactcaaggagggagcgtcggcgggcgcggtgacggccgccgatgtcatcgcgtggtgccgccagcgcatgccgcactacatggtgccgagaacggtggtgtttcgcgacgagctgccaaagacctccaccggcaagatccaaaagtacgtgctccggaaccttgccaaggagatggggtcaacccggaagggaggcagcagcatcagcaagatgtagtagggatgtcctcttgtttggcgtgctcgctgcacgctgtagcatggcatggggttggcaacttggcatgcatctcctttggatcggcactactcaaagtagtataattgatgcggacctggacgcatggggtttcctgatacatcagatttgtctcatttttttttatcttatccgatcctgtggtgactcacaagctaaatgattgatagggacgaatgctc

SEQ ID NO: 25298 - DNA, 651 bp, Sorghum bicolor
  Clone ID: 30950047
tgatgcatacagaatgggtgacaagctgaaatttgccaaccatgcccctgacccgaattgctatgccaaggttatcatggtggctggtgatcatagagtgggcatattcgccaaagaaagaatcctcgctggcgaagagttattctatgattaccgctatgagcccgacagagctcctgcttgggcccggaagcctgaggcttcgggagcaaaggatgatgggcaaccgtccaatgggcgtgcaaagaagctcgcccaaaacacaagaggctgaatttgattctgattctttcattgctgggccacaaatttggcagctattcaaccaagatagaacctgtcattcataggacccaatttatttaaacttgtcactgtaactcgaatgttttatttgcttgaattctccatggcagctggtcctgccatctgtagaattagctggcgggcgactgatctgatgtaacatgagttgctgataggtagcgtgtgcccctttagagcctgattcatgtgggggcacggtcagagcgtttctgaggcaactagagctgtttttgttgccgcaaaagtagcatgttaagctgctttagtgcaatttatcggctagttgtacaaggtgaattgcattaaattaggcatacttggcgt

SEQ ID NO: 25299 - DNA, 630 bp, Sorghum bicolor
  Clone ID: 30950100
tggcatcaccgtgtattgcagtataaatccagcagctaactccctcggcatcaataatgcggttttgaggtcatccaaagtcaatgtcattcccatcccgagcattgtgaaggagaggccgagcatctgcgcggtgggtccgacccagaggaaggccggcggcgaggggctgaggagaagcatgccgcgggacggagtgaggaaggaaaactgaactgccgttgactgggcagagtgagagctgagatgtggggtgttgttacgatcctttctggaacttttcttctacataaaacaaaagacatggctgatggtgggctttcgacttcatcctccttccgtcttcctacatcttcttcagtgcggttctcaaagcaaacagacggagatggtgaaggaattcctctaagatcgtccgaatcattccggtcaccacattaacgcttgtttgctaatcattaatttgcacgagttagggggtgggtatatagagataatatatccatgagcttgtactaagggtacgatgtagggatcctcttttgattttttttccttggcagatttgtatgtatgcccaacatcttgtcgaactcacaatatattttctcagtggttagcactcgagtg

SEQ ID NO: 25300 - DNA, 547 bp, Sorghum bicolor
  Clone ID: 30950108
ccgagtacggcaagttcctttgggagggcgtcgccggcgccaaccgcacccagagggactacttcctccgcctcgtccttgactccatttacgactccgccgcacggggagggccgcttgtcggcggcgcgttttggcagctgcttgacggcggcatggacacgctcagggatggatacgagatcatactccccgaggatcgacttgccgccaccatcatcggtaaccactcccgccagctggcccagctcagccttgtcaccttcaccggggaggacgtcgacattgaagcggcggcgcttcgccggaggagcaggagaagcccgcatagcaacaggaagatacgcgtacgcagcgtgggtggtcctagtgatagtgatagttattatacacaaacacaacggttgttgcacatactcttggttcgtttcatgtctttgttcacatcaattttttcattgttcagtagtgtatagactagagaaaattttaatgtatactcccctaggtaaaaaaatatatactagttaggtgatgtgtgtgtggg

SEQ ID NO: 25301 - DNA, 531 bp, Sorghum bicolor
  Clone ID: 30950112
tgaaaaggaaaccatagtggatcaaaatttgaacgcaaaaggagggcgctgttgccaccagcaaggagggcgatgttgcctccacgacgccggcacatcttgggtttcatgggcacacgttgttggagcccttcctgtggacgcgaggtaggtacagaatcctatcaaggacctatgacctatctaaaagaaaaaggactggaccaggcatatatgacgatccagaccatatatctgattctgttctggagcaactgtaacactgcataacttgcactcatctcatataggttctcctccggtcctgacaccgtgaaaccatgaagattatcttattattgggcttcagcaggtatgcaaccaaatatacaacttaggccaaaagatagtgtcctaggaggtcttgacacaggagttagtaatattgttccactttcgaaactattagtgactcgtgtgtcacacattatatgaaattcatgtaaggatgaatgataaatgcaattacaatatttgtaggagattttagtc

SEQ ID NO: 25302 - DNA, 666 bp, Sorghum bicolor
  Clone ID: 30950126
taacccgtggcttggtgcagcggttgcaggcccagagctcgatggtttctttgttgcctgggctgttcttgatgcagtcgtatcagttttgttcactgtggtgccttgggtggttgtcatggaccgtgatccgcgtccgcctgggcgcaatgctgtgaaggaagggtgctatcttgtgtctctgatggcaactgatgccacattgctcaagtgctgggaaacagttatgtgtggcagcatggggcggctcatcatggtgacattttgtggaaaggtttttggtggattcctgcattcgactgcgcaggtctacttcatggtggtatggctgctgttctactttgcagcaaggtgtaaggaggtgagactgggtggtcgtcagtttggactggaggatgttgcagctgctcttgatggatttaggtagtgtccagttgtcggttgccgcttggatcatcattacttgaagagaggtatatttcatggcccatggtgcttattgatgaaacgctgctgatcttggcaaagtagaggtttttgtagttatcttgatcttctaaatcttgctgagatggtaaatggttcggatgagagaaagagaacttgacaatgttgtatgtacagtttttgcctcagagtggcatacaaagaaaggctgttggtccc

SEQ ID NO: 25303 - DNA, 564 bp, Sorghum bicolor
  Clone ID: 30950146
tgaccgtgcgaggcctgatgtacccgcagcggcagcgggaggggaggaagagcctcaagggccacgtcgagatgaccgtcggcttcgacctcccgccggtgctcgccttggtcccggagagcatcatcagaggcgtcggcgagacggtcagaacttagattcatctcctcacctgcagcctgctcttgcagagaagtagagaaccatcaccggattgattggcaggcattttgtttgtgatgaacaatgcgcaggtgttgaggaagatggcggagcagatgaagcaggacatggacacaggcctggcagcagatttcaagaagtacagcagggagaagctaaccgagaggcgcacatcaccctgaattaattttgagacacatttcacaatcacatccctgtatcaatgtatcatcaacagtagccataactaggaattctttcgactcccagtgctgtcaacctcttgcactattcattcaccagttggatgacaccaaataatgataataaataacttgatgtatcacattttattcactgtaacaatgttgctcataattc

SEQ ID NO: 25304 - DNA, 634 bp, Sorghum bicolor
  Clone ID: 30950160
cactgaacccgacggacaagccgatcgatgcatgcgccgcggtgaacgacaggtggtgcaccggagggagttgttggagccagcaaatggcgaaggccaagccacggccggcggcggccatccttcttctgctcatcagcttcctggccgccgcggcgtcggcggcggctggtggtggctcggacgccgagacgacgggcggcggcggcggcatggtgggcgtggacggcacgcggttcgtggtggacgatggcaggcccatctacttcagcgggttcaacgcctactggctgatgctggtggcgtcggacccggcgcggaggggcaaggtggtggcggcgttccggcaggcggccgaccacgggctcaacctcgcgcggacctgggcgttcagcgacggcggcgacacgccgctgcaggcggcgccgggcgtctacgacgaggccatgttccagggtctggacttcgtggtcgccgaagccaggcggcacggcatctacctcctcctctgcctcacaaacaacttccacgacttcggcggcaagcggcagtacgtgcagtgggccagggacgccggccaccgcctcgccaccgacgacgacttcttcaacagcaccgtcgtcaaggactacta

SEQ ID NO: 25305 - DNA, 663 bp, Sorghum bicolor
  Clone ID: 30950168
ttgttacacaaattactctacactgttggagcaattaattgtgcacttctatacggttatatatatagttggagtacttttttatgcaaagttcatgattctatacataattttctatgcatagcaattgattggcgagatgactaaataaaataatggtttttgtatattgtttttatgtactttgattttttatttctatgcttcttgagccaaccatataatcaagaaatcatttggaattgtatatatattgttggagcatattttatatattatttggagcatggattcgagttcattactttttgtgttgtttttttttctcgtaattatagtcacaaaatttctataacttttctgctagttactttttattgattaatatgactgctgttggaaagttctccaatttatccaaattgtttcactgtacatgcactttttattcgttttccaacccatttggagtactacccatgttgaatgggagtgagttgggttatcgtaaatcatatccaaattgctaaaaacaagtttctatgctgttctatacgcctttcgtgccactgtaaggtttctatacatgctaaaacatatttctatatggtataaaaaatgtttctatgccagttttgttcaaaaaaaaatatttttcttgct

SEQ ID NO: 25306 - DNA, 554 bp, Sorghum bicolor
  Clone ID: 30950182
gcaacttctcttgccccacgtctctgacctctcgccacaccagcacacagcagacagcacggagccactgaccactccccatttcccactgtcactctatcatatcaatgcggttctgtccgtgactcgctcacaccacggccgggccgccgccgccgccgcgccgccgccggaagcagctaccagctaggcctaggcttcccgttcccagttgattcccttttccgttcggccggccgtctccccccctcccactttccaatcgaatccgaccctcccccttccatcccgttcccgttcccgttcctatcccccccgacccgcacccaccaccaatcctcacgccactcgcgccgcatcaccacccacattccattcctcctcgcaccaatggaggccaaaaccctaacccccgaggcggacgcggacgcggacgcggacaccgcggcagcatcccaaaccctagccgccggggagctcgtctgggtcaagccgtccaagccccgccggcactgctggtggcccgcgcgcatgctcgccgcgtgccccgcctc

SEQ ID NO: 25307 - DNA, 653 bp, Sorghum bicolor
  Clone ID: 30950184
gaaagactcttggagatgctcttagtacaggatgctcattcattcacatcatgatggcatggcttgtttcttggattcattgattctatttgagtggtagaccgcagaatatgctatttgttgctttgcttaacgaaaaggggttaaagattgcaaagcagcttttgcttggcttcatgtatggatgatatatattggctaagtggtggtgctaattggcaaaaccaccacatgcctgcttttcatttcacagtttgagtgagccttggaagcagcttccacaaatttccttacgcaatcatcattcttccaagcttgtttaagttcttaattttctagttaattacaggaaaaatatattaacttagcctgagaacaaaacactctagctatatgtccttgaaatccgtctgtatgacatttttatgtcaagaattggcatcatggatttgacagtttccatggtcttatgtactaatctaaacattctacagtttgccgagtccatttgcagcggcaagtaggtatgcagccaaaagttggggtttcatttattagtctatcataataaaaagctgaagtaatagtacacttgtttgtagtatttcgaaaatattgcatgaattttcctttggaggcttctagtctagttg

SEQ ID NO: 25308 - DNA, 509 bp, Sorghum bicolor
  Clone ID: 30950192
atgtatggcatgccattaccggttactggggtggagtcaggccaggtgtagctggaatggagcactacgaatcaaagatgcagcagcctgtgtcatcaccaggagttcagaaaaacgagccctgtgatgctttggacagcataacgaccaatggaatgggccttgtgaaccctgagaaagtattcagtttctacaatgaactccactcgtatcttgcatctgctgggatcgacggggtcaaggtagacgtgcagaacatccttgagacgctaggtgctggccatggtggaagggtactgctagctagaaagtaccagcaggctctagaagcttccgtcgctaggaacttccctgacaatggcatcatatcatgcatgagccacaacactgacaacttatacagttcaaaacggagcgcggtgattagagcctctgatgatttctggccgagagaccctgcttcccataccatacacattgcatctgtcgcctacgacaccgtctttctt

SEQ ID NO: 25309 - DNA, 559 bp, Sorghum bicolor
  Clone ID: 30950196
ttaaaatcctattttcattaagaaaaaatctttctctttttcattgcgacaaacgatgagtagtacgctctccactcctttccactctactaatgtttgcttaggtcagaaaatctttttttatttatgtactaaacataagagcttctaatgttctttcgctcgtgaggtactacacatgatctgctaattatactaaatgatgtgcttttcatgcccagttacatcttaattgatgattattttttaaggtttgttgtattcggtttaggtgtgatttgcgacctattgcaagtatttatattgcaaaaaaaacctttgtatctatcaactgaatatgggtattatttttattggtttcatttcatctattatactttctgttccgggtctattatggaaatatattgtttggtattccaagagttttttcccttgcaaacaaaaactatgatgtctgtttttgcaatggtagttggaatttagagctacataatacttagctatagttctgtcctcctttttcttctaatttttattttgcttgctgtttgaaagg

SEQ ID NO: 25310 - DNA, 494 bp, Sorghum bicolor
  Clone ID: 30950198
agcgaggggaaaatctcaattcccgtccacctgtcgtgtgtcctctcgccctctacgttccggaaccctcttctcttatcccgctctcgcctcaccggcgccgccaatccgctggcgagctagggcttcctgatcattggcctccgcagctttccgccaccatgggggtcgacagtgacgacgaggatctcgtggtctatgggacgcccatcgagcgagaggaggacacctccgcccgcaagcgccgcgccgtcgccgaggctggtcaactccgcgcactccctgcctggaagcaggaggtgagggatgaagaaggaagaagaagatttcatggcgcatttactggtggattctctgctggattttacaatactgttggctcaaaagagggttggacaccacagacatttacatcatcacgaaagaatagagctgagctgacaaagcaaagcatatacaattttcttgatgaggaggatataaaggatatgggt

SEQ ID NO: 25311 - DNA, 647 bp, Sorghum bicolor
  Clone ID: 30950200
aggattgccactgcaggttagacatgtcaatactacacctcccctcataccgtcctgcagtccatccatgtataggggtgctggatcaggagggagcacaccactcagatcagcggcggatcagagaccaagctcagattcaagaagatcaagaaagggccttgccctgagttctccgtcgtcgcttaccactacatgcgctctcaagacgccttcctcgtatggcggatcgagggagaaggtcaacaaccccagggacctcttcaccttctcctacaagttcagcaccgatatcccgatgagcgaaacgcaaggggcgtccatcgatgagtacctgcagaacagtcccaggatcgtcggagctgtgttcccggatcagcgcaaaagaagaaagatcaacgacgaagaatggagcgtgcagctcttgcccatccagttcctcttcctgtcggcgtcgccggtgatcgtgatgcgcttcgtcagcaagtccggcgggaaggagtacccgcccaacgtccccgtccacgccaccagcctcctcctcatggaagtgacggactacaagctgaatggtctggacagcaacgccatgccgtcgcacctggccctgaccgtgcgaggcctgatgtacccgcagcggcagcggg

SEQ ID NO: 25312 - DNA, 591 bp, Sorghum bicolor
  Clone ID: 30950227
aaaactactctaacatatttccaagtggagtaggcacctaacaaggaagtactactgcaaactgcaagctcttgatcggaagcaatggatgctgctccggcgacattggtggctgcagttgccgtcgtcctcgcggttgtagcatcggtcccagtactgctccgtctcctctctgccagcgcctgcggcaagaagacgaatccaaaagcacccctgcctcccggttcattcggtctgcctttcatcgggcagacgctgagcctggtccgcgccctccgcgccaacaccgccgacgactggctccggcggtgcgtggccacgtacgggcccgtgtcgcggctgcgcctcttcggctgcccgacggccttcctcgtcggcacctccgccaacaagttcatcttcgccagcgctgcggtgaccgccaaggctcccgagtccttcgcccggatggtgggccgccggacgatcagggacgtggacggcgacgagcaccgccgcgtcagggccatgatggtgcagttcctcagggtggacgccgtcaagaggcacgtcgccagcatggacggcgaggtccggcgccacctcgacgcc

SEQ ID NO: 25313 - DNA, 597 bp, Sorghum bicolor
  Clone ID: 30950233
atctaatcaaaagccaacttccgtgcccaccccatgtcctcctgcctgcgcccacctttggcccggtgtggcggcgcccttccgttgcccagatcaccggcaccgttcccaccccagcacacctctcccctctagcaagcccctcgagctccccatactgatccacccacgcgcctccccaagcggatgcgtgcgtgccggcgctagtcgcggcgtattttgctacgggtgccaccaggattgccaagccgctgccgattcttgtgccccatattgattgttgatgctggatggagatgacgaggcaactgcacagcacggccagatcttggcaacccctaccgtaagcagtcatcttcctcaatggaatccccatctgcatctcaagaagcttgcccctcttcaatcccacgctctgtatcgtgatttttgatttgtgaccaatctgggaatcccggagtagttgctaattgggatttcaaccagtgctttcttcgatgattcttctagatggaagccctctgttgagtttaatgggatcatattcattaattcatgaggcaacacgttgagctcacaagcacttttcatatgtac

SEQ ID NO: 25314 - DNA, 494 bp, Sorghum bicolor
  Clone ID: 30950252
acgtgtcagtcgctttcttgatggcactatccccaacctcgccgattccagtctccacactcgccgagcgacaccgcgcgggacgaccgagcaagcagagcatgccgccgtcgtgcctgggcgcatgcagcggtggcggactagccctctccgccccccgccgccgcgccccctcctactgcagcatcgcgccccatagggcttccgtctcgtgctctgccgccggcggcaaggcgtcgccgcgggggaaggacaacgtctggagcgtcgataacgaccgcgccgccaaggaggcggtccggagcccgaagcaccgccgcaggagacgccccagcggtcgccgcctgccgccaccaaagaggaaggggaaggatgcggagtcgagggttctagtgtctggagccatgcttgtggaggtcgagactgtgctccaaactcaggaacctgtcataaagccttcttgggatacatttgcaagtagtttaagtggtaac

SEQ ID NO: 25315 - DNA, 554 bp, Sorghum bicolor
  Clone ID: 30950254
aggtccaagagctgcaagaggcggccggaggcgacggcccccgcgccggcgcctgccgcactctcctccactgaggcgcggtcgttcgcgtccgcggcagcagccgccagctgcgcctcgtttgcgtcgtcgtcggcgaacgtctcggaggcttcgggcgcgcggccggcggcgagcgggtcctccggctcgggctcggccgcttcgtcggcgcggagcatcccggagctgtacgaggagaggggcgccctgtgggagttcggcctccgggagctccgcgtcgcgacgcgcgacttcagcccgctgctcatggtcggcgagggcggcttcgggtgcgtctacaggggcgtcctccgcctccccggaggcggccccggcggcacgccggtcgccgtcaagaggctcaacctcaacggacgtcagggccacaaggagtggctcgccgaggtccatttcctgggcgtcgtcgagcaccggaacctcgtcaagctcatcggctactgcgcctcggagacggaccgaggcccgcagcggctgctggtgtacgagttcat

SEQ ID NO: 25316 - DNA, 493 bp, Sorghum bicolor
  Clone ID: 30950256
atcgatccacaaaagcatcttccgccgccgcccgcctccccccgtccgctccgcactccgatctcctcccaactccgacccggcggccatggatccggcgccgcagacgcacccgatcctctcctacgtgctctcccgcatccccaccctcgccaagcccaacaaggcccccactacctccgagttcgacatcgagcagccgccgcccgtgcacaccccgtccccgcggacggcgccgtcgtccccgtccgcgggggagttcgagctcgtcgagcgcatgccggggctgcgccacccgtccgtgctccgcgccatgacgcgcgccgtcgccgacgtctccgccgcgcgcgccgcgctccaggtgctcggcccgcgccccgaccacgagctcgtcgtctcctcccgcgccatcgtcgccgccgccgaggccggggacgcgcggatccccgaaggggacgccgaggcctgccgcgcggtggggcgcctggagcag

SEQ ID NO: 25317 - DNA, 527 bp, Sorghum bicolor
  Clone ID: 30950263
agataaaattcttctcctacgccactctgcgagagtgcgagctagagtagatcgctgaggccgtctccgttcacgcaagccagacctccacctctcgcggtcgcgccgccggctacctcacggcaatggacaggctcggctcgaatccggcgaactcatgcccgctcacgccgctgggattcctggagcgtgcggccaccgtcttcggcgactgctcctccgtcgtctaccacgacacggtcttcacctggtcgcagacacaccggcgatgcctccgcctcgcctccgcgctcgtctccctcggcatcacccgcggcgatatcgtaagcctcgggcctcggccaattccgcgaattgatcaccgctcatccctgccatcgcgggaaatgagtctgatgtgattaatcattcctctggtgcttggcataggtgtccgtgctgttgccgaacgtgccggccatgtacgagatgcagttcggagtgcccatgagcggcgccgtgctcaacaacatcaacacgcgcctgga

SEQ ID NO: 25318 - DNA, 606 bp, Sorghum bicolor
  Clone ID: 30950265
tggaatcctcgttcattttttttctttaatccaagcgacttcgcgtgtgagagcgggagagcgcgcggggctagggtttccgcgggcgatggaagcagcggcggcggcgccgccggcagtggcgtcgtccgcatctgcatcggcttccgcgggccggtcgcgcccatctaccagcgccgcccaggacaccactattacggctgtgcaagctggagaagaaaatgctgcctccccctatgttttatctgttattgactcgttaaaaaagaggattacagcagatcgtttgacttacattaagaataggataggggagaataagattaatctcagcagctatacacagaggacttacaatttatcaaaaaataggcaaattaatacatcaaagggtactgatttggcatcaaatttgctcacaaaaaggcaagatgatgcgctatgcaccctgcatagttatgatattactccggttgacaaagatggtggcaattttcaagatgaaaatcctttctcctcatcgaatgttatttttggtggaaatcttggtcccaagaatgctattagaccaattaaattaccagaagtgccaaagcttccacctta

SEQ ID NO: 25319 - DNA, 567 bp, Sorghum bicolor
  Clone ID: 30950282
aaggcctgccggtgcagaatgcactgaagaacaacaggctcttcatcctagaccaccatgatagtttcatgccttacctcaacaagatcaacaagttggagggaaacttcatctatgcaagcaggaccctactgttcttgaaggacgatggcaccctgaagcccctggccatcgagctgagcctgcctcaccctgatggtctgcagcacggtgcggtcagcaaggtgtacaccccggctcacactggcgtggagggtcacatctggcaacttgccaaggcttacgcctgcgtaaacgactctgcctggcatcagctgatcagccactggttgaacacacacgcggtgatcgagccgttcgcgatcgcaacaaaccggcagctcagtgtggtgcatcctgtgcataagctgttgagcccacactaccgtgacacattgaacatcaacgccctggcacgccagacgctcatcaacgccggtggcatcttcgagcgcaccgtgttccctgtcccccgacgtgtacaagagctggaatttcaacgagcaagctctccccgcagatctcgtc

SEQ ID NO: 25320 - DNA, 577 bp, Sorghum bicolor
  unsure (1)..(577): unsure at all n locations
  Clone ID: 30950299
tattctaactaggctcaaacagaagcaggaggagtggtcaaggtgtagatcagacttcaacaaagtttgggctgaaatatatgccaagaattatcacaagtcacttgaccatcgtagtttctatttcaagcagcaagatacgaagaacctgagcacaaagtctctcctgacggagataaaagaaattaatgagaagaaaaggaaggaagatgacgtgctccttgccattgctgctggaaataggcggcctatagttccaaatatgtcatttgagtatgtagactcggaaatccatgaagatctacataagatcattaagtactcctgtggtgaagtctgcaactcttcagatcagttagataaagtgatgagaatatggacaacttttctggagccaattttgggtgtgcagcgaaaacatgggtctgaggatcctgacctagttaaaccgaagagccgaacaacaaaattgggtcttgcaaatgcgggagaaagcaatactggagctgggattgtctcanagcaaaacaacggtgatgaaagtgaacaaggactgtcatctcgggctagattagca

SEQ ID NO: 25321 - DNA, 655 bp, Sorghum bicolor
  Clone ID: 30950315
gaaagactaagagtggtatccattgtcggttttggagggctcggaaagactacacttgcaaacgaagtctaccgtgaccttagagacaaccttagcgggaaccctgaaaaaagttttagttgcaaggctatcatatcagtgtctcagagacctgacatggttaatcttctcaagagtttgttcacaaaggtttcaggccaaactgctgatcacacttacgatctcccaggtctcatcgacatagttcgagagtatctacaaggcaaaaggtatttgcttgtgattgatgatttatgggatccatcagcatgggaaattataaaatgtgcttttccagagagtcactgcggcagtagagtgttgacaactacacgaattgtaagtgtggcagtggcatgttgcaattaccagtggaagttcgtttacaggatgaaacctctggatgattatcattcaaggcaattgttccttcgaagaatttttggctcaggagatagatgccctgagccatttgaagtactatgtgagaaaattcttcaaaagtgcggtggtctaccacttgcaatcatcactatagccagcctcttggctagtcaacaaaccaggtcaatagagcagtgggagtatgtccttaattctatacggcataatctag

SEQ ID NO: 25322 - DNA, 335 bp, Sorghum bicolor
  Clone ID: 30950327
tgtggcctttttttttttttttttacctgagcgttactgttttattatatcaagctgttgaagtcaatgtgtgataaacaagctgccatggtatatatatccatagcaatcatgtacagtattcaccaactacactatccgagtccaacgaaaccctcgtcaagagatctccagaaaagaaatgaaccactagcagcctagtgttttatagctcacaccaccctgacgtgtttactctttgctgcaatagatcatacacaaagtgctactactgacagtgtaaccacccgtcattctatcaacggcttactcccacgggtataatccttcataca

SEQ ID NO: 25323 - DNA, 523 bp, Sorghum bicolor
  Clone ID: 30950363
cggcgactggggccaggggaagccgctcaagtgccccgacctcaacctggacctctgcatcagcccgccggcggcgccgtgccaggaggagaaggccatggtgacgatgaagcccgtgaagcgggaggccgggctctgcttcagctgcagcctgggcctccccaagagcgccgactgcaagtgcagcaacttcctcggactcaggaccgccatgctcgacttcagaagcctcgagatgaaatgatcgcgtctccccctctgtaatctcccccttcttgttcttttttttttttacatctcgcctggatgatacgtatttggttagcttcgtaggtgaaaatacgtagtagtgagtgagtgaaagagagataaggaagaaaaaaaaaaggtgaggatttgtgccctgggtacgtcttccctgctgctctctcttgttgctccattttgtctcctctctttttctctgtaattaccatcaccaactcaactgatcatgggcaataatacttgctgcttagtctcg

SEQ ID NO: 25324 - DNA, 506 bp, Sorghum bicolor
  Clone ID: 30950374
ttgccaagttctttgttttgaattcaaaagtgttacagaaaatgagctttggactcgctaaccgccgccaggataagtggatggttaatcaacgcagacgacttcaactggacaacaaagcttcacgaggcgctcaatttgcattgtgatggtagcagttctatccctaattctctgaaggctgatccttttgagtgtatggaaccaggaaagtttccttaggtctgttatctgctaggggccaattagcatgtaatattttgtgatgaaataggggtgtgcatgggagagtagagactcaaccctccacactccttgccaacatgaaatgttttttcccctaaatttaatactgtgctcatttagtttaagttaacttttgatagatgttttcatccagtaattattactaagttaccaacatgcgtccctttgtgtggcagttcctgtggtggttgtgtcattgtattctgtaacgagtttaatttggccagtaagtttggtgc

SEQ ID NO: 25325 - DNA, 605 bp, Sorghum bicolor
  Clone ID: 30950416
tatgaatggggatttatcgtgtgcggcatgatcatggcgatcgtgtggatttatttgatcgcagctgaactcgtcggaattattacggcagcgggtcttattttgggtatctcgaatgcgatcatgggtttgacgattatcgcgtggggtaattctgttggagattcagtctcgaacattattgtctcgcgcaaaggtcaccctcaaatggctattgctgcttgcactgccgctccattgaccaatctgttgttgggtcaaggtatttcaaacttgttgttggccttgaagaaaggaggagtcatattgttagttaatacggccggcgaaaaggtcttgactaacaatatgttcttggcgttcttattcttaatgattacgttgttattgaatattacgctgatccccctattcaagttccagttcaagaagcaattcggagttttgttggtggtgaattacattgcatttacaattttatcatttttgaccgaatttggatacttgttcgatagagaaatttggttcgagcattgagaagtatttttcattagtggttaataccatcttgtaatatagtaatcgcttaataaaaatactataat

SEQ ID NO: 25326 - DNA, 548 bp, Sorghum bicolor
  Clone ID: 30950422
acgtgttcgcgctcttcaacgaggaccagaagcccggaccggcgtccgagcgacattacgggctgttcaaacccgacggcaccccggcttacgatgtcggcgtcaaggcgccgaccatcacactgcccaaggggaacggcagcagcgggagcgggaataatggcaccggcggattggtggtggcgcaagggcccggcggcgccgacggcgccgggcccggcaccggatactacactgtgtctgccgcagcaatgaacaaggtgaagagcaggcggcggcggtgcatggaaagcttggtggcggcggctgccgtcctggccatggtgtccggactctgttagtttcttggcagagaacagacaagagagacattacagagattggaaatcgactgaactcagccgaggcatatcatatgccatcgaattcgattgattcgtcattgtttttgggcctgattcgtatttatgccttgtagctgtgtagaggaagacagtagacatgcattcctgtatgtaattgattgatacgcacacttgatctcctct

SEQ ID NO: 25327 - DNA, 551 bp, Sorghum bicolor
  Clone ID: 30950429
taggcatatgtggaattcatttgttcgaaaacaaagggtgctagctgatggtcatatcccttgggcctgcgaggcattctccagatgccatggacaccagcttgtccaaaaccctgccctgctgtggggctggcgtttcttcatgattaaactctggaaccacagccttctcgatgcccgtgccatgaatacttgcaacacaattcttcaaggctaccaagacggaagttcggaccccgagtaaatttaatacaaaaaaaaatgttggccaacttgtgtataatggcactggatgtagatctgccaattcgaggggttacttctgaacccgaaaacaactatgggaagaatctgaatggcccataccagcatttgttttaacttttaaggtttaagggtagctaccccccacctggaaagaaactaggagggcgaatctggatccttggccgagataatcattgtttcattcatgactcattgtattgattgatccagttgttggcagatggagttgtatggatgataatgataaatgaaggattcaccgc

SEQ ID NO: 25328 - DNA, 473 bp, Sorghum bicolor
  Clone ID: 30950434
aagccatcgcaagagcgagtttatggaaacagaactgtgagattcatgttatcgcgcatggaaaaacaggcacagagaccatggccaaaggataggatatgggtgttcaagagtgatccaagattctttggtagtccaatgatggacgccgtgttgaataattccccgcttgacaaggagatggtgcattggctcaagacgaggccaaacgttttcctaggctagtaaaaaaggattgtaggcagataagatggttttggttgtttctcccttttggagattttagtctacaggattctttttccgactcacaccttggctacctgatcatggggagtttagcttttagatagcagggtaacagtctcaccaccccccatctgtacattctcctctccctaccttccttgtagaaatgtatctggttaataactgatagattcgtcattgatttaatgtagtgaattttcccc

SEQ ID NO: 25329 - DNA, 585 bp, Sorghum bicolor
  Clone ID: 30950440
ctttagttactgccaggagtatatggctcgactctactgcagctgggaaaatgcaccattctccagttgagacagaagattattgcatagttcatctgcagtgctggtgcaagatgggaattttgtataaggtggattgaaggagtaattgactcttttcttatgataattgggtagcttcaacaggaacaccagggattggtggcattttggtgatctgttttcttctagaagagagacaaggggaagcaagcaaacatttaggaacaccttttctttaatttaattatttccatttcaggtttttaaaaaaatccattaacgtttttagattagctagcctgtacacaactgttgttggaaatgggtcagctggtgttggtcgatgcttgtggtggccaacaataccatacccaactataccagagactgcagtggcgaatgcacctttgacaatgtcggtgcacattataatgctgtgttgttgcgggaagaattgtagctcatgttgtacttatattagtggcaaaaggcctcacaaatgtaaaaatgtatcgttgtgctgacatgctaaaccttatttgg

SEQ ID NO: 25330 - DNA, 584 bp, Sorghum bicolor
  Clone ID: 30950471
tttccatgatggatcatcatgtggttctcacgggtatcagggcacctactgatagcattccttatggtgatcatatactaggtggtggaaattcaacttctgttcctggagatatgcagcagctcatagattttcctttctatggtgaccaagataagtttgttggcagttcctttgagggattgcctctagactatatcagtatcagcagtccaatcccagatattgatgacttgttgcatgatgaggatttaatggaatacttggggacataacattaggtcaggatgaggttgctagcatttgtttttcatccatttagtctcgccggagtcatcatcctaacttgagtatggaaggctaaacttctcattttgttgccggtcttgttatttgagaccaaccatctgttgtatgctgagtgatgacttgcatactttggcaataatgtatcatgcagtgacacaattgtacatgtggaaggtgaacatggcctcacttaaatatgatatctttctggagataatatctgttgtagaaaggattttttataattttagaatcctcaagatacgattgtttcc

SEQ ID NO: 25331 - DNA, 588 bp, Sorghum bicolor
  Clone ID: 30950494
taggcatgttgaaagaactcgtccgggttgccctggctgtggttattcctatgggtcaatggtgatagatgtggtggtaagatgattgtgcaatcaaagcataaagcggttcagaaggactataaccttttgttcaggcagtatactaatgcctgatgctggtggttatgatatgctctcattgtacccagatggcttaaaaggcatccatgaaatatgagttgacatgaaggaaattttctgtagtattggtagagctgcatagctgctgctattaagatactaattgaagccctgagctatccatattgtattcccagtttctacatgtactcattgcagcaagcatggatagatggaccctgtgaagttgagtgtatccacttttgaagcatgacaacagagtctgaaatgcaagcaaactgcattaaagacagtcatgttggttgcaaggttacctatagtttggttgcctcttgcctctgctgggaagggtttgtagttcatctaagcgcctttcagcatctttgctcccaccttagatggtgggatgtttcttgtaatgctgacaattatcaaactattatg

SEQ ID NO: 25332 - DNA, 722 bp, Sorghum bicolor
  Clone ID: 30950524
aagggccctccatgcttccgccctgacacgagagctccacggcccacgggggagaagcgcggagcatcggcggcggcggcggaggcatggcggcgcgaaaccttctgcggcgtgcggcgtacgcggcggcgtgcggtcaccgcttccccgtccctgttccctcaggcgctcttgctggtcctggaagccggagcatcggcgccgccgctcagggtcttcgtcattatgctgccccatccagtgtggaggatgcagtggaaaacttggaaatgcatgcacccaaggcaaaccgtcggtcaaatatcccaaagaaaaatggaacagccatgatgcttccactccatttccattacgaagatgtactacgtcaggatctgttgctcaaacagaatcatgccaatatcatgcaagttccagggttgtttgagatcaaactagcaccaaaagcaggctccgatctcaagatcccaattggaaaaatggctatggaggtttcgagtggtcagagattcaaagaggcaaaaagtgacccttttgcgaaagcaagaaagtcttctcggaccaatccatttatcggggctgacaaggacagtagcaccgcctttgcgcaaccgactgttctccgaggacatgcaatgtacaactttttggtgaggatgctgacagtgatgtccatgttagactcgcgggccgaaattcgggaaacactataaagttcttca

SEQ ID NO: 25333 - DNA, 619 bp, Sorghum bicolor
  Clone ID: 30950533
aaaagaccaccgaaacacccaacggcggcctcgtgtatgctttcgcccattcctgctcgccccgtttctccccttccatcctgcttccttctctctttttttcactcccgatttccaaatctcaaacaataaataaccagaagagaagcgaatcttctcctccatcaacccagcaaatcgctcgttcgagcgtccattcgactgagaaattatcgtccgtcgcccccggctggctctcccgttcgccgccagggcccaatttcgtgtggacaggttgccgtgatcctttgctggatggggcagcgcagctagccacaagaggttgcctaggtttgagtttaatcgggttaccaaagtggtagttctcatggatcaacttgccatgcttgcgacggagctgggtgactcgtcggactttgaggtggagggcatccagaacctcactgagaatgatgtcagcgacgaggagattgagcccgaggacctggcgcggcgaatgtggaaggacagagtcaggctgaggaggatcaaggagcggcagcagaagctcgccctgcagcaggcagagctggagaaattgaggcccaagccgatatccgaccaggccatgcgcaagaag

SEQ ID NO: 25334 - DNA, 583 bp, Sorghum bicolor
  Clone ID: 30950543
tggataggacgcagaaggaatgttgtgtcatggaattcacttatatctggatatggaatgcatggctttggttccgagtcaatccaggtgtttgaagagatgattcaggaaggcatttcgccaagtatcatcacatttatcagcgtacttggggcttgtagccatgctggacttgtggagcagggaaagaagctatttgaatcaatggtggagtacaatgtcacacctcgtgctgagcactatgcttgcatggttgaccttcttggtcgtgctgggcgtctggatgaagctgtggagctgatacagagcatgcgcattcaaccaagccctcaagtttggggctcacttcttggagcttgcagaattcatggccatgttgagtatgctgagatggcatgctctcatctctttgatcttgagccccgaaatgctggaaactatgttctcctggcagatatttatgcccgagctaagttgcagaaccaagttgatgtactaaaggagttacttgaggagcatgcactggagaaggtgccaggctgtagctggatagaggtgaagaagaagctgtactcatttgctt

SEQ ID NO: 25335 - DNA, 566 bp, Sorghum bicolor
  Clone ID: 30950545
aacgctttttaaccaaaacaaataccttacttgcaggccacctcgacgccgccgccgccgccgtcgcgaaccataaaaaaaccccaaccctaccgcttcgccggcgaaaccggggctggcggcgtcggggactatgggggagtacgcggcggtgaaggcctcggtgtggtgggacatcgagaactgccatgtcccccgctactgcgacccccacctcatcgcgcagaacatgagctccgccctcgccgccgccggctacaccggccccatcaccatctccgcctacggggacaccaactgcgtccccaaccacgtacagcacgccctctccagcaccggcatcgccctcaaccacgtccccgcaggtattaaagatgcaagtgataagaagatcttagttgacatgttaatctgggctattgacaaccctccaccggcgaattatttgctaatatctgatgatcgggacttctcgaatgcccttcataagctagtgatgagacggtacaatattctactagcacaacctccaaatgtgtctcaagcgcttactgctgcagcaaaac

SEQ ID NO: 25336 - DNA, 694 bp, Sorghum bicolor
  Clone ID: 30950589
actcccagttgaccactgttccactccgcctgccttctcagcagaatccgatggcccaccttcccgcctctccggcggccgcggtatccaccggccaccgcgtctcgccctcgcctcgctcttgcccttccctcccgcagctgaagacgaccgtactgtcgtcggtaggagccgccgcgggtccccgaccttcccggccatggaggggtgtggcagccacgggctcggataaggccggcctccacgctttctgaaatctgaagtcatagggccacaggctgggacttatctttgacgagtttatgcaagcaaatcctctgcgcacaatcatctgcaaactcggctcatacgttttctgacgagacatcgactggaacaattgccaatgcaaacgaagttcctgtcttgtctttctctgaggtggactttcttgtcttttgtatctctggtggcacaagttcaatttacatcattggtaacatttataagacagtggttggatgctctttctcttttgagagattatattattggtccttattatgctctcttcttgattaattcttgagcaatcaatacacaattgtacatcatatatccatcgttgaaaaaccatgttcctttcatgtgtagttttttagaacaattgttatgaatagtaatggaaaacactaactctgcatgactgcatcta

SEQ ID NO: 25337 - DNA, 694 bp, Sorghum bicolor
  Clone ID: 30950597
aagaccgccgttcgcagtcggacttggaatcggcaaaggagaagatgtcgtcgtcgttcatcccgatctgatcagctgcctccccgacgagatcctccatgacatcatcactctccttcccaccagggacggcgcccgcacgcaggccatctcccggcggtggcgcccgctgtggtgcgccgcgcctctgaatcttcaggtggaccaccgcgggctctgcgggcaggaccgcaagcgcgtgaccttggtcgccaagatcctcgccgaccaccccggccccgcgcgccgcctggcgatcccttggttccgcctccgcgaccgctacgccaaggtcgacggctggctccgctcgccggcgctcgccggcctccaggagatccagatcagctacgcgcccgacggcgggcctcgctcgctgccgccctccgcgctacgcttcgcgctcaccctccgcaccgccgagttctgctgctgcgacttcccggccgccgacgaggagatggccgcgccgccatcgctgcacctgaacttcccccagctcaagaacctcaccctgcgcagcgcctccgtatcggaggccacccttcaccgcctgctgtctggttgcccggctctggagagcctacggctggagaccaatgtcggcgttggtagcctacgcgtcagctcggcgactctcaagagcataagcatc

SEQ ID NO: 25338 - DNA, 690 bp, Sorghum bicolor
  unsure (1)..(690): unsure at all n locations
  Clone ID: 30950637
attgacattattatttatagcaagcatgtgtcgacattaatttgcacgaagatcgatgcgagtatgtgaggcagatgtgctcagaaactgaaggctttgtgaattatctagaacttcattattgtaccttccaagacaaagcatggctctcattatcgatactacttattttgatgttggtctatttctacatgcttggatcgaccgctgagcgattcttttgccctgctttggctagagtatccgaaggcctaaacttatcgcctaatgttgcaggtgttactttattggctcttggaaacggttcgccggatatttttgcgcaagttgcagctgctaataacggagtattttctactgctatgggcacgatgttaggctcgagtttgttcgtgtgtactgtagtcgtaggcctcattacgttggtctcgaaaagtgcagtgaccgttacacgaagaccctttattagggacgttttgttctttatgatttcagtagtatttttgttcctcgtatgttgggacaacaagatctacgtctgggaatctgcctcattgattggattgtatataagttacgtacttgtagtggtaatcgcacgcattatttatcaacgtagcangaaacaaagaaaaatagagaagcgtgagaacactgaggcttcgttgcttgataacgatagtttgcgtg

SEQ ID NO: 25339 - DNA, 597 bp, Sorghum bicolor
  Clone ID: 30950641
ctgttggcctacgggaaaaccctcttcctgctccagtgctcccactcccactccactcccgatcgtccctgcaatggcgctccacctcatgctcgccgccgcggccgcattcgccgtcctcgcaccgccagcagcgagtagcggccccacccccgcaccgccggcgctagggatcaactacgggcaggtggctgacaacctgccgccgccacaggcggccctactcctcctccgcgcgctgaacgccacgcgagtgaaactctacgacgcggacgcgcgcgtgctccgcgccttcgccggctccggggtcgacttcaccgtcggcgtgcccgaccgcctggtgccgcgcatggccaccgacccatccgcggccgcgtcgtgggtgcggagcaacctcctgccccacctcccggccacgtccatcaccgccgtgacggtcggcaacgaggtgctgtcggggacgaacgccgccatgctgcggtcgctgctcccggccatggagtcgctgcacgcggcgctggcggcgtgcaacctcacctcccgtgtctccgtcaccacggcgcactccctcgccgtgctgtcctcctcgttcccgcc

SEQ ID NO: 25340 - DNA, 573 bp, Sorghum bicolor
  Clone ID: 30950649
aacgaccctttttccgagccgccgctcgtagctccgtagatcgatcgccgaagtttcggatctcgttcctggcgaacttttccggtgaaagttcggcgagcttttccggccaactccggcgtcctctgcagaaaccgttaccgctcggaggcgaggtcattcatggacgagcccgttcatcatctccatcggtcggccacgttacccttcaggccagcggcgccaagcctcgtgcctcctctctgctagccacctccccgcgcaacctacgtcgcctggccctacgcgtggctgcaggccgagagcagcaacacgctgtgctcacgcaccggccgtgcgtggcctagcaccgcgggcgagggcgcgtggcccagcttgggtgcgtgcgagccctccatctggccggacagcaggccaaggccccacgcccgaggcctctgtgcccctgcacaagcccctcgacgagagcagcagcggacagccatagatgcatacgtgaacaaggggaacgcaagaagaagcgtggttcgtcaacagtgaaaatcaggggctaaggaccgacagtcaaagcag

SEQ ID NO: 25341 - DNA, 612 bp, Sorghum bicolor
  unsure (1)..(612): unsure at all n locations
  Clone ID: 30950653
aaatgaaaaccttgaagcagataggtgatgggaacaactacacatccaaagttgcaaggaacttcaccagtcagctggatggttctgatgagcttgatggttattttgctgatatttcaaatagagagaatgctaacctttcatttggacaaggtttctataaacgatcaaaattgcttgatgctagaaagtcctctgcggttttgtcaagggatgcagaaatgaggcgtttgatgcagagacaggcagagaacagttataggaagatggaagagtttgtcataaacagactgagagaaattatgaggagtaacagatttgattttttcattccaaaggttgccaagatcgaaggtaggttgaaaaatgggtattatgctcgccatggctttcgtaccatcaagcatgacatccgtaccatgtgccaagatgcattgagatataaagatggcaatgattcgggagatataaagcaaattgttgtctccttcatacagctagcanagagactagggaacccaaggcacatttctgagagaaatggagcagcagcccatgacagtctggacattagtcaatattcatttgatactaaactcaaaaagaagcaaa

SEQ ID NO: 25342 - DNA, 556 bp, Sorghum bicolor
  Clone ID: 30950691
ggtcatgtatattctgcaaggcgttttcaagatcttcaagaagtcgtagaagagcaagagcaagggaaagaagaggcagtggaaggaggaatgggaaccaggctaatctggaaaattttaatcttgaggttccaacacaatctgttgaattaagggaaattagatttgatgaaattgatgatgaatacatagtcacaggggccattcctagtatcgcagcaccgggaagaatggctagtttccattacagggatacaagatatggacgttgatgcatagaatctgcagtaaaaaaaaggaatagctgttatgcaatgtatcgatcatcataaccattgtacttccgttcatttgaacttcttttccacctgtcctcggtaggtgctgccgcagtttaaacttatctgtgcataaaaagtagcaacagaaccccgctgttcgtttgaaacaggcctcatgatcctagtttttattttgtatatatttagcacccatctatataggatgttggtgacagttctttttggaatgcttctttgatgtagcgcagttttac

SEQ ID NO: 25343 - DNA, 589 bp, Sorghum bicolor
  Clone ID: 30950695
caggaaagatgaagggaagatccgggcaaaacttgggaagatattaaaaggtaaggaaggggtgcgctttgaggatagcattgctacaggcgacggcattaaaatatctacagaaggtatgcggtcgtcaaagttttgtctccaccctgctggggacactccttcctcatgccgcctgtttgatgctatagtcagtcattgtgttcctgtgatagtcagcagtcgcattgagctcccttttgaagatgagattgattacagtgagttctcccttttcttctcggttgaagaagctctaagacctgattacttactgaaccagctcagacagatccccaaaaagaagtgggttgatatgtggtcgaagcttaaaaatgtctctcatcattatgaattccagtatccccccaggaagggtgatgcggtgaacatgatatggaggcaggtgaggcacaaaatccctgcagttaaccttgctattcacaggaatagaagactaaaaattccagactggtggggatagtgtacatattaccacttccactgttagacctctggttattttcgatgtgttatggaaaccacggtc

SEQ ID NO: 25344 - DNA, 585 bp, Sorghum bicolor
  Clone ID: 30950735
aagagtgacaataagcagaagaaggctgccaaggtgccacagaagacgccagaagcttcagctccctcccaatcaccaccaccagctgcagcagcggcggcggcggcggcggcggcggcggtggcagcagcagcagcagcacaagaagcggcagcaaaagcaaagggagttgcaggtacagcagctgcagcacaagaagcagcaacggcaaacaccaagggagttgcaggtgttggctcatagtggcattgggagaagcacagtcagcactctgtgcacccaaccaaatgagcgagtcctcttgacataacgtggagtgtgattagggcgaaaggttgctatgatgtaaggagttgcgtagccgactgctgcagtaggagagcagctttcttgtcccaacaatttggtggtggtaggcaacctgaagaagttgcatatattatttgtagcaggctagggacctgggtgtagatgcttgccttctgataggtatgtcattttggtgcggaatgctttctgtgatatatgattacgctggctattgcattctgccattggatcggtaactaaagtgttgtctcttaa

SEQ ID NO: 25345 - DNA, 659 bp, Sorghum bicolor
  Clone ID: 30950752
gaggatgatgactcggggtatcaaagcgacaaggagattgtttgggaggatgacaattacatcaagccggtgagggatgttaggacacaggattgggatgcgtccgtgttcaccgatttcgggccgatgattgtgcttgtgcataacagatataagagaccgcgggagaatgagatggcgagggctgagcttactaaggcaattgagatgttttgggaacacaatctgccgtcaccaaggtgtgtggctgtagatgcctgtgccgagcctgaccttgtggacgcgctgaaagtttctggtttccctgagattctcttcaccaatgcagggaggataatacaccgtgagaaagttgtccggtcggcggaggcatggtcgaggatgatggcgtttttctactacaaagcagcaaggccaccgttcttgtgtgaagcagatgggaagggtcaagaaaaggttcctttgatgtcatgagcacaacgtggaggcttagctttgtagtacaactattttagtgcttcgaagttcgaatcaaatttttagaaaatcaatgcagtttgttagaacttcacatatgtcattaggaagtttatgctgttaggactaagagttgaaacttacaactattatgagaaaaatacattaatcagcctctttta

SEQ ID NO: 25346 - DNA, 588 bp, Sorghum bicolor
  Clone ID: 30950764
cgggaggagctgggcctgccacacaggttcactaggctgttcacgcggtaccctggggtgttctacctgtcgttgaagtgcaagacaacgactgtggtgcttcgtgaggggtacgagagagggaagctcgtggagcaccatcccctggctgctgtgagggacaaggtgcattatgtgatgcgcactggagtgctgtaccgcggaaagggtttgtccaagcttgttctggatgaggatggcactgaggaagagggtgcactgaatgaggaggaatttgaaggggagggaatggacgaggatgctgatgttgagtgcttcggaatggagattgtggatgacgatgggcctgttggtgatgtggatgatgaaggtgatagtgatggctgacatggattgacgattcttgccttcttgatttatgttttgcaattgtgtcttcagtcatgagttacagtgactgtgggtttgattcaacttattagtggctccaaatgagaagttcagcaagttattgtagattgtatcatgctctgttaatactttgatatatgctacattcatctgcttaagaagtagcaagctaaatta

SEQ ID NO: 25347 - DNA, 427 bp, Sorghum bicolor
  Clone ID: 30950774
ccttcacctcgggatccaaaacacagacttagagagaggtcgtactccggctcacctgtggacagcatatcaagaagtgggagcccgtatgaggatggatatcccagatcatcccaaagggagagatttgtttttgtcagcggatgaagcagttttacagtttagagctactgctgtgaatttacgcatggtggcctacttgttatgtctttttgaaccataaatattctgtctagattatcattcccagtaccagagaagtatcgtgagactgtttgctgtacttattagtcttgaggatacagaacgggggtccccaattttcagtagatggactatgacccctaagctacgccagtgcccctgctttgtgtatttatagaattataggcagttttgtggtatgaataaaattggttggattgtg

SEQ ID NO: 25348 - DNA, 643 bp, Sorghum bicolor
  Clone ID: 30950803
ataggacgcatccgccacttcttccgcatttcctcaacacttcgcgcgccgccgccgccgccgccactctccggcgtcgtctactcggctccgtccccccgccaggaagcagaccaccaccccaatccctctcgtccttcagagatgcagaaggttcgtctcaaatgggtgaagaaccggggcctggaccacctgatcgagcgcaccacctccatccgcgcgtcctgcctgctgctcgaccacctctcgcgcctccccggctcctcccccgtgccggcgcgctccctcgctcgcctccagaagccgcttggcctcacggtgcctgtgcttcgcttccttcgccgccatcccacgctcttctccgagcaaccgcaccctcggttccccacgctgccctccttctccctcacgtccgcgtcacacaccctcctggcccgcctcgccgatgcctctgcgcacgacgcgcacctccgcctcgcgcgcctcctcctcctcacccgctccaggtcgctcccgctcgcctccgtgctcccgctccgcttcgacctcggcctgccgttcaacttcgccgccgcgtttccggcctcccaccccggtgtcttcgccgtcgccaacaaccgcatctccctacggtccgcctccg

SEQ ID NO: 25349 - DNA, 183 bp, Sorghum bicolor
  Clone ID: 30950807
cgccgccgccgccacgcgcctctcttctcagcttgccatcctcccggcacccggccacaaataagagcaagatgccggcccctgtcgctgcctacccggccaagatggtatgctgtctccagctccaccttcttcgccgctcggcccctgctccactccctgctcgggtcctcctcctgctct

SEQ ID NO: 25350 - DNA, 542 bp, Sorghum bicolor
  Clone ID: 30950817
agactcgattggacggatcggagcagcactcctccacggctccccacctacagccctgactgatccggtctctcttgagtggttaatcctagatcaatatgagaaggggctacagttacagcccttcaccaccaaggggctacaggagaagggagcgcagcccaagcccccgtgattattatggtggccgtggtagggatctcccaaccagtcttctggtcaggaatctccgtcgggactgcaggccagaagacctccgtcggccatttggacaatttggtcgacttaaagatatatatcttccaagagattattacactgggtaaggcacctacctagactgtgtgcattgcaaactgttgcggccttaaatggtattgacatggaacattacttttgcccacctcttgaagtaacgtgaaaataattttttgaagacacaagcttaaaagattactgttgaagagaaggaagaaatagagaatttcaattaagtgatctgcaacttaaaagagtactcagtactgttcaagagatgggaa

SEQ ID NO: 25351 - DNA, 523 bp, Sorghum bicolor
  Clone ID: 30950824
gccccccatcgctcgcactagacagatccgccactcccaccccatcccgtcgctccaagcttcgggtccagcgcccgccgtccttcgccactcaggccaccaggccgccgccgttcctttggtatcccgcgtgccgtaattgatgccccgtccgctgtcgccccgctcgacgcgccacggcgccgaccgttgcctgctccagatctgccatccccgagtgtggccaatcctagcaagcggttcctcccggcacgtcgcgccgctggccaccatttgtcccagatccggtgccggtgccgcctctcctgcacacggtgtctccggtgcggccagtaccggcgagcaggccttctttcccaaggtgtgctgctccaccagttcgcccctccttcttcttctccctctcggaggaaggtaatgcaatcaatcgccctcctggaatggagctgctcttcctctgctcctgcgtgcgtagacggtgctctgctccggcgaaatgccgccggtgctcgccgtaatgccg

SEQ ID NO: 25352 - DNA, 590 bp, Sorghum bicolor
  Clone ID: 30950865
ctaaacccttcttcccctctcgtcccaacttcccaacgcgacgcgatgccttccacctctcgccgtcgccgccgcaacaaacctgcaacgcccgcaccgcatccggaggcagtagagcccgcgcggggcaccccctcgaggggcccgacatgggtgccgcggtttcctccgcccgccgccttcgcacgcagtctccacctcgccccggatgcggcagcggtcgagcaggcgaggggccccgtaccgtcgccgcggcctcctccgctcgccgtcttcgcacacaagcccgacatcgcgccgcgcccgtctccaccaaaccctagcccattcgaacccgaggctcgtgccccgatgccgccgccgccgccaccctcgtcctcctcctcctcctcctctggtcgccgccgccgccgcaatcgcggccgcggccggaagaaggacgaggcccaggaggagacgagggactgggcggcgctgccgctggacgcgatatcggccatcctccgcaagctcgaccacatcgagatcctcttgggcgccgggaaggtgtgccgctcctggcgccacgccgcgcgcgacgagccctcact

SEQ ID NO: 25353 - DNA, 290 bp, Sorghum bicolor
  unsure (1)..(290): unsure at all n locations
  Clone ID: 30950873
agcaacagcaccgtctcaatccccacctcttcccggctccggcggccgcgccaccatggcttctcctgcgggggctaacagcggggcctcctcctcgagggggacacccttgccgttgcccttccccttccccgctgcggcccacttcccctcccgcggcgccggtcccttcctgtcgcaacaccatcacccgcccgtcacctccgaaggcgacgatgaggtcgaagaagacgagggaagcatggacgatgacagcgccgaagaggatgatgccgagctgnccgacggtg

SEQ ID NO: 25354 - DNA, 562 bp, Sorghum bicolor
  Clone ID: 30950887
gttgttggttgtaatgaaaagctggatctgctagagccaagagttttcgttgcaagtctgcgtttccacgatgggttcaggcaacttgatcgtgaagaaggtggtaaagcacagctcctttgatctggacatacagctcgataagagttggatggaggacgttacctgcccgatctgccttgattaccctcacaatgcagtgttactgagatgcacatcttatgagaaaggctgcaggccgtttgtttgtgatacagaccagacacgctcaaactgtcttgagagatttaagtttgcatatgagctgccttccaatgcgaaagtttcatccttagctgtgcctcctcttgatagcattattcatatcgtgccatctaatgcaaacaaccgccccagctgccccttgtgtagaggtgatgttattgggtggattgttatcggtgaggctcggctgcatcttaatcagaagaaaaggtgctgcgaagaggattgctgctcgtttgttggtaacttcaatgagcttcagaagcacacgcaacaaaagcatccagattcacgccct

SEQ ID NO: 25355 - DNA, 632 bp, Sorghum bicolor
  Clone ID: 30950892
cagcccagccaaccaacgggcgtgctcactgcgcggcgccgttggggtcggcgagcgccatgggggcgccgagcagccgcgcgctggcgctgggcgcggccttcctgctgctcctcgtcgcgctgccctcggcctttctctacctcaccacctccgcggcgcccgcggcggccacccgcgccacgctcctcaacctcaagcccttctccgccaagtgcgcgcccgccgccgcgccgctccgcgtcttcatgtacgacctgcccgcgcgcttccacgtcgccatgatgggggccgacgacggcgcggggttccccgcgtggccgccgtccgcgggcgggatcaggcgccagcacagcgtggagtactggatgatggcgtcgctccaggacggtgccgcgggaccggaggggggaagggaggccgtcagggtgcgggatcctgacgccgccgacgccttcttcgtgcccttcttctcctcgctcagcttcaacgtgcacggccgtaacatgaccgatcccgacaccgaggccgaccgtctcctgcaggttgaaattgtggacattctatggaagtctaaatattggcaacggtctgcaggccgtgaccatgttattcctatgcatcaccctaat

SEQ ID NO: 25356 - DNA, 574 bp, Sorghum bicolor
  Clone ID: 30950914
ttgatggttctgtgtgtgtcagtgatgatgctcaaaatgatttgaagttttccaagtgcaacttggaagatgcttccaaagaaccttctactgttcaaggagctgatcggagtgatagttttgcaaatgtcaatgctgatgctcaaaatggatctgagcttaccacaaatgagttggcagtcattaccatcagtaatgacaaggaaaatgaatccaagcttttcacatgcaactcagaagaagctgaccatgatgatagctctgtatgtctcagttatggtgctcaaaatgaatatgtggttaccacatgtcattcagatgttactcaagaggatgaggatgagggtaaaactgcaggcgctgaaaagaaattggaagcatcaggaggtgcttctttgaaatctgctatgcatcaagaggctgctggagatattaataccacagatgcaagtaaagatactcatgttactgaagaaactaatcaatcattcaatatgcaaatgccagcagaatttactgatgcaaaagaaccttctattgatgacatatgtggtgcgttcagtggaatgaacct

SEQ ID NO: 25357 - DNA, 550 bp, Sorghum bicolor
  Clone ID: 30950934
gcagcgcagcagtctccctcccctctctctttcttccccagtcaaaaaaaagattaaagaagaagaagaagagagagagagagagagagagagagcgcgagtcgcggcgggctccgggctccccgctggactccgatcagctcccgctccctcaccgcttccctccgggatctcccctcgtcgccggctcgccaccctcatggcctggcgcctcgccatctccaaggcggccaggcctcaatccgatctacagcaacgaagaacctctccgatcataatacgcgatacgccacatgactcaaatctccagctttgttcggagtttctacctgcacacttaatccaggccccgaggcttcggtcggcaaatgccgtttgcaatcagctagtggcttcctccgctttcatcgcacctagaatcgacaatgctgcaggtggcatgcttagaaatttgcaggagaggtaccgctcaagctacactggtagctttccacgctggatacgggaactggactccccgagtgaagcttctctgcttaaacagatctat

SEQ ID NO: 25358 - DNA, 618 bp, Sorghum bicolor
  Clone ID: 30950944
cctactgggtactacccacacgcaccccgctcgaccaagctcccgcgcccgcggccggcgccctcacgctcccgcggctgggcctggcgcccgcgcccgtggccgtggtcggcgcctccaatctcacagcttggctcgggaccaagaggcgagggatacgccctgcgcgagtgcgcgctcggcagaacgatgccgctgcactgttccctgcccgcgacctgttcggcgttgtgcctgcgagcagcggcgcggcctgacccccgctgtccgagctcccacgcgcgcctcgtcggcctagctctttctcgcccgcgccaccagaggctcgtgcacaccggctgcgcgcgggccgggacgagcgactctaaggccgtgcagctggtgctgggcggccgtgcgcgcggcgacgatgacgacactgactccgagtccagcgatggcgaggactcccaggatcggatgacggacgaagagcggaagacgctgcgccggaagatacgggagatgatggaccgcgtccctgaaacggcgcggctgacggacccggaggagcggagggccaagatgcgggagctgctgaccaagtacgagctggtggtagaggaggaggacccggac

SEQ ID NO: 25359 - DNA, 592 bp, Sorghum bicolor
  Clone ID: 30950958
catttatgttatattttgtctattccttgatgtctagttatcttgctactattgttatctttaagacagaacagtgttaaaaaaaacgattacatatttacaccctacctttgcagtgtgatgtctgccattcatttggtatatatactaatatacatgtaccataatttgtcatgtggccatagcccatacccaataagtctgaaaacctagtagctgattagttggcataatctcacttgctgtgtatgctttgcattccccaacaattttagcggcatgccttcagttttccagcagtaggttcatgttcatggaactcctgtagacaccagtaattcatgtacaagtagattcgctctgatttgattgttgcaatgggtggcactgtttatcatgttgtactatttgcctgtggttgaatagttgaattgcattggcttctaattgctatatataatatattgtactttgagggagcactggtctgtatttgccaccatttgtgatctcattcataaagaattgcagccagtattcaataatacttgtttgttttgctatttttttaagagcactttttttcaacaaa

SEQ ID NO: 25360 - DNA, 617 bp, Sorghum bicolor
  Clone ID: 30950971
tgcagataaagatccattggctcaggaaactggtgggttaagtgggaaacctttgtttgacttatctactaacattctcaggtagatgtatatgcttacacggggcaagattcccctcataggctgtggtggtgtgagcagtggtgaggatgcatacaagaagatccggtctggagctacacttgttcaactttatactgctcttgcatatggtggtccagctcttatacccagaataaagactgagctagcagaatgtttggaaagagatggtttcaaatctgttcaggaagcagtcggtgctgatttcagatgatcctagcagattgccgagaaggcctaaataaccgttccattaagtttatatgaacttttgtgtaagcatgctttccaatttcatttggccggtacttgaaaagaaatactgagtttaaacttttttgggtgagtggtactcattaccctaagcatgagcggttgtatcacgtgcgcatacatgagctttggtttacttgcctgggttcaagcaaggtgtacaacagattttggtcaaagtttgtgtataatttatggtgtccttttgaaagataagtgttggtttgatgcattaggagctc

SEQ ID NO: 25361 - DNA, 119 bp, Sorghum bicolor
  Clone ID: 30951010
tgtgacttgtgattcgaacgcagtgcgatgtatatgtaggtgatgggagcgctatcgattcattcattctttgtacgcgatgtaatcgatttatttatgtcaaatcgaaatatttgtgc

SEQ ID NO: 25362 - DNA, 668 bp, Sorghum bicolor
  Clone ID: 30951024
caaagtagaagagaataggtggcatgaacggtttactagcatttttggggcatcaaagtttcctaaagaaagacatgatggttggatggaggcggagatgggcgggttccataatgatgaaggtaaagacggtgaggtttccgtcagatttaggacgttgccatatgcgaagattggtcttgttgctctgggtattgagattagacctaagggcctcctctccacatcgatcgccggcaagcgtgtggctatttggccagccttccgcgccccatgtcatctcccattgcttgctgatggggaggtccttcaacccctggcgtccatgaaggcgttgttcttgcggctcttggacggccccgtcctcctagccgatggcctcacggtatgtgactttgcttctgcatgtatctattagttttatgtggtagatgattctaggacaatcagctctcaacactgatgcgtgtggtgtctgtagagctcgtggcttgacaaggagaccggtggcatatgctacatgttgtccgcgaggaagctcagcattgcgtggggtgataatccgacctattggcactggattcctatcaccggcttcaggttggctatatatctcgctcgcacagtcatatatatgttagcttgccaaatctgaaattttgatgcat

SEQ ID NO: 25363 - DNA, 637 bp, Sorghum bicolor
  Clone ID: 30951030
gaggcatccggcgctgtactttccggcaactccgttcaattgacccttactagacagagtgcccttgctgacggtagttacattatgttcggtcgtccttctgacggcggtgacttgtatgctacgcctttcaacaccaattacactatgttctctcgcgcgtggttcgtcaccattgccgtgcaaggtcaagccactgctgacgtatcattcgacgtttcctccgtgaaagatgttatgtctgccaataatggcagctacctcttgctgtaccaattgccctctgcaagtggttcccacgacattattgctgaaaatggtgtcgttagcagtgacaacaacaccgtcactttcgccggtgtcaccttaacaactggcttcatcacggtcggtagcactgcttctatacctcgagccccacaagccccacaagctcccacctcgggccctgtcgctggtcctgctgctggccctgcaagccccactccatacgcttatcccagccctggcattgttcgtcgatctgacgcgactgcttctaccgtctccgttgttagcgctgtagtgttggccgctagcttgatgttctaagaactaccatattatttgtttttcaagcgaataaattgtatttttt

SEQ ID NO: 25364 - DNA, 663 bp, Sorghum bicolor
  Clone ID: 30951032
tcggtgctgtggctggtgccgcagttcgcgctgatgggcgtggccgacgggttcgcgctggtgggcctgcaggagtacttctacgagcaggtccccgacggcatgcgcagcctgggcattggcctctacctcagcgtcatcggcgccggcagcttcctcagcagcctggtgatcacggcggcggaccgcgccagctcccgcggggggcgcgccagctggttcgccaaggacctcaatcacagcaggctggacctcttctactggctgctggcgtgcatcggcgccgtcaacctggcattctatgcggtcgtcgccaccaagtgctcgtacaagcagaccgtcagggccggcagggttggagacgacaagtccgccgccgccgccggcgacgtcgagtgcgccgcgtaggtacggtacggtgtggtcatggaaccaaccatgcatgcacatgccactagtagtatagctagctgcaggatcatcgtgttattgttattagcggctaagtaattataactcggtaagaagtacgactagcttgtagtagtcgcgtctatcgtgttgttgctctagtgcgtccgtggaatgtacgtgtacaagtgctgatgtgtctgctatctggttcgttgtagcaccgatttatcacatgcatgagcttaataa

SEQ ID NO: 25365 - DNA, 250 bp, Sorghum bicolor
  Clone ID: 30951046
cttactccaaggcctttcccgcgcgctgatgacctgggctccattatctcttctcgctgctcccgagcctctttccgctgtatgggctttttgcccttttctagtgaatttcccggctctctgatccatacgcttcattctactccttggctgatatatcaatggactatgctttggcagtgccaaagaaagaggggtagtattttgtggtggttgatcatttttttatcatggttgatttttttctaac

SEQ ID NO: 25366 - DNA, 434 bp, Sorghum bicolor
  Clone ID: 30951055
catggtctttttgacgtagatgccttcgtatgttgtcatgtggccgcagcaagtatgaatacgcctcatctacatatactcctacatggtttcatggcagctgcagagatggagcagcaaggtttctgtgcaatttatttttgatttttatgtttcttgaactgtgcactttttttgtttttaatgcttcttataagccagcaacgtaagccaccaacgtatgtatccatactcataattaatatgtatgtgctactccctataaacatgtatagtttcatactcataaacttgtatatgttcatactcataagcatgtatgtatatcctcatactcccactatatatgtatgcgctcatactctttttataggtatacctgtataccctccagtttgatacttgtatgctaatggaaaatacatcaaagaaaa

SEQ ID NO: 25367 - DNA, 494 bp, Sorghum bicolor
  Clone ID: 30951069
gtcatagcacgtgcctgctcattcagatctccaaaacgcacgaaaccatatcctttgggccgtccagtgatcctatcaacaacaactttagctcctctaactgaagggtagttcgctctgaacatgtcttccaacatagagtcagtaacatcaggagccaaatcaccaacaaatattgtgtgatcagaaccactatctccacgcttatccccagcgctgccagaagcccagttaagcttataagccatctcaacattcggcatcatagaccagatcgtgtgtatgcatgtgtgttacgaccagatgcgttagactcgatcatgtgttaacccatgaataggagtggtcacgtatgaataggatcacattgattattgtccatgtaaacaatactgcatgatctccaagaggtctatttatgtatggtgccacggatggggcttttccatccattgagaaacacgcattcaccaatgacccaagatagggtttgg

SEQ ID NO: 25368 - DNA, 201 bp, Sorghum bicolor
  Clone ID: 30951088
tccagggaagttgttgttataccctaaatgtcaatgtatatagtccaactgattccatatatcccccatgtaaaatatgtttgccaatgcccccaaccctagaccctgaaaaccattcatgtacaaaacatacttattccctgttctgttcaattttcaattatcagttgtgcgcgcgatggcgcgcccccttcctttgtc

SEQ ID NO: 25369 - DNA, 581 bp, Sorghum bicolor
  Clone ID: 30951096
tcatagttaggtattaattctttaggtttcatatgagatgtgttttccttaaaagaaaaacatagctaggagcattttaatgcgctgtgagagggagtagcaatttatatacacagagggagtagcaatttaatgctgtatttgtgtgactttgggctttaactgttacttcaggctttgctttcaccaggctcttggggcaatgtgattttttgaataccttctagtttactgtttgacagcctcgctggctgaggaaaaaggtcctaaattataaagtttgtcttgggagcttgcaaactgaatgtacttttgattttttttttgtttctgaagttaagaagtggcacctgtgcttacatgggttatgactgcattatttgagatagtatgagagaattgttccctattccttattacctggaatgtatttttttcgtttttgttatgactgtttgttttttctggtaagtcatccttagcaatcagatacagcactgcactaccttagcacagctaccgtttttctagatcatttgtctctgattcaacaatggcaaggattgaggatagacttgtta

SEQ ID NO: 25370 - DNA, 614 bp, Sorghum bicolor
  Clone ID: 30951098
aaaaaaaaaactaacttaacttgctctcgtcccttcccttcccttccagccgtcggactccaactcctgggcaggtgcgtgcagcagccaggctcgatgccagcgccacgccacgccaccgcggctgttgcgttgtgccgctgcagatcttgcgctgcgcctccacctgctgtcgcactgcgtccgcagctctcggctcgacgcgtcgattcgttgatggattcttccgcatccgaaacctatcgccggccgcgtcacactttgctgatgagagtgcgagatccagcaggaagggtattcagtgagggacaccatgatctggcgggtaaggaactactccagcgtggccattgctagctcgtccctccccactctcatctctgcagtggctggttgcgaccatttctactgggtggctgatgcaatgccaataggtgtttgaggaaatgcaggaaaagcggttggtgattctgtttttaaggtgtttgggattattaaaagattttgatttcttgactagtttggtactgaaatgcaatgtctacaattatttttgtttctctaagcattgcagagagttgttgcagtaggcgctttgctggtggggcattgga

SEQ ID NO: 25371 - DNA, 564 bp, Sorghum bicolor
  Clone ID: 30951121
tgccggattcatctacagtgggttcaatggtgctaacctcacccttgatggcatggcgaccatcacatccagtggcctcctccaactgagtagtggcaatggggaacacaaaggtcatgcgttccaccctgagctgctgaggttccacaaggctccccgtggcaaggtgcagtctttctctgtttcttttgtgtttgccattctctccatcgctccgaacttaagctcccatggcatggccttcctcatttccccaagcacaaacctctcttcctcgggtacaaggggattcctagggctcttcaatagacagaatagtggcaatgcaagcaatcatatctttgctgttgagctcgacacaatccagaatactgagttccaggacatcagtgataatcacattggtgtcgatgttaatgacatccgctcggtgcgatccaactacaccgggtactatgatgacagccaaggcagatatcaaaacctgacactcaatagccatgagccaatgcaagtgtgggtagactatgatgaagtgactactaagattagtgtgactattgc

SEQ ID NO: 25372 - DNA, 478 bp, Sorghum bicolor
  Clone ID: 30951163
gcttaagccctcgccctcctgccagttccgcttgctccccacgccgaccgggacgggacccggcttgaggctctgtatagcatcaccgccgcggcgccgccgccaccgcccacctcgcgcgctccacagtcctcccggccttcccgcgcttggtctccccccctggcgctcccgatgtcgtcttcggctgcggcgctagcgtggcgccgcaccctccgcgacgccctccggcgcggcggcagaggccgcagccacagccgcgccgaagaaggtgcccccgccaccccgcaagggaaggcttttaactggggccatgatagcgttggccattggtggaggtgcttatgtgagtgccgcagatgaaggaaagttttgtggctggttattcaagtcgacagaactcgtgaacccactatttgcactgctggatgcagagtttgctcatagtttagctgataaagctgctgcccatggattt

SEQ ID NO: 25373 - DNA, 464 bp, Sorghum bicolor
  Clone ID: 30951197
cacgaagtggtgcaggtgcatgtgcaatagcagctacctaggcctccccatctccatggcgtcaaagatcctgccagcggttagcgagctctttcccgcgctcgtccgggccggcggcggcacaaccactgctcgccggccaccgccaccaccagccgcacgcagcagcccatcgcccaccaccgtccacaggcacgcccctcctcccgcggcacggctcgccggcggctcggggacaacgacaacgacgctggtggtcgacgtcgacggcgccctgctcctgtcgcgctccctcttcccctacttcatgctggtcgccctcgaggccggcagcttcctccgcggcctcgtcctgctgctcctctaccccgccatccgctgcctcggcgccggcgacctggccgtgcgcgccatggccgcggtcgccttctgcggcctgcgcgctccaacgttccgcgccggcc

SEQ ID NO: 25374 - DNA, 631 bp, Sorghum bicolor
  Clone ID: 30951205
tagcccaaagacaacgactttccagtccgcctcgccttccgtccggtgtgcggggcttcccacgcacacgcacgcacgccagggtcacgatttggacgggtgcacacatcagacatggccaccaccacgacggtgacgacgacggtgagcgcgcgcgggaagcggcgcggggggtgctgcgccctcgcggcggccgcggacgtcgtgccgctgccggcgtcgcgagaggaggagcagcagcagcggccggcgaaagcggcggaggaggcgcagctgctgccgcggctggtgcggttcgaggagctgccggactacctgcgggacaacgagttcatccacgcccactaccgctgcgagtggtccgtccgcgacgcgctccgcagcgccttcgcctggcacaacgagacgctcaacgtctggagccatcttggaggcttcttcctgttcctctacctcgccgtcgccgagccaacggcgaaggtaaccgccgccgccggagccagcgccgcccacggcatcgtgacgttcgtgctggcgtcagccaactcctcgtggtcttcgtgggagaccagcagcaactcgagcttgacgttgagcaaaggtttaaccacggccatgttcgggagcagcg

SEQ ID NO: 25375 - DNA, 502 bp, Sorghum bicolor
  unsure (1)..(502): unsure at all n locations
  Clone ID: 30951222
tggacgctctcatccccaaccgaaatcgacccaaagcggaaggaacccgcggtgatcgatggacacgacagtggcggcaccgggcgcctccgccagcngtgnacccgagaacacgcgactgccggaggacctcctgttggcgtcgctcgcgcgcgccgggccggtggccgcctgccgcgccgccgctgtctgccaagccttccacgccgcggccgacaccgacgcgctctgggcctgcttcctgccccacgacctccctccgttcgctgacaaggagctctccccaccaccgccgtccaagaaggagctgttcatgcggctctccgacggccccgtcctcctcgccgactgtctcacggtacgcaactgagtccgcggagagcttctattcgcatatacggagtacacatattcatatatatatgtactagttttgctctctggttcgttctggccggagccatcagctgatcgattgctagctctgcttgtgtggtgtggt

SEQ ID NO: 25376 - DNA, 524 bp, Sorghum bicolor
  unsure (1)..(524): unsure at all n locations
  Clone ID: 30951232
ggcttcatcctggcngtttaccaaatgtttcagagcgtttcttctctgggatgtctcntggccacactctttcaacatctggttctgcaccgactttgttggccaataaattcaataccaacaaccctgttccgggagttagcttcagcggctcgcaatgcttgacctctacggcaattagtgctccaagcagcgcagcatactcggtttatgtcgtggcccaactccctggcgttggcgttcacgtcttagctgcccaagaacaatctacgagcgttggatacgcgttgattcttacactcaatggaaccaccattgagctcggcttctacgctgacggtgctcttgttggctccattgtggccgagtctggaaattatattcaaggcgatgctatgatcttctggtacactcaggatgcttcgtacggcacgattggctttgacaccatgtacaactcttttgcctcagccaccgcttcctttacagcgaccttgatcactgctattggttgcaatctgaat

SEQ ID NO: 25377 - DNA, 649 bp, Sorghum bicolor
  Clone ID: 30951237
tactggagcctcagtcagtccaagagcatgaacaatgctggtactcagctactagctcaaacaaacccgtcctcttcttcactagcaaagggagcaagacctcaccgtcttttgtcggagtgtttggttgctaggatggagaagaagagcttcgaggttggggtcgaggaccatgaggtctgggtggacgactcctccgtggatcaccgcgggaggtctccctcccgcgccaccacggggtcgtggaaagccgcaatgttcatcatcttgattgagttcagcgagaggttgagctacttcggcatagccacgagcctgatgatatacctcgccaaggtgctgcaagaggagatgaaggtggcggccaagaatgccaactactggatgagcgtcaccacgctcatgcccttgctcggcggcttcctcgccgacggctacctcggcaggttctccaccgtcgtcgtctccaccgccgtctacctgatgggtctgacggtcctggcgacggcgcagctggcgccggggctgaagcccgaccgctcgccgcgcctgcacgaggcgctcttcttcgtgggcatctacctggtgtccgtgggcacgggcggccacaagccggcgctggagagcttcggcgcggaccagttcgacg

SEQ ID NO: 25378 - DNA, 428 bp, Sorghum bicolor
  unsure (1)..(428): unsure at all n locations
  Clone ID: 30951243
cctactggatttataaaactgtagagcctgctcgatggacctgaagtatctatctgtatataatctggatgttatattgtgttatgtgtaggatggaataataagtaacgaataacatgttggaccatgaggtatatgttgttttgcagtacatttcagaagtgcctatgcctatttgtaactgtttgatgccaccttcacccatatgtaccatagcatagaaattaatcatggtgtatgattttacaagatcatgtatgatgtatggtggcaggtaacttatgatttgtggtatttgaattgaagcatgataactgaaagattggtgcagtcacaanaaaaaaaaaaaaaaataaaaaaaaacaaaaaaaaaaaaaaaaaaaaaaaaacccaaaaaaaaaaaaaaaaaaaaaaaaaaacccaaaaaa

SEQ ID NO: 25379 - DNA, 618 bp, Sorghum bicolor
  Clone ID: 30951295
tgcaagagagggcaggagaagctgcactcaagagcagcagaaggaactaggagagggggtctaaacagaggagaaaagcatgtcgtttttctttactaagtctaaaggcttaaagtttggcttcctcatgaaacgaggttttccaagagataaaggaggggcatcctctatcaaagataaagttacttctctgcttctcaatgatgaagatctccatgaagaatgggtttcgaagatgttgctttgcttgcattgtcatttgaaacaagcacttgtaaggttccaatgaatacccaggaatctccagcaagcctgactgaaagagcaactaaagaacaggtggaaagccgtctcttcaatattgttattgcataggacacaattgtagttgctgccttctagcttgtgcttttccttttgagaatgttccttgtatttagcctatccatgagaagaagccaagcaaaaactctgagtttgttggaacatttagagtcccaaatccagataaaaggagttgggggctgcacattttttgaagggaaagttgtagaactttgttgatgtatagtggctgcttccctaaatataatgctaggaagctttagtatttgatgc

SEQ ID NO: 25380 - DNA, 535 bp, Sorghum bicolor
  Clone ID: 30951300
agctttacagtgttcatatgtctggttatggatatggtcagcaatctggaggctactatattccgaatgctgcatatgcgtatgctagtgcaaacgagcttgcccagaggatgaatggcctttcagttcaaaacggtgatccaaatggaataacagcaaataagcagagcagacctgaggattcactctttggcgatcttttgagcatcgccaagatgaagcagaacaaacctgcagctggcaaggttggtggctaagtgtgagtaaagaagaaagtacctaatttcatcttatttgccagcagcagaagctttttcctgacagtacatataattcttttgccacgttttatgcaatgccagaatccagatggcttctggatgtaagctcatctgagtaggaattcatatcgggaagtggacattatgatgcttgtggcggagcctcatagcaagtgtgtctataactctaatatgtaaatatgtattgtcataaattcctttctgcgcaaatattaggcagaaacagaggattc

SEQ ID NO: 25381 - DNA, 616 bp, Sorghum bicolor
  Clone ID: 30951306
cttgatgcatcagtgaacttgcttggggcaaagagtagtaaaggagggtagttctggtgtggtctcagttgggtttctgtctcaaggggctccattatctgttagcttaactgaccaacaagatgtgcagcaccctgctaatggttcattgaaggtggacaattcaacacgagcaaccccacctcagggtggacaggtaaccaaattcatatgcctaagatcattaagatcattaagccagttcgttactttgccacagttatggatggtgtacagcaagttgcaataacattcaaggcactcaggtctgacggagaggaggtattcgtggatgacaagcagttgaaagctaaggagcccctggtgcttattaattactatgagcaacatcttcgctataaccccacctcgtgagaaggatgcattgacactgctgtgtttcagttgcttgtgctgcacctatgtttggaaccgatggagatgtatttaaacgtagaattttttttgtgctagatatatctgtgctctgttctagtaattagatggttagtccgcacttttctcatttggttgtcattctgactatctgagtgcaagtaaaatattgatagcatgg

SEQ ID NO: 25382 - DNA, 366 bp, Sorghum bicolor
  Clone ID: 30951358
tttattttttttggacaaaaacaagtcatttaatgcagcggtgaaatagaagaagtcatgtattttgaagcaaagagggaccagttagtgcaggaaaatagccaccagaagaagtgttttttttttttgagaattttatgtagatgattaatcaatgcacccttaggccctgtacccagtttccagaagcatttgccacatttttgtaaattacatacgggggagaataattgtttcgtcgggtataggattccccgtccatattgttaaggaaatacatgatttcctgtcatccagtgccatcccttgaacccctgaatggctgtatgctttggatgtttgtacttgcatggttcttttctgtcc

SEQ ID NO: 25383 - DNA, 708 bp, Sorghum bicolor
  Clone ID: 30951366
gctcactgaacttgggacttttgagctttctgataacttgggcaacccagcaaaagaagattattcaattcaagaaaatcaagcctctgacagcgtgttgctagattctgaagagatgccaaggcatgactgtgttgatggtgaatctacacattcctgtgtcgacatttatcaggaagaaagagtgtccacaagggaagatcaaacatctgaagaaactctgtcagtatcccatgatcataatgatgttggccaagaagctagtctaagtttggcagagccatcttctattgatgagcatgcacaaagttctgccaacaacttttactatgactatggtgaatggagggttgtctgggatccgttctatagtcggtattatttttacaacatccagacacaagagtccacatggtgtcctcctgaaggattggaggattttgcatcatattgtagcccagataccactaaagagctagttgaactgggatctcagtgtacaagcatagcaccgcaagagaacagtaagacccttagaatttttggattatcactttgagtcttgttctttgcagttaaccttacgaatagctatatgcactgtgatataactttctacaatatgtaacacttgagcatgtagcaatggattgtaaacatttaataataaggtagtgaaatccattacacactgtattgagttttgca

SEQ ID NO: 25384 - DNA, 617 bp, Sorghum bicolor
  Clone ID: 30951368
acgatgtgacgcaacatcatcgcttgggaccaaacttcaagcagattccgatcaacgaaccgaagggtattgtgcctaacactgtctacacgggtggtgcacatcgtcacgacttaaagcctaacggaggctggcctcattactcgccgtcattgttcggaggtctgcagcctgcacctcagtacattgacccgcccatgaggactgacggacctgctgacttctacgacgtgccgggtgaaggctccgatgccgacttctacggccaagcccgcgagttcttgaaagtcaccacgccgaggaccgcaaggccttgatcgagaacttgagcacttctttgcaccgcgtggctgaccgcgtggtgactgctgtgttggcgcacttcaatcagattgaaccggcacttgccactgctgtccgtgaaggaattatgttgcgcaagaacggcagtaaagtcactcctggcaaccctgtgctcaaacaattcaaccaagagttgttgggcaacgctaatatggacattaacgctgcttaaatgcaattttgagcgaatttttgatatgacacttggtgacactttcgatgcccattgtcattttgacttgttaaataaattt

SEQ ID NO: 25385 - DNA, 651 bp, Sorghum bicolor
  unsure (1)..(651): unsure at all n locations
  Clone ID: 30951374
atcggaacttagctngagcaatgatcctcacttggaaggctgtatcagtgattttcctgtgcctgaagaattggccaaccttgatgaggattttttagccaagagttgtaatcttggataccgagcaaagagaattgtaatgcttgcacgcagccttgtagaagggaaggtatgtctacaaaaacttgaagagatgtgcaaaatgtttgtaccagctgcagaagatgcatacagtattggatcgacctacgagagattgaacaaagagttatcgatgatctcagggtttggtcctttcacacgtgccaatgtgctcatgtgtatgggattctcccacacgatcccagctgatactgaaacaattaggcatttgaaacaggtatttcccttcttggaacctttgcatttttttaggattcattgttgatgatttcaacatgccctgtactatgacgaaatttattgcagattcataaaagagcaactaccatcagttctattcatcaggaattagataaaatctacggcaaatatgctccattccagttcttggtatactggtttgagttatggggcttctacgacaagcaatttggcaaaattagtgatatggaaccatccaactacggactattcactgcaagtcattga

SEQ ID NO: 25386 - DNA, 558 bp, Sorghum bicolor
  Clone ID: 30951378
atcagttctagaatttgttaatgctgacttttatcaggttccttttttagcacccgaaagcctgaaatgtaggaatgaaggtatgcccagttggcaaaataaatagaattaaacagccgaattcaagaaattttctggtagaaactttccaaactttctgattttcttttctctggtagtcttcgggcttgatttttttctctgttagtggagccctagacgatcagctaagaaaagatgtaatgtaagcatgggcagcgtacaaataaatgtgagctaaacagaagggttgaagattgctccatttgaaaagttccaaaagcttatctttttttgctggtagtatgttcttcaatcatcaagttggttggaaatgttgtaagcttcatgtagagctgtcagtgaggagctagacgattaacaaagaaaagtagatgcattcatcttttcgttgagtcaattagcacttgttacacaattctccttacttatcactgttactgtcatagaaatatgaaagatgaccctatggagatcccctctctttgttttgctttt

SEQ ID NO: 25387 - DNA, 680 bp, Sorghum bicolor
  Clone ID: 30951400
gtcaacttttcaatagcaaccacgtctatacacaatggagactattaagaaagctgctgcttcggtcgtacatgcggtcaccgaaaatagaaacacaatgcccgatgtaatgaccatggccaccggatgtcccattgcacacaacaagaactctttgactgctggtcctactggtcctgtacttatgcaagacaccgtacttcaagagaagatcggtcaatttgctcgcgaaaagatccccgctcgtaatgtccacgcactcggatttggcgctcacggcaccttcactgtaaccaaagacattagcaaccattcatatgctaaggtcttcgccggcattggcaagaagactgaagtgtttgtacgcttttctggcgtattcactgaacaaggagatcccgacactttgcgcgatctacgtggatttgctgtcaagttttatactgaagaaggtaactgggacgtgctgtgcgtcaacacacctgtctttaatgcccgtgatatgaaggtcggtcctgatgccatccacgcatttaagcgcgatcctcgtaccgccgaatggaaccctactcaaacttgggactttattgccacgcatcccgaatcccttcacaatgttttgatgatctacactgaccgcgttggaactccattaagtttccgtcaacaaaactggttcc

SEQ ID NO: 25388 - DNA, 206 bp, Sorghum bicolor
  Clone ID: 30951402
ccctctcgctccgccgccccgtgcgcgtccccgccccagcccccgcccgccagctaggtgtcgcgcgtctcctcttcccgcgtccgcatccgcgcccgcgaccaccgcttctagggttagggttccggcggagatgggcgtgccggcgttctaccggtggctggcggagaagtacccgatggtggtggtggacgtggcggaggagg

SEQ ID NO: 25389 - DNA, 630 bp, Sorghum bicolor
  Clone ID: 30951408
gcaatcttaggagaaatgcaattttcttcttccctaatccaaaaaaatgtaagatgaatacttgtgggaatttctagagaatacacatcaagagatataaatagaatgcgttatatgattatcgcactgcaaatggtataagcatgtgaaagcaaacccctcaatgttaaagacagatcagttcaacacaaataaatggcacttaatattacatctgagatgaggaagggtaattatgaactcgagtaaagtatcatttgcacttttcgaaaaagcagtagttaacagtaaaatcttggtaaatcttgacaaaatgttcaaacaactattttctgtcctaatggatcagcgctaagtttctatcatgtatcttaatcggtattatatccataatatttgaagaggtaaaactaattgttttttttttctgttcaacatcagcaccatgtgaataaaatgaaatgtaaaacttacatgtttgacactgttgtcagcctggttctatacttcatcaaatggttctatttctgcaaatagttgctcaggctccaaatcaagggtaataaaactatctgttagccctttttggctcaggatttgtatgtggaagctgggttatatttcaagatg

SEQ ID NO: 25390 - DNA, 243 bp, Sorghum bicolor
  Clone ID: 30951416
tgcgccgctgcttgtccaccggaccaccgccgatcggccacgccagccgcccaaggtagccactacgccatccgccgttcgccctgccggctcaggcggtcggtccccgcccaccacggctctgcgagcgctccacaggtcacgtccccgtctccccgactcccgcagtccgcatcccgctgtcccgcagccgcacaggcgcacaggtcgcgactcggactcgcgactcgcgagcggccgagc

SEQ ID NO: 25391 - DNA, 556 bp, Sorghum bicolor
  Clone ID: 30951458
gaagtcaccttccgtccttccgggtccgtgcgtcttccctccctcctccggcgccatgctcgagccgggccgctcctcatccccttggccgccggtgaagcacaagcagatccccttcgatatcgtccttcccatcgtccgcttcggttcccgcggcccccgccgctgttttctcggtcaggctgggaaggacttcggcggcaggctagtcctagtccatgccagcgccgagctcggcaggaggacgagccggccacgccacgatgcttctccacgagagggaaggagccagtgccgccgctcggccactgcgcctccatgagcagtcgctgaggtgctgctgctgcggagcgacctccatgagcagtcgccgattccgtgcgtcttccctccctccgaggtgctgctgcagcggggcgacctccatggttccatgagcgcttcaccatggccggcgtgcttttgagagaacatggtggatgggcaccatcagctcgctatgatgcagcagcatcagcatcagaaccacgccagcagaggaccgaaaaaaaaaact

SEQ ID NO: 25392 - DNA, 562 bp, Sorghum bicolor
  Clone ID: 30951464
cgatttccttttgcaactccggcttcagtgagtcgttgtggtggtagtggtgtttggacggagcggagatgtcgtcggcgatggtggagcgggcaacgagcgacatgctcatcggccccgactgggcgatgaacttggagatctgtgacatcgtcaaccgcgaaccagggcaagcaaaagatgtggtgaagtccctcaagaaacgcattgcgcacaagaacccaaaggttcagcttcttgctctcacgttgctggagacgatgataaaaaattgtggggacattgtgcatatgcttgttgctgagagagacatacttcatgagatggtcaagatagtaaagaaaaggcgtgctggagtcgtatttcctcaaagatcgaatggttctgtgccaatcatcactcctccacagactcagcctctacaaaactatccctcatctttacgcatttcacagcaggaggaacttgactcgccagcttcagatttccctgcattaagccttacagaaattcagaaagcacgtggcatcatggatgttctttcagaaatgctggatgcttt

SEQ ID NO: 25393 - DNA, 636 bp, Sorghum bicolor
  Clone ID: 30951470
ggacatgctcgaacttgagcccgtcctcgctccatgctgccgcaactcatattcctctcctccctccactgcagctcgtattcctctcctccctctccctccaccttcagtccccaccggagatgcaagcatcgccaccgtcgaggatctagcgtcgcctgtggatctagccgcaacgcctccttccctgccgaaggcggtggcagggcctctcccctggcggatctcctcggccgcggcgaagttggtgattcttaccaacggcggcgcttccacccagcggcaatgctctcttcttgctctattccatggtgtaccctccccccaccccatggatctggcggcgccccctcctccatgcccttcgatctggcgacgagccgcaccaggggctgtggcggcggggcttccctctcccggctgcagctgcggtggcttcctcatctcccctgatggcatccacttgaaggaactggcatccggcggctccatccctgccgagcagttccgtgccttgtgctggccgcatgcgtcgtctctgtcctagtagcatgcttggtccgggtcgcgtagttgccgagccaaaagcatgctttgtgtggcagcactgccgctgagacaacgtcgatggaatca

SEQ ID NO: 25394 - DNA, 566 bp, Sorghum bicolor
  Clone ID: 30951513
cacaaaaggaaacttcgctcccctgattcggccgcccggcagtttcgcgacgccaccgatcttgcgcggccgtcatcgccatcgcgcggggaccctcatcctcgctccgcatgcagccggccaccgtcgttcgtatccgccgctacccatcgtcaccctcacccgcagctcactgcgtcgccgtcggatgccgcacggaagctggcgaggaggccacgacacggcggcaccattgaggccatgccatggcgatagaccacgacgcgggatgctgggctgctggcaacagctaggcagaagtacggtatggcccagcctcggtgtggccatgtggggcagtcgccggcgctggaatcaactacgacgggataaaggtgcaggcatgcggcagcgacggcaatgttggagcaagctccatcgatctttcaaagatgagtagtggtgggctggtggcagtgtcatcggagggagtgggacctatcggctgatagaaaatggagattgctggtgcatagaagttttgaacgaagctgctgccagagaaccctactgatgtgctttgctag

SEQ ID NO: 25395 - DNA, 663 bp, Sorghum bicolor
  Clone ID: 30951528
gggcatctcctctccccctccctcctcgcccccgcgccaccaccaccaccttctcttccaccctcagccccctccccttctcatacaaaccagaagagcagaggaggcagcagcagcagcttcgcattcctggtctccgtcctccaatcccacgctcttctctcttgcctcgagagagaagagccaccaccgtcgtccgacaagcagagagagggtgcgagggcgcagccggcattatggcgccgggcggcggagacggccggcgcaacggcgagggacagcagcaggcgaacggcaacaacaacaacaacaacaacagcaacgctaaggctaagcacgggtgcgtgtgcgggttccccgtgtgcgcgtgcgccggcgcggccgcggtggcgtccgcggcttcctccgccgacatggaccgcgtggccgccgcgcagaccgagggccagatcggcgccgtcaacgacgagagctggatcgccgtcgacctgagcgacgacctctccggcgacggcggcggcgccgaccccggcgtcgcgatcgaggaccgccccgtcttccgcaccgagaagatcaagggcatcctcctccacccctacagggtgctcatcttcgtgcgcctgatcgcgttcacgctgttcgtcatctggcgtatctcgcacc

SEQ ID NO: 25396 - DNA, 587 bp, Sorghum bicolor
  Clone ID: 30951542
cggatcaagaggctggaggcaggcacagcctggcccggagccgtccgccgttgggtcgtggcgcctactccagcgaagggatggacattgtggcacgtctcatgcttcagaaatgatcaggatgggccaacaacatctgacgaaggtgatggcttcaagtacgttgcccaatcacagagctccggtggtgtagaggtgaaagaggaagaggtgagtacctcaaatgaggagcaggtgcagaatttcaaggacagggattggttcctgcaactgcagaagataaaagaaaatttactgggcagaatagtaagatttcagacagaacgctggacagtaccttggactggacaaaccattgctcaggtcatgattttatggattgccacattttggtttgtgggttcctggatagtgccattcttggctcatgctgctgggtttagcaaggaaacattgacacacagaggccgggcactatatagtctcttgacagacataacagaaggccttgctgggattgcaatccttcaccaatgccttggtagattccggccccttcctcctggctggtttgagttcaatttgaa

SEQ ID NO: 25397 - DNA, 644 bp, Sorghum bicolor
  Clone ID: 30951562
agcagaagatgctttcgtttcattggttgatgtatcacgcaacctccgactgcttcaaaaggccccccttctatttcaccctatgtgaacacattgcatttttccaaaatgtttgttacagtactttattttgttcatactgcagagtttccttattgcaagactttctaattgacattgaccatggctatggcacatggttaaataccaccttcgttgcttgatttggacagacaggacacactgttgttatgtacctgatatttgtttatgtcttgtgctcttttttgggtttatattttggtgcaccaattatgtcattggttatttactgaacatatgtttatgaggtggtttctagaattccatttctgcacaagctgcagtgcatttctatctgacctactcagatctggcattcagcggttgccacacttgggagatcagatggattacatctccaaaaaagaagtacatctccatcgggaattgacaaccagttggaccaggggaatatacacggatgcagttgcctctacctgattggtgttccagatttgaggtcatccattcaccagcaaaacgaagaatgattgtgcagctgcatttggactgaagtggatgcttaatcatatacttgaact

SEQ ID NO: 25398 - DNA, 674 bp, Sorghum bicolor
  Clone ID: 30951574
ccagtaagtcagcatatgctgctttctttttggggaccgtcaggtttgctccatggaaaagaatttggaagagctgggctcctttgtgctgcaaattttcaattggctgtggaaacaattcagcacatcctaatctcttgtgtgtttggccggcaagtatggacactgatttttcagaagctaagcctgtctgctgttgctcctttgatcaaggcaacccatttctctagctggtgggttagcaccatcaggaatgtccccaaggagatacgcaaagggctcaattccctaatcatccttgtggcttttgaagtttggaagcattggaatgcttgtgttttagagggagtgttgccaaacattcaagttctccttcaaacgttagttgatgggtggggtttttgtagcatggcgagggcttctaatctccactttcttaggttgcctgccccagatttctatttgttgggaggatggctggtctttctttcggtcatggctgtttgtgttatgtgtgcttgacggggctgcttttttttcttccccctctgtacctttttctctcctagtgaaacgacatgcacctctcctgcatcgtttgaggaagaaaaaacaacgaccaggcttcacataatgcccccttctacaattttaaagaatgaaaatatgcacat

SEQ ID NO: 25399 - DNA, 445 bp, Sorghum bicolor
  Clone ID: 30951586
acgtttccctattgaatctaaggggcggcaaaagaagctttatgaggttgggactgtgacagcaatttgtgttacctgcttcctgataagatgtgttgtggttgcattatctgcattcgatgccgatgtatctctcgaggttttggatcatccaatcctagatttcttctattatatgttcgcggagatactgccttctgcgctagttctcttcgtccttcggaagcttcctcccaagcgggtatcggcgcaataccaccctattaactagagagttttttttttttgtttttgttttatggtgttacatgctaagaactccggataagctgaaacggcggaaaacctacatccggttgtagttgaatgcttttgcttgtgctgttatgtttatggaagcatcagtgtttgcgacgaatgaccatgcatcgtcgtcatcatcatc

SEQ ID NO: 25400 - DNA, 538 bp, Sorghum bicolor
  Clone ID: 30951614
gtgtcaaacaacatacacgaattgattttagaaatgtactgatttatctttgtgagtttgtgagaaaagcttcaaggtatgcctgtaacttcagcaatgacgtcctgaggatggtgaatgcacaataaaaaagtgtcgcagaaggtggattgtagttcccctctatgttgacagtgcctaggaatagatacactgacgctttgcacaatgggtagcacaatgtgcatccatacatatcactatcctgtatcttgttttgttgctgatcagaggaatggcactaccggcatgggtctgacgtagtgttttgagaaaaatatttttctttgcttgatgaatctgggcgtggacaataaattgattttttactagaaataaattattgtaaccatgtcggatcttgctgtcatgtaaagtgtaaatttctgtgtaaatatacatgtagatataaatgaactgtttcccttgtttttttgtccattgtactgaatcacaaatgccacagtatttcaaatgtatttccacactaattcagggt

SEQ ID NO: 25401 - DNA, 750 bp, Sorghum bicolor
  Clone ID: 30951615
agaacttattgatagatcggcgtactaatacactgaagcttgctgactttggtttatccagggcatttggaattcctgtccgtacatttactcatgaggtagtgacattatggtacagagctccagaaattctgcttggagcgaaacagtattcaacaccagttgatgtatggtctgtgggctgtatctttgctgaaatggtgaaccaaaagccactattccctggtgattctgagatcgacgaactgtttaagatattcagctatgattgtgctggcattaagtttcttattttgtatttgcatttctagactatctgatttgtttgtatcatggtcactgttgaagggtactaggtacaccaaatgaacaaagttggccaggagtcagttgtttgcctgacttcaagactgctttccccaggtggcaagctcaggacctggcaacaattgtcccaaatcttgaacctgctggtttggaccttctctcaaaaatgcttcgatacgagccaagcaaaagaatcacagctaggcaagcacttgagcatgagtacttcaaggaccttgagatggtacagtgacctgctaaatgtgcttgacgttgcattggcaattgtatgagctgagtctgctctgtcgctcattccttttgtgaacgcctgtactctcattctctctacatttttgtcattcgactggatattttaaatctggtgtgttttgagatgtattaaggaatttcaagtagatt

SEQ ID NO: 25402 - DNA, 535 bp, Sorghum bicolor
  Clone ID: 30951625
acaaatacatgagggtttgatggaataaacattctccttgtgattttttttttgtctggtactcttgatgagaactggatatatccctgagacatgatcaataatttggttactttagcaacatctggttgacacgcttgtttcctaaattgtagctacggtggccagagctacaaatacaatggggtggccccactgcctgcacagcggaacctaactccacccccgacactttatccacagcagccaatgtccttttcatcagaaaactacagataccccagattttcctcctcgtcaatacctgattcaagtggtggtagaacaagccgagcaaacctcgatatatgatgagatatgtgagttttatccattatcccctggaatgtggggaaaaacatgacacctgggttttttgaatcccaggtttttttatctttttttagttgtgcccctgtctttgatttgatatgtgcatgttgacagggcgtttgaacattatgtttgtgggatcactagtgataaattctttgat

SEQ ID NO: 25403 - DNA, 591 bp, Sorghum bicolor
  Clone ID: 30951635
gcgggcagcaagcagttccggtccagatccgcggtgcaagcgacgaggaggagcgccttcggccgccgctacgatcctgtagtgcccatcgacgacgaagcagacgacgagacgttgcgtgatgagatggttgcggcgtcggacatcagctcgttcagcagtgatctcgacgacgatgacaccatcatcaaggaggaggaaaacagctgcgaagataacggggtggacgaggacgatgaggacggcaactcgtgcgacgaggagctctttgagctggcgatgaggccaggaccggagacggagacggagacggaggtggaggacgaggtggacaggaaggccgacgagttcatagccaagttcagggagcagattaggatgcagagggtcgagccggccaggagatgacccaccgatcgaacacgtccgacaaagtgtttacaggcacaggcaacaggctcacagttagcctccctcgtgcagtgtatgatagcgtgatatttccttttacgtttgtcttttcattttgggtgtcgtaatgtaattacagcctcaacagcggtgtaaattaacaacatagacccggggctc

SEQ ID NO: 25404 - DNA, 553 bp, Sorghum bicolor
  Clone ID: 30951641
tcagtttcacaccgaggctgttcacatgacatcaaagctcgacaagagatattgtgctctagttgaggtccaagcatgtggatcactcgtaactgaggagcaaccacatgcaatgcttataccaatggagtacttcttcatgggatatggcttgtacaggcctagccagctggactgcagcccgcgcagccccctgagcccattctgtatatcgccggatctcctgtcacctgagagcatgggggtgaagctaaagccgatcaaaacgcgagtcaggcttgaagtgtagcagaagtgagtaatgggatggggcgcttaggggctgacatggtgagaggttaggctaacttgcaggtctgtcttaatttttttggaggtataaagtcaagatacctgttatactgccatgtacatataggaaaatgctaggttggtgagctcggctggggtgggtgggttcttgtattctttgatttgtagcctgatgaaacctgtaaatttggtatacattgtttatcaaaggaaagtgaaagaaataatagcagaaggtgag

SEQ ID NO: 25405 - DNA, 651 bp, Sorghum bicolor
  Clone ID: 30951673
tgtttcgccgtcctcaagacagtcgatgatcactgtgggctttggttaccatataacatcttccagcacctgttccaaaataatactgcctatcacgacatccaccaccagctgcaaggaaccaaatacaactactcccagcccttcttctcaatctgggacagaatactaggaacccacatgccatacgacttagtgagcaggaaagaaggtggatttgaagcaagaccattgcgagactagcttgaagtcatggaagtgtatagactccggtgaatgagtcagaatacggtgcttagcctccctttcacatgattaggagctcccaacaggggccatctaatttacttccaagatgatgaaggtgttctggcaattggtggcttagtctacatcttggttgagtctacacgctacttaagcagaggtcgaagctcatgcattgcttgctcttttgagtgcggtctatatggtctgcgcgttcaactggttgtacgaatggttttacctgtcatggttacttttttgtgcagagctgccatttacattgctgtgcagatagtgtatttgaaaatccacacttctgtatgtacccaattatttgtgtaattgaacctggtcgtgatcgacaccttcggcgctatcttggct

SEQ ID NO: 25406 - DNA, 524 bp, Sorghum bicolor
  Clone ID: 30951677
ccggtgagcaaacctacttgctgattaatctattgttggatcgacgggacgatgacagacagtgctttcttctgtcattgggtgcttcttcctatacagcagtactgatgctgctgctatggtcaaccatgttggtctgtgttgtttggcaactcttcggtgtgttttgtcaagagtgaataaataacttggtttctgatgctttgctacctgcctacttgcatcaaccaagtttgttacatcagtgttgatgtgtgtgcttgatactacaggggtgtgaatttgtatgcacatgtctcttgagagactaactggttaatgtatcatttgctttggtttggtttggtttggtttggctggttatctgtgtgcgtgtgagtgtgagctcgaaaattgaaataagaggctgggtctgatgcctccagagaacccaactgatggtgttcaagtgttggttttcagtttcattgaatgtattgggcaaaatgtatgcttgtttgtgatccatgcagcagcacgctaat

SEQ ID NO: 25407 - DNA, 524 bp, Sorghum bicolor
  Clone ID: 30951679
ctgtggagtcaaagcatgaagataaaatcagagatgcacatgatgaggctatatttggtgtccctacaatttcatttgttgatactgaaactggtggggacgagcttaaaaccaatcatgaagatgggaaagttgaagatatagaagctgatgaacctagcagctccctcatcagcgacaaagttctggccatgcaaaaaggttcctggagagatcgggctcagaagttgcggcaggattcgaatacatgaagtttgtcctcgtccctgcgaccctgctcaagtttgaatttgccagcatgtgacagatctggcatcttgtgaagaatggagcctgaatttgaacttaaccccacccaccccttagaaaagtatagtagtagatggataatgtaagctgaactagacggtggttgtttgtaacactctttcttgtcatctacaaacaattgtataaacaaaatctacgttacgctgtctatatgggattctacaccatttaatccttgcatgaaattaatcaat

SEQ ID NO: 25408 - DNA, 613 bp, Sorghum bicolor
  Clone ID: 30951695
agccaccagccacgccaccaccgctttcctctcctcttcggctcctccgcctcccgtcccctccccagttcccaaccctcctcgttcctccctcccgtcgtcgcctcgcgcaccaccgtcccctccctccgatccggatggtggtgcgttcggaatcccgcccggcgctctagcgtagctcgggctcggccaggctccgggccccgccaccgcgccgcgcggtgccgcagtccagctccaggtcaagctccaggtcttttcctgagtttaagggagatgcttgcctttatctaggaggccctttttgatacttcagcagagttcttgccttctggagtagatgtcattccgtagcatcgtgcgtgatgtaagggatggtttcgggagcttatctaggagggggtttgaggtcaggtttctgagtcctcgcagagggaaatctcatggtgctgtccatgaactgcacgacccagtgcctgtggtacagagcagctgctgggctagcttgcctcctgaattacttcgagatgtgattgagaggttggagaccagtgaggatacatggccttctaggaagcatgtagttgcttgtgcagctgtctgcagaacatgg

SEQ ID NO: 25409 - DNA, 699 bp, Sorghum bicolor
  Clone ID: 30951707
gtactagtcgttggcgaggtctgcttcatgtttcttactttgtttatttattagggaaagaaatccctgatcaatagagatggatccacatgcaataaatcttctgttctggcaccttcccaaatcaataagggcgaggcgacagcagcgaggagacgaagcccttaaaggcgccagcttttcttctgttccatttggtctcctcttgattcctctttaaacgatttcatcttctgcacatcatcagctcatcagctgatcctttccgtcgtatttccgagcaaaagagaaaccctttttatgcgctgtgctgttttgccatctctgttcgtcccaccgactcgaatccccattctccccaaccgagtggcctctggcgtcacaaaacaagaacacgaccggttcctattccctagatctgcgtagaggcggcgagacacccgaatccggcaaaagggttcgctgtttgattgggaaaagcgcaggagtccggcgtcaaaacccaatcttggcgccggagcagccgtgcgccatcatcttctccgtgtgttgttagggagaggagaagaccagtggagatggtgccgtgggaagggtacatcagcgacgagacgatgggcaccttcgcgcccatcgtgctctactgggtgtatgccggcggctaccagcttatccttcaccgccggccgcttgagcggt

SEQ ID NO: 25410 - DNA, 658 bp, Sorghum bicolor
  Clone ID: 30951711
ctctgtccgctaggcctcttgctgatcagcacacacctaagaaaaatatacacagcagacagcaccatcgtttcttgcatacactgtagctggttgctaagggattggagatccattctggaagcgatggagtagatatgggctacaaaaatacctctggatcagagcttcttcactttgttaatcttctcctctatatacagactcgtcatgccgcggattacagcggacgacatcaggacggcagtacaacaaatagttccttacttagaggacacaagcaacaatgcacctcgggtcatctacttcgacggatggtacggactggctgcttctgccgtgcttagagctatagcagagcaccctccacaatctttaagagagaaattcgacaagatcatccacattgactgctcgatgtggaagagccgaagagcactacaaagggtgatcacggaagaactcaagcttactcaacaggtagcggccattgacatggaagacaaggagaacgatttcagtggtgtagaccaaggctccagagctgagatcagagacataacaggagtgataggtcgatacctagtacaatacagatgtttagttatctttcacaatggaagtagcagcacggttgacttgactgactttggcattc

SEQ ID NO: 25411 - DNA, 485 bp, Sorghum bicolor
  Clone ID: 30951753
acctgcccttttttcctttcctctcctctctctctctctctctctctctctctctctcctccgtctcggcgtcgtcttcatctccatctccgccttccccctcgccacgccacgccacgccgcattcgcatctccggatccccattccccgccgccgccgccgccgcctcacgcgctcgcgacccacccggcctcccgcttcgatctcgcctcgattccccgtgcccgcccccccccccacccgattcgtccctgtcacgcgcgcgcgcgcgggtgggaagacagcgatggctcggggccggggcctctcgcctcgccgcgggtgacctctcctcacgcggggagccctcccgcgtgccccacgcggaggatcccgtcgcggctggtgccccacttcctcctctcctgacgccctcttcccgtgagcgcgccctccgctcctagggtttgctccctctccttcctcaccacccgatttgatttcg

SEQ ID NO: 25412 - DNA, 656 bp, Sorghum bicolor
  Clone ID: 30951755
agcgaccctaccatcaccgatgacggggcggcgctgccgtgcggccgtgcctcaggcgcttgccccgcggtcccgtatcccagcttccgctgcacatcccaggcgctcttcaggccgacccgcctccgctgctcgcagcgctgcttctcacgggtcgccggggagcgctggggctggcgttccgtcttcgtcgcgcgtctcgctaggttgttgaccttgctgagattgattgctatcatcctattcttcatatggcgtatcaggcacccgtatgctgatggcatgtggctctggtggatatccatcgttggagatttctggtttggtgtcacttggttgctaaaccaagttgcaaaactcaaccctatcaagcgtgtcccagaccttaccctcttgagccaacaattcgatctccctgatggcaactctaatctccccaggcttgatgtttttatcaacaccgttgatcccataaatgagcctatgatatacactatgaattctatcctatccattcttgccgtagattacccaattgataggactgctacctacctctcggatgatggagggtccataatccattatgagggcttgcttgagactgcacttctgactaatgctcccttcatcatcaattttgatggtgaccacta

SEQ ID NO: 25413 - DNA, 481 bp, Sorghum bicolor
  Clone ID: 30951763
caaagcagagagggagagggcgaggaccaagggggagagagagcgagagcgagagcgagcgagccagagatgaggagggagctcgcttcctccttcgctactgccgccgccacggcgggcgcttcctcctcggctgccgacgcgctccggggctggtgggacgacgtcaacgagtcgccccagtggcaggacgcggccttcttctccctcgccgccgcctacgccctcgtctccgccgtcgcactgattcagctcatcaggatccagcgccgggtgccagagttcggatggaccacgcagaaggtcttccacctcatgaacttcctcgtcaatggggtccgtgctctggtattcggcttccatgcacatgtcttcctcctccacacaaaagtatacaagttggtgttgctagatctccccgggttgttgtttttctccacctacaccttgcttgtgctcttctgggcagaaatataccatc

SEQ ID NO: 25414 - DNA, 707 bp, Sorghum bicolor
  Clone ID: 30951779
aaagagcgccatggacgccgcccagtctcgctcccatgagctactggccgcaataggatggcctcttctcccccagcagctgctgctggttgtggtgccactcctcgttctccctctcctctgcctgctgccggcgtcgaggcggcggcggaggaggaggagcagagagcaaggaggagcagcagcagcagaacgccgccgccaacgacctgcactgctgcagtcgccccaactcaccaggccccaggatgctgagctacgacttccttgacgtggccttcagcccctacagcgactactggcgcgagatgcgcaagctcttcatcctggagctcctcagcatgcggcgcgtccagtccttcgcctacgcccgggccgccgaggtggaccgcctcgtgtcctccctcgccgtcgccagctcgtcccctccgggcgccgccgtcgacctcaccgagaagctgtacgcgctctccgacggcgtcgtcggcacggtggcgttcggcaagatgtacgggtcggcgcagttcgagcggagcagcttccagcaggtgatggacgagacgctgcgggtgctggggagcttcaccttcgaggacttcttcccggcgtccaggctcgcacggctcgccgacgtcctcaccggcgccgccgcccgcaggcgccgcatcttccgccagatcgatcgtttcttcgactcggtcatcgat

SEQ ID NO: 25415 - DNA, 705 bp, Sorghum bicolor
  Clone ID: 30951785
gaccgcttcttcgcaacctccccgctcccactccccccttcgtcttcctccgtctccatctcccacggatcaccctcttccttcgtcttccttcgcagacctgcatttgctggtgcgccgccgccgcgtggcgaggagctagcccgcgcggccggccagcgccatgcctatccccaaggccgacgagctggttgtgcacgccgtcaaggagcagttcgtcggcctcgacttctgcatcaccagccccccgccatggctcacggcgatcctcgtgggcttccagcactacctggtgatgctcggcactaccgtcctcatcgccaccatcatcgtcccgctcatgggcggcggccattatgagaaggcgattgtgatccagaccatcctgttcctgtccgggatcaacacgctgctgcaggtccacttcggcacgcggctccccgccgtgatgagcggctcctacacctacatctacccggccgtcgccatcatcctcagcccccgatacgcgctcgtcatcgaccctctcgagaggtttatcttcacgatgaggtcgctccagggcgcgctcatcatcgccggcgtcttccaggccgtcgtcggcttcttcggcatatggagagtcttcataaggttcctgagccctctcgcggcggtccccttcgtcacgctctcgggcctgggactcttctacttcgcgttccc

SEQ ID NO: 25416 - DNA, 664 bp, Sorghum bicolor
  Clone ID: 30951803
gaactacagcagcgcaagcgactcgcaccgtcgcaggtatagagccctcgcaggtatacggcagccgaccaaccaaccaactcgccggcagccgaccaaccaaccaactcgccggcagccgcaagccctcagatcctcccgtcgcacgggaaaacaaccctccctctgctgtcgctgctactcaccctcttggatcccttcccaccccacctcccggatgcagccggggacgccaccgccggcgcctctgccaccgaatccgttgatctagttgctgctattgctgccgctgcttgattgggttgaggaggaggtggaagaggagggaataggagatgatgttctggaaggacggcggcgggactgggggcggcaacggacgggacctcagcggcgggccgccctgcggccaggtgcgtgtgctcgtcgttggcgactcaggggttggtaaatcttcattggtgcatctcttattgaaaggttctgcagtggctcgaccagcccaaacaattgggtgtgcagttggtgttaaacatatcacttacagtagtccagggagttcatctaatagcatcaagggtggtgctgaaaggaacttctttgttgagctttgggatgtttctggacatgagcgctacaaagactgtcgttcacttttttattc

SEQ ID NO: 25417 - DNA, 566 bp, Sorghum bicolor
  Clone ID: 30951815
atgaatgcttcacgaccaagcctcctagctagcttcctctccccgcccgaacgccaaggatctgtcgctccaagcttcccaataccgacgccaccgcaccgatcgcagcaacctagctaccgagaccccgaacaaacacacagcctcgggacaacgcaagaggcgcgcgcgcgcgcgtcgtccgcaatggcggaggcggcggccggcacggctccagcgcagcagcagcaggctgctgctagagtagctacgacgacggcggcggcggccagcgacgtctccgcgtccgcgtggctgcagcaggtgctggcgctgctgttcccgtccagcctggccgcgaaggcggcgctgttcgcgctggtggtggcgctgctgccgctgctgccgtcggggcaggcgcaggaggcgcccaggatctgggagctgccgcacctcctcctgctcggcatcatcctctcctacggcgtcttcggccagaagaacgccgacgacggcgccgaggtggccgccgcggcggcgggagcggctgccgacgacgccaagctgctgcccggcgtcgtcgacga

SEQ ID NO: 25418 - DNA, 529 bp, Sorghum bicolor
  Clone ID: 30951819
cccattatccgagatcgaccaaggaccaaggtttcttgtgcgtgctgccactgccatggccatggcggtcgctcaccttcttctccaactctccgccgccgccggaggcaatggaggtagcaggaacagcaggatggtcattccggccattctcctgattcttcttcagcttcttctcttcacaggtgcggtgggattcttgcttgtttttttccccacatgtttttgctctttggtgcttttttttttctttgacatgatttgatccatccagcattgttgtggagaaatttaccagatttcatcatcagttctgttctggtctgtgcgtgaaatttgattcacatcaagcttttgtttcctataaccttgagttcttaaccgagtgttcttcaaccttttttttatctttaattagtagtacatttaattcttgcatgatttgattttttgcattattatacaaatccttccatgatttctctctgcatgcttgcatatatgcaaatataatgtacagctagttagt

SEQ ID NO: 25419 - DNA, 656 bp, Sorghum bicolor
  Clone ID: 30951820
agagagagagagagagagagagagagggagaaactgtgcgcccgcctgccccctccttccgtcgtttataagcgacggcaacgcaggcgaagaagccggggagggaggggcgcacgaggcaatttatagggaggaggaaggaagaggagcggccgggcctgagcagagcaggccgggccagccatctctcctctgcggcgtccgagcgggggcggcgcccgagatgggggactccggcggctccgtcgtgtcggtcgacgtcgagcgcatctccttcggtggcaaggaacaccatatacaaacgagtcatggacctgtatctgttgcagtttatggtgaccatgacaagcctgcccttgttacttatcctgatattgctttaaaccatatgtcctgcttccaaggactattgttctgtcctgaagctgcttcactgctgcttcataatttttgcatttaccatattagccccccaggacatgagttaggagctgctccaatttcgccaaatgctcctataccttctgttgatgacttggcagatcaggttgcagatgtcctcgatttctttggattaggctctgttatgtgctttggtgtcactgcaggtgcctacattctaactctgtttgcgacaaagtatagggagcgggtac

SEQ ID NO: 25420 - DNA, 701 bp, Sorghum bicolor
  Clone ID: 30951830
tgaaagtggaccatataagtacatatttagtacagagggtcatttgctacctgttactcctgagatagccttggtagatgaacattgttcttattttggagcattctgtaatggtggtgccgaccatggatatggtgctagtgctagttctactaagcatcaaaatggaaactatacccaattagatgatattcaaacccattccagtctctattcaacgtccaacgtgttgtttaagacaggaggttacatcaaggtaactcttatgtggttcctgattaacattttttattccttggtcactgcatatgtaacctttgttgacagaaaatggaacaatagtggattacaatgtgtgaagtctaagctattttaaagagtctattgatgtggtccatgagacacagaatggtgcatatgacatccaacaggttgcagttatcaattaactggagttagaaagcaatgaatatacagcaaggagggtgtagttttctttctgtctcagtgtggcgtatatggcatctgaagctagttttctaccttgatccagtgtatttggtattttgttacatgaacaagagcatcctgttttcctggttttattcttttttttattgaattttgaatgctagtcttgctaatagaaccatctatgtttttgcctcttcatctaatagattaacactaaatgcatgcac

SEQ ID NO: 25421 - DNA, 627 bp, Sorghum bicolor
  unsure (1)..(627): unsure at all n locations
  Clone ID: 30951855
tttttgataactatttttataaacataagaagtcaaagttaaactttaaagatattgttattgtccaaaatacgaaagaagtactacagtacatggtactgtactgcattgcttgcatgatgactggatgatccctaccagtagntagaagagtttgctatgcactgtaccttttttggtctctcctcttcncatggttagcggatcatcagaccctctaataaggccttgtttagatttaattttttttttttagattttgacactgtaacactttcatttttatttgacaaatattatctagttatagaataactaggcttaaaagattcgtatcgtgatttacaagtaaactgtgcaattagttatttttttatctatatttaattttcatacaagtgccatacgattcgatgtgatggagaatcttgtaaagttttgagtttttgggtgtatctaaacaaggcctaagcagcgcaaattgaacaaatatttgttctttagggccggtcgaggtgacaattattttttagaaaaaggatgcttttgtaaagtcacgttgtcatgggaggattaaacaattgttgaattatttagaaaggtgacttttggatgggaagtgtgatt

SEQ ID NO: 25422 - DNA, 588 bp, Sorghum bicolor
  Clone ID: 30951892
ttgacctttgctttgtgttttgggcttacgaggaatactcatacctgcttaacaggatctattttttatatcatatttgcctgttgttctaccccacccatgtgtctttgttacagtttctttgttgcaggtcatagtcgagttataattctctgcattgacggagagatcatgctaattaaagaaaaaaaatcaaagcttttactatcctaacgagggaagctccagctgtcatcctcaaaaagcagcagcaactacttgctgaggaccgcgctccaatcaaatggcatcatcatcaacttttgtagggcttattgcccaaggcatagagagatgtgcacaccaaattcatgtggaggaactattggattctatcttagtctcgtgaactgtggaatgtatgcgtatgtaagatgtctcactttaccaaaagttgttgtatgatgagctccacgactgtaaatatgtatgcttacatacccaccagatattgtgctttataccctgctgcatcagtaaatgtaggtgttggtatcatatatgtactcaacttttggattctccaagtggtacacactatctgtagtc

SEQ ID NO: 25423 - DNA, 604 bp, Sorghum bicolor
  Clone ID: 30951894
ccaagacactggcagagacggaggcatttgattacgccaagagaacgggactagatgtggtgtcagtctgcccatccctggtgatcgggcccttgctgcagtcgacagtgaacgcaagcagctccatcatagtcgattgcttgaaaggagatcatgaggtgaaactgaagctgaggaacttcgtggatgttcgcgacgtcgccgatgctctgctcctggtgtacgagactccggaggcgtctggacgctacatctgcgatgcaaatgcaaggcaggtgtctgatgtcatagcgctgctgaagaactggtaccctgcctacaatcatgctaccaagctcgtgcaagtgagcgatgaacctttgttcagctccaagaagctggaggcgctgggctggaaattcaggacgttcgaggagaccctcagggacagcgttgaatccttcacggcggcaggtgtcctggattgaacaaacagttgccctgttccgtataactttcgcattttgaaaatcaaagttcttgtcttgtgcaacatcccaacttccttgacttcagaacttagacgggtatataatgtaataaataaacaaacaaaagggaaaaa

SEQ ID NO: 25424 - DNA, 680 bp, Sorghum bicolor
  Clone ID: 30951900
aggaccagcggcttcggtgagcggacgcggcagcgcgggcaagaggacgtatctctagcgagtggacacggcgggcgagcatgatgtggctctggctgagcagacatggcgggcgagcatggtggctccagcgagcggacacggacaacaagcgcggaagcatataatcttcgcttggcctccacctcgcgatggagatcgcttggcctccacctcgcgatggagagccgcgtgcaggcggtgttcgtcgtggagcccggcctcagccagggaggaccatcgagcatggaaaaggcatatgatgagcggtggcggcggcggcgacctgtatggacctacaggctgcggcggccttggcgagcgacctgcggcggcaacgagtccgctcagacctcggcacttccctacagcgggggcaggttgcgcgaggatggcgcagccttcgcggcgacgagcacaacctactgcatggtgtcggcttgtgcaatgaatgcgaaggaggtgatggaaaccagtagtttctccccaacgctggttttctagtttctgcatcgttttaagtgtcgacgtcgtttcttgagggagaaacgaattcttcattttatactctctcttctcaataactcatttgccatgtcagcaatttgctgagctgttcctctaattaagaaggatagaaa

SEQ ID NO: 25425 - DNA, 553 bp, Sorghum bicolor
  Clone ID: 30951903
caggacaacgatggaatcaacagctctgcaatgctggcctcatcgatctgccatcctattgtccatactgctagctctttgccttggacgcgctcaggatgttggcaaccttcttgaggagattgagcaacacagaggagataacgtccctctttatcagcagcattcacaggctcatgatcttcttgataaggtggcacatgagatgatttgcttcatgtccccattctcagttaataagtgctgacacgaatacttcaaaaaatggaatttggtttaaagactttgtagtggacaatatctattttgagtgtcttaatagtttttcattgattttgttacaaaccttgctaactttatacgaatgttccgattgtcaaactcttgtgtatataattgttatttcgttacaataggcaggcctaggtttctttatcttaccagtatttttacatagccaattatatgtagcgttatctatatcctagcaagatgtaattgtaacatcaggatcttaattgtgttaattgttgagaagaacgtgaacaagggg

SEQ ID NO: 25426 - DNA, 690 bp, Sorghum bicolor
  unsure (1)..(690): unsure at all n locations
  Clone ID: 30951904
caagatggatgtattattgagctggctagagcagagggataattataaaaggaatcatcaagccattcaagatgcattcaattctcaagatcaacaggaagaagatatcagtgcaatcaccaagaagccaggatggagtcaacctcaggcaacaagccaaggtaagtatcaaagtgatttcaatcacagacaaccacccttnaagagaattaatattagaacaagctagaattaatgagagtatttataagaagcttgcttttaatgatgaaatgttagaaggaattaattcaaaattagataatttttctctagcagccaaacaataaataatgttcaataaaaagatagaatcatagattacacatctagcctctatgttgtctgccactaaccatgaacagattaaaggaatatttactagaggaggtaaggttacacgtgatccaccttacccaaaaggggcacatagaccttcacaatcagtacaggtagacaaagaagctggagagaacaataaagaaaaagaagttgaagtaccttcgccaccagttgatgcacaagagcccaaattaatgaaagacttccctgatactactctcctacctttcccacaaaggaggagtaccaccactgatgagcggttcagtaaatttgtagatgtcaatcagaaattatatgtcaacattc

SEQ ID NO: 25427 - DNA, 628 bp, Sorghum bicolor
  Clone ID: 30951912
cccgcacggcgtgcggggcgacgacggcgcggacgtcggcggctacaaggtgcccaggggcgcggaggtgaacttcctggtggcggagatcgggcgcgacgagacggtgtggacagcggcaagggagttccggccagaccggttcctggatggcggcgagggctgcgacgtcgacatcactggcagtcgggagatcaagatgatgcctttcggcgccgggcggcgcatgtgccccggctactcgctcggcatccaccatgctgagtacttcgtggcgaggatggtgcgggacctcgagtggcgcccgccggtggacggcgcggcggtggacatggcggaagagctcgacttcaccactgtcatgaagctgccgctccgtgcacgcgtcgtctctaggcattagctccactccatgtctggagtggtagtccgaggtggatggcatggcgccgccgcgccgcactggacattcgaagcaccgctccatggaagcatgctggcatgcatcatcatcaccatacatagatctagctgacaaggtctttcttgacttcttgtcaaaaaataaacatgagaaaaggctaataatatttacaacgactatttatgtagcaatttttcttcacag

SEQ ID NO: 25428 - DNA, 734 bp, Sorghum bicolor
  Clone ID: 30951918
agtcaattccgaccaaactgtgcaattagttttaattttcatttatatttaatactctatgcatacgtctaaagattcgatgtgatgggaaatctgaaaaattttgcaaaatttttcaggaactaaacaaggccttagttccgaaatctgaaaagttttcggaaccgtagcacttttgtttgtttgtggtaaatattgtccaatcatagactaactagagtcaaaaattcgtctcgtgatttacagtcaaactgtgtgattagtttttgttttcgtctatatttaatgcttcatgcatgtgccgcaagattcgatgtgacacggaatcttgaaaattttttggattttggggtgaactaaacaaggggaaacattttctctaccgtttttaagtctttccctaggaatttaaaccctagggaaacatcgagaagggagcgcctgaccgctggcacttgcagcttgcgtgcgagagggagaggtcggagcctgctggtgcccctgccatggtgagcagcccatcggacaagtggtctgttgggccaagcgtgatttgagggagcggagggaggagaaagtagccgaaaatagattttatatttttgtgacaacttttgtaattcctagaaaatcaaggaggagatttgaagtaatttgatttaaattctaggaagaggtttgggatggagattcaatgtaaatattttttgtgccacaaataaattgagaaagca

SEQ ID NO: 25429 - DNA, 606 bp, Sorghum bicolor
  Clone ID: 30951931
acaaggatgacaatattagatatctatttattttttattggagttagatatcaagttttgtggcttcttttgaggatccataaaagcatataattctaataccttgttaaagtcggcaaggagtcatcatcagtgtgtctcgatttccatatatgtacactacttagagatttctggtatgtgtggatagcatgaacatatatttatttttagtggattggatgacaaagtgttcaagatttaggtttattctgtataaatagttaggtcattgactaattcatgttataacagcagtatttgttcctaattaatatcaacaacttagtaataaaatatttgtttattataagtaaagggtcaatgcttaaaagacctgtaatactgtatttattatttatcttatttatttatataacaaaagcatagttactttattatagcaaataaaaaaatataaatataaataaaataaaaagaaaacaaaagtcacggacatcgtcaggggggtggcaccttcctaagaccccatgcctgaaacacctacgtgctggaaaaggaaaaaagaaaggtaaagcaagcagagaaggaatagaaacggaaaaa

SEQ ID NO: 25430 - DNA, 605 bp, Sorghum bicolor
  Clone ID: 30951972
acagtcactattgcacgcgaggagagggcagagccgagagcccgagacacactatagtgctgcgtttatatgcttgcttcttgggcacccgctcggcgtgaggagcacaacacacggtagatcggaaggggaagcagggaatctatctagtctagtctagctagcatagagcgaggatgaccagcggtggtgcagcaggcgccgcggccggaggaggaggaggaggcaaggccgccgccgtcccgctgcggctgcaccactacctcgtgatggccggggtggcggcagcggtcgtcctcgcctgcctcaggtacgcgccggacgccgcagcggggtacggcttcctggccgtcgcgccgcagcagccagtggccgcggtcgcggtcgctgtcgcccgcgcggccgacggtggcgacgacgctcatcgcccgtcgtcgtcgtcgtcgtcggtgatcatcttcaacttcggggactccaactccgacacgggcggcatggcggcggtcaacgggatgaacttgaacctgcccgagggacgcaccttcttccgacgacccaccggaaggctctccgacggccgcctcgtcatcgacttcatctgtgag

SEQ ID NO: 25431 - DNA, 628 bp, Sorghum bicolor
  Clone ID: 30951994
gtcgggcgcggcggccgtggagcacgcgccgctctcgtccctatccgcggggcgcgtcgaggccgccgccgccgtgctgctgccctcgctcgccttcctcccgcgcgccgcgcagcggaggctccgcccgtggcagctgctgctctgcctcggctcgcccgaccgcgccgccgacaccgtcatggcgctcttcctgggcctcctccgccgcacccacctgctgtcccgccacgcctcctcctcgtccccgaccgccgggtggctcggctcgtgctcggcatcatcggcgtcaacgccgccgcgcggtgcctcgccacccgcagccttgccttccgcatgagcgtcctctacttcgatccgatattcgaggttactgggaaagtaaagcgtccttctattgtatttccttctgctgcaagaagaatggatactctcaatgatttgttagcagcaagtgatcttgtttcgcttcattgtgcattgacaaatgatacaacacatatacttaatgctgagcgccttcagcacataaaacctggagcgttcatagtcaacactggtagctgtcagctcatagatgattgtgcactcaaacaactcttgattgatggcactatagctggatgcc

SEQ ID NO: 25432 - DNA, 579 bp, Sorghum bicolor
  Clone ID: 30952075
cgagtcggccttgttggctttctgggtcacatccacaatttgcacgaggttaataggagtatctcccaatcggccagccgtaaatttaataacagcccgtaggtcgtcgtgatcggtaccaatggaagtcgcagcagggaggacgaggccggggacggcggtgtgcgtgaccggcgcgggaggcttcgtggcctcgtggctcgtcgagcgcctcctcgccggcggccggtacgtggtccatggcaccgtccgtgatccgggtacgaaatcgatcactcactgcttgtcttcttgctcctgtggtgagctgccttgttcgtgctcgtgcgaacatttggctgatcgtcctgtgctgtgcgtggcgagcaccgagcaggcgacgccaagaacgcgcacctggcggcgatggacggcgccgcggcccggctgcgcctgttcagggccgacttgctgtactacggcagcgtggcggcggccgtcgccggctgcgacggcgtcttccacgtcgcgtccccggtccccagcacctacccaatcggtagagctgctggctccggccgtgacgggcaccatgaacgt

SEQ ID NO: 25433 - DNA, 651 bp, Sorghum bicolor
  Clone ID: 30952083
gtagcaaattagtggccaccgtccgaacaaacaccgggcagaaatatttactttttgtgccgcatcgtctagaacaggatcggagttggggttgaactaattaggggctgtttgtacagcttacaatagctttatgagctgttgtaagctgtttttttttgtcaaacatttatttccaaaacagcttcatgggtgaaactgtttttctcctcctcacaaagatataaattgggatgaagctgaaaaaagtagcttattgcagccctttccctcatttctctctctcaactatgcatgaagtagttgtgaagttgagctataccaaacaagtccttgataagtgaagaaattgaaaccgtggcgatggcgtcgacgtcgacgcagataaagcgagcacgttatgcatttgacgcttgggtggtgccggatgctcaacaaaacgcgtcgcagaattcagtttctgccacttccaagctcgattacggcagttccaatgatgcagaaagcacgcaggtgggctagcgttgtgcaagcgagcgcactacagcacacaagcacgcgcgagtgcaaggccaacggagtgcgagcgagtggactgcagcgtgcgaacgcgggcaagagcatggacaacgcagctagcatgcacagcgt

SEQ ID NO: 25434 - DNA, 665 bp, Sorghum bicolor
  Clone ID: 30952089
ttcgccattccttccttcctgctcgcgattctctccttcgtctcgatcctttggatccccaaccttcacgcgtgcaggcccggtcgtgccgctgctcgcccgttgcccgcaacgtcggtggccgcgtccgcccgctgccgcttgaaatctgcccgcgacggcgctgcccgctgcccgcgccgccgccgccgcgcccccactgctcgagcaactacgacccgccgctgaccgcgctgcgccccgctgcccgtgcgaactccggtacggtggccgcgtccgagtgcgaccacggtggccgcgttcgccgccgcgtgaactccggtggccacgtccgagtgcgactccggtggccgcgttcgcctgctgcccgcgcgaatgccggtggccacgaccagcgaccatgtccgcccgcttcttgcacccccgccgcgcgcccactgcctgagcgaccgccgggtcgcgccgcgaacgccggtggccacgaccgagtgcgactgctggtgcctcatcttcccgcccaaagcctccacatgcgcccgacgttccacaactgtgccctgttgcaagaaatttcagggcctacgactcctccatctccattcccggtgtccacatccatctgatcctcggtggttcctgcaggatcttcatcaatagctctactt

SEQ ID NO: 25435 - DNA, 577 bp, Sorghum bicolor
  Clone ID: 30952122
cgggaacgcttttgcgcgtctcccctcgtcgcgggcgagtccggaatggctccgcgttgagcggaggcggtcgacgtttgccagtgcgctcctaccaccatcgcgggcgagtccgaaaggctccgcatggtgtggcggcggccggctatcacctcagtcgcgggtgggtctttggaggctttgcaacggctctaggcgaaagctcagctcaaactttttgagccaggtacgagattctccttcctggagtcgtcactgaagagccttgcaactacttctcatcggcacatggctcgggagaaatccttgtcaagctccggcttgcatgacgatgattacgttatggcgtcattcaccccctagaggcatcatcgaagagctcatgtcctgattagtagtctccgcgtcgtgctattgtttccttgtttatgtgtggctctaccacttttcgccctagcgctagggcgctcggtgctgttgttgttgttgttgtttttcctcctcaaaacctctgtaaatctgtctttttgggccctttttgaatatattcaggtgggagtaatcaccgggaaaaatc

SEQ ID NO: 25436 - DNA, 507 bp, Sorghum bicolor
  Clone ID: 30952124
caaatgggcgttgcagaggtgcaaggcgggggaagccgtggtggccatggaccccaggatgcggcggagcccggcgtcggtgcccgcggtggagaggatgctggcgctggcagcgcagtgcgtcgcgacggccagggatgaccggccatcgatgcggcggtgcagcgagctgctgtgggccatccggagagactaccgccgccaggaggagccgcgctgcgccgccgtcgcggaggaacgaagcgacgagtgggtcgtcaggtagcttcagtttgtaaaatcattcagaggctacaagtcggatgagatgatgcgtgctttggatcgattggtatggaagtgtaactagcctgtaacttttttttttccttttttcttttgggactgcctgccaaatggggaactgctcatataaaaattatgctctcactatacagtagatttctcatgcgtttggagtatgtgcatgtaaaattttagaaactcatgcaatgacagttttttatg

SEQ ID NO: 25437 - DNA, 518 bp, Sorghum bicolor
  Clone ID: 30952162
gccatgcaaattggtagtgacactactaatctcctcattgcatttcaggtggcctatacgtcaatcatcaaaggacattgggtttgaggaactgcatacaccatgaagaggacagtgctgcatttgtgtgactttgggcatgaactgttacttcaggctttgctctcacaaggttctcggagcaatgtgatttttgaacaccttctaggctactgtttgacagcctcgctcgttgaggaaaaagattctaaattttgtcctttgtatacttcagtgaaaagcttgaggatgcgggtgtggaatttttgcagaaagcaatctgattctgctttgtttaagtggggattgcggtttctaaattctaaagctgccaacagtagattttagagttctgaactgagattaggttggattatgaaattctactgacaaatgagttgttggaggtgtatactatacttaaaaaacatgttttcacttttttttttctaaaaacaagtgcataaaaatatgcattc

SEQ ID NO: 25438 - DNA, 636 bp, Sorghum bicolor
  Clone ID: 30952195
gacggatgggtggaaagtaatgagacgggtcaatcctactatggaacaggagttgctcgagtctcttgtcgaaaccgatacaaaaaggcaggaaagagctaaaaggatggaagaaaagaaggtctatctgcaattgtacgaagcaatggaggcccttgtccacatatgccgagacggatgcaggacgatcgggcctcgagatcaagcgctcaagggcagtctagcagctgcctgcaagtttccggcctgcaagggcatcgagctgctcgtgcgccacttctcgacctgcagagttcgggtgcctggtggctgtgccaactgcaagcgaatgtggcagctcctcgagctgcattcccgcatgtgtttcatcccggacacctgcaaggttcctctctgcaggcattttaaggagaaaatgcggaatctggggaggaaggaagagaccaaatggaaccttttggtgtgcaaggtactggagagcagaggaaccatggcttttatgccagaaaggagaaaaaaattatcaatcctaacaccagctgggagttgccacgtggctcctcttgtaggacctatttgaaacaccgaaagttcgcaggggttttatgtaagacgggaaggggatcaggaggagcg

SEQ ID NO: 25439 - DNA, 358 bp, Sorghum bicolor
  Clone ID: 30952199
aaccagaacagagggatgcataaaggttgaaggagccagctgctgaaaaaactgcgtatgctgtatacccttgctccaaagaaatagtcatcacacattctcgcttgtgatgtgtggaactggagtagccgtgtaaaatagaaggtgtcttggtggttacatggtgtccgggataagcttaagaatatccaggagtccaggaccaagctgcagtggtactactactgtgccgtagcctgtaaaatccacaattatgttgccaggagattacagatggagtacattgtactggtagcagctcgttgatgtatatgcagtttatcgtaagcttgtactaagacatatacatcggatactg

SEQ ID NO: 25440 - DNA, 689 bp, Sorghum bicolor
  Clone ID: 30952203
ggaagctttgtgtgtgaatatataggagaagtgttggaggatgaagaagcacaaaaaaggacaaatgatgagtacttatttgctatcgggcacaattattatgatgagtcactttgggagggcctatcaagatctataccgtcacttcagaagggtccgggcaaagatgatgaaactggatttgctgttgatgcttcagagatggggaactttgcaaaatttatcaatcatagttgcaccccaaacatatatgcacaaaatgtcctttatgatcatgaagatatcagtgtgcctcatatcatgttctttgcttgcgacgatattcgacccaatcaagaactattctaccactacaattacaaaatagatcaggttcatgatgccaatgggaacatcaagaagaagaaatgcctttgtggctcggttgagtgtgatggctggctgtattaaattttttgaaggtagctgcattaagtttagaatctgcagttattttaggcatagctaaacttgagcttgcttcattgcgcctgcttcttggttatgttatgattaaaaatctaagttaagacaccagtgtttttagttgccagtggattcaagttttttccttctttcccatccaatttgttattttgtatgtctatttttcaatatgaagactaatgtgcatatacatgtcaataagt

SEQ ID NO: 25441 - DNA, 705 bp, Sorghum bicolor
  Clone ID: 30952205
tagagagggaaaactgagagcaatttgtggtggtggaaggtatgatagattgctttcaacatttggaagtgaagatataccagcttgtggcttcggatttggagatgctgttatagtggaactgttgaaagaaaagggtctcttgcctgatctgtcacgtcaaattgatgacattgtcttccctttggacgaagaacttgaaggaccagcatccagtattgcttcctctctgagaaagaaagggcgttctgttgaccttgtagaagacaagcgtctcaaatggtatacctaccatatttttctttctttattgttgtgtctgaaatattcgttttgatactaccagggtatttaagcacgcagagaggatcaatgctagcaggctgatattggtcggaaattcggagtgggagcgaggcatggttcgtgtaaagatactatcaaccagagaagaattcgaggtaaaggcgggtgaactagagtgatagttttgctgattataatcatggtttttctttcccttcttttgttttgccatttgtcttagaagtcgtgtagatacatggaaaagatacaactctatggtacgcgcctttgctctctgttgtatcttcatttggaaaagatactgttaacctgcagtaacagtacgttggaaaagatactgtcagtcttctgtaacagtatgttctatgagtaaattgt

SEQ ID NO: 25442 - DNA, 610 bp, Sorghum bicolor
  Clone ID: 30952214
cagatgaggtgtagccgcgaggtaagaaagaggggtgcctgccaacgaggaggcacgacagctgggcaaggaagaaaagcaaacgccggcgaggtggcaggccaccgggttggttgatttgaactgtggatcaacatattcatcgtgctactctacgggtacattgtgattgggctgatgggtgtttttggatcaacattgtgctctgcagcgggagggtttaatcattggaggcatgatcctgttggccttatccttgcacactcagatgttgttgagttcatgctgcttctactgctgcagatcagttttgtccccattggatcgatgttgtgagcaccagaggagcagccagcagtggcatggcagctgctgctagaacaaaggtgtagccataggttttgcatatccttttcaaggcctcgctgctgccggatgtgcaggatggctagcggcaccccgcatcaccgtggtcgatgcaggaacatggtggcaggagcacccgcctctgaaaaacctgaaaatgtgcatctaattttctttttcactttgctatgataatgtgtcgtgtgttattaaattttagagtgtttggaagccaatggagaaa

SEQ ID NO: 25443 - DNA, 714 bp, Sorghum bicolor
  Clone ID: 30952237
gaactggaggagcgagcatgtatcccggcccggaacgcgcatcggcacacacacgccaacgccgccaccaccaccatccggcgaggtagggaggcagcgacatgggttgctatcctcccctgggcaagttcgtgtctaaagcgctcggaaaatgcaacgggcgccaacgatggagggaagggaggctggacttcgattacgccttggcctatccgcccacggagacccactacatgcggccggtggcgcgcacggtgaccttcgccagcaacaactccatctacgtgatcccaccgtcgtcgccgccgccgcaaccgcaaccgcagcagcagaacgcaccagagccccagcaaccccaaacgccgcccggacacgagcccgagcagcagcaccagcaggatccacccgaatcccaacctcctcctcaaccccaaaccaccgagcaaccagagcagcccgatccacccgcgcaaacgcaagacgacgcgccgccacaggccgagccgaagccgccaaagggcccgaaacgaggcaagaagaagcagcccggccgcgtccggttcggcccggagccgcctcctccccctcagcagcaacaggaacaagagcaagcacagcagagcccgggcaacatcgagaaaccgccggatcacgggcctcctcacggcgcggcgcccgcgcccgcggccacgcaggggcagcaggggtacctgc

SEQ ID NO: 25444 - DNA, 760 bp, Sorghum bicolor
  Clone ID: 30952241
gcggtggtgagtggtggtgaacaagctcccttctcgttctcgcctctcgccctcactctctttacagagagagaggctttcgcagtttgcgctccagaggccagagccttagactgatttcagggggagcatagtcgatggaatgccttgagtttgattgttctgatttattcctggatggcgatgcgatcgacttcccattggaaatccatcttgagtccaacagttcagcaggcgccaaagctgcgccggatcataggcggcatgctcagcttcatcgcagcaaggcccctgatccgccaccgttgcctggaacctcttatgacgcgtggagaatttctaggaaggcaaaggcttgtcgccgcgtccctgaaggcgtcgtcgattcctgggacaggttgttcttgcagggataccaatctgatctccgtgtttggacagacgatgacactgaaattctttcacattcctgtgttcttggtgtcaaatctcctgttctgagagctatgttggaggaagccaaattgaaagatggttttcggtgtattcgtatttctggcgcgccttcagaagcagtctgtgttttcatcagatttctttactcttcacgttttgagcaggaacagatgaagaagcacgttctgcatttgcttgtactctcccatgttttctcggtgccatctctgaagacggtctgcatcgaccaactcgagaggaatttccttgctcctgacaacgtggtagacatgctgcaacttgc

SEQ ID NO: 25445 - DNA, 665 bp, Sorghum bicolor
  Clone ID: 30952249
attcgagggaagaagtgcttaacatgcggccagatctacgggcttacaaaattttcagggagcggttctccacagagtttgatgatgagaaatatattggcagtgtgcctggaatctatcctggtgatatctttcatctgagggttgagctttgtgttgttggtctccatcgcccacacagggtaggtattgattgtaccaagaaggatgatggtactactgtggctgttagtattgtgtcatgtgcacaatcttctgacatcaagtataatctggatgtcttggtatatactggaccagtggcagttacagtcaatcagaggatagagggtaccaactgggctcttaaaaagagcatggacactaatacaccagtccgtgttatccatgggttcaccactcaaaatggaaaaaaaaagtttcctacttatatatatggtggtttataccttgttgagaagtactggagggagaaagagcatggagaccgttatgtgtatatgttccgactgagaagaatgaaagggcaaaaacacattgacatccaagaaattctgcaaacagggaactctggatcaaagaacaatgttatcatcaaagatctatcacatggattggagagagttcctgtacctgttgttaacaaaatatccgatgagtgccca

SEQ ID NO: 25446 - DNA, 584 bp, Sorghum bicolor
  Clone ID: 30952264
ttgcgttctccggtgaacgttctccggtgtcctgctgttgccccccgccgccgaacgttccctgttgccctgcttcccgccgtcgaactcggacgtccgtgcaccgccgaaccaccgtcaatcgcctcaatcgcctgaacgccgcccggatccggccatccgtccgtcgatacctcctgcatcttggacggcaggcctcgtgccagtcaggtatgcaatccacatccctaattacgaagtatgcaatccctcctcctatttcccttttcacatctcagattgtatgccaccaagaacatttgagtactgcttgtttagtccacgaagattagaactcgttgatacggccaagattagaacaatttagtccatgaggttttgagtactgcttgttcagagcttctaggcaatagttccattgtaggcaagataattggtgcaactatcatggatttttttttttttgtcgtcgtttcattcttgtgtgcacctcagattcagttaattgattacagctagaagtcaataagtctccaatgagtcacgcgacttgccaagccagccaataaatctgttccctttct

SEQ ID NO: 25447 - DNA, 644 bp, Sorghum bicolor
  Clone ID: 30952288
aaaactagtgaaaatcctttgagtgatttttcactaatgcaagaaagcattgatcaaagagcaggtagttccctggatggtcgccggctagcgtgcaagagaaaaaatattgaaggagccaatggccagagttcagcaggtgctagcacaagtttttccctcaggaacgataatgctttctataacattgcttcttcaagttacaatcctgcacctatcagaaattcatcctctcccaattgcttgccagttccaagttctattgaggatcaactcccacaatatggaactaatgcagggctctcagccggtacctatgaccttaatggaggggtccacaatgctgggaattcgcagagaagtttccgggcaagaactaccacgtctcaacagattgctccctgtagtgtatggccctcttcaaatgctatcaggctttctaattcatggaatcaccagccacctcattttcaaaatgcatttgatggtccccaggaagttattcctgtggtcagcagcctcaacttgcaataccagcatccagtgaatgtttctggtgtgccacgggctgcaaaccgtttcactggccatggggcttcatcatcgagagctacgagtttggagaacagaaatcttggtagtga

SEQ ID NO: 25448 - DNA, 698 bp, Sorghum bicolor
  Clone ID: 30952297
atcaacctatttgccacttccgcatttttatttttatttttttgccatattgttctcttttgctttctaatttctaatccaacttggatggatactctttcctagccttcttcttcatcccaaatctaccaccatctccaaccgttaaaatcacttcattgcttacacaactgcaacattgcagctgcaaaggcgatgaggtcacatgtggagggactgatcagcgtaggtcaaatagtaccatatcacagtgtttcccaccatttacttgcctgcagtcaatagccaagaggcctgtcttgaaagtgaacatttggaaaaagagtgagattaagatattcattaaagcagaggaaactaaaagggggtatggcaattcacagggataagtagattcaaggttgcaatgatctttcgaaactatagaacctagccaaccaactactagcagcgattagtaaatagcggacccagacgcccgcgtcgctctccctcgagggcgaccgggcggctccatctgccgccgccgcaggctccacccccacgcggtctcggtcaggccaccgccggagctcgacgccgggcttccgacggaaggcaaggacggcggcggctcggccctctgcatcccttcccttcttctcgcgaagcctctgcggtgctccgacgccgactcaaagaagttggccggcggcgtt

SEQ ID NO: 25449 - DNA, 571 bp, Sorghum bicolor
  Clone ID: 30952299
cagccggcaccagatgagagctgactccccacatggcgtcatggccagcagcgtcaaggaggcagtccagcagcagcagcagcagcaggaaaagcgccgagctttcgggcgccagagctcacagccacagccaccatggccgggcgacctcctcccctgccgcctacggctacggccggcagctctcgtcctacagcacccgctcctcccaggtcagcagcagcagtagcggctccttcagtgcgcgggtcgccggcgccttcacgagctgcttcgtgccgcggaggcaggtcacaaccgaggaagaggaggagaagaagagccggcgctcagagtgccatgtctccatagattcagcagggtcatggcaagaaggcagggctctcacaattgctgacgtgtccaaggcaacatcaaacttcagtgaaaagaacatgatcaggcaggggcgctcaagcaccatgtacagaggaaagctcaaggatgggtctcagatcgctgtcaaatgtgtcaagaagctgaatggtcagaatctgacagctgaactctggagggagcttgagactcttga

SEQ ID NO: 25450 - DNA, 599 bp, Sorghum bicolor
  Clone ID: 30952309
ttggtgagcatgttggcattattggttcggcaaaagagcttggctcatggaagagtccggttgagatggattggacaccaaatggttgggtctgccagcttgatctccctggagaaacacttctggagttcaagttcgtggtgtttttgaatagaggcaaggacaaaatatgggaggatggtgacaaccgtgtagttaatttgccaaaaaatggttcatttgatatggcatgccactggaataagacaaaagagcctttaaatcttttaggaacatcagagattaagttgtctggagatactgagaaggagaaagatgaagatgctaaactatctcgaaatattgctctagaagagatgggaaatatttctaatgctggggatggcgatctaacaccaaaactcgagtcgagcacacttggtggcctatggcaaggtagtgatacagttttcatgcggtcaaatgagcatcgcaataatgagagtgataggaagtgggacatgactgggcttgatgcagtatcactgaaattggtggagggtgataaagcatcaagaaactggtggcggaagttggagcttgtccgtgggctcgtatct

SEQ ID NO: 25451 - DNA, 650 bp, Sorghum bicolor
  Clone ID: 30952329
actctcgcgactcgccaactgtagtgccgcgccgccgcttcgcctcccggtccgctcctctgcccggacatctcgctcggcacctccaactcggccgccgccgccgccgccgcggcctccgcatccccccacggcgacctccacctcctcctccttggtatccaccgcgatcaaagagcccatggagagggtttccggcacagagtgcagagagggcatggctgttatgagcaacaaggaggagaaagaatgccaaataaccaaagtagagaagggacggaagaatgggaagaaacataaggacaagggtcagggtggcgattgtgagggcaaggctgttgttatgagcaacaagaaggaaaaaggctgccaaataaccaaaggagagaagggatggaagaaggggaagaagcgtaaggacaagggtcgtggcggcgattgtgatagctcaattcattctggtgacaggaaccatagcattgagatggagcaagctgatgtgtcagccacgatggctgaaaacccctgcttggagcatgcagagggtgctatgagcaaaagctctgtgaagaaacataggaagaaaaagaagaaagataaagaggttgaaactaatggccagaatcaggtacttgaccctgatgaaaatg

SEQ ID NO: 25452 - DNA, 637 bp, Sorghum bicolor
  Clone ID: 30952334
agggttcgcctccccccgcccctcgtcgccctcgatgggcccggccgcgcagccgccggacgccggcggcggcggggacccggaggcgtggtacggcagcatccagtacctcatcaacatctccgccgtgggcgccgcctcctgcgtcctcctcttcctcctcgtcaagctccgcttcgaccaccgccgcatcccggggccctccgcgctcgccgccaagctcctcgccgtctaccacgccaccgcggcgcagatcgcgctccactgcggcgccgacgccgcccagttcctcctcttcgagcgcgcctccttcctcatcctcgcagccgtcgccgccgccgccgtcgccgcggcgctcccgctcaacctcctcgcgggggacgccaccgtcgtcgaccacatctccgccaccaccatctcgcacatccccaagtcgtccccgctcctctggctccacctcctcctcaccgccgccgtcgtcgccatcgcgcacctcggcatctcccgcatggaggacgcgctacgcatcacgcgcttccgcgacggcaacggcaaccccagcgaccccaactccagctccgtcgccgtcttcaccataatgatccagggcatccccaagacgctggccgcggacaag

SEQ ID NO: 25453 - DNA, 579 bp, Sorghum bicolor
  Clone ID: 30952338
ggcccaattggatgcttcggccttcggttgtggagttgccaaatgccaagggcccaaggctgaaggcgcagtctcactcaccgcaatccctcccgccgtcggtcgccggccgccggccgctcccgacgctatgctccgcctccgaaattgcattcttccacacctactctcctcgtcccgccgctcaacctcctgcatcgcccccctccaccgcctcctctgcggttccgccgccgccgcgagcagccccttcacggtcgccgactacctcgtcgccagatgcggcctctccggagagcaggccctcaaggcatccaaaagtatccccagcctcagctctccctcgaagcccgatgccgtgctcgccttcctggccggccttgacatctccggcaccgacctcgccaccgtcgtcgccaaagatcccagactactctgcgccgacgtggggaagaccttggccccccgcgtcgccgagctccgcagcctcgggctgtcgagccaccaggtcggccaggtagtactcgccgctcaggcccggatccgcagccgctcgctcctccgcaattttgaattctg

SEQ ID NO: 25454 - DNA, 259 bp, Sorghum bicolor
  Clone ID: 30952343
acggagctgcttcccgtggtggacatccgggcgctctcgctgtccgacctggacgcgctcgccgccgcctccgcgcacgcccttgcgccgcggacctgccccaacgccgacccgctcccgcccctcaagatcgaccccgccgtcttctacgagagcgccggttcccagaagcagaccttctcccgcctccgcctcggcgccgccgccgccgggtcctgctcctcgccctcctccgcctggcacatctcctgcgcgcggg

SEQ ID NO: 25455 - DNA, 699 bp, Sorghum bicolor
  Clone ID: 30952416
ccgcaaaagcgcaattccaatcctgttgcaccaactcgacgggaaagaatggcttggagtggagcagaagaagctatgctgagggaagcaatggcaaaattcgccccagagaatgatgctccaattccatgggttcggatactaggatatggtcgtagtgtgtttgacatggcacgcctggcatctgatttgagggtcaagtggaggaacatgcagaagaagtagactgatgctgacaatcttacatagtggaacactgatgttgtgcgaactcctcactgcaagtaggaatggagtgtgctgctcttctaactaggatgttgatgattggtaggagccatatattcagcaagcatgaagcatgtgtgcgtatcttttggccgtggtatcgtgacaattatcacatactattatataatatcatacttagtcttgcagttgcagtttagatgagaatatatgtacataaacatgattacgagaaggtgtagtccgtttggagagaagctgacaggttctggccttctgggaagagctagctgcagcagcgctgttgctgctgcacttccttactatacctgaatcagttataaaaacaagcagcggcagcgctgtggctgctgctaaagtagcagcatgtgtgggctgggccatactcctatatatgatgcctaatctgtttggttgtcaaccaaagtt

SEQ ID NO: 25456 - DNA, 658 bp, Sorghum bicolor
  Clone ID: 30952428
tacgtttgcggtgatgccaaggatgacccacccgctgaagttcaagactttactgctcaagtcatcatcttgaatcaccctggtcaaatccacgctggatatgctcctgtcctcgattgccacactgctcacattgcttgcaaattctctgagcttctcgagaaggtcgatcgtcgtaccggtaagacccaagaggaggcaccaaagaacgttaagaacggtgactctgccatcgtactcatggtcccctcaaagccaatgtgcgttgaaggtttcgctgattacccaccattgggtcgatttgccgtacgtgatatgcgtcaaaccgtagccgtcggtgtcatcaagaagaccaccaaggccgttaagggtgctgctgctggtgctaagggtgctaaggctgctccaaaggctgctgctggtaagaagaagtaaacaaattaccgaccacattatatacttaacaacaacaacaacaattttcatcttcatcattatatatcaattatattttattcataattattattatcattacatgttgttattctcttataatctaattacgcgtacgtacatttaatgtgtcgtgtcgtagtaatagtatagtatattgtagattaatttttgccttctttccacacaataaattttgagt

SEQ ID NO: 25457 - DNA, 708 bp, Sorghum bicolor
  Clone ID: 30952457
ccagcaagggatgagcagcatgcagaggatgctggaagcgtgcatggatatgcagctggaattgcagcgttctgtgagacaagaagtgtcagctgccttgaatcgatttgcaggacctgaaggattctcgatggatctgtctgacgatggatcaaaatgcaatcaagtgaggaaaggaacctgctgcatatgctgcgatacgcaaatcgattctctactgtacaggtgtggacacatgtgtacttgctcgaaatgtgcaaatgagctggtgcgcagcggtggcaagtgcccgctctgccgggctcccatcgtggaggtggtccgcgcatactcagtattgtaaagtggtggaagatacagtcagtaggaaagggaataagttaacggcaagtgaagttttgctgcaagtgaagaaaagggaccccggaaaaaaaaattgctctcgttttgctccttcattcttcgtttcttcttctttgtgtatctataggggaggctacttacgttgcctgcatattcgttgccttgctgctttgcgtcgccgagacgctggcggcaaagggcgtgccattgaattttggaagagcttgcgttgggatgggaaggtgtgtctccatgcaagctgtttcactgtatatttatacactgactgatcctcaaccgaagcagacacctgcaatgcattgatatatacaaggttccctgact

SEQ ID NO: 25458 - DNA, 590 bp, Sorghum bicolor
  Clone ID: 30952471
tgcacagcacgggtcagaggtacatatacacaggatcaagtgacaagactgtacatatttatgatgtggtaagcggggagactgtcaagaagctttcgtggcatgactcgatcatcagagactgcacctggcatccatactacccaacgctcgtcagctcctcctgggacggctatgttgcccgctgggaggcatccggcgacgacaaggacccttcaatgctcgtccacaacgagaagagggcaggtgcaggtacccgttacttccggagatacgctgatcccttcacagatgccttcatgtagagatgcatgttcctcgtctgcaaagaggttacacttacaccaaacggtggtgaacatggtgtttgatttgttgtttgggaattgcaactgagcaacatgtacagtgccgtttggctcatatatagttatagccgtgtgataatatgttgcttttagctcacaaaagtaaatgaccatatcacgttgtaaaatttttccaataaatcacgtgtattcatagaggtgtgcgttatactgtgtaattttttttaaaaaagaacataatagatggatcaaagtgattcc

SEQ ID NO: 25459 - DNA, 691 bp, Sorghum bicolor
  Clone ID: 30952472
aggtgacaggtggagacaaggtacatgcggcgacgagtgaagaacgaggataggatgtcttgccgaagaaccgctggggcggagaagggtggatcgaggcttgcgtttgagggacatgcgatcgtgcggtgtacgtctactgtacctggctacacggcgggaggacgtcgagggaggtttccggattacgccacaaaatccggggttcgctggttgagccacaaagccatgcatcgtaccggacgctcgtgcggcgggcgttgaccgaagatggaaattccggcgatcgcgatacgatttcggatggtcatgcggtgacatcgcgaggatcacatcgcggagatggagggatcgcggacatcgcggaatttaccatggaagattagacgtaattagaatttacgctcctacgttaaatttatttagtgtagggggttatgtgtaaaaggtagagccacccttggggttataaatatgtggcacctagggttgagagggtttggggcctttttctacagtgccgcggttactattcacggacgtaaatagtaacggcgctgctacagtaacagggaaccacctttctccccttttgtctagcctagggtttcaaatcatagcgagagatttttagttgatctctccaatcaagagagggaggacgatcgggcggaggctagatgcaatttgt

SEQ ID NO: 25460 - DNA, 674 bp, Sorghum bicolor
  Clone ID: 30952502
cgatggtggagggagatgccagaaacttctcagatgtaaaaccagatcttattgcctgtatgaagtccttatcaccagcactgacttgtacagttgagtcagtttctgctcaacttagtgacagtgctgtgacctcaactaacagtgaccagaagttttccagtgtggaggggttgtccagcattaaagattgtgactttgatcaggaaaggaaccaagccactttgcttacttcagaagaggcaagtataatatgcggcactgatttgacttggctacatgatgacctgtccggctatcaaggtgtctccttcagcaatataggactgaatagcatcgatttatttcaatgcaatgatacaatgggggcactacctggactacagaataactggtatgatgatatagagttgagcagtgaaactatggagatccaattgctagacggaggcctgtttgcataagtgcccttatgtgagcaaggatgatgttctttggtatgttcccgtatagtgcctcctgtagggctatattaatctaacttgatcctgtggtggaaggatttaatttgtagtctctccacttttgataattgtctgtattatagactgtgccatggtacaatgactgcaatatatactcttcacgatgatcaaaactacatattagacttc

SEQ ID NO: 25461 - DNA, 575 bp, Sorghum bicolor
  Clone ID: 30952524
gaacaaactgtgggctgccttccctgttcaagtgcaggaaccagtcaaagctctctttgctgcagccatgaacacaattgtgggtgatggaaataccactctgttctggaccgacaattggctccacggcttgtccttgctgtcctagcccctctcattttcagcctggtcccgaaacagcgacggaatcgacgtaaagttagtgaagtgttgcatgagcatcaatggactcatgacatctgaggtgctctcagtgttgctggtcttgctgagttcataggaatcgtggacctacaagaggaagtgagctaatgttgggcgtcctggacaagcatcgatggaggttctcagctactggacagtatttgtcaaaaatcagcttatgagaccttcattggagcagtacattttgaaccgtggaggagccgggatgaagcagcagtttgcactaagattaggatgctagaagggaaacttttttttcctttctctacttgtcttttgtaggaaactcctgtacttactgttttgtttcctgtactacaatgaaaaggcagagtacctgccattttcct

SEQ ID NO: 25462 - DNA, 668 bp, Sorghum bicolor
  Clone ID: 30952531
tcatattatgcaggacctgacacccaatcaacttcaacaagctcttagcaagacattttcaactaaaaagaggaaaagcaagctgcagaaggcatgggatggaacgaaagttgtttacaatatagcatcatggagcgcgacggctattggtatctaccaaaatcctgcgattgtacaagcagcaactgcagccttctggacatcctgtcgtgtaatatcaaagtttctgtgaattcatggctagacggtgcaaatatgcaaacattgtgtggctgtggcttgggcctatgctgaaggcctccctctccgtttccaaagatcaaagggaaacaaaaaaaaaaaagttcctaaactttgtggcatgcttagattatgatgtaaatagcctgcaagttcgttgattgatttaaacagtaacatcatatgctcaaagcattaagcaacatcagttaccggtgatgattaatatagggctggtcagtggtatctcgcatacacaggttgagtgcacgcaccatcacctatttaccagtaccatttgcatcagaccttgaacaactactgtacataagcccatgggttgcgtatcagtcatcccgcttaacattagtgtatcagtgtgattgtaaatatttcgattcatttgaataaattcactcgcattgttc

SEQ ID NO: 25463 - DNA, 270 bp, Sorghum bicolor
  Clone ID: 30952541
tgactccagccaatgagggcgcaccacgtcaccccgccgccactcatataaaacctcttgacctcactgcccgccgccggagaccaccagacagcagcccgccaccgcaggtccctgcccgcgagcagctagctcatcaagagccaagtcagcgaagcccccgaaccgtccctcccatggccgtccgccgcaggcccgcggcggccgctgccggggacccgcctccgcaggggccaccggcaaatgcggcggcggcggcgccagaggaac

SEQ ID NO: 25464 - DNA, 621 bp, Sorghum bicolor
  Clone ID: 30952579
gttgctcccccacactccccacttcgccttcgcccggtcgcccccccggctgcgagcgcgagggcgcggaggggctagcgcgctagcggcgccatggccctgaccgacgccaccgcgttcccctacggcctgcgcgtcctcgtcgtcgacgacgacccaacttggctcaagatcctcgagaagatgctccgcaagtgttcctacgaagtcaccacatgcggtttagcaagcgttgctctccaaattctccgagagaggagaaacaagtttgacattgtaatcagtgacgtcaacatgcctgacatggatggtttcaagcttctcgaactcattggacttgagatggatctacccgtcataatgatgtccatagacggagagacgagtagagtgatgaaaggtgtccagcatggtgcttgtgactatctcctcaagcctgttcggatgaaggaacttcgaaacatttggcaacatgtgtataggaagaaaatgcatgaggtgaaagagattgaaggtaatgacagctgtgatgatctccaaatatttagaaatggtgtggagggatttgacgagaggggcctatttatgagagctgactctgataccatgaggaagagaaaa

SEQ ID NO: 25465 - DNA, 562 bp, Sorghum bicolor
  Clone ID: 30952583
gcgcagcccctgctcaacctcagccaacccagatgttcccgttgcacgattcgaacggcggcgaatcgcgaaaaattggaaggtgggagaggtcgagtgcgaaggcctcctcaccgtcgccgccgccaccaccgctggcgtctcgtcggctataaaccctacccctgctagtcttcccgtcaccaccagccccctcgccgaaaccctaaacccctctccccgttaggtctccaccccgcgccccgacgatggcggaggacgcaccgcctgcggcccctgtgatgacgctggaggaagtgcaggccgaggccgagctgcggatgcgcgacataagccagcgctttggtgctatcccggaggacgacgacgagctgctccggttactcgaggaagccgaaatgtggttgtccagggtggatcaatctccgcccgagagcatgtacaatgctcttcgccccactatggctgttttgattacaagtgagctactggagcaccgtgatcccaacataaaggtcgccctcacctcttgcttaactgaagttaccaggattaccgcccc

SEQ ID NO: 25466 - DNA, 397 bp, Sorghum bicolor
  Clone ID: 30952597
gtactccgcaatcgatctaatctgctctctcgccgattcgcgtcaccgagctcaacgcgaagtcgccgaatcgccgattcgccgggccagatgcaggggcattacttctacggatgcggctggtggactccaatatgctctttcttcatgtgggcaacataactgcctgcagtctgcacaggtaagcagtaggtaagtatttgccttttccctttacatacatcgtatcaatttcaggtgcaaaggttcatgattctctattatttaagtatatatgcatgcattatttatgtttgtcttagtctcataaaggatactagtttttttttcacgcgtaaaattcattgaacttagaacaaagatcgggtcaaagtggtgttggtgggaaggtgccact

SEQ ID NO: 25467 - DNA, 595 bp, Sorghum bicolor
  Clone ID: 30952599
atgaggccattaatttggtagttggtatgtattttgataagtgatttactgatttgtactcccacattttttcacattatgtgtgtagcaaataaataaataaatagcagattcatagactttggaatagttgacatgttacaatgaattccttgtgcaacatgggtccaggctattcatggtatgaagcttataccaattataaattctgttttcctggtcatcagtttgagctaaactgttttctggcacttgaactgtgctctggcactatggcagggatgcgttttacctattgatggtagcataaattagatcggcctttcactgcttgttcctttctgttttcaagcctccctaaggtctctacatcttcattaacttgcagctgtgtgatcttctgaaatcaagggttcaatcgcctgaatttctagagaagctagatacccttcagaagtcagtatatcaacatggtgcagtggatgaaacagtatcatgggatattataagtgcggcagatatatgggatgataagagtgtgaatgttagtgatgattcagaagacggatatgttcttgttaagcaagaggacata

SEQ ID NO: 25468 - DNA, 574 bp, Sorghum bicolor
  Clone ID: 30952615
aaaaaaaaaaaagaacaattacagagtcgccaggctccagggacccacatactcctgggagccttcaacccaacgaaacccatccatccacccaataatctcttgtcgatcgatccaagcgagatcagtgcttgaagaacccgaggcgacatctgcgccgggcgctgtcctcctcctctcctctacgccgcgggcttgtagagcttctccaccatcttcctgaactctgaacagggagaaaacggttcagaacaaaagtaaggaaccggcttgctgagattcagaacaagaaatcgatcgatcgagcgagcgattgttgacgagaacgaagcgagatgtcgaatcgcgtaccttcctggttcgcccagagcgccgccgcctgcgtgttgagcggcgagtcgttgttcggctctgcatagtaaatcataatccgtcggtcagaaaaaaaaaaaaacaaggggaaaacgcacgccagcagcacacgagatcgatggatcgaccgaacaaaaggaaggaaccggtcgcgactctgtttacctccgagcaggctctggatggagaggaggatggtgcg

SEQ ID NO: 25469 - DNA, 663 bp, Sorghum bicolor
  Clone ID: 30952624
caagaaacccacaaaactatctgtaccaataagcttacattaccacaaacttctgtccagttgctagaagaagtcgacccatggatcagatctccgacccaacatttccaattggagcagaatgccacagtaactcttggttttaacagaaccagtaatgtcttaccaacagatgcacctgagtctgggcatttgcctgagttcataactgcacaggatacaaacatgatttcgcagcctgacagcagggaagctcatctgaatgctctgcaacatgaaaggggtgagaaagtaaaccaagatctggaagatgtctctgcaagtatttggccagtggaaaaggaccatgttcatggggatctgactttgcaatctgctggtgttttactttctgtaagctgcaatggtgccaatcaaggaagtaagtctgaaaccaatcttcaaccaggggctgcagcagaggacttgtctcaacaagatttgtgcataaaatgcggtaaagatggtcagttgctggaatgcagtggctgttctttagctgctcatgatagctgtttcggttcatcggtgacatttgaagggaccgacttattctactgcccacgatgctgctataagaaagccactgaagcatatgaaaaggcaaagaaaacatattacgaa

SEQ ID NO: 25470 - DNA, 515 bp, Sorghum bicolor
  Clone ID: 30952631
ctctttttttctcgccttaaagcagctttaattttttccaatgggtaaggagaaggttcatattaacattgtcgttatcggtcacgtcgatgccggtaagtcaaccaccactggtcacttgatctacaagtgccgtggtattgacaagcgaactatcgaaaagttcgagaaggaggccgctgagatgggtaaaggatcgttcaagtacgcctgggttcttgacaaactcaaggccgagcgagagcgtggtattaccatcgatattgccctctggaagttcgaaacccccaagtacaactacaccatcatcgatgctcccggacatcgtgactttattaagaacatgattactggaacttcacaagccgatgttgctcttttagttgttgcctctggtactggagagttcgaggctggtattgccaagactggtcaaacccgtgagcatgctttgcttgcctacaccctcggtgtcaagcaactcatcgtcgctgtcaacaagatggacgacaaat

SEQ ID NO: 25471 - DNA, 485 bp, Sorghum bicolor
  Clone ID: 30952694
attcatatcgctagcatcgccgccgccggtctcatggcttcccgacaccaccgtcgctgccaccgcaacctccactaatggcgtcgccgctgtttcccccacctccaatacaggcgctgctgccttcttcacctgcaccagtggtgccgccacctccagtaccagcgccggcgccgccgctgcctccactgcccaaatctcgtccaggaaaggaatggtaggtggctacctgtctccttcagatctcccgcagggggcctggtctccgcggtagaccatctgccggtgtcgaggaaaccgttgctgcagtggttcatggagaagcgcaagtggcgtcggatttggttgggatttggaggacccggggttccgtggttgttcctctacggcaaagatgggattttcttctatgatgtgcgcgcggcaccgcggacgtgctggttctgtgattttccctccaccgacatgagatttgattcacgcta

SEQ ID NO: 25472 - DNA, 413 bp, Sorghum bicolor
  Clone ID: 30952695
ctttttttttttttttttttgcatggccgcatggggttcaacttcgtctgtcaacaaaagacatcccaattatgtgctgttatactgcaagtttgtgtcaaacagacaacgggactccattcaacaacagagttggatacccccaacgcagaattgtatagacagccaatagggcgctttattaattcatcctttgtagggggaacttgaaacttcaaaggatagacagccaatagggggctttattaattcattctttgtagcagaattgtatagacagccacggaattctccctgttgctgctcctgccattgattcagtggcgaggatgctactaccaaagagtgagcccatggcctgggggcctccgtgaccttgaaggataaaaaatcagatcccgtaggatggcaac

SEQ ID NO: 25473 - DNA, 518 bp, Sorghum bicolor
  Clone ID: 30952706
ggtgctctctcgactctggagtctggagttcagtcaggttcccaagaacaagaagccgccgaccaaccaccaaaaccctcgtgcctccgcggaatccagccagcctccgtcccgctccccgcaattcagtgcgggagtctgcaggattgacttgatccctccgtgctccgactcgcctgctgttgcgaggagcgagcgattgccgccgcgaattccaccaagctccggcagttctttcacggcaggacgatgcgaggagtgcggcggagcgcgcgcggggaatcgtccaggaaggcggcggaccgggaccgggaccgggaccaggacgtggagcggttcgcgctgtgcgccaagatgtcccacctcacgaggaccacgtcggagccgtgccgcaggacccgcggcgccgcttgggcgcgacggagcaggcccttctcggcgttcgagctggtgtcggcgagggaggccggccgcgcgggcggcgccgggttctccgccgccgaccgagcctacctcgg

SEQ ID NO: 25474 - DNA, 606 bp, Sorghum bicolor
  Clone ID: 30952708
tatcaggcataacccctctctcccttccaccacagcaagacagagagaaacacacattcatcggctgagtctattaggccgattagttattatacctgcaaattagttcttctacctgtgcttactgtcaatataactcaacacaatctgcctgaggcaaagacgaagccatgggttagatctttccatacataactcagctgctctggccctgcccagagatacaaatgaaatggatcggatcggagtttgttgcagcattatcatcccctggctagtagctactgaaacttgacaagtgtaccgacctgctgctgctggttaatcaagatccagtgcatctccgtcatgcgtactgaggttattcaggcggacaccgtcgatgcggctgttgaacaaatcctccgtgaactcagggaggacaccagcactagaatcatcagaaacagagagaatgtcatctacttcgacggctgggacgggctgggggcgtctgccgtcctccaggccatgggccagcgcctcgacgtcgacgtggcctcgtctgaggccccggaaggactgcagtttgatcagatcatctacatcgactgctccaattgggag

SEQ ID NO: 25475 - DNA, 685 bp, Sorghum bicolor
  Clone ID: 30952722
catgactgtttgattttggctgatgacggtacatgaaactgcactcccagtcaacatttgatgaagctttttcataatctaggatttttgctttctccgaactgtagaagttcttctccatgtcttgttcatagtgtttgttcaccagatccttcattttattcatgaggtcctcattgactccatgattctcaagctgccatggagtttagcgtgcagtatgttaaaaaatagaatgaaattattctcatatagagaatgatgcatattttgttacttacccaaaagaaaccccattgcgcacaggcattatggaggagtgaaagtgtctctgacctcttctcgccatgcagctgatccatctttatcactggaatctccatttcctgaaacactggtgtgttgcagtctaaccagatgtgctgtctactcttctcaagttggtacgctacatctacagcaggccaggtatttatagtggcctagataggaatgttgggaatatcccttttgagattgctaacatgatgttgtttgagaatgaaggaaaccttgctttcttatgaggtttgtatagaatcatgtccaaatacattgcactattcacacatggtttagctaagataacctatgtggcatccttggtaattcatcaacatggttgacctatgagcacagcatgatg

SEQ ID NO: 25476 - DNA, 512 bp, Sorghum bicolor
  Clone ID: 30952732
tgctggcgatgctcatggacaggaaggaggacgtgcacgagctccggcggcggggcctggtgcacggcgccctgagcaacaagcaggcgctggggttcttcaaggggctcggccagcacctgcgcttcggccgccgctacttcgccgccctggaggagatcgactcgtacaagcgctacaggtcggtgaggatcaaagtctacaagttcgtctacaataactacaagttcatcgccgccttcctgtctgtcaccggcgtcctcatcggcatctttaagacccttttctcactccagcgccattgctaatgctgcctatgatatattcatataatgttgttgtatggtactataagcttcagcctatagaaccatgcattgttcatgattgccactcgtgcatgcatatttttcttctttttttttgtttacaatatacacatcgaacacgcaatgcatgcatgtgtttacaatacacatgtagcaaaagttcgattctaatcgtgtggttcg

SEQ ID NO: 25477 - DNA, 549 bp, Sorghum bicolor
  Clone ID: 30952734
tatatgcaaagagcacctaatgctagagttcttttttcctatctgttggttctttcttcgacagaggcttccagaaggtttatgaaattgtgtcttctaaaactgaaccatcaggttttgacaccatatgcaaagagcacctaatgctagagcacttctttttccttggtgagaggcagcgatgatcatcatccacaaggtagagtgctctggacacatgctcatccaggcaaggggattcgagtgcagatcctaagcacgagcccaaggcgcgaagcagcctgtggcatacaatttagacattcatactattgtctttatgcattcaatctgccaataccaatatgttttgtattgaatattcctaactagcacagtttttatagagctgagttttcttttagttgaggttataattatcatttaggttatggtacaaaaatttagtggatgaatactgaacttttgatttcagtaaattaggtgctatatatgttgatggaattatatagtacctttattcacagataaaaagaattttaacatctc

SEQ ID NO: 25478 - DNA, 681 bp, Sorghum bicolor
  Clone ID: 30952739
taagtgttgtaccttgattgtactcaggtataaagaagaagacaaggatgaattagaccctaaagatggactagcaaatcggaccactagagtgaagaagggaccggtgcaagacctagaagacaaactagcaaaacggacgagtagagtcaagaacggaccagtgcaaagaaatcttcataattttttactcataaaagctatgaaggcccatgaagacttgttggaaagcttgtcgagtctattttcaagcccaaatggttgcacctgaattggtttctccttctttgagatatgactatgtgaatacagactggtaagaagatcaacagtaagcatgatgtccaacttcccatgcaaaactgtaccaatctacataatttcgtggtgcatgctgcacttggtgtgaaaggttatcaagttatctttccaacgcatccagccatgcatcatttggaagttttaagatggagttattgctaaaacactaaagactgcactgaagaccaacagccacgcgggaactctccaagaagtcatctcgaagaggcacatagtccgcattagcttttccatttcgtgtttctacctatctagcagagttgttgctagtataaataccccctaagactcattgtaatctcacacttttgataattgaaatacagaaccccttttgtt

SEQ ID NO: 25479 - DNA, 674 bp, Sorghum bicolor
  Clone ID: 30952743
aagatcagactcgagacatcacaaacaacatcatcgggacatttggttacatgtctcccgagtacgtgatgcgtggacaatactccacaaaatcagatgtatttagtttcggcatccttgttatagagattgtaacaggacagaaaaatgctgggcattacttcgacgagcaaaatgaggatatcataagcattgtatggaagcactggacggagggaacacttacagagattatagataattcgctagggaggaactactcagagactgaggtgctaaaatgcattaacattggcttgcagtgccttcaacagagtcctatggatcgacctacgatgtcggatgtcatggtgatgctcaacgatgttgatactatttctctgcctaatgccgcaagaccaactttcttcttagatgcaagctctgattactcttacacttcgggcactatttcacaaccttctgccaggtagtgtaggctgagacctaatgcaaacctattgcttgtatattagttgcaaaaaacatggaattcaccatgaagtgctcactgatcactatagtttcttactaaattctcaactacaaagtttctcttactagaggtcccacatgatttcaaaaaaaagtatggaaatgcttactaattggaaaattggaaaaatgttgtgctc

SEQ ID NO: 25480 - DNA, 660 bp, Sorghum bicolor
  Clone ID: 30952745
caatccagctagcgaagcatgtgtacggcgcgtcaaaggtggcagcgacggccagcaccaagaagatcgagctgctcaagagcctgggtgtcgatgtcgccatcgactacactaaggacagcttcgaagagctgacggacaaatacgacgtcgtcttggacgcagtcggccagggtgacaaggctgtcaaggtagtgaaggaaggcggcagcgtggtggtcctcaccggcgccgtcagccctccagggttccggttcgtcgtcacctccaacggcgccgtcttggagaagctcaacccgtacctcgagtcaggcaaggtgaagccgctcatcgacccggaggggccgttcgccttctcgcaggtcgtggaggccttctcctaccttgagaccgggagagcaaccggcaaagtagtcatctctccaatcccatgagagctgtgtagactgcaaagtttgttcgctggccatttgcgagccggcctcagattctcaagagtgtcatatagtctgaaatggactttatttcaggtatacagtccatagaattacaatacaaagaggtgtacatacattgtgctcattgctgagccacttatcaacgttccagtccaggttgtgggaacggataaatacagtataagaaggcccctctttttct

SEQ ID NO: 25481 - DNA, 576 bp, Sorghum bicolor
  Clone ID: 30952750
tccgagtcggagaacgggcggcggcggtcgtccgtgtcggcgcgcgacgctcgggcgtgcggatggggcgcggacgacgccgaccgagttccggcgcaccgtggaggcgttcatcgacaagcacaagcgattccaccgccaggagtccatgacgatggccgtcgtcgccggctccggctccagcgggcactgcgaggcggccccggccttcaccggcgccctcgccgtcgtcgaataataagtcttcaccggcgcagttggcagcagagtacatagcggaggcggagaagcttccctggctgaacttgtcgtctcgtgttcatagtttgcctcccaaggctccttcgtgttcttcacaggggggatgccaccttttttttttctgtgttttttttattttctcggcgcgtgcgtttcttcgtttcgccataggaacccgcagctgcgactacgaacgggggtttagagagccgttcaggtctgccgttggatcgcggcgtggatcggatccaacagaacgatctttaacctgtgctctgatctggcaacgaagggaaatggacgaaaattgcatgc

SEQ ID NO: 25482 - DNA, 711 bp, Sorghum bicolor
  Clone ID: 30952751
aggaagtgtggaggaagatgagttttggaatgttagttttgctggaatgcaaagggttcctctcatgttcgatgatcggccattgttttctgaggtgcttagcagtgctcgtgatgagcttaagtgcaatgctaatgaggatgacatctcagttgagggggtacttcactatggtaaatcgggtcgtatttttaggcggttggtccccattgcatcagaggctcagtgggacaaatatgtgaaaactgtgatgaagaatgactttcaatgtttggatctggtagtacggaagttgtccaataatctctccattcatgggtatgcatcccctaatggacgttcaccccctcatgggttgttgccagaacgagataatctgccaatctctgagcctctgttacccaaccgcaaggtggatggtgaagatgtggttgtggtgcctgatgctcaatctgctacggatcatccaacgcaaggtgcagaaacaagacgacgccgtccgccttcgaaatacactccaggaaccggagctcttggccataagggaaaggttaagagaaggctgcgttcaagatgacttgttggttcatactatatggtcttctcgtactgtcattattttgggtgcatggaaagtgtggtaacttgtagggactactggactgtatgcactatgtttattatttggttatcttgctacattcgagatgg

SEQ ID NO: 25483 - DNA, 732 bp, Sorghum bicolor
  Clone ID: 30952761
tagtggatatgaagcctatgcgtgggatccaaactactatgcccaatacggtgcgaattatggttgggatcctagtgccagtgcaaattatgcggatggaacacagtatgccgcatatgcaggaggccaaagtggagggtatgctcattcgcacggaggggagcatggcagcggatatgagcatgttgcagcagtgccatacggagtagattatactggagggtatggtcatgaggcagcggcaaccacgttaccaccggtgcaagaaccagtactgccaccagagatgggtaggattggagggaaaagaggtaggaatgatatgccggcccagattttagaggtaaatcaagcagagctgatgaaaaacagaccaaagcaggataaatccaagctcacagggttggccttcggtcctagttatcagcctgccccttcagcaaaaggaaagccatccaagttgcataaaaggaaacaccagattggttctctgtacttcgacatgcagtcgaaggagatggagcttgcggagaggcgttctaaaggcattcttacgaaagcagaaactcaagcaaaatatggctggtgagcttgtaagaaaaactcaggatacctgtatgggatctgttgaattgaaatgtgcggatttttgttgcaaattttgttgtatctgttacggacaagtaaacccaatgcagaacaaatagttcaatgatcaatcaatattgagtc

SEQ ID NO: 25484 - DNA, 465 bp, Sorghum bicolor
  Clone ID: 30952763
atggccattgatttgtgtgatggcaggaaacgttttttggggctgtagttttttgttccccgcattacaggatttggcaacaacaagcaagtttgaagggcattttggttgtcatgcaacaaaagtggattctgttcccatccaaggcatgggtgctagttgtgaagcagttgcataatgtttattcggagcatgcaggcttgggtagaaaccgtggcacaatgcccccccaaagctgcactttttggttggttgagagagcaattagttaccagcagattcccttctcaagatgtaatagatgttatgaaactgccatttgaacatgtagctgattgtgtactttagctttggattagtatttgttatgaaaaacttgaatgatattcgaagcccatcaaacttaatgtttgaattacttgagtatggatggatggttcaatgactttgttataatattgaggc

SEQ ID NO: 25485 - DNA, 762 bp, Sorghum bicolor
  Clone ID: 30952766
atattcagtctagtaatgcttcaaggaaaaatgagggattggtacaacagagcatcaatgctaatcaacaaaagaatgggacatcaatacgacattctgaaaacttcaccacttctgctcaaagaactgctggtggctttccaccagcacttacaacagaggaaaaattcaaagctgcaaggccttcatccagtactgaagctgcacccagaaaagaggggattggacagcgaatcagtaacattagcatattggttcaaaagagaactgagaacacgaacagagatgtcgcaaagaaagaagttggcacctcctctccattgcctccaaatcctgctaatgctatgcataagggaaatggcaaggtcagtaggccagtggagaacacacaagcatccatgcagagatttggcagcccatcgacgtcaagtgcagcagggggggtggatagaggaacacctaggtcatccatcccaagcccaagcattacaatacggaggcccaatgggatggtacggatggctgaaaacctttctgtctctgctaagaaacctgatgcaggtggactttcacctgctgtgggtaaggaaaaggaacaagttggaaggttgctgcaagctaatatttcgaatgatcagaaactggctatgtcaaaacctccagctgtggagaaagctgcagatggaagagctgaaaggatggagaaggtcagagatggggcacctgatattgccaagaaagaggacaaaaagagtgatcggc

SEQ ID NO: 25486 - DNA, 604 bp, Sorghum bicolor
  Clone ID: 30952788
aaatgaaaagggaagattgaccaaggatgagattgatagaatggttcatgaagctgagatgcataagaatgaagacgatcttcaaaagaagaaaatcgagtcgaaaaacgcattggaacaatactgttattctatcaaacaaactctcaaggacgacaaaattaaggaaaaactcagcggatctgatgctgaaaacctcgagcacctcgctgaagaaggcttgaaatggattgaaagcaacccaaatgctgaagctgaagcctatgatagcaaacgccaagaaatggagaacgtatttaacccaattatcaccaagatttatcaaggaggtgaagatggccaaggacaacaaggttctgaaggtagtcgtggcttcccaggaggcaccacgggaacaggagcaagtggattccctggtggaacttatgctagttctagtggtggtcctagagctgatgaagtcgattaaattattattattagataaaagatttgagatgtatgtgtatatataatagattatatattatagagtatttccattgaaaaaaataaatatatttcatcagagtaaatagataagtcgtatattacttactattcc

SEQ ID NO: 25487 - DNA, 570 bp, Sorghum bicolor
  Clone ID: 30952790
gataggcgagaagtgaagactactacaagaatgcatgtgtctgagactaatcagaagcgcaagcgtagctccttcaagtcctccctgtcatgtggtaaccagagatgccacacgaggcctctgcaagttaaagctgctgtgtcagtgtcacctatgctcctcccgccgaatttcaccgttcccaggttgaagaccccaactcgtccctaaaagtgtgaaaccactggccactgtagtctgatgtgctgacaattgaagttgtcccaacacgccctgctctgacagtaggtgaagcttatccgttgccgctggcaggtttgacttaattgcaaagcagcattgtatagtcgatttaactgtgcctgtaacatatttcttctctcatctctgcgttggaatgcttgcaacatgtattatgtttttttttttgagattcatgtactatgggtgctgtgtaacagatgcagaaggtgtccatgtgtgtaactcgcttgcccggctttgagcatatttgtttatgtgtaacagattagcagttcttgtggcatatcttcttgtgagagtattcgc

SEQ ID NO: 25488 - DNA, 655 bp, Sorghum bicolor
  Clone ID: 30952826
gagcagcaacgaccatggcgggtggttgttcggcggtattaaatgtttcaaaaatagatctgttaaacttggggtcctctccgtattcttcaacgttaatattctttaaaacatcagggcttcgtcttagggcgtcttcaaatgcaccagagctgaaaacttctgataagggaggaatttggctggtcataatctccttgaggtcctcgcctctatttcttttataatgttcattttcttccttttcttttactgcagcttctttctgttgttgtttaataattttcttttgtttggcgagctctaggatctcctgcttcattaattttcgctcttttggtgtgacttgcgatatataattattaataaggggtccctcgaccttctttttgtattcttccaaagcacggccaaaatactctcgcttgatgtcgatcacctcttcataatcaaaaggagccgctgcgacggcaaagcttgcatcatctgaaatagctgtggcctttagcgatgtgctagtatttttggctactgtagagctgctaaatctagccttttggatgctgatgaggttgcggccttgctttgaacgcaagcttttggtgagtactactcgcaacatttgaacgcgtttgcaacgaggtgagtgttctac

SEQ ID NO: 25489 - DNA, 695 bp, Sorghum bicolor
  Clone ID: 30952828
ttagtacatgattaaacaatattgtcaaatacaatggaagtggtactgtttatattttgcaaaattttttagaagtaaacaaggcccgttttgattttctaaatctattgttcatccattcataactgaggccttgttcagttggagattttttttggttttgggtactgtagcattttcgtttgtatttgacaaattttgtccaatcatggactaactagactcaaaagattcgtctcgcaaattacaggtaaactgtataattagttgttttttactatatatttaatgcttcatgcatgtgacgcaagattcaatgtgacggaaaatttaaaaattttttagaaactaaacaaggcctgaactgacatgcatccatgattttttttttttttgctcgcgcacagaaggttataggactgcagtgccgatcgttttgttgtgaaacgatgtctcctctgaagagacacctcttcatcatctaatcggtgatctcatctggtgataagattagcagttagcctagcagttagcatgccatccgaaggggcatgtcctttggccaatagcagttgctctttctgtactcaaacaccaaggagtcacgtccgtacgactacgaagagacgtccgtacgacgtgatctctcacttgtatataatctaacaagatcaatgaaagcagcagttgttccc

SEQ ID NO: 25490 - DNA, 281 bp, Sorghum bicolor
  Clone ID: 30952844
gcatgacaaccacgaattcgaaatgactgttccgtgttattacccgtgttccccagtttcccatcaatccaatcctccagcaggcggcggcatggacactaacacaagaacgatactcgtcatcgacgacaaccttcccgccattgccgagaggatggccacgacgacggcgaggctggaggccgatttctccgaggtggagaccaagatccaccggttccccggcagcctgcgaggaatcggcggcgacaatggtcgctacgtcgtcccgagcgtggtgg

SEQ ID NO: 25491 - DNA, 463 bp, Sorghum bicolor
  Clone ID: 30952848
gggccagtaacgctttaacccctcccctcccctcccctccgattcctctaatccgcgatcacccaacccctcgccgccgatcccccccaaccctcgccgcccgattccgctcccgttcccgcggggccccaatccctccgcgcgggcgcgatgccggcggcggcgccgacgcccaaggcggtggtgcaccagcggttcggtgccaaggcgcggtacacggtggaggaggtgcgggaggccgtgggcggctgcccgggcctcgcgccgcagaccaggagcgtctaccgctgcgcgctcgacctcccgggcctctccgacgccacgcctggcaccttcctcaggaagaaggacgccgagcaggccgccgcgcagatcgcgctcgacaagcttggtattcagcccacggcaaatattcccagtacaccccaagaagcttgggatgaactgattgctcgcatatctg

SEQ ID NO: 25492 - DNA, 579 bp, Sorghum bicolor
  Clone ID: 30952857
acgcgtccgcggatcccaaacgatttttctgtatttgcacccgaagcgcataacagaggtcttgtgttctgcaactattcacgattccgtggtagaatggacaactgtttaggttgccagtgaaatttgtgtttgatgttgcgtaggggtcagtggatttagacctattattattatttgtttgattgtctcatcgatccatctttggcatgttgttgcctcttcctgaggtggtatggtatagtatactccgtgtctccagttcttcatttctaagatcacggctagccttttccattcgatttttttatgcgtgtttcggagggagacggtacatattaagcaacgattatgcggtattgcaaatttagttttcttttccctgacaaagaaacttgcgccttccatggcacgaatctgagatcgaagggattaggtaggattaggatgagtagggacaggtttttgtggtgggggtcgcttgggattaaatccgactatccgagcccttagtattcgggtccaaagccctgtgtccaagctgctctttagggtctgtggagctgtttgtatggcttg

SEQ ID NO: 25493 - DNA, 635 bp, Sorghum bicolor
  unsure (1)..(635): unsure at all n locations
  Clone ID: 30952861
accgcatcgaccggccggttcctctctcccgacgcgacgcgccccagcccagtgcacggtcccgccacgctagcctcccagcagctcccagccccagctccgctcagggcgcgcctgcagttccggccatgagacgggccggaggaggagacctgcagggcgaccacgggacgacgcctcggtccgcggcggcagggcaggccatggtggagctgcaggccaacgggtcggcggccgccgccgggggcgccatggtggtgggtctcagcccgctcagcgagaccctgtggcgggacagcaaggcgctcccgccgggtgccggccccgccgcgctcatcggcgacgtgtccgccaggctcacgtggaaggacctgtgcgtcaccgtggcgctcggccccggcaagacgcagaccgtgctggacgagctcaccgggtacgcggagcccggctcgctcaccgcgctcatgggcccctccgggtccggcaagtccaccctgctcgacgccctcgccggccgcctcggcgccaacgccttcctctccggcgacgtgctcctcaacggccgcaaggccaagctctccttcggcgccgcggcgtacgtgacgcaggacgacnacctgatcgggacgctgacg

SEQ ID NO: 25494 - DNA, 533 bp, Sorghum bicolor
  Clone ID: 30952878
cctttttttttttttttttgtgctgagctgaatccgaaaacttgaagcaagcgcatcagcagtgcttgacgttgttgcatgagctcatcactagggactgtatgcgggttataacggaagatgacgtaaggatattggctcgttctatttttaacgccttcaacgccgtattcggcattcaattttttgcgttcttgctcttggtgcaactctcgaacaacttgttggtgagggtagatgggttcttcagcaggcacgtagttcagatcggccttccaagcgtctgaaagggcggcttggaacagcttcaagcagtaccttctgttttcagcaaattgcaagtgatcggtgctggtgatcttcaacacatccaactcggggtcgtatcgagaaccgactatctccaacaatcgactatgaaccatcttgggtagcttcaaagcagccactttaaccaataaagtggcgcgtctgaacaacttctccttcttaatggtctcgggaatcattggattgtcaacagtgacccacgc

SEQ ID NO: 25495 - DNA, 597 bp, Sorghum bicolor
  Clone ID: 30952887
agtccggagcaggccctaatactccaaaatcaccacgcacccaactagtctgccttgcgttgctactagtcctcctagtcccagcccgtccgtccattgctctcatcttcttcttcctcctcctccatccccttgcttgctgctttcccctctctctcgctcgctcttggatctcatacacacctaattaatatagctagctcccttcttcttatccattatatattgccagatagagatctcgctctccatccttcgccgtgtcgtcgtcgtctctatagctgcttaattatatatcgatctacgagctcatctgatctatatctgtcccaactcatcatctcgccccgcatatatatacccatccatcttaatttaatctctgttctcaatcccatctatacacatatatataggcgaatctatctgtagctctagctatagttcgagttaattctattagccgccagattgagagatcaagcagctagaatatatgttatactggctacttgctttattactctattagctatatataggcacatatccatcgatcgatatatacacatatatcctagctactcctccatgctt

SEQ ID NO: 25496 - DNA, 639 bp, Sorghum bicolor
  Clone ID: 30952901
acactgatccatccccacgtcggggagccgcggggcagtcccgtcatttcagcgcgcgggcgagccatgtggataaggcccatggccctgatgatggccatgccgtcacaccgcctactcccggtcgccccgtccgttccttcttcctcgcttcacacacgacgacggagcgggccggggggcacacgcacacgcatatatccagcttgccatatttataccacctctcctcctccgtccgcggtcgagaccaacctcggccattcttatccccagaagcttcgccaaaagtgatcgatccgtctacacaagggacctgaccgcccgccggcggaatccgacgacacactcctcgtcgcgttcgcggcgcttctcttctcatctcttcatgcgccatcgccgacgcctccacctctgcgacgccgcccacagatagagcagcaggacgggggcgatgccttcgctctcctgccacaacctcctcgacctcgccgcggccgacgaggtgcccctgccgtcgcccacgccgctccgcctcccgcgcgtcatgtccgtcgcgtcaccggcctcgcccacctcgccatccccggccgccccgccgcgccgcgtcatcgtttcccaccgcctgccgctccgcgc

SEQ ID NO: 25497 - DNA, 550 bp, Sorghum bicolor
  Clone ID: 30952906
aaagccgctgttccgccatctcctcgtctctcccgccgccaacgccgtcgccttctcctcttccccctcctctggagattgccccagcgcgcctcccccggccgccgcgctcctgcgcctcctcctcctgccagcgcccatgctccccgcctccgcctccgaccccacggccgccatcctcttccagaccctaccgccgttcctccagtcccaggcgctctccttcctcgcctcctccgctgacctcctcgacccgcacttcctccgcatcctcgccgcccgcgtcctctccgccccgcctggccggtatggactatgggtcgtccgcggcgcccgccacctgatcgacggattgcctgaagaggaaggcgtccctggtgtggtctccgacgagttcatcgatgggtttcacgatccgccaatgtggcttaaagaagcggccgcgcgggcgcatcctgttctgccgtggctccctgttgattgccggagcttgacggggagcgggagcgggacacgtgctggtcctggtggtgaggatggtttggacggg

SEQ ID NO: 25498 - DNA, 560 bp, Sorghum bicolor
  Clone ID: 30952909
tattttatatactataatatatcatgaactttagttattctcttgcccaactatatgaaatctcctgatgtatgatgccatctgatatctttatctataaatttgtgtgtattgaactatgtggtatctattatctttatatctaaattctgttctaaactatgtgtgttctggaaagcatatttgatttctttctttgccatcgtctggactatgtgtgttctgggaagcatatttgaacaatcactacgggaaacactagatttgcctagagctttgaagtttgccgagagcatcctatcgggctctcggcaaacacgaaatttgccaacagtcactctcggtgaacaaatactctcggcaaataggtctttgcacgtggtggcactcgccatgtcaggggcacgtggtggcactcgccatgtcaacagcatcctaggtctcttgtgcagggaacacttccctggaattgtcaagttcgcggggagggaggagccagcctacacgtttgctcactacgcggccgccaccgacacgcaagaaggcaatgtggccaatag

SEQ ID NO: 25499 - DNA, 503 bp, Sorghum bicolor
  Clone ID: 30952910
cctttcccacctcccatcctatcccccatcccaccccctcatgtcgtcgccttcctccccgcgctcttgccccctcatctgctcgctcccccaccagcaccacgcgctcgcattaacggccaaggctcatctctgattatggaggtaacagtcgtctagcacaccgcaccgccgtgcgtccctctctgttgtcgttcccagtttagaggagtttttgtttcggttccttcgttccaccgagcgccgcggcattctgtgggtcgtgtggatttgatttggccggggggaaggaggctggtcaaagatttgtggtggaattgatggtggggttcatggaatgggtgcatgactggttgctgtgggacgccttcttggagtgcggagggatcatgaggccaccgattagatagcggctggggagcgagggaccaccggaggcggaggccgccgttagcacccacaccaccccgcggcgcgtgtccgcagccatgggggaagacctc

SEQ ID NO: 25500 - DNA, 597 bp, Sorghum bicolor
  Clone ID: 30952918
gcctactgacaagattattaacccccaccaaatcctcgttcatttgtttctttaatccaagcgacctcacgtgtgagagcaggagagcgcgcggggctagggtttccgcgggcgatggaagcagcggcggcggccccgccggcagtggcgtcgtcctcatctgcatcggcatccgtgggccggtcgtgcccatctaccagcgccgcccaggtggactgatggtgctatgtttctttgcagagaaacaaagaagctaatttagacctcaggtatctctagtatctctgaatctcttctctacagctaaaaaatgtggagcacttaaaatttcaaatttgcgttcagtagcatgtgattgaagtgggtacagtattttactgatgtaactttgttgcatagatgtggctatgcttcctttgccttccttttgctggactctttttttctccctctttctgaaattactttgtgctaagcttacactgagctttgttatacagtgatgtgtaagagcaaaaaggaaaactagcttaatattgtggactagcttatattgcctctcttggtgttaccattaaccaaacaatatgactatat

SEQ ID NO: 25501 - DNA, 621 bp, Sorghum bicolor
  Clone ID: 30952926
aaagttcagaagtacgaccgcttttgcgagccgccactcgtagctcggtagatcggtcgccgaagttttggatctcgtttccggcgaacttttccggtgaatgttcgacgagcttttacggtcaactccggcgtcctctgcgaaaatcgtcaccgctgcgaggctatctccggccatggccgcggccctcctcgcctcgcgcctagcgccgctccccgaccctaaccacgccaccacgtcgagccccgcgctgtgcgtgcctcccttgcgtgctgcgcaaacagccgccggcgccgctcacggccgcatggccggctctgtgtggctcgtgcaggtcgtcgtgcgggcccttgccccgaccttgcgcgtgggtcatccggccgcatgccgctgcgccgccggcctggtcaagtctcggccgagccctcccttcccggtgcccagcagctgctgcttccgatcttctaattggccactgcgttcacgaacaggacccaagaagaagcgtggttcgtcagcagttaagatcacgagctgaggaccgaaagtcaaagcagaagttggagatcagaagaaagaagccaaagaattctgagcagatatacactgggaattaagtgt

SEQ ID NO: 25502 - DNA, 519 bp, Sorghum bicolor
  Clone ID: 30952927
ctccctggttcctttagtagagagactatgaactaaaattttttagagtgttttgtactgatttttgagtgggaatggaggcctaaatcctccggttgtcctccgggattcatcacttttacctgtgatttttgtttctctgagttcatcatttttctctattttcgttcttggctaagatcccaatttcccggagtttggcttaatctcaggcaatgattctttggggatgagtttgtgcctaggtgaatttcatctgtgcaaagtttgggagaaagttcttttgatttgagttggatttcattgattttgtggctactgccgtttctgttggttcttatgtttgtgcgtctgttcttctgctcgtgatttggtagactcatgggatcggacaacaacgctaccaacgccgagcgctcaacgccgcgcgtgctcgattgagcagcgtttgcctcagggccaggcagtccgtccgtgctcgattgagcagcgtttgcctcagtgccaggcagtccgtcc

SEQ ID NO: 25503 - DNA, 540 bp, Sorghum bicolor
  Clone ID: 30952932
attgcccgcatgcatcgctgttgatgatgcatcccctctgagcaataagctcctctcactccctcctgcgcactagccatggctcctcccttcgcgtgcgccatgcacagcggccgcgccctgctagcagcagcgctgctggcggcgtcggcagccgtcacgctcacgcttctcccctccgccgccgcgcagccgtgggtgggcccgtggccgacgtgcgacgacaccacgggcaactactcggccggcagcgcctacgccaacaacgtcaaggagctcatccacaacctccagacgaacgcgtccaacacgcccgccctcttcgcgaccggctccgtcgtcggcgccggcggcgcggacgacgccgtctacgggctcatactctgccgcggcgacctcagcctcaccgactgcttcgactgcggcaccaacgccggccaggacgtgcaccgcgtctgcaacggcacccgcgacgccgcgctcgtctacaaccagtgctacgtccgcatctcccccacggacttcctcgccaccaccaac

SEQ ID NO: 25504 - DNA, 585 bp, Sorghum bicolor
  Clone ID: 30952939
attggtggggcgcgtggtgcgcgaacgagggagcaaacttggctgatggagatgaatgctggtggcctggacaggaacaaggaccagacgaaggagtcaaagctgatggaggtgaatgctggtggcctgaataggggcaaggacctgacaaagaagcgacactggaaggacagtgtgctgatggaggtgaacactggtgttcttggcaggggtaacgaaggaaagaagcgacatcgaaaggacagtgaggatggcgaaaggaagaagatacgcaagaagaattcagaggcagaaagctataaggagagaggaaagaggcacatggaggcagaaaactatgactgggacaacgacaaggagagaggaaagaggcacatggaccatgaaaacaaactaaatttgaggcatggaaaagatgtgaagaaggaaatgtcaaggaaatatgataagcatcgtcactatggtggtcataggagggaaaagggtcaccttaaggaaaaggatcatgttgaggaaaagggtcattctgaggacagggacaggcatggagaaagaaagggtttggggaggaagagtgagagctgg

SEQ ID NO: 25505 - DNA, 556 bp, Sorghum bicolor
  Clone ID: 30952948
aaagatttccagcagcagcagcagctctctcactccctcctcttccctcttccactctcgaagcgcagctctcttcagcttcccttccaaaacccaagcaaagccaaagccccggagcaccaccaggtggtagcagccagcaggccggtgcccccaagctgcgaggctacagctagtacatctgacagagcccgaccacagccatggcagccgccggagcagcgctgcggctgcgcctgctgtaccggatgctgcgcgtgggggagctcctcgcgctggtggcgttcctctcctggtcgtcgtcccgcgtcccgtccgccgccgccgccgcgctgcggctcgcggggtcgctcctcctcaacgcccgcttcgtcttcgtcctcgggaacgccatcgtgctcctcctcctcgcgctgtcgcggcacgacctctccgcctcctcctcctccagcggccagcagacgagcacggcggcggcgacgagcacgtccgctgccccgccaccgcaggatgccgcgccggccgctgcaagcgacagcttcccttcctcgttcgc

SEQ ID NO: 25506 - DNA, 560 bp, Sorghum bicolor
  Clone ID: 30952960
atggacattatcggaatcagttctgaagaacaggaagcaatctttcgggttgttgctgctattctccacttggggaatgtcgagtttgcagaaggggatgatggggattcatcaaaacctaaagatgaaaaatctctttttcatttgaggacagctgccgagctattcatgtgcgatgacaaagctttacaagattcgttgtgtcagcgcattattgtgactcgcgatgagaatatagtgaaaactttggatcctgaagctgccaagggaagtagagatgcacttgctaagactgtgtactcacggttgtttgattggcttgtgaataaaatcaacaactctattggccaagaccccaactcgaaatgcttaattggagtgctggatatctatgggtttgaaagcttcaagacaaacagttttgagcagttttgtatcaacctgacaaatgaaaagctccagcaacacttcaatcagcatgtgtttaagatggaacaggaagagtacaccaaagaagaaattaattggagttacattgagttcattgataaccaggacgt

SEQ ID NO: 25507 - DNA, 556 bp, Sorghum bicolor
  Clone ID: 30952963
cttgctcactcgcccctcctcttcactcctcgctcgcaccaaaccaggtgaagaacacgagcaggaagggggaagaagaggaggaggaggaggagaccagtataccagaggcagatagccaacagtatctgtaccaccagattaccgaaatcttgtagaggcctagaagggaataatggcgccgatgagcagctacgagatggcggcttccatcctgctgtgcgccgaggacagcagcagcatcctggacctcgaagcggaggccgaggaggaggaagtgatgctggcgccacggagcaggaccaggacgcgcggggagcccagcgtggagttccccgtgccctccgaggaatgcgtcgacggtttcgtggaggcggaggcggcgcacatgccgcgggaggactacgccgagaggctgcgcggcggcggaatggatctccgcgtccggatggacgccatcgactggatttggaaggttcacacgtactacggtttcggccctctcactgcctgcttggccgtcaactacctggaccgcttcctctcgctctaccag

SEQ ID NO: 25508 - DNA, 299 bp, Sorghum bicolor
  Clone ID: 30952965
atccggctgctgcccctgagcctccgcccccgccgtctcggcgccctggtcgccgccggagcgccgcctcaatgcctcgatctcggttctccgacgcgatgcagccgccgatggggaacgagaggccgccgccgccgcccggccgccctgtctcagccttcgtgcccggcgcagctgtcccgcctccaccgtttggggccgcggccggtggcccgttcgccccgccgccgcggcagggagtgctgccgcctcctcagtctggtgctacggcgcccccttttggggctgcgccacccgcc

SEQ ID NO: 25509 - DNA, 704 bp, Sorghum bicolor
  Clone ID: 30952971
actgcctgctgcacggagcaacgccaccctacagctccccaccgtgaggtacagcgccaccgttggctgtccaccaccgctcgcccacccgccgtcggccgccctcagccagcagaatcatcgcccttcacctagaccgtagcccctagcaccgacgactccaaaccctagcgccgccggccggccggccggccgccgccatgccctccgcccctgtaccctagcctcgacgcccccaaatcccagcaccaccattgttcaccacgaagtgcagaagcagcatatagatccaccttcatctctttctacacatctgtcaccaatcctgatcttctgttgccatccaggtagctgctttcaacctcacagatctgagataagttgcatcaacaatccaagttcatcccttgctctgtgattccaagtacctcacagatctagttggtaagttgactctaggctattgctgttgccatttcgcttctggagtagaactgggagttactatttagtggtgtctcactgctgatctcattcgttgttcttgctgccattccgcaactggttcccgaattgtctgcacacaatttgatctgcagctgcatatggcatgtttgctggatggagcacccatgggatttttgcatgtccacaatgcatgtttgctggatggagcacccatgctacattgactcgagatgtga

SEQ ID NO: 25510 - DNA, 418 bp, Sorghum bicolor
  Clone ID: 30952972
ggttttcctcccccgttcccctctcctcgcctctcctgcggtgcggtggagtgctccaatccccctcctcttcttccttcttcgcccccacccccacctccctcctcctcaaccctactccgacgcgacgccacgacacagcagcaggcggcggggagcaaacgagaactaaaacgaaggaaatcgcggcgcccgattcggtcgcggtcgcgcggggggccggattcgattggatcctcggatcccccgcgcgcggaggggaattcgggccccagatccccgcgattccggcgccggcgccgggcatgagaggccggagggcatgcctgtggttgcccctggcgcgggacgagtgagccggcggcggcaccagcaacagcagaggcaccagcggcggcgggtggtggtggaggaggac

SEQ ID NO: 25511 - DNA, 221 bp, Sorghum bicolor
  Clone ID: 30952984
aaaaaaaaaaaaaaaaaaaaaaaaaaaaaaaaaaaaaaaaaaaaaaccctggtttcgcccccttcggccttcgccaattgcaaatcgccaaaattccccacgcccggttcttcttcactcgagccaaacccccctcaactctcaaccgttgaacgcaaagttctcaacctagcacgcggggccgccgccgcagccctcaagggggtcccttttcaaggacc

SEQ ID NO: 25512 - DNA, 546 bp, Sorghum bicolor
  Clone ID: 30952991
tagcccgccgcccggcccccgcatccaacggtcatctcccgactctccgctcccaccgccgccaccgctcccctcctcgcggcgcaaaccgcgcatccacgggaaaccccaagcggcggccgtcccttccgcggctccacctccctctgctctccgattcgagcggattccatggccagagacgacggcggcgctctggttcccgcgccggcgccggcgcccgctcccgctcccgctccgggccaggtctacctgccggagtggcgccgcgcgtacgaccgcctcgtgaagatgctgcgccaggcgtacgcgcaggccgaggagctgtgcgtcgagcgcgagcacctcatcaccgagatccagttcctggagagccggcgccgcgagcgcgaggagaactttcaggcccgcatccagaagatgcgtaagcacgagaagctccgcaagagagtcgatgaggctgagacggtggtgagtcttggtggcaaggatcttcagattcatcgctaccagaagcttgcagagcttgctgaggatgatttggag

SEQ ID NO: 25513 - DNA, 649 bp, Sorghum bicolor
  Clone ID: 30962912
tggatcatgagaagtcagctgacttggttcaagagagtgaacccagtgtggagacagcagaacccaccggggaggaggtttccacacaggatgccagtgcagaggtcgatgaagaaattgcagatgctagtgtacatgtatccagtgcagagcacagtgctgaggccacattggaacactccaccacattaagggaggtcgatgagattgtaccggtcgacgaaacacccatcttgaaggagcctgaaaggtgtgggtctgctcgcagcctggcagattgcatatcgacaaacgaggaagaggaatggtccgcgctcgaaggtgtgacgcgggtgaattccctcctgaacctccccagaatactgtctggcgacaagagatcgaccagctggaggaagcggcggtgaggaagctcccctagaattcttcaccaggtgggggttcttgcagagggacggctcaacccagtactggcattttttgccaggcgcgtgtaaaatccttcagtctttgggaatttgttccagctgatttttaggcttactccgattgttttgacggcaggcgcgtgcgttccagattctttgttcattcttgtgccttttgccgggaggtgttccatgcttgggcttctctgtgtcagtttggc

SEQ ID NO: 25514 - DNA, 596 bp, Sorghum bicolor
  Clone ID: 30962938
tgagtatttggagaacgggtggatatctgtctctgggccactaatgttaattcatgctttccccatcatcgagaagaagggtgttaccccaaactccatacagcaactcgagagttatccaaaattggtacagatggtatccaaaatattccgcctttgcaacgactccgcaacgcattctgaagagctgaagagaggagatgcgccatcttctatagccatttacatgtcagagaacagagccacggagcatgacgctcgcaaggccatgagagatctgaccatggagacctggaaaacagtcaaccaggatgcgttcagtaactgccgattccctcttcccttcgcaaatgcctgcgtgaatatggcgcgcatctctcactgcatctaccggggcggaggagatggtattagtgcaccagatgatgagaaagtgatggaaatcaaggagctattcttgcagccattcaaagtggaaaattgaaggtgcatgcagatgcagcttgctaattaattgccccaactcagtccaccgagacattgtggtgaaaattagaatggtgtaaaagtgcattccatgcgtttcaataaatcat

SEQ ID NO: 25515 - DNA, 589 bp, Sorghum bicolor
  Clone ID: 30962959
agacggtggaggcggtgcgcaggggcggcgacgtaggtggccgctgcagggaggtgattttcagcattgagccgttcagcgaccagctgctgccgtccacgtcctcgtcgtcggcggcggcaaccgctagcgtcgcgtccggcaggtgctgctgctgcatgaagaggctgcaggagaacaaggacatcttcatctacctgggagagaaggctttctgcagcagcgagtgcaggaaggggtacatcgaggaggcggacgaggaggtcatgatgattctggatcctgctcgaaatctttgatcaggatttgtttaatgccgtggcaaagtagtagtggtagtataatattgcccgcaagatttcttttttctgctgccttcaactttagggactactgggagagtgaggggggaaacaaaggaaggggaaaaaatggaaatgcctctcgttcaagtttttgctgaaaggagaggtggttgtccaggtttggccagtcagtgcaacggccggccgagccaattttcgtgatttgttgagctccattttggctgctgtcaaactagtagctcttcgccatcaatatattatta

SEQ ID NO: 25516 - DNA, 580 bp, Sorghum bicolor
  Clone ID: 30962970
tcgaggacgtcaccgggctgcgcctcgtggacgccgacgccttcccgcgcttccacgcctggctgcgcgacttcgaggccctggacgaggtccgcgacaccatccccgccgtcgaccgcctccttgactacgcgcgcggcctccgccacatgctgctcggcctcgccggcgccggcgccgcggccgcaccctccgcccccgacgcccccaccactgccgccgcgcccgcggctgacatcgccgtcgacatctgaacgcgcaaggcggcgtcgtcgggctccggcgtccggcgtctggcgtctgtgccagcgcggcgcctgtccggctagggatcagtagcagctagtaccagtatagtttgccgtgtcgatggcgccatgtacgtgtggtggctgcggagtctgcgtgcgtgcctggagtgggctgctgctgctgccacccactgttataatggcgcagtttgtgtttgtctaggtgtcgagtttgttttctcaacgtccttttttttttttcttttgatataaactttccctccagtgtagtctatgtttgcttgttctagcagtttggctggcttgtg

SEQ ID NO: 25517 - DNA, 624 bp, Sorghum bicolor
  Clone ID: 30963013
cgacacgacggcgacggccatggcttcgccggagctcgccgccggcgacggcagctacgacttccacctccgctcgctctccgcggcctcacgggactccgctgcggccttcgaccccgcctccgaccccaacctcctccaatctgtgaggagggtgtgcgagatgtgccggacggcgaaggaggcgaaggacgagatggtggcgcgggcgttcccggtgatgggcaagctatttcagcgatgcgccgccgctccgacgcaggccgtggcctccaccggcgtgctgcttctaaccattctgcaattcttcttggattttggggaggcggtcttgcacgatgctgatggtagcttgaaaaccttcttccgctcttgcttaagtagggagtttgcagatcctattgttgcagagtgcacggttgaattccttgtaacaaacaagacaaagatccttagctccttccccaatttgattccacagttctatcctttgctgttaaagcttgttgcatcaaatggtgagagtgttggtggtggcattggaaaaggtggaaagaagttctggaactcttattggcagtagtatagctacaatccagaagagcgctgctcctgagatgcttc

SEQ ID NO: 25518 - DNA, 655 bp, Sorghum bicolor
  Clone ID: 30963014
cacgcagcaggggcggaagggcaccaatcaggacgccatggtcgtgtgggagagttttgattcaagtgaaagcatcttctgtggggtgtttgatggccatgggccatacggtcattttgttgccaagaaagttagagattcacttcctgtcaagttgcgcacacaatggcaaactagtgctaatgggggctctagtcctcatcaaaatggaagcatctctggaagtatcaactccgaagaaacaggttctattgttgatgatgaatggggtgatggtgacgacactgaaaagcttcctgagatgtttcttccacttaaggaatcttacctgaaagctttcaaattgatggacaaggaactcaagctgcatcccacagttgactgtttctgcagtggatctacggcagtaacattggtgaaacagggattggaccttgtaattggaaatcttggggactcaagagcaattatggggacaagagacgcctctaacaatctaactgctcttcaactcacagttgatttgaagcctaaccttcccagggaagctgcgaggatacaacaatgtaaaggacgagtttttgctcttcaggatgaaccagaagttgccagagtatggttgccaaataacgactctcctggattggcaatggca

SEQ ID NO: 25519 - DNA, 636 bp, Sorghum bicolor
  unsure (1)..(636): unsure at all n locations
  Clone ID: 30963026
tcaagattatcagtacctgaccaacagatatgtgagtcagcccccttccttcttccatcacccttggtctacattatctgcctgtagatctggtgatctcgtatgtgaccatgtgttcaatatggttggcggctaagtttctattagagattgataaacgtttggtgtaatgctagataagtttatctggggattttcaatgtcttgctactacttgataatttgacttgttcccagtgaagtacgactactctgttgttaaattcttgcaattgcgcatcatatggactacttgacagcaagaagaagcatgtaccctactacctagctatggagacagtacgacacgaacaagtgaaggtgtccatctggttcccccccacaaccagctttccagtttgctgataagggaatttaattattgaggttttatcggtaccagtctacagattatgctgctagaggtggtagttcttgattgagttgttgtgacagcgtgctgacgagaggcaatagctgttgttatcggtgcagctattgcttgtgcttttccctatagttattgtgttgttggtccatacttggtgcttatatgatgacnagtgaacttctgctatagactaattttgattatct

SEQ ID NO: 25520 - DNA, 667 bp, Sorghum bicolor
  Clone ID: 30963037
gcctcggttgctgtcgcgtctcgcaacttcctgcgactccccgcgcgagcgcgaccacgctccagggctcgacggcgcccgccgggcccccgtcggccgtcgccccagccggcgcaccgcataatccgcgacctcctcctccagcttcctcctcctcggtggtggtcggccggcagatccgccgcccagcagccacttaccccggcgccccacacgcccagagtcccagacccccagcaaccctgctgcagcctgcagtgctgagcggctaggcgctacccggccagtgcccaggtccggctctttcccttgattttgcttaggtaagcaagttgaacatattgattatactgaatttggtggaaagaaggttttttttttccacgaccatgttagcatgtactatatcgttaagaaggagttttacagtggtcagtgaatagcgctgattggtcttgaatgcgagcggcactacaagaaacatgtaggttgtgctaatatatcctcgtgttcatttgttgcttactagaatatttatgcaattattaataacactttccgtgtgtgtatatattaattgtacgaatactcagaaagatggttttttgtttttgaatttggcatcattacatgttcaaatgaacttgttctcagttactagtgtcag

SEQ ID NO: 25521 - DNA, 406 bp, Sorghum bicolor
  unsure (1)..(406): unsure at all n locations
  Clone ID: 30963045
tgtacatgcatatcggcagtgcgtgcacggtgcgaggggcagctatggcgacgacgcccaaatgggttcagcagcagcagcagcagcagccgtgcgcgccggctgcacgtcgtgctgcggggtacacggtggtgagatgctcctcgttgcctgagggaccggcgccgcagctgcaactgccgccgcctatacngcggtcggcgaactaccaacccaacagttggaactacgattcattggagtcatcattagcgggttgcaacaagcgtaatcgtgagggggacccatctagcttcgacaagttaaagtttcgagtaaggcatctacttctccaacaggaagtagaaatattgacgaaacttagagtcattgacacagttcaacggctcggtgttgcttaccattt

SEQ ID NO: 25522 - DNA, 636 bp, Sorghum bicolor
  Clone ID: 30963047
aactcgacgccgccgttgttattacccaaccgtctcatcttccccgcctccaccttcccctcccccccacgcgcggcacggaaacacacacatctctctctctctctctgtagtctgacgggaaccgaccgaccgatcggcttcgttcttggctggccaggccatgcatcatcggcggccggagttcagcttccaggcaggctcggcgtcgccggcgcgcgggggactaccgccgcggccgccggcgagcaacccgataccggcgccgcggtacggggacgaggaggaggaggaggtgcggtggctgcaggcgtcgctgcaggcctcgccggagacgaactactgcagctctggcgggtctgggtccgggtcgggcacgccgtcgccgcagctgtgggcgcaggcgcagtcgcagtcgcaccaccaccagctccaccggcagtacccggcgtcggcggggagctcgccgtcgcgggcgcaggccatcgcggggtaccgccgcgagatgctcgacctcgtccggggactccccgagtccgcatacgagctctcgctccgcgacatcgtcgagcaccacccgtcgcccccgtccccgcctcgcgctcctccgtctcactctcctccaccgccgcctac

SEQ ID NO: 25523 - DNA, 630 bp, Sorghum bicolor
  unsure (1)..(630): unsure at all n locations
  Clone ID: 30963055
tatggataaaatccgatatatggtcacttggttgctgtatgtttgagattttagcacaccgtcctgcatttaaagctacagacatggcagcattagtcaacaaaataaacagatcttcaatatctccaatgcccccaatatactcatcagcactaaagcagatagtgaagagcatgttaaggaaaaatccagaacataggcctactgctggggagctgctgaggcatccacatctgcaaccatatctggctgaatcgtgcagctgttcaccaatctatcttccagtgaagcccaacaaaagtaacctggtagacaagcaatcaaagaagccaagcagtggcagaaagcgaactgtgaaagccaatggatccaatgaaacattagatactgcagcagagcacactgtggaagcaagagacagctcgacgaacttttcagatgtatcaactattggtacccaggaagccttgattttgcaaatgccggtggatcttgatgccagaagcaaagaacagcagaacagcgatgttctatcaattcagcatgcagcagagaacttgatggcgacaactgatcaacagatcaatgcgactatacgtcttanagcaatacgaaccagtaatgtaaaag

SEQ ID NO: 25524 - DNA, 600 bp, Sorghum bicolor
  Clone ID: 30963068
aagagaagagacccgccgcgccccgcccacacccccgagaccgagagccagcacgccgatccgcgcccggtcgacgaggcgcatcctgctctcgtcctcatcagcgcttgggagaacggcaacggttaccgctcgaccgccatggtggaatccagtggccaccggagcgccaccgcccccacggccgtcgggttcttccgtgtcccgggcctgttcgtgaggctgagcagcagcaaggggggaggagtgagcaatgccgtggacgccgactcggtctggagcccgacctccccgctggacttgaagaaccacctccggtccagcccgccgagggtcggcctcggcctcgtcgacgccctcaccgccgacgacgagaccggttgttccatgcacttcggcggcaggagctcgttcctcgactccatcaagccgttcctcgacctggcgctgcccaaggcggcggcggcgccggtgtgcgggaacaaggcggctgctgctgcccctgcgtcgtcggccggcggcgtcgccgcaagggtggatgaggtgaacgagtacccgtacgccgactgtgaggagtacacttgcgtcatctcgcgcggg

SEQ ID NO: 25525 - DNA, 612 bp, Sorghum bicolor
  Clone ID: 30963075
ggtgggggtggttctgagaagcaagattggatagtgtcatttgaccttgagacagagaggtggagaccaaatatcaggggaccccaaggccttatcatccacaatggactggttgttgagaagaacctttcattagtcaacctaaatggctcactggttattgttcatgtccggtatccctgtatggacctttggtgtctgttggacttcgacaagggccactgggtcaggcaacacagcatttcgatcaaagcgtgcatctgccacagtctgttgtcctttactcccttgattgtgttagacgatgggaggatagtcatacatatcaatgggttgggactgggaatgtttaagatttatgaccccaaaatcaacaaggtgtcgagcgttgtggagacgggtctcagcagtgcggttagtgtgtacacaggaaccttgctgagcttagagtggtgaggccagtatctatattgtggatttgtggttatttgtccgtctggtttatgtgaaagactttggcttttatactttctttggtccttatcgctatgataggactgtttcttgtttctgttggcgaggagtttgttaactgaaacatgcatttcagag

SEQ ID NO: 25526 - DNA, 634 bp, Sorghum bicolor
  Clone ID: 30963085
cgtgaagttaggggggcttatagtttttgcttttgctactgccttcatattgctcatgatggaaacactgagtgccttcctgcatgcactacgtctgcactgggttgagttcatgaacaagttctatcacggggatggttacaagttcaagccattttcatttgctctgctagcagatgacgaagactgatgcatatgtagttcagcacgtaaagagattggttcatttcttacaaaggaatttttggagcacagtgtcaaatttcgtgggcaagatggactttccctgatacacagcattttggcagaccgctagacttcttcccagcgcatgagtgcagtccatgttgagattgccagccttgtggaaggagattttgtaagtttacagcaatattgtagagggcaggttcatggtacagttcctccaacggagatgcagattatagttactaacaaaaaagatagaaatgtagatttgcccgcgtacttttagctttaaattttatcaacatgactggcccttaccgcttatgaatggaaaagatgtatttggccattcatatgccgaggctggaaaaaggcatacaagatatttttactgtttttttttacaattcaaataaatagttgt

SEQ ID NO: 25527 - DNA, 655 bp, Sorghum bicolor
  Clone ID: 30963087
caagtagaaagggttagacagaggatttcagctgaacgcgtcaggatgaggtcagccctattaggtcccaccggaagcggtctgccagggggcagtagcaccatgccatcaaatccagcaggcatgagccccagaccaatcggtgtgccaggctccatgccacagaccagcatggcagccacatatgccaacaacatgcaggggcatgggcatcctccaatgcctcagatgccgttcttacatcagcggccgcagatgctctcattcggccctcgcctaccactctcggctatccagactcaaccatcgccacaggcatcaaacatcatgttcaactctggcatgcccaattcgattgctcctaaccaccatcagttgctgagatcgtcttctggaaacaattctagtgcaggatagaggaattgttcatacgattttttttctcagcttagatttgtcagatgtagcattatatcatttataaacacatcactgtaattcatttatgtgatgtatgtgtttgtcatataagtttttttattaggtcctatattgtcctcatattgctgcgcccttgtgtacctttgttaccaggccacctcttcttcccagtgcaagggagattcaaaatacttgctccagtcaaataaattta

SEQ ID NO: 25528 - DNA, 559 bp, Sorghum bicolor
  Clone ID: 30963090
gccatggccgagctcaaggtcctgctggcgctcgtgctgtccaggttccacatcagcctgtcgccggcctacgtgcactcgccggcgctcaggctcatcgtggagcccgagcacggcgtgcggctcgtgctcaggaacgtggagcccagcccaggtgctagctagatgggcctgggcctgggcctcgttagtttcttccacgctgggcctcctcactgaaacggaagttcggcccagtcgctaataatctgctgggtggtcacggcgattgcattgtacagattggacagcaacagggtagatgtagaggatattcaaggtggtgtctgtttctgtcattcagattgtgtttttttaaaatacactcaacgtggcgcacgcacgcatatgcccttgctgcggtttgcgatttgcaagcatcagctaagcaaggcacttccatggtactactagcataccatattatggcttctctggatcagcactttctgtctgcttaaagtacctgtaatcaggggatgataagaataaatgttgcagctgagagccaagattaggg

SEQ ID NO: 25529 - DNA, 669 bp, Sorghum bicolor
  Clone ID: 30963104
gctcttgtgacagtggcttactttcgagatagatattcagcaaagaagcacatacggtatcgacttgtccaggcaatcattgttgggagcacagtggctgctattgttgtgctgttagaattcacaaagtttcagtttgttgatacttttactagtcttttggcttttctgccaactggctggggaatcgtatctattgctctggtattcaagccatatttgaggagatctgagatggtctggaaaactgtggttactgtggcacgtttgtatgacatattgtttggagtaattgttatggcacctgtggctgtcttatcatggttgcctgggcttcaggaaatgcaaacaaggatcctgttcaatgaagctttcagcaggggacttcacatttcccaaatcattactggcaaaaaggcacacacattttgagctaaatacacattccaactgacagattcccaaagtgagctgcttcgttattctggaggaggctgtctccgtggcttaaggtttatacaagctttatggcgtagagtagatgctagctcttccctgtacaggcaatctatttatcaccaattcttcttaacttgatgtacactcagaattttcatggtagagatgatagtcagtctaatgagatgtcgattcggtcccgtatcaaaa

SEQ ID NO: 25530 - DNA, 606 bp, Sorghum bicolor
  Clone ID: 30963112
gaagaagaggaagaaagggaagctaccgaaggatgctcggtcggcgctgatggactggtggaacacgcattaccgctggccataccctactgaagaggataaggtgaggctggcagcgatgactgggttggacccgaagcagatcaacaactggttcatcaaccagcggaagcggcactggaagccatcggaggacatgcggttcgcgctaatggagggtgtcacgggcggcggatcatcctccgggacgacgctctacttcgacactggcacgatcgggccgtgatcacactctgacgacatcagttgcagcatacaatttactgggcatgtagtgtttgcattgcagttcaactgcattgcactgcactgcactgccaatgggggtaattgttggttgatgatatggagattagtcacatgaacgaaccaataaccgctgtcattttgtcgggattttattgtgtatatgggcgacaacgtgttcggtacactgcacacagtatgtagtactacaagggaagttgctgtccagtccagatggccctgtaaagactctgtctgaaagtaccataacaattacttataacatgaatttttagttgc

SEQ ID NO: 25531 - DNA, 629 bp, Sorghum bicolor
  Clone ID: 30963114
cttgtttcacaaacagcagaataaggtttgctgccccgaccttcatgtcattggagagaaagagggtgaagactacaaggctcactatgccctacctttcatcaaaagatgaagatatgttgtacgctgagggggggacgagtgatggttcttatggtaactactgggaggactacgactgacgcctttcgtcccctgatgagcgctcctgtcctgatttgagcaaagtgacctgtgatgacacaagattctacaatgacatactattctctacgatcatctcaatgtcctgtttgaaccgttgcgggttgtgctattagttgtttatatgtcattgtcatggtgtatgctctaagttggttaagcctacatcatagtgttttggatatttagtgtttacatctgagtttatattattgccatctttggaaaagtcggattcttggttccggtggaagttgaacttattcatatattgtgagtcacaggtcacaagtttgagctgcttcatgacctgttaacgttctgtttttatcttttgaacttgtggtttatactggataggcttatgcttgtgtatcagtccatctattcatggagacatacatttatgcaaaggttactgctgt

SEQ ID NO: 25532 - DNA, 606 bp, Sorghum bicolor
  Clone ID: 30963123
gtgctgcacgccgacgcgatccaccgcggcggcggccagatcatccccacggcgcggcgcgccatctacgccgcgcagctcacggcgatgccgcgcctcatggagcccgtctacctcgtcgagatccaggcgccggagagggcgacggggagcatctacagcctcttgaacaagaagaggggcagcgtgatagaggagaggcagaggccgggtacgccactgatcaacttcaaggcctacctccctgtcaccgagtcgctcgagttcagtgagaagctacgagccgagacgtccagcgaggcattcccgcagtgcgtcgtcgatcactgggaggctatcaactccgatccgctagaggagggatccatggcggcgaagctcatcgccggcatcaggaagaggaagggtctcaagaacatgatccccctgtccgagttcgaggataggctttgagttgccccctttttttacattattaattagttgatctgcgttttgcttcaagttattaggtttactgcattgcttgttttgttctttgttcagtaggaaaatttcagttgtaaatgtagttatcctaaaaccttaatgaaatctgtcaggtgg

SEQ ID NO: 25533 - DNA, 603 bp, Sorghum bicolor
  Clone ID: 30963128
cgccaccatcgggtgggtgggcggctacgcggtgcccatcttcgcgcgcatggtgatgcgggaggacgacttccggccagggccattctacctcggccgcgcaagcaggcccgtctgcctcgtcgccttcctgtggatctgctacacctgctccgtgttcctgctccccaccgtgtacccgatcaagatggacaccttcaactacgcgcccatcgcgcttggcgtcgtcctcggcctcatcatgctctggtggctgctcgacgcgcgcaagtggttcaagggccccgtcaggaacatcgacgaacacaacaacggcagcaaggtctgacacaccacctacatacgtcgtcgtcaagctcaagcaaatcctcgagccactcacgccatcctctctttttgaacaccatgggtgctgatgaacaccatgctctctccgtctgtgtgtatgatgctggatcagtggggtttagttagtttagattgtggagtgagagctctgggtgacatacaaggaaactagaggttgacccattgtggagaacagaggaaaaattgagcaaacagaaaaggaatatgaatgaccaacaaagtacaagcattggg

SEQ ID NO: 25534 - DNA, 657 bp, Sorghum bicolor
  Clone ID: 30963132
cgaggcaacgaggcccggtgttcgtcacggccttcaatcctctctgcatgatcataaccgccatcatgggctccatcatactcaaagaagagatcactcgcggaagtgtgattggcgctgcgatcatcgtgttaggcctgtacgcgctcatctggggcaagagcaaggacgaggtgaaccaggtggccgacgtctcagcatcaggcggctgcggctccaagggtggcgagctgcccatcaccttggcgcagcccaacggcaacggcaagcacgagcttggcagcggccgcggcgtcgtcttcgatgtcgagacgccggcggccaacggccattctagtagctatagctagcagtactcctaaacctaaagcaagcaacctgcccgtcagttctagctagacatgcagcatgcatcctgcaggctatggcctggtcgatcgagttgaagcacataattaagtacgtgtgcgattttttatttcttcttcttccgtttttgttaatttcgccttgaaattcttgtaagagagtgcacgagagaggagacacagatgatccttataccttgtattaacggataaggccataacgttatgggttgcttaatcaatcagtaaacaaagcatcagctctgctgcttacgtagagctgggaatt

SEQ ID NO: 25535 - DNA, 620 bp, Sorghum bicolor
  Clone ID: 30963147
aaggagtagggaatactgaatagtcagtcagtcgtctgtcgtctctacctcatccacctgacgattcttgattcttgaggttgatttggtgtcattctcttttagctgcaactgcagcaggctgtgatcatggcatcgctgagtgccgaccttttctatgacatactcaagcgtctcgatgctgcagctctggcaagagcaggctgtgcctgcgctgattttcgtgccatatcaaatgaagaggatttgtgggaaaatgcttgcacatctctgtggccatcaacaagacaagatgatgttaggagcttaattgtttctgttggtggattcaggaagttctatgcagattgtttcacccttatattgaacaaggatgtccctgtggttcagactaatgaaagtaatttctttgctgaagaatgggccgagtctgactactactactatgatgacatggatgagcttgaaacctcattgccttcagatttcgtatctttgattgatgtatggtacaaagaccgtgcactctactcaaaggtcatatggggaattcccaactcagacagtgccaatggatggttctataactacccattccggatagacttgtttcaacactc

SEQ ID NO: 25536 - DNA, 657 bp, Sorghum bicolor
  Clone ID: 30963148
gtaacgcacgaacgccacaaacaaacagagccagcggcgcaaccgccgccgctgaaccgcgccgcaacccgcaggagatcgagcccctcctccattcctcggcgccggcagcttcggttgttcgttcgccatggccggcggggagagggacgacgcggtggcgatggactccggcgagaagcgcctcaacgagctcggctacaaacaggagctccgcagggagatgacgctgttcaagacgctggccatctccttctcgacgatgacgctcttcacggggatcacgccgctgtacgggagcagcctgcagtacgcggggccggcgccgctcgtctggggctgggtcgtcgtctccttcttcacctggttcgtcggcatcgccatggccgagatctgctcctccttcccgaccactggttctctgtatttctgggctgctcatttggctggtccagtctggggtcccttggcatcttggtgctgtgcttggctggaggccatcggcctcattgccggaattggcacacaggcatatgcaggatcccaagtattgcaaagcatcatcctactctgcaccggcaccaacaccggcggtggctacctggcccctcgctggctgtttctggtcatgtacatcgggttgacactgatctgggc

SEQ ID NO: 25537 - DNA, 654 bp, Sorghum bicolor
  Clone ID: 30963153
gtgtgggaaaagctctgaacgatgtgaagccgtacctggccatgatcctgctgcaggtagggttcgccgggatgtacatcgtcgccgtggcatcgctcaagcgcgggatgagccacttcgtcctcgtagtccaccgtaacctcttcgccaccgccgtcatggcgcccttcgcgctctggttcgagaggaaatcgaggccaaggatgaccatcaaaatcttcctcaagataatggggctcactttactcgaacccgtgctggatcagaacctctacttcatgggtgccaacctgacctcggcgggcttcgcgtcggcgctgataaacatcctcccggccgtcacattcgtcatggccctcgtcctacggatggagaaagtgcggctgcggagcgtgcacagccaggccaagatcgtcggcacggtcctcaccgtcgccggcgcggtgctcatgatcctgtaccacggccccgtggtgcagttcccgtggtccaaggggcaccaccatgacgccggcgcccagggcgccgcctcaagcggcagcttcctcaccgggatcatcaccatcatcgtcgcctgcgtctgctggtcggccttcttcgtcctccaggccaacacgctcaagagctaccccgcggagctgtcgctgaccacgc

SEQ ID NO: 25538 - DNA, 653 bp, Sorghum bicolor
  Clone ID: 30963174
tccctcgagcagaactcatctcctgacggccgatctaacgccaccgggccggggaaagcgcgagccgtcctcgatctcctacgggcaacgagctccggcgccggagtccatcacgatcccctggtctggccccagcgatggcgtcgtcgtcggagcctttcgccgggcagggaaggcgcgtcgagcccgttcgcgccgccaccaacatcggtgctctgcccctggacgccctgtacgacatcctgctccgcctcccggccaaggaactctgccgcctccgcctggtgtgccggtcatggcgcgccctgctctccgacgcagccttcgccgctgcccacgcagcacgctaccctgagccactcatcctcgtcggctacaacaacgatcctgtattagaatcaagtggtgattggaaataccaaggcgtcatcagcgtcatggatctgtccgggcacgtagtcaagaacctgcgtgtggacggccacatcacgaacatgtcgctccacctcgcctgcgtcaagaagaccggagacggcagctgccggtgccggctggtgaacccagccactggagccgtgcaccacgtgcccagaaaggatccggcttacgacggctacagctacagcttgtgcccgtttgggcaggttgccagc

SEQ ID NO: 25539 - DNA, 646 bp, Sorghum bicolor
  Clone ID: 30963184
ccttgttggagaagatggtgtcctatatttgctaaatctcagatcaaggattgtttgcagcgtgccacgcttcacagcaattcacaagttggaacaatatttcatgagatggacactattgaatcaccacctacatatttccgaactgataagtttaccaatgctttccaggaaatagttgatgcatatggtgttgctcgatatcaagaagctaacccggctgtatattctgttgtgacattcccatttctttttgctgttatgtttggagattggggtcatggaatatgtctattactaggagctttggttcttatagttcgcgagaagagactttcctctcagaagcttagcagctttatggagttggcattcggcggacgatatgttattcttctgatggcaatattctcaatatactgtggccttatatacaatgagttcttctcagttccattccatatatttggcaaatctgcatatgaatgccgggacaaaagctgcagtgatgcacatactattggtctcatcaaagtccgtgacccctatccttttggggtggatccaagctggcgtggaagtcggtctgagctaccctttctaaactcattaaagatgaagatgtctatactaatgggtgttgccc

SEQ ID NO: 25540 - DNA, 675 bp, Sorghum bicolor
  Clone ID: 30963186
gcctactgttccagagagtcgatggggataatgatggatcagaaaatgatagtgataaatggactgatgaagaaacattgttgctattggaaggcattgagaagtacaatgacaactgggatgacattgcaagtcatgttggaacaaaatcaaaggcacaatgtatttaccattttattcagttgccagtggaagatggtttgctagagaatgttgagatacctaatgtacccattccatttcgaccacaaagcaatggttatcaacattcagattccaatggcagcacttcaggagctccagttcaaaatattcaacaaggaaatcagcttccattcattaactcttctaatccggtcatgtcattggttgcatttttggcctcttcaattggaccaagagttgcagcttcatgcgcacatgcagcattatcttttttgacaagagatgatgactccagggtgagttcagaaggcatgcatgctgatggtatgggcaatggtgcaaatccaaattttcggaaccattatggtgcttcaccatccatttctccagaaaatgtgaaacatgctgccatgtttggtctgtcagcagcagcaatgaagtctaagctctttgccgatcaagaggaacgtgaagttcaaagactagctgctactgtaataaatcatcagt

SEQ ID NO: 25541 - DNA, 558 bp, Sorghum bicolor
  Clone ID: 30963191
cttccctactcgatcgggagcatggtgttcctgcacgccagccgggcggacgtggtccgggacctcggccgctgcgggacgtcgctggacctcggcaagagctcctacatgaaggtcacgcaccggccgctcttcggtgacggcatcctcaagtccagcggcgaggcctgggcgcaccagcggagtctcatcgcgcccgagttctgccccaacaaggtcaagggcatggtggacctcatggtcggctcggccacggcgctggtggcgtcgtgggaggacaggatcagcagcggtggcggtggcggtggcgcggagctcgagctcaagatcgacgacgacatcagggcctactccgccgacgtcatctccaggacgtgcttcggcagcagctacgtcaagggcaagcggatcttcgcggcgatcagggagctgcagaaggcggtgtccaagcccaacctgctggcggagatgacaggactcagcttcctcccgacgaggaccaacacagaggcgtggaggctcaacagggtcgtgcgggacctggtcctggacgtcgtc

SEQ ID NO: 25542 - DNA, 538 bp, Sorghum bicolor
  Clone ID: 30963204
agcatttcccaaatcgcccctccgccaaaacgggagctcagcggcggcgcccccccccccccccaccaacctctaaccctcccctgaaccctaccccccctcgtcgccggtcgccaccccacgccatggccctttcccgccgcctcctcccgctcttcctccgccgcggcgcccgcgtccccgcccgcgcgctctccacggccgccgcgcctgcggcggtgtcctcggagggggaggacgaggaggccatcaccgtcaagggcgtgcgcatctcgggccgccctctctacatggacatgcaggcgacgacccccgtcgacccgcgcgtcctcgacgccatgctccccttctacctctcccgctacgggaaccctcactcccgtacccacctctacggctgggagtccgacgccgccgtcgaggacgcccgcgcccgcgtcgcctccctcgtcggcgccgacccgcgcgagatcttcttcacctcgggcgccaccgagtgcaacaacatcgccgtcaagggcgtcatgcgcttctaccg

SEQ ID NO: 25543 - DNA, 669 bp, Sorghum bicolor
  Clone ID: 30963209
tactggttccggatgctctctttcttctatacaactgttggattctatttcatacaatgatggttgtgctaactgtctatgcatttgtatgggggcgcttttaccttgcactcagtgggcttgaggactatatcagcatgaacacttcctcttctaataatgcagccctgggagctgtcctcaatcagcagtttgtcatacagctaggcctgttcacagctttacccatgattattgaaaactcacttgagcatgggttcctcactgctgcgtgggatttcatgaaaatgcagctacagtttgcatctgttttctacacattctccatggggacaaagacacactattatgggaggacgatccttcacggaggagcgaagtatcgggccactggcagaggctttgttgtagagcacaagaagtttgctgaaaactataggctctatgctcgcagccatttcatcaaagctatagaacttggtgtgatattaactctgtatgcatcttatggcagcgcatctgggaatacactggtgtatattctgctgacactttcaagttggtttcttgtgtcgtcatggattcttgctcccttcatttttaatccctctggttttgactggctgaagaattttaatgactttgaggattttctaaactggatctggt

SEQ ID NO: 25544 - DNA, 513 bp, Sorghum bicolor
  Clone ID: 30963216
agttccccccatgtattccgctgctgcagagatcacggccagcttctgcgcctgcagcagctccagcagtagcagcagcagcagcagcagggtctgcagtgcaaacggcagctgctagttccccttccccccatgatctcccctaccttttcttgttcttgcttgcccctttttttcttctgcgctagctgccgccgcttcttcctcttcttcttcgtcttcctggagcttcccgcatccacacatgccccaagaaccagacaaataaactacacagaaccatcgggggtcttcttctactactatttcgttccagcgattttatttttattatatggatgtgtgcacaggtgcatgtagataggtagtagaaggtagattaggcggcagcagcagcagcagcagcttggttcgttgctgggggcacgcgatcgagtcgagctccaggagccaagaagattgctgggaggcgcggcgggcatggaggatctgtacagcatccacccggggatc

SEQ ID NO: 25545 - DNA, 625 bp, Sorghum bicolor
  Clone ID: 30963222
aaaatttggcctttctctcgacatctcccatctcactaccaccacctcacctctctctctctccaactccaatggcggccgccaccggcacctccgcttcctcctcctccgcctccagcaagccctaaccctaggtaggtcgctccacttctccccaaccccccacttctatggctgccctcctcgcgctcgttgtcctgctgctttccgggggcggcgccgccggcgacgacgtggcggcgctgctcgagttcaagaagggcatcgcggaccgggaccgggaccgggtgctggggtcctggtccccgccggcgacgaccgagtccggcagcggcggcggcggctgccccgcctcgtggcgcggcgtcgtgtgcgatggcgacgcggtggtcggcgtcgcgctcgacggcctcggcctcgccggggaactcaagctggggacgctctccggcatgcgcgcgctccagaacctctccctcgctgggaacgccttctccggccgcctgccccccggcatcggctccctctcctcgctgcgccacctcgacctctccgggaaccgcttctacgggcccatcccgggccgcctcgccaacctctccagcctcgtccacctcaacctctc

SEQ ID NO: 25546 - DNA, 638 bp, Sorghum bicolor
  Clone ID: 30963230
acgtcttcaccgctcgtctcgtcatttcccctgctcctcagcagacagcagcagcaggagaggagagatcagagatccatccttcgccttgctcttggcgtcaccaccttttgggcgccggccttcatttcacgatggttaaggtcaccgccggccagctccgcgcgagcatgaacgagaagcacaacatcaggaacatctccgtcatcgcccacgtcgatcacggaaagtcgacgctcaccgactcgctggtggcggcggcgggcatcatcgcgcaggacgcggccggcggcgtgcggatgacggacacgcgcgcggacgaggccgagcgcggcatcaccatcgagtccacgggcatctccctctactacgagatgggcgcggcgcgtttcggcggcggcacctcgtcgtacctcatcaacctcgtcgactcgcccgggcacgtcgacttctcgtccgaggtcacggccgcgctccgcatcaccgacggcgccctcgtcgtcgtcgactgcatcgagggcgtctgcgtccagaccgagaccgtgctccgccaggccctcgccgagcggatcaagcccgtcctggtcgtcaacaagatggaccgctgcttccttgagctccagcaaaacggcgaggag

SEQ ID NO: 25547 - DNA, 375 bp, Sorghum bicolor
  Clone ID: 30963234
ggtggcgtggctggtggacgcgtgcatgggcaccgccgtgcccgcgcgcgtggacggcgaaggggtggtggagcgaggcgaggtccaccggtccgtggagatggtcatgggcgacgacggtgaggccgcgccggcggccatccgggcgcaggctggtcgttggagagaagtgtcacgtcaggcggtggcccgcggcgggacgtcggagaggaatctccgagcgttcgcgttgggtacggctgctgtgaccgatccctgatcgaccggccacgtcggggcacgagattgctgtaacattggtgcatacgatgcgtggacatttccactgttcgtgcataggaaactcgtcgattaaaataaaatgagtgtttgtcc

SEQ ID NO: 25548 - DNA, 662 bp, Sorghum bicolor
  Clone ID: 30963248
ggggcaaggctccatctaagattgttgcttcttatcagactacaaagggagaaactaaaaccagtcttctcttgacttctggatggtggggcttgtcacgtcacttccactatgtcccagagattctatctgcgtttttctggactgttccagctcttttcaatcacttcctaccatacttctatgtgatcttcttgactatattattgtttgaccgagcaaagagggatgatgaccggtgctcatcaaagtacgggaagtactggaagacttactgcaacaaagtaccatacagagtcattcctggcatttactgagcatcttgggttctggacgactcttgatattaagcccgacagatgctatgattctcaatccagtcttcaaaccgatctgcaactgcctttgtaatttcgctggtaggttcgcgctgtacgcagtattaggtgtaggcaacttggcatctaccttgtatgtgtcgtgtatccagggctgcggcttgctttgttagacagtagggggtagtcttgccttctcaggggtgcgatgtattttttttttcccattcagtcgacagggtgacacaacaatgagtaggggctggtgacattctgtagcgcttgaataatatttgtgtgctgtattgttcgacggacaaaaaa

SEQ ID NO: 25549 - DNA, 608 bp, Sorghum bicolor
  Clone ID: 30963260
tccggttgggcgctccggggatctgggccggcatgctctgcgggactgcgctgcagacggctatcctgctgctcctcatctggaggaccgactgggaagccgaggctgcgctggccaaggaacggatcagcgcgtggagtggggaatgccgccatgtcgatgtcgtcaagcagcagcagggggataccggcagcgacagcgacagcgacctcaaggctaatttgcgagtgtgacatgcatgccatgccacatgtacgagcagagagagcagggagggacttgcattattgggcgtcccgtacgtatacgtgctggcactggcacggcctgctcctctctctgcatgcttcgtgtgtgacctccacaccacacacgaggaaacgtcggcacaggcatggccggctatggcacatctgcacacgtctttctactctactgtactgtgcgttttgggattctagctagcagtggtcagtccatggatctgaagcacagtgtctgtgtcttgtgcaaggttaggcccccccaaacagtttgtaactgatcgatcagcacgctgatacatgcatgtgattcacatagcaaaaacaaattcatgaatgcaaatt

SEQ ID NO: 25550 - DNA, 617 bp, Sorghum bicolor
  Clone ID: 30963262
catatatcagcaaacggatgcgtgtaggtgtaggtgccgataaagcttctgacaaagctgaacagcttggtagtcaacagtaaacagatgttcaaccccttgccagatagatgtttatggtatcattggtatgaatctttttacactcgcacactcggtaaatgaaaggtttagcgcccagagatctacgtttgccagtagcaggcgaactctgctgtctttgctttccatcaatacagcggctacagcaacttctgatcagacaattcaatgccctcaacgatgaatacggagtatgatatttggggtgacggggacactagtaccacaactagcttgcaggactcctggaatgattgcgcccctcctggatgaaacgcaatgcagggcagctgttcctaactgctcactgtttggcgcctgcagatggatgtcgcgtcgcgtaggcgagactgctgaagagccaccagggcgctttttttttatcaagtattaaaagttagaaaacgtacaaagacgcgtacacgtaggcctcgttttttcactttttggtacggtagcactttcgtttgtttgtgacaaatattatctaattatagactaactaagattaaaag

SEQ ID NO: 25551 - DNA, 206 bp, Sorghum bicolor
  Clone ID: 30963274
agaagaaatgaaaaaaaaaatcaagaaaaaaaatgtgtcgtcatttggggcagaacaccgttgatttgcgtacgtttgtgttcaactgtagaaatgcgtcatttggaagtgtgtccgtgtggtggtcatatataggtaggagcctaggatcagggtttctttcaaaaaaaaaaagcaaaagcaaactgtaagctaggattagcatg

SEQ ID NO: 25552 - DNA, 610 bp, Sorghum bicolor
  Clone ID: 30963281
ctcaagtgggggccaggcacggagcggcactggggcctgttctaccccaacggcagcgcggtgtacgaggtggacctcacgggccggcgccggtcgctgccgtcgtacccgccgctgccgccggcgtcgaacgaccggccgtacccgggccccctgtggtgcgtggtggcgacggacaaggggccagtgaacgagaccgcggtgagggcgcaggtggcggcggcgtgcgccgacgtgccggggttgtgcgaccccgtgcggccgggtggctcgtgcttcctgccggacacggtgagcgcgcacgccagctacgtgttcagcgcgcactggaacaggttcagcgaggactacggcgggtgctacttcgccggcttcgccgtggagaccaccgtcgatcccagccatggatcatgcaagtttccaagcattctactgaagtgaaggggcttcacatttcatggaaaatccctgatcgagaactgattgtccttaccttcaagttgttgcctcccatttcattctatattttccggatttaattggcttaccgcaaatcacatgttcatgttcggttgctcatgtatcgcagttgaattgatcccgagcaata

SEQ ID NO: 25553 - DNA, 652 bp, Sorghum bicolor
  Clone ID: 30963286
agtcccaaatggaggagctgaaagcagacttgagcaaagcaaagaaagggaagcctctaggatatgataaagaggggaagcaaaagaggaacttggctcctgaagcgattgaaaagaagattgcaatggttgaaggcaagatagataagatggagatggacaagaagataaaagaggatctgaagactgttgcacttggaacgtcaaagatcaactaccttgatcctagaattaccgtggcatggtgcaaacgccatgaggtccctattgagaagattttcaacaaatctcttatcgcgaaatttggatgggcaatggacgtcgacccggacttcagattctaggagagcattggctgccatgtgctagccagtttgatccagtttccggcccttgtccctggatactaattgcagctaggaaaggaaagagctcggtgttggttttttcaaaagttcccctgctcctggaacgaaggaagcacccggcatttctctttgtaggcccttattttttccgttttcggttcttagtgtactggccaccgttcgattgcgttaagttctgtatgcatgcattttgctgaggaatctgagttcgtttgagaacggtcggacattcaattcatactgagttaatctcaaatatagat

SEQ ID NO: 25554 - DNA, 653 bp, Sorghum bicolor
  Clone ID: 30963329
aggccagctccaagttcaacgccgtcccctacctcgccaacctctccttcttggccgtctacgtcagggcgtcgccggcctgcaagtccacctggacgtgcttctcggcggaggcgttccgcggcgtccccgacttcctcaagctcgccgtgccttcggctgtcatggtgtgcatggagtggtggtccttcgagctcctggtgctgctgtccggactgctcccaaaccccaagctggagacggccgtgctgtccatctgcttgaacactagctcattggcgttcatggccccgcttgggcttggtgctgccgtaagcacgcgcgtgtcgaacgagcttggagcagggcggcctcaggcggcgcgactggcggcgcgggtggtggtgctcctggcgctcattgtgggcatgtcggaaggcctggtcatggtgctggtacgcgatctgtgggggtacgcgtacagcaacgaggaggaagtggccaggtacaccgccaggatgatgccggtcctcgccgtgtccgtcatgctcgacagtcagcagtgtgtgctttcaggtgtcgttaggggctctggccgccaaaagaccggcgctttcatcaaccttgctgcctactacctcgctggtatccctgccgcgctcgctttcgccttc

SEQ ID NO: 25555 - DNA, 657 bp, Sorghum bicolor
  Clone ID: 30963347
ctgctgttcctccccgacctctccgtgttctccgtccccggcgcggggaaattgcgcaaaccacctccaccgcctccgtgctctccgtccccggcaccggcagccgcccctcgtcgccgcaccccggcgtccgccggttcccaccgccgccctcagtcgcgcgccaccgccgccgaacgcgggagccgccgagatgccgccgaagccggcgaagccgccacccgctgccgagttcgagtactgcgagctgtgccgccatcaccacgaccatggccggcgccatcgctacgtcaccaagcaccggagaaatctcgacgctgcgctctcctccttccgctccaagctctccgacctccgccgcgccttcctccatggctccccctcttcccagccgccgcgggtccgtctctggtgccccttctgctccaccgacctcgtcgacctcgacagccgctccgctggtaaaaatggcatttaccatctggcaagcagtgagcacctgaagggtgtgaaggatttcctgcggaagcatgggggaggtatggatcaggtggactcgcttaggatttcagatgacgtgcttgccaagtgggagaaaggctcggattccttgagcacaggaacaaaaaaggggactgaagggctgattggaccatc

SEQ ID NO: 25556 - DNA, 166 bp, Sorghum bicolor
  Clone ID: 30963363
tcgttttgctccgcaagtcttctccgatcaactcggctctcttggctgcttcttgcccaacgctccagcctgctctctggcctcctagtttcatctaccacagggtcaggatgctccgctcggaatggcctccccatcgacagaaaccccgccactcccgaccctc

SEQ ID NO: 25557 - DNA, 646 bp, Sorghum bicolor
  Clone ID: 30963370
acatagcagctgatggtactgcttgttagtcgtcactccactcagtcctcctaggagtacgcggctacgccacaactcagccatggcaacgccgctgcacctcctcctcgtgctcgccgccatcgtcaccgcggcgacaccgtcgtgtgtagcagcagcagcatcatccgccgcttccacagccgagcacatcctgggcgtcaactacggcacgctgggcgacaacctcccgctgccgcagcgcgggctggagcttacccgctcggcgggggcgtccgccgtccgcttctacgacgccaacgccaccatgctcgccgcggccgccgcctcggggctcgagttcgtgccgagcgtcccgaacgagctgatcccgtcgctcgccgcctcccagcgcgccgccgacgcctgggtggccaccacgctgctcccgttccgcggcaacccgcgcctccggtacctgttcgtcggcaacgaggtcctctccgaccccaccgccaggtcccggtggccgcggctcgtcccggccatggccaacgtccaccgcgcgctccaccgccacggcctcggcagcgtcaaggtcagcaccacgttcagcatgcacgagctggagggccagaacgtgttcccgccgtccgccggcgcgttc

SEQ ID NO: 25558 - DNA, 573 bp, Sorghum bicolor
  Clone ID: 30963395
aagctgcagatcacgaaggcagtctccggtgtgctctacttcggctacatgctcattgcctcctacgccttctttgtgctcaccggcaccattggcttttatgcctgcttctggttcaccaggcttatatactcttcggtgaagattgactaggaagctagaatggcatcacttcatatggtttcatgagaaatcagaggtcaaagttgtgaaaagatacatgaaaacttagcatggcttatacacagaagtaagttgtctataggatatatctattatgatctgataattcagttacattaaaagcattggatgtcagtgacttgaggtatgtgcttgtattatcacacagcttacagaattgagatggtacttcagctcgaagaactgaacatatgtttctttagctgaaatgctgaagtctcagtatccatgctgagtaacgagcatctagtgttgtactccctctctttgatacaaaatatagagcagtcagccattgcctcagtgtaaaagataatacttttgactatgttttgtatgagaaaataatatttcaattaaaagactgct

SEQ ID NO: 25559 - DNA, 629 bp, Sorghum bicolor
  Clone ID: 30963417
cggcgtacgtggcgcagctggcgcggcagtgcccgcaggccggcggggacccgctggtggccatggactacgtgtccccgaatgccttcgacgagggcttctacaagggagtcatggccaaccgcggcctgctgtcctcggaccaggcgctgctcagcgacaagaacaccgccgtgcaggtcgtcacctacgccaacgacccggccacgttccagagcgacttcgccgcggccatggtcaagatgggcaccgtcggcgtgctcaccggagccagcggcaagatcagggcaaactgcagagtcgcctgatgatccatcagtcgtgtggatggagttgtagattcattgtattgatttggcgatcggacgctgtcgacgtgacgatagcatagagcatagcctggttgtgcttgtaacttaattgtatgtatgcctgtacttgtgcgtgtatgggtatggctgtgcaaattgcaatggctatattcgttggctgattattacctctatattcttttttcccacttgattgaggcatgtgtgtctcttctgctttgtgagagaaaaatctgtaaccagaaaaaactgcttgtgtaccaattgttagatctaaacacataataaatcatgatt

SEQ ID NO: 25560 - DNA, 591 bp, Sorghum bicolor
  Clone ID: 30963420
aagtgctgtcgcttcaaagtccgcatggccagcgccctgtctctgcctcaagtgctgagagggaaaggaattctgcttggaggtcaagggaattgagatatcaatttagttcacctggcgtgcaatctcaagctgacaacagcagggagtggccacgtcggtcggtgcacgagaggttgagttccgttgaagatggtgtgggatctgcggaaaggagaccttggatggagcataggcagatatcgttgataaaccgaacactaaacaatgacatgaactctctttcgctcacaagccgtgaatcaggcgatcagtctcgtgctagcgcgcgaaccttgtataacaagcccaggaggaccagagtaatcctggaagattgagctcttgggatgctcatgcctgcatatctttttggcagactgttgatatttgttaatctgtatatttcattgggtttgggtgccacgagaacaccaaaacacagcgtagagctcctcatggtagacgtgtattgaatgaactagctgagacgaaatttgttgcaaacatgacaaggcgcctgttctgtagatataatctcttgtaattttg

SEQ ID NO: 25561 - DNA, 603 bp, Sorghum bicolor
  Clone ID: 30963432
gacaggcccgacgccgacgctgccgggggcgacgccgcagatgccgcggtcggcaggtgctgggcaaggcagcggccccgacgggcagggcgtgatgctgggcgacaactcgtggctcgccagcctcgccacgggcgacgcgtcgtccgcgccgttgtcgccgccggcgctccgggcctcgcccctcgctccgctcctgctgggcgccctgctgctgctgctgctggtgctatagtaccaggctaccaaccgaccccgtcacaggtgtgtgaggcgaaagttttggtcaaagaaagaagcgggcgcgcacggcacggggcaccggcgcaaagcgaagcggtgcgctcggcttcccgccgtgccgacgcggacgccgagctgccctgccccgatggaatggaaggggtggtggttggtgttgcgcgccgtggggctgtccctccgcctgtccgtgctgggtttgtgcggggagatgatatgatttcatttgaccaagatcgcatcacgccattgtaaaatccgccattttcttcttcttcttcttcttattattattggaattgtaccgttgtgtccaacaaaaagaaaggaattactccaaga

SEQ ID NO: 25562 - DNA, 484 bp, Sorghum bicolor
  Clone ID: 30963458
attgcttcgttcgctctctacacgctagctaccagctggcacgtgtttgcgccatagccaatctattcagttcattgagtgcaggcactcgccactctcatcggattcacacacataatacatacatacatacacatggcaattctcgacgtcgacctggccactcctccctgtcatgctcatgctcgtcagcagcaggcacacgcagacgagcagcaggacgccggagaggaggaggacgagcagctgctgctcctcaagggcgtgcgacacctgtgcgagcgcggcaccattacgaagctccccgctcgctacgtcctgccgccctccgaccgtccatcacccggcgacgacgagcagccaccacgcagcagctgcgtgtcgttccccgtcatcgacctggcccggctgcgcgtgccggcggagcgcgccgccgccctggccgagctggacgcggcctgcagggactacggcatcttccagg

SEQ ID NO: 25563 - DNA, 628 bp, Sorghum bicolor
  Clone ID: 30963479
aagcaatccgccgaacacaaaaaaaaaccctagaccgccggcgcccagcccagcagtgtctctccaccgccgccgccaccacctcgtgctccccttgccctcgtatcgtgggatggagcacgacgcgcacgccgtcccgccatcggaggacgccaccgtcgatgattgggctcgcgacgacgcggagcccatgtccgtcgaatctggcgttgcccccgcggagttggctgcggcggattccggcgctgatgccccgcacgcgccctcgccctcggcagcggtcgcggcagaaggtgtcaaggaaattcaatcatctcttcaatccttggaccttaaaacaaatgttgctactcaagaagatgctcatgtggttgaagacgatgtagatgagacaaaaagacacttgaatgtggttttcattggccatgttgatgctggaaaatcaactactggaggacaaatattatttttgagtggtcaagttgatgataggaccatccagaaatatgagaaggaagcaaaggataaaagccgagaaagctggtacatggcttacatcatggacacaaatgaggaagaaagggttaagggaaaaactgttgaagttggtagagcacactttgagaca

SEQ ID NO: 25564 - DNA, 646 bp, Sorghum bicolor
  Clone ID: 30963480
attcggcacttcccctttctccttctcggcgcgctcccatctcctctcacaagtcacaaccatggcgacgacccacccggcgctcctcttcctcctcgtcctagcatgcaccggcgccgccagcgggttctatctccccggcgtcgcccccgccgacttccgcaagaacgacttgctcgccgtgaaggtgaaccagctgagctccgtcaagacacagctgccctactcctattactccctccccttctgcaggccggacaccatcagcagcagcgccgagaacctcggccaggtcctccgtggcgaccgaatctggaactcaccctacttgttcgagatgatggagcctaagctgtgtcagatcacatgctagattgttctgaccgaacaggaagcaaatgacatcaaggagaaaatcgaggacgagtaccgtgtaaacatgatccttgataaccttcctatggtcgtcccaattacgatgcttgatagaaatgcgcctccatactatcagcaaggtgtgcatgtcggtgtcaagggcatgtatgctgggagtaaagatgtcatgtatttcatctacgaccactactcatttctggtgaagtataacaaggaagcacaaacagatcttgctaggattgtggccttt

SEQ ID NO: 25565 - DNA, 638 bp, Sorghum bicolor
  Clone ID: 30963499
aacctctttcctcgtactccctcgcctcctccctccacgcgggcacagcgacggcggcggccgccctcctcctctacctcctcccccctcgcatcgcagcatgctggacaggccagcacgccggcccaccgcccgaggcgctgccagggcgcgacggcaccccctggctgtggcgcggcgccatacgtgggccttggcggtggccgtcaccagtcatggccgccgcctcgttcttctcctccactcgcgtcccggtgtatcggcctctctacgtcctcgcccgtgacctcgtcgtatgtgctgctcggggcggctgggcgccggttcttcgtcttcgtcaacggtgacgccagcctctgctcggcctctggctctggcggcggccatcatcaggccttcgctggcggcgagcacccaccaggtacgcacatcccttctcttccctgcttgttgtgcagcacccagcactcaaaccctagcttaatccattcgtattagaatctgatctggctacaatctttgttacctggtaagtgtgcagttgtggtagatttgcctggtgattatgattccctttttttctccacagattattgccatgtttatttttccctataaatttgagccttattttctaa

SEQ ID NO: 25566 - DNA, 663 bp, Sorghum bicolor
  Clone ID: 30963506
ataagagagtgacaacaacgagtggcagcgggcggcggtcagctagtagtggcgatggcggtgcagaggatggaggtactgtacttgcaggtggcggcggtggcggcgctgctgatggcgacggagctgcgcgcgcagctgcgggtgggcttctacgacaactcgtgccctgcggcggagatcatcgtgcagcaggaggtgagcacggcggtggcggccaacccgggcatcgccgccggcctgctccggctccacttccacgactgcttcgttggggggtgcgacgcgtcggtgctcatcgactcgaccaagggcaacaccgcggagaaggacgccgggcccaacaccagcctgcggggcttcgaggtcatcgaccgcatcaaggcgcgcgtcgagcaagcctgcttcggcgtcgtctcctgcgcggacatactcgccttcgccgccagggacagcgtcgcactggccggtggtaacgcgtaccaggtgccggcgggtcgccgcgacgggtccacgtcgcgcgcgtcggacacgaacggcaacctgccgccgccgacggcgaacgtggcgcagctcacgaagatcttcggcaacaagggcctgacgcagaaggagatggtgatcctctccggcgcgcacaccatcgggtcctcgcactgcagc

SEQ ID NO: 25567 - DNA, 595 bp, Sorghum bicolor
  Clone ID: 30963509
tcggaagccagcgaggcggcggcgagagaagggcccacgcgtcagagactacagaacccgcggttctcactctccggcggcggggcgatggccatggcgccctcctcctcttcctccggaggcggcggcggcgacagcgccggagccgccgacccgatggcgctcgtgcaggggtacacggccgaggagctcgccatcgcgggggagttcctcaccacctggctccccttcctctccgccggcctctgcccttcctgcgtctcctcgctccgcggccgcgtcgactccctgctcccccgagcagaggagtcgccgccgccgccgtcgccgcggcagccggtcgatcagattgagccgtcagggtgggactcggatccggcgctccagcagaaccttcctttcgagccgagcggttgggattcggatccgcccccacccgcgccggcgccggcgccggctgagaagccgaggatgtcgtgggcggacatggcgcaggaggacgagctcgccgcggcggcggaggacgacgcggcggccgcggctgccgaggatggggacgagggggccgaggcggggaggcccaaggtgcagccca

SEQ ID NO: 25568 - DNA, 666 bp, Sorghum bicolor
  Clone ID: 30963520
ctaagatgcattcattgtcaatgaaagaagacaactttacatgctttgtaacagaagaaatcctgatgcgtgaggtggaagatgggggagctgttaatatccaggagcgaccacttctgatggtagagaaggtggagaaattgccaggatatcatccatgttgctggggcatccacttcaaagcatacatcatgcatggacaagatgcatcaaaagaaaccaaggaagccaccaccaaaaccactgaaagccacaagaaaattaagtcgggtcatgaggaagatgttggggaagaagatccacccagagcagctcaatgggcgtagcaatgcagaggggccccttactgcatgatgtttattcttgccgacaaatttgcttctctatttggtttcattggatccctatgactcacagattccttcctagagagaagcacccatggatagtcgtcgtcgtcaacaatgtggaagttcccttttttgttgctgtgtttcgtcgccaccgaagcatgaatagcattctgcttttcctatattctcctgcttatttgcatgtataaatcaactgttggtgtgtgtgtgatcttgtaagctgtcattctctgccactgtcttgtcgtcgcggtatgccaaaaaaatttaataaaacctctgcttatccgtt

SEQ ID NO: 25569 - DNA, 596 bp, Sorghum bicolor
  Clone ID: 30963533
gatactttcaatacagcagttgtctctcccatctactatgccatgttcacgaccctcaccatcttagcaagtgccataatgtttaaggattggtctgggcagagagcaagcaacattgcctctgagatttgtggatttcttacggttcttgctggcactgttgtgctacattctactagagaacctgatcaaactgtatcagcagacctgtatgcaccactcccgccaaaaatatactggcatatccaagggaacggcgatgttgggaagcaaagagaagatgacccccttacatgcgaattcatcactgttgtgcggcaagactactttgtgtagggatcatcctggatgcttggtgttacatgtgttctttctgagaccctctgctgcagttgtagacagaatctggtgtgcacccatgaacaccaggtcgaagcaattccaaatttttgtagaaattgtgaccagcacacagtttctgagccagtgtccacaataacacctagcattctagcctgacaatgccttgtaagatattgtaggaagtgttttctgcccccatccgagtgtaaattatgtaggttttctttctattg

SEQ ID NO: 25570 - DNA, 611 bp, Sorghum bicolor
  Clone ID: 30963539
gggacagcggcgagtgcgaccctcgcgccatggtgtttcctggggacgatggggaggaagaggagcggatggggtggaaggccgacatggacgtcgactcgtcgcgccagctcagcccggtctccgttctcgacctgcactccgacgacgacgacgagtcgccggtgcattcccactggggcgacgagaagccatcgacctccgggagctcacctccgtcggagtctttcctgggcccggcctcgccatgcttcagctacaatctccacgacaagttctgcgagatggaggtggacgacgaagccgatgaggagacgacggtccggaacggcagcaggtccatagaggagcagatctcgtcgtgggagaagatcgcgggggacatcccgaggatcccggcgatgatggagctggacctgtcgcggtccgcgcggcaatggcgggagccgaggccggaggtcagggagatcggcgccagggtagagacactcatcttcgacgacatcaggagggaggccgtgtgcgacatgctcgcctcgcattgtcgattggcagcaggagcagcagcaacatcttgttgctcggggtaggaggaggaggggtttctggtt

SEQ ID NO: 25571 - DNA, 622 bp, Sorghum bicolor
  Clone ID: 30963571
cgtgtacatgctgctgcagaaggagaagggcagccggccgtggcgggacaaggtgttcctggagagcgactactacttcgagggctactgggcggagatcgtggggcggctcgggaacatgacggagcggtacgaggcgatggagcgccgcccgggggctgccgcgctgcggaggcggcacgcggagagggagcacgcggagtacgcggcggcaagggacgccgccctggccggggccgggctggcggagaccggggtgcacgggtggcgccgcccgttcgtgacgcacttcacggggtgccagccgtgcagcgggcagcggaacgagcactactccggggacagctgcgaccagggcatgcgccgcgcgctcaacttcgccgacgaccaggtgctgagggcgtacggtttccggcacgccggtccgctcagtgacgacgtggagccactgccgttcgattaccctgcaaaggcagtgactagctgatcgacgtgaatttccggctgttattactagctactaccccttgcatagcatgcatcacgcatagtcgcattcaaacggctttgctggctagttgctcctttctgggcttcataacttcagttggtgccttatctc

SEQ ID NO: 25572 - DNA, 640 bp, Sorghum bicolor
  unsure (1)..(640): unsure at all n locations
  Clone ID: 30963593
ctgttggcctctggatgtcagtattctacgtggcgtgagtgcgtgacagggacactaggcctgtgccgtgtgcatcccgatagcgagagcggagagccgagagcacgcgatgccgccgcgcgctgcgacggcgaagccgtcgtggctcagcgacgcgctcctcttcgccgcgggcgccgtggtggccaccgtggcgctgctcgcgttcgccaacccgttcgttcagcctgagggttactacggcgacgcagcagccctgccctccggctctgctggctcatcatccgcgggtggtnggtggtggtgccgcccgcacgttctacgacgacccggcgctggcgtacaccgtggaccgccccatcacggggtgggacgagaagcgcgccgggtggctgcgcgcgcacccggagctcgccggtggtggcgaggagcgcgtcctcatggtgtccggctcgcagccgacgccgtgccggtccccgggcggtgaccacacgctgatgcggctgctgaagaacaaggccgactactgccgcctccacggggtgcagctgctgtccaacatggcgctgctgcggccgtccatggaccggtactgggccaagataccggtgatccgcgccgccatggtcgcgcacccgga

SEQ ID NO: 25573 - DNA, 191 bp, Sorghum bicolor
  Clone ID: 30963600
gtcatagtatgaagtatgcaccttcggcaagtgcctctaatgaaggggcatcaacttctggagctgcatcgcaaacagcatctggtgtgttatctggatcaggagtgctcaatttaagaccagggagtacaacatcatcaggcccattagctcagatgttctcttccatgagcgcagatgtggcacgtgaa

SEQ ID NO: 25574 - DNA, 646 bp, Sorghum bicolor
  Clone ID: 30963620
tgcttgcaggctgcgcgtcgtgtcctcgtcgactggggaagttgcgcaggagctggacctcacggtgcagccgaaacgtagaggatgcaatgaaatccgttgcgtcaggcgggagttgctggtgcaggccttggaagaggagctgccaagaggcaccatccgctactcctccaggatcgtgtccatcgaggaggacggcgacctcaaggtcctgcaactggccgatgggtcggagctgagagcaaaggtgctgatcggatgcgacgggatcaactcggtggtggccaaatggctgggcctcgcggagccgacctactcggggcgcatggcggcgagaggcctcgcgcgcttcccggacggccacggcttcgagcccaagttcctgcagttcaacggccgcggcctccgctccggcatgcgaccctgcaacgacactgacatttactggttcttcagctggactcctactgaaaacggttagtagtagtcatgatgccaatgccttcatttttttttgtactttgtttatctacgacaacattttttctatcgattcttgaggttggtgattttgtttccctaaacgtggtgataatttaacctgccatttccagtgaaattctccccgaattcgttccgtaatgaa

SEQ ID NO: 25575 - DNA, 577 bp, Sorghum bicolor
  Clone ID: 30963637
ccccgtccctccgctactccccagtccccactacctttgccgtcacatgcgcacaagaaagaaccacccgcgccgcccctgaggcctgcctgacccctcctcttccctcctctcctccagcgcccagccaagccgtcgccgcgccgcttccatgaccctcgttcgcggcatcgtccgtggcagcgccttcttgtgcttgacaacccgctgagctgctgcgtggccgcactcgcgcattgcgccgagaccagcgagggggtccgtgcgatggccgccgcgaggaggctctcggagctgctgcaggagcagcaggaaccgttcctcgtcgaggccgccaggggaaggcggccccggcgcggccgtggctcgagcgcgagcggggcagcagcagcagcagcagcagcagcaggaggaggaggaacaggctgctgccccgccgtcgcgtgccggcggctgctcaggctctgcaaccacgggatcaagaagaggagctcgccgggcggcgtcgcgagcggcctcaggtcggcgctgagcaaggtgctgggcagcagggccatgcgccgtgtgctgcgctggg

SEQ ID NO: 25576 - DNA, 652 bp, Sorghum bicolor
  Clone ID: 30963666
ccgagtacctcatcaagacgctgcccgggtggcacgtcgaggacttcctcgtggacgaggccgccgccggcgccgcgacaaacatcgccggcgtctccgcagacgcgtcgtatcagggagggctagctcggatcggcggcctgcaggacggctacggctactcggcgtggatggcgccggagcagctcttctacgaggactcgtccgccgccggcggcgcgcggggcatcagggagcagtgggtgccgcagatggcgatgtacagcagcagcacggggctgtccgtggccggcgccggcagcaagagatcccgagccacgtcggcggcatcctcgtattcctactggtgattggtgaacaactcaacggggaagacgaccgtgacagagtcgccgatgatcgagccgccgcctgttgtattattattaattatgcctcggctggtgcattattactgctaccgctacgctacttgttgactactgtaactgaggttgtttcgatcgtgctcaattgccagcagtgcaatttttttttttcgctcctgggcgtcctcgttcacgtggagtgatgatgatcagtgtatgcttgggagcgttaatttgggctttttttttaggggcgctagagaatgaagtacctcagtgccttg

SEQ ID NO: 25577 - DNA, 162 bp, Sorghum bicolor
  Clone ID: 30963707
gacttgtggtttatgttatgaacttttggtttatgttgaactttatgttagatttgtcatatctatgtggatttgtgatatctgtggacttcgatatgtttcatgtgtgatatatatgtggattgtgatatagacatgtggatttgtgatatatatatatat

SEQ ID NO: 25578 - DNA, 660 bp, Sorghum bicolor
  Clone ID: 30963714
gcggcgggagaaccgggagctgaagctggagatctcgcggatgcgggtgcggctgacggagctggagcgggagcaggggctgatgaagcagcaagggaggatgcgcggcggggacggcggcgggcggcacggcggggagcagggccgcgcgttcctcgcgtcgctgtcgaggggcttcggccgcatcaccatgttcggcgtcggcggcgggcccgcggcggcggacaggagaaggaagaagagcggcggcaggagctcccagtgctccgacggcaaggctcgcaggcggcacaaggcgtccttcgcctacgactgatgcagtgaagctttggcatcgtcgacaatggaggcaggcggcgatcgtggatggatgccgtctctagcagccggaggatcggagatagcaggccagtgggctgaggatgatcaagactgcgtttttagatgttggtgaaggcagttcgtcactcagacgaacaaatggaatggatcaagcggaggtttatagcaggaattgcttgtgcttgcgacagattttagcaggaacaacgcagggtaacgaaattagcaccaggaactgctagtgtcaaaaacttgatgactgtaatatatacactagtctagtatactactttttagcctgaaattgaatgctgcctc

SEQ ID NO: 25579 - DNA, 631 bp, Sorghum bicolor
  Clone ID: 30963720
ccatttcagttgagcatgcaagagaatatgggcacacacatttatatgagtatttacctttggaaacacagatagcaagtcagtccgacaagcttggaaacaaagctattctactgatccacttttctgctcgttatactacagaggaaattgatgctgcaataaacagattgccaccatctttccgtagcagagtttatgccttaaaggaaggcttctaataaaaacatgaaccaggaaatcagtaatgaagttttgtcaatgggatcagcaatgcagttttccaaattgggccgcgtgggtaatttttcactagaaatctttttgctatgtgtgctctgatgatactataccaatcatctgaagatttgtgcgggactttttgttgttggtacttgatgcttgtgacattggaatgattgaatagtggaatatgaaacatcccgcataagcgcatagccttttcttcttttttgttttgttcgtgggaacatgtaagattagcaatggaaatttagctatggccatccctgaactcttgcgacattgccaatgggcattcgcactatgtatggccgatgattaatagtgaagctttaagctttctagaagaaagaagagaacattagcg

SEQ ID NO: 25580 - DNA, 161 bp, Sorghum bicolor
  Clone ID: 30963737
tgcaattgtttattacagctcaccgaaataagtaaaatctttttactgacacgggaaacaacggatcatgccatgctctggaatcgatgatttttttcaccagacagaggctgtgcttggcgcatactgaatatatggttccagttataaagaaatatttt

SEQ ID NO: 25581 - DNA, 538 bp, Sorghum bicolor
  Clone ID: 30963741
cgccatccgcatccgctcccccgtgattcgttcgtgagaccctcttctgcaacccatctccgatcacgatctatcccctcccaggatcccactccaatcactcaaggtcgtcgcctcgcacgccgctacccatccctgcaccttgcggccgcacacgccgttgttccccgtctccggatctcgtgtccctgccacaacaccatcccctgccttgccgtggatctccccatctccaaatcccatgcccagccttgccgcggacagcagaggacgcacagctcgtggatccagggacagcggcgttcgtcccaccgcccgcaccttccgtcgagccgccgagcgtcggcgcccgcgaatccgcctatccgacgccggctacgctcgcaagagggaggaggagccgcagctcgtggatccagaggcagcggcgagcgacagcacgcgtgaatccgccttctccgctatgcctctcccaccttgcgtcccgtgctctaggaaagaggcagcggcgttcgagtggaggagacaatggaggcag

SEQ ID NO: 25582 - DNA, 451 bp, Sorghum bicolor
  Clone ID: 30963743
gaagttagccgtgtccttcccctcccccaccgccgcccctctctctctctctctgcggcggcggcggaatggcgaaaagcggcgagtccacggtggaggttgcgtcctccagctcctctcctcttactcccgcttccgcgtcggctacgaggccgaaggcgaagcaccgtatggagatcgaggggtacccagtggatggcgtctccatcggcggccaagagacctgcgtcatcttcccgacgctgagcctcgccttcgacatcggccggtgcccgcagcgtgccgtctcgcaggagttcctcttcgtctcccacgggcacctcgaccacatcgggggccttcccatgtacgtggccacgcgggggctcttcaggttgcgtgcgcccaccatcttcgtcccggcgtgcctccgggaactcgtggagcggctcttcgaggtgcaccgcgccat

SEQ ID NO: 25583 - DNA, 656 bp, Sorghum bicolor
  unsure (1)..(656): unsure at all n locations
  Clone ID: 30963763
ngaagaccaaattccccactccaaattgtcttacctggccaacaattggtatctagagcctaggttttgacagagctcagccatgtccacctccagcgagcagagacactgcgcagccactgccgccgccactgtggtcatcaacccccgtgctgcagcaggcggtgtgccagatccggacgctgatcatgccactcaccttgctgctgctgaggctcaggccgcagcgtccaccaccaacttgctgcgagcggggatggagaggcagcccagaggatcgcggagccctacacggcgccatgcttcatcaccatcgccggagtgcagtcgtggacgcggaggctgtcacgggtctcctgcggccatccagacgacgtacaaggactctagcgtgggcgcaccgtggtcaatgctcaccaggacagactaccacgagtggagactgctcatgaaggtcaagatgcaagctcgcccgtcatgtcgtaccacgacgatcagcgagcgctcgaggctatcctcaccgccatccctctagagatcggagccccgctcgccgacnaggtctctaccaaggaagcgtgggactccatcgctgcaacgtacatcaacatcgaccgtgtccgtcaggcaactttgcactggctttgtcgggacta

SEQ ID NO: 25584 - DNA, 644 bp, Sorghum bicolor
  Clone ID: 30963769
gcgctaataagcccggtctttagctagctaggactaacactagtactactatcatcctcctccgcgcggttgctacagtcagcttcgctttcctccagcccatccatccatagcgattgacctcagctcatcaagccctgagctgagccgcctcaatcccgtcgagagcgcgatcgccgctcaggggaaaaaaagcaacaagcagagagagagagtgggcaagatgaaggtgcagtgcgacgtgtgcgcggccgaggcggcgtcggtgttctgctgcgccgacgaggccgcgctgtgcgacgcgtgcgaccgccgcgtgcaccgcgccaacaagctcgccggcaagcaccgccgcttctcgctgctcaacccggcgccgccgtcctcgtcggggtcggggtcgccggcgcagcagcaggcacagcctccgctctgcgacatctgccaggagaagcgggggctcctgttctgcaaggaggaccgcgccatcctgtgccgcgactgcgacgtgtcggtgcacacggccagcgagctgacgatgcgccacacccggttcctgctcacgggcgtgcgcctctccgccgagcccgccgcgtgcccggcgccgccgccgccgccgtcggggtcggaggacgagaacagcc

SEQ ID NO: 25585 - DNA, 663 bp, Sorghum bicolor
  Clone ID: 30963790
tgtcggccttcttgaggatgaggagagtaagatgatcaagggtcctggtgggtacatgagaggcagggggaaggtcaagatcacggatgttgttgaggccgcaagccttgcggccagcggccaaccatttgaggtggtgtactacccgagagctagcacaccggagtttgttgtcaaggcagcatcggtgcagaacgcgatgaggaaccagtggtgccctgggatgaggttcaagatggcatttgagacagaggattcatcaaggatcagctggtttatggggaccatagcttctgctcaggttgccgacccaatcagatggccaaattcaccgtggaggcttcttcaggtgacatgggatgaacctgacttgctgcagaatgtgaaatgtgtcaatccatggcttgtggagattgtatcaagcattccacccattcacctgggaccattttctccacctagaaagaagttgcggatgccccaacatccagactttccatttgacggtcagctgttgaatccaattttccacggcaacccacttggtccaagcaacagcgctcttcgctgtttctcggacattgctcctgcaggcatacagggagcctggcatgctcaatttggtttacccctaacagaccaccagcttagcaagctgcacct

SEQ ID NO: 25586 - DNA, 644 bp, Sorghum bicolor
  Clone ID: 30963816
atcgcacatacgcaccacacgcctgcgcgccgccgccgccgcaccccatccgccaccgccgccgccgcaccccatccgccgccgccgctgaccagatccggcgccactggcccacacagcccctgcccctggcccgcccctccccatgccccgcactccgccgccgcctcaccccgcacggccgccgcgtccccgcacccgcacggccgccgctttgcctatgcaacctacgagctgctgctgagccccgaccggatcgagctgctgctgagcgggcggtgcgtgtcgctgctgctgtggctggaggagcggtacgaggtggtgtacagccgccacccggagttccaggccggcacccgcccgctgctcgcgctcgacaacccgttccccaccacgctccccgagaacctcttcggcgacaagtgggcgttcgtgcagctccccttctccgctgtgagagaggaggtggagtcactggggaggaggtacgcggctggacttggatctgctagggttcgagcttgatgacagcacactagtccctggcgtcgccgtggaatcatctcgcgccaagcctctagccgagcaggacctatcggaggggactcggagcaccttgggcaggtgcgagctctccacaccct

SEQ ID NO: 25587 - DNA, 584 bp, Sorghum bicolor
  Clone ID: 30963818
aaaaaaaaaaaaaaaaaaaaaaagtcgatccccaatccgttcaggcctccccgatctcgccgtcaccgccctccactccggccgccgccgccgccgccgctctccatcataaacaatccacccctcgtcgcctcgcgtccgtctcctggaccaacgtactccccccttctcctacttgtaattcccctccttctgcttgtgcggcaggggcctcttccgcgcggatggggaagcacgagttcctgacgccgaaggcgatcgcgaaccggatcaaggcaaaggggctgcaaaagctgcggtggtactgccagatgtgccagaagcagtgccgcgacgagaacgggttcaagtgccactgcatgtcggagtcgcaccagcggcagatgcaggtgttcggcatggcgcccgaccgcgtcgtcgagggcttctccgaggagttcctcgagtccttcctctccctcatccgccgcgcgcaccgccactcccgcgtcgccgccaccgtcgtctacaacgagtacatcgcggaccgtcaccacgtccacatgaactccacgcgctgggccacgctcaccgagttcgtcaag

SEQ ID NO: 25588 - DNA, 661 bp, Sorghum bicolor
  Clone ID: 30963824
tatgcactcactttcttcctcctctcttccgctcccaggctcccaatttgttatcgccgcgcgccaacgacgaccgtcattccttggcctcgtccgtttctcctcgggtaaccaacctccttcctactcctccagaccacacatccaccccactggtttgcctgagagcatcacaacaagagggagagacagagacaagcaggcggcgggccggagaagcaaggaggcatggggatgggcagcgacgctgccgccgtgttgttccccttctctaccaccaccaccaccaccacgtcgccgcggctctgcggcaccgccgtcagtagtcacaggaggatattttcagatgtcgctgaggatgtgaccgtatcggtggatggacagtcgtttctcctgcacaagttccctttagtatctcggtgtggacgagtacggaaaatggtagtggactccaaggacccagatctcctaaagctggagcttgtaaatgtaccagggggagcttttgcattcgaacttgctgccaagttctgttacggtagcaatttcgaaataaccacgggaaatgtggcccatctgcgatgcgttgcagagtacttggaaatgacggaggactatcaagaggagaacctcattttcaggacagagacgtacttgaacg

SEQ ID NO: 25589 - DNA, 575 bp, Sorghum bicolor
  Clone ID: 30963830
aaggctgggaatctattctttgctgaagtgtcacaaatagaaggagaaggtgcctggaaggtcacatgttgttgcataattgattctaatgaaaatggccagtgcaatacttgtagaaacgatggatgccctgatatgaagcaccccaataatactggtgcatacactgctggtcgcttgaatggatattttcagtatggagaaggggagctaagtgaatccgatgatgatgatgttgaagctgagaccgttaggttaagggttctgttaaaggatcttgatgatccagatgctatgaagagaatctaccttcgagccgtgcaaaggctgcgtagtagtgggtcggatgcacaagtgtagggtgttgcaccattgttcacttcttgctatgttattctgtttattatctggtcaatgatccaaacatatatattttaaggagcaggtttctttggtggcacgtggaaaggatattccttttttttctggtccggacctgtttctatctcatgggtgtactctactattttgtttgctgaacctttgggttgctcaacatggattccaatcttact

SEQ ID NO: 25590 - DNA, 671 bp, Sorghum bicolor
  unsure (1)..(671): unsure at all n locations
  Clone ID: 30963854
cctatggccatttcgctaaaatttcaagagtttttttnatcgtcatgttctatttttcttctccgtgtgagtactaaatattgtgcatggtttggttacattttagacacagaggaggaacaagatcatgagaagataaaggtgctgcagtgtttcagtcttgatgttttttccaagcacagactgacaaggaatccacgtggtatgttgcagtgtggcaccgagccaccatcccaccgaggaggcaggagcgccgagcagcgaacaacagaatagtagcagccgagcagatgtatacatgcatgcacgtccttttgattgcctctatagtctgtaagcttggctgcttggctctgtggtcttggatcctcctcttcaggcagccagaaaaacagttggaagaacttattctcatatatatacggtatggatttctctatctcagttacatatattgatcctgacaaatttgagacggatctacaaactggagcacagtataagtatgtggtgtggttgttgcttctatctcgtatttccacttgtatgttattttcctcattttttttgttccgtatgccgttcctatcttccttttagattgagtttcttccaatcaatagagaagcctacgataccgcattatccgtgattgtattgatttcataaac

SEQ ID NO: 25591 - DNA, 674 bp, Sorghum bicolor
  Clone ID: 30963868
ctgaagaagcagtggttgcgtgagcaggaattgatcaaaaatgcacctctttcaattacttacagttactgggatgggactgggcacaggagagttatccaggtccgtaaaggtgacagcattggagaattcctaagggccgttcaacagcagcttgcccctgaattccgtgaagtacggacaacttctgttgagaatctactttatgtgaaggaagatcttatcatccctcatcaacacagcttttatgaattaattatcaacaaagcgaggggcaagagtggaccgcttttccattttgacgttcatgaggatgttcgtaccattgccgatgcaacaaaagaaaaggatgagtctcatgcggggaaggttgtagagaggcattggtacgagaaaaataagcatatattcccagcttcaagatgggagatctatgacccaacaaaaaagtgggaacgctacacaatccatggggattagcatggaccatcatacatagagctaaattatttgtactttggatgtctgaaattaccagcactcgggtatgagaatggcacaagtgacgattggaatagtagattattagtgctgtttgccaacatgtactgctaaaactagaattatatgactgttattttagcgatgccaaaatttactcctctttgatactg

SEQ ID NO: 25592 - DNA, 665 bp, Sorghum bicolor
  Clone ID: 30963890
aagaatcaggtagcgcgaacaacaacagaggggaaaatggatcagcactgacagaagcagatgaagaagaggccatggagcttctagaatccttgaccgacgagaagcaggtgccatcatcgtcaagctctgctcaagagccacaccagctataccccccagggaaaatattgcacatggttggattgccagcagcagaagaggcaaccacaagtcagcaaggagcccaagaggaggtcgtcgccctgtatgagacaccccgacatttgtacagtaagattcgcttggcgaggtccatgataggagaacattacatgcccaagtacattaagacaatggagcagttgatagacaagcttgcagaggacatcgacgaccagctggactctttgtagcatcaaaagtgtgtacaggataactattgtacagatcatgaaaaaggaaaaatcattgtttcagattgcttgttcgtaatcgtagttggtttaaggtttgtgatagcgatctagaagatgtacaagtttggctctggtctgtttatttgctgtcatttcactttggcaggcacctcaggaagagctcgaagagctgtgcctggtgatggtctctgtaatttcaacagcagctgttttctttagctgtgaatattattatatttaaccgtt

SEQ ID NO: 25593 - DNA, 131 bp, Sorghum bicolor
  Clone ID: 30963898
ttatatcttcagagaagatcggtaattttgctgaaagctccctgttggatggctcgttcctgcttggccgtctgcattgttcaaattcatgtggcgggaacggaccattaatgcttatatcattcttcagt

SEQ ID NO: 25594 - DNA, 643 bp, Sorghum bicolor
  Clone ID: 30963916
attgcaaacaagccattccttgcctgagtaaagcaatggagcaattcccagagtatgaggttaagatcattggacactcaatgggagctgcgattgcaacaatactaacatacatcctacgcgagaatgagaagctgtcatcatccacttgtattgcatttgggccagctgcttgcatgacatgggacttggctgagtcgggtaaagacttgttaccaccattgttaacagaaatgacgtagtgccatctcttggcatagtttctgctgccaagcttcgtatagaggtacctctcggccaattcatttgctgatatttgagtatctaagcaaagtggaacacagaatatattgaatagttaagtgggtggttagaaggaaggacaattattcttcaaacaatttcttcccttaaaagaaaacatgtatatttactattgtactaaatgttggcaggttatgtcatcgtcttggacacatgaccttcgtaaacaaattcagcagactagattcttaggttttgtgaaccgttctgtgagtttcataagatctcatgtgccctttgtctctgatccaagatctaaagttgtggatgttgatatgctgcagtctgagagtcctgaggctgggagtaagccttcagc

SEQ ID NO: 25595 - DNA, 665 bp, Sorghum bicolor
  Clone ID: 30963935
tttgtcgacggacggcgatgccgcaaccgccaccctacctcgaggctacgggcactcggccctatggacagattaggattccgagcggcttagtgatcagtgtcttccgcgcccccgacgggagattgtacaccgatgatcctgatttgggcggtccgtttcgccacagccggaggcttctctctgcaatctattgccggtttggctgccaaccgcagctagaggtgacgcaggacggatccccgtcgccggcgttggcagaggatcccctgccgctgcctccacctccacctccaccgtctgacaagcttctggtggtaagtgttgctgagtctgcatcagcacttactctgcaagagcccgaagtttcatcatcagaggcgttgctcgattttgtatcatcagaagaatttgacagtgatgacagcactgacgaggaagaatctgttgatgatttatcacttgggcctaaaattttgatccgagatccaccaaaatggtaccaagtgtattttattaggaccgacaggtcgggattgttccacatgtaccctgatctaggtgggccatttcaaagtttagatgaagttgattgtgctattagtcaccatcttgctgaactgcagagccgatcagtgttgaaggaaccagaaacacattctact

SEQ ID NO: 25596 - DNA, 686 bp, Sorghum bicolor
  Clone ID: 30963959
ctgttggcctctgggcaaccaagtgagagaccaattcaacaacacctaaaccacaagcatcatccttgaaatctgttcagagcttcatcagctccccccacttctcttcttatataccatctaatccgtccttgtcccatgattattgcggtgacttgacttctcgcccgttccatacacaactgaaggacacacatactctctcttgacagtcgattaaagcggcacaaatgtgcggaaagatggagcacatgcacatggaacacaagggcatacttggtggagaatttaaagagggaatttgcgcctcaattcccaaaccacctcctagcacatcaagcaggccaaacagcatggttgtgaagaaggtttgcccgcgggagttcatcccggcgcacatcatcgcggaggcgatctcgacgctgcacgggctggacctgcggtggtcggggcccatcacgcccagcgagcggcagtacgtggagcagtacgtgcttgccatgtacccgcagtactcgcacggcctcatagaggacggcagctgcgacaaggacgacctctactccacctactacggcaacggcagcacggcgtcgtcgccggaggccggcggcagcgagcggcggcggtcgtcgccggtggggtcgccgtcgtcggccgccgcgaggcccgacatggtggacatg

SEQ ID NO: 25597 - DNA, 465 bp, Sorghum bicolor
  Clone ID: 30964001
agaagggggatttgaagaaggcaatcctgaccgggaggaggatgaggagggtggttatgatccagagttcttcaaggagtggatggaggagctcagaggtggtgctagtggctccaactggcctggaccagcggcagccggacaatagcaatgttgtgagggctaattggatggtttgacaagagacatcagcttacatcaagtgaccaggaggatcaatgaagattgaagaaaggtgatagtaatgaacagaggtgcttcgggagtcttaatttgtaggatttctctttaccattgtgtttgtgcgttcgttctaaccagtaacttgtatggtatggtgcgtatgttgttcagtttctgttcacttgggcctctcccttgccattctcggttgtttccatgctatcctgtgaatttgtgatctatctgttacccgttaatggtaatatagcggagaaatgagtt

SEQ ID NO: 25598 - DNA, 414 bp, Sorghum bicolor
  Clone ID: 30964014
gaaaattaatgtcactgatgtaattatggaggacagaggtgatggtgaattggaaaagcaaacagtgcagatgcctagtgacgttcagcagataagcaaaggtgatgaggaccatcaaagtataaaaaggaattcacccttgactggggatcgaattgctaaacacaaacaaacatcaacattcattggtggcacatcaaattgggatccatattgtaaaggagtttcattaagctccctcagactttctgatttgccggatccaccaactattgtcaagatgagcagccaagaggatgcccaaccaatgactgaatcatcgaatgctgaggtgaacacctcaagtgctgtggctgctggagagtctgatgagtcccaggagattggatcgccaaagagtctaaaagatgcatc

SEQ ID NO: 25599 - DNA, 488 bp, Sorghum bicolor
  Clone ID: 30964024
gattgaagtttgggctgatggtgtacttattgacagaactaaaatggagaaatgaggttcagatctaaatatattttccagacatttctaaaactttgcttctcagatggtagggggctatgcttcaaaatctcagatgtcgcaaggcactctggtttggagcctctccactgtacacgaagttgtcattctatttccagtcttgaaagtcgtaaataggtgcctgttggaagcgctgttgaagttttgatgcctaatttcaaaggagcagactgtagccatttctgtatataccactagaagtatgggaggaggcttttgttcatacggctgatgtaccaagctgggaacagctacccaactgtacctgaacgtgaagtgtgtttgattaattccattgataacccctacccctagatattttcttctcggattagggtggtctgtacatggatgaacaagctctcgtggccgtgctccttatttcc

SEQ ID NO: 25600 - DNA, 107 bp, Sorghum bicolor
  Clone ID: 30964044
gagtcgtcacggccaagcgtagtctctctgtccatgcgcgtgcgtgcgttcgtgtgtaactggatgtgcaagcaaactgcccgtttttagtaaagaataaacgagcc

SEQ ID NO: 25601 - DNA, 448 bp, Sorghum bicolor
  Clone ID: 30964050
aggtgcataatgagctctaaggatcgtgcactggctagaagtaaaagctgcagggctaccttcatggtgattccaaatagttggtttgatgattttgagaatactagcacgacaccaccggatgaaatctttaggtatgctcccagaaggcttgataaggtcaggagaagcctgtatgacgacaatggtgattgccaaaatgaggacttcaaaacctccccgttgattcctgaaaaaaatgattaccaaaatgaggactgtttactggactgctccacggtttcctgtgaagtagcatctgatgtgctcacttgtttttatgtttgtccttgtgtgtgcgtgcgtgcgcgtggtagatatattttttttcttgtgtagtttcacagaagtggataaaaaacatcacatgttctgactctgtattctattagtgttgtagcattttgct

SEQ ID NO: 25602 - DNA, 656 bp, Sorghum bicolor
  unsure (1)..(656): unsure at all n locations
  Clone ID: 30964074
aattccccccttcccctcccctcctcttctcggtggtccgctcagaggcagcagagacgagccaccgaggagacgacaaagctcgccgttcactaaccggccgcattcctcccccgcgcgtggtgcgtctcccgcattggccgcctagctagctcccacgaccgcgcctactacctctcgccggcgcaggtgcagggggaggagcgccagccagccgatgggggccgcgggcgaggagatggcggcggaggccaaggaggagaggataatggtgtccgtccgcctcaggccgctcaacggcagggaagccggggacagctccgactgggagtgcatcagccccaccaccatcatgttccggagcaccgtccccgagcgcgccatgttccccaccgcctacacctacaatagggtgtttgggcccagttgctctacacggcaagtctatgaggaaggagcaaaagaagttgccctttcagttgtcagcggaattaactcaagcatatttgcctatgggcaaacaagcagcggaaagacttacacaatgacgggaataacagagtatagtatgcttgacatctatgactacatagataagcatcctgaaagggagttcattttgaaattttcggccatagagatatacnatgaagctg

SEQ ID NO: 25603 - DNA, 527 bp, Sorghum bicolor
  Clone ID: 30964100
aggtcgccggcacgcgcagcagcaccatcgcgtcgagggctgctgccacggccccgcctttgctgaccatgccgggcggcgaactcgctgacgccatcatgggcggcggcggcggcggcggagcggacggggacccgcgggccgccctcctccgtctggctgccctcggggaccgcatggccgccgtccggggccgtatctccgcctccatctcgggcgaggcccggcccctctcctacgccgacatccaatccgtctcctccgagatctcctccgccgcgcaactcgtcgtcctcaacgccgcggagctcctcgcttgctccgtccccttccccgccccacttccacctcctccctccgccgctccttctcccgctcccgtccgagagatccccgctgtggccgcctccgtccaagagcagcaacccctggaggccgccaagggcgacggcggcggctacgaggtcgtggagctcgacgccgccgagctgctagcggagcacgtccacttctgcgagatctgcggc

SEQ ID NO: 25604 - DNA, 495 bp, Sorghum bicolor
  Clone ID: 30964114
acactgccgatcaagtacaggtgagcctagcagacacagtcattccggtaccggctattcaagaatatgctactggttattcacagctgagtaaaactgacactacaaatcaaacacagaccaatcaggaatacattgctgatcaagtacaatcgaacctaacagacacagtcattccagtacaaggtattgaggaatacacaactgattattcacatattggtaaagctgacattatgaatcaaatacaggccaatcaggaaaacactgaggatcacttatatttaagtcaagtagactgtgtcactgaaatgcagataattgaggaaaatttgtccaagcaacctcagctgagccaatcagaaactggggctcgaatacaaattgatctggaaagcactaccgatcacttgcaaccaaactatgatgaaaattctatgctgcaatctggtttctcttgggctcctgaacagaacggcggagcccctactacag

SEQ ID NO: 25605 - DNA, 606 bp, Sorghum bicolor
  Clone ID: 30964121
caaccagttactgggatgagtttgtgtggggtagttcatggatgtaccttgcaactggcaattcatcatacttgactctagccacacaccctaaacttgcaaagcatgctggcgctttctggggtggaccagattatggtgtgttcagctgggataataagctcactggtgcacaggttcttctaagccggttgaggcttttcttgagtcctggatatccatatgaagagatgttgagggcattccacaaccaaactagcattatcatgtgttcctaccttccaatctttaaatctttcaacagaacaagaggtggtttgattcagttaaatcacgggaagccacaaccccttcagtatgtggtcaatgctgcattccttgcttctgtgttcagtgattatcttgaggctgcggatactcctgggtggtactgtggcccccatttctactctattgaggctcttcgcagttttgcaaggactcagattgaatacatcttaggaaagaatcctttgaagatgagctatgtggttgggtttggaaaccattaccccaagcatgttcaccaccggggcgcctcaatccctaagaatggtgttcactatg

SEQ ID NO: 25606 - DNA, 674 bp, Sorghum bicolor
  Clone ID: 30964126
gtggcataaaggacttgaacaatgtggttttcctctcccttacaactgctcgggtgttgtctgaaagtgacatgatctccattctgcacatctttcgtcgagttactgggttcatgaaagatattatattttctagaaattctgaacctgatttagagccaaaactgatagtagtatctcttctaactacccgaaaccactatgatgaaagtgtttccacagtacaagagggctttctttcaagtttggcctttcattttccttttatatcctcttttatgggaggagatatccctgaacagaaacaaattaggtcgaagcattcctttaatcgactgcctgagaacagaactaattctgtagaacaagacgaattctcacaactttctaattggtcatctgatgctgctactgttcctaaattatttcctgaagaatttgaggatttggaatctgtgagtaatgacaggaatgagagaataaagccagaatctctggaagataatttggcagttactggagaaatgagcaaagatgatgacagagagcatttagcttcacagcaggaacatcgtttcttgagcaattcccctggttttgatattgcacaattgtgggctaagcagcgtgcgatggcaaatggaagcagtgaaaatgatgagcttgatattgtc

SEQ ID NO: 25607 - DNA, 660 bp, Sorghum bicolor
  Clone ID: 30964130
tgggtgcccgacgacaccggccgacacccgctctacacagctccgagtgcccgttcgcggagcgcgggttcgactgcctcgccaacgggcggaacgacactggctacctcaagtggcggtggaagccgcgccggtgcgacgtgccgcggttcgtggcccgcaccgcgctggagcggctccgcgggaagcgggtggtgttcgtgggggactccatgagccgcacacagtgggaatccttcatctgcatgctcatggccggcgtggatgatcccaggacggtcttcgaggtgaacgggaacgagatcaccaagacgatacggcacctggcggtcaggttcgcgtctcacggcctcaccgtggagttcttccggtccgtgttcctcgtgcaggagcatcctgccccacggcatgcccccaagagggtcaaatccacattgaggctggacaggatggataatttcagccggaaatgggtgaattcggacgtactgattttcaacactgggcattggtggacggcgaccaaattgtttgatatgggttgctattttcaggctggacgttctcttaaattaggtacatctatcgatgctggtttcaggatggcactggagacctgggcctcatgggtacaaaaaagagttgatttaaaccgaacgc

SEQ ID NO: 25608 - DNA, 613 bp, Sorghum bicolor
  Clone ID: 30964136
atgtatctggagaggtcgttgtattctgaaggtgatagaaagctggcagatcttgacaaagcaagcgagctggatcctactctcacttacccttacatgtatcgagctgcatccttgatgagaaagaaagatgctaaacttgccttagaggaaattaaccggctcttgggcttcaagttagcattggagtgcctggagctacggatctgtctatacttggctcttgaagactataagtctgccatctgtgatatccatgcgattcttactctttcacctgattatcggatgttggaaggacgtgtagctgcttccaaaataggcactcttctcggtgcgcatgtcgagcagtggaatacagctgagtgttggctacaactttatgagcgctggtcatcagtggatgatattggttccctttcagtgatctatcggatgcttgagtcagatgcagcaaaaggtgtcctgtactttaggcaatctttgctgctccttaggttgaactgtcctgaggcagcgatgcgcagtttgcaattggcaaggcatcatgcagcaactgagcatgaacgactagtatatgaggggtggcttttatatgacacggggcactgtg

SEQ ID NO: 25609 - DNA, 527 bp, Sorghum bicolor
  Clone ID: 30964153
gaaggagatcccatctcaggtggtttatgaggatgagaaggttctttcatttagagacgtatcaccacaagctcctacacatattataatcattgcgaaggttaacgatgggctgtctaggctgtcgaaggcagaagaaaggcatgtcgaagttctgggcagtctcctgtatgctgcaaagattgtagcaaagcaggaagggcttgatgatggcttcagaattgtcatcaacgatggacccaaaggaacgcaatgggtctaccaccacctgcacgttcatcttctcggtggacggcagatgaattggccaccgggatgagttgatattgcagaagggactttactcctgtagaactattgttgtaagacccaggcaaagggcttcgtgggagtgggacatgttgtacactcgttaggaattcataagtcataacacaccctcatgcgcagtttgctttgtgttgcaaaactcgttttgagttggagttggagaacagtcatccgtagacgctgccccctgttcctgt

SEQ ID NO: 25610 - DNA, 556 bp, Sorghum bicolor
  Clone ID: 30964164
acatgtcaactgtgcctacagcttgggtggaggtgaagaagctagagaattactcgctttttattgggtgtgatgtgaggagccctgcattttcttgcgccagcttaggacgatggagcgggaggagcaactgcttgtactacgggtattatgatccacccttggtgttgcatgggcttggagatgatgcggatgctgtgtggaatccagacaacgatgattaccttgagttcaagaggaactggtacacccaactgcaggttttctgggtgtacccaagtttgctctatcgctgatggcaagtgatcgatgaactccatctgcttgtgctgaaacttcgccttgaatttccttagagaacagaagctttaatttgcaatgaataatgtatgggagatgagagttcttagacttgcagtttccattcagttatcagctgtgctccgttgctacttctaatcttttgcgctacttatgacttaggaacttgttagctattctgggaagcctggaaggctggatactgttattttaaagagtagtagagaaacgttct

SEQ ID NO: 25611 - DNA, 410 bp, Sorghum bicolor
  Clone ID: 30964176
ataactgcagattgtgcaattaattatgtgatttctagaacatgatatcttcattatagcaactttatcgacgctttggacttggacatgaaattcaagaggcatacttactatttgcatcagcagcagcaacgcaagaaattcttggctttcaccgtccttgagcatgtcgtcacttgcctgtgcagcatgttgttgatagtggattttctaagcagaaaggctataatccgggtctaaacttcagaaaggaaaaactgaagcagctggactaaagcagttggttacttgcttatcactagaattccattatgcccttacaaatgtgctgctgctgcatggtttaaatttgagacataagaccctacatgtgtaatgaattggtggattgatgtcatgatatgtattta

SEQ ID NO: 25612 - DNA, 492 bp, Sorghum bicolor
  Clone ID: 30964182
acttggcggtggagggatatcccacgatctacttctactcgaccaccggtgacctttattcctacaatggtggaagaacggccgaggacatcatcagtttcatcaagaagaacaagggccccagagctggtgccgtggacgaagtgacgcagacggatgctggtgctgtagaagagggcactgcaccttcatcgacgtcagagcttccgaaagacgaactctgatcaaggtgtcatatgtagctatgctgtgagagagtgaggcacatagagagattcagagaaaatagccaattacaagttgggaaccatttgtcataagtcattgcacactgaggttgctagttttatttggttgaaatttgctgtcataagccgttactgatctgaataaggccattgtaatccagccagcactcaaccttttcgttgtttctgcccaattcatgcaaaatagtcaaacttttttagtgcttctagccaattagcaaga

SEQ ID NO: 25613 - DNA, 566 bp, Sorghum bicolor
  Clone ID: 30964191
gctgaagccggtggcagtggagattcaaggaaattcctggcgaataaaccaagaatgatctggacagctaattcaaccggtctgaatacctgcatggggaagttgatagctgcgcagagattctgggaaattcctggtaacaaccgaggatggtatggacaggttccctggtcaagccaatcgatctttggccctgaagtgataatataattgcgacgagaaaggtcaaaaggaactcactgctggcagtcctgcgagtcgaagcatgagatcgccgtccagaagcaatcaaaacagtgttgacaatgagcagtcaagtcagtgggcttagctttcttgtgagggtacgtacgaactgacgagtgacctcgagggaattaaagtatcatgctctgcgttaagagaatctgctcgctgattgttgacttttgaaatatgtgctgcataacacagttttttttcattaatttatgcatctggtagttgcggaaattagattttctgactgtagcaactgaaattgttggagaaaaatattcagaatggcaacggtgatccatagtcca

SEQ ID NO: 25614 - DNA, 453 bp, Sorghum bicolor
  Clone ID: 30964208
accaagcgattaaatgatgaaaaggctcttacattggctgttggtgatgaagatactgacatgcttgctgatgtgaaacagatggcagctgcagcagctgcagcaggtcaagcaagttcatcttttgagaaccagctccggccaattgatagatatgcaatgcgctttatggaactctgggatccagtaattgacaaagctgctgtgaatcatcaagtaaacgttgaggaggaagaatgggagcttgaccgtattgaaaaactcaaagaggatttagaagcagaaattgatgaagaccaagaaccactgtcttatgaatcatgggatgtagattttgctacgacagcctatcggcaacatgttgaagctttaactcaaaagcagttgttggaagaacaggaaaggcaggctcaggaagcagcaaaggagtggaggagaagaatgataatatga

SEQ ID NO: 25615 - DNA, 542 bp, Sorghum bicolor
  Clone ID: 30964220
tagtgatagatggtgaagctctttcatcttttgagctcctgaagatacatggaactcaaggatcatctggtagtaagatttcaagtgaaactgcaagttcatctaggacaaatatgtcacgtgagttgaccactgaggatggtgcccttaaagatattggtatcgacagctcaacaatcaaaccttttccaaggtttagcaccacttctgaactctcagtggatcctattttgtcctctaaagtaagcacaccatccaaggagatcccatcaactttacgcaggctggacaagtcaaaaatgcctgcactaatacctggagatggatccttaaacttaagccttaagcaggttcggaaggttactcagaatttctcacctttatttaagttaggtgaagggggaatctggacagtttacagggctgtattatcagataaccagtttgctatcattcggagagctaaaaagggtcacgttcaagaggcaaaacatctcatgaaagtgaaattccttacagaaattaatcactggagtttggtg

SEQ ID NO: 25616 - DNA, 528 bp, Sorghum bicolor
  Clone ID: 30964223
cctactggagctgtcgccaaaccctagcccccattcccaaagcctcaccggccccggctcccgatggcgtcgctggcggcggcgggtgaggcgctgcccttcagcgacgacatgctagcagagatgttcatccggctccccaccctcgaggacttgggccgcgcctgcgcgtcctgccccgcgttccgccgcgtcatcaccagccactccttcctccgccgcctgcacgcgctccacccgccgtccttgctcggcttcctctccttctcctcgttgttccaccccgcggaatcgccacacccctcggcgcgcgccgccagcgccgtcgctgaagctgccgatttcgagttctcgttcctacccaccaagggtttctggatggtccgggacgcccgcggcggccgcttcgtcctcgactgcgacgacgatacaggttctacattcaccaccatagcggtctgcgaccccttgttccgccgccacgtagttctcccgccactcccccaagacttggccgcggcagtcgag

SEQ ID NO: 25617 - DNA, 506 bp, Sorghum bicolor
  Clone ID: 30964229
atgcagctcatctattcagtctgcatgctccttgataagagtccattttctcaggtggacctgtctgatatgaattttgtgtttactcaaaatgaatttagcatgagttcctgggaagctgacgaggtcatctctgcctttccttcaagcatcacttccagggactgtgacctgggtattttttgctctaataaggatcatcagggaagtaatttgacaaatatttttgaagatattcagaaagccctacaggaggagagaataaaagaatccagagaaagggcagcttccattgcatggtggaatagagttagatgccaaaagaggcctatctatggcacaaacatgagacaggttttgactgtaaatcatcctgtatcgaacattcttgataagaggaacaaccctttgtgccacatggactattcatcaagccttgcagatcttgttcttccatctgtggaacgctttcagaaaatgcttgatattgttgaatcatttacatt

SEQ ID NO: 25618 - DNA, 556 bp, Sorghum bicolor
  Clone ID: 30964235
tacaaaatgttacgggatcttctaaatctttatgcttttcgtgcccttcgggtgaactccctcaccgtgctatatacataaatgtccgaggaggtgctactgaaactccatgtccctacagatgcatgtctgacagatatcgcatgcctcactgttatacagctctggaggagttaatatatacttttgggggaccttggctatttggtctacttctttcaggccttcttatcttgttagctcttgttttaagtgttgctcgtatgaaatttgttggcacggatgagttacctgggccagcaccaacccagcaagggtcccaaattgatcattcctttcccttcctagaatcactaaatgaggtcattgaaactaatagggctgaagagtcgcacggtcatgtacacaggatgtatttcatgggtcccaacaccttcagtgaaccttggcatctctcacacagtccgccagaacaaataacagagattgtatatgaagatgcatttactagatttgtcgatgagataaacacccttgcagcttatcaatggggggg

SEQ ID NO: 25619 - DNA, 689 bp, Sorghum bicolor
  Clone ID: 30964236
aaagagcacgcagttgttagctgtagaaaagttgaagtcactgaaaggactagacacctagtgtgggaccacgaacacttcacaatggagatgaaattccctggccagctaaaaagggcctgcagggcaaggacatttcgaagtaaattcagttatggcattgtgagtaaatcttttcttgaagaccttttttcaacattcaggcaccttcgtgtcctagtttttaaccatgctgaatttgaggagctgccaaattcgattggaaatttaaggcacctaaggtacctagatctacaatggaatatcaaaatcaaatacctaccaaattctttatgcaagctggtgaatctacaaacgctcttgcttgctcgatgtcaccaactagtggagctaccaagaggggtgcatggacttgtcaatctgacatttctcttgctaacttcaaagcagaaacatttgttaagacatgggttttgtggttgggcttcgctagcacatctacatttgagtggctgccttgagctaacatcattcacagagggaattggcagcctatctgccctcaaagagctacgcatcttcaactgttcaaagttggcttctcttccctctgccatgaggcaactatccaaactccaaaagttggttattaataattgtgcagagcttgatctgatggaaccaaagga

SEQ ID NO: 25620 - DNA, 556 bp, Sorghum bicolor
  Clone ID: 30964245
gcaaatggtcaagtcctcacctttggacgaggaggagcgagggtgcgagggaattcactgggaatgagcgctcaacttcctccgccgacggcgagcggcaaccgcctcgcggtcatcgcgtcccacttatcatgccctccgctcggcagtccggcagccatgtccggggagaaggaagccgccctcgccgccgagcccatcgccaccggcacccctaccatgtcagctctcttgattctctccaaatcctgtaccgtcaattcgatttcgtagcgtcatgagggagtaattaacttcgatttggtagcgtgacggcgagtaattcgttctagtaaaataagcaaaagcagagagtaccctgggattttggatccttggtgttggacttcggtgcggagctgtgctggtcccaatgcgagggatggttcgtcattcgtgtagtcaggatcgtattctgttgaggttgatagattttataggagacgccgatgtgcttagattatcactcaattgggtgaatcaagatatccgaatgcagtatgtccatagtgctgat

SEQ ID NO: 25621 - DNA, 504 bp, Sorghum bicolor
  Clone ID: 30964252
ctacttgtgtgtggtgtactggtgtgactaccttgtgattcccttccctcctcctctcctctctctctctctctagagtgtaacatgttggtctccatggtacactaccaattctccggctctctgtaggcaaaagctcaaagagaataaaagttccgttcactttcactgccacagtggccccacttaccttcccttgtgatcccaatgcatcctttcagtttcatctctggtactgggatacatgtcttgatctcctctcccctatgatatcttcttgcagcctttcccactgctgctactgtcacagctgcaacgactacagctaggccacctcctacactggacatcttcccagcttggcctatgaggtctcttcacacacccaaggagggctcaaatgtgacagcagacagcacagacgactcggagagcagcagcaagaacaacagcaaccactcagatcagcacggagcagcagcagacatgcaaagccagtttggt

SEQ ID NO: 25622 - DNA, 590 bp, Sorghum bicolor
  Clone ID: 30964257
cttattccggtgaccgagcgagcgaaccggagaagaggcaattcttgccgccgtcgacggcgaagaggagaaaggggaagcgatttcgccgccgtagccggcgaatgcgccggcatcgatcgacccctgcttcttagatagtctgacatcatgcaaggccctagcaaaatgatctgtgcctctgcctccagtatgccccctgctgtgtatggacttgaagggtgggcagatctcccagaaggtctgctccattctatcattcctctgttgagctccttccttgagctccacgcttttgctggcacctgccgctcttggcgtgctgctttcgcctcatacccatctaaatccacattctgcaccttgctcccacctctcctcatcctgccccatatcaaagtctctgctcctaatcttccttctagaagcgatgatggtcacgagctccgcacgtgccaggtccttgatccatccaacttgaaaagtacccttcgctgccagattcctgaagagacatttcagaagttgcactttgccggctcttcctatgggcagctgatttgtggccgcggcagaaattgtgttatcgt

SEQ ID NO: 25623 - DNA, 620 bp, Sorghum bicolor
  Clone ID: 30964260
gcctactgagtttatagtgggagaaggttctgtccagtgcttgctttcaactagttatagtgctttgttcctgttaatctctcttgctctcttgttcataaaaaccaaacaaatgaaattgcaagttaattaattgcaatcagcaataatgtaaattataagtattgagcaccgcaattttagctctgagcatatgcaatttgtggaaatttaatttacctcatgagtataattgatatatacattgttcaaagcaaatttgtaataattttcaatgtttatttccaaatctcttgaacaaccaacctttagatcaaagaggaatggattagcttacaacttagtagttcatatattaatgcctcatagtttacagtgggtgagtacgggcataagataggtttaatggcatagtcaatggacccaaatttccttcaatacctattgagaatctttgttagttgttatctctaaaacctaagtaaacatcatactgaaactcctcctgcaaagcatgtgtcacgatcatggggaagtgaccggataggataggattgggaagttgacggcctatagttattatcgaacataacatctctcccctctagaaagagctcatc

SEQ ID NO: 25624 - DNA, 485 bp, Sorghum bicolor
  Clone ID: 30964265
atgccccgcctctctcctcctttccctgcagtcgcagcagtcacagctgtgacctgtccagttcagtcgcttcagcgttcacaagcgcgttctctcctcctctctttcccctcccacctcgcaaagcttgctcacttctgtgtaaggacaatcctcagcaacctcgtggagtcgtggggactggggacgtcgttgccgttcccgggctcggcagccgccgcaatgctggcgcaggtgctgctcgtgcatctgctcctcctcctcctcctcgccgccacgtcctcagccgaccaccaccgccgccattactggggcagaagggcgctgcacgagccgctgttccctttggagagcacgcccgcgctgccgccgccgccgccgcccgcgccgttcttcccgttcttgccaggcgccgcggcgccgccgacggtgacgccggatgtcggctccgcctccaccccggcggacaccgccgggccgggtga

SEQ ID NO: 25625 - DNA, 226 bp, Sorghum bicolor
  Clone ID: 30964267
attctctcgtctccagttctcctccgcgcagtactccgcatccgcgattccccaaccccgcaaggaagccgacgcccaccagcgcgaccggaccacaccgcccgtccgacgcgacccagccggtccagaagcgtcgccgccgccgccgcccgtccttccaccaccccgctcgcgccgccgtcgcacgctcgctccccctagggttccccagggtccggatcgccgg

SEQ ID NO: 25626 - DNA, 442 bp, Sorghum bicolor
  unsure (1)..(442): unsure at all n locations
  Clone ID: 30964271
tggtaggtccctagcaaggtagcagcaagggctcaagcctggcagcngagatnnggacgctgcctggttccgacgacggntaagcagcatggcgctgcagcttggtagcaaccttnttctctctcntgctccttcaatgctcatccgtcattgggctagaggatggaagaggcatagatctgaagcttccttcccctatggagccttagttaattgttttttggtattttaattggatttagatttttgagatagggactggatctgtttctaggcaaatcgatttgctcaattgaaatcttagtacgattgttctttagattttttatttgctttgtccatcatcattaactggattatgtcacagggactccatggggaatttatccccgctcgattggagcttattgtagttttcttgtgatgatattgcagactatta

SEQ ID NO: 25627 - DNA, 536 bp, Sorghum bicolor
  Clone ID: 30964276
tactggccgtctgccggaacaccctcacctggctccggtcccggacaagactcggcgccgccgtcccgttcaacgacaacatcaacttccacaaggtggtggccgggggcgtcgccgtcggcgtcgcgctgcacgctgtgacgcacctcacgtgcgacttcccgaggctgctgcacgccagcgccgccgcgtacgagcccatgaaggcctacttcggccagcgccggatcccggactactggtggttcgtcaggggcgtcgagggcgtcaccggcgtcatcatggtcgtgctcatggccgtcgcctacacgctggcgcacccgtggttccgccggggaaagctcagcgagggcaacccgctgcgccgcctcagcggcttcaacatgttctggtactcgcaccacctcttcgtcatcgtctacgtcgccttcgtcgtccatggcgtctgcctctacatcaaccggacctggtacaagcagacgacatggatgtacctcgccatccccatcctgctctacgccggcgagcggcttttc

SEQ ID NO: 25628 - DNA, 582 bp, Sorghum bicolor
  Clone ID: 30964286
attagccaccggaaaaaggaactgccggcaccggcggccaccgccgccaaagcaggaagccgccttggcccttgggtggtgctgtgtagccagctgacgggtagctagggacggtgaggccacggtgcagtcttactgtctatcgggcggagggcaactctgcagcatgcgacggctgccaggaaggcagatgcggctggaggcgatgaggattgctcctgctctgcacgtcggcgcccatgggaagttagaggaacatcaccagggctataagaagggcagaagttgaagcaacacctgtgaccagaaagagtccagaaaagcttctgaagtttagactgctggggctggcgatggcaccatcattttgacagacatgttgatctccgatccatttcttttctatctgaatgatggcatctccttctgttatgctgaggattctcctggagaagtcattgaccataggagatctcttggttaccttctgatgcagcttggacattgcctgcattggaatctctgatgtgaagaaccagctttgtcttatagtccctatgaactgcgtagaaatcttccatg

SEQ ID NO: 25629 - DNA, 212 bp, Sorghum bicolor
  Clone ID: 30964293
cggcgatcaggaagagaaacgggatccatccggggagcaagctaagcatcgtaaaagcagaaggcgatgtctacgtcgccatgatcgacgacaaggtaatcaccaagatcgggacgaggtacgacgtcggcagcgtgatcccgtcgggtttcagtgtcgccgcgcatggcgacggctactgcatttgggagaagagagactaccactaccac

SEQ ID NO: 25630 - DNA, 430 bp, Sorghum bicolor
  Clone ID: 30964311
ggtgcagcacctgatagagaggtgcatgacgttcgggatgagcatggaggagtgcatggaggcgctggccaagcgcgccgacgtccagccggtcgtcacctccacagtgtggaaggagctggagaaggagaacaaggagttcttcgacaagtacaagcagtggatatcggagaagagaagcgcaagcacctcctagcacagtatagaactgaattagctgctgctggcttgcttaaatagttatgatgtttattgtttagttaattttggatttattactcaattactgtgtttaattagagaggaataaggcgtagggaggtcgatcagctgctaatgtgatcttctgtaatcacagacatcatgttggctgtggcgttatgtgtacatacagggtaaagcaggggaagccatgcatattatcgtgcgc

SEQ ID NO: 25631 - DNA, 618 bp, Sorghum bicolor
  Clone ID: 30964320
tcccatcaatgatgatggaacagttacagtaaaggctaccctccattaagtggaaggcaggaatggatattgtcaatggaaagacatgcgacaagaagggagacaagcgactactggttgatgaaagttttttcacttggttcagcaatacagaggacaaaagttttgctcatggtgagatggatcaggtggcagatgtcatcaaggaagacttgtggcctaatcctttgaagtatttcaacaatgagctagaaggcgagtttgaactagaggatgatgaggaagagggatctgatgaggaagccgaagatgaagatgaagacaaggaggatgaagaggagccctgagccctgttccacttaggtcaggtttgacaacttgtctgcagaatgtgtgagaccgagcctccatatggctgatgaaacaaggcgtcccccttttgcggtgtttcagtacttgacttggttggagttttaggacctattttcaggaaacccaatggggtttggtatttgacagatttctttatgtgcaatccattatgtaccgtggaagttctgcttggtctggtcgttgtctgctgtgcgtgttcttgcataatgctatggctatacgttc

SEQ ID NO: 25632 - DNA, 355 bp, Sorghum bicolor
  Clone ID: 30964324
agtgcaaacccaagaggttcaattgaactgcagcgtgcgagggtgcaacctttgcaggtgctatcaccaagattaatccagcagctcctgcggaggaaacagcacagcaagatatatattgccagatgacaaaaccatcatacacgcagattgaagctatccatgtataatatgcatgctcatgtgcacatcaataccactacttgcattgttccctaatgtatgcagccatcaatggccataaattttacagctaagatgttgctagacctgtaaaatataaccatgtatgaagtctacctcgaacattctcatgtaatatatgtgttggtaggtctaaacttattatgtttcc

SEQ ID NO: 25633 - DNA, 582 bp, Sorghum bicolor
  Clone ID: 30964345
gaaagcttcgaggtcatcttcatttctatagaccgcaataaggaggaattccaagcaagcatgagttcaatgccatggcttgccatcccttattctgacactgccaggcaaaagcttacaagaatcttcgctgtcaagggcatcccaggactcctgatacttggtttggatggtaaagttctaaaaacagatggcaggacagcaatatcaacttatggtgcaacagcattcccattcacggaatctagagtttctgaagtggatgaagccctcagaaaggaaggagacaagctgtctcgccaagtgaatgatccaaaacacagacacgtgcttgagttggacatggctaaggcctatgtttgtgatgaatgccagaagaaggggaggtattgggtgttctcctgtaagcagtgcaactttgatcttcatccctcttgtgtattagaaaataaaatagacatcatctaagatatgtatatatatatagttaaaggtatgaagttctatcatcaaaatggactggcaaatgtttctattgtactctaaactctacgggactcaatgaaagtaatgggcaagact

SEQ ID NO: 25634 - DNA, 529 bp, Sorghum bicolor
  Clone ID: 30964364
gaggccgtcacgtcgtaagtcgctcgctccccgctcctcgcagcatcaaacgcaggccccagaaaagttcccgaccgcgaggacgatgacgccaagcaggaggcggaggaaggggagccggagccggagccggagatggtgcctccgcgcctgtcatgtccgttaccgccgcgcgcttcaagccacgatcccgcccggggcaaggcatcacaaatgatgaatacacatatgatggattccttggagtgctaaatgccgcgccgcggttgtcccaaatcatttaagaccttggcaggagtagcagctggcatctattcttcaccgttcagaattcagatggaatggaatatatcacatatgtgagagccaacaaatgctgggaaagtgaaaagattgttatggaaaggtgctttgggtgttgaaggaccactatgtttgctattgaacattgctgcaagaagttggcatttcagcataatctagataataattttggcagcaagcagagaaaagtttccatgaagctgat

SEQ ID NO: 25635 - DNA, 526 bp, Sorghum bicolor
  Clone ID: 30964380
aaattttccggctgctccctggacagactcaaaattttccgcctgttccgttcatctctctccttgtccttgtcccgttcacccctctctcttgctcgctctcggccttcctttcctgtcggcgacgcctgggcgggcgagcgccgtcgccctttgccagttcttccttggccccttcgccggtgattggcgccgcgtcttattccgccctttcgcgccgggactagcgcccaccaggatcaggattgaaggggctatatagagctggccacagttaacctgatcgcctgaaactgaaatgtcattggtggtgaagcggtaccgatgtacgcactctgcgagctgtgcttgcctcaagggccaggtcagggaggatgctatgtatctcgtgttcaaacacatgaattggaacccgaagatgattgctatcttatccagcgtatgtaagtggtttgatgaatttgccaagagggtgctctggaaggaattctgcaatgccagggcaccaaagatgatgaaggatttg

SEQ ID NO: 25636 - DNA, 537 bp, Sorghum bicolor
  Clone ID: 30964387
tactggagctcacttcccttccacatccatctcgtacacgtccagaaccagaacagcacgcacgtccagctgctgactactctaacagtggacaccagtcccgcccgccggcatggcgaaccacctggccgccggcctgttcggcctcctcctagctgtcgcggtgctgtgcttgcttattggctccaacacggcacgagcccaggtcctgttccaggggttcaactgggagtcttgcaagaagcaaggcggctggtacaagtttctccaggcgcaggtggacgacatcgccggcgccggcgccacccacgtctggctgccgccgccatcgcactccgtcgcgccacagggctacatgccggggcggctctacgacctgaacgcgtccaggtacggcacggaggcggagctgcggtcgctgatcgccgcgttcaggggcaagggcgtggaggccgtggcggacatcgtcatcaaccaccggtgcgccgaccagaaggacggccgcggcgtgtactgcatcttcgagggcggcggcgg

SEQ ID NO: 25637 - DNA, 161 bp, Sorghum bicolor
  Clone ID: 30964403
atcgggggcagcaggtattgatctcctgcttggcctgcagtagcctccaaagcaaccccatccaaagcaggcactgtcagcagcgacgaggcagcggacgacagccgcgaccgcgagcggagcaggggaggggaagggaatggaggaggagcaggggaggt

SEQ ID NO: 25638 - DNA, 391 bp, Sorghum bicolor
  Clone ID: 30964406
ctactgggacacctgccgcgttacgagggtgtgaggtgggggagagagagagagagagagagagagagagaggggactgggagagatccagggactctgggggcgcgccggccttagaagatctggcggctgctgctgctgctgctgccgctgcccagaggagaaacaacgaggataccaccgccaccgagagggcggccaggcccaggcggggaaggaggacggaggaggaggaggagcggcggggagatctctggctctcttctcgctcttccgtccatggagctgggagacgccaccgccggccagggagcgcaaggggacgccgcctccggggcccttgtcagcttggttcgattactgctggcccttggaggaatcaacagtgctc

SEQ ID NO: 25639 - DNA, 256 bp, Sorghum bicolor
  Clone ID: 30964409
acggcagtggcagcagtctcacctttccctaggacaaggagggagcgctaaaaccctagaggggggttttccactttgctcgcgatgcggaccgctgaagagaagggcaagagggcgaggacggacggcgccgaggaggacgggggacagcccatcgaccgcgcgctcctcatctccatcgagaagctccaggagatccaggaccagatcgagaaggttaatgaggaagcaagcaataaagtattggaggtggaac

SEQ ID NO: 25640 - DNA, 303 bp, Sorghum bicolor
  Clone ID: 30964413
atatatagaggcgccgttcaaaccgacgaccaagaatcatgtgtcaggagatataccatttcatccattctactttctgttacgggtctattatggaaatatactgctcattattagtagaggttccttttcccttgcaaacaaaaacctatgatgcctttttttgcatgggtagttggaatttagagatcgatgatacttagctatagttgtcttccttttccttctgatttttattttacttcatgtttgaaagggttcagaattgaaagcaacatagtgcttcttggctttgtttattat

SEQ ID NO: 25641 - DNA, 434 bp, Sorghum bicolor
  Clone ID: 30964424
ctctactttcttcttatcatcgtagcagctatgacttcctttaaggtccatcaggacaagtcagcattcacaggaaaatctatactgtacttgaataggcaccaaaccgaagaatggaagggttggatgcaggtgctattcttgatgtaccattacttcaatgctaaagaaatctacaatgcaatccgtgtgttcattgctgcatatgtctggatgactggatttggcaatttctcttattattatgtgaggaaggatttcagtcttggaagatttgctcagatgatgtggcgcctcaatttctttgtgatattctgctgcattgtcctgaacaatgactatacactctattatatttgtcctatgcacacccttttcaccctcatggtttatggtgctcttggaattctaaacaaatataatgagattagatc

SEQ ID NO: 25642 - DNA, 617 bp, Sorghum bicolor
  Clone ID: 30964427
gcctactgatggagaagatgataccccttcagtgcacagaggagaagggagctggaggccatggatgatgccaggagaaaaggaggtaagcttcaggagcttcttggctgcaaggagagagactatgtcataagtgcagatgacataaaggtgaacaaaaaaactcatgaaatacctctgttaataggaaatatgtttgatactacatactacatttgcaagtttgattaaaaaaactaggacatgattcaggtgagaaaatagtctagacacagacttgagaaactgtgtcagtaggtatgtcctatgacagggaacaagaacacacaaccttgcaaataaacgaaaggcattatagcaagatcccaatagtgcacataatggaagctaatatgcaagcacaatcttgttcttcctaatatctctctaattttattgtagaagaatatataccatgtaaattggaaatggaagattaatagatattgttaatctagctatgcttaaagctgtaatcatataaagaatacaaaactagaaatgggaaaaagggtgtgatatctcaaaatgcatttgcaaactaaccaccattggggcttgacaaatttgcagataat

SEQ ID NO: 25643 - DNA, 601 bp, Sorghum bicolor
  unsure (1)..(601): unsure at all n locations
  Clone ID: 30964430
agagcaaatgagttgtccagtgcacagttcaatacctggaggaagaacccatttgnccatatcagaagcaaaaggtacatagcctcacccatcagcaatagcaccacagtagaaggcaagtttaaagaggacgagtgtggccatagaagatccttctccagcgtcattatccgatactcatcatcaaacaagacatcctctgtttcatcatcgtcatgttcttcgtcaaattcatcatccttctcaatcccaagctcaaatgactctggtgttggaccagtgctgaggaggagcagcagtgcaagttcagagatggacaacccaattcagggcgcaatagcatactgcaagaagtcacagcagctcgcctcggtgaggaagagtgcaagcgacgcaggattccgtttcatgtcatcatcagcatcaaaaatagcagcagaatccgaagacgctgagggtatatttgagcccgaaatacaaatgtaaattcaatgtcccccaaaaatactgtactcttttgatcttgggctctctgtagatatgatatgtctgatattattggccttcagaaatatcaatgtaagcaatttctgttaaagac

SEQ ID NO: 25644 - DNA, 538 bp, Sorghum bicolor
  Clone ID: 30964432
cacccaaccgcagtgttctcatcagagcaggcagtgcaaccagccaccattgcaagcattgtattccccttgcagcagccactggtaccatcagcaatgactggaccaccttatgctgcaccaccactggaactgaagctcttcccagaagtggcatctgccgaaggccatgagccatgtgaagaccaggaagcacccaaccatgtggcacgaccacaggcaaggtacccaacgcaatcggcctcatggcctgtaagcctgttttttggccttccaggaatggaagatgaacaatgcagtagcagcacaaccggcagcagcaagacggttagcacagatatagaatgagtggatcagctccgacaatcaaagagtttctgttttgagtttagtgggtgtactgacagcacaagctgtgtgcatgtaaatatgaacctcctttttggatctcagaatgatagattatactttaatggaaataccgaaatagtaccctcccattgcaatctttgttaatagatctctataaatgcggatc

SEQ ID NO: 25645 - DNA, 433 bp, Sorghum bicolor
  Clone ID: 30964443
gcggggtgcccgcctacccgtccggccgcaaggggctgccgctcaagttccaggagttcgtcaagcgcggcagcgccctgcaggggatgtactccgtgggcaaccgcttcttccaccccaagtaccgcggcaagtgccactaatgcatgcagtgacaaggtgtcaaggtcttaattagggcttgatgccagcagggatcgacatcaataaaaataagctaggttaattattgtctctttgagatcgatcgatcagttagactttgtttggatgttgtcagattcacttcaatgccatatgtattggtgtgggttggagaggaatttagttcaagttctactccaatccacctcaacatatgtggattgatgtgaatacgactacatctaaacaaggtcttagttgggtaattttaattagctagtgttggttg

SEQ ID NO: 25646 - DNA, 584 bp, Sorghum bicolor
  Clone ID: 30964444
atcgtggggttcaggggcgtgcccgagctggtgctccccgccggctactacggcaacgcgtgcgtgcccgtggctgcggtgaccaccgcggggccgctgctggctggttctctgggcgccgccgtggagctcgtgcgggagacgaaggcggcggtgaccgccgagtacgtgcggtccacggtggacctgctggtgctgcgccgccggccgtgcgtggcgctgggcaacctgttcctcgtttcggataaccggcacgcggggttccaccgcgtcgacttcgggtggggcgagccggtgtacggcggccccgcggcgacgctgttcgggccgagcttcttggtgcacgtcggggacgacggcggcgccggcgacgggaagggcatgggcaaggtgggcgtgctgatcgtgctgccgcggccggccatggagcgtttcgcgtcggaagtcgagacgttgttgaagagttagtgcgtgcgcgctaatgcatgtgtacactagtgtgttttgtttgctcgttgttttggtgtgtactaggaaatacagtataaccccctaagtttacatacaacagggaatgctctcta

SEQ ID NO: 25647 - DNA, 593 bp, Sorghum bicolor
  Clone ID: 30964453
ccaatgaccaagcagattatgatcctccaccttccagacagaccaagtgcgtgtacccagcgaagtgccgatgggggaacgaagcacttgcccaaaagcagaaacggaaaggaaagccaggcgaaagccgagcgggacaaggaaaagctccgtccacgcgccgcgccgctagggggctccttgtccgccgtcgacgggcgcaccagcagcgcaccgttcaggcccccacgccacgaggaccgcgcgctcgacgttgacgcggcctccgcgccactcgcgcgcggccgcgtgccgcggcctgtcgccgtcgtcgccgcgggcccggccggcggttgccgccgatacttaatcgagtggaccggagagtataattaagtaaatcctcggcgttaactattgggtcatcggcgacaggtcatccccaggcgccgggtcctgacctcggacacggcacaggtgtcggcgtcgcggcccctgggactgcaagctcggtcgcggaaggcatcgtaggtttcttgaatatttatacacgacattgttatgctatcctcacccgcttataatacttgaatatactcggacagacgatactc

SEQ ID NO: 25648 - DNA, 590 bp, Sorghum bicolor
  Clone ID: 30964483
cctcatcaattgctgcgccaagtcgcgccgcttcgatctgatccctgctgttctcgacgagatgtcatacctggggatcgagtgcaattcggttatccacaacgcgataattgatgggtacggcaaggctgccatgtttgaggagatggagggtgcgctctctgccatgcttgagagtgggagcaatgtgccagacatttacacgatgaactctgtcatcggggcatatggcaaccatggaagaacagatgaaatggagaagagttacagtgagtttcagctgatgggtgttgagccagataccaagacgttcaacatcaagtcctacggtaaggctggcatgtatgacaagatgatgtcgatattcagccttgtttagttccgaacaaatttcagatttcgacactgtagcattttcgtttttatttgacaaatattattcgatcatagactaactagggtcatctcgtgatttacagataaactgtaaaattagtttttattttcgtctatatctaatgcttcatgtatgtgctctaatatttgatgtgacggggaatcttgaaaagtttttggttttcggggtgaag

SEQ ID NO: 25649 - DNA, 493 bp, Sorghum bicolor
  Clone ID: 30964498
gcatcacatacctgccactgtaccgtgagtgcgtgagtgcaggtgggcagctgctgccccaaaggctgaggggggagctgctggaggcggtgcaccggctcggtgagcctgctggcacagagagccagggtaaggaccttgtgcggacactagagcgccacatgccgtcgttcttggttggatcttgagatgtttcaaggtgtaaaagaagcttatgcaggctaccttgctttaaaagggtatgaagtagtgtgcagttgccaaccaacttcgagaggaggtggaagtagcaatagttttggtgcatcacatgcctcatgatcgtgtaaagaagttttgtttttattttgtataagaaagaagttttctttcttgattgcctattgaaggcacctctgtgttagtccatcactccaatccatggtgtctcaaaactctggatgttggtaaacaccatcagagcgacgtttgaattgcaaacagcaaggaacca

SEQ ID NO: 25650 - DNA, 707 bp, Sorghum bicolor
  unsure (1)..(707): unsure at all n locations
  Clone ID: 30964524
gaactttattattctctcccccatcaaaatcaccgcggggaaaaataaagatactgtccccatctccttccacttttgcttgcatgtttgattcccccttctccttcatatttccccccctacccgcatggtcttcgatcttgcaagtttcagatcggcacagttttggtggcaacggcgcggtattgttcttgatttagggttcttcggctgtgtatgatcaggagttgccggattattttagcagggagcagaatggtgtgagattggattacagcctggacctttcttgcatcaaatgtttgagcaaggcaaaccacgaagcatccgggcgaaggcgaagaaatcgccgttcgtggaggtagaggctgacgagatcggccagngctagtggggtggtgttcgcaagggaatcagcgctggcgcctaagaacgaccaaggatgcggcgtcagccatagtcatggggacgacgaaacacaggaatcggatggttgcgtgcaaagccagggtctagacgagcatggggtgggtggacttcgggcactcactgcagctggtgctcttctcgcggcagtggagccttgctgaaagtcttgttgatctagcagatcagcagtcgatgctggattatggcctgtcgattgcccttgatgccatatggttcttgcggacnaaacgggatcttgaggggctcaacagtctgat

SEQ ID NO: 25651 - DNA, 604 bp, Sorghum bicolor
  Clone ID: 30964532
aaaaaaaccaacaaccacttctgccaagaccaacccaaaccagaaaacacaggtcaccaaacacacaaagcaaggcaagaacaatggcaaaacatagcccccaaatccatgaccaaccactccaagaagaggactacatagacatggatctgagctcaccagcagcatcagaagcagccaccaccaccgcaagcttcctctgctacaacagtcccatggcagcctcgccacaacactcgcgagagtttgaattccacatgtcggctccacctgacctgtgggagcccgtggcatccccagcagatgagctcttctacaagggcaagctgctgccactccatcttccaccacgcatccagatggttgagaagctacttgagagtgcagctgagaagggcttactttcagcaagcactgccccagcaacaccgtaccagtcatgcaatgtatcagcagcaaactcatgttatgccagtggtgagctcgatgcagagtactacttccatgaatgcatatccactggtagtgatgctgccgaggaggaggcagcctgtgagaagaagccatggtccaagaagctcaagttcatcaggcacctcaacct

SEQ ID NO: 25652 - DNA, 640 bp, Sorghum bicolor
  unsure (1)..(640): unsure at all n locations
  Clone ID: 30964535
gtggccgccacacccgctgcagcgcgacaggaggcgcgtgcgccgagccgtggaggagcacgcggcaggcgggagcgccggagggtgccgcccacgcgcccacgcgtggctctccgcccaacccctcctcctcccgcacgcccccaccgccatcctggcccgcggggcaggcgagcccgaccgccgcccaacggaacggcacgagccgttacgtggcccgcgcgggtccccaccgccctcctctttttctgtttctttttctcctcctcggctcctcctcctcctcctcccgccgcccgtcgtcctctccgagaagaagagcagcgaacgacgaccaggaggactccagtcctaaccctaggtccccctagctcaccgccctcccgccgcgagacccaagcccgacaacctcgtcgtcgcgcgcttgcgccgttctgcagtgcaaccctctgcgtcttcgaattgaatccaggtctctgcaggaggagggtggagaggaggaanagggttggaggnttgttggcaggatttgcccagcccaatggttccgtccgagagggggagcgtcgccaccgccgtcagcacgcctgccgccgacaagctgctccatgggcctatctctggcaagaagaagtgcaag

SEQ ID NO: 25653 - DNA, 669 bp, Sorghum bicolor
  unsure (1)..(669): unsure at all n locations
  Clone ID: 30964543
tactggacacgtcattcgcctgacctcccttcctcctccagttaaaccacgccaaaaaccaaacccgctcgcgattccgtgctcctcccactgatccgccccctgccggccgccattcccaccgcgcctcctcgccctcctgcctccgctccccagccgctaccacctcttccgggcggccagccatggacgaggccttcgcgcgcgcggtggaggacggcctcaagctcaccaagcgcctggtcctgcccaacgggggcgggttgccgccgccgcgcccgcacctggcgatggaccgggacaacgaccccgccgcggcgctgctgcagctcatgcccgcgtcccccatggcctacgcggtcgtcgtcgacccgggcgccgtcgacagccccgacgtgcccagctaccagccccacgtgtacggccgcctcgacccgcccgcgctcatcccgctccagatngcgtgaggtcgacctccgcgtcgactgcgccgccgccggctgcgccaccgccgaggtcgccctgcgcgcgcgctggtgggtgcactgcatcacccgcagccgcgcctgccactgccgcatcgtcgtgcccatgggccaccagggttcaattctaggcgctgaggttactgttgggaaaagatcatacaatactcatgtaatcgatata

SEQ ID NO: 25654 - DNA, 678 bp, Sorghum bicolor
  Clone ID: 30964548
gaatagctcacagcacattttgagaatttccagcgtctgtcatttcatcctccctgttactgtttgcctgtttggggttttcctcaaaatatcaccttgtggcctgtggctagacaagtccctgcaccatcccctcatgccggaagcgacggagcactacgtccagccgccggccatgacgacgacgccgctcgcattcgccgtgcgtcggagggaaccggtgctcgtcgggcccgccgcgccgacgccgcgcgagacgaagcgcctgtccgacatcgacgaccaggagacgctgcgcgggcacgtgccgttcctcttcctctaccgcggcggtggcggtgcgcgtgccgacgacggccgcgacccggcgtccgccgtccgccgcgcgctcggcgaggcgctggtcccgtactacccgctcgccgggcggctccgggaggtggaggcgcggaagctcgtcgtcgactgcaccggcgagggtgtcatgttcgtggaggccgacgccgacgtgcggctggcggagctggaggcggcctcatccggcgagctcaggccgccgttcccctgcatggaccagctgctgttcgacgtcgacggatccggtggcgtgctcaactgccccttgcttctcatccaggtgactcggctgctctgcggcggcttcgtcctcgcgctccg

SEQ ID NO: 25655 - DNA, 529 bp, Sorghum bicolor
  Clone ID: 30964557
agtggccatgtcggatccacccacccaccaccaacgccagtagtagcaggcgaggcgatagctgcgacggcgaccccccggtttcggcggcggcggcggcatgaagaacttcctcaggaagctccacatcggcgagggctcgggcgacggagcgtcatcgcctccccctccgccctctcgtgaaggcggtaccggtaccggtggcggtgctggtggggttcatcatcatcaaccgcaccacgatcaaaggcaacagacctcggcggtatccagttggctcgactcggtgcctaccaggcccccgccaccgattcctgtcgaagcggaggtgccgacgtcgtcgtcctcgccgtcgtcggtcgggattggggcagaggataggaaagtgaggcagtccggggcagtcgagaggcggcgatcgcagcaggaggagagggagcggaggaggtcgcaagaggaagagacgttgagggagctgaggcggtcgcgggaggaggagatggggcgggagcgggagcggaggcggtct

SEQ ID NO: 25656 - DNA, 654 bp, Sorghum bicolor
  Clone ID: 30964561
cgcaaagatctctcgctctcttctcccctagtcctcacccgtgtggccgtgtgccgtctccgcgagcaagttctctcttcatccatccatccgtccatccgtcccccgtctcgcttcctgcggcctgtgggtggcggttgtcgatcagcttaccctcccccggccggcgagctctccctgacatggtcggccggatggagcggcagaccgcgtcgtcgtcagcgtcatgctccccctccgccgccgccgccgcctcctcttcctcctcctcggtctgcggcggcaagaagcgccctgatatcctcaacatgatccggaatgcagcctgtcttaattcatcatctactgataccggcaagggaaggggtaaattgtcaaccaacaaagttgcacatggattccacctggtggaaggcaagtccggccatgacgtggaagactaccatgtggcagagtacaagtatgtgaagaaccatgagcttggtctctttgccatttttgatggccatttaggagataaggtgccatgttacctgaaagctaacctttttagcaacataatgaaagagcctctcttctggtctagtcctcaagaagcaataaagaatgcatactgctctacaaacaaatttattctagaaaatgccaaacaac

SEQ ID NO: 25657 - DNA, 235 bp, Sorghum bicolor
  Clone ID: 30964585
ctcattcgcttctgctccaccggtctcgcgcgcgccagctttgctagctgcagcggaagcggccggataagatatggccaatggtggagcggcgtcgcgtggccctcccgacggctcgccggccgcgctggtgcagcagcccctcctccacgcctacgaggcgcgcaaggaggacccggcggcgtgccacggagaggcgcacggcttcggccccgcggagcccgacggcggcgcg

SEQ ID NO: 25658 - DNA, 637 bp, Sorghum bicolor
  Clone ID: 30964614
atcgaagacatggagcctgttgtgttcaggtccatgcttcacttcatctacactgacatggctccggagctcgacggtgacgaggaccctcaggcagcggcgatcatggctcagcacctcctggctgctgctgacaggtatgggctggacaggctcaagctgatatgtgaatgcaagctctctggtggcattggcatcggcacagcagctacgacgttggttcttgccgagcagcaccactgctcgctgctcagagccaagtgcattgagttcatcaccaagtctcctgaaactcttgatgctgtcttggcaacggatggctacgcccatctggtggcaagctgccccttggtgctggctgaactactgagggcggtggcgcatggaaggaagatctgagctggatgatggttttccttgacagtccttgtgtcctaatattagtactatctgcctagtgttgctagttgcttctcatattatggtttccctatgatatatgactgctatatcatgatgaactagtgcttgctgttgatttcccccgtttttgtttgaggtgcttaatttttagtagccgttattgcccttttgtggctttcatgtatgcacacacataacatgggaagctagcttg

SEQ ID NO: 25659 - DNA, 345 bp, Sorghum bicolor
  Clone ID: 30964626
ataaactctcaagtgtcatcacaccgacacacaaatatataagtctagaacaaacaattattatgaaatacatgtgtaaagttcatcagcattgttcatgacgtccggatcaccgtcaatgtctattgcttcctcgttgtccctgtcctcctcatagtgctcatcttcctccttgttattttcctattgcaaagttaattaaaattagatgtagcaactagtacagttaaggatagcaagcaccaagcagtcaataaacatacctcaattttaagtttagccacaacattagtcaaagcatctacctcaagatcagtcacaattgatccaagcattttagaatcg

SEQ ID NO: 25660 - DNA, 647 bp, Sorghum bicolor
  Clone ID: 30964643
atgatttacttgtcacaaacccaaaaacgtatatcagaggctattggcaagaaggcttgcaatgctttgttgctaaaggttaaccagattggtactgtcactgaatcaattcaagctgctctcgattcgaaagctgctggttgaggtgtgatggtcagccacagaagtggtgaaaccgaagacaacttcattgcagatttggctgttggcttagcaagtgggcagattaaaaccggggctccatgccgcagcgagaggctggccaaatataatcagcttctgcggattgaagaggagcttggcaacgtgcgctatgcaggggaggcgttcaggtctccataagaactatacagacttcagaatctgagtaaagcgtaaattatgtgtactatccagtagaaataaaagaactagatcatggccagtcatgctttcatccttgttacgacgagttatcccaattttttgcggatttttttcttgacgcatcttattatctgcgagcatttgctgatttagtcatcatccaggaagaggcttcttgtgcaccgcgcgagtgtgagaaagtgacagctttatatggacatggccattaacaatcatgcttgtaatcgtgcgttatagtcatacaataaggccttgtttac

SEQ ID NO: 25661 - DNA, 575 bp, Sorghum bicolor
  Clone ID: 30964644
cgccaaccgccaacttgagcagacactaagcgggatccttcatcttagtctggaagaagaggagtttgggatcactggggtgccagctcatttgactcctgatgaaaaattcacgctggacgtgctacgtggccgggatctttgtctgacgtcccacaccgatgacacattgtttatatggatattacctgtagcagataagggcttgaacacactatgggagtggcattacgccatccagctctcaggtctttgccgtacaatggctcttcctcctttcagcgacggaatcatcttgtacgatactgaaaatatatgctgctacgacctggcaactctcaagctgagggtattatgcaaattgcgtcacatgaggtaccagggggcacgcaactggaaaaatctcttcaacttcgatgtcgagcccttcacggaaagtcttattcggatcacttaacagccgatcgatcatgagaataacagcttgtgctgcaagtatattatctattttcgtgcttgttgaactgatatgtaataagttgaaagttgtatgcttagctactgaatatatgttt

SEQ ID NO: 25662 - DNA, 716 bp, Sorghum bicolor
  Clone ID: 30964651
gagacggagcaggaggcgacgagcctggtggagttcaccagccagggcaggaacaagacggtccggctgcaggtggagcaggacacggaggtcgtcgtccggtcgtcggagacgcggaaggaggtgggcaaggtggagacggaggccaagtacccgctgtggctggagatggtgacggaggacggcgagaacggcacctacgtgatgcgggcgaacctgacgcactccctgcgcgtcgagacggacgccgaggccgaggggctgttcgatgccgagacgaaggtggcggacgagcaggccgccgtggggtggatgctcgtcagagaccacgacgtgctggacgggtccgccgccacgacgcaggcgtacaggtacagcgacgaggcggggaagtatgagcgcgccatcgatacgctggatggtgcggtgctgagcgacaacgtgacggagagctaccgggccttgggcttggcttggcttgatgctcgagctggacccgcggaagctgccatggaattgtgacgggaagctgtttggagtgacattgctgacgctgctatgcactagctgttcaaccgtgtttttccccgcaacaaattaactttcagctatagcttatcagccaagtgaacagtattattgtggttgagtggctgaggcttcttcagaattgtggtcgagtggctgagacttatcagccaagtctaatcagaatt

SEQ ID NO: 25663 - DNA, 538 bp, Sorghum bicolor
  Clone ID: 30964662
ccaagccgagcccgagctgcagagccatgcgccgccagccagcagcacccagcagcaggctgatcgggacgacgaggaagaggaggttgggctggagctcacgctcgggctggagccgctcgtcaggcagaggcagcagcagcagcagcagcccaaatcttcgcgctgcgacgaccacagcgggttgagcttgagcgccgcatcgagcctcatctgcctgcgcctgcagctgccggcctgagatcgccagctcgccgcatctcgcacatgcctgacaacaattttgggaccatgccgtgtcaggagacaaacaacaaaaaacagacttcttcctaggttttttctttctttttctgtaaaaaaaagggctgctgagcaccgtcctaggatctctttgtttctttgcgtcctgtactactaccttacatgtgatgtgatggtgtctttaatttgttcaaactttttatgtttagctccggctgtcacaaatttttcaatccgttgaagaccaattaaaaacactgagatcgtggtaggt

SEQ ID NO: 25664 - DNA, 613 bp, Sorghum bicolor
  Clone ID: 30964666
gtgttgttgcatcaatagaccatgttaatgcccctttattgtgggacaagaagatggtgcacaaacagttcaagtggagctggtatcatgtcccgacatttgcaccttacaaagtcgaaggcgtgttctacccattgatccttgctagtggtggtcacgcccaaaccacaaaaactgctcttgttgttctgcagagtctgacaccgaatgcacaaagtgttttcagagttcttgctgaatatcagttggcaaatgagaaggaggaaggtatgccagtcaacagtttgtatacaaaatgccgtgagcgctttctggtaagcagtcaagtgacattgaattcacacctgacggagtttaaagaccatgatctggttaagatcaggaagcactctgatgggcaagattgcctccgcattcctcttgtttctgatgcactggagaagttgctgcaagagttggcttgacattttgcattatcactcaagtattgtagttttctctgctacgtgaaactgaaggagcttctccttattaaaggaaaatgtattaccatggaaagaacccagatgagcatgccattctgtaactgtgcatgaattatttataaattgga

SEQ ID NO: 25665 - DNA, 709 bp, Sorghum bicolor
  Clone ID: 30964677
atctcgccccgccagtcgccacagcagcgcaagatgcagcagcgcgcgccgcctctccgcctccccctccatcccctactcctcctcgtcccggccctcgccgaggttcccgaccgctacgcctccccgcgtgcgggctcgggcaccagaacgaggctcagtaatgcgccggcgcaggtgtatcttgaccccacctatccggtcccgcggcccccgccggcggcgccgatctgcgtagtgccggtgctctcctactccttcgccaacacctacggcgcgccccccgcaaaggccacgtacgcgccgccggccgggtgccctgcgccctggtccctcgtcgttctctccttctccgtcgccatcgccggtgaccagtacgaccgcgtcgcggccgtctggctcgacggcgccgagctcctccgcaccaccaccgccgagcccacccccgacggcgtccgctggaccgtccgcaaggacgtcacgcgctactccgcgctgctccggtccccacccggcggcgtgctttctgtcatgctggagaacctcgtcaacgacgtgtacaccggtgtatacaacgtcagcgtgtccttcgagttccacggcgcccctgcttacctcgtcgacgacgcggggtcctcctcagctgccggctctgcggaccccggccaggcgacaccaaaactgccggcatcctacttccagccggcgg

SEQ ID NO: 25666 - DNA, 618 bp, Sorghum bicolor
  Clone ID: 30964686
actagagattggtatggtgtcaagcatacttgcctacaagtttggttcaacttttgcttggattacttcagcttcagttgctacttatattgctttcactttggctgtcacacagtggcggactaagttcaggatggccatgaataaagctgataatgcttctagtacggtggcagttgactctcttctgaattatgagactgtgaaatacttcaacaacgaacaatttgaagttgagaagtatgacaaatatttaaggaaatatgaggatgctgcattgaagacccaaagtagtcttgcctacctgaactttggccaaaacgttatctttagctcggctttatctgcagcaatggttttgagctcatatggaatcatgagtggtgctctgagtgtgggtgatttggtcatggttaatggacttctattccagctttcattgcctctgaacttccttgggagtgtgtatcgagaatctagacaaagcctcattgacatgaagtcgctgtttcagttgcttgaggaaaaacctggaataaaggatgagcctcatgcacaacctttgcagttcaagggagggtgcattgaattcgagaatgttcattttgggtatgtacc

SEQ ID NO: 25667 - DNA, 652 bp, Sorghum bicolor
  Clone ID: 30964687
gacggtccacgtcaccagtggcagtcagtcccctctccttccggcttccgcagtccgctgctcttctttcctggcatcttggagacggcggcgagacgagggggaggactggaccatggctgcctcttcggctctcaggctaatcctgggctcctcgtcggcgtcgcgccgccagattctgtccgagatgggatacaagttcactcttcttagcgcggatatcgacgagaaagcgatcagaaaggagaaaccagaggaactggtggtcgccttggctcatgcgaaagcagatgctatactggagaagatgcagaacaatgggatgatgaaagagattgttgattctcaagagactactctgatgataactgctgaccaagttgtgattcatgatggagtgattagagaaaaacctagcactccagaagaggcacggaaattcatcaaagggtactctgaaagccatgctgcgacgattggatctgtgcttgttacaaatgtgaagactggagctagaagggaaggatgggataaagcagaagtttatttccataaaattcctgatgaagttgtggagagtttgattgaggagggtaacgttttctatgtcgctggtggtctccttgtggagcatcccctaacttcccctctt

SEQ ID NO: 25668 - DNA, 205 bp, Sorghum bicolor
  Clone ID: 30964691
tctctccccgccttcgcctcctcacgccaccaccggcctgctcctcctcctcctcctgctcacctgcaccgccgccagaattgccaccctggcgtccgcgcagccgcagacgcagacgctggcgtcgtcgcacggcaaggctctcctccgagtgcgccgcctgctgctctacccacccgctctccagccgctgcacggggcgcca

SEQ ID NO: 25669 - DNA, 696 bp, Sorghum bicolor
  Clone ID: 30964693
gcctactgtcaatactcaagtctagggtccgccactgatggcaccgagaggcggacgcccagcggctagttccggttctgaggatgaggaagaggaggccgggttctccaggagctacttcctggccaaggagaaggagccatcatctgggaagaagcgcgcccgtgccgccgcgggcaagctctccgacctcaacctcgtcgacgagcacgtgttgcgtgcatcccttgctgagatccctccgaagcacgaggaagaggtggaggctctgactagaagctacaaggaacagtaccacaactggtggttcgaactaagatgtggttttggtctcctgatgtatgggtttggatctaagaagcaattgctggaggattttgcctccactaccttgactgatttcactgtcgttgtaatcaatggctaccttccgtccgtcaatttgaaacaggtcatagcaacaatagctgaaatgttctgggatcaaacaaaagctaaacgcaaaagacagccaggaacaagggcccagttgtcacaacagtttccgtcacaatcaacagaggacatcatctcattcctaatgagacagacatccgatgatgtggattaccctgtttgccttcttattcataatgttgacgggcctgctttgcgtgatactgaatcacaacaatgtctagcacaaatttcttgctg

SEQ ID NO: 25670 - DNA, 677 bp, Sorghum bicolor
  Clone ID: 30964696
ggaagtggacctagaagctgggccacaccttctcccgcatcatcacctccaagccgcccttcgccttctcccggcccaggcccaggcccaggcccacccctcccgtcggtccgcctccccctcctcctccgccgcccgtctcgatcccgccgcagccgccggaggaggagcttcctccccccttcggcttcggcttcgcccccaccaccaccaccaccatgccgcaccacggcagccaccgcccgccggcgcatgccccgggtggccccgtgttcccgcgcgccacgtccacggtggtgcccgacccgtcccgcttcttcgcgccgcagctcctcgccgcgccgctccccaccaactccttcttccagaacttcgtgctcaagaacggggaccagccggagtacatccacccctactccgtccgctcccccggcggcgccgcgctcgacgtctgctacccgacgcggaaccactcgccgtccttcgtcatccagacgttcgttccggacctcaccgtctccgacgccgccgggaccgcggcgcagcgccaccacgtctcggccttcgacgacctctccgtcacgctcgacgtctccccgtccctccgcgcgcacctcgtccgcggatgcccctacgtcactgtcaccaccacggcgggacccgtcgacatctccgtc

SEQ ID NO: 25671 - DNA, 685 bp, Sorghum bicolor
  unsure (1)..(685): unsure at all n locations
  Clone ID: 30964702
gctcccaccctcctgtctcctctccccttccgtcccctcttctcccctagaacccagacgatggtggcgccccttacgcacggcgagcagcgcgagctgcacacagcctgaagtgctcatctcggacggtgctagtcgatctcatggctggtgcccgagggcgctcgtcccatggtggccaaggcagcagccagcacgggcggcagctcggcgtgcgcggaggtggcgacatcgtttcggatccagccatggccggcagcaacggaagctgaggcagaatggatccggccgtcagcgtcacggatccggccgacaccagcaccatggatccggccgtcagcgtcacggatccggccgtcagcgtcgcatccagcgcggcccgtccgtggcatctccctcaagccgcaggaggaggagcacgagcgccgcaccatggcctcgacggagaagttggcgctcgaggtcgaggagatttgcagtggttgctacgtcggctcgcttcaacgatggccacagtaatagtgttgtggccgcattcatcaacggtcgaggccatggcagagccttgctggtgctggatctgatncggatgcagccggcggtagttttcctatcgctcctccatttaggcgctgctttactgaaatctaaatccctgactatgatttgcattctgtttcataca

SEQ ID NO: 25672 - DNA, 353 bp, Sorghum bicolor
  Clone ID: 30964735
gtccccgcacccttcgctccaccggaacaccatccgtcgccctccccactccagcccgagaccattttgctacctgacacaccccgccggtggttccacatcccagtagtcgctcttctcggtgcagaggcctgcactatatgtggagaaggccaaggatggtggcgcatgggttggggcggaggcggcctggcggtggagacaaagccgctcgccggcaagccgttggtgacactctgcttagggtggaagcaacctgctcccgggcttgccacatgtgctgtgcgggcctcttgaatctcgatccatggcttctcgggcaaaggaggttcctgtccgaggatagagagcag

SEQ ID NO: 25673 - DNA, 604 bp, Sorghum bicolor
  Clone ID: 30964747
tcctccaggctcacaccacacgccggtgacggtcagcctgccggtctctcgtgcccgttcgctcgcgtccgtgcatccatccgtcacacacaccagccctcgcggccgtgtccgtccgttcggcatcgtccatttgggttagttcgggagtagcagactagctagcagcagcaatggcgctggaggccgtggtgttctcccagccccaggcggcgggccacttcggctacgcgatgccgtggtgcgacctgcagctgctacagggaggagggaggaggaggagggtttggcgatctctgcgccgccgcgggggagtgggaccacgacctcgacacctgctgggccgcgcccaccatggccgccgtgggcggggacgactgggactgggaggcgctgtcccgggaccagtcctccgacgcctccacggaccacggcaacagcaggaagggcggcggcggcgcccgagccggaggcggccgccgcggggaggaggaagcggaggcgcaccaatgtcgtcaagaacaatgaggagatcgagagccagcgtatgacccacattgccgtcgagcgcaaccgccgccgccaggtgaacgagtacctcgcc

SEQ ID NO: 25674 - DNA, 724 bp, Sorghum bicolor
  Clone ID: 30964754
ctccgcccaactaacaaacgcgacgacctctacctcgccgccgccgccgccgtcaccgccgccatataagtggaccctcgtctcgtcctcctcccagactctccaccctccgcctccgaacacatggcccacccgcggctcgtgctctcctccccgaagccccttctccccgccgccgctaccgccattccatcgcgccgcgccgtcgccgtccgcgcggcgctctccaccgcttcgccgcccgccaaggcggcggcgggagcggaggcggtgcggtcgatccgcgcgcggcagatcgtggacagccgcgggaaccccaccgtcgaggtcgacctcgtcgccggggacggacgcctccaccgctccgcggtgcccagcggggcgtccacggggatctacgaggcgctcgagctccgcgacggcgacaaggccgtgtacggcgggaagggcgtgctccaagccgtgcgtaacatcaacgaggtcatcgcgcccaagctcgtgggcgtcgatgtgaggaaccagagcgatgttgatgcaatcatgctagacatcgatggaactgagaataaatcgaagttgggtgccaatgctattcttggagtctccttgagtgtatgtagggctggcgctggtgcaaagggagttcctttgtataaacatattcaggagctagcgggaattaaggagcttgtcatgcctgtccctgctttcaatgtaataaatg

SEQ ID NO: 25675 - DNA, 332 bp, Sorghum bicolor
  Clone ID: 30964755
gaaggccaaagagcccactgcgatccccttcacacctccttctccccgcgccgtacgcagcaccgagcacccccgcggccggcttctgcacgcagcaacccccaccgccgcatcaagcaatcccccgcggcttctgcaatctggtccccccccacccccccgggtcgcccctaacacccacggcagaggtgttgagcgcggcggccacaagcggcgggcggcggccgcctcctgcggacgggcaggtggatgacccttctcttcgagttcgcggccaccgcctgtggctggatccgttgtccgccgccgggaacgggtagggtacactggct

SEQ ID NO: 25676 - DNA, 686 bp, Sorghum bicolor
  Clone ID: 30964764
gaagttaaggtgtagaatgtgctttacatattcggatttgttaggaatgttgtggtgtggatgtggaaggtgttggtgtcgtttcacctaaagacatggaagggtactcaatggcaagcagatcaggttcttgcttctaggttgacaacacatttgaagccactgccacccttcacagatacctctgctacggtactcgatcgcgccggtggcggcggcgacgcctggtctcgcgggtgggagcggcggtgcatggccctgcgaatggcggcggtcgcacgcgggcgagcgagatccggtgcgggcaagggggatcaggcttgggcgagatcaggattgggtgcgggcggtggagcaggcatggggatgtgcgagccgcggggacctagggcacgcttcggcgatttctccatctatttttttcacactgctgagttcatcagtctgggaagggaacgagaggtttgggccttcatcaggtcagtggcaggggcacaactgtgactctccttccaaagtaacatggacacacacgtattacataacggtgatggcattgaaggaaaaaaactatgtaattagatggcagttaagaaaagaaaatacatatatgtaatggtgatggcagttgaggaaacaaaaaaaccaaattaatggccgataaggaaagctattattttttaggc

SEQ ID NO: 25677 - DNA, 514 bp, Sorghum bicolor
  Clone ID: 30964774
tggtcggcaacaaggtgccgctgtacggcggcggcccgacgctgacggcggcgccggcggccggcggcaagggggcgcaggcgaccaccaccacggtggcgtcggtgcccatggtgctgaggacgacgctgcactcgcgggcctacgtgctgggcgcgctggtgaagcccaagttcaccctcgccgtcgagtgcagagtggtcatgaaccccagcaagcagaacaagccaatctccctcgagaaggcctgccactactcataattaattacattgagctgttccttctccctcttcttcattcttcgtctccccttctcagctgctcaacaacacaggaaactatcatgcatatccttgctccacatcgccatggccacgcatctcccaattgtactgtaatggagtatttatttctttctttttgccaattctttctcttctcttctcttctcttctcttctcttctcttctcttcggtgtattattaattcttcttcattttgtggatcatc

SEQ ID NO: 25678 - DNA, 643 bp, Sorghum bicolor
  Clone ID: 30964775
aagaaggtgtattcggcgaaagctcgatttttggacattggtcagattcatcacatctccatagagggcgacacggcaggggcgagggatcccagcttagagattaggattggcaagaagaaagtgttgcaggtgaagaggctggcatggaaattcagagggaaccagactatctatgtcgatggacttccagtggaggtgctctgggatgtgcatgactggctatttggttcctcgaatggatgcgccgtgtttttgtttcagtcaggccactccatggaaaaatccttgttcagaacatgctcacagaatgaaaaggaggctcaagcacatcgttttggtttcacattgatactaaaagcgtggaagactgagtaagcactaggcagaaacatgatggcaggtttcttcaactactctgctctgaatgttgaatagtaacagtaggaatctaggatctagcaagtctaacaaggccctttgcaagaattctgtgcttgttacatatgttgttctagcgtagttgacaagctgagattttgaatatgcatatgatctttgatatgtcatcaaagcaatttagataggacgtgggactctggtgctcaggtcatttaacataatgtctcacgactacattttg

SEQ ID NO: 25679 - DNA, 579 bp, Sorghum bicolor
  Clone ID: 30964804
cgcggcgtgcgcgcgctgtgcccgcgcgtggtgacgctcgtagagcaggagctcaacgccaacacggcgcctctggcggcgcggttcgccgacgcgtgcgcgcactacggcgcggtgctggagtcgctggacgcgaccctggcccgtgacagcgcgcagagggcccgcggcgaggcggccctggcgaacaaggcggccaacgccgtggcgcgggagggccccgaccgggtggagcggtgcgaggtgttcggcaagtggcgcgcacggttcggcatggcggggctgcggcccgtggcgattgggcagggcatcgccgaccgcgtcaaggcacggctacgtccggggttcgacgtgaagctcgacagcggccggctcggggtcggctggaaggggcgcgtggtcaccgtcgcctccgcctggcgttaagcgtagcacgcctggtgacgatgagctcatcagctcccggttacagcattgttaccaccaccagtccatcagagtacatcaggaacagccgttgtgcatccaagaccttgtaataatctctctaaattctttacggccaatggtagttgaata

SEQ ID NO: 25680 - DNA, 673 bp, Sorghum bicolor
  Clone ID: 30964809
atcagctggaaaacaaaattgcaataatcataaggattccccgtcttttgtaagaggtgcagtgccatgcagccacacagcaagcactccaactggtttagaggaggaggttaattcaaacaaaatcgttgacaatggaagtaaagtgaggccaatcctgccaggggtattgctttcttgtcatgacatcaatagccaagagaggcatccatcatctaatgctcctcaatcatacttacctgctgcaaatggtcgaccactggagactatagagtttggatctttgggaccttttgcactgcctttatccacattgaaatcaaacggagctactaacacacaaactacaagtaaggtgtttacagatgcctctccatttgtgttacagaggtccagggcttcagcaactgaaaacaggcccccgggactttgcaaagtgggagacgaggatgaattcccacctcttagagctgggatccggtgagaacttatatataggtcatacagacggatacaactgatcatagagttagcaaaaggagctgaccagttgagctttgtgcagaattttcttgggcgcatagatatgaggattgcagtgacatagtagcctataatcctataccctgtaaaatctcgtcggcaccttatcaatctctgtctttttttcccc

SEQ ID NO: 25681 - DNA, 614 bp, Sorghum bicolor
  Clone ID: 30964814
gagataaaagaacaaaggcactgggatattacatctggtgagagattaaatattcttaaagattttgtgcgttttggtctggaacattggggctctgattccaaaggagttgaaacaacacgccatttcctactggaatggcttagttacacctgtcgctacattccggtgggtctgctggatgtcattccacaacgattgaactggaggcctccaagctactatgggcgtgatgacctcgaaaccctgatggtctctgattcagcagctgactggataaggatctcagagatgttacttggcaaagttccagaaggatttacctttgcaccgaaacacaaatccaatgcctatgaccgagcagaaaacggttaaacctttgtttgtcagggcaggaacccaacaacaccaagggtgggttctcttgaggatcagagacaactactgaggtccatccatggtgcttgaatccatcatgtagcatgattttattttagccaaatggcaattgtaccaatagtttaagtataaactatagaatactacaataattgaaaggcatcccaattctctccatttagaaacgataacatctgatatatgaacgtacgttc

SEQ ID NO: 25682 - DNA, 628 bp, Sorghum bicolor
  Clone ID: 30964834
agctcagaaggccttgtcttgtctgcttgccccttgagttctctagcaccttacctgctactgatctgcagctgatcgatcgccaaagcttgcaatcaagcctgctatattaccctagctagtgactataccaccatcatcgccatgggctgctacggtgatttcttcgagaaggccaagccttacatcgccatgacctccctgcagtttggctacgccggcatgaacgttatcaccaaggtgtccctcaaccacggcatgagccactacgtgctcgtcgtctaccgccacgccttcgccaccatctctattgcaccatttgctctcatccttgagaggaaggtgaggcccaagatgacgtggtcggtcttcctccagatcttcgtactcgcactgctcgggcctgtgatagaccagaacttctactacgccggtctcaagttcaccgggccgactttcgcgtgcgccatgagcaacatccttccagccatgaccttcgtgatggccgtgatttttaggatggagaaggtggacctgaagaaggtgaggtgccaggcgaaggtggccgggacgctggtgaccgtggccggcgcgatgatgatgacgctgtacaagggcccgctgatga

SEQ ID NO: 25683 - DNA, 633 bp, Sorghum bicolor
  Clone ID: 30964843
agggttttaagctttcttcccttccgctgcaacgccgctcttccccgttcctcaaactgcaatttcgggttagggtttagctttaggttcttcgggtagtgtgaaggtacatttcgccaattttaggcgaaatcggcggcggtcggagtgacccggggctcccgcttccgctcagttcggggacgaaggcctctgatgttcgagcccgcttacgtccccgtcgcttcgccgcactgaagaaaaccgcgatggccggcgccgccgtcaagcgggcccgcgcgggcggtggttcgatcagcgaccggcttagcgccctgccggacgagctcctcctccgcgtcctcaccttcctcccggcgcagcaggtcgtgcgtaccacactaccaccgtgctgtccaagaggtggagggatctatggcgttccgtgcctggcatcaacctcagtctctcggatttcggaagaaactccggagaggactggacggcggtttgggaaaggatggaggatttcgtcaacaacctgctgatgttacacagagctccatgcctggatgcgttccggttggtcacgatcctcgtcgacacatcgatagatgggtccgtcgtgccattaaggacaaccccttaatgctc

SEQ ID NO: 25684 - DNA, 636 bp, Sorghum bicolor
  Clone ID: 30964856
acagttctcctgcctccctcccccttcccctcccccaacgtgccgtctagggtttcgcagacgcaccccgatccactcgagcgccccgccccgctccgcctccatggagttcgacgagtacgagtacctggagaaggcagtggagccagctgctccgccggccaatggctccggcgagaaggaccgaggatcgcgccgccgcgagggcggcgaggaccgcatatcgaagcgttcccgctcgggggaggaccgcgaccgggaccgggaccggcaccgcagcggccgggagcaccgcgaccgggatagggatgacgggaaggagaaggagaggagccgcgacagccgcgggaaggatagggacagggaagggagagaacgagagaaggataggggggacagacaccggctcacggagagggaagtggaacgggagcggaggagccggagccgctcggagcggcgccgtgccgaggaagaggagatggtgagggagctggagcgggagcgcgagcgcagcgagcgacacctctttcgcggtgacgtcaggcgtacgaaagatgatggggcagagccagaagttgatccataaagggaccagaggacagtatttgccttccagctatctttgaaggcaga

SEQ ID NO: 25685 - DNA, 624 bp, Sorghum bicolor
  Clone ID: 30964865
gatttcggcgtggatttgttcccgccgcagtcggaggaatgcgtggccggtctggtggagaaggagcgggaacacatgccgaggtccgactacggcgagaggctgcgcggcggcggcggcgacggcatcgatctctgcgtccgccgggaagccatcgactggatttggaaggtttacacatactacaactttcgtcctctcactgcctacttggcagtgaactatcttgatcgtttcctctcacggtacgagctgccggacggcaaggactggatgacacaactcctctcggtggcgtgcgtttctctagccgccaagatggaggaaactgccgtccctcaatctctggaccttcaggtcggagatgcgcgctatgtgtttgaggccaagacgatccagagaatggagctccttgttctgagcaccctcaattggaggatgcaggccgtgacacctttctcctacatggattacttcctaaacaagctcaatggtggcaacgcggcgccaagaagctggttctttcaatccgcagagcttatcctctgtgcagccagaggaacctgctgcatagggtttaggccgtctgagatcgccgcggcagttgcggcagccgtggtcgtc

SEQ ID NO: 25686 - DNA, 606 bp, Sorghum bicolor
  Clone ID: 30964868
gtctgagccccgacccgcgcagccgcaccgcacccctactctgacgccgcccatgtccgccgcaccggcggccgcggccgcggccccgccccgccgcgtggtcatctgcggcggcggcgtggtgggcgcgtgcacggcctacttcctctccacccacgccgggtcccccaccgtcccgacgctcatcgaaaagtgcgccccggcgtgcgccgcctcggggaaagccggcgggttcctggcgctcgactggtgcgactccacccaggcgctgtccagcctcgcgcgggcctccttcgcgctccaccgccgcctcgccgacgccctcggcggcgccgacgcctacggcttccgccccgtccacaccctctccgtcctgctgcccacgcaccccgggcccgcccccgctagttcgccgcacccgcggctcccgccctgggtcgacccctccgcgtccgcggccccgccgagggagctcgggaccccggacaccaccgcgcaggtccacccgggcctcttcaccaaggccgtcctcgccgcgtcgggcgccgaggtcgtcatcggcgaggtggagcgcgtcgtggcccgggacggccgcgtcgccggcgt

SEQ ID NO: 25687 - DNA, 649 bp, Sorghum bicolor
  Clone ID: 30964876
agcaagcccctgctcctcctcctcccctctcctctgcaggccgtgcagccgcctgcctgcctctgcctgccgctgctgctcctcccctcccctcgcatttaccactcacccgctcaccttcttcccctcccttcccttccatctcctcgctcggatcctcctcgacgcggcactcaaccgccgcccggctctcggcgtcgcatgccctccgagccgccgcccgcaatctgcccgttccgtgcttcctcctcccctgctactccgccgctgctcgccgccgtcaaccactcgagtcgaggagatgcagatcggaggctgtaacgggaaggagagaaaaggtggagatcaaaaggcagcattgaagaagaagaaactaaaggctaagaccttcaagtggagatcaagcaacggcgacatgaacaacaaggtagaggcggggggatctgatcaggtctgtgatgatgcagtactctgctcactgtctacagccagcttcggcggtctggttagttggaaaagagtgaggacccttgggaaggtgactgagcagtgtgatgctgtcgatccaccagttccaagaaaattaagatcagccataaacaagcgagctggtcgatttgcttctacatcaccacgtcatgtcaaaaag

SEQ ID NO: 25688 - DNA, 644 bp, Sorghum bicolor
  Clone ID: 30964879
aatcccagcaagaaagcaagtctgcctcacccactcacaccactcactcattgttccacaccaagatccaagagcaagacaagtccacaagcaaacagagtagggggcaagaactccctcaccaccatggcgtcctacgacaaggccttcgagtcctacaagaaggccctcaccacagcggcgtccgtcgccgcgtccatgatgctggtgcgcagcgtggtgaacgatgtggtgccacccgagctgcgagatctgctcttctctggctttggctacctgcgctcacgcacatcgtcggaccacaccatcatcgtcgagaagaagaacgacgggttcgccaacaactacgtctacagcgctgtgaagacttacctcgccacgcgcatgaacaccgacatccagcagcgcctgcgtgtcagcagcatggacgagaacgacaagatgatggtcagcatggatgagggcgacgagatgctggatgtttatgaaggcacggagttcaagtggtgccttgtctgtaaagagaactcaaatgactccctcaacggcagtcagaacgagtcccagttcttcgagttgaccttcaacaagaagcacaaggacaaagccctcagatcatacctcccattcattttggcgacagc

SEQ ID NO: 25689 - DNA, 664 bp, Sorghum bicolor
  Clone ID: 30964883
atcgagtcggccttgttggcctactgagccgtgaccccgactccctccgcgcttcctgttcgtgcgcggctcccatgcccgagagggcgacgcgccgccatccgcagccaggggagctcgccgagcggcgccatctctcctcccccggcagtgcctgatcgccgaggctccctcccccatcccccgccgagcctccctcccccatctcccgtcagtgcctgccgcagaagggtgccaaaatccccaaccctaaccctaaaggagacaaaggggaagaagaagagtgcctccacctctctcgccgttgaaggagtagaagggtgacgtccccagcaagctccatcaatcctacaagatgtcttcaagtgagaatggtgacagcagcgatgatgatgaacaatttttttctctcattcaaggttgtgctaaactagcagaagcttatgtgtttaattatatggacaaggcaccaccaagaacctcacagttgagtggaatgggatgggtgattgagactctaaacactccaggagaatgcaacacaatgcttcggttgaaccagtacatctttttggatcttcatgataagttggaacaagtaagattcattggtaagaccggaattccaactcaaaatgtgcttgccatttgtgattttgatatg

SEQ ID NO: 25690 - DNA, 416 bp, Sorghum bicolor
  Clone ID: 30964887
tccgaagataagatgccgggttgttggtgcatattttgagaaactaggttcaaaatcttttgcagtttattctatcgcggtgactgatgcggataacaaggcctggtttgtgaaaagaagataccggaattttgaacgtcttcatcgacaactgaaggagatacctaattattcattacatctgcctccaaagagttttctttcatctagtgttgatgattaccttgtgcaccaacgatgcattctcctggacaaatatcttcaagatctcttgtctatagctaatattgcagaacagcatgaagtttgggatttcctgagtgcatcctcaaagaattactccgctggaaagtccacctctgttatgaaaaccttggctgttaatgtggatgatgcaatggatgacattgttcgac

SEQ ID NO: 25691 - DNA, 669 bp, Sorghum bicolor
  Clone ID: 30964888
cctcctccctgctcgtcgctggccgtcccgatcctccgtcctcgctcctccaaagccccgctctctccctccctcccttaattgccgcgctcaatcccactcaccaaccttcccccctcttggttcgttggagcagcagcagcagcagtggtagccgcgcggcacttgcaagcaaagctcccggtccaggctgcttgcttgctttgctttgctttcttgtgccgcggtgcggcggtcggtgcatgggagcacggctttgttgagagggaaaggaaggagaaaggcgcgcgcgcagaagcccagccgcgcccggccggccgcgggagacagaggggagcagggaggatgaagttcatgaagctgggctccaagcccgatgccttccagtccgacggcgccgacgtccgatatgtggtctctgaccttgcaacagatgttgtggtgcatgttggccaagtaaaattttacttacacaagtttcccctcctttccaagagcagcaagcttcaaagattagttcttaaggccgctgaggaggtgactgatgaggttcgcatagatgaccttcctgggggagcaaaatcatttgaaatatgtgccaagttctgctatgggatggtggtcaccctcagtccacacaatgttgtagcagcaagatgtgcagcggag

SEQ ID NO: 25692 - DNA, 660 bp, Sorghum bicolor
  Clone ID: 30964891
atactgcaccgcaccacgcgctgtcggccaagcttatctcttccctctccccctcgcagcctcccacaccactgaaacttttttttctaaaaaaaacccaccctccccaatctcgccgctctcacccgcaacctccggattccttcggccgatccgcaacctcgccgtcgcagctgcactccggcgactcccctctgccaacatcgtcttgcgccaggccacggtaccagggagcacgggctgttcccccgccgccgccgccgaggaccatctgaaagcgcaggggcaagcacggcgttcgatccgacccacagaaactcgccgcccacgctatcggcaaacatacaggtgatcctttgatgacaggcggcaagggggcacatgggggtagccggttcattcgtcacatgcggatgaagcatgccttggggctcccatatagctataagatgtggcccgcaaagcggatgcgcggccgggatcgtcgtcgtggtacttggtgggaccgcaagcggaactgcatagccatcgaaggagtggactttgctcaagatacacaggaagggggtgcagatgaatttgagttgatacctgattcggatgaagaaggagttgctaagggttcatctttgcttggtgatgacgatgagtacgtacctg

SEQ ID NO: 25693 - DNA, 666 bp, Sorghum bicolor
  Clone ID: 30964908
aagctctcttccccttcccacctcgttcccctcgacctctccacatcctggtgctgcacgccccacggtctcggcggccacgccccagccctatcctcctcctcctccccggcccgcgccgccgcgcaccccatggagcccccgcccgccagctcctccgcgacctcctcctacgccactccgccgcagccttcctacgcgccgtcctcctacccctccagctacaccaagttcaactccgcgctcaacgcggggctgctcaaccccatgtccccgccgccgctgccgctcgacaagacgcgctccagccccaccctcttcgacatgatggccaacgagcaggactaccacccccgctccgccgccgccgccgccggcgtccactccatccccgccccgccgcaccagccgcaccaccagctccagcccgtgcgctccatggacaggcagatgctgctccaggaccgcatcgccgacctcatcggcagctgtagccccgggaaccagttcaacgacgccgactcctccgacgtccgcctcaccctcagctccaaggacggcctctccgtcacgctctgcgtccaccgccacatactcgtcgcgcacagcaggttcttcgccgcgaagctctccgaccgctggtccaagcagcagcggacgctgccg

SEQ ID NO: 25694 - DNA, 679 bp, Sorghum bicolor
  Clone ID: 30964916
tgttgagcgccagatcgcagaggagttcttgaggacatgggcaatgcagactgagttagcggcaatgcatcgtaaagtgccagcaatacaccgctacgaagtgagccgagtgacggcaagactctttgttggggttggcaaggggcagatcttggtgtccaaggaggcccgctgccagctcttgagcacctggctagagcccttctatgaggactttggatggatgcggcgggcatgcaaggggcttgatcggcgtttgatcgaggatgggctggcaaacacaatcctgacactgcctcttgcaactcagcaggagattcttctggcatggtttaatcgcttcctcaactctggggaggattgcccaaacattcagagagggtttgaggtgtggtggcggcgtcccttctggaaaaggaactctgaaccagaactgccatcccgtttgaggattactgcaatctgtgagaactcttgatgatgatgatgatgatccatatttgacatggaatgtggtggatgttgtgatataaatattgattttatgtgatgtagtagtgcctaactgtttctcagttttttttttggtatgcttgtttaggcagttagtcaattacacatgttatcatgatcctgttttaacgcaatgtataccagatccagtgtattgctatgccgc

SEQ ID NO: 25695 - DNA, 682 bp, Sorghum bicolor
  Clone ID: 30964921
ccatgcaatggcagtggatgctcaattctttccgcatcctccagaaggcaagtactatgttgtggatgcgggctatcctaatcgtccaggctacctatctccatacaagggcgaaagatatcatttaccagagtggcatcgaggtatagaaccaaatactccaaaagaaaagttcaaccggatacattcatctgttcgtaatgttgttgaacgttcatttggactaccgaagatgaagtggcaaattctttataagatgccttccttttccatgctcacacaaaagaaggtagtggctgctaccatggtgatccacaatttcatacgtgagcatgctagtggggatgtggactttgctaaatttgatcgagatccgaactttgtgccaactatcccagcaagatacaacaaatatgccgtgtctcgccatgcttctgatacatcaactacggaagcaagctttgtgactatggacacatttcgtgatagtttggctacatccatcgcattagcttggaattaatgtaattatgttctcaactatggacttgtatctcagattatttggttggacttgtatgtcgaattgtttgctttgatggatttttcgaattatttaggaattattattttggattatcttgtaaggtgttggaactttaattcaattcacaaggtttat

SEQ ID NO: 25696 - DNA, 591 bp, Sorghum bicolor
  Clone ID: 30964938
tccagcagctgagggctggctcaagcaaagaactcgccctgattgacaatggagaacaagcttgcacacggcctatggaggatcaatgtgacccctgtgaaaggcggataccaaaacatccaaactcactaaataagcaggtgacaagcctgagcgcgagggagagccagcaccaccggattagccagcacaggggcggaaggaacagctttaaggaccagattgggggcatcctgctgcagtcgcgatccaggaggatctttgacaagctgtggagcagcaaggggcagggcgagcatggcggcaaaggctcagagacgtctggtagctcgcagagcccaccgttgtcagcaaagcctgcagaagtgaagccctcccctcttccccctcttaggaacaggcggtactctgtttcttagagggtttttccccctcctagtttagagctctggtttaggttgttgtacagaaggaaggtaatcagctgctgctcatcctctttttgtaagcaggtcaatctgctgttctctatgtgatcatccatgctgtagcttttactgtagtggcagatcaatctgctgttctctatgg

SEQ ID NO: 25697 - DNA, 633 bp, Sorghum bicolor
  Clone ID: 30964955
cgatgatgcattgttgcagtgaccggtcaaagtgcgtgcccaatgagcagagtgaactgactaggactagtctagtctgcttttgattttctttttttaccgcgccaagaaaggtcaaatggctcccgattgcaacggaggtggtggttgtgctgtgtgagatggatgtgcattgagaggcgaaaagggaggggattttgacatgacgagaggagtctgggcaagagcaagaagttgatgaataaagatgtgaggtggacaacccctaaattgctgagcttttctttgcaaggcccggaggagaggagggagacagacaggcagccccaagcttggtgtgccacaaagggcgccccatggctttgtgggaacacaaagctggaggagatcgatgaatgagatgatcagaataaaggtggtgaagggcctggagggaccaggccgtaggcaatatgtaggagaactaggcactgacctgcctatctttgagtattatctgataaattgctttagtagtttctagtattttttttttatttttcagtttcattgtgaagagaaaaatgtaggagaggagaaatgtatttgtgacccaaaaaaaagttgatccagatgaataaattatgaggctaa

SEQ ID NO: 25698 - DNA, 669 bp, Sorghum bicolor
  Clone ID: 30964978
acatgatattgttagtatagccactatgggcatgaagaagttttgtgtatccatgttcgcttgtggtgtctaattatataagtttgtgggaccatttcatttgcatgtaaagataaagagcagtgtcacatttccagggataatacataggaaactaatgcattggctcatggatatgttttgtcaaaacaataatgtgtgggcttttctctgccaaaaatgaatgtttcagctgttaacagtatatcttactattggggtttattttgttatagtagtttttacttacatgcttctttggtttgtagggctgggcacatctattgatagttcagctgctatcaatgtgcctaaaaattgcctagaagtattgattgcttctcaggtgtcctctgcttgctcatagagattgtcaatatgcatgttattggttatcccatacttgtgtttttccatggtcggacaaagtaggcatattatgtctgcttcctcttttcttggattaaagctaagctaagcagtttttagtggtactagatagacaatgttctaatcattttagtgacatgggctccaatatcagcctatccaacaaactttgttcctttttttcctttccagctaattaccttttttttgtgtgtgtatggtttttttgggggggagtcc

SEQ ID NO: 25699 - DNA, 544 bp, Sorghum bicolor
  Clone ID: 30964985
tgcaaaactaaagatgcttgaggtaaaaaagatatccttgtatgcagcaagttctgctgttagagaaattcagagaataacccttgatcccaagttcaatcttgattctagtttcgaggatcaaaatttgactagggcggtttcagagaacttggcaagagtaaccaagcagaaggtatcttgcagttgagattctggggtctcgtgaaattctaacatgccattcagaggattgaaaccgacgcggaagtagatatagtgattgtccatgtattgtattgtgtcatatgaaaggaacccattctaattcttattgggttacacattgactttccctgtatattgtgggttaggaagagtaccagttaagctcatgtagaacaagataaaaaggccccgaaagctgattccagtactgagttctagcttggggaattgttagtacaataatctctatccctattggtaacatctgaccagtaattggcccgaaattggtaacccccagggttaaagattcgaatactgagttttcaccatggtt

SEQ ID NO: 25700 - DNA, 664 bp, Sorghum bicolor
  unsure (1)..(664): unsure at all n locations
  Clone ID: 30965002
atcccgtagcccgcctcggtgcgccgccgccacgcctccgctccaccatggcagcgaccgcgccggccaccgacccaccggatgcctcgcctgcggtcacagaggatgctcccactcctgctcgtcccaccccggcggagctggtagcccgcgccgtcgcccccgtgaagcccgccttccttcgcccgcctcccgtccgcgaggcacccaaggaggagggcggcggcggcggcgccgtcgtaaaggtggagaagaagtccaagcgccagctcaagcgcgagcgccaccaggaacaaaagtctacttctcatctttgtatccaagtagggaaaagtggaaatgtggactcatgcaaatacggcacttcttgtcgtttcagccatgacataaatgcttatttgtctcagaaaccagctgaccttgaaggcacatacccctgatcctcanaatcatccagaaggaaaccatgagagaaatcctttgagcaaagaaattcaaaagctcttatggaagagcaaatataaatttcccaaggccagtgcccaaatcaaacttcttggtcttaaggatggaaacaagaataaagcagaagcagcaaatgataatccagatgaaacatgtgagctgaatggtgatgagaaaacgtctctttctagcattcctg

SEQ ID NO: 25701 - DNA, 613 bp, Sorghum bicolor
  Clone ID: 30965008
actccgcggtccgcgccctccgctttcgttttttccccctccccctcccctccactaccgccgccgccggccgagtcccgtggcgacatcctgagccggagcgccgtagctcctccggattcgagacaccgagcgcaccccgagctctatctgtagtgtttggagctgaaaatgagtgaggcaaatactactcagcttgaccttgagaaaggattttctcaagtgtctaatgataatgattcaagtagccctgcaactgtgcataagatgaaagctgagacagaagatggtggaagtgaaatcgaatcacccactccagaaaaacgtgaatctagaagcaaaggggttgttgtgagttcactggcaaggaatttgcttgcagagaggtacaaagacagatttgcatatcagctggtggaagatgagggtgagacagatgaagaagactataatgaaagtgtttcgcctagtggtaggcgatctctttttccagaaagcattgaacttcttgagaaacacaaggatttgctgaatcttttcaatagaatggagagttctataagattgcttcacctacggaagaagatggctacatttaataatattgccaccc

SEQ ID NO: 25702 - DNA, 625 bp, Sorghum bicolor
  Clone ID: 30965009
ctggcgggatctgtgcactctgcttccttgagctggttgatcgtaaagttggaaaaaaccatctatttaagaggagcatcatattgatcaaggcatggtgctattatgaaagtcgcctactaggagctcatcatggacttatatcaacctatgcactggaagtacttatcctttacatattcaatctattccacaaatctctccacagccctctggaggttctttataggtttctggaatattttagcaagtttgactgggacaactattgcataagtttaaatggccctgttgctttgtcgtctttgccaaacttaactgttgaagctacaattacacataccagtgacttattgtttgacaaagaattcctcaagagctccatggataaagcaactgtacctccaaaaaattctgattcatgctatacgaggtttcgtcctaaacatctaaacatagttgatccactgaaggagcacaacaatcttggcagaagtgtcaacagagctagctttaatcgtattcgaacagctttcttatatggtgctcgaaagcttggtcatattctcatgttaccatcagaagttattcctgatgaaatttatgggtttttcaaaaacacttt

SEQ ID NO: 25703 - DNA, 654 bp, Sorghum bicolor
  Clone ID: 30965012
acccgtcctcttgtcatccttctctctcgtctcgcgctttccctgcctgctcccgtgcggcggtgtctacgcagctcttgctttgctctgggcttctccggcggcatggaccccgctggcgcgccgtggtgcgaccctcgccgtgggtacgcctacgcctacggcgccggatcggccgcgcaggcgccggcgctgaagaggcaaccgcggccgctgctgccgccgcgacaggacgttgcggccgtggcgagcggcggggtgcttaagaggagccatggcgaggtggagaggtggcagcaggcgctgtacctgcgcgaggtgaggcagcgcgtcgcggcgcagtcgcagatcgcgcacccgccgatcgacatcgggtccgtcctggcgggggccgtcgtctcgcgggccccgggttcctccaggccgccttcgtcgggctttgccggcctctcgccgcagccgtcgtcgacgctgtcgtcgctcaccaccgcgtcgcacttggagacgccgccgtcgcatatgctgccgctgttgcagcggcagatggtgtccgcgcctccgcaggccgtggccagggtgccggctgcgggtcgctccgcggccagagagctggtgctgttgcaggagctggagaagcacctactcggcgacgac

SEQ ID NO: 25704 - DNA, 667 bp, Sorghum bicolor
  Clone ID: 30965016
gatactccgtaccctctctccgccccccctcccccggcggccggcgctgaccgcgtgatcctcgctccgatggcgggcacctccacacccgcccgttcctccgcgcatccgatggcggccacatccacacccgcccgttaccgttcctccgcgcgctcttcgctgccggtgcgcatcgtgctgcgcgtgcgcccgttcctcccgtcggaggccgcctcagcgacagcgccctgcgtctccctcctcagcggccaccccggcggtgaggtcaccgtccacctcaaggaccagcacaccagtcggagtgaactgtacaaagtggattcgttcttcggtcaagaggacagcgtgagccagatatttgaccaggaggttcgcgcagtgatcccaggcatcttcgaggggatcaacgcgacggtctttgcctatggggcaatcggcagtggcaagacctacacaatgcagggcacggaggattttccagggctaatcccattggctgcttcaacaatcctagcacactgcactggcacatggtgctctgttgagatctcatactatgaggtgtacatggaacggtgctatgacctactggagcctaaagcaaaagaaattatggcattggatgacaaagatgggaacatgcagctaaagggcttgagttggg

SEQ ID NO: 25705 - DNA, 635 bp, Sorghum bicolor
  Clone ID: 30965028
gaaacggcccttcattggattggcctctgtccgcctcttcatcccctttcgttgtgcttattcctttggcgtgtgcactatccatctggtgatttcgtcctccgttgggcttgtgctgctgcctgctagcggttctcgatttcgcctgtaaaaggtttgtttttatcttacgcgttggttgggggttgggaatcacaggatgcgcctttctggtccgcgttcttgatttgttgctatctcagttttcaggtcgaacgaacgcgcgtgcattcggcgggggttatctcgggataatatcgtctgcaaagatgagaagatgacggatccgttccacgattgcttcggtccttggaggaattaggcgtcctagtagaatccaaatgcagaaaccagtctcctgacaaagaaagggcagttgcgcacgtggtgttcgtcgaaaagccacaccgcactgagggaaactgtcacattcgtcacaatgagagattttgcatcttgcctaagtcaaagtgccgttcaggttgcgcattcctcttcctcaagtgggcagaacttggtgcagtgtgcatacctggcacgccttcgcggcaagccttgcgtggtcaccgtcacctggagcaaggtggcgtcggggc

SEQ ID NO: 25706 - DNA, 542 bp, Sorghum bicolor
  Clone ID: 30965029
gcagcaggatctgccattcttttgttttgcctgcgcttcagttgcgttacaggcaggcaggcaggcaagcaggatgcctcacgccaagacggactcggaggtgacgagcctggcgccgtcgtcgccgccgcggtcgccgccacggacccgcggggccgtgtactacgtgcagagcccgtcccgggactcccacgacggcgagacgaagacggccacctccgtgcactccaccccggcgctgagccccatggcgtcgccgcggcactcgcactcgtccgtgggcagggactcctcctccagccgcttctcggggcacggccaccacaagcgcaaggccgacaagggacaccaccacggcagcagcaacaagggcgcgccgggcggcaaggggtggcaggagatcggcgtcatcgaggaggaggggttcctggacgacgaggaggagcacacccgcatcgtgccccgcaagggctactacttcctcgtcttcgtcctcggattcgtcgcgctcttctccttcttcgcgctcgtgctgtggggcg

SEQ ID NO: 25707 - DNA, 622 bp, Sorghum bicolor
  Clone ID: 30965040
agactagatgtccagttcccaatatccttactactccccttccctcccctctgcgccgccattctggtccggctcaggtggagcagcacgccggcacttcccctcccggaccgggctactcagtgatgacctttgaaggctgaagcaagctcctggctaggttgttcgcacaggatttggtagtcggatttctttgctgccttctgctggattgagatcagatcgaacttggagtcgacgtccgatcaaccatgggcttgtcgcggcgttttctgaatctgatcgtgcaaagccacgcgccaaccattagatcgctgcgctgcatcgatctgaagcgtctgcaactcttttacccaaccccaccgtcaccaaccaaccccgccgccgataccatggagacctttgggcttcccggaccaactccgatcttccgagcctgcgattcggatgctgattgccagtggagagttgcttgctacccactttcacaacggagggtgctttgcacagaccagtgtcggcgcaacttgctctacgacgcctgcacgcacgaagtggcagctattcccgagttctacaggcctaggatggattctctctcgctctttgtcccggccagcgg

SEQ ID NO: 25708 - DNA, 507 bp, Sorghum bicolor
  Clone ID: 30965070
ggagtccgggcattcacagatgctgggatttgcaggatgcagtgccctgattcggcaaaggcctgctatctacaaggagctgctaatatgttacttaaggactacaaaaaggcatgtgatgcatttcttgatggtctcaaactggacccagcaaatgttgagattgagaaagcattacgggatgctgtcaactgcttgaagacacttgacacggccaagtaattgtcaagattgccttatgccaagggacactggtccggaagatagaagtaccacgacttttgctagttccttgtcagttgtcacctgttggcgtttaaagaggctttctgttgaagaaaccatctagtcttgtaaatatggttcctttcttctcactctcagttaggtcctgatgaactacgtagaatgttgtgtggaagtgctggccacgtaggtctcatgaatcaaaacattatgaccctcctttttacctcgcgtaactaacttttcgatgctgaatgcgag

SEQ ID NO: 25709 - DNA, 553 bp, Sorghum bicolor
  Clone ID: 30965077
gagcatggagcgagcgtttaattttgccgacaaccaggtgcttcggctatatggtttctcacacaaggggctggaaagccccaagatcaagagacccagggatcagacaaccagaccgattaatgatgtggagaacttagatatgaaggccaaaatatccacagtttcctgaaagttcagatgagagttggtggtttggcagttggatacttgctttgactatcaacaaggtcagagcattttgtgatatgggggatatggttgttctagtttccactctcttgctctctctttcctttttgttcaccaatctttattgttatgtgacagctagagattgcaagctttgtttattatggagttaaacacgataggatctcaaatcagatggaaatagtctcgcttttgtactctgccatttcatttttgtgctaggttcttgtggaacatgcatcactgatatgtggagtttgtgcatgatattagactagttgttctctatttagttgttacctttcttatcttccatggttgaattatgaagcctattgct

SEQ ID NO: 25710 - DNA, 288 bp, Sorghum bicolor
  Clone ID: 30965088
gatgttgaccatttggtgctggatgttgagcaataggtgaatccaagatatacatcttgttgaatagttggtgttatatgttggaagacatgattactcgaatggaagtgaagatcccccttgaatcattgcccccacaccaattggcaataaaatccttccaagatgagttttagagaggttttttttttaagggaggagtgaatccctatgaataagtttgtttcaaattaccctgaagtcagtttgtttcaaattaggctaaagttaataagcccctgtttagtt

SEQ ID NO: 25711 - DNA, 581 bp, Sorghum bicolor
  Clone ID: 30965133
ctgcaataaaggttgctttgagtgatacaggtataccaaaagttaatgtttctgttaatgctgcatctgacgaggagcctgaagttgatgtaagcgacgaggaatttctgcagtttgacacctccagtgtgcctgttattattacattaaccaaggtgggccggcactacatcgttgacgctacctcggaggaagaatcccagatgagttctgcagtgtcagtatcagttaacaggaatggccaaatatgtgggcttaccaagaggggaggtgcagggctggacccaagcgtcatcttcgatatgatatctgtcgccaagcatgtgagccagcagttcatctctctcttggattcagagattgccgccgctgaagctgaagaggctgagtgatgaaaggaaaaaggaccggggaagagggtttatcgttgcgcaaatgctcgtgtgttcaacttcagccttgagagctgcttagaagagaagacgatttactgtagaaatgttcaggaatttggttcaatttttatgctgttagtaaacactgaagatttggatcctggcagataggttcacgaacagtgt

SEQ ID NO: 25712 - DNA, 231 bp, Sorghum bicolor
  Clone ID: 30965142
agcttcttacggtcctcgatgtaaactactgggtttagctcctaccgtcccttctccgcttcctccgattccccgagaaaaaaaacaccgccgcctacctctgctcgtctcgctctccctctccctgttgcccttgctctgcggccatgggcgacggcggctgctgcgaccggtccgcgacggtggcgcccgctctcctcctcgtcctcctcctcctcctcgtcctcctcc

SEQ ID NO: 25713 - DNA, 330 bp, Sorghum bicolor
  Clone ID: 30965151
actggattcccttgtcctgcttttccacaaattgtagcgcttgttgctttcctgttcaggtgccttgttcttggcctccttcgcacgcaaagaaccgccggccatcttcctctccagcatcacccactgcgctccagctcctggaaggcttcttcttggccgcctctgcctgctttgcggtttcttgctctgcttttgagtagagtcgcagcggagtggacagtgtggagtggatcagcggtgaggtggaaggccttggttttgttctggttctttggagaacaaggggaagacgaagaggagcaggaggaggatggcgggaggaggggc

SEQ ID NO: 25714 - DNA, 498 bp, Sorghum bicolor
  Clone ID: 30965156
ctttcctcttctcccctgccctcctcttctcccgctctctcgcgtctcttgtgggcaggccaggtcagtggtcaggtgcccgggcgttcgtcagttccttcgccggcgacgagcatccactacgacgatggtgggtctctctgaaggggagaagcacttcatctgcggcggcattgcgcaggacctccgcactgatggacgtaggcgactgcagttccgggccctctccgtccaaaccggagtcatcccacaggcgaatggctcagcgcgtgttaaattgggggccactgaaataatcgctagtgtcaaggctgaacttggaaaaccaagcattcttcaccctgacaaaggaaaagtttccatttttgttgactgtagtccaaccgctgagcctatgttcgagggtagaggttctgaagaattgtctgctgagctctctgtttccctgcaaagatgcttgctgggtggtaaaagtggtgctggtgctgcaattgatct

SEQ ID NO: 25715 - DNA, 571 bp, Sorghum bicolor
  Clone ID: 30965167
tcaagggaactgactaggattttgagtgtccagaagtctccagttatccatttgtttagtgaatcaattgctggtgctgctacaataagaggctttggtcaagagaaacggtttatgaaaaggaatctctaccttcttgactgttttgctcggcctttattttccagccttgctgctattgaatggctctgcctgcgaatggaattgttgtcaactttcgtctttgctttctgcatggcaatacttgtgagctttcctcctggcacaatcgaaccaagtatggctggcctcgctgtcacatatggacttaatttaaatgctcgcatgtcaaggtggatattgagcttctgtaaactagaaaacaggataatctctgttgaacgcatttatcaatattgcaagcttcctagtgaagcaccactgattattgagaattgccgtccaccatcatcatggcctcacaatggaagcattgaactgattgatctcaaggtccgctacaaggatgatctaccattagttcttcatggtgtaagttgtatgtttccgggcgggaaaaagattgggattg

SEQ ID NO: 25716 - DNA, 489 bp, Sorghum bicolor
  unsure (1)..(489): unsure at all n locations
  Clone ID: 30965168
gttttcgttgtccgctccaaaaccctaccgaccccgccgacgatcaccgcagcgatggcaccgccccaaacctccggtctcggcgcgccgcagcggcggctcctccaggcggcggccgacggcgacctccagctcttcaagaggaccgcaagtgcgctggacgccggcaagggccgcctcagagaggcagtcgaggccgtgaagagccggggcgctggggcgcttcacttcgccgcgggacgcggcaggctggctgtgtgcgtatacatggtcgaggagctacatacggacgtcgacgcatcggacgataaaggggatacacctctagcctatgcaattcaaggtggcactgtggacacagtacaatatcttcttgatcatgatgctaatccagataaacctattgggaaagggtctacacctcttcatttanctgccgccggaggaaattgtgaaatgttaaaagccttactctcaaagggggccaat

SEQ ID NO: 25717 - DNA, 327 bp, Sorghum bicolor
  Clone ID: 30965175
acaacacaccttcggcgcgtttccccctcctcctcctcctccccctgtccccgacccgacccgaccccacccacacaccctctcatcctccgatcccatctcacaattcccattccccactcgccgtcgccgcgggtcgcgcactccagctccagcgcgccgcgcggtgctgctctccccgcccatgtgacgctcgcgagtcgcgctccccccccagtcagcagtcccagaccccaatccgcggcgtcgggcggggaacccggagcgggcaataaagacccgaggattccgttctccgtggcggggatggggcaggaggggatgggg

SEQ ID NO: 25718 - DNA, 283 bp, Sorghum bicolor
  Clone ID: 30965205
agcgtgggggccaggtccaaacgcagggcctcctttccttcccgtcctcatggcgcccgctatgatttcttgccaatcactcgtgccgttgcctcttaagccgcaatccatcccccgagtcttcccctccctcgcccctccacacagtccacagtggccacgcgtcgcttccttctcccgccgctcctccgccggaggcgccccggcggaagaatccaatgagttttggctccgggtagtgtaggcgcgcgcactggagatgccctgcctgaccctgcaatgc

SEQ ID NO: 25719 - DNA, 201 bp, Sorghum bicolor
  Clone ID: 30965228
ctcaagatgaaagcgcatctggccggccaaggccagtggggcgatgggaagtctgggagcagtggcagctaagctttactggcactggaatattttggtgcacgtggtggttaggagtggagatcctttgttttggggatgttgatgtgcaagtgtagttatcgttaactcagttatctatctatgggctcagttcagctt

SEQ ID NO: 25720 - DNA, 564 bp, Sorghum bicolor
  Clone ID: 30965232
gatgatgaagagatttttaggggtctggaccatggcaagatggatcaagtttttgccagcttcagagtttattgcaaattatttttgtctggcttcttaggcatgctctgggagtggaaggtgatgctgctgtcatcatccgttactggacaaattgaccaccctggaaggtgatgttgctgtcagccatctcttgcagtttcgtgctttggtatgccgatgccgatgccgatgccgatgcagagaacacaagtcctgaaacacaacgcagcagatgtcggcaagcgactagtatgtctcagttaggtgtgctatgttgtaatgagccagaagaggacctccaagcagtaacttcgagatgttatctttctatatagttagtcctactcataaagggctgtagtaggaatcaagtatagaagtgtcatgtaatgatgcacaatagagtagtgtcgtgtgtagactatgagcttatatttatgatccacaaataaatttatcttttgaagaaaatacatgtccattagaaactggattgactatcagctcatactagtcttctgc

SEQ ID NO: 25721 - DNA, 496 bp, Sorghum bicolor
  Clone ID: 30965239
cgacacgtgggcgctcggctgcatcatggccgagctcctgtccggcggcgcgccgctgttccccgggaggtcggagatggaccagctcaacagggtgttcgacacggtcgggatgcaggacatgccgtcctggccgggcttcgcgctgctaccgcgcgcgggttcgccgctctgcaagcgcggcaggcctcccagcaggctccgggagctgttcccggcgctgtcggccgacgggttcgacgtcttggccgggctgctggcgtgcaggccggacaggcgcctcaccgccgcggacgcgctccggtgcccgtggttcgcggatgccgcggcggcggcgcctgaggccttgccggatcagccgcgcgcttcgtgctgcgccgccggcttcgccgccggtgtcgcaggtgttgccgagggaatcgtagcgtagaacttgagaattaagagacatttgattctttgattgattgatcatctgtagattattaaaggttac

SEQ ID NO: 25722 - DNA, 472 bp, Sorghum bicolor
  Clone ID: 30965243
gatccagatgtgtatagaattgaaagggcaaagaaactgtttataaaccaagagcagtcattgcttgatgcaattgccaaactcgatgaagcatctgatcacgaaaatgatgatatgatgctcgttggaagccggattaccattgggtgacatgggtggcacacctctgacaggggcgatattttggagttcacacctttgacagcgggtgaagagacaatgatgcgtgaaatgctgtgtaaataacgctacttgttagtccggtaggttaggttcttttggcagtcaggcaaatctatgcatgcaatgtgatgggaatatgtattttgagcaccatcacatccggtgatgtgatgctgtttcatttcacctttaatctgagtaagcttatctgtgcttgcccccctagaaatatgggtcggtttcactagtttgtatctatgttaatatctaaggatgtctactaaaatgg

SEQ ID NO: 25723 - DNA, 570 bp, Sorghum bicolor
  Clone ID: 30965256
ggaagcaggagcccaaggagtcgcagcccccaggatcaggtgatgagcccaccaccaaaggataacggcgaaggcaatggttcagaccgtggcgagagccccagaggaagggaaactagcaggagcaggagccgcagcaggagcccatccggtgataaccgcagccctgcagctaatgggcggagcccgagtcctagaggtgaccgtagcccaagccccagggctgaccgtagcccaagccccaaggctgaccgtagcccaagccccaagggcaatggtaacaatgacgatgatgatgctgcccgtggtgcttccccagcaggaagcaagtcaccctgaaagatgcccatcccagtttgtgctgcttcatgatgcaatggacagactttatcgtcattgctgtttttattatcacataccaaagacatgcatctttctcctatctgaaacgtggacttattttgtttgctttgagctaggactcgtatttttctcttatggatatgatatgatgccttcgggctggtttgcatctgaataagtggatgttcgcatgttgtgtaccatgtt

SEQ ID NO: 25724 - DNA, 444 bp, Sorghum bicolor
  Clone ID: 30965300
gtgcacgtgacggctcaacctctccgtctccatctacctccgccgggtgccgccaaaaccaaggtcgtcgccccaacccaagtacccaaccgaatccaacgggacacgagagcgacgtcatggtggtggaagtgggcaccgccgtggggacacgaaccacctccacttggcctgcaggtccagccgcccggcgcagttcacggggccaggtcgtctccttcgccttcgccttcgccctcgcccccgagtcgtcccgccgggtccgggtccgggtccggtgccgcgcgatgcagcaggaggagcggcggccgccgaccgtccgcgcggtcaccatccccttcgccgacctcagggagacggacaaggacctcggcggcaagatcgaggaaggcctgggtccccatgggctcggcatcatcaccattgccgatatacctgagtttc

SEQ ID NO: 25725 - DNA, 595 bp, Sorghum bicolor
  Clone ID: 30965305
ctactggaccatccccccctctccctccactccgagggccgacccgacccggcccgccggaaccctagcctccccgccccccgcctccgcccgatctcccgatcgccggattcgtgccgccgcgggatggactcggacgtggagatgaacgccgccagcgacgaggaggtgatggacgacgaggactactacgactactgcgacagcgacatgggcgatgacggcgacggcgggagcgaggaggaagaggagctggtggccggggactacgacgagggcatcgaggccgaggggaccgacgaggtggtgtctaggcgtgagcagacatttgtggttttaaacgaaggagttatatctgagcgtcaagcggaagatgtaagcaaggtatctgccgtgttgttgatcacaagggaagaggcgtgtgccctcctgcatcactataaatggaacatcagcaagttgagtgacgaatggtttgcagatgaagaaaaagtccgccatactgttggcttacttttgaatggaaatcatgatccctgctctaggaagctaacttgtggaatatgttttgaagggtattcttctgatatgatga

SEQ ID NO: 25726 - DNA, 513 bp, Sorghum bicolor
  Clone ID: 30965321
aaggtcagccggtggttaggcttgtggggtgcttatctaggggttcaagtaagcttcatccttctctgcctgctcgtggtggccttctaaggactgctcctgtgcgtgaagttcatcttgaccttgtgcgagtttcaacagggaagctatacaggctaaggaaccctagcagaaagtacttagcctctttatccacatatgactcctccaacccaacaaaagattgggggtttcctgatatatatgcaaatcctgatattaatttgagtaagcagtccactgcaaagtgccaatctgaagttcttactgatgaatcttgtatcgggggaagtgtctccgctgctaataccatggagccaaagacaaaagcttacagggacagagctgccgagagaaggatcctacatcgtggcttaggggtagggcctggacagaagcagagtaacaccaacaatttcgatgaatacgaggaatcaatcgaagacattgattcaatgggaactgtgtcagttg

SEQ ID NO: 25727 - DNA, 340 bp, Sorghum bicolor
  Clone ID: 30965326
caagtgcaaaccttcgctccggcagctgctacctagctgcttcgaacgaaggcctgcattctacttctatacgatgggcacaacaacaactactccggtcgccggagctgtcgtcctcagcctcaaatacctcgacaccgttaagcgaagcatgctgccgctcgtcctcgccaccctcaccaccgtcctgctcctcggccccgtatccgaccgtggagccgccttcgccagcccgccgccggaccccgtgcagtgctcgtccggcggcggcacgtccgactgcaccgtgtccagcgcgtacggcgtgttcccggaccgctcgacgtgccgcgccgcgggc

SEQ ID NO: 25728 - DNA, 528 bp, Sorghum bicolor
  unsure (1)..(528): unsure at all n locations
  Clone ID: 30965328
tcctctctacgccgcctccgctgcgctccccacaccaaaaccgcaacaagccaagaacccgtccgatccgccggctttgcggttgccggtcgccatggagcactacgagcggctcggcaagatcggggaaggcacgtcggggatcgtctacaaggcccgcgaccgccgcaccggcgagaccgtcgccatcaagcgcctccgcgttgctaccggcgacggctacggcgacgcgttcgacgagacgttccgccgcgagctgcgctgcctcgaggcgtgccgcggccacccctgcctcgtcgacctccgcgccgcgcaccttgacccctcccgtggcgcgttcctggtcatggagtacgccgggcggagcctggcggaggccatgcggcagcaggaccaccgcgccgagcggcggacgttcccggagcccgaggcgcgccgcgtgatgcggcggctcctggagggcgcggncgcgatgcacgcgcgcggcctcctgcaccgggacctcaagcccgacaacgtcctcctgga

SEQ ID NO: 25729 - DNA, 291 bp, Sorghum bicolor
  Clone ID: 30965334
gcaacccgtccccgcttccgtcctacgccgccgccgccggattcgctcccgtctccggcggccacgcccattccccgcacccccaccttgcgtcctccgccagctcctcccggccgccgcgcaactatctccaccccacgattacagcgaccacgagaccagcaacgcctccttccaccaacgggaaggatccattcagccagtccacgcacaccgcgtctttgactcgcactccgcttccagatctaggcggacgggccgaggaacgatgaacggaggcgccgccccacc

SEQ ID NO: 25730 - DNA, 526 bp, Sorghum bicolor
  Clone ID: 30965340
atgctccgtggccggagcttctggatcggaggatctcggagccgcgtccacgtccaccaaaaatcccatcagcgttggatcctgcgttcaacggtctagatctttagaagcggattctcgcctatgacagcttctcctgcttctcattagcttctctctcgcttctcgtccacttcccctacttctcttcagaatccggcaaatcaaatatatagcgccgctccagcttctccttccagattctttcctcttctctttctcacgcgtcgatcctctctccctcgtcctcccgacgctacgggcgacggcgccgggggcgagcggggcggcagcggcgggcgccaccctcctcctctctccttctctccccttccctaccgaggcagcggtgggcgtggcgaggcaacggcgcctcctccccccgtgggcggcagcggcggccccctccctctcctcgtcctccgcgcggcctcttcgatgcctcctcggccggggtggggagctgagttgggaggaggactgctgc

SEQ ID NO: 25731 - DNA, 658 bp, Sorghum bicolor
  Clone ID: 30965361
atgatggatggtggcaaccatctgagacgagggcagagagatgagggctggggtccaccaccaaggcaacgttgctccacctccggtccctttgagctgtctacggggtctcctggccatgccatggctcctccggctgatatcaggcccagacagcagacacggcccgtcttcggtgctacaatgaacaatccatccagcgccctgcgaaacttcataatctcgcctgtcaagcgtccccaggtgtcccgtaaccgccaacacatattcacgctgtagagagtgggaatagctgacggggtgctctgcattggaagttaaattgtcggaagcttgccgtgatcctgtaaattctgtaagatcacacagccgccctccctcacttttagttcaacaagccttttggtatggtgtttcttggtgttgccaatgttaggggatagacgttggagaatggatatatagttggttatgctagaaacctcttatacgcagactttgtccatttctacagttacatgtatagcaggaagtttcatctatacccgtaatctagccttggcatgacaactgtggttaacttctttctaactcatccgaatctgaacagaccaagtaatcttgtgcactgattgaggacctaataaacgagtttttc

SEQ ID NO: 25732 - DNA, 346 bp, Sorghum bicolor
  Clone ID: 30965373
ttcgtgtgcaacctatgcaaccaccaattaaggtcacatgatctagatctaacgtctgaggattttttcacttaaacccctccacctgtgggtttaaatctaacccgtgtgtatctagatgggagggtttaaatgaaaaaacctcagacgttggatttagatcttgtggccttaattgatagttgcataggttgcacacgaagctgggttacacaggatacgttcccttctataagaagcctgagttgctatacaaaacatctcaaggtgcccaaaatgacatatgtggattgttatacgaaatatctcaagatgtccaaaatgtcatgtgtgatgaatagtttat

SEQ ID NO: 25733 - DNA, 453 bp, Sorghum bicolor
  Clone ID: 30965392
gtcaatttgatcaaggacctggtgccgaagaaggtagcgaagttcatccccatccccatggcagtagccatccctttctatgttggagccttcttcactattgatatgttcctgggctgtacgatactcttcatctgggaaaggaagaacaaagctgaagcagactcgttcggaccagcagttgcatcaggcttcatgtgtggtgacgggctctgggcactacccgaggctattctgtctcttgcaaatgtgaaacctcccatttgcatgaagtttttgtcaaggtctgtcaatgccaaagtggactctttccttgggaactagtgagtgctagtttgatagtagaatagaatttttctttcttttatagttgagtggctgaataatcctgtaaatttgtggagtctcattggcagtggtcatactttttagtgatgactaggaagaactttg

SEQ ID NO: 25734 - DNA, 600 bp, Sorghum bicolor
  Clone ID: 30965403
attcagatgaattacagcgcacctggttgtgcagagccaccttgaaaggcatagactccaataaaggttggtcataccagtcatgctttcactgccatcactcggttagttgggatggaagcaaattcttgtgcaactatggttgtccaaataacaagttatctgttaggtacaagctggatgcagtgattaaagacgagacagactctatgaatgtcatgatatttgatggtccagcacaaaagcttgtaggtgttccagcagaggagctcaatggagaggtcacaggtgatgacatctcagctgtcatcagttcgcaacacagacgtgccttcgttatgacatcttcagctgtcattaagtttttatgccgcaccgaaggtggctgttccggctccgtgccaccgaagaagcatttgggcttagtagtcccatccactcaatgtagccatgtatgaactggaaggcaatatatgtaattttcatcgaaatataagttgtatatatgccaaactgccactagactggatgtctggatgccttaggtttcagtagactttgtgattgtggtcttgtggacatgtgaatatgtgactctga

SEQ ID NO: 25735 - DNA, 659 bp, Sorghum bicolor
  Clone ID: 30965405
taagccatggcactgtgccgctgctgaattgattggccgtctgataataaatccagacaatgagccatttcttcttcctgtcattccacagatatacaaacgactagttgacctattgagtgtaccagcatatgatgcacaggctgctgctgttagtgcactctacaatgtagccgaagtgaatatggattgcaggctcaagcttgccagtgagcgatgggctgtcgatagactcctaaagatcgtgaagacgccgcatccggtgcctgaggtctgcaggaagacgtcgatgatactggagagccttgtctctgagcctcaaaacaggatgcatctccttgtgcatgagaacacttttgctgagatcctgacatcagaagggaaatactcggacacatttgctcggatcctatatgaattgacagcaaggccaagcaacaaagtgacctcggggcaggccatctggggaaacataaactgatgcaacacaattgctgtaatatgttgttggaatctagactagatgacatgtaatgtaggtacttcgttgaccatatattatgttcctgagccctgactctatgtaacaggctctttgctgtatggagttgcaggcttgcagcttggcaacctggccgaatctggatagtttctttcat

SEQ ID NO: 25736 - DNA, 639 bp, Sorghum bicolor
  Clone ID: 30965421
ttattggacacaggagagcttgacccaaatggcaatacacatgagagctttattataatagtttttgcaaacttgagtcataaaaggtgaggtagtgcctattataaatgcattggaaaagagaaactgaccacccatcatcactatgatcatactgtggaaatgtggaaatgaaggcaaaatatggtgcaaagctttcttttgaagatgactgatattttgtttgttcgtcgaaatctccttatccaacactctcctgctaggctcaagagagttaagagtgtctccaagaacaccacattttgcttcaagaaggattaagataatttgtatgtgtttaggtgattttacctttgaactaaaaaaatccaataataaaagatgatttgagtactatcagtgaattcatgtgtgttagaggcggaggttcagaagctaaggaagtgattgccttcagcattgtgaattgagatggatagcatatgcacagttgcacacagagttttcaagtgaccaagagacctccggccatggtagacaagacgaacaagcctggtttttgtcatatgtttagagtgggctgatgcaatgattatttttgtggtggattttccgggtattaacatggagctattcttt

SEQ ID NO: 25737 - DNA, 644 bp, Sorghum bicolor
  Clone ID: 30965441
gcggcgcgtccttgctttctggtggcgtcgactgggcggcggccgccgccgccaccaccaccacctccctggtgtccaggtcttcgtcgatcccttcgtgtctgtaccttagcctggtcttcgtcgggcccttgcccttcgccggcgacgagcacccaccaggctcaactgctctgtagctaatctaataatttctagaaacaagatgaagtgtaatgcttgctggcgggagttggaagggcaagcaatatcaaccacctgtggtcatcttttatgtgcagacgatgccaagaaaatactcagtaatgatggtgcatgtccaatttgtgatcaggtgctctcaaaaagccatatgaaacctatggatataaatccaagtgacgattggacaaatatggcgatggttggaatatccccacaaatacttatgaagagtgcatacagaagcgtaatgttctacattggacaaaaggaactggagatgcagtacaagatgaacagaattgttggtcaatgtaggcaaaagtgtgaacttatgcaggcaaaatttactgaaaaactggaagaagtccataccgcataccagaagatggccaaaagatgtcagttgatggagcaagagaatgaaaacttgaacagagata

SEQ ID NO: 25738 - DNA, 594 bp, Sorghum bicolor
  Clone ID: 30965451
ccaatcacctcgcctaatcctgcccgattctccaaccagcgcgcaatcatctctcccaatcccggccaatgatgccctcgcccgatgaaagtctcccccgcgttcgatgccgtgctcacacaacgtgaccccgtcctctcctgctctccatcccttagtgccgccgccctcgcagcaggctctccacgcaggacatcgtaactatgcgtcgccgccctcgtagcagactctccgcccatggcaactgacgagctctctgccatctcaagtgtccaagcgcgggcaaggaggaagaggaattgtgtgccgccgctgcgcctactcgatctctcccctgcccctcaccccacgcctcgagaccatggcgggatcatcctcgaccatagcggtccccatcctctcccgatagtggccgcggcgcccttccccatcctgacagccttgtgttcgtgggtgttggtgatgggcagccgtcctcgaggctctggatccatgctgggcggatgcggcagtggcagattccctcgggacgggtaaggatcgcggtggggctggtgccaatcatggacgtggatgagctccagctctactctg

SEQ ID NO: 25739 - DNA, 634 bp, Sorghum bicolor
  Clone ID: 30965456
ctactgggtcgtcgcccacctgctcgtcttccactcgcccctgtctctctctctcccccggcccgcgtggtcacctttcttccatgagcacgacctgctccagtggactcgctccccagcgctgaccctttcctgctccccgtcgccgcctccctgcaccgccacctggatagtgccgtgggcgtcgccgcatccatggacaggcggcctagatccagggtctgatgccctagatccacgatctagtggcctcgctcaatgctatagtgttgtgaggtcatacattccccaacccgacctccactgccaggggccagagctccttcctacgcggttgcgcctggggccgagcctagccgaccggtggccacagccaaggtcacgtcggtcacctcccccgcctaactagctatgcaggcgaggagcttcccagaccgcctgcgcggctacatcagggaccaagccggccggcttgcaggcccttcggccctccactggctcttttccctgtcggctgcacggtcctgcccgctcccaatccttcgtcggtgacagattgacagttagatgcatgcagatgcttgttgagcagttgatttaagatcattgagtactgctcaaaacagaggacaaa

SEQ ID NO: 25740 - DNA, 559 bp, Sorghum bicolor
  Clone ID: 30965461
cgggtgcattctcttcctctcaggccggtgacggtgagacatgctgctgcgcaagcctccgtcgctccaccaggcgagcccagggttagggatgaggacaagcttgagcccccatgccggaatgcgtggtccatcacaaggtcaaggtgacttcaccccgctgtcccagttaaccctcggataccacggtcggagctgcagagtcctggtgcgcgtctccaggatttgggtggcctccaatccaattactggcgaggtatacggtctccactgcctcctgatcgacggcgagggtgtagttatgcaagcgtgtgcgcgtccctgggacatggagcgactcaaacaccagctagttgaagggaaggtctacgccttgtcgaatttcggagtacgcgaaaaattggacaagtacatggcctgtagcaatggtttagtaattagcatgggagcacagacagtggtgaatgagataaccgaccatgccggttcttcgatacctctccatagctttgagtttgttgattttggtgatcttccatctaggaacaatgacaggagc

SEQ ID NO: 25741 - DNA, 644 bp, Sorghum bicolor
  Clone ID: 30965501
tctgggacgttttctatcactccgcctccagctccgagctccaaaccctagctatgcagaagcagtcaggcaagtctggtgggaccggtggaggcacgccggcgaagcgcggccgcccgttcgggagcaccaccggcggcggagccgcggccgctgccgcggcggctgcggtcgtcgacccgggtgcgtccgccgcgctggttgggccgtccctccaagtcctatcagccctgtcagatcagaacaacaaaagaattgtccttgcattgcaaagtgggttgaagtcagagatactgtgggcactgaatgcccttacagtactctcatttaaggagaaagacgaccaacgacgtgatacaacacctcttgctaaagttcctgggctcctagatgctcttcttcaagttattgatgaatggagagatatttcaatgcctaaggaccatctgaaaccacccagagtaagaactttgggtgccaacacaacactctcgggctttggccaggagaacatggaaaaagtctactctgacactgccactacctctaataatgatcaatcaaagacggaagactccagtgtcacgaagaagcgcgctgcaagcttttggtttgatgaggatggcttgtttaacaatgatgat

SEQ ID NO: 25742 - DNA, 622 bp, Sorghum bicolor
  Clone ID: 30965511
tggttcgcgtgatttcgtacaaatggcttagtcggaacttctctatatcatcgaatgatgccaagaggttgcttcaggagtttgtcaacaaacatggaaccaacctccaagtgatttacagtgtgtcggggtggttgaagaacaatccccaaaattactgtataaagctcatttcagggacaaaacttgaagaaggaaggcaaggtttcaaagattcttgttcggtccagatctacagtatccaggcctgtattccaaaagatacagctgtactttggaatcctgaatttgtgcaggcagaggagcttttcaaccagccttttgatgacgagaactgtttgagagataataggttttgtggtgttttgaattcttctgtcaagcgaacatccaatgggaagcatgtgagttcattgccaccaaagcccttaaatagtgctgcagtagtcgcacagtctaaacctagtgttactccaaaggagcagtttgttactgctcagcagcaagatttgcctgtaagttcaaagcagggagcaggcaataagtctgagaaggataattctacagtattagataaagctggcagtgcacctgttgtcaaagaacaatcaattgatgccca

SEQ ID NO: 25743 - DNA, 618 bp, Sorghum bicolor
  Clone ID: 30965528
ctactggctttatgataggatgcagtttatattaatatcaatgatcatcttgttcagttttcaaagagtgatgaaaatgatgcacccgaaaagcaagggaaaggtaaagatgtcggcgcggccctggtaaaaacacttcaaaacacgagatactcccttgatgaaaagttggaacaagttttataaatttctttggtgggcgtcctgctgctcaatccaaagacagtgatgctgaaggcaatgtcatctctgcaagccaggatgatcagggtgacacaaacttgcagcaagtagatgacggtaacaatagcaatgcagtcaccatggagagaaatgaacattctgaaggctctagtgatagcgaagaggataatgatgatattcagctgagggatcgtgatgttgaattgagggaagaagtagaaatttgcaatggaagagtgaggcgaaaagctgtgtctgctaattttctagatgacgttgatgatgagggtactgatgaagatggcgatgatgaggaggattctggtgatgaccagttgtctggggattctgtatcagcagatgatagtggagaagctagtgattcagaggatgaaattgagaacacttcaaaat

SEQ ID NO: 25744 - DNA, 632 bp, Sorghum bicolor
  unsure (1)..(632): unsure at all n locations
  Clone ID: 30965535
aaaatacctggctgcaattcaaaatggagccaacaagaaggcggagaagtttggtgcgacacgggctatccaagattggtgaggaggccaggcgacatagctctgaccggacaagttagccaaaggtgcgcttgtttccaggaaaacgagctcgacaaagctgggctagtggtgtacgaagggtgtgattacttgtccaagtcttgcaaagtaaactagaactgtacatgtccctcccctttgtccacgaacttgttgctttgggcactcaacgcaaggttcattagttgggagcagtgacattccacgagcacaagccacgcatcatgatgggtcttctgtactgttccgcatcagtcctttcggaatacctggtgcaacgtcgtgtttcagaagccaagatactccgcaattgattggaagatacgtgcaatcgaatcaaatgatggtaacactgcgctgccacgcattattcgtgtagggcaagatcaatcgcaaaggctgtccatgttaatagccatggggcctttggctgtcgattgatcgagtcgaggcacgcaccgtcggcatcatctttctggatcccaaactcattttctctgttgcaaatacctgcctttgtatatatatnt

SEQ ID NO: 25745 - DNA, 532 bp, Sorghum bicolor
  Clone ID: 30965536
tgacctcattgtggagctttcatcaggaaaagaggttgctgatatcattcctaacattcatgaaatcaaaatatgttcaggcagaggaattattgttacagggccagcgcctgctggatctggttatgacttcttcagtcgtttcttctgctcaaaatttgggatacctgaggaccccgtttgcggcagtgcacattgtgtcttggcaccttattggggtgggaagctggggaaacacaaattgacggcatttcaagcatctccacggagtggaatactatacctggagttagaagctgcaggcaggagagtgcgaattcagggagaagctgttactgtgatgactggtaccctcctagcgtagccgctcaataatgaacttcgcggtcttcagtttggttgtgcggcatgattactctgcagcaaggaataaactaattctcatttcacccgtcgaaagaacttaaatacactgcttccagtcttggaatcagagtgtaccagtccggtgtctggaataataacttagtcg

SEQ ID NO: 25746 - DNA, 593 bp, Sorghum bicolor
  Clone ID: 30965551
ttccatggtgaaacaaagttctttgcatgcacaggatttttcattaactatgatggatgtccgactattctgacctcagccagcttggttagggatcctgatggcgcaaatgagattgtgagcggcttaaggattgaggtgttgcttccaaacaaagaccatactgtaggggaattggaacattatagtttacattacaatgttgctctagtcagcgtcaagaattacaatgttgattgtcctaagctggaatgtgagttgatgcggtattgtggaacggtggtagctgtgggccgttgctttgaatcaggtatattaatggctacaagtggggaattcatccatgactgcgacgaggagtcaatcgattcggattgtgaatactttagttacactacatgtaggaccactaaggtagcacccttcccttttctttttaaattgcctactcagcctaccccaacttgtttgggactaaaagactttgtgtacttttaccaaaatatgatgtacttaaccttactgttagaattaattgctatttactgtaatcacctagttacttgtgtaatctcctagctatttactcccct

SEQ ID NO: 25747 - DNA, 646 bp, Sorghum bicolor
  Clone ID: 30965554
tcgtccatatggtactcttcaagcgatccaggaggtttattgtgagtccggtataagaggattttggaaagggcttgttccaacattaatcatggtatgtaatccatcgattcagttcatgatctatgaaacattggcaaagcgcctgcagtcaaagcattctggaaagcaactaccaaaaaggaacctcactgctatggaggtttttttattgggtgcaatagcaaagcttggagctactgtagtcacttatccattgctagtcgtcaagtcaaggttgcaggcaaaacaagaaattggcagcaatgcgatgtccagatacacaggtacactagatgcgataataaagatggtccgctacgaaggaccgcatggattttacaaaggaatgggtacaaagattgtacagagtgtctttgctgcctcggttctattcatggttaaagaggaattggttaagttagcagtgcttttagttgcaaggagtaggactatgcttattactacatccaagaaacaataggtgtatgtccatgaccaatatttttttggggagaaaagccccccattttttttgcctcaacttgtaatatataggatctcattatacatatcctgttcatgatcaatatgaaatctttactag

SEQ ID NO: 25748 - DNA, 669 bp, Sorghum bicolor
  Clone ID: 30965585
ggaagagatacaaaagatgagaagcgaaatactacagttatcggataaagcatcttcatttctttcatcaggaaataaggctgaagcaggttctgtctacaagacaatcgaacaattagagcggaatctgtaccatgctttctcaaccactttgctgcacacgtgtgaaacactcctgaagatatatatggaattacaagattggcggactgcattggcatactgcagattgacagttcctgtttatgaaagagtttatccaccttttcatccgatgattggattgcaattctatacttgtggaaagcttgaatggttgcttgagtgcacagaggatgcactaaaatctttaaccagggcaacagatatacttaaagtaacacatggcacaaaatcccagttcatgaaggagctctttggcaagctagaggaagcaagagctgaagtttcttttaggatatcctccagacatggacatgatgagtaatttttataactgcaggccaaccatgatggaaaagaatatattgaaaatatccttctagtgttgagatcatattttaagggacgataagcattgtagagattttgtaggcaaataaatagcactgttctgaaatgtgccttaatttgttgtataacgaataggattattattattttattttt

SEQ ID NO: 25749 - DNA, 544 bp, Sorghum bicolor
  Clone ID: 30965609
cttcaatctcttctcaggcttcttcattccgagaccgaaaattcccagatggtggatatggtactactggatttgcccattggcatggacagtgtatgggctcatcgtgacacaatacggagacctgcaaaagctcatcacagttcctggcgaaactgacaagcagacgattagctactacgtaacacatcattttggataccccagggattttatgccagttgttgcgccggttctcgtgctctttgcagtattcttcgctttcatgtacgcagtctgcatcaagaagttgaacttccagcaacgataggaacagattatggcagcaaaaggtcttgagatatatttttttttggggggtttgggggggggggtacacttctttttctctttcattttttgaatccctttaatatattgcagtgtatataaggtgtaccttgggtattccacacatcgccaaatgttgcgaggtcttatacagatttcttgtacccatttaactgtggaccattgcaagagcataactatgagaaaatttgtc

SEQ ID NO: 25750 - DNA, 568 bp, Sorghum bicolor
  Clone ID: 30965617
ccgagctcgagaccaccacgacgaacaagaaagaagcgcacgggcgggggggggcttctttctccttctccacgctacttccccattgcgtgattccgccgcgtcgcgtcgcgtgtgcatttgcgcggcgcccaatccgtccccggcgcaggagccgccctctccgatccggcgaagatcggccgggctctgaaaaaggggaagggaaaaaaaaaggtggtaatcgctgttgattccagaaaggtgtccctgcactgtgccctttctcagcaatcttgtattctcatgtctcactctcacgagatgacgagtaggaaacctcctggtcttcagttacttggtggtgccggttcactaagaacataccagacactagtcttggtccttacattctttgcatacacatgctttcatatgactcggaagatcacaagcatcgttaagagcgctctcgatccccagacgaaggttggattctcccactggggacgactgcacatgagcaagagcaacgctcttaacactggctggttgccatttaacactgttgatggttcagcattacttg

SEQ ID NO: 25751 - DNA, 626 bp, Sorghum bicolor
  Clone ID: 30965620
ctcgagtgtagagcaatggcagcgcttacagaggatagaaagaagatgcttactcctacaattcggttaatggtgcggctggtactaaaaagaaaactacaaaatgagaaggtcattccatcctcaagtatagataactacaatctggttgatgccttggagtctcatatatggaaggttgatgaaaatcatcttgtgctctatgctcagatggccaatcttgtgagccttattcttcctttgattgagcttgaccttaaggaaattgcacacactttttctaagtttgcctgcaatgcgcataccatatgtgaccctgaacttaggcctcttgggactggactgtaccctgtcatatccattattaaccacagttgtgtaccaaatgcagtattgatatttgatggtcgtacagcatatgttcgtgcattgcagccaataggcaaaaatgaagaggtatctataagctacattgagactgcagcagtcaccaagaagagacacaatgatctgaagcagtacttcttcacctgctcatgtccacgttgtgtcaagggtcctgaggaggatgctctacttgaggggttcaggtgcaagaaccaaacatgtgatggttttctcctgcc

SEQ ID NO: 25752 - DNA, 653 bp, Sorghum bicolor
  Clone ID: 30965623
ctactgggtacaatcctccaacgtggatgctcgaggtcagttcagttgcagctgaagtgcgactaaagatggattttgctgagtactataaaacatcagatctgtacaagcaaaacaaggtagtggtgaaccagttgagtcaaccagagccaggaacatcagatctttatttccctacagagtacacgcaatccacaataggacagttcaaagcctgcctctggaagcaatggctgacctattggcgcagcccggattacaaccttgttagatttaccttcactttgtttgttgccttgctgctcggctccattttctggaggataggcaccaacatgggagatgcaaacagtctcaggatggttattggagcaatgtacaccgctgtcatgtttgttggcatcaacaattgttcaactgtgcagccaattgtttcaattgagaggacggtcttctacagagagagggctgctgggatgtactctgcaataccatatgccttatctcaggttgtcatagagataccatatgtgtttgtgcaaacaacgtattacaccgtcatcgtatacgccatgatgagcttccaatggacagctgccaagttcttctggttcttcttcgtttcctacttctccttcctctacttcacctac

SEQ ID NO: 25753 - DNA, 651 bp, Sorghum bicolor
  Clone ID: 30965640
tgaccatccggtgacgtcgtcttcttcccaagctatccctctcgctgtctcgatccagtgtgtatacagtgacccacgtctcggttcatcgccggcggcggcagcgtcgccgcttgggcgagctcttcatctgcgcttcaccggcgaagtttccactaggtgggggtgaacatgtcgagcgcagcggtgaacgggctggccggcgccggcggcggcatcatcgctcagatcatcacctaccctctgcaaaccgtgaacacccggcagcagacggagaggtcagcgaagaagaggaaggccgggagcggcggcagcgccacccacacctccaccctcttccagatgctccagctgatacaaaccgaaggatggggtgggttgtacagtggtctcaagccctctctaatcggcactgccgcgtcgcagggaatctattactacttctaccagatcctcaagaacaaggtggaagatatagcagctgctcgtagtaagaagggccatggggatggtactgttgggatgctttcttggcttggtattgcagctgttgctgggtcaatcaatgttcttctaaccaatccaatatgggtccttgtgacacgtatgcagacacatactcaagcgaaaaggaaaatattggagtctaag

SEQ ID NO: 25754 - DNA, 617 bp, Sorghum bicolor
  Clone ID: 30965647
ctactgcgagtcggccttgttggcctacgggaaaaaaaatcccacccgcttgccgtctccccgcgtccccaagccgagctctcgctttcggcgttgctctctctcctcggtcctcgcccccgcccgcgtcttccagggcgcccatgagctgaggccgccgccgatggggccgccccacgccgcgcaggaccccgtgccgtcgccgtcgccgtcggacggcagcggctccggctcctccaggcgccgcctccgccggctcgaccgccgcaacgcgtccaagcacatcggctacacagcccccaactactgccagtacccgccgtccccgcagcccgccgcctccgcgccggggtccgggccggcctcgctcgccgcctccgtcgcctgctccctcgacctcgtcaacagcttccgcatcggcggcggcggcgacgggggcggggacctccgcttcctgtgcgagagcctcggcctctccgggcccgacgacttcgccatcccgctggccgactgggaggcgcacaaggccgttcgctcctccgcctccgcttcgagctccccctcctccgcacgccccaaccacgactcccctcagcgggactcaccgctctgtcagg

SEQ ID NO: 25755 - DNA, 620 bp, Sorghum bicolor
  Clone ID: 30965649
tactggaccggtctgccggccccgtcttccgctccgacgacacggaggtctgtccggtcgatagccgccttaaccaccaatccgtccctccgccgaagctacgccgtccggtctcaagggcagccctagctcgctgaggcggatcgtagcaaaaccgatactggttcgttgccgtggaggcagtttgattttgtggacctaacggccttccggatctcttgggagccagagcgatggcgcgcggcgctcgcttccttcttgttctcgcgctgctcgccgcgctactcgccgtcgtcctccagctctaccgcctcaggaagccgaggttgtggacagtggaggagctgtcgccgtacaatggaacgaatgaggggttgcccatactactcgcgattttgggctcagtgtttgacgtcacaaaagggaggtcacattatggtcctggcggaggttatcatcactttactgggagggatgcatcacgggcatttgtttctggaaattttacaggtaatggtctgactgattccttacagggtttatcaagcagtgaggtaaacagcattgttgattggaggaaattttacttcgaaagatatatatttgctggtaaacttatt

SEQ ID NO: 25756 - DNA, 573 bp, Sorghum bicolor
  Clone ID: 30965693
gctactggagactgcagcgggaccggcggacggggcggctcctgcgcgtgcagggcgccgccggcggagcaggcagggagcgacgcgcggccggcggcgtcggggcgcgggggcgactcctgcacgtgcagggcgcggcgggcggagcaggctgggtgcgagcaccttgggacttcgggatccacgtatctcatctcacagtataaaggcttaaagtatgggctatggcataaataaaaaatgatacttacctgcaacgttgcttttgtggacccaactatttcctccttcaatcagttctgcatctactctggaaagatgctgccaagcaagaggggtgctgatgatctctcaagattctcaaccgactcatcgatttcaggtttttggagtgagctgagtgacgaagctgcatcaaagttgtccaaaagtgttgtctcaattgctttgacccatggtgatcttgtaggacaaaatgtgctatttgcatcctctggcatagctatagaatgccagcctaacttcacaaagtttgtgacatcagcaattttggttagagctttaaatgctgaa

SEQ ID NO: 25757 - DNA, 664 bp, Sorghum bicolor
  Clone ID: 30965699
tactggcgcttgcctgcgtcggcctcgtccatgtacatggacgatcaaggcctcctctctgagctccacctcgccgttgatcttcggccttcacagacggcacggggcacgagtacactcgggcgggatgagaagcgtcgccggctcacggggccatcgccggcttcaccgatggacctcgacgatcccctctccgagatcctcctccgcctgcccccgctgccgtcctcgctcccccgcgcgtccctcgtctgcacccgctggcgccgcctcgtcaccgaccccagcttcttgcggcgcttccgcgcccaccactggaagcccctcggcgtcttctttggaggagacagagatctctccttcagcttcttcttgggtccgcgggactccgccccgtcggagcgcttctccctgcgcgtgccacgcgagtgccacgagggcggcggcgggggccaggccggtcgcaatgactgcttctgggaattcttcggttgccgccatgggcgcgtggtcctagccaaccgcagtggctatggctacggcacccgccagatcctggtgtggaaccccgtcacaggggaggaccatctcctaggagtttcgcagttctcggattctaatcagagcccgtacgggttacatatgcaagcggcagtaatctgtg

SEQ ID NO: 25758 - DNA, 198 bp, Sorghum bicolor
  Clone ID: 30965705
catttgcaggattgcggcatttaatcaggatagttgcagtttttttgtccaagctgtaagaagtttcatgtccagtttctgtatgaggtgccctccctactctgaatttcatctcttgtacatgcaagtatctcctgtataatgctgctcctatgtttctttcaaacaaatatttcatgtacttgtaatcttgttaaa

SEQ ID NO: 25759 - DNA, 638 bp, Sorghum bicolor
  Clone ID: 30965712
gaagctcaggtacctgaaggcggtggtgaaggagacgctgcggctgcacccggcggcgccgctgctgctgccgagggagacgctacggcaagtcagcatctgcgggtacgacgtgccggccaagacgcgggtgctggtcaacgcgtgggccatcggcagggacccccgcagctggggggacaggcccgaggagtttgacccggacaggttcaacgacggcggcggcgtgggcttcaacggcacgcacttcgagctcgtccccttcggcgccggtcgccggatgtgccctggcatgggcatgggcgtggccaccgtggagttcacgctcgccaacctgctctactgcttcgactgggagctcccggacggggtgggggtcgacgacgtgagcatgcaagaggccggagggctctccgtccacaagaaaacgccgctcctgctcgtcccgactagatacaaatgtcgatctcgagatcagactgtcgtcagtactcagtagtcgtgccagtgcttaattatagtattagctactgcatgcatgatgatgagtagtgatgaccattttattaattagcaacccttgcattatatatattattacagcagaaaaaacactagctagccatagctagctcttg

SEQ ID NO: 25760 - DNA, 639 bp, Sorghum bicolor
  Clone ID: 30965718
cgcagctccatactcaactacgaatgtgggagcaaagagatgatccatctgtacgagatcctgctcaaggcccccggcgtcctcggcgcccggttcagcggcgccggcttcaggggctgctgcctggcgatcgtggagagcgagcgcgcggaggatgcggccgcgtacgtccgtgccgagtacgagaaggcccggcccgagctggtctccaggatccccgcggatcgccgcgtgctggtctgcgagcccggggactccgcgcgcgtcatattgcccgatcctcacatgcgctcctgatcgatggcaataagcgtggcattggccggttcgtttgtggcggccctgtttccgctgcgtgaagccagaaaagcgagcgagctcggggacgcgtcacgcaatccaaatctcgcttttttcgcaggcaatggtagagctgagacgcgaagcgtttggttttagcttaaacgtagcagtaagttgtattgagtaaaaagaagtggaactagtccagtagtctttgccgctgcgcttggtccttgccgttgcgcttggaactcgatctactgggttagtactctccgtccagtttgtaaggcatttcaattcacgtatgagaaattaaattttgaaactttgatc

SEQ ID NO: 25761 - DNA, 620 bp, Sorghum bicolor
  Clone ID: 30965724
aattcgacaatcagacacttcggctgtttaagatggaggatgtgagcatgggcatgtgggtggagaagttcaacaagacgcggcggccggtggagatccggcacgacgtgcggttctaccagtcgggctgctacaacggctacttcacggcgcactaccagtccccgcagcacatgatctgcctgtggcggaagctgcagtctgggagtgcccggtgctgcaatgtgagatgacgatggcgaaaacctgatctttgtggctaattccacttttgaggttcaaagaggacagacagatggtggacgacgggtcgacagcccgtaagaacagctcgcttatgaggaacgacggctgacgacccggtggtggtggggatgagtttggaggagtttgctcctcttgactttgtgatacgatcgatgattcgttcattcttttgatcggtggcccgtttcagctgctgattctgacagtcctgatcgatgttcttggtcagggattcttttatacactactactacctgttgatattgtagctgcgtcaaacttttttgacctagaaattttgacttgggcgagttgggttagtatactggcggtgtttgtgtataaaaaggatt

SEQ ID NO: 25762 - DNA, 586 bp, Sorghum bicolor
  Clone ID: 30965756
cgccaaccacaccaaatacgggatcgagtggccgttcatggtgtgctgtggcaacggcggaccgccgtacaacatggatcagggaaagcctggctgcggcgacctgtgcccgccggaggcgaaggtggtgagctgggacggcgtgcacttcacggatttcggcagcggccttgctgccaagcttgccatgagtggggagtactccaagcccagggtgaagctggcgagcttgatccatggcggatccaagaaagcgtcagattcttgatatggttcatcattgatcgagttgtgaccttttggatccacatctatagaagatggaagatgggtaacggtgatgaactgaagagacgatgaaggttgtcgtggttggagggaggagatgttgcatcaggctgtttcttgacgtcgattgactccttgtacacagaagtacagaaggcaaagtagcaatggaaatgatcacttgcaattgcaaggttaagttaattttggtgtcttcttttggatcttgtggttggtgcagagtacaaaagttttgtacctttgttgtacgtgtatagactatttatgatagttattc

SEQ ID NO: 25763 - DNA, 595 bp, Sorghum bicolor
  Clone ID: 30965757
acgcggaggttgaagaaggcatatgccaggtcatgtcttacctgtggctggaatcagagattcttccgtcatcctcaaggcacgcgcagccttcatcctcttatgcctcgtcctcctcttcgtcttacccaccaacatcgtccaagaagggtggaatatctcatactgagaagaagctgggcgagttcttcatgcaccagattgccaatgacacgtcaacggcctatggtgacggtttcagaactgcgtatgctgccgtcaacaagtatggccttcgccaaacactgaaccatatacgcctaacaggaggcttccctgtataataagatagaaaaaagagaaaatgtccatgctggacgcaacacaaagatcatatggatatcaaaggttatatacatattgggatcaagttggctatggaagcatagtgattcagtttcggtgaccttgagttttcaaagaggtcctgtcagagtaaatcagaaaaggagctgtatttgctcgaattaattggaaggaattggcggtgcccaagtgtaataagttcgctaaagtactaatgtaatgcactgttactcacactaatataatgaag

SEQ ID NO: 25764 - DNA, 674 bp, Sorghum bicolor
  Clone ID: 30965795
acatgtgacgggcgacctttccagagcgacgcctccagttcgctgttcgccaagggagccagccagccataccaattaccaaaccactcatcaggtcgcgttgccagccgctcaagccaagacagccccctaatctccccgggatcgtggctcgtggtgagctaatcggggcgccccaaccatccctcaccaagatctcgacaaggactagactagcccatgcgcgtatcagttggagtagataagcggcgcgatgggtatgaggagcaggcacccaaaggcgttgggtttccgctgctacccggcaagccaccggtccctaactctggtactgtggagcctagcggcattggtcgtcgttgtgaatttccatcttctcatcattcataaggaggaggctgagagtatgagtacacacgagatccggcgatcgattatgagggaactggaggtggtggagggaggagaagttccggctatctcctccacggagccggaggaatccccgggctgtgcgccgcaagggagagaagaagccgcctacaatagtggatgagttcttggatcagtcttctgcagtgcatgatatgttcttcccagaactgaatacggctgtagatccaatcaatggaggaaatgacagcatgtacttctactaccccggcagaatttgg

SEQ ID NO: 25765 - DNA, 595 bp, Sorghum bicolor
  Clone ID: 30965809
acacacctcctccaactccattccccacaagcaaactagtttcacaggacgccgtgttgaacttcattcgttccaaccgtcatcagctccccgacaatggcttccacggtgacgctggagaagacgaccaccatcctgagtgatgacgcaggtgctgtcggatcgcccaagaccgccatgaggtctcgtctcctgatgaagaagggggcagcaggtggcgccaaggccaaggggaggtgctgcgggcacaggtgcgagctcgtcagctacgacaagctgccggagttcctcaagcacaacgagttcatcgtccaccactaccgcagcgagtggcccatcaaggaggcgctgctcagcgccttctccatccacaacgagaccatcaacgtctggacgcatttgatcggcttcttcgtcttcctcgcgttcgccgtgtgcgccgccacggtggtcccggcggagtacgagtcgcctcacatggcgacgacaggcctgggcaacatcaccggcaacgcagtggtgctgaggagctactacagcgccgacggagcgatcttggcaagtacaatgaaggcgttccgcaacgtgtccgtcg

SEQ ID NO: 25766 - DNA, 614 bp, Sorghum bicolor
  Clone ID: 30965819
aaccctaagtctctcggcagctgcctctctcccgcagccctatcgcatgcgccgcagtctctcccgaccttgactctccagcagccagtgtagccattcgcgagcaagacgtaggtaagagatgctcctttgcactgattcgttttgcccaacatagggttgggttggaatacttcgttttggcactggttgtaggagggggcggagggcagacgcaggggcttcatcggcggtgggcagagttgggacactgggcgagtcctcttcgagaccatgaggcacctcttccgctccaacgtcctcatctctgggctactggagtagtgctctaagatcgtcaccgctcacctgagtttgggcgttggtgcttccctacgcgcctctgatttctacatggtatccagagcctaaatcaatctatccccatcgccatgtcgagctcgagctcatcatcatcaaatccccactctggcctcaaggtcccaaaaaagcttgggaaaagcaactaccctctatggaaggcgttcgtccgatctgctatacgtggcgctcgtctccagggtcatctctccggtgatgccaaggcacccaacaaagagatcatcaccaccgaa

SEQ ID NO: 25767 - DNA, 585 bp, Sorghum bicolor
  unsure (1)..(585): unsure at all n locations
  Clone ID: 30965827
ataacaccctccttcttttctttgttaatcaggcattttgttgttgtgttggagccactgccagagcaaggctgctagcatatagagccgccttctgaacttgcagcactcctctactctccgtttgcgacctcaaatggctcatgagatggcttgtttcctcggccctgctccaccagtgcctgctctgtctccgttccatgagggacaagcagagagccatggccatggccatggcagcagccgcagtgggcactcgagaggccactggcggccagccgaggacgccaagctcaaggacctcgtggcgcagtacggcccccagaactggaacctcatcgccaacaaactccatggcagatcaggtaagagctgccggctgcggtggttcaaccagctggacccgcggctcaaccgccggcgttcctcgggaggaggaggaggagcggctcctggcggcgcaccgcgcctacggcaacaagtgggcgctcatcgcgcgcctcttcccgggccgcaccgacnacgccgtcaagaaccactggcacgtcctcatggcgcgcaagcagcgcgagcacttgtccggct

SEQ ID NO: 25768 - DNA, 643 bp, Sorghum bicolor
  Clone ID: 30965843
tccggtgctcccagcccgcccggttcgccgtgatccttccacaccatgacgatggtccccctcgacccctcgtccaagcccacctcgcagcgtcttatcacggagggcgacacggtggtggtgtacgagcgccacgacgcgatgcgagccgtcgcggtgcgcgccggcggggtgctccagaaccgcttcggcgtctttcgccacgacgactggatcggccgccccttcggatccaaggtattcggttcttgcggcggaggaggcaaggccaaggccaaggcgggcggcggtgggttcgtgcacctcctcgcgcccaccccggagctctggactctcgtgctcagccaccggacacagatcctttacatcgccgacatcagcctcgtcgtcgcctacctcgagcttgtgcctggttgccttgtgctcgagtcgggtacgggcagcgggtcgctcaccacttcgctggcacgcgccgtcgcgccgcatggccaagtccataccttcgatttccaccagcagagggccgcctcagctagggaagactttgagaagaatggcttgagcagcctcatcacagtcaatgtgagggatgtacaaggggaaggattcccagaggaacattgtggtgctgctgatgctgtct

SEQ ID NO: 25769 - DNA, 658 bp, Sorghum bicolor
  Clone ID: 30965848
atcgcgcctgttcccctccgatccatagcaagcgcattctcggtcgcgcctcgatcccccatgatcccctccgatcctcagaaggcgcgccccgatccccgcgatccgcagcaaccaccgtcgagaccgccaccacgagcgtctgcggccgccggtggccacatcaccgtccgcgctcgccaaacgccgtctggggtgccccgatcccctctttctcggttgcgcctcgatcccctccctggacgtccgcgcgagcgatgtgatcttggccgcggccgcgagctctcaaacaccatcgcaaccaccgccacgagcacctgcctcgcacgatctgaaatccgatgaggcaggtgctggatccgatgaggtggaggcggcggatccatgcgagatccgccaggcgggcgtgggtttcggcgaggatgaagcggatccggtgagacgcacgccggtcttcagctctgcgctatgctcagtcccggcaccgacgccaagcagcctcctcctcgtcgttctaatcagggaagttcatcaccttcgagggtaccagggctgcgactaattgacctccccttgggctcgtactattacaacatttgctaggatcggtagtttggattgggcatttgttttttttgtccactgattattactacgt

SEQ ID NO: 25770 - DNA, 654 bp, Sorghum bicolor
  Clone ID: 30965884
cccgaagcgcgggatccgtttggattacggtactctaattgaatatgatatgaagatcaagacgggtgaacaggagaaggatgatctacagctgattgatggtgtgtctgtgataggcctcatgggcacagtggatcgttctgtattcacaagtcgcatcattggcgattatggtgccattgacataagtgcatcacgtctcgaccgtgcagttgaggtgactgtagaagttaccgtgtcagaagtgcaagacatcttccatttgtgtctcggctgtttcatcagcgggttacacgaagaaatccggctctttgatggcaccattggtgagccccgtggcttgaagaggtatgtggttgcggtagtgatgggtactcagatggatttgaagttcaaggtagacgcagagtcctctggttgctcagaacattgttgctccttcacggcacaccaacatgggcatgccgatcaattgatcaagactgattttgcgtcattcttggtgaaggtgacacggtctgttttacctaataagaaaaaccttttcggcgcgccagctaaaagagtagagtgatggcagcagcattggaacactagtgtaataaaaaatcaggctttcccaactagtagttgtaataaaagtttcgtacttct

SEQ ID NO: 25771 - DNA, 665 bp, Sorghum bicolor
  Clone ID: 30965885
caacaagtagcaccaaagagttacatttggtcaaaatccagattcttccgtatttcctcagtaacaacaatggttctgagcttgataatacctcttttaacaatgggcatggtgtggccctggactggaccagcagcatcagcgactcttgccccttatttggttggactcgttgtacagtttgcatttgaacagtatgcacggcataggaaatcaccttcttggccggtgattcctattatcttcaaggtatacaggcttcaccaattgaacagggcagctcagctggtgacggcactcacattttctgtcagaggaacagagacaacaaatcaaactctggctatcatgaactcattaggagcattgctgactgtccttcaaattctgggcgttatttgtgtttggtctctctcaagttttctgatgaggtttcttccctcttcagacattcctgatccctgactcctagaagctttggtagaactttggaacatgggcatagcttcccaaccattgtaaattggtaactggttacacggaaccagttcacatgtttgcaaggtttagcatttctttagggcttcttgatgcgatcttcggctgagtaattggagaaaaattgacactggaatcaaataaacagcaaataaaaggtctgaggc

SEQ ID NO: 25772 - DNA, 642 bp, Sorghum bicolor
  Clone ID: 30965890
atcgggggcgggcggcgagcgtcgcgctgacaagcggcagctggcgtgcgtgcgtaccttggcgagggtgttgcccgagagcggcgcgatgacgagggcgtcggcccaccggcgcagctcgatgtgcaggacctcgtcgccgacccgcctccagcgggaccactcgtcgtcgtcggtgtagagcgggacgccgtcggggaaggaggcctcgtcgatgaagtgcagcgcggacgcggtcgccaccgcgcggacgtccgcccactcggcgacgctgcggcagagggcctcgaacttgatggcggccacgctgccggaggcggccaggaggacgcgagggcgccgtcgaggcccggcccccgaggacgccggcgcctggtgggcggccatcgcagtagcaaggtggaaggggagaagacgcgcaaggcaagactgaatacgagatcgagaatggctcctagaagagtatactcgaaggaagcaggcaaatccaattcaattcaagctggataggcgggagccggaacgagaaatttcaatatttaggatccaattcatctgccttgcaacatttgaattgatatccgattcgtctgcctttcaaaatatgacattggggacgtaaattatttcaatatataagag

SEQ ID NO: 25773 - DNA, 633 bp, Sorghum bicolor
  unsure (1)..(633): unsure at all n locations
  Clone ID: 30965895
cggtgnccgcgggaggcggtggtggctcgggcaggtgccgcgccgagccgcgtcggagctgtggcctggtgagccgtctctcggcccgcggcggcgcggacgaggacggggacgaggacgaagaggaggaagcggccggggtcgaactgggccgccggttcggccacctcgccgtggagaataaggagtacttcagcggcagcatcgtggagggcgccggcggcaggggcaccccgctgccggcgtcgtcgctcaagcgctccaactcgtacaatgaggagaggagttgtaggcccggcgctggtgccatcggcgaggagacgacgatgatggatgagcagatggaaggcgacggagggatcaggggaagatgcatcccggggaggaagaagccaacgccaccgcagaaataggccacctcccatttctccatcagatttgcaggaaactaaacgcatctggctcaacctctttgtagtcctgatttgaacactagcgtagcgtgtttagcatagctatttgtcgttgagggcagggcatgcacgggagcttgttaactaggggatgagtactcagttgtgtgagtgttgatatcaccatggtgggtcgtcggctatcagcgatggcgaagaa

SEQ ID NO: 25774 - DNA, 620 bp, Sorghum bicolor
  Clone ID: 30965905
aaatgcctagtagtaacatatatagtcagccattgaaactatagaaacattgaaaaggggatgttgcatatgctactctgaaactgctttggggacaattctgagacagcaataaggagatgttgcatttgcattagcggttcatgtaccaatgggataccatactgtaataataattcgtgagttcaaataggcattagctatgagcgatgagtcccgtgtctcgtcaggtttgttccgatttatattgtagtggaggcttcatctgtcatatgactcatatcagggctgaaggcttcatccattagcaagtggagaagtctgacttatatcaagtctgacgcaagtgcagctgatgagcaattgaggcaacaaacactgcagtagcataaatgggcgagccgtgagtttcctttgctgtgcacgatcaaattgatgtaactcaaactatccttttgttttaaactgtgatttatttgttaggcagaaatgcagaattcaatttctgcatgaacctactttttagtccttcttttgctcctaatttaaaactattacatgtacatctcattgtcctatgtatgtaattggtggtgtatacggatgtttactaattatta

SEQ ID NO: 25775 - DNA, 645 bp, Sorghum bicolor
  Clone ID: 30965915
ttcaagccaggggaggccggtgacagagaaatggacaataaaatgtggcatattgagagagaggagtttgacaacgcagtggcaaacaagggtcctatcgatggtgaccgtctgaaactgctcgatacatttgagctctctctcctaaggcctgatggacattcagggccatatagagcataccatccttatgagaagggcatgacagccaaagtccagaatgactgcctccactggtgcttgcctgggcctattgatgcatggaacgatgtactcatgaagatgctggcaaaggactgaaacattatcaggtggtaccctaggcatggcatctgatttcaacaccagtattgtctcaagtctcctttgctgcaaaaacttgtggtatccagaaattcgtgtagcttcaaacatcacttcgcggtggatataatggtggttcttgaagcaatctccctagcagagggattgttattagttgttaatggtgtgctgtaaaagaggtaacttgtgatagcacgcccgagtgctccagttacttcttaatatctgtatgtatcagagtggtctaaggagtctcatacttgagttgcttccaaaaggaagtataatatataaacagtggcgatatatatagagcggtgc

SEQ ID NO: 25776 - DNA, 533 bp, Sorghum bicolor
  Clone ID: 30965918
gtagacgtagtagtctcctaagcttttgttggtggtttcaactttcagagcatgatgacgaaagaactggttagctgctgtcatcacgtttaattggttcatctttgggtcatgttacggtttcgcgggcgtcagcccatgacgagttagtttcttgtcagtcgtcgtggtcagtgacgaatttaggaaaatatttagagaatgcttctggtcccttaagataacttaagctcttttttaaagaccatcaataataaaaatttataggatgagctaaaggggactccatgggttttccccccgtaggggggttgaagccctaccagcccccccgttggctccgtcgctggtcgtggtcgtctgggtggtcgtctaggtttaagcatactgctatctcaagttacttttgatttccatcgcaggggtaattcatatactatgggggatgactaatatgatactgtatttgacttttcctttgtaagataccccatcgactgctcatagtaattaattttaagaggccttttgtt

SEQ ID NO: 25777 - DNA, 648 bp, Sorghum bicolor
  Clone ID: 30965932
ctgaggttattaatccaaaaaagatgtatgggccttcagctgatatatggagccttggctgcaccgtgttggaaatgctaacccggcaaataccatttcctaatgtcgagtggacaaatgctttcttcatgattggaagaggggaacagcctactattcccaactatctgtcgaaggaggcacaagatttcattggccagtgtgtaagagttgatcctgagagccgaccttctgcatcacaacttttggagcacccatttgttaacagaccactgcgagcttcatttgaatctgcatctcccccagccatcagattatagtattgatatagtggggtgtttcttgttgtgaggccaactttcaggtcacgtgctgatctttatgatttacactactggttccagaatggaattatgtgggcttatttagggtgtagtttagtatctgtagtccgtagggttggtgggcagcattggctctgtgtttttgtattctttgggtgttgattaggcaaagggttttcttcctggttattacgtagatttgtgtacactttgtaggtaaaaagggttgcaattgcctctggtgtagggttagctgatgtttgtgaatgattgatatcaccattctttacttaatattaatggt

SEQ ID NO: 25778 - DNA, 360 bp, Sorghum bicolor
  Clone ID: 30965938
gcatgaagtttgggcatggattgtttcatgacccaatgccaacctggctgatcatcttttggagctcggttgggattgcacttgtgattttcttgctttcatggtcagggaggagtccccaaagattcaggagaaagcggctgtgatagactgcaagaacttatttcagattatttcaattcgcttgtttattttctttttcattttaaaataggcgctgtacatatttgatatgatacgtgatgtaacttacgttttaggggagccccatttttttgctgctcctggcagggacttggtttgtcacgatagatcattgttgtcaacatgagattgataaataaatgagatagctgcagc

SEQ ID NO: 25779 - DNA, 649 bp, Sorghum bicolor
  Clone ID: 30965991
acgcacaccggcaaaaccaaacccaggaggcacacagcgtcgccggcggcgatggatcccctctccgtgctccgcgactacgccgcccgcaacgagctggacaagatcatcttctccggcgacgagatccacttcggctccgactacaccttcccggcctccacccccaccgccttcgcatccaagcagtccggccgcccctacccgctctccgccgccgtcttcctggcgcagcaccacgacctcaagcacaccgacttcatccaggccgcgcgcctccgccgcatcccgcccgtttccctccccgaccgcaagaccttcctcgacttcctccgcttcggccacaactcgctcccctccgccgacccgctcctcccctccgccttccagccgcaggagccccacctccacccgccctcgccgccgcccgaggaccccgcggccgccgaggaggccaccacggggaagcaaatccgcgcgctcgagcggcccttcaaggaccgcaacgccatcctcgacgcccgcggccgcgacttcctcgccgtcttccaggccgccgtgcgccgccaggacgagcagtgcaagggcggcggcaaggacgcggcgccctcttcccgccccgactctggctccgccgctgcagccctgg

SEQ ID NO: 25780 - DNA, 624 bp, Sorghum bicolor
  Clone ID: 30965992
atgactgcaatcattggacgacactctcgctccgtcacctctctgcccgcttcccaacccccgccgcgacgctccggccgccgtcgccgccctcctggcggcggcggcggcccgcccgcccgcgcctgctcctccctcccccacactcctccttccccacgctcctctccccccctccacttcttccccctctcccgttggcctaggggccggcggcggcgccaggtcttcttcggggcgggcgccggtggccagggccgggggtctaccggatctgggcccctggccccctgccctccggcggccttggtgtccgcatccggcggccgtggggactgggctccgctcgtttcctgccgcaggcggcgccccagctgggctactcggccgacggcggcgacggcgccccagctgggctactcggccgacggcggcgacggcggcccgcgtttcaaccgtccttcggcgacgtcaggctcctccgtggtggtgggcaccggcggcctgggccgggggacggccggatctggcccccggcccccctttttctgctgctgctgccaaccccaccgttctccgtcggccggcctacccgtcctgtccccggcgtcggcggcttgtggg

SEQ ID NO: 25781 - DNA, 649 bp, Sorghum bicolor
  Clone ID: 30966008
tctctctcccacccatatgccacggcactgtcaggtgcagtacgtttaacagcaacatccggtattgatcgtgcccaataagtcggcgtctgagaagaaattgagatgaacatcatggattccgaggtagtgcaggtggtagagtcgtcgtttgtagtgccgaacgagccgacgccgcgtgaggggctctggctctctcccctggacctcattctcgccaacagaggccacaccccaacggtctacttgtacagctccagcaacgttgccgccggcgacgatggcttcttcgacgtggccaggctcaaggaggctatggccaaggccttggtcgccttctaccccctcgctggccgcctcggcgtcgacaaccatggcagggcagagatcacttgcaacggtgagggtgcactctttgttgtcgctcgggctgacctcactgttgatgacatcaaggacgacttcaagccgtcaccggagctgaggaggctgtttgttccacggattgagccagcatcagtcatattggcaatacaggtgactttcctgaagtgtggaggtgtagtgttagggacggctctccaccatgccgccatcgacgcctcaagcgcgttccacttcttccagacttggtcggccatctctaagc

SEQ ID NO: 25782 - DNA, 630 bp, Sorghum bicolor
  Clone ID: 30966011
gtattatgtaattagaaccggagaagattgttctgtatgtctcctgtgatttaatttaatccttccatcatgaaaatggaattctcttgaattactggaatggatggtgacttattgttgactctagtaccatgactctgtttgcgtaacaccatatataagggagcttcacttgagcaaaccccttaaattatgctttctctggatcaatgggatgagttacctgcgcatctcagtcatctttatgtcattgctagctactttatccagtcagctgttagaaattcctttttgtgctaactgttgtataatggtattacaggaatttgactgtatcatgtgtttcttggtgcagatgtgttctacttggtgcaagctgtggtgcaaatattgctgattatgtcactcggaaggtggttgaagatgggaaaccgtttgacccaattaaggttgttgcacaagtactgatgtatccctttttcatagggagtgttccgacacactcggaaataaggcttgcgaactcatacttttatgacaagtccacatgtttacttgcttggagattatttttgtcagagaaagagttcaatctagaccaccctgctgcgaaccctctggcgcctggca

SEQ ID NO: 25783 - DNA, 672 bp, Sorghum bicolor
  Clone ID: 30966025
aagcgacgcccggcgcagcaagcaaaaagcggccacgcaaaggaaagggacggccgccccggaactcggttccgtcggttcccccaattcgcgtcccgtccgtccgtccgtcgcctcctctcccttcctccctccaccgccctcccctcccctcccctctcctctccactcctctcccgcacacggcacagggcacgcggatctgaccaaaaccgtccaggaggccctttccctcccgaccgcggccgaccgcgagcaacaaccggctccgcctgtcctgtgccatcggcttccaattcgatcgatgtgcccgatggagacggaggaggacgacagcggcgggtgtgacttcctcgactggctcggccccgacacctccaccaccgtcttcgagctcctcgacgaccccgccgacctcgcccgcgtcggcgccgtctcccgctcctggcgccgattcgtgaccgagaacgaattcagcaagcgcctgtgtcggcggatatgcccggaggccgccagcttcacccgcgcggtcgtggtgacccgttcgccgccgccgccgcagcccgccgcgtccgcgtccgagtccagccaggacgctgagtgcagggcccgcgagggggagcacgcggcctactcctacctcgccggcgcgatcgtctccgccaagcccgc

SEQ ID NO: 25784 - DNA, 603 bp, Sorghum bicolor
  Clone ID: 30966028
cctgtcgcgcgcggcttcgattccgcccttgttctcccacagtcccactcccgtcctcggagaaggaagagccgctctggaaccatctcctcgcatcgcacctcccctgccccgcctccacgtcccggtctggagcagatatgggttttttcggtagaacacctcctgcaagctgcccagcaacccggcactgcgcagaatgggcccgaatctacttgaagtattgcttgtgcagccagaaggaaggtgctgccctggcacttgggctaatcagtgtcataagctggggcctcgccgaggtgccacagataataacaaattacagacagaagtcaacagaaggactctctgtcgccttccttatgacctggattgttggggatttgtttaaccttgttggctgcttcctcgaacctgctactctgccaactcagttctacatggctttgctatataccatgacaacactgattcttactggacagacgctatactatagccacatctaccatcgtcttaaagcaaaaaaatccagggcagctagcaagccacaaaagcatcaccgtggggatgcttcattacgtgaaaagcttttgggcgcca

SEQ ID NO: 25785 - DNA, 673 bp, Sorghum bicolor
  Clone ID: 30966033
ttgatgttcagatctcgaggtgaattggcttactcaagagcacggtggtgaattggcttactcaagagcacggtggtgaattggcttactcaagagcaaggcctgcacacaggctacggacatggctggctgttctcccacctttctgaataagctcattcatgtaatgcttgaagtgaattgattggaacttattctaagcagcactggagatttgctcatgtaccgattcctcaaggttctaggatcatttggggtgatgaaaattgtgaaattcatatggaggtgggtctattatggagaggcatggtcttagtacttaagcggtcaagaacttatgattcacctcgatggatatgaagaaaacggagtagcagcatcagccatcaaggaagtgctattgacatcacggcttgtgtaacagcctaacaccccctttagattgtcacgctgagatcttcctggcgaggattgggagccagatatccttgacgatgatgatgataatcgccctactccatattgtcatattgttgtttgcactcttgcagctgacatgtttcgtgcttttgtgacgtacaaaaatgtgagcattgctcttgtaaagctgcactagttcactaaaacattgttgttttggaatgattttacaggatcagcaataaggaaaaat

SEQ ID NO: 25786 - DNA, 614 bp, Sorghum bicolor
  Clone ID: 30966044
gcgcgtggcctgcagcccgcatggtccctcaggcgtcgtgccgagccttttcgtgcttcatgctgctctccactcaggtttgctggctagtgtttgttgaagctgcagttgtgctctttccggtggatgctttgccaccgaggtgtttccggcggatgctttgccgccgaggtgcgttgctttgccaccaaggatgcatctccggcaggtgggtcgttgaggttgctgaggtggggacggatgcttggccgtcggatggttgctttgccactgaggacgcgtctccggctgagttggtcgtcgaggttgctgaagtggagacggatgcttggccgtcggttggttcgctttgccactgaggacgcgtctccggctgggttggtcgttgaggttgaagaggtggggacggatgcatggccgtcagttgtcctttatgttgcggctacgaacactgctgcctacctaggtgttgagttgttcttcttgtttttggcttagctttgctttgttcgtgttctgagtttcaatggtaatccttggattacttacgaactctttgtatcggttacttgccgtttctttcggctcttctttttaatgaaaaacacgtgaag

SEQ ID NO: 25787 - DNA, 645 bp, Sorghum bicolor
  Clone ID: 30966087
tccagtagttagtcagaagctatatgaacattttaagacacaacaataccctagtcgttctgttaaagaaagcctggcagaagaactagggttaacatttcgtcaggttagcaaatggtttgaaagtaggcgtcatttcgcaaaggtagcttcttccaggaaaggcatcactccagataagcatagccccgaaaatactaatagcccggtgacacccagtatgcaacctaaagaacctgaggggactgtgatggaagaatctaatgtatgcataaatagggatgccaccatctctaaaaaagcggcctcttcaaaagttggatcaagaaagaaccttggcaagaattcccctggaagtgatgtgggagggtcaaaagttgattctgctgaggatcagaatccggggcctgaccttgcagcagagaaggcaaggcaaaaagcagtacagcaggagttgaagaagaagaaaatgggacgatgatgtttgtagacaaagacatgaaccagattttggactgctcctgaaatttccaggtcgggtctgaattcgctgcagcgctatgggccttgaaactttgtgttgtatggctctacattgatagccaaaaaaaacatagatataccattgcaagtcagctagctctc

SEQ ID NO: 25788 - DNA, 667 bp, Sorghum bicolor
  Clone ID: 30966101
ccggtgcagaagaagctgattcgtacggagagagctggcggcgctgggggcgccgtctccttcgaggttagggacaagccggcttcgctcaagtcagacgattgggggcgggtggtggccgtgtttgtgcttggcaaggagtggcagttcaaggactggcccttcaaggaccatgtagagatcttcaacagagttattggtttctatgtgcgcttcgaagatgatagtgtggaggcagccaaggtggtgaaacagtggaatgtaaaaatcatatctataagcaaaaataaaaggcatcaagacagaacagctgctcttgaagtatgggagcgcttggaggaatttatgcgggcacgcacataattgttgtgcactcattgactgttaaacacccaaatgttatgttgagctggaggcagactttgtgcttgttgatttactgatcggcagaatgactttatttttcttaaaggggaaggataaaagacaaccattttcctagattcaatctcaatattggtcgttgaccatagatggcagaatggaatggctgggagcacgtgaagactgcaatctttgtacgctaggatgtatttgtaatgttgtacttgcaaactgctaacttcttatttctaggcaagtatatgagataatttgcaagttgcgc

SEQ ID NO: 25789 - DNA, 591 bp, Sorghum bicolor
  Clone ID: 30966117
aatcataatttgtggacatgtgaaaatgatgttatatctgtttaatgtggcatggtatgtcctgtctatgctttgaacagagatgtcttcatggggttaattgatcttgttaactatgaaatcatctttatatgacaataacaaagttgtaggtaactttataagctttctgtgaagttaaaaatcatatttgttggagggctacaactccagttatgcttgtttgaagttcctatcagctttcctgcctataattgtaccctactgattggggcaacatgcgcagtcctaattgtgcaattaattccatagtataaattatgtttgctgtgaaacttgtctatacaaaagttgaagataactctttcatctcgcttgtgttagagtttcatatcatttggataaatggtttgtgagttataacggtataaagattatctgacaaaatgcttgttctctggaattcctggaccagattctgtaaatatgtatgtttgacttaggtaactttcaaatcatgctaagatgattaaatatgaattgtatataattttataagatttccataatgtcttgttgcatggattttgg

SEQ ID NO: 25790 - DNA, 640 bp, Sorghum bicolor
  Clone ID: 30966119
gcgttacggtctgctcatgctcgagctccagcctagcaggattttgctgtgctgtgcgtgctctccttctccgtgcgccttccagtctgtctcacactactagcttggatcgatccatcgatcgaagtgggtgtgtcagtgtcagctggcgcggtgaccacgcatatgagcgcacgcagcgcggagctgatcaagggaaagtgatcgatcggatggagctggagctcgggctcgcgctgccaaacccgtaccagtcgccgatggccgccggcggggagctcgtcggtctgctcagcggctcggcgggcgcgtgcgggaagaagagggtgttcggcgacgcgttcggggccgccgccaaggccacgcttcttccgctcttcgtgcacgaggatggtgacggcggcagcggcgaccacgacgatgtcgaccatgatccaagcaacaagaagaagaggctggttgggtggccgccggtgaagtgcgcgcgcaggcggagctgcggcggcggcggtggttacgtgaaggtcaagatggaaggggtggccatcgggcggaaggtggacgtgtccctccacggctcgtaccaggagctgctccgcacgctcgagcgcatgttcccctcggctaaccaacaaggtgc

SEQ ID NO: 25791 - DNA, 553 bp, Sorghum bicolor
  unsure (1)..(553): unsure at all n locations
  Clone ID: 30966151
ggtactcctcgcgccgccgccgccgcagttcgcttcgcgtgaccgagagctcgtcggcccccgtccacgcgagaagcgagaggttcgactcttctatccccaattcatccccccgatgcgccgtagctgtagattttatgctgcgtcacgcgtttctttatttgttcctgtttgcaagctttgattcatgcgtgagcgttctgaatcctctggcgttacgcgcttgttctggttccatggatattatgcgatggatgagcatagtaacacttgatttcttaattttgtatgttggatgctgtgtgtgactatnaatctggtgttgtcgtgtgggtgtcttattgatttcatccgtagacttcgtcgtgcaaccctgaagggtctcttaggttttggtgtcctccgtgaatgaagttgatatgtatgttagtctagttaaacatcatgatgaaggacacatttgttagtccagttctagaataatatgaattgttgtggaactaagcatggatgttttgggatagtagcccatgattcttcgtttatatgttgt

SEQ ID NO: 25792 - DNA, 654 bp, Sorghum bicolor
  Clone ID: 30966152
gcctgcgcctctgcgcctgcggtgcgccggtgcccgtcccaccaccgtccgcccaacctgctgcgccccagtcgcccgctactgcagatagcacagacggaggaaggcggaagccgatggctgccgtggcaagccccgccctccggctccgcccgagggccgcctctacgtcggcgccctcctcctcctccgcccctcctcgctgtcgcttcggcaccttctctcactcctgtttcaagtttgcgaggccatttccagttcagagagtcaatggaagtgcgccgcagcatttaggtacactaaaagcaggtcaagtcttaagcagcatcggtgaccatgatggacgacttcatattaagaggactatatgcttcgctgctaccgacaagcaggagccagtcgtttcaattacctcagatatgccggttttgcaagagacagaaagtggtattaaagtaagccctgcatctgaaaactcctacttcgctggcagaggtgctggtaaaccaggattcatctcttttcatggaagcagcttccaaaagacaactgtggagagtgtgccacatcctggaaaggaagcttctagattagtttggtttattggccctactatcctcgtgtctttcttggttcttccatctctttacttgc

SEQ ID NO: 25793 - DNA, 653 bp, Sorghum bicolor
  Clone ID: 30966154
gagcctgccctcgtcgatccagccgccgtcgcccgagatctagcccgccctcgtcttctcttcttcctctgccgggttgggagctggagccgtcgtgtgagctctaccatacagcgtcctaacattgccgaatctcttgccggaactgccccgaattcccgatgcaccgcctcattcctacttcgagatctctcctctctatggcatctgctccgcttcgctggtggcggctcccactcatggcggcttccaatccccccgtccgtcgtgtttcccgattttgttatggatctcagaacaaggccagcagcagtggagtaagaggcgaggagaagtctggtaaaccagacaacagacagctcataccttctgccagggatattatgaaaaatgtttagaatagtgacacaaccaaggagttcatcgaccgccatgggagtgtcaagtgtctatgtaatactgggaggaggtcaagcgtggatatcatttatggtgatgaagaaactcggaggaaaactacggatgtcacagatggtgaacaagaaacatggggggaattccgggaggctctgctagaagcggatgccaataagggggcagccaacatgcgccaggcagcagcagcagcacatcaatcctctgttgaccgtgta

SEQ ID NO: 25794 - DNA, 284 bp, Sorghum bicolor
  Clone ID: 30966164
aaaaaaaaaaaaaaaaaaaaaaaaaaagccaaaaccgcgagcgcacaaagcgacaacgccccccaaacctcctctcctcccctcgctccggttccggccatgtcgcgcttcttccgcggcgccgccctcaccgccgcagcggtcgggggcctgccctctgcactctcgtggaagctgtcgtcgcccattcccacttacttcgaaacttcgccctcctcttctccatcggcgcccgtaggccccgccgcggtcaccggccacctcgccctcgtccgcgcgcaccc

SEQ ID NO: 25795 - DNA, 670 bp, Sorghum bicolor
  unsure (1)..(670): unsure at all n locations
  Clone ID: 30966177
gaatgaggttgaggatggggtggcagctgtggagggcgagctgaaagagttgaggataggggagaccttcgaggggttcactggaacttcttcattgtcaacaacgaatgatgatgacgcgtccagtacaaccacagaggccatgttcatcatatcaccgaatggcaagttcaagcgtaagatcaagtcatggatgcgtggtgctcttctgggaagcggctcatttgggatggtgtatgaggggatcagtgatgagggtgcgttttttgctgtgaaggaagtatctttgcttgaccaaggaagcaatgcacaacaatctattgttgcacttgagcaggaaattgcactcctcagtcagtttgaacatgaaaatatagtccagtattatggaactgacaaggaagaatccaaactctatatttttattgagcttgtcacacaaggatctctttcatccctctatcaaaaatataaactacgagaatcgcaagtctctgcttacacaaggcagattcttaatggattggtttatctccatgagagaaatgtggtccacagagatatcanatgcgccaatatattggtgcatgcaaatggatctgtaaagcttgcagattttggattggcaaaggagatgtcaaaaattaatatgctaaggtcatgcaaagga

SEQ ID NO: 25796 - DNA, 668 bp, Sorghum bicolor
  Clone ID: 30966185
agcaccccccctcctcctgttctgtggagttcggagcgcagcgcaaggcgggggggaggaacaagccgccgccggccgccctcctccggctcgccaccagcctgcttcctctccgccgccgccacggggaggagcggcgtccaattcgggattcttataagcggcttcagccccgaggttgaaccaaagctattttctaagaaaatggcggcgacgatggtggcgatgactgcgaggagcaagaacagcgcattatctgtggagaagaagcaggtctggtctattcagctcccggagctccggttcccttgggattcgcatgaagacaagggcttctctctgagcctgcagggctctgggcctgctcatggcggtctgtttgctagcgtgggtcttaaagtgtcgacaggtgcgccagcagtggcgcccggtccgggtgacaaggatattaagattccgtttgctgatcattgtatgaagtacgtgtccgaggcggttgggtataaggttattaccactaaggctgagccagtggaggaggaggtggtggatgctaaggcaaagaaggcggccaagaaacgtgggctgaagctgaaaattaagattgggaacccacatttgaggaggctggttagtggagcttttgcgggtgctgtttccaggacttg

SEQ ID NO: 25797 - DNA, 671 bp, Sorghum bicolor
  Clone ID: 30966187
gtttgcatcaacttatgctctatatgataatttttttaggtagacaaaataggattgaccccttttaattaacatttatcatacctccttaggttcaatgtttccaccaggtaaattgtatctgcagttttctgttttacttgcttccctttgttgcatatgtgtagttctgtcatggtaatatgaaattgtctctgttggagttaactatcaattgcacaagcagggcagaacaccatctatggaaagatcaagaagcttgaagcagaggttgtgtgctacagcagaaggtcaagaagacagacgcatttgctataaggagtagatcaaagaagacaattccatgcctcgtgcagtcatgttggaggccgtgaaggcacgagccatgagtgccctcgttcctcaagcagcagaggatagttcatcagactccttacgcctaaatccaatgaagtgtgcagcagagaagagaagaaacgattgctcctgacttccttagcatattcttaaggctttaagtgttagtattttatgtttttattttttatatattttctaagtgttagtattgtggcattatttttttcttgcaatacacgggcatttacctatttatacatataatcgaacctatgtacaagatggtatcgagatacggcgaaacttttcag

SEQ ID NO: 25798 - DNA, 661 bp, Sorghum bicolor
  Clone ID: 30966192
gcaactccaattttcccagaggcggtggacgtggctcctacaataggagccgtacttctccaagtgaagaagatgatcgccccctatgccaagtttgcttcaaacttggacacactgcagataggtgctggcacaggtatgacgaagattacgtgccagatcccaagcatgtagccgctgcaacaaaatcctacagtgttgacaccaattggtacgctgacacggtcgccactgaccacatcacgagtgatctagacaagttggccttcagaaacaagtatcatggaggagatcagatccataccgctaacagtacaggcaatgaagaaaacaattctagagggatgatgccacaagggtctttatcctcttcctgctccaccaataaagcaagctcatggtgtgtctcgagttccaatgtccaggtatcatagtcgtctaggacacccgtcaactagtattgtcaaacatgtcattagtcataataagcttcatgtttccgttgagtcctcaaaagagtctgtgtgtgatgcctgtcaacaggccaagagtcatcaattgccttataaaaaatcagatagtatttctactgctccattggagcatgttttttctgatgtctggggccctgctcctgaatctgttggtagaaagaggtatt

SEQ ID NO: 25799 - DNA, 239 bp, Sorghum bicolor
  Clone ID: 30966223
ttgccatgctttcacaagttccataaagagtgtattgacgagtggcttaaaagaaagaaactgtgcccagtttgcaagtttgggattaattgaagtttgccatgtttacaagtgggagttctacttggtagtggtagcgactgagacgctgcaatttttcgtactggatgcttccctgccgaattttttttttgtccaagataaaataatttgttgctgtgatcagtgcttttggcctc

SEQ ID NO: 25800 - DNA, 568 bp, Sorghum bicolor
  Clone ID: 30966226
gatatgggtccgacaaaatgatgatttgtcgttactcattgtcacccgtcaaaaaagttttgccatactatggaatgtggggttgtgccatgcttggagagtagggatatattccaaggacaaggaccacggcacaagttccatgcaaactctacaacgcaaactaaacaatgtgccccaactgaattctagcgcaacagaaaattgatttgtgtgatcccaattggcctcgatcggtccccaacccggacacggaatgtgtccatctgcatgaagtccaccactgatccggtctcaccacgcacagaggaaagatgaaagctgctgctgcattgcgtgcctatcgacgtctcagaccagggacttgaagtgtcttcttgtaccgccatgacccaccaccatcaccttcgatccggaatctctgctcctctctatcccggcccacttgtggaatttcacgtcctcgtttcgttcacaccttggcatctatcttagggacgcattattacgttttttgtgatactgctcgcttctgctgtcacgtccgaatgaattccgattccattcc

SEQ ID NO: 25801 - DNA, 519 bp, Sorghum bicolor
  Clone ID: 30966249
cttgtattgagcaagtgcagcgtgcttgtgaagccatgaaaacatctttcacagatattagaccctttgagattcttcttcgcacgtatgaagtacgagatgttgctctgaagagtgtcacctccgaggaagcatgtgtggggcctcttccgcagaaaagaagaatgttgacaagcccaggtgaaaacacaggctgcacacaaaggagttcctccattttggttaggccgtgcagcactgttaaagggcacactgggtacttaacctttgcaaggctttgcgtgtgataggcaaacataatcatagaatagctgagtgtaaggattagctgatgacagatgttgataggaaattacactccattttttagcgcagttgtagactgtatgctttgatacgcctactgaagatccaggtatggtcgaatgctgttgtttcatctgcgcaagctctgtgctcgcctgtaactttatcttttctcttttctgagaacactgaaaatttgcgagtcagagaatc

SEQ ID NO: 25802 - DNA, 606 bp, Sorghum bicolor
  Clone ID: 30966253
ctcaagccagggccgggcaccgagcgacattgggggttgtactatgccaacggcacggcggtctacgagatcgacctcaccggacggcggccactgtggtcgtacccgcctctgccggcgccggagaacaatacaccgtacaaggggccgatatggtgcttgctctcggccgccgccagcaacaagctgaacgagacggcagtggggaacgcgctgacgtacgcgtgcgggcagggaaacgggacctgcgacgccattcagcctgggaaaaactgctacatgccgaacacgacggtggcgcacgccagctacgctttcaattcttactggcagcagttcaggaagattggagcgacgtgctacttcaacaacctcgcagagcagactatcaaagacccaagtcatggatcctgcaagttccctagctcgttggagtcgccttgaagacagaggagaggcggggcgagatgacaacatacaagtcttgattttgtgtaacctgcagattagacgacttgggaggtagggaagtggtgtggggcaacgtagtagatgttctgacacacagtactacttcttacccagacttgtgctatgacagtgaag

SEQ ID NO: 25803 - DNA, 661 bp, Sorghum bicolor
  unsure (1)..(661): unsure at all n locations
  Clone ID: 30966268
atccccaaatcgcgcagtcaatttttttctatccgatttgaatcattcatgttaaattcctctgttctatacgctctcgattttaccgggtcaatcaatcgggctaaaggagagaagatgggttggtggatcgtggtggctaacaagttgggaaaaaggtcaatgaagcccatgttgccgccgatgtggaagagggattaaaaattggtgctatttggtggttgaactagaggcctcatgtcatgtgatgtgccatttcagtctttggttctttccccagtcagttgagagagatggaatcatggaaaagctttggctgattggaatgtcgaattaggttatctacagggttgagagtgaaaatctgcccttgattgtcttagcaaacttggtcccatttctccaatgtgagagactggttcttgtcttgtgctttcctgcctgcctctttctgtgtgcagaccagacaggttgttggacgaccatcttgtgtttgatgctccacacaaaagtgtgtcttggtgagagtctgggcacgcatgagctgaacccatacctcaanggaattggttcagactacagcaacggcgtcaacttcgccatggcgggctccacagtgacccaccgcgcctctgactactccctgaacgtccaggtcgac

SEQ ID NO: 25804 - DNA, 667 bp, Sorghum bicolor
  unsure (1)..(667): unsure at all n locations
  Clone ID: 30966276
agagtctcctgtgtccctcctcgaggccactaccgctgccgcggtggcgccgtcggcgacccagccgctgcagggcctctcccgccgccgcgctgccttcgccgaacaacagccgaatccgtcggaggcgggagcgaccaccagcctcgccggcgccctcgcgcgcgagcggatcaggcgccgcggcgcggtcccggaggagcaggaggccttgcccttctggcagaggacctggttcctcgcgctgctgctggcgatggccgccgcgtcgttcgcgctcgcgcttctgctctacctcggcctcgacctccccgaggctgcgccggcgcagtcctacgccgtcgacccgggtaccgtcgtcgagataacctacgggtcagtgatcaagttgatgcatgagaggaccaagtttcggctgcattctcacgacgtgccctatggatctggcagcggccagcagtcggtcaccagcttccccaacgtcgacgacgccnatagctactggatagtgagacctcaaccagagtcatctgcaaaacaaggtgatcccataacacaaggaacaactataaggcttcagcatatgagaactagaaagtggctacacagccacctgcatgcttcccccataactggaaatctggaggttagctgctttggtgatgag

SEQ ID NO: 25805 - DNA, 611 bp, Sorghum bicolor
  Clone ID: 30966285
aagcctcagcagctcagctcagctcagctcgcaccacaacccttaccgttaagcaacagctagctagcagtggcggcggtgcacgtcatcgtagaaggcggcagcagcagctcgcctcagcatcagcatcagcaatggcggctcacgctcgtcctggcagttgtcgtccctctggtcttcctcatcctcctcgcaagaacaagaacacgaagaagagcaaagagcgggagcagcacggagaaagggcggcgcctcctccacctgccgccgggccctccgacgctgccgatcctgggcaacctgcaccagctgggcgcgctgccgcaccagagcctacgcgagctggcgcgccgccacgggcccgtcatgctgctgcgcctgggcagcgtgcccacgctggtggtgtcgtcggcggaggcggcgcgggaggtgatgaagacgcgcgacgccgactgctgcagccgccccgacacgccgggggcccggcgcctctcgtacggccacaaggacgtcgccttctcgccctacggcgactactggcgcgacgtgcgcaagctcttcgtcgtcgagttcctcagcgcgcgccgcgtccgggccgccgactacgccag

SEQ ID NO: 25806 - DNA, 666 bp, Sorghum bicolor
  Clone ID: 30966292
acccacacccgccgctctctcttctctctgactccttgtctcctctccttgccagcacgcacctgctcccgcggcggcgcggctcggcctctggagcgggacacagacggcgacaccggagcgggatctggagcgggacaccgatggcgacggcctctggagcgggatctggagcgggacgccgacgacgcggcctcagaccggatccaccacttgcctacgggatctggagcgggacaccgacgacgacggagacgaggagccctcactccggctgcataatcccatcgccgtcgccaccctcgctccacgccgccgacctcaaggagttcgtcaagggtacgtgccgccatctcccagccagcgctgggttcgttgattggtcgggttgtactagtcgttaagaattcgtagttttggattcaggtttttgaattcctagttaagaattactagtagtttttgaatgcctcagaccggatcctccacttgcagttgctttagtatcttacggcactaaacatggctgggttaagaaacttgatatgatttcagaaaaggtgggtgcgagaagctaacaagctattataagttttgcctcagcggccctacataaatctttattctccattgtcgtctctataatattagcaattgctatcccat

SEQ ID NO: 25807 - DNA, 665 bp, Sorghum bicolor
  Clone ID: 30966293
ctgcgttttctcctctctctctctttctctttctctctcctctcgctgctgctagtaggcagccgcttcttcggcttctctcttcctcccgatcttctcgtccctcctcctcctcccgcggcccaacgccacggccaccccgttcgacaccaccgccgccgacgccttcgccgcggccaagccgcacctcgcccacctccagtccatccccaaccccgcctccgcctccacctccgcgtccgcgcccgcgtcgtcgtcgccgccgccgccgacatgccccgcgtccatctccgtgcaccgggagcagctgccctacgacggcgtgcgcgtggtggagctcccctgcgggctcgccgtgggctcgcacgttaccgtggtggcccggccccgacccgccaggcccgagtacgaccccaagatcgccgagcgcaaggacggggaggccgccgtcatggtgtcgcagttcatggtcgagctggtcggcaccaaggccgtcgacggcgaggcgccgcccaggatcctgcacttcaaccccaggatccgcggggactacagccggaagcccgtcatcgagatgaacagctgctaccggatgcagtgggggcagtcgcagcgctgcgagggattcgcctcccgccccgccgaggacaccgttgacgggcaac

SEQ ID NO: 25808 - DNA, 664 bp, Sorghum bicolor
  Clone ID: 30966299
aaatccccccgatcccaccacgtacgagtacctttttaggagcgccacgtacgatcgcctcgccacccgcacggccgcactctcatcacacgcgctgcgccttcgccaccgcggccgcgccagcgccgccacgcacgcgcgcgggagagagagagagagagagagagagagagagagggagagagagaggccacagcaagagccgccggtgggcgggataggaatggtggcgccggggggaggagcaggaggaggtccgtcgcggtggccggcggcggaggagcttgacattgtacggaagaaggtggtggacattagtggaagggatgaacaagaggttagggttgctgcttgcccctacagaatttgccctttgggggctcacattgatcatcagggtggagttgtcacagctatgaccataaattatggagtactccttggttttgttccctctaatggttctgaggtgttacttcaatctggtcaatttgaaggtgttataagattcagagttgatgacttgcaaaagcctattgataaacctgagaacataaactgggaaagttatgcaagaggcgctgtttatgcactgcagaatagtggatatgatctaaggaagggtatcataggatatatttctggtgtgaaaggtcttgatagt

SEQ ID NO: 25809 - DNA, 660 bp, Sorghum bicolor
  Clone ID: 30966310
ttatattacccagagttttcatgcacaagttcaggcaaatcgccatgctgctgactccaggattccgttcgaatattgctacgatttgagctctagtgaagcaaggtttccaattcctgatataatcctaagaacagtttctggaagtctgtttcctgttattgatccagggcaagtaatctccattcaggagcatgagtatgtttattgcctggcaattgtcaagagcaggaagctcaacattattggacaaaatttcatgactggtcttcgtgtggtgttcgatcgagaaaggaaaattcttggatggaagaaatttaattgtttctcatcttcaacaactgagaactactctcctcaggaaacaaggaaccctggtgtttcccagttgaggcccctgaacaattcatcaccagcagcattatatgatagcttgctcatgatgcttattttggtccacttggccattacgttctgattcttctgactagttttggttaacctggctgtaaattagttatcaaagtagatactgtagagcttgactaggtggtacagcatagagaacaatattgtttagtggttacacgcctgcaattgggcaatagtaactagttgtgatgccgatttttgatgtctcgttgtacaagcattcccatt

SEQ ID NO: 25810 - DNA, 658 bp, Sorghum bicolor
  Clone ID: 30966324
agatccggtttcatgaagtggctctgcaatttcctgaaggggccgaagcccggcgaaccgaaccgccgccggccccaggtgacggccggagaagaggaggatgcgctttggcaccaacgaccagttagaccaaagaatgatccacctagaaatgacaacgaagaactggaccgtgcaattgcagagtctcttacagaggatgtcaaaccccccaaagagaaaaaccataagggagacaacaacgacgaagatcttgcaagagccatacaggacagtctcaacatgaacccttacacgccttataacccctatgctccctctcaggcccaacctagagggcacagggtatgtggaagctgcaagcatgagataggacatggccattacttgagttgcatgggaatttactggcaccctcagtgcttccgctgcagctcctgcggtcaccctatccgcgagaccgagttcaccttgctaggtacagatccataccacaagttgtgctacaaggagctgcatcatccaaaatgcgacgtctgccttcagtttatcccaacgaacaggagtggcttgatagagtatagagcccatccattctggggccagaagtattgccctttgcatgagcatgacaggacgccacgttgctgcagctgtg

SEQ ID NO: 25811 - DNA, 639 bp, Sorghum bicolor
  Clone ID: 30966359
tgatgcattcgaggctgatcaaacaaaggcagtcattagtgggattctcaagaatgaagccaccccaagcattatggatatgaaggttgaaaacactaaggaaacaagggaaggaattgaagatgatgatgatgccaaaaatgataacaaagaagagcatgagaatgcagaaaacgatgatgtagtagcaaaaacttctactagtgaccaagccgaaacaactgatgaaattagaaaagaagagatcgaacctggtttggtatcatctgttcaagaagcatctgatccagctccttcaaaagacaaaatactagagaatgatcttgttcatgtcattcaagcatcagagaaagagattgcagatgaaatagaagaaagtaaagaaatacatgaagacaatgctatttgtcatgatgaactacagacaaattctgaaaaggaagaatcgcctcaactgcgttccaatgaaccatacaatgtggatgctaaaattgatgcaacacctctatgcgaagaaataatccatgacaatgcaagtataaagcctagagaaactgaagagataggagaaaacaagggactcgactccacttctgaaccttctgtagaatcatccatacagaataatgttgaggactc

SEQ ID NO: 25812 - DNA, 617 bp, Sorghum bicolor
  Clone ID: 30966369
actcagactacctggccgaggccggcgccccgaccgtgtcgtgcgcgggcggcgagaccgtggcgcccgaggaggtgttcgcgctcgccagggcgcaggtggactacgtgctgggcaccaaccccaggggcgtcagctacctcgtcggctacggctccaagtaccccaaccgggtgcaccaccgcgccgcgtccatcgtgccgtacaagcacagcaaggagttcatcggctgcacgcaggggtttgaccactggttcggcaggcggagctccaacccgaacgtgctcgtcggcgcgatcgtcggcgggccggaccggcaggacaggttcagggacaaccgggagaactacatgcagacggaggcctgcacgtacaacacggccccgatggtcggcatgttcgccaagctgcaccggatggcgcggcaggagcgggaacacgggtcgccggcgccggtgcccgtgacgtccactgcggctgaggtgtaaatagataggatgtagagcggggggctgtacaattttccccattctttggttcattcttttttgggctttgaatttcattttacacagatcgaggttattgtatacaagaaagaaaaagaaaaagggtgg

SEQ ID NO: 25813 - DNA, 629 bp, Sorghum bicolor
  Clone ID: 30966390
tgatcaggctgaagaactatttgacgttgcatcaaggtacctgttgtttccccttaagcgggtcgtagctgatatgctgttgccatatctggagcatgtgtctcctgcagaactgtgccattggttgatgctgtctgacatatatggtgtcatgaaaataagggagtatatcttggatatcattgcttgcaactttgagatgtttgcagacacccgggagttccgggccttgctcttgactcttccaccaccatccggagatgactcactacggacaactcgtcccagtgcacctgggactggaggcaacactgaccaaggcaacattcttgatgatttgcgcgagaagtggctagaagcagagggtgctgagcttgacgaaagggatgagagtgcagctctgttcgacaggcgactggagatgcttatgctagttgcagagaaagaagccgatgatgtagacgcttgagtttcagggagaacttgtgcggatagcactgtttttgcaggctttacattactgcagagtggcttaggtttgtgagttacaagtttatcttttgttgtatgaacttcaaacagatcagttttgaccgatcaaatatccagtgagcaagcatagtagatcg

SEQ ID NO: 25814 - DNA, 580 bp, Sorghum bicolor
  unsure (1)..(580): unsure at all n locations
  Clone ID: 30966406
gcgggctgttcctcatcacnggcgtcgtgtccggcctcatgctcctcgtctacctcgtcacgttcgtctaccgcgagcgtggagagatccggccggagccagaggaggaagggtcggggagttcgtcgatgcgccggctgcgcgcttggctgcggcacttcgaccagaaagacctcaagtgccccacgttcaagacggggaacgatgactccatcagggatgggaaccagacgcagagatgggctgagtttgagtccgtcaggaacggccgtggcgggaacggaccggtgcaggcggcggccgaggaggaagccattgccattgccatgagcccgctcagtttcagcacctccactccgtcggagaggatcaacgccggttcgtcgccggcgtcggagcttgggacctcgttcgaacagaggatgcaggaggcgccacactctgtgtcggtggacatgccaggatcaacggccccgtaactgtacacgtttacaggggaatctgtccttggcatgcctaacaagccaatgtctagacaatgtacatacatcagctcagcgaagtgctgacatcgcactac

SEQ ID NO: 25815 - DNA, 581 bp, Sorghum bicolor
  Clone ID: 30966430
gcatcagcatcaccaccaccctctcctcatcaaccgagccagcggccacggccagccacgcctcctgccttccacccgtgtcctccctgcaaactgcatgcgcgaagcaggtgagacttgacaggagcagccagccacgccccgccccacgccacgctccccatgacgcccttttaagaggaggacgaggaggcggtggaccagttcgttcgcgttgcccgcgactctctccgtcctcctgctgccacccgactcgtctcacacgcttggcgcgcgcgtgcttccacccgtccgtcgcttcgattggtttggttgccccgggctccagcaatggcggcgcaggcatgtctgtacgggaagtcgggaatatgtaatcgtctatctacctgagaaaaaaaaaaaaaaaaaaaaaaaaaaaaaaaaaaaaaaaaaaaaaaaaaaaaaggcaccgaaggcacgcccgcattcgcacaccaaaatgccacacacgggcgccatgaaaacaaaggtcctggggctcctgctcctgctctccgggggctcctcgctggcgctcaaatggcaaacggacacgggctccg

SEQ ID NO: 25816 - DNA, 639 bp, Sorghum bicolor
  Clone ID: 30966431
agtgctcgacagctgctgccgcgctggtcgctgctgagtgatccatgcagtggtagaggtagacgagatggggacgctgctgcgctactactcgtcgtgctctcactccgactccgtcccctccctccgccaccgccaccacctggggctcgttctggcggcggcgctgctggtctggtgccaggccagcctactgccggtggccacggcgcagcagcagcagcagcagccggcgccggcgccgcgggtgcgcgtgggcgtcatcctcaacctgacgtcgctggtcgggcagcggcggaaggtcggcattgagatggcggtggaggactactacgccgcgtttccgggctccagcaccagggtcgcgctgcgcttccgtgactccgacggggacgtcgtcggcgccgcttccgccgcggtggacctgatcaagaacgagcaggtgcaggccatcatcggcccgcagacgtcggcggaggccgagttcgtggcctacctcggcaaccgcacccacgtgcccgtgctctcctcctccgccacctcaccggcgctctccccgtcgcagacgcccttcttcgtgccggaacagaaagcggacatcgtcgtcggcgacgtgacaatcacggcgagcaggatgga

SEQ ID NO: 25817 - DNA, 643 bp, Sorghum bicolor
  Clone ID: 30966459
aattagatttggtccagcttgataacctgtatgatgcctgtgccattgtaatctgctggcagatgccataatttttatcattcctgtattctatgcaaggatatgattgattttaacatatattgacaagatagtttagatacaatcacataattaaactttcagctctatctgaggagcaaacttgcagcagtatgaagtttttttttctgttgtattatatgtctccatggagtgacctttttttcatgtttaatcattactgttttcaactacttagcttgggttcaggttttattttaagattcacacattatgtacattgttctctaatttttattttttccctgttccttttccttcccttccattcaattaatggaatgttgataccttgcaattgcaccagcccactcaattgtacttcagatagcatcttctttgattgtcctcttttgcatactcttgttgacggtgctatcatattcttgaaaaccttccatgctgtccatctgagcattcttctatctctgcatttgtcccttaacagtcacttgctttgaggttccattttccatgtggatacccatggctgaatccagtttgagattattacataccttttgttctagctgtttctgtt

SEQ ID NO: 25818 - DNA, 639 bp, Sorghum bicolor
  Clone ID: 30966460
acgacccgagcctagtctactatgctcagccgactcgccgcggcgcggcggcagcagctgctgctacccgcgcgcggcgccccggccgtcgcgttcgcgtaccgctcctcctcgacagcggcggccgcggtccacggggccgcggcgcccgcgcccgcctccgcctccgtgctcccggacacgctcgacaggggctccgacgcctaccagcgcaacgccgccgccgtcggcgggctgctctccgacctgcgcgcccgcgtctcccaggtgctgcgcggtggaggcgtcgaggcggtgaggcggaacgcggcgcgggggaagctgctcccgcgggaccgcatcgaccggctgctcgaccccggcgcgtccttcctcgagctctcgcagcttgcaggctcagatgtttatggtgaagcattaccatccgcaggtataataactggcataggacctgttcatggacgattatgtatgtttgtggccaatgacccgaccactaagggtggcacatactatcctcttactgtcaaaaagcatctgcgggcacaggaaatagcttccgagtgcaaactgccttgcatctatctcgttgacagcggaggtgctaatctccccaggcaggctgatgttttccctgac

SEQ ID NO: 25819 - DNA, 640 bp, Sorghum bicolor
  Clone ID: 30966468
atgatcagcaggttcatgaggacaactaccagaagtggaagacaataaagcaattgaagttgatgaagcctccaagcaaagtaatattgccactcctgataatgcagctggagaaaggaatgaactggaaagtgatccagattcatatgcccagccagcagaacaggtagaattatcaatagacaatgagaacaacaagcttgtaaaggcagaagaaacctcagaccaaagcagcactgtcgcccttgaagaaagaacagaagattctgttgcaagtgaaattgacccacctgttgacattaaacaagagcaaccagtggaagaaatcaagggtgtcgatgccactgaagctgaagaagactttcatacaagccaagctgatgcaatagagaaactagcttcagacaataatatagcaacaatagaaccgacttatgatattcagcaagtggatgacttggaagcaacggaggaaaagcagagagttgaagccattaatgatggagaacaatccaatattgctgtctcagaggaaccaactccaacagataatggagcaacaccagaagatcaacatgtagaatcaaatgaaggaacgatggggaatgaaactgacaatgtcattttggcacacggaatc

SEQ ID NO: 25820 - DNA, 659 bp, Sorghum bicolor
  Clone ID: 30966473
agttcgccttggtggcttgctgcctccctagtcccatgaccatgaggccatgacctcatccgatccctttcccatccgcgcgtcccgactcctccccttccgggcctcaacaacgcgaggaggcgacgcaattctgggagctcgaaaccctagctcctaacttgagccccggtgccgtcgattcctcaggggccgccgcgattcggctcctgtagcagcttagggctccaccgctccccggctgcatcagcatcgacggcggcggcggacgccgcgacgactgcgctgcgctcgaggaagcacctcgtctcggcgggtcctcgctcttggaggccttccataaggcggtttcgtggtgccccgagcccggatctacggcgatctgggagggggaaggcgatggatgaggcgattcagtggtaacccccaatccggtgggtttcctgctggcagaggcggaaaggttcgggccttcggcgggtgatcagatttctccttgcggcgtgcggcttgtcttcttccgcgacggtgtaggactggaacgcaggagccgacaaggcggtggagattaaaaatttttttgcttgcttgtacacttgttcatgttcattagttcctgctatttgttctggtttaaagcatcaattttccgctcaatt

SEQ ID NO: 25821 - DNA, 623 bp, Sorghum bicolor
  Clone ID: 30966480
acagaggaaggtcgggagacggagcgcgaggccaggccagtcagtcctccgatcacgcacacacagacgcgcgcgcggagcgcggcagggaggaagacagccgacagcccacagcaggcaggcaggcaggcggaggcaggggcacggagcggccgcgcgccggccatccaccgccgcacatgcgagagggcgcagcggcgcggaggcagcagccgcggcgcgcacatgccaaggcgccgcgcggggactcccctcgtgcaatgagtagcgccgccgcgaccgcgacgtcgtgtcaccgcctcggggtcgcgctgccgctcttgctgctgcttgctgctgccgcggttctgggtggagccgaggggaaggcgcacagctacgaggacgcgctgcagaagagcctgctctacttcgaggcgcagcgctcgggccgcctcccgcacagccagcgcgtcgcctggcgccaccactccggcctcaccgacggcctcgagcaaggggtggacttggtggggggatactacgacgccggcgaccatgtcaagttcggcctgcccatggcgttcaccgtgacgatgctgtcgtggagcctgatcgagtacggcggcgacgtcgcggacgcc

SEQ ID NO: 25822 - DNA, 652 bp, Sorghum bicolor
  Clone ID: 30966511
gctaaacccatggcaccaattggtgtcaatagcaactcgagaacagctgaagcagttgacagcagacatcttcataaagtgggttctggtaacctcagtgggcactcatttgatcgtgtcggcgaaggagctatgggattttcaagaagtggaagcggtcctgtccgtggtcaccagctaatgtggaataattcaaataacttccaccgtcatcccaattcccctgtgctgtggcaaaatccgggatcatttgtaaacaatgtaccgtctcgccccccagcacaaatgcatggagttccaagagcaccatcacacatgattgagaatgttcttccaatgcatcatcatcatgtgggctctgcgccagcaatcaatccgtcactttgggacaggcggcatggctatgcaggggaattgacggaagcatcaagttttcatcctggcagtgttgggagcatgggatttcctggtagccctcagcttcatggtttggagctaaatagcatattttctcacaccagtgggaatcgcatggatccaaccgtgtcttccgctcagatcagcgcaccatctcctcaacaaagaggtcctatgttccatggaaggaatcctatggttcctcttccatcatttgattcacctggtgagcgga

SEQ ID NO: 25823 - DNA, 667 bp, Sorghum bicolor
  Clone ID: 30966514
gtcttgaatgaaaccactgatgtcttagtaacataaatatattaatctcttgcaccatggaaagtatattccattacattaaaacttcaatgatgctatgctctgttcagtttaaaactttggtgaagggtccttgagatgaggtatgttatgggtagaagattacaaatatgctctttcccagtgatggaagagtatattctggaacagccaagcctggaagttccactcaggtgaattgggccagagtaaattgaaagggaatcatttctgatgtgttctgatgcaatcctagtgtggtgaatggggaaaacttctgtggctcttcaactggggtcttaactctcgtctcgtgctgacttcctgaccttccagtttaacatggtgctgggctgcctctacgtcaacctggttggtccaggctgtgcagtcttcaaccatggttgtctccaaaggatgtgcagctgaagtgatggtgcttatcaccacaccctcagagctcatcaccacttgccgtctacacctccctcgccgacaatgcatacatgctacatcaacacgagggctgtcgccgtagagcgatcgtggagtcttgttgtgcgttgcgtcaccgtcaccaccaccgccaccgccacctctaccactactgccatcgtcaacaccatgc

SEQ ID NO: 25824 - DNA, 675 bp, Sorghum bicolor
  Clone ID: 30966517
gaaagtttcataatgcaggaaactaggaagctttctacactcaaagtctctaaaggtgcttcaacagttaaggtgaagcaaaacttaactacatcagtagcatacccttttactctcatcaaaccatcttgggaggaaggtgatgttactcttcaggatataaacaagcgaatccatgctcccccaaagaaggccccggagatcctgggaacttcagctttctctggcaagccagtgatcggcaagacaagaatcagaacagaaggggggagaggcagcatcacaattctaaggacaaagggctgaccggttctctggaagcctgagaatgcttttgatcccttatttatctgctactctccatttatcagaagtgaggggtgcagctccttggtagtcaattgtgcaggcctgagaacctgagggtgccattgatccacagctccttggtggtcaattgtgcaggcctgagaacctgtgggtgccattgatccacagttgaaggaacagagaggcctgagaaactatgattgccattgattctttgtaactttccaattattacttttattccttccagttttggtgttgaatcactgtagatgcaaactctttcttcaaaggttcagcattcttccggtgtatttatgacatgtggctaaatgataatatatc

SEQ ID NO: 25825 - DNA, 208 bp, Sorghum bicolor
  Clone ID: 30966529
cggcgcggcggggtcggggactgggcgaactatctgtcgccggagtcagcgcggcgcatcgacgctattaccaagagcaagttcgagggtacaggcctcagtttgtaaccagggaatgacaacacattgcgcttacgcctatgtgatgtctgatgtcttgtatctatcttgttaagagaatcgcagatttatgtattaaaatgaagag

SEQ ID NO: 25826 - DNA, 666 bp, Sorghum bicolor
  Clone ID: 30966625
agtcgggtacagtaggatacctcggtcgcatcgcgcacagtagacactcaaatccgattgccgagggtgcgaggagggttgcaacggctggttgcggcggcttgatggaccagtcgtaccatggcggcgccgccgccgccgccgccggtggaagcgatggccaaattctctgggattggcaaacaggagagcactgcgaacctagcgatggaagtcatgatgctactaaattcttgtgggattgcctcaatcaagatgacaatgagctgctgggattgcttggaaatcgaaccccactgagagactgctgtgatttcttcgccgaccttggtgacatcacctgcaaggagaccctggacctggaggaatctcgggagtcaaagcggcggcgcatattggagtacccttcagagtctagtcagtcagaagttgcaagtcatgaaactggttctccttttgtcacatctgaggtagcagaggtttcattgctctgcactgatgaaccagagagcttaaattgtgatatgcagtacacttcaaataatttagatacgaattcaaatgaagcaccctatgagcaagaagataaccattttgaacattgctcttatggaaccccagtgtacatcgagcctgatcaagtgccttgtagctgggagagcattg

SEQ ID NO: 25827 - DNA, 640 bp, Sorghum bicolor
  Clone ID: 30966633
aaatgtgagagccgaaaggaacctccttgcagaggttgatagtgcttatattgttaagctgtactgctcatttcaagatgatgagtttctgtacctcattatggagtaccttcctggtggtgacatgatgactttactcatgcgcaaggacacactgactgaggatgaatctaagttttacgttgcagagacaatactagcaattgaatccattcacaagcatagttatattcatagggatatcaagcctgacaatttgttgctagatcgaagtggccacttgaagctttcagatttcggcttgtgtaaacctctagatagcagtagcttcccaaatctgagtgaccttgactatgcagcaggtaagagcaccaatccatcatcagatggtgataagcaatccagtaactctactgcccccaggcggacacaacaggaacaactactacattggcagaagaatcggaggatgttggcttattctactgttggtacacctgattacattgcacccgaggtacttctgaagaaaggatatggaatggaatgtgactggtggtcacttggtgcaattatgttcgaaatgcctgtgggatatccaccattttattctgaagacccaatgtcaacatgtaggaag

SEQ ID NO: 25828 - DNA, 641 bp, Sorghum bicolor
  Clone ID: 30966635
tttgaccacttatacctgagctcaatgaaggttacactctaaccgattggtgctctcgagaagttatccagcgtaaggtcttcacagatcatattcagataatagcattggtaagggcacttggggtgccgctgcgagtggagtacctctttcaagaagttggtcaagacctgtacactgggcaaacctctgaggatgatatctcaatctgcatatgtttaccatgtcatcatcatgtactaccccctgctcatcaagttcctcgtgtgactgtgctatactcagatcaacactatgatgtgatctatccatattgtgctgatggtaaagtgattttaactgatgtgagatctagtcagcagtctgacaagatagagtgcccaaccgccgctaagagtccaagtcaacaccagggaagtagctacagtgatgagaaatcaagtcaacgattgactggatagatcagaacaccaatgatgaggaatcaaatcaccagttaccacttcctgatgagctattatgggatacctttcttcaactaccaggagctgacatccagcgctgcttgagggtatgtaagcagttcagaaacctgatcagacgtgagtctttccaatatcatcatggtcaggtatggtccc

SEQ ID NO: 25829 - DNA, 599 bp, Sorghum bicolor
  Clone ID: 30966640
aactcctgctcctcctagctccttcctacccgttacctgctgcggtccggagccgagacgacgaccacttccacctcctccccctcccgaacccaatccccatccaggcccctcccaatttccagcagcccgcccgcgatgcccaagacgacgacgacggccaaccggcgccgtaagcgccgcggcgccggcgacgagggggacaccgccgacggacaggccagcaacaagaggaggcccgccaccagcgtgctcacctcgctggacgtcaacgacgccccgcgcccggagctccccctcttccagctcagccggcctcgccagcaggcgggacgggacgacgaataggaagaggaggatgaggaggaggaggtgaccggcggaggaggaccagggtcgtcgtcgtcgtccgcgctcgccgccgcgggcaacggccacggcccgcaccagcagcggcggctgtgggtcaaggaccggtcgcgcgcgtggtgggatcagtgcagcagcgccgactacccggaggcggacttccgcgccgccttccggatggggcgggccaccttcgcgatgctctgcgacgcgctgggctccgccgtggc

SEQ ID NO: 25830 - DNA, 638 bp, Sorghum bicolor
  Clone ID: 30966666
acacacagcagtcagcactcagcaggtgtccatggagactctccaagctcatgatgggctgttttcatgcgtcttcctcgtcatcgttaccaccattaccgttctctacttgaagcaactgttgcttgcagcgttcaagagacgcgccagctcgccgtctctcccatgtccaagaggcctcccgctcatcggcaacctccaccagctgggcacggccccgcatgactccctcgccgcgctcgccgccaagcacgcggcgccgctcatgctgctccggctgggctcggtgcccacgctcgtcgtctccaccgccgacgcgctgcgcgccgtgttccagcccaacgaccgggcgatgtccggccgcccggcgctgtacgccgccacccggatcacctacggcctgcaggacatcgtcttctctcccccggacggcgggttctggcgcgccgcgcgccgcgcgtccctgtcggagctcctgagcgccccgcgcgtgcgcagtttccgcgacgtccgggagggcgaggccgccgcgctcgtcgctgccataaccgacatgtccagaagcggctctcccgtgaacttgagcgaggagcttatggccacgagcaacaagatcctgcggcgtgtcgcgttcggcg

SEQ ID NO: 25831 - DNA, 658 bp, Sorghum bicolor
  Clone ID: 30966672
atccttttaattggtttttcatcccaaaacatcctcgagtttgattttcctgctttttgcttacatgagtttcttgatggcttttcttaaatcattcatgagggattttctttttgttgctatatactgcactagtgtatgtgagtttcatgttgatagccttccagatcgcatacaagtgaaataacgaactggtgctagctacttggtattggtgttttaaattttaaatataattacgttcagtagaagataagtacttgaaaaatatatatagttagcttgtctgatattgatcaatgatgattagattgttgcatacaatttgacttggattacctcatatactttccatgcttattcatgtatgtacatgtcgtctttttatgtacacaaatgcaacttgtagcatttccctattgctggtttgtgctaaaaatcacttttatctgtacagctatatgccaatagagattgttggcttatgagaatgtttgattaatagtgttttagaatttaaggtactcctaattgccatttctgtttgtgttaaatttttgttgtggttagatgccaatagttcatagattcagcagtaattttgtaccagtacattgagaggttgcacttcattccttaatgtagagagcatttggtt

SEQ ID NO: 25832 - DNA, 634 bp, Sorghum bicolor
  Clone ID: 30966694
cgtgaatccaaatgagcccgggggaaaggctgtcagcgaggtcatcacggagatgaccggcggcggcgccgattactgcttcgagtgcgtcggctccacctcgctcatggcggaagccttcaaaagctctcggaagggctgggggaagacgatcatcctgggcaccgatgccggagcggcacccttcagcatatcgtcgtcggacatcaagcgagggcggtcggtcaccggcgggctcctcggcgggatcaagcccaagaacgacatccccgtgctggcgcagaagtacctggacaaggagctggagctggacgagttcatcacgcaccaggtgggcttcgaggacataaaccgcgccttcgacctgctccagcaggggaggtgcctccgctgcatcatctggatggacgacggcgccaaggagaacggcgcgctcgcatgacagacttgtcagtgtctgttcgtcactgtcgacaccataggttttcagagggggtcatgtcttcgcgctgttagctgtactatctcgttcatcatcgtgtattcgatcgtgttgcgctggacttgaggtgctcctccgtcatgccttgcaatgcatcaaaggatgcatgcatcggctactctgatgcgtgct

SEQ ID NO: 25833 - DNA, 653 bp, Sorghum bicolor
  Clone ID: 30966711
tccgtccgtatccagcttgcgtgatacgcgtgtctagtgcttgatacgtatcaggcaaacgtatcacattattaaaaaaaacaaaattccgatactcctccagtacgtactgaccgcgtatcggcagcgtatccgtatcggatacgtatcagatacgggatacgcgtgtaccctgaagtatccgtgcagcttagctcctttctgtggcgccgcgggctgccgtccactacacaagaccaaggtatactccaatggatgtataaatttgagcgaatttgggtttgcctgacaggatgccatggtcgttgagaaaagagaactggctgccgtttggactcatcaaaactggagttacttctggtgcctccactccggacaaggtcgttgaagacgcactgcagaaggtgtttgagatcaagcgtgaagaacttgatggagcaccccaagcattagagcctatcttgccctatttctcgaaacaaagagagccacgagccgagaaaggtcaacagagagactgctttttccagcatgtttggatacctgatgatgcagcttattacttgtggagttgtggtctgtggatagtaataataaaccgccgcgtttttgtgttgttagtttcggaacgaagttagtaaacagttcagacg

SEQ ID NO: 25834 - DNA, 606 bp, Sorghum bicolor
  Clone ID: 30966731
tggtcaaagtgcttctagagtacttttagtttcagtttgtggtttcatggttgcttgaaaatatctcagtcttgtgttctctttttgccccttctaaaaacaggatggcatttgcttggtagttgtcaatgttttcatcagctatcctgatgccatgattctaaaaaaaattgatggtctaagaaaatatataaccatgtccatcttatttatgcttctgtattgcaggtttatttttagagcatggttttctaactcacacttcatcttcgagccagcagcccgtgggttgcaaacaccttcccccacaaccatcttccccactaagaggagcttcctccccaggtctttcgtcgccgcagcatccctccctcgagcaggacattaggctcaaatggaggcctatgttgctcaaccaatagaagaagggcaaaatccgaagactcctgttgaagctgtagctcacgttctgccaaaatcaacttttcttcgtaatgtgttgtattttaagacttgtggaatgcttgtgatattgcagtcatatgtggtgatgttcattcatttgaatcagatttttgtatgacctaaagatatatgatataatta

SEQ ID NO: 25835 - DNA, 661 bp, Sorghum bicolor
  Clone ID: 30966743
gtttattcagattttttctgtcttggtcaatgttaatatgtctgtttagtcgcgaaaggtcagaggagatggaataactaaagatggtaactagctgccgaagacagtttgatgcagttgacattttagtggctatatttactcttttacccaatctttcttgattagaggttcaccagaaatgttgcctttatacatatagatattgttacttgtcacctgattgcattataatgtttgcttgagcttatcagccaaatctgtcagccattcagcaatatttttctctcaacaaatcagccaacagcacactctgccatggcttatcagccaaacgttgctattgtcttaatttcagaatatctcatatcaataattgtcttaatttcagattggtttctggcataaagaatgctactattgttgaccagttctatgacaaatccaactggtgcattgttctcgagaagctttgagctgcaggcaaagggaacaagaagccatctgaagctgatatttgggaggcttcagtggtaggcaagccaatgttttgatcccgaaatgtatgatgcattgttaagacttatgtgtcagattgcccgatattttgtgggccatctggacttgtagaaatatttgctgtcaatctggtcaacatcgt

SEQ ID NO: 25836 - DNA, 646 bp, Sorghum bicolor
  Clone ID: 30966745
gcctggcgctacactatggaccccagtagcactggcaattgggagctgattgatacagtttctttgcgtcaggtgtttgggcccaatgcagatcctacttggtcttctcagggtgctgatgttcgagtggctgcggttggggataatgctgattttgtgttcctaaggatacagaagaaagtcttctacttgcatatttcaagcaggacagtggaagaagtgtatgagctagcgcaacatgaatccctgttcgggatctatcccttcatgatggtttggcctcccacctttcctacattgaatggtgggcatgataatgatgaatgatcccacaagagcgaggtgccagattgggccaagaacatgtcatgaaggcacaggcacattctgcagcactggtactgagggattctgcattggcggtagatgggtggtgtgcactagtagaacgaagtgattcctgaagtttctggtggttgcagctatgttaggtgtttagttctttcagcgcattagctagttctatttggcaggcctgtaagcctgcagtgttgttaaatacttaaatcttttcccagcatgtgacatgtttggaagggatactactgatcttctaaacctcatgtggaccagtttaacgaaggac

SEQ ID NO: 25837 - DNA, 643 bp, Sorghum bicolor
  unsure (1)..(643): unsure at all n locations
  Clone ID: 30966748
gaagaatctttctacattggtgcactagtnatataggcataagttgtcatctctcttgtgagttaaaccgagtcaaatttctgttatactgctaccagtacattagtctgattgaagcttgtctnttcgttgcgattcctgtcaagaattcaactgtttgctcgccagtcctagctgaggttttctttatgctctgtacacacttttcaaagctgaggcatcagatatttctaatttctcctcgattggatcgacaagtgtatgtacactatcatcctggagtagtgagatggagacctggaagttgaaagccgaagtcttgtgcgggttcaaatgcaagtgaaatttccccgtgaaattcgtagtgagaccagacctttccagttgtagccgagtcttatgatgaaactcctttatttgataactctgccaagtcagcaattatgcttatgtggcatcctatttaatgtgcataacactctcatgaaacatgcattgagattagcctaaggaccaaagtaaaataggtatatatttgtgtgtatatatgtgtgtttcgagggaaatgctatgtttgtattcagccttgtaactttgtatctatagctgtgtcagaaggaaatgctataaactaaggcctgtt

SEQ ID NO: 25838 - DNA, 185 bp, Sorghum bicolor
  Clone ID: 30966751
ttcagggtgcagcaatttcaatttccccaggggacagtattgaagtgtagtactgtaataaggcagtgtcggtgcagggttttagtcaactggatagtccccccccgttcatgtaggttggtttaatgatcatgtgcgcgttgttgtcaaaaaaaaaaaaagatcatgtgcgtcttgacaaaatg

SEQ ID NO: 25839 - DNA, 629 bp, Sorghum bicolor
  Clone ID: 30966759
aaaatgataactttgcagacccagaagaatcaaacatgctgaatgtatttgaggtagctagtaagttgatcaaaagagaactggatcaagaaatgcatgggtcattagggcatggtgaagaggaaaacatggaagaaggaatggatgcatttgtctctgatattaatggcaaagatgcagatgaaaccgcattagaaaatagtgagtggacaggtactgaagaaggatctgctcgcgttaaccaggaggaccaaaattcatctggaagcaccaacagaggaaaaaatgatgtagatgcaaatcgcgatacaacttgtgatgaagttggatctgaacccctttcaggtgatgaagttgtcatcaaagctacaattgatagcatcagaggggtttccagcagaggagaaagagaattaccaacagaaaggtctacatgtgaagatcataggaaggcaagcataatggaagaaaaagatactacagcaaggatatcaaaggcagaacatgtaccatctcccttggagacgatgtgtggtgtaactaactctgctgaagctcccacatcagtagagaacatgacaagagcagatagtgcatgtgagaaggataaagggccttctcaaagagtc

SEQ ID NO: 25840 - DNA, 655 bp, Sorghum bicolor
  Clone ID: 30966768
gtactccgtacgttcgattcggccgttttctgcatcaacgggccgaacacgcccttgccgaccgccgccgccgccctaatccccggctccccgctgcccaggtcttggtcggaccctttaccggcgacgagcacccgctacgacagggcttgcatgatactagtattttcgacgataacagcaagaagccttcataaagccatacctgcttctcattcacattcttcaaacttttggaacaaagaattctttagctgtaagccaacatttcaacatcttagcactgacaacccgatgagcccaaatgatttgttggaggctcaggatagggttcctgctgagggaaaccacagttgctcctcaagtgttcagtccaccccagaaattgagaaaaagtatgtgcatcgtgtctatgatgctatagccccccatttcagtgcaacaagatttgctaaatggcccaaggttgctggattcttgaattccttgaggcctgggtcgattgtactggatgctggctgtggtaatggcaagtatttgggcttcaaccctgattgtttattcataggatgtgatataagcccaccgcttattgagatatgtgctgggagagggcatgaggtgttggttgctgatgctgtcaacctcccataca

SEQ ID NO: 25841 - DNA, 656 bp, Sorghum bicolor
  Clone ID: 30966773
cttattattcatatgctttataccagaagtccagaacagaatcactgacatataacttattaaattagtattttcaagatatggatggattattaaaattcattcactacatggtttagttgtaacttatggcaatggaacatcagaaaggttgtccctgtaagtttgcactggctatcatatcaataaagctactgttaaattcagttcaattataaaatgcagctacatgcatagctttgttttctccgcactgacgcagtacttgcagttaaggaactatagggattaaaaaaatttggtgccaccagatgtaaacatatcatgtttttctgttgcataagtggttttcaggacgagattgccactgccttctagctatactatttcagaaaaaaccacacattgcatgttttctgcatcaaaactgctccagattccctctaggtgcatgctaaatttcaggtaagagtctattttgaatagtttttaattagtcctattgttgccacacagggagttatagaattggaagtaaaacaacatttttgcctcttcacatatggacttctctgcttattctgtgtaacctatgtggtaacaaaacataaccatttaaatggaacacaacagatttatgatccttgaaatgattt

SEQ ID NO: 25842 - DNA, 673 bp, Sorghum bicolor
  Clone ID: 30966776
tactggatgcaaatctccaccaaggaagaagatgccacgacccaaccccgtcctcctcctggccatcttggcgcttgtgctgtcgtcgtgcccggcatcgtgcgccgcccccgtgctcctcccagtagctaaggatgccgccacctccctctacaccatccccacccgcgacggcgcccaccacgtcatcgacctcgccggcccgctcctctggtccacctgcgaccacataccggccaagatctcctgccgcgacccggtgtgcaagctcgctaacgcctaccgcgcgccgagctgcggcatcgccggcgccggccaacaatgctcaaagcggtgcaaggcctacccgtacaaccccatcacggggcggtgcgcagcggcggagctcgtccacacccgactcatcgccaacaccaccgacggcaagaacccgctgagccaggtctccgtccccgccgtggcggcgtgcgcgtcggcgacgctcctggagaagctgcccagggacgtcacgggcgtcgcggggctgtcggccgccggcctcgccctgcccgcgcaggtcgcggcgtcgcagcgcgtggccaaaacgttcctgctctgcctcccgaggtccggcggccgcggcgacggcgtggcggtctttggtaccagggggccgttctacctcaagctcttc

SEQ ID NO: 25843 - DNA, 669 bp, Sorghum bicolor
  unsure (1)..(669): unsure at all n locations
  Clone ID: 30966777
cttatttctcactgtgacatattgctggcatgttgaaaattagaagtggtggtgaattgctgattggctgtttcaaacacttgtcttaagtcttagtggcctttcagaactaacgcagatacttctgcaaaaaagggtgaaagaaagaactaacacagatagataattatctagtgtgcctaactacagagcttgcagtttttgcactcagtctcaagattcaatgtgccatgcttgagaaatgtggcttaagttcacattacaagaacgtagtttatatacctacatgcgaagaggctttttggcccatgcctgactggtgcattactggcacagcatggccaatgcatctccaaaggctgctcagagtctcagagatagcaatgatcagcatatttagattcgaacccttttcttttcagccatgcatgccattttaaagtgtcatactacagttttaagaatcagcttttgcaaaattacatgcatgagcagttttattccattcaggtccacctgcagacttcatggatgtcccaactatccatctcactgttgtggcatgatatgcaagttctgtctcaatggcatgtggacccaatatgtcattcccagttcaatgcanaaaatcatttgaagcaaaatttcatgataatgtttatatatgtc

SEQ ID NO: 25844 - DNA, 417 bp, Sorghum bicolor
  Clone ID: 30966782
aaagagaatgcgcgttcgccgttagccgccagccgggccaacatcgccatggcagcggcggggattggggccgggggaggagaggaccacgaccttcccctcgaggaggtcgacgccgtcctggcctccttctccggcgaccccgccgccgccttcgccccgctgccggcaccggaggcggcggcgtcgcgggagccggtggtggttgctggtgagagcctacgggaggggctgggggacgtcgagaagttccttatgcaggactacgaggacgaggcaccgttggacggggttgatgagttcttgaacggcatcctcgttggggacagcgagggcgagggtagccccaagctcactggtgagaagagcgcggatagggcgtgcgcgggggaggatgaggtggtggtgggtgtggat

SEQ ID NO: 25845 - DNA, 641 bp, Sorghum bicolor
  Clone ID: 30966809
ctcttcggctttcgtctccgcgccctagggtttctctgcctcgccggggaagcgatgcagccgccgcaccagccgccgatgaacgggcaacacggcccgcccccgccgcagggatccggggtgcccacccctccgcagcagcaggcgcccgcgccgccgtactaccagcagcaggcgccgccgccgccgcagtactaccagcaggcccccccgcagccgtgggggcagcagcagcagtacgctccaccgccgcagcagtatgcgccaccaccgcagcactacgcccctccgccacagcagcagtacgctcctcctccgccgcagcagtacgctcctccgccgccgcagtacgcgcagccaccgcagtatgggaccacgccgggaaccggtgaggtcaggacgctgtggatcggagatcttcagtactggatggacgagaactacctccactacactgccttcgcgcctgtgtgtcaacagattgcctctgtaaaaattataaggaacaagcagactgggcattcagaaggttatggttttattgagttttactctcaagccgctgcagaacatactctgatgaacttcaatgggcagatgatgccgaatgttgagatggcttataagcttaactgggcttc

SEQ ID NO: 25846 - DNA, 655 bp, Sorghum bicolor
  Clone ID: 30966841
attctctcacgccgcccacctctccctgctctctcctccggctgggctgctaccgtcgtcgctccctctagccgcgccgctgtgcctcaacctctggtgtacgccgccgacccccaagcatcgcgccgccccgacccattctgctgccactagtcgcgtcaggacgattagggctaggcatgggcgcttgtgcacgccatggccacgccctggccgacgccgcccctcctcttcctactaagcaggacaccgagcatcaccaccagagatctgagatgcaatgtccagcgctaccgaggttgaggtgtctggttgccttcatcctcaaacacgagctcaagagaatatctctggttgccttcatcctcaaacacgatctaagtacctgaacattattttggttctctgttgcagaattcttatgggttggttgtggtatagagaagtagtaatccataagcaagcattgattttatcaaattaatgaaatccattatctgttgtttaacctgtgctttccaatagcgtatattggatacttgctttatttcagaatactacctacctgcttcctaatgggaggcaaaaactgaaagtctgttgcccaagccttctgcagacaagagatattctaaacagaataaccactaccatg

SEQ ID NO: 25847 - DNA, 654 bp, Sorghum bicolor
  Clone ID: 30966851
aaaaaacagccttcgttctctttcactcccgccattccctccctgcccttcaaactcgagaagcaattttttttttaatttcaaaaatcaaccaaaaccatcttctccaaactaatcaagcaaaaaagaaactccatctctggaggatcgtccgagtccgttcatgtccgtggctgcctgccctccgtcgtcggagcagagcaggcagcacgcgtacgtacaggccgcagccatcatgggccaatgctgctccaagggcgccggggcggcggccgatgacgcggcggcgccagacgcaaaggcggaggcgccgagccgcgccgcgtcgaacggtggccaggagcggccgtcggcgtcgtcgtcggcggcacctgctgctggtaccaataacaagcaggcggtggcggcgtcgccgtccggcggcagggccagcacgggcacgagcagcagcaagccaccgggcccccttggcgcggtgctggggcggcccatggaggacgtgcgcgcggcctactccatgggcaaggagctcgggcgcgggcagttcggcgtgacgcacctgtgcacgcacaaggcgagcggcgagaagctggcgtgcaagacgatcgcgaagcggaagctggcgaccaaggaggacgtggaggacgtccggcg

SEQ ID NO: 25848 - DNA, 643 bp, Sorghum bicolor
  Clone ID: 30966862
ccgcgggcagcgaggccagggccagcagcgagcgcggcgccgggttcgcggcgcggaacgtggtggacggccgcgacgacacgtactgggcgccggcgccggcaacggccggggaagacgacgggcactactggatcgagctgcggcggccgggcgcgcgggcgttcaacgtggtgcggatccaggagcacgtggcgctggggcagcgcgtggagcggcacgccgtgtacgtggacggcgcgcccgtggccaacggcacgacggtggggcacaagcggctgcaccggctgccgtccgccgtcgtcgcgggcacgacggtgagggtgtggatcgaggcgcggcgtggcccgccgctgctctcggcggtgggactccactacgaccccttcgccgcggcggacacgatgtgacgtggcgacgggtggggcgcatgattgcttggtgggcgtaatggtggtccgtgggcagtcggcgtcgtcgtccctgtcctggtcgtcccagccccaagcgacggaaccgcgacgcgcgccaccaccaacggcggaccggcgaggaaagcggcgctgtgtctgtcggtcgttctggacttctgtcggtgggaacccggaaccgcataaaagcggcattggcattgccattccgt

SEQ ID NO: 25849 - DNA, 486 bp, Sorghum bicolor
  Clone ID: 30966866
cgttgatcttgaaactatgaagctcgagaagtttccaaacgtagagcccatgggggcgttgacctatctttacacaatcgcgtggccaccctctttcttgaatcctgctggacaaggcggttgatgtggtggggagctagtcatggtagaggcaatggtggaaaaggaagaatctcagttgttctgatgaagccttggggatgatcagttgctataggttgtgattgttctgatgaagtcttggggatgatcagttgctataggttgtgattgttctgatgaagtcttggggatgatcagttgctataggttgtgattgttactggtttctcctgtggccttggcccttgagtcctatatttgcttttttttactagattggcacaatgttgtccgtacactcaacgatgagagtattgtgtttggtggttgtgctctagttatgctccttagaaactgcttagtcgttgtatatctctaattatt

SEQ ID NO: 25850 - DNA, 470 bp, Sorghum bicolor
  Clone ID: 30966868
gcgttcctggcgtacgtttgcgtcgtggccgggtggagggtgttcgcgctcgccggcgggctcacggcgctgggcgtcggactgcacggcgccatgaggctgtgcaggtccaggaagtggctcaggttcaagaccggcgtggtcgccgcggcggaagatcatccccagcaacaaggtgatgtggtcgtcgtttctgctggagaccgagtttgaatgaatgaagtatccccagttccgcatgcgtgtcagtatgagttgaggtcttgcttggatgtagtcggattcacatcaatttacatgtgtcgaggtgggttggagtggaacttgaactaaatttcatttcaatccactccaatacatatggattgagatgaatacaagaacatccaaacaaggccttttactcaacatgccgtagtacatgtgctacattattttcatgtgatgtgatgaagagttttttttttttt

SEQ ID NO: 25851 - DNA, 646 bp, Sorghum bicolor
  Clone ID: 30966874
cgatacttcatcgagcaccgccactgccagcgccgccgccgccgcgatgtcgatatcagcttcggcgacgctgccaccaccatgccgccgtggccaatagctgtcggagtgcaagccatgaatgggggtgcaacgatggccgtcgagacggcgtccgctgccatcgccggtaccggtcatgacagcgaggtgggaccctcggcggcgaggagcttcaggctcttcggcttcaatgttgagtgcagcggcgacgatgcaccggcggcaccggcttccgccgaagtggagtatgtcgacgtcgacggcgacgacgactacagctagtagcagcaacgacgtaggtgggcagagatgatgatctactgatctggaagactggaaccttattactataggtagagctagcaatttctattgatacacggtggtgccttattgaatcttaactagtcattcttatttccaattggattgatggtttattttaggtaattgcatgaagtaattaatgatgattagatccttgctctctcgatcttgttctttggttccttgttcttgtttttgtttctgtagtataattattactactcttagtgcagttgattatgagcaagaaggcaattatttactatggtttagttgg

SEQ ID NO: 25852 - DNA, 204 bp, Sorghum bicolor
  Clone ID: 30966900
ctttacaccgagtcacccgattggtttaggagaaggaaggttaacaattcggtacatagtattagtattattattaggatcaaacaaggtgtagatcatggtgaaatataatcccatgatgtgctagttcgactactaccaatttttactgccatggagctcgagtatcatagtatgtatggtgtcatagagaagtcaataaat

SEQ ID NO: 25853 - DNA, 532 bp, Sorghum bicolor
  Clone ID: 30966903
ttaaggaggaagacattcccatcgaagaatttgagaaaaggaatttcccctatctactgaatgaaccccgctccattggtggctaccagtgcttgtttgctgtggatggattctccagagtaaaatttaagccccaaattcccccgctttttttggtgaaagaacccaaggtgttcgcccatgggaatatgagagaccctgacattttttcactgaattggcccggttgtccttgaggacagtgagacacacccagattcctgtcgcaggaccactaactgccaacagtgaagatgtgttctgtcagtctgtttgatacatatatgatatatactagtaaatctctgtgtctttccatgaagctacctgcaaatttagatggggatcctcctcccccagatcccaactccgaaaccaaaccccagctttaagggactaccattttgaggtgaaaaatttgtgtaacattttagagccggagcaaagtacccactcttttcctgaaatgagaatggggggaatcatagcagag

SEQ ID NO: 25854 - DNA, 615 bp, Sorghum bicolor
  unsure (1)..(615): unsure at all n locations
  Clone ID: 30966905
acgccgccaacgcgctggcgaagggcttcaacgacgcgctcagggcggcgctggccaacctcacggcctcgggcgcgctgccgggggcgcgctactccgtggggagctcctacagcgtggtgtcccacttcacggcgcacccggccgcggcagggttcagggaggtggccagcgcctgnttgggcggcgggcggctcaacgcgcagaccgggtgcacgcccaacgccacctactgctccgaccgcggcgagtacctgttctgggacggggtgcacggcacgcaggccacgtccaagaagggcgccgtggctatcttctccgcgccgccgcagatgggcttcgccgcgcccatcaacttcaagcagctggtgtcttcttgatgctcggaatcctgagctttctcaactgatgacgcaaatcattgcagctagcagcctagcacgaccaaaagagcttttgattctttattacacacgaatcagtagagatacaaactagtaataaaccaggaaatgtagagccgtagagggagggagcagcatatacagattgatgagtccagcactccagcgaggcaaatttctcgccatgtacgatcgtgaataataaacttat

SEQ ID NO: 25855 - DNA, 623 bp, Sorghum bicolor
  Clone ID: 30966932
cttgccaaagccaaggcacaaacagctctagcagagagtcgtgaagctgcagcaattgaagcttccaagcaagccgaggatcggcatgctcagaagcttaaggacttctaccttgccactaggcccaagagaagggccgacactttggaacaaagagagtgggacctgcccctcgcacctcccccaaataacgcctcatatgtaatttttgagacaaggtcgtcagttgatggaaaagaaatcctctcactcactcaagcatggacagataatggtgtctcctttcgtgccatcctctggaaggactgctcgagccccgaagcatgtgatcaatagacacatcgtcccctcatggaatgaagctaatacggtccgaagccacacctatgtacccgtattataatgcttgcatttttcgcctactatgtaatcccaagtaatgtaatgcatcggctttagtggagttagcagctttcgccccccgctttagtagttttatgtaaacatcctttcgtctaagggggagtggaccctaatccactcttttggaaaccctcacgccaggatatgtactttcacttgtggcttttttctttctgcttataatgtagtcctgctcaata

SEQ ID NO: 25856 - DNA, 647 bp, Sorghum bicolor
  Clone ID: 30966939
caccggctagaattaaaagcggccgcgcgtagcagttgtcgccaccgtcacgttggaggttggactccgcccccctgctggtgctgctcgtcgccttgccttcctccgccggagaccccgccgcctcagctgccgctccagcaggaggaggcaaccatggcggggaggtacgaccgcaacccgttcgaggaggacgacgtcaacccctttgcgggtggaagtgtacctcctgcttctaattctcggatgccacctcttcctcatgaaccagcaggcttctacaatgatcgtgttgcgacagtggacatacctcttgattcaactaaggaccttagtaaaaaggagaaagaactgcaggcaagggaagctgagctaaacaaacgggaaagggaactgaaaaggaaggaggaagctgcagccagagctggtattgtcattgaagataagaattggccaccctttatgcccattattcatcatgacattgcaaacgagataccaattcacctacaaaggatgcagtacctggcgttttcttcactgttgggattgacagcctgccttttttggaacatcattgcaactacagcagcatggattaaatcagaaggtgtcatgatctggttgctagcaatcatctacttcat

SEQ ID NO: 25857 - DNA, 489 bp, Sorghum bicolor
  Clone ID: 30966950
acaatttctcgccgacggcaggtacctgatatatctatcccccgacgccaccgccgcctccgccgccttcccttctcgcccagatccaaatccgaaccccgatccgcgcgcgcatgaatttcttcagctccgtcttctccgcccctgccggggaggatggcgaggagccgcggcaggagggcgagcaagagccggcggcccaagagtccggcggagggtggattttcggcagcctgatcgatacgctcaaggaggagattgaggagcaacggaaagtgaatgagtcggccgccgccgcggaggcggaggaggcccatagtggggccgagggagaggctggccccggcggcgggtggatcttcggcgggctgatcaagacgctcgcggaggagattgaggcccagcgaaaagagcaggaggccattgcagccgcagccgcagccgccgctgcggaggaggaggaggaggaggaggaggaggaggaggagg

SEQ ID NO: 25858 - DNA, 663 bp, Sorghum bicolor
  Clone ID: 30966955
aggtctaagcgtgaaccaattgagctaccttttacatagaccttcctcgcgtgtccacctttggttgtgcccataaagaagtccactcactacaaccaccctcgtcttcattgttggacttgtccagttagctaagatggcagatgaggcctggaccagcagctattgcctaaccactcctggtttcccaaaacttctttatgcaaccatgactaggctaggtattttagaccacccagaatatgttggcagggaatatgaagagtatggcacagagcggtgtgatgtggtcatttttgttggaccaagtaaggaatttcctgacacaataccatgggtggtatccaccacgggttttcgcttcgaggacacttaccaggtcgcagctcgcaaggctttgaggtacctatggcaaatttatgaagagcatgtaggtcgtacacccatgagattctttccccctttggaaaggaacagtcctgtatgggtagataggatgaggaccctcaaagggactaggttacgcgaagatgacccaacaatagtgttcatgtctgaatacttgctttccctagacgagcaatatgataggcaggccaacagtctaagggagtgcatttgtagagctgaggaggccgagaagcagattagaagccttgaagt

SEQ ID NO: 25859 - DNA, 654 bp, Sorghum bicolor
  Clone ID: 30966972
atgcccgcatgaacgctcagcacacttgctaccgaggctctcactctcacgagtcaccatgaaccaggagatccaaataacaaagctgccgtcgcaacgccaacagcaacaagagctgccactgccaccggaaggtgtcaccatcgtgcaagatggcacgtcgcaagaccagcagcaacaggcggcgcaaggtcgccacggcgccgtgcaaggcggcggccacggccaccaccaccaccggagcagccgcaagctgacggtgctcccgctcatcttcctcatctacttcgaggtggccggcggtccctacggctccgagcgggcggtccgcgcggcgggcccgctcttcacgctcctgggcttcctcgtcttccccttcgcgtggggcgtcccggagtcgctcgtcacggccgagctctccgccgcgctcccgggcaacggcggcttcgtccggtgggccgacctcgccttcggcccgctcgccggctcgctgctggggacgtggaagtacctcagctgcgtcatcaacatcgccgcgtacccggcgctcgtcgccgactacctggcccgcgtcatccccgccgtggccggcggcaggacgcgcacgggcacggtggtcggcatgaccgtgttcctgtccttcgtcaactacgc

SEQ ID NO: 25860 - DNA, 641 bp, Sorghum bicolor
  Clone ID: 30966978
actcaagatatctcaccaaagctgattcctcctctagccatgcccctctgctagtctctcatttctcatcaagaaaacttctgacagtgataacctatagatagccagctagacaagatcaagctctcttagctcttgagttgcattatattcagacatgctccatctgccctagatattcaagaaaatccccccaaaacatttcctagatcttgtgctatatatctagctagagcaagagagaaacgacccagccaattgatcccatgtacatggacctgagcttgggcacactggtacaagacactcaagaagttcaagaagaagaccaagaagacaatttggaccagcaacgagctataggtcaagatctccaccagcaaggtggcggcggcggcggcgagccaagccatggggtggagcgggagcacatgttcgacaaggtgctgacgccgagcgatgttggcaagctcaaccgtctggtggtgccgaagcagcacgcggagcggttcttcccggctgccggcgccgggacgcagctgtgcttccaggactgcggcggcgctctgtggcagttccggtactcctactgggggagcagccagagctacgtgatgaccaaggggtggagccgcttcgtc

SEQ ID NO: 25861 - DNA, 650 bp, Sorghum bicolor
  Clone ID: 30966987
accagtacacaccacactctcggctagctagctagcgagctactactactggacctctcctttccttattagctccaaattaaaagccccgcccctggtactacaaccctagcaagagcattttgccatgtctcccactatggcttcgtcgctctgcgtgtttgcagcgatgtctggcgccaccggcaggccgtcgtcgaccggtggctcggtggtgccgccgggccgtctgtccagtactgcacaggggaccaagggaaagagggccgtggtgcagcctctcgcggctagcgtcgtgacggacacgccgacgccgacgccggccatagctccggcggccccgccagctcggccagtcgtcgacgccccgcgccgccgtgggggccgcggcaccggcgagcacgcggcgtggaagagcgtccggcaggagaggtgggagggggcgctggagctggagggagagctgccgctctggctggatggcacgtacctgaggaacggcccgggcctgtggaacctgggcgactacggcttccggcacctgttcgacggctacgcgacgctggtccgcgtctcgttccgcaacgggcacgcggtgggcgcgcaccggcagatcgagtcggaggcgtacaaggcggcgcgcgcgaacg

SEQ ID NO: 25862 - DNA, 647 bp, Sorghum bicolor
  Clone ID: 30967003
aactctgccgggctctgcgagggaccttccctacgcttttggcctctctgttcgctccccatgtttcttggctgcagctgcagcaggcctcctctctgccctttttctcccgctacgaggaccatgggccgcgcgatgagatggctcaagaaggtgctcaccggcagcagcaagaaggaagcggactgcagggatcgcaaggcacacaatgccgccgcgtgcgccggcggcggcggcggcggcggtgtcgggctgggcccgccgccgcaggcggagaagaggcggtggagcttcgcgaagccgaggaacagcgtggctgactccggccggaggccctcctccgtgaccgccgtcgccgccggggagctgctgtcgcaggtgcgcccctgcaactgcggccaggagcgcgaggtcgaggccgccgtcgtcatccagaaggccttcagaggctacttggctcggaaggcactccgtgctctcaggtcgctcgtgaagctgcaagctctggtgcgtggctacctcgtgaggaagcagaccgccatgacgctgcgcaggctgcaggcgctcatgaggctccaggccaagacggcgtcgtcccggaaatccgttgagcaagagcggatcgttgcgcgcggcgtgaagccact

SEQ ID NO: 25863 - DNA, 662 bp, Sorghum bicolor
  Clone ID: 30967006
acgcacgcaacggcgaggtcgacgccgagtcgccgacggtcgctcactgcgtctctgccggagtgccggatcctccgcccgccgctcctccgtcgaccctccgcttccgcccatgccccgacccaagcctggaagcggcggcggcggcggcggctggctctcagggtgggggtgggacctcatgctcggatcgattgccgcgttctacgccgtcatggcgccctacaccaaggtggaggagagcttcaacgtgcaggccatgcatgatattctttatcacacttatcacatcgagaagtatgatcatttagaatttcctggagttgttcctcgaacatttataggagcatttgttatatctattctctcatcaccggcagtctttgtattgcgtttacttcatgttccaaagttctatagtcttcttacagttcgattaacattgagttgtgtcactttgatgagtttgagacttctcagacttcaggtaaaaaagaagtttggccatcaagcagaagcattctttgtcatactaactgctatccagtttcacttgctgttctactcaagccgtccgctcccaaatatctttgccttagctttggtcaacttggcatactctttctggttcaagggaagctacctatgtacattacaggctc

SEQ ID NO: 25864 - DNA, 292 bp, Sorghum bicolor
  Clone ID: 30967038
ttggattggaaatggcatactccgaagagaagtagagaagaaagagaataacatatatgcacctccatttgtcattttgtagctgaaggcagcataagtaacagttattatcatattataaatggattccttttgtggacttgattaggtaatgtatttacactttatttcctgtccacacttgcctgtgtggtagctcatttgaagttcaaccacatgagatgaagtcatacatatagtctctccacataaatggatgcacagacttctctcatattaaatatagtattga

SEQ ID NO: 25865 - DNA, 655 bp, Sorghum bicolor
  Clone ID: 30967049
tatgctgcctagcaaattcctcttcctcaagcatctgcgtatttatctgggatgggccttttcctcgggctatgattttttttctctggtttctttccttgatgcttctccttgcttggagaatttattgttgaatcttcaggtatcccagcatgcatcggtttttgatggttcatcacagttgaggcagatgcctgaacagcaccatggctgcctcaagagtgtgaagttcataggttttaattcagagaagagcttggttgagctaacatgttatattctcaagaatgccaagtcacttggatgccttacactggacaccacttatggtgatcccaagtgtgataacaaaataatgaccggtggcatgtgcgctcccatgaataaaggttttctcatggaagcccgtagaggtgtcgcagcagttagaacatacattgaagataaagtcccgtctactgttaagctgacagtggtggagcactgtactcggtgccatgctgataacttatctgaataggttagacttgatgaaccatgcttttctttcttggatagcaaggcctgttcaatatttatcacagattcacagtagctgtgtaatattcctatagatggatgaaccatgctttgtgtcttgtgttattgacccctc

SEQ ID NO: 25866 - DNA, 650 bp, Sorghum bicolor
  Clone ID: 30967060
tagataaggatagcaagaaaaatactagtccattttcaagttttagttggagtggtcaacgcaaagttccatcatatcttcacaaaaatgttttccctcaggaatttatgagtaccctacggacgattgccatgcaagaacatgagcttgaacaagttgcttgtggatcttcttggggtcaaaatggctgaacttgacgagggctctggaacagaagcatctgacaccgaactgcttgagcagtttgattccattcagtcagaagactgcgcgagtgaaagtgacgagaagcacaaaaggaagtcaaaaataaattaccgttcatgtatagtgtaccgaagagggcaaaagcagctgacaaggttgttcctgagggaggcagagtatcttctggagctttctgcaaaagaacagacctaacaaacttatctggcctgcatcaggtcttgaattgcagagttgtcaaacttagtgctggtggccagatccgatggaggaatggccaaaagaggcacctgtatgtaccctctcggattcttcgggcaggagaccttctttgctttgctaggggtagcaatagcattcacatacatgcaaaagcacttgatgccagagtacgtatgcacgtttgatgtcctttccaaaggatt

SEQ ID NO: 25867 - DNA, 622 bp, Sorghum bicolor
  Clone ID: 30967083
ccaagggagaggacttccagtattaattcaaaagagaggactggggacttggattgtcaagttcataaaagattctccttgcctggcattggttcagaagctggcaaacacctgacaaagaaaggcacggttaaccgatccctgaaggccacaaaagattcccaaatactggggtcaaggcaccatcttgccagttccattgatccagttcccactagagttgagctagagacttgagagggcatgtgatgcttgaacatcgccatggattgcactgagctgctggatgccgttcttatctgcatgactgcatgtaacatccatgttgtactggcggagacacagaatatctgggcatgcccttgcggtgcgcgctatgctcatttcatgagataaaaccagatgcgtgtccatatatggtgaggttacctttggttgtattgttgtatttgtaagttcttgctaggagatgtaaatttctgtggtcgaacggtgtacttattatgtgttgttggtgtatggtattggtatagttgtaacttggaaggttaagcgagataaatccattgaactgttttgtggacatggtattgccgtgttgttatatatatagatttaaatt

SEQ ID NO: 25868 - DNA, 631 bp, Sorghum bicolor
  Clone ID: 30967110
tactgggcgcacgcagaggagcacagcggcgtcactgctgcggcagtaatggccgcctggttccaccaccacggcgtctactagtgatacaccgagcccacccttccttggttccttcaacacggccccctccggcctccggatcgcgcaccgcgcctgccacccaccaaagcgctcccggaatctttgccgagcggcgccgcttactggccggcaaggcgaccccgtctctcttccggcgttgatctggttactccggttgaggcgggcggagtggcggcgcgatgggcatctcggcgaggtggctcaagtcgttagttgggttgaggaaggtggagcggcagcagcagcatcgtaaggaggatgcagatgttggacgaatgaaaggcgatgttgccgatcagtttcattttcagaatcagcgctctcaagaagacagcagcattgctgcacaagaagaaattccagaggttccttatggaaatgatccacctgaagttgattctaatgcaccttcatgcttggaacccacttgcgattcagctcatgtgccactgtctcaaaccgaagaggaactggaagagatctgggctgctacgattattcagacagcatttagagcattcctggc

SEQ ID NO: 25869 - DNA, 668 bp, Sorghum bicolor
  Clone ID: 30967141
agtcctgacgccgccgcccgccgccgttgcctacgagcccgggatgctccgcggcgccatctcccgcctcggcgctcgcctccgcctccacgccgacccttccccggtctctccttacctccgcgccctctccacccgccgcggcaagcgctcctcccccaccgtgtcgcccgctgactccgatgacgagggacccctgcgcggcctcttcgtgctatcccgcgaccccgagtgcccgccgcggctgctggtggtgcagccgcgcctccgccccggaagcctcctcgactccaagcttgccgaggcactcaacctggccaactccctcgaggagccccgcgacggcttctaccacagcgagttcggcgccaagggcgcgccgccgcacctcgtcgtccagaaccccgcctcccgcggtcgctcacacgccgatacatatttcggccctggaactgtggataatgtcaagtgctacctgagggcttcggaatcagaggaagatgtggatgcagtttttgtcaatgcgattctctctggaatccaacagagaaacttggaggttgcctggggaaagccggttttggatcgtgttgggcttataattgaaatattcaatgctcatgctgaaacaaaagaagcaaagttacagtcagagttggcagctctca

SEQ ID NO: 25870 - DNA, 402 bp, Sorghum bicolor
  Clone ID: 30967146
aaaccacacaatgggcagcagcaagagagtgcccccgtaccttctgctggtgttgctggccatcggagccgccgcggtgagcgtcggcatcctgcacaagatgagggagcgccgtgtccttaccgtcctcctccaggaacgcgaccagacagctcatctccttccaagtactcctcgagagaagagaaaagaaattattaaagagatgaggaggaaagttgacgaactggaagccaaaacatctgtcctgagtattgagagggcagaattgaaaaacaagctcatggattcagaaactaccaccacatatcttaccaacacccagaaagaattggaagcagctcttgtggagaaagagagccatatcaaccaaatgatagagaatgcagctgcttcataccc

SEQ ID NO: 25871 - DNA, 640 bp, Sorghum bicolor
  Clone ID: 30967169
cattcgtcgaactcgaacactgccatggcagccgccgctgccgacgacgacgccaagctcgaatccttcctccaatggttccaggccaacggcgccgacctccgcggctgcacgatccgcgcatgcggcggcaagggcttgggcgtcttctccaccgccgccccggagccaggcgccaacgacggggtggcgatggtggtgccgctcgatctcgccatcacgccgatgcgggtgctgcaggacccactcattggcccgcggtgccacgcgctcttcgaggagggacgcgtcgacgaccgcctcctcgtcatgctcttcctcatggccgagcgccgacgccctggctcactctggaagccatatttggatatgcttccgagcaccttcgggagctccctttggtttactgaggaagagcttgccgaactggaagggacgacgctgcatcgggctacggtgatccagaggaagtcattgcaatcctcatttgatgagaaggttaaaggactcgttgaggagcttttacatgtcgatgaatcagaaagctcaattgaagtgctgtttgaggacttcctttgggcaaactcaatcttctggactcgagcactgaacataccactgcctcattcttatgtttttc

SEQ ID NO: 25872 - DNA, 659 bp, Sorghum bicolor
  Clone ID: 30967177
tttccgttcaattctccagtatgtgttgaaatgattagtgtattccgtgaaagttccatctcgggtaattatgcttgcaagggcataagctgccctttatgccctgatacaaatagcagattcttgctcttcacctgctatgaacatcaaatgctctgctccccatctctgaagatgtgtatgctgggtgtcttcctgcttgttattgcagctgcatctgttcacacaaaccgactgccactgttaccatagcccgacaccttgcaactattttatgggttaccagtcatgaccgagctacagttgttgccaccctatgccacctggaccagatcttcttcgggacctatgcccacccctttatcttcacttccctgatatgtgatactgagcagccaaaccatggcagtcatatgggttggacccaagacccgtgggttttggatctgacagggtgtggcgggttttgattttgcgctgcgggtgcccacagctccccaaaattcaaattttaactatcagtttagccaatgaaacagccacagccgcaccccggtcatccacgttcccagccgcgtgccattgtcgtttgtggcttgcccgctttcctctcctgaccactgccctagtgccccacacatcctgctgtctgcatcctc

SEQ ID NO: 25873 - DNA, 554 bp, Sorghum bicolor
  Clone ID: 30967202
gagcggctcccgacgtcgtcggcaacgctggtgacgctggagagcacggaggtgttcggactggacgccgccgacgtcaagtacgtgacgcagcacttccgctacaccttcaccaacgacaaggtgcgccgcagcgcgcgctactactcgccggggtggcgcacctgggcggccgtcgccgtgcagctggcatggcggaggtacaagcaccgcaagacgctctcgtcgctgtccttcatccgcccgcggcgaccgctgtcccgctgctcgtcgctcggggaggagaagctccgcctttacaccgccatcctcacctcgcccaagcccaaccaggacgacgacttctagttctagctaggccgtttccaggccgccggcttcttcgtgacaacgacgacgacgtggatgacctgttactcgcatggcacgaggcgcagagacaatatgcacgtatccaatgcaagttccgatggggaaaccacgaaatttcattcctccacagaaattcacttgtatgcaacgccgcaaggagcgtgcgcagccacttttatact

SEQ ID NO: 25874 - DNA, 637 bp, Sorghum bicolor
  Clone ID: 30967223
tgtgatattaagccagaaaatatactgctcgatgcgtcatttgttcctaaaatcgcagactttgggatggcagcattcgttgaaagggattttagcagagttttgactactttcagaggaactgctgggtatcttgccccagagtggcttggtggagttgctattacatcaaaagttgatgtttatagcttcggtttggtgctgctggaaataatatcaggtaggagaaattcacctgaggcatatagtagcaacaattatcatattgaatatttccctgtgcgagctatcagcaagcttcacgagggagatgtgaggagtttggtggatccacagctacatggcgacttcagtttggaagaggttgagagggtttgcaaagttgcatgttggtgcatccaggataatgagcttcatcggccgacaatgggtgaagtggtccatgttcttgagggtcagcaggagattgatatgcccccgatgccaaggttgcttgcagcaatcacacaaggcgctggagctatcacagaaatctctaatgcatcttcgatgtaataaattcataggctactaatatttgtttcagaaaattttaatgctcatattggagcaaagtaatagaggaaggccagcctga

SEQ ID NO: 25875 - DNA, 626 bp, Sorghum bicolor
  Clone ID: 30967251
tttcagcttcttcttcatctgcagtgctttgcgggcttggatatttcgctcttgttcaagaagcttgatcgtttcaggtagctggctttcttcttgttgagcttgagacaaggcttcttctacctgtttgagttctgccaacagggcttcccttctcgccgatagatcagaaatcttttgcttcaatacatctcctgaggatgtcagaatgtcgatgctcttgttcttctcatcggcaaggagctttactttcatcatctcttcagaaagctgagcgtgagcagctctgtcggcaagacgctgggcagccttttgatactgcagctgacgactctctaggtgtgcagcctgaaaaaggatttcttcggcatcggtaggaatttggcctcttagggtcttgaacaaggctttggctgggtcggagtcatcgaccaattgggctgtgtcctgatgaaggagggccgataattcttctaactttgccctgatttctgccgatgtgattccaactgctcgagaagaacttgcttcctcgccttcatcttcagagatgtcgatggcaaaggagaacaagctgtcaggagagtcttgttcctgaaaagaaaaataaaataagttattctatg

SEQ ID NO: 25876 - DNA, 605 bp, Sorghum bicolor
  Clone ID: 30967255
ataaagtccgatgtttttagctttggcatcttgattcttgaaatcttaaccggaagaaaaagcagtggttcctttaacatcgaggagtctgttgatctcttaagtcttgtttgggagcactggaccatgggaacaattgttgaggttatggatccatctctgagaggcaaagctcctgcgcaacaaatgctgaaatatgtccatatcggcctactatgtgttcaggataacccggtcgatagaccgatgatgtcaacagtaaacgtcatgctcagcggcagcactttctccctccaggctccactaaagccagtatttttcattcccaagagtggttactactcaactgtttattcagaatcatatcctacagcttcccaatccaccgctaacgttatgtcaggggcgttgtcacctaatgaagtgtcaattacagaattggaaccaagatgagccttgaagcatcatgttgccacttgctagagcaattgaattattattgtacgaataaactgaacatggggcaatgctctagcatctgtattactaacttttcagttatgtttccactgtccctctaattataagtcgtatatttcagtggc

SEQ ID NO: 25877 - DNA, 666 bp, Sorghum bicolor
  Clone ID: 30967266
ctgtaagcagaactcgcagttaaaggaggcaatattcgtttgctttctcctgaggatgttacgcgtactgagcctgtcttttaacaagagccaagcaaagaccttgtgtttaggctgacaagccgatttccatatccaggttaaagccggctcagtttgttgatgccctaggagccttctgtacgtattttcagatttaaaactggtggatcctccttgatatgtccagacatcttgaatacttccatccagctgcaagacttccattttctgttgtatgatcgccatctgttcataggctacttgtgataccgggaggttaaacattactgagatattattgaaactgagagctttgtgtgccgtaatattcttgtttcttgcaaaggagaacgcctatgggaactgaatttctaagagctgtgaatcccaagagtccttccaaaagtgacacgtgattccactattcgttttgatcgacgccatttgtttaaattgtggaagtaattttagcacatctctccaccaaaaggagcccttcttcacagcacctggcaacttgtcattcttgtaatgcctttcccataccaagtttacccaaggaatttctttcctattgtagaattcatctaaatttttcatcaacaaagcttgttctgcagctcc

SEQ ID NO: 25878 - DNA, 676 bp, Sorghum bicolor
  Clone ID: 30967279
tttcaggtacgaggtgtattctttcttctccggatcgccctcgctacgtctgccagcggcgtcgccaccggcggcatctcctactacaccatttaacgggacgccgacggcaaccccaccaccaccaggaagaaccagaaacaaaacaggaattgctttagcaattgtgttgcctataattgctgcggtgctagctatcagtactgtttgtctctgtttcttctggaggaggagaaaacaagcgagggagcagacaccatcttattcaactaatgctggagacatggaaagcattgagtcacttcttcttgatatatcaactttacgcgctgcgactgataactttgctgagagcaataggcttggtgaaggaggttttggtgctgtctataagggcgtccttcctgatggtcaagaaattgcagtgaagaggctctcacagagttcagggcaaggaatacaagagctgaaaaatgagcttgttttggttgccaagcttcaacacaagaatcttgttaggcttcttggtgtttgcttgcaagaacatgagaaactgcttgtgtatgaatacatgcccaatagaagcatcgacaccctccttttcgatgctgagaaaaacaaggagctagattgggcaaacagagtcaagataatagatggaattgctagaggatta

SEQ ID NO: 25879 - DNA, 629 bp, Sorghum bicolor
  Clone ID: 30967283
ctgactagcagagaagttggtggcctggccggagaagttcttcttctccttctcctccttctcgagggtccccttctctttcctttccagtgtacaggccagcaggcagagagggcccgatcgagatgcagcggcacacggggcgggacatgtgggacgtggaggagtgccagagcccgcgcatgggcagcgtcatcctcggcgtcgacggcggtgccagcaacaccgtctgcgtctgcatccccgccgccatgcccttcaacgacccgctcccggtcctctcccgcaccgtcgccggctgctccaaccacaactccgtcggagaggacagggcaagggagacactggagagagtgatgtcacaggcgctgctcaaggcgcgccggcgacgatcaaatgtctgtgctgtctgcctggccgtagcaggcgtcaaccatccaatcgatcagcagagaatgttggattggctcagggacatatttccaagccatgtcaagctgtttgtggagaacgatgcagtggcggctttggccagtggaaccatgggcaagctgcacggatgcgtgctgatcgcagggacagggaccatagcttatgggttcaccagtgatggcagggaagcccgagca

SEQ ID NO: 25880 - DNA, 602 bp, Sorghum bicolor
  Clone ID: 30967312
ttccctgctccctccactccacaagctcatatcctcgtcctcctctgctgttttcgcgtccacgggcaacccagctcaggcaagggcagatcatctgcgtatagcgctcgccatctcctgattttcccattgatcccctgaaatcgctgaccgacagtcctgtccgccatggacgccgagagaagctctgcgcgcagcaccaagcctcttgctgtgccgcccgctcgccactgctagacgcgacgacgtctgcgtttgccttcccggttcaactgccggttcccttgacggcctagtgcttgcgatccagcggggcgagacggcgagacgccggcgaggtagccactgtcaatttgacgacacgtggattgagagggagaagacaatgccaaaccaaaattgagagttgtatcgccatcgccatgtcaagcgacctctccgcacgctcgtcggcgctttcctcctccaccgcgtcgccttccgacgactcgcggcggaaggagcaaggacggcatgcgacgaccaacggcagcggcagcggtagcagcagcgggcgccgggggagccactggcggagccagcgcgtgcagtggctcggcggc

SEQ ID NO: 25881 - DNA, 649 bp, Sorghum bicolor
  Clone ID: 30967332
acactccaccatattcctcttccgccgccgccgccgccgccgccaccaccaccaccaccaccgtgactgatactctagcggcaggacaagcccttgccttcggcgacagctcgtctcgaggaacggcaagttcgcgctgggcttcttccagccgacagccgtcatcagtaagtcccgcaacatcacctccccaaactggtaccttggcatatggttcaacaagatcccagttttgactacagtttgggtcgccaatagagacacgccaatcactgatcccaagcgcaagcaaacacacctcaaaatctcaagcgatggcaacaaccttgtcattgtaacccaggccagtcctgaaactgaaactttggtctggtccactcctactcccagtgtcaatcggtcaggagccagcttaaacagtaccactaccactgctgttctcttggacagtgggaaccttgcgctcctagaattagcaagcccatcatcatctaatgtgaccctgtggcagagcttcgactacccgactgacatcgtgcttcctggcgccaagtttggccggaacaaggtcaccggtttcattcgccagggcatcacatggaagagccgcattgatccaggtctcggctcatactccgtcgaaatcgac

SEQ ID NO: 25882 - DNA, 647 bp, Sorghum bicolor
  Clone ID: 30967356
gccagctatgagaatgttcttaagaagtggatgccagagcttcgcagatttgcacccaacgttccggttgttcttgttgggaccaagttagatctccgtgaccacagagcctaccttgctgaccatcctggagcttcgacaatcacaacggcacagggtgaagagctgaggaagcagattggtgctgcagcttacatcgagtgcagttccaaaacccagcagaatgtcaagtctgtcttcgatacagccattaaagtggtccttcaacccccacggagaagggaggcaatgcctgccaggaagaaaaacaggcgtggctccggatgctctataatgaaccttatgtgtggcagcacatgtgctgcttaggagtcttagaacactgaactggaaggaggtgaaggcgtgatgcatggtgtgtatgttgtgccaaactggcaagttaatttgctatagaatgggaccgcatggatgactgctgcttttgttttccttagctcatctgctgtatgcttgggttttttaggcgtagtgcgtcaggctcttcaagtactgacttttaccagactgctgtgttatgtaagaagtttgctagacgaggattgctgtaactgtaatatgttctccgagagggatgtggtataact

SEQ ID NO: 25883 - DNA, 555 bp, Sorghum bicolor
  Clone ID: 30967359
cagttgtccttgccagtttcacatagtgctcctgtggcagttcgcattgctgatggtcatactatgcattgttcttcggtggtgaagagtgttacttggactatccagcaatatcagttccagcatgacttgaaggttctgcctataccccagtatgacattattttaggtatggattggttacaactgtttagtccgatgaaggtggattggaatgctcattggctgtccataccttaccacggtcataccattcagattcatggcaattctgattctgagggggacaaccctttccaattcctgattcagctgctcagcttagaggtgtcagaccggccagattcttcagtttgtccatctgctgtcagcgaccttctggctgagtttccatcggtcactactcctcctgattccttaccgcctaggcgccagtgtgaccacgtcattcctttggtggagggagcccgtcctgttagcattcgaccatatcgttatccaccggctctgaaagatgaaattgaggctcaggttgctacaatgctcaaacagggt

SEQ ID NO: 25884 - DNA, 572 bp, Sorghum bicolor
  Clone ID: 30967388
cggtgatcgccagcgcccgcacgtccggatgggccggcgactactacgcccaccacctgcagtacaggtacgccgtggcggtgaacgtgatcgtgtgcgcctactcgatcgcgcaatcgttcggcgaaatccggcgcctgatctcaccaaggtttatattccggagcatgtcgagctactactgcagcctgttcctggaccaggctctggcgtatctgctcatgtcggcgtcgtcggcggcggcgtcgcgcaacgacctgtgggtgtccaggttcggcacggacgccttcaacaggaagatcaccagcgccctgtggctgtccttcattgcgttcctgatgctcgctctcaacgcgctcatctccacggctaatctcttcagcatgctctgagcctgacacgcttgtcctgacattattattgttggaatccagtactagttgtaaattttggagtaactatagccgcgaattagtcggaacacacgcgctatttttagtactggtacatcaggaccacacttttatgattttattatcaaagggctaatagaatgtttttctttgtttttt

SEQ ID NO: 25885 - DNA, 641 bp, Sorghum bicolor
  Clone ID: 30967413
gaagcaaggaagccttagtgttgatgagtattataaagagaaggagaaggcgatgattagagccaatgtaattgaagatgaagagcaaacaattgcaagatttatgtcagggctgcatcggaagattcagcgcattgttgaatttcagcaatatcgtaatcttgttgaattggtgcatcaagctagcaaagctgagcggcaattgcagcaggatatgaagtctactagaggagtatcttttagcacaaagagtgcagcaagtggaagtaaattttcacccaaagaaagtgaaagtaaaggtacattttccagctcaaacggtggtgcacgaactagcaaccttggttcttctagtagcaaagagttggctgctcaaaatgagaaattcaaatcagcaaactcagtgggttcttccagcaagagtagtggaattcagtgcttcaagtgtggtggtcgtggtcatgttgcaagagagtgtccaaacgctagaaccatcattgtgaatgatcaaggggagtatgaatctgctagtgaggaagaacaagaagatagtggaagtgagagtaatcttgaggacatctatgaatttgaatctggtactgctcttgttgtaactcagattttgaggtacaaatgagcga

SEQ ID NO: 25886 - DNA, 552 bp, Sorghum bicolor
  Clone ID: 30967433
ataatctcatatattgcactctctgtaaattacgacttgacctaggagaagataagatgatgctggagttcttacgagaacggttggccaatgcgcatacggatcacttcgacagaggatgcaaatcagcacccaagttctgtttgcagactatgtttggcttgactgcactctacatacagtgtgaagaatgcagcacatttgatattgtggtataatgcttcaacagaggaaaggaaagaatattccaaaacctccctgaagttgttccatcgtttcatgttagattagctggttaagttatgagaagatgggctgtacatcagaaaggtggcacaaactcagcacccagaacacgttcatccatgcaagcttcgagtgaaaacaatcgacatacatacatatgaaattttcatgtatgtctaacttaaatgttgctggttgtacggtgggtagtatatatgcacttgaccatggtcaacatcttgttgccagtttacttaacgttgaaactgcgactacattgaacagtattaacagagatgttcattt

SEQ ID NO: 25887 - DNA, 684 bp, Sorghum bicolor
  Clone ID: 30967455
cgaatacacactccatcctcgccggcggagacgagccgcgcccgtccgtaaatcggagctccggcgtggctagcagctggtcttccttcgattcggcgtcctcaacacctcacgcgcgaccaaccgcaggtctagcgcgagctcgcagttcacacggctacaacgtcgattctgtgggcgcctcgtctccgatcgattgacggcgggaccgagcgtccatggattcggcagggcccaggagggtctccctcaaagcccgccgccccgactggaaatcggagcttagaacaaattgcctcagaagagttagaaaggacagaactgacttgctttggaagatcagggagcaggggcagctgccagccaatgacatggaaaaggttgaatctgctgtcaggaacatcatctctgatgaaatagagaaactcaaacagtccaatgaaggaaaagaggaccaagaaatggatgtcatatgggaatatcaaggaccgcaggctgctgagcctgctgaagttgaaagtgaagatatattgcttgaaatggaaagacttctttatgaagatattagagaagaacaaatcagaaaacaactagaggcacttgatgaggaagatgcatatttagctcaaactgtttttgatcacatgcaactaaatgacaatgaggctgctgaaactgctaagc

SEQ ID NO: 25888 - DNA, 658 bp, Sorghum bicolor
  Clone ID: 30967459
agtagctgtaggctgtagcgcgcagcctcgccctcgcacgccccggccccggcggatctcggagcaaagtgcgcagctagcgtagcgccgaggatgggcaccgtcggcggcgagctgcccctcgccgacccggccgccgacgcagaccgggcgaggctgcagcagctgggatacaagcaggagctcaagcgcggcctctccgtcgtttccaacttcgccttctccttcgccatcatctccgtgctgacgggcgtgacgacgacctacaacaccggcctccgctacggcgggccggcgtccatgacgctggggtggctcgtcgtggcactcttcaacggctgcgtggcgctgtccatggcggagatctgctccgcctacccgacctccggcgggctctactactggagcgccaagctcgccggcaaggaatgggctccacttgcctcctgggtcaccggatggttcaacatcgtggggcagtgggcgtgcacggcgagcgtggacttctcgctggcgcagctgatccaggtgatcatcctgctgggcaccggcggggccaacggcggcggctacctggcctccaagtacgtcgtgctggccatccacaccgccatcctcgtcgtgcacggcctcatcaacagcctgcccatccactggc

SEQ ID NO: 25889 - DNA, 634 bp, Sorghum bicolor
  unsure (1)..(634): unsure at all n locations
  Clone ID: 30967466
aacttgaacatctaagattcctcctaccttacgtgctctgccttccttcccctgctccgatctccttctccctccgatcccctccttctcccgtacgctactgctaacacttggtactcagagccaatcgatctagatcggcggaatttttctttcgattcacaaacaactgcggtcggattcatctcagcgattgctggcgcttgctggatagtcgcagagatcccgtaattcccagttccgtgagcgattgaagttttttccgatctggatcccgctgttccacccccgccgccgccgccacttccacctaaaccgccgattcgccaccactatactcgccgcccaaaacagagcacgtcaaccaccgccgccgcagccatgaacccagatacacaacttcagctggaagaaatccgtaagctctccgtcgagcaaacggtcatacagcagaaactcaccgagcagaaggatttcctggagcgtcgcttcaccgaggtggacgacaacatcgacctccgcttccaggaggccgaattggtggtggagcaaaggatcatcgactccgagctccgccaggatgttcgcctccnagccatcgagaagacaaccgcagatctgggcgagtggcgcc

SEQ ID NO: 25890 - DNA, 675 bp, Sorghum bicolor
  Clone ID: 30967494
agtagagaaccctaaacccccatcccaaaccttgacgccggcgatctccgccgccgccgccgccgccatgttcgggaccccatctaccactcccgtcttcgggaacccctccaccaccccggttttcggcacgccttccaccaccccggcatttggcgcgacatcgtccaccccggccttcggcaccccctcgtcgacgcccgccttcgggaccccgtcgtcgacgccagcgttcgggaccgcttccacgaccccggccttcggtgcatcgacgtcggcgccagcgttcgggaccgcttccacgagctcggcgttcggctcgctcaacttcgggacgccctcgtcgacctcagcattcggcacgccatcctcggctccggcgttcggcgcgctgaatttcgggacgccctcgtcgacctcggcattcggcacgccctcctcggcgccggcgttcggcgaaactccttcgccctcgccctttgggttccagcagcagcaggcgacgccgtccccgtcgccgttcggcttgctaggaggtggcggcgcgcaaatcaccacccagatggcccccgtcgcgccgctgccgctctccccgtctgaccgcgacatccaggccatcgttgatgcgtacaaggaggaccccggtaacccccgttatgctttcaggcatctgtt

SEQ ID NO: 25891 - DNA, 643 bp, Sorghum bicolor
  Clone ID: 30967497
gatcccttcccttcctttccttgcattcttccgccacgcgcggcagcggcacacacaccatggcgtccacgccacggacgccggctccggtgaggtcgccgccgcccgtgcctactcctactcatcctactcctcctcctccgcctctggagacgccgcagccgccgctgcccgtgtcaactcctcctccggctctggagacgcccccgccgcggcgcgtgcgcactcctccgccgcctctggagacgcccccgccgccgtcgccgtcatcgtcacagccgggggacgagtaccacacgccggcgccgtctctggcggacgggtcgccgcgggaggaggaggccagcttccccagcgacgggagggaaggaggaggagcgccagcgcctcccaagagcccgcagctctcgcccatccgcctcgccgcggcgcgcctcctgctgccgccgcccagcccccgcacccctaccgggcaaaacgggcaggaagaacaggaagggggcgctaaggccgcggcggcgggaacgggaacgggaatgggaacggcggcgccggcacgccagcagctccgcctgacgggcctcgcccggtcgccgtcgtcgcagaggtcgctcgccaccaccaactcctccccttctccgtc

SEQ ID NO: 25892 - DNA, 689 bp, Sorghum bicolor
  unsure (1)..(689): unsure at all n locations
  Clone ID: 30967523
acttgcatcctaggcatacttcttgtttgcatcaaatctgaattatctttgcacgtgtgtttgatctatttacatcactcatatcttgtggtcagcactaggcattgaacttctagtttggattgtggtttaactttacaatatcaagaattcagactgcattccttgtgaaatatatccccaccaagctccacaaataacccaccgtcattggaaaatactgatcttggattctcccaaccatcattctcggttaccacctcgcattggccgttgtaatctgcggggaactcacacgagctttggttggtaagagaggtgagattgtgagattccacatataattccctattctacatatattgttgctttgccttcactaatttttttacagcaagatgtctgagcatccagagattgatgattgtgtcacagtggcacaattcaatgagatgaaacaaagcatggagacgctaacaaacaatgttcaagcactcatgaaccggttgcaaattcatcctcatcataatgcanatggcagtcaccatgaagatgaagttgaagaaagcgaaggagaagctgctcgtcgtgcaagggaatggccgagagagcgagctgctgccaatgcaagaagacctcctttttcatgacgtgatcatggtggtagaggtgctagtcatggatatggg

SEQ ID NO: 25893 - DNA, 557 bp, Sorghum bicolor
  Clone ID: 30967551
cagaatcgatgtcaacatccatagcgcacagaaggtgtttgccagaatgcccatgaggtaaacattttctccatattatgggtcatctcatattattatcggactgaataggaattctcttacgtagtcaccatgttgtatgattgcagttctgtttcaattccgaaaaactgcatagatggtttacggttttctagttatatctagaaatcaaaactttcttgaatgcccaaatgcttatcttgctggtcaggtactgaatggaatctcttttattattaggtttaatcctagagttcgttggacgtttgtccattcgagtagtttcctactgaacccactgatcgattatccatgttgcttccttgctattatacagaatactgatgcaattgattttggttgactgatatggtgtatctgtgtaatgtattgctgaagcgtttcagttcgatttgagcagcttgcttttggttcagattggcaaatcacgtgatatgctgatctatggtcatgtaattgagcgtagctgtgccctattatatatcaaataacaa

SEQ ID NO: 25894 - DNA, 510 bp, Sorghum bicolor
  Clone ID: 30967568
gttactgaacgtcagcgtgcgctgctggaagaatttgcagtagaggaagccacgaaagaacagaacacttttgtagcaggaaattggtggcgactagttgcagaaaatatgacaaggcaaaatgtcatgatcggagtcagcatccttgtactgattcacctgatgctgagcaaggctatgagctaaggcccaagttcacttgtgctggggcagtggggcaacatcaaatactataaattcttcgaagattcagcttaacacaatgaaacaatggttgcgattctttaaagattattttcacccactagagaccacaattttgaagaaggcgctggttagaaggttgctgcttcctgtggtaaaatattacaataatatctgctcacatagttctgaaactatatgaagctgtcaattgagtaaaaatttcttgtttttttcctctttccgtgtaaatgtaatgtggatgctctcaagttggaatagttcaacgtgctgggtgaaatttat

SEQ ID NO: 25895 - DNA, 322 bp, Sorghum bicolor
  Clone ID: 30967582
gctccgcgaccagcgccgcatccacccggtctccgtgctcgccagggggttccatggcatccccgacgagaaggacgtcttcctcagcctccccgccaggcttggccgcgccggcgtccagggcgtcgctgagatggagctcaccgaggaggaggccaagcgactgcgtcgctccgccaagacgctctgggagaattgccagctcctcgccctttaatttgatcgatctcttttcattacattcatttcattcacgctccatctcatctggtggtgtttaacagtttgattttggatcgtcgtaatattactattcccgtct

SEQ ID NO: 25896 - DNA, 493 bp, Sorghum bicolor
  Clone ID: 30967593
ctaactaaaccccttaaaggatctagaaaagttcagttgaagctaaccctgtaaaaagctcatgcaaataacaggaactgatacttttttcaatatccagtaagaaaatttttttggttaattttcagatcactcctagctagagaaaaagggtccgtgtttaaaccatgctgctagccaaagcctgagatgattttccatcgataactgagacccataaaagtttaacaaaaaagggtgatcaaagatgactaatttccagaagatgaggatcccaaggtttttttccagaccaattatagacaattatttatgggtttgcatagatgggacatgttaggttattgcctaccagatgttttgaaaacttcatggctatagtcatgattccgaccatgaactgtaatgtttgactcgatagaggggttatgcttgtaatgaatggttgtataatatatggctgaatagaaccatgatggcagggcccaaactg

SEQ ID NO: 25897 - DNA, 497 bp, Sorghum bicolor
  Clone ID: 30967626
cgcaaaaaaaaactcggtctccttcgcgtcccttctttgcttcctccttcctcccccgacgccgccaccagggcgaccgtgatggcgatgagcgcaagcagcgcgccatggccgccctcctcaaccccacctctacctcttcctcttcctcttccttcgcctcctcctcctccctctccccttcccttcggcggcggcggcggggcgccaggcgacccctcggtgtgcggcgcgcctcctgaattcgcgtgccacgcagacaggtgggcctccttgcacgcggtctctccctcacgcttgcttccttcctggctccctcagcactctcgctctcgcatctggtgcctggcacggcgcggcaccacggtccaccctaccctcgcgcatgccgcactacggcggctcccctcctctcgtgcccccacactctgctcccttgaactccggccgcatcaggcaaccccgcagcgctgcctctcacgggcactgccgtgtcc

SEQ ID NO: 25898 - DNA, 489 bp, Sorghum bicolor
  unsure (1)..(489): unsure at all n locations
  Clone ID: 30967636
ggaaaaaaaaaaaaaaaaaagcacgcaccaccgccgcgatgcctcccttcccggcggcgaccaccgcctccaccacctcccacctcgccctcctcgtgctcctctcctcttcctccctcttcttcctctacaaatccctccgcctccgccgcaaaccctccccagctccagccctcgcccgcactgccactcctactcttctctacgcctctgccaccggcacctccaaaaccctcgctgagcatctctccgcccgactgaccgccgatgccggcttccccgtccgcgcctccgacgctgccaccttcgaccccgacgaccttccctccgtcccgctcctcctgctcgtcatccccacccacgacggcggcgcgccgcccccttctgcggccttcctttcgcgctggcttgaggagtccgccgctgacttccgcgcgggagcactcctcctctccggnctccgcttcgcagtcttcggggttgggtccc

SEQ ID NO: 25899 - DNA, 520 bp, Sorghum bicolor
  Clone ID: 30967647
aatggcggcctcgtcgtccttcagccgaacccgctgtcgctgagcgtgccggaccctgcgctcgatcgctggctccgggacagcggctacctcgacctcctcgattccaccaccaccggagcgccgtcgtcaacctcggccccctccacctccgcctccgccgccgccaggcccggaaccggcccggtctcctcgggcgtcgcggccgacgtcctcgccttcgcgcgcaccctcgcctcgctcctcgcgctcaaccccttcgcgcgcctctccaccgccgacctggccgcgcccaccccgtcctggtcgctcgccttcgtcggtccccccggcgccgcgtcctactcctggccgcccacgccgacccaggccaggctccgcgtccaggagaacgtccgccggtacgcgcgcaactacgccgcgctcaccatcctcgtcttcgcgtgctgcctgtaccggatgccgatggcgctgctggggatgctggccagcctcgccgtctgggagggcgtgcgctact

SEQ ID NO: 25900 - DNA, 452 bp, Sorghum bicolor
  Clone ID: 30967661
aggagaaccagcccgtccaccctcgtcgtcagcgaggtcgccggagaggaagggtagggggctggcagcggagcagggagcctctccccacgggcaagatctgaaccggttctggaagggagagaagaggaggaaaagttgggtacggttactacagatagctgatactacaggggatagatcctaagggcacctacaacgcgtctcttcctctcatctctgtgttgttgtttttgcgaaaaacaccctcatctcgcttggagacggtcgccccgtcgtctcgcgaggcgacgatgagggcccgtgctccgaggctcaatcgccagccagagcaccgatgtacgagtcgtcttctgaactcgtcgacacatatggatcccgcgtgggtgcacgcggaaactagtattggcgcacgggaggtgcccaggccgccgtgagctgcacgatggagt

SEQ ID NO: 25901 - DNA, 537 bp, Sorghum bicolor
  Clone ID: 30967677
agtgtgcttgtcttgtacagccaacgactgcgcacctcgcgtcctcctcctcctccaatcccaattcccatggcgggctaccgcgggggctcctccaccgccgcctccgccggcggcgggggcggcgcgtcggccgcggccttcgccacgcggatgctcctcctcctcacgctgctgccgctcgcgctcgccgccttcgccttcgcgctccagtggcgcggcggcatgcgggacccggccggcgccgcctggcccgccgacacgcagcgcttcccgggcatggagaacagccctctcgggtcctcctcgtcttcccacgggggcggtgcctcctacttcgcggtatcctcctcctcctcctcctccccgggagccgactgcgccgagatcctcggccggagcgccgcgtcttcttccaacggaatctcgctctaccgcggatggaacttcgactccgaatcttctataacccccaagatctgtatcacgggaagcacatctgctgggctacaccagattctcccatggttgtattat

SEQ ID NO: 25902 - DNA, 443 bp, Sorghum bicolor
  unsure (1)..(443): unsure at all n locations
  Clone ID: 30967679
acatgccgccgctcttccctcgccgtcgccggggcttcacgacccggcacgcttccggaatcatctaccagctcttctacaccgctctgattctccgcaggtcttgttgatcgccagattcaccgttgttcggaacacaaggactactacaaaattcttggtgttcctaaggatgcatcacaggatgacatcaagaaggcatttcattctcttgccaaaaagtatcatccggacacaaatagaggcaatactgctgcaaaaaggatgtttcaggaaataagagatgcatatgagacactacgggatccttcaaagagagagcaatatgacatgctattttctagagggtcaaggatggagcatgacacattctcangatccaacaatcagagacatgaccctttcacagaattccacagacagaatgatggtcgtttctctag

SEQ ID NO: 25903 - DNA, 521 bp, Sorghum bicolor
  Clone ID: 30967682
aatccgccgctcactccgccgtcatctccgacctcctgggatctcagccgccaaatccgggccgtgctcgcgcttgggcgtctgccgcctccgatggggagcgagtcggagcccgccaaggggctgctgccctacctgcagcgcgccgacgagctgcagaagcacgagcccctcgtggcgtactactgtcggctctacgcgatggagaaggggctcaggataccccagaaggagcgcaccaagaccacaaactccatcctcatctccctcatgaaccagctcgagaaggacaagaaatcattgactttggggcctgacgacaatcttcatttggagggatttgcattaaatgtctttgctaaagcagataaacaggaccgtgctggacgagctgacataaacactgctaaaaccttttatgctgcaagcatcttcttcgagattcttaaccagtttggcgagcttcaacctgatgttgagcaaaaacagaaatatgccatctggaaagctgctgaaataag

SEQ ID NO: 25904 - DNA, 496 bp, Sorghum bicolor
  Clone ID: 30967691
agatcgcttgatgagcgctggggcgcaattgcagcggcggagctcggtgcggcggtcgcggagcatggcgaaggaggaggaccggggccagccgcccgacgaggaggtcatgtcgcggagccaggggtccagcacggcgcccgtgctcgacaaggacagcgccacggcgcccaagtcgcgccccgccgagcagagcgcaggaccttccgagatggacctgatgaaggagaagttcgccaagctgctgctcggggaggacatgtccgggtccgggaaaggggtgccctccgcgctcgccctctccaacgccgtcaccaacctcgcagcctctgtgtttggcgagcaacggaagctggagcccatggccccggacaggaaggggaggtggaagaaagaagtgggctggcttctgtccgtcgccgaccacatcgtcaagttcgtcgccaagaaacaagtcctggataacggcgtcgaaatggaggtgatgggcacgcag

SEQ ID NO: 25905 - DNA, 609 bp, Sorghum bicolor
  Clone ID: 30967706
tgtgccccgcggggcttgccgtccgtggcgccggcgaaggcgggagaggctgcgtcgtcggttgccgcagcgcctgcgccgcgtatggtgccccgcagtactgctgcacggggcagtttgggagcccccagcagtgcaagcccacggcgtactcgaggctgttcaagtcggcgtgccccaaggcctactcgtatgcctacgatgatccgacctccatcctcacctgctccgccggcgcatcctacgtcgtcaccttctgcccgcaccaccgctgatgagctgctggtggatccaatcccattccaataatccgtagaagatagtatagggtaacatcaagggcggtgttgggttttgcgaggtcgatgagtttagctgtggcctgactgaaggctgctgttcttggtttcgtttttattctcttttttttttcccagctggttggtatcgtttcgtcggatcttgtagtatcgtatcgtgtcgtgtcgtatggtcgtagtgtggtctaccactggtagtccgagatcagatggggggtatatcagtgactcagtgtatctcagtatatgggagacgggggtataagtatgctagaagcactcattttcc

SEQ ID NO: 25906 - DNA, 636 bp, Sorghum bicolor
  Clone ID: 30967713
gaagcaagtagctccaatcagtcacaaaaagaccaagaaatgcagttacaaaacagcagtgacggtttagtgcctctgcatgttaatgcaaatggtgctgttggttcaggaacaagcacaagggatcttgaaaattcattgcagaaggcacaagaaaactttattaagagccagattgagatgttacaaatccaactgcaaatggtgcagcgtggtgctgctgcgtcggccagtaacaatgggaatgctgaacacagaaagaatgactgaatctgtaaacaggcgcttctgcatcgtggagtaataatgagaatgctgagcacatagagaatagctgaatctgtaaataggcggagatgaggaagggataaaagagaacaaaaattggtggtacctgggggataaactattacatgataccttgccttgaatttgttaggcttgttaatttaaacttctctgttagtgccttcttgccagcactagacgtttcttttttgtcatgtgtggtggtttctgtagtttgggtacatcaagcctgtataataccttttgatgggagaacaatggctggtttaatcatgagactacacagaattcttctaccaagggaaaatatatatgactttttcttcc

SEQ ID NO: 25907 - DNA, 649 bp, Sorghum bicolor
  Clone ID: 30967716
tcaggactaggagggacacgttcctggtgacgggggaggacgaagggctggggtttgccgccgtggaggactaccgcctccgcctgtggtcgtggagcgaggctgtatgggcgccgtggagggacatcagcctggagacgatgatacccttgaccatcggagaccccaccaccgagctcaaggtgatcggcttcgcagagatgtctggtgtcatctttgtcatggcaaatggcatcgtttccgctctcgagttgatgtctggcgaaatcagcgaggtcagagagacgctcaactccagcactatctttcccttcgagagcttctatactccaggaatggggggtgcataaggatctcactttccagttcgagggtcttcttcagtgttatacatctaccctggtagcattgcaggaagatagcgttcttggcctttctgcaagagggtaactgcactagaattgtagtactctctttgtgcttgggaactgaactgatggtaactgcagtagaattgtagtactactctctttgtgcttgggaactgaactgatggtaactgcagcagaattgcactgtagttcgcaatcagacaaggagaatcatacgattcctcatgttaccttgatgaatttttggtaacttcatg

SEQ ID NO: 25908 - DNA, 662 bp, Sorghum bicolor
  Clone ID: 30967740
ataaacaaagcgcaggggcagaccataccaaatgttggcatctaccttccggaacctgttttctcacatggacagctatatgtcgctttgtcgaggggagtttcaacgcaaacaaccagaattttatcaaaaccaaacaaggaactggattcaacatggaggagcactaaaaatattgtatggaaagatgtgttgaactgattatgtgtggagcacagcgagctgaatgagcaaggtgtcaattttcagttttcaagttgtgaaaatgggtgcttagtgtctcctcaaggctgtctactgaaggtgcgatggttgcgatgatgcaagtctttgttttcccctgcaaagaatgtttcaacaatcctgttaccttgctatccctgcatatgagtagcagacgcatatcaaatgcctgaacagctcaaggaacaatctgacattgttattatcccatcggaaattgtattccatactttaagcaatgttttttagctgtttgaattgctgggatgtttttttggctgatatcaattgttttttgtattttggcaacactatgtcatttaggaatattaagactacaagtgtttgcctggttacttgttcattttgtttccatgaatgccaagcatgggagagagttgcttaattattcctatgcg

SEQ ID NO: 25909 - DNA, 656 bp, Sorghum bicolor
  Clone ID: 30967785
ctactggagctagctcacagcccagtattggtgcctgtgttccttccaattctcttctcctgcaagcagcactctcttctttgggtttttaatttcttcccccctgcctgtttgcttctttctgcatccaaaagcttttaaaacgggcagaatcataaacaatccccttctttaaaaatcattgcttccttttccaacacttccttttaacctaaaaaacaaaacaccactctgttgcaattggagtatttttctctctttttttcgctgcttttctggttttaaaattttttcttgctagctacatcagtacgtgagctagcagaaaagcatggccggcctcgacctcggcaccgctgcgacgcgctacgttcatcagctccaccacctccaccccgacctcctgctgcagcacagctacgccaagcagccggagccctccgaggatgaccctcatggcagcggcggcggcggcggcaacagcaacaacggcgggccgtatggtgagcacgacggcgggtcgtcctcatccggcccaggcgccggagacgcccccggtggcagcggcggtaacggggagatggtagcccgccgaccgcgcggccgcccgccgggctcgaagaataagcccaagcccccggtgatcatcacgcggg

SEQ ID NO: 25910 - DNA, 662 bp, Sorghum bicolor
  Clone ID: 30967811
gatcaccggagatgttattttgggcaagctacctctctccccacatcacttagtgctgatctagagatattcttgtcttgggtggatgaagttaaacagataaaggtcatggtcaatgcagacactcctgcggatgcactgactggaagaaaaaatggtgcgcaagggattggattgtgcagaactgaacacatgttcttctcttctgatgagaggattaaggccatgaggcagatgataatggcggatactgctgaacagaggcagaaagcattagaccttctcttgccatatcaaagggtagactttgaagggatttttcgtgcaatggatggtatgtgctcacagacatgcatttttgtttgacttcacagttgttcaaatgtcattaatggctttgataaggctacagctgcagagctattatttcagttcaagtaatgttgactgctcaatgcatctgtaacctcatgattgtgacatcataaatgaacactgatctccttttcttatgggatgaacattgatccccttctcttaaggggtgaacattgatgtccttttcttaggggatgaacattgatctctatattcagtactcatgctaattatttctcaaattaaaatgaatttgaagcgtaaaagtgaacttgcttatctga

SEQ ID NO: 25911 - DNA, 665 bp, Sorghum bicolor
  Clone ID: 30967820
aaagcattttccccaaccgaccaactctcggtttcgtttcgccagcacagcacacaatcccacactgcgatggcagcgccgccggcgccgggggagggggagctgacggaggtgctcatcggcgagatcatccaccgcttcccgccgaacaatccggcatgcctcttccgcgcttcggccgtttcccgggcgtggcgtgccttcgtcacctccgacgatgtcctccgccgctaccgcgagttccacggggcaccgccggttctgggcctcctgcagaaccgcgatcctgccgacgaaccagagcctcctgcacaagtgcagcctcgcttctatgccaccgctacccctcccccgccgatcaacctgcccaacatccagggcgactactcgctccttctcgactgccgccacggtcgcgtgctggtccataccatatttccccacggcctcatcgtctgtaaccccatcaccggcgagcagcaggtcctgcccgactatcatgtgtttcccttcagttgcttcggcggagcggtgctctgcgccgtcgacgactgcgaccacctcgactgccatgggggcgccttccgcgtggtcttcacgggcaccatcaacaccgacgctgaagcggacgaacacatcgacgaggtcttcacatcggcgatccc

SEQ ID NO: 25912 - DNA, 660 bp, Sorghum bicolor
  Clone ID: 30967845
cagattgggcggatagtgtatgcaaacccttctgaaggcgagaggtattacttgagggtgcttctaaatcatgttagaggtccaacttcattcgaggatttgaaaactgtagcagggatcttatgttctacttttagagagtcatgtgagaaaaggggactcatagagacagataatacaattgatgactgcttggttgaggcagccacttttcagatgccgtatgccctcagaaggttatttgctacggttttggttcattgtgaagccaccaggattcgtgcactatgggagaagcataaagaatcaatggctgaagattacagtagaaaccagtgtaactcagaattagtagaacaaatggtgcttagagatattagagatttgctgcaatccatgggaaaagatataaaaaattttgatcttccagagctgagtgatgcagctgattattccaatgacaaaatgaggttggttagagaagaactttcggtgggggtcgatccagaacatttacaaatcaaaggtagtcttaatagggaacaacttgctggatttcatgagattatgaatcatgttctgaacaaaaaaagccaggtgttcttcgttgatggtccaggaggaacaggaaagacgtttctgtacaaggcacttcttgct

SEQ ID NO: 25913 - DNA, 552 bp, Sorghum bicolor
  Clone ID: 30967870
ctaatagcagggctgcttgattttggcaggttaactgaggtggagaggcgtcccgatgagatgattgacatgagagttgagttgtcacggtctacaatggataatatgaagcgtgcttttgctaaggctcaaaggccccagtcatatgcccgcattgctagaaggctgaagagacccccctgaatgctttaatcagctgaaacttttgaggctcatggggtagaagtttaacccctggagccctggactgctgaattttttgactaccaaggtttttgactagcctggatcctgcaagcctggaacgatttttgatcctacaagcagtggtcgggattttagtgtagctcttgtagattcctgaccccattttgtgctagttttcggctggttactgattctggtgtaataagggtgctagtttagtgatgctgcattttatccctattttttttttcagaatatatggtaaggatatccaattgggttatgtaatatcagaaactcctggctgtcagcgttaggcccctatgctgatcctttgaccctatt

SEQ ID NO: 25914 - DNA, 657 bp, Sorghum bicolor
  Clone ID: 30967872
tgagattacaaggatcagtaatattgcacctggaattttcaggaaaactctaacagatgtgcaagtgaatggctacacaatccctgccgggtggctagttatgattagccctatggtgggtcatctaaacccaacgctatttgaggatccactcaaattcaatccagggaggtggacgacacaggacaaggaaaaacaaagcattcagcagaggaatttgatgccatttggaggaggcataaggctttgtcttggggcagagtttgccaagcttttcatttcacttttcctctacgttctagtgccaaactacagatggattgagataaaaggaggagaagtatcacgcgttggggagatggtggttcctcacggctatcatatccaactcgttcctaggacctaagataatttatctacagtttccaccgtgcatatttgagctttgatccatccaataactagtgtaacgagagagtgtgaggttaacactttctttcttgctgtatatcaagtgtgtttgagaacacattttatgcttttcctccctaatttgtgtgtatgtctaaataaaggggagcagctaatgcacggctgcccgtgctattatcatgctgcacactccatttccagaaagcatatatatcttcaccggtt

SEQ ID NO: 25915 - DNA, 631 bp, Sorghum bicolor
  Clone ID: 30967873
gatgtaggaggccagagaaacgagagaaggaaatggatccatctttttgaaggtgttaatgctgtaatattctgtgctgccattagcgagtatgatcagatgttatgcgaggatgagacgaagaacagaatgatggagactaaagaactctttgattgggtgctaaagcaaagatgtttcgagaaaacctcattcatgttatttctcaacaaatttgacatatttgagagaaaaatacaaaaggttcctttaagtgcgtgcgagtggtttaaagattaccagcctatcgcacctggcaaacaggaggtggaacatgcctatgagttcgtgaaaaagaagtttgaggaactctacttccagagcagcaagcctgaccgtgtcgaccgagtgttcaagatctacagaacaacagccctggatcagaaacttgtaaagaagacattcaagctgatcgacgagagcatgaggcgttccagagaaggaacttgattgagataagccacaagacaagtaactagaatggtgagaggaacagaaagtttacagtgtcacagctttgcctattggattcttttttttacatgaggaacatttgttgatctttttgctccaccacaggccagtaaaagta

SEQ ID NO: 25916 - DNA, 567 bp, Sorghum bicolor
  Clone ID: 30967882
gttgagcagcagtgtttgctattgcctgttgacagttgacttgtcttggtatggctgacttgcagcttgtttttttggttgccatttgtctgggtactaatagtggtgatatatatctgtggtgctttggttacagggggcctcttcccattgccaacatcgttggaaggtacatgacgtcctttacaagatcctctttccagtaactgaagtgaagaggttccactcaatgttcctaatgctgatgtcgcctcataatggtagttagagagttgtgttagggtggagccaggctgctgctatcttgtcaacttttgccagaactagccctccgagtatgctgtagcgctgttgttgtattgtgtttgtatatgatcgcctttctcccaccagtgggaactagaggttagctctgccgctagcagttggcacgagccctcaggccgcctcacgctgtcgtgtgttgagcttgtgattcccttaggggatgaagcttgtcggcgccgatgctaaatgtcgattacaatttgcataggaaatttggacatgattgtgttcttgttccag

SEQ ID NO: 25917 - DNA, 668 bp, Sorghum bicolor
  Clone ID: 30967973
agtctttggtactccgttctgcttctgccgttcttcaatcgagagattacgatttctataatcaaacccagacgcgaatcagagagatagggggatttgggggaattagtagatacagtagaactgaggaggaggagcaggtcgaaggaagccccagctttcgccgatgattgcggcggcggcggcggcggagaagagccccgaaagggaggcggaggagtcgaacccgcgcgcggaggcgtttctggagatcatctgccgcgtcccggcgggggaggtggaggcggcgctgtccgcttgcggcatcggccccacggcggaggtcgcggaactggtgctcaagtcctgcgagtgctacaagcgccccaagtccgccgtccgcttcttccgctgggcggggctgtccctgtcgcacaccgcctacgcgtggaacctccttgtcgacatcctcggcaaggccgccatgttcgagcccatgtgggacgccatccgctccatgcaccaggagggcggtggccggctcgtctccgtcgccactttcgcctccgtcttcgcctcctactgcgccagtggcaacctcaaggatgccatcgcggccttggacgtcatggaccgctacggcctcaagcccgacgccgtcgcgctcaactcgctgctctcggcgatct

SEQ ID NO: 25918 - DNA, 659 bp, Sorghum bicolor
  Clone ID: 30967975
actgcaaaacaaactgatggctagcctggggaagaaaatccgttctagttctagtcgcagtacgtactagctagctagggatggaaggaggtttgctggccaataatccatcatcatatgcacttctatgttgtgttacggtggggattgcatggttacttcactgggtttacagatgggtgtgtcccccatgcaaggggagacttcctcctggctccatgggcttccccgttattggcgagacgctccaatacatgaaacttagcccttctatcgacatcccgagcttcttccgccaacgactgaagaggtacggccccatgttcaagacctgcctggcggggcagcctatcgtggtttcccttgatccagagttgaaccggttcatcttccagcaagagggcaagttgttccgaatttggtacccgcagacagcaaacacaatattcggcaagaagagcatcaccacattcacaggtcccgtccacaagttcatccgcagttttgcgtccaagctttttggccctgaaaacatcaaggaatcgctcatccatgagctagaggatgccatgaagcagcacttcgcagcatgggctgccaagcctagcgtcgaggtgaacgatgccatcgcagatatgatttttggtcttgtggccaag

SEQ ID NO: 25919 - DNA, 675 bp, Sorghum bicolor
  unsure (1)..(675): unsure at all n locations
  Clone ID: 30967999
aagctttgccgagttgcggcggccgccggcggtgaccagtggccatggtggcgcgtttcgatgtgggcctgcgcgcggcgatggcgtcgtgctccctccacgggttccgtatgctgctgctgctgctgctactgcgcgcggcgggccagcgacaacgtggaatagcactttttgctcaggttgctcctctccttacccaccggtcaaatgtcctgcttttcttcctcgcctgcctgccggtctggatgaactgaatccatttcagagacatccaggattccaggacattggtgttctttgccatgctacatttctttgagatttgcagaaatatgttgccctgtcagatgcctacaaatagtacatcgctgcacatgtcattctctgaatgtttccaatctttacagatagactcttgcttttctccttttgtctctacaatacatgtaatgtaagtgtaatggggcaacaattctctgcacaaatgaaagcagcctaatctagatggtgtatgtcatctgtacatatatttatataaggggtaaaaggaacctgacattttgtacatcatttgtgcacgaggtagccatataaaaactcgttccacacatcangaactccggggaggcaccaatgtgtgcaatctgcataactggctgggtctgcaatttgctc

SEQ ID NO: 25920 - DNA, 566 bp, Sorghum bicolor
  Clone ID: 30968038
gccgcggccgcgcgttacggagtgcggctggtgcaggacgccaaggagtgcgtggacgacgattacgtgcgctccatggtggacctcctggaggagcggcgcggcgcccgcccggacctggcggcgagcctggtcatttcggcgtggacgcgcctggggctggaggacctcgactttggcgccggcaaggccgcgcacatgggcccgctcaccagggagatttactgcgtcttcctccctgtaatgggcgacccgcaaggggtcaccgtgctcctttccgtcccgcaggccgccgccgacaagttccagcactgctgcctcgaattcctcaaggacaccgacgtggacgcaaagctcagctgatcgagctatatcatccggctgctagctcgatcaccatgcattttgcatggtacttatatatcagaaaatgagtcatgaatactaattactccggccaatcgagttgaaagaatgatcatccgcctatgatcataatcatgcttgtatgcactccgatccgtagcaatatcaatcaatgggtgatgagctcctttttgtgttat

SEQ ID NO: 25921 - DNA, 572 bp, Sorghum bicolor
  Clone ID: 30968039
ccacgcaggccatgtggccgttcccgtccgacaaggtcatgcagggctacgcttacatcctcacgcaccccggcaacccatgcattttctacgaccatttcttcgattgggggttcaaggacgaaatcgccgccctggtggcggtgcggaagcgcaatggcatcacgccgacgagcgagctcaccatcctggagcacgacggcgactcttacgtggcggagatcggcggcaaggtgatcgtgaagattgggtccaggtacgacgtcggccacctcatcccggcgggttttgaggttgccgcccacggcaacgattatgccgtctgggagaaagccggtaccgaacaagtgactcgagcgtaatcgtctcagagtgatcgaaataatacaggatttaatttctctgctacacgcagatatatacatgatttggtgtaaccattctacaccagtacaatgtacacgggactgcattgataataagtggtttctcttttaaatttgtaataagtacgtaagggagcaaaaaagggcaattggagccatatgtaacgttaaaggttttattgagcc

SEQ ID NO: 25922 - DNA, 205 bp, Sorghum bicolor
  Clone ID: 30968045
caagttgttgagaagaaaggaataatttggcctgttccgcaacagatcacttgggggaagcaatgtaatttagtgcttgatcaattgttaccctttttgctacacatgtgcgctcatggaattcagatggctgagcgcgtttacctgctcaacttttagccatgttgctgttctgcttaagcggtgttaatcacttattaagctc

SEQ ID NO: 25923 - DNA, 621 bp, Sorghum bicolor
  Clone ID: 30968056
tagttgagagcatgatgatggttatcgccgcgattgttccggacttccttatggggatcatcgttggagctggagtgcagggggtgatgatgctcaatgggggcttcttccgccttcctaatgagctcccaaagcctgtatggaagtacccttcctactacatctccttccataagtatgcagtgcaagggctctacaagaacgagttcatggggctctctttcccaagtgatcagctgattgaatccaatgtcaccatcagtggcattcaggtcctgaagaaaaacttgcaggtggagatggggtactcgaaatgggtgaaccttgccatcctttgtggaatgatggtgatatacaggatgatgttcttcgctatcgtcaagattaccgaggaaattcgacaaaaaaggggaggcaaacgaggatgtgttagatagtagttgccttctgtatatatatgtctttcattttcccattcttgtatcactttaatgacctaattgtataaactgcaaataatgctttggttgtctcgctatgccatcttaaaatggatggtatgccatatatatttattgatttccatcatggtatcccatgatgttacccaaagaaaacttt

SEQ ID NO: 25924 - DNA, 659 bp, Sorghum bicolor
  Clone ID: 30968073
caagcaaagaagagatcagaagagcacacgctgcagcttttcatctaaaaaagcatgaaactggccagtcggctgaactggggccatttagtaattgcaaggtatggggaacagttgaccctgactatggaccggtatcaggtacttcagatatgagtgagacacgcaagaattcaaactacagcaagtgggagttacttccacttgagaagctgagaagagaagctcaggaacaccatatccaaatgggtggcgtgtctctgtacaagatggatggaaacaagttggatgatcttgtctgtgtaaggcaccagcgttcatcaagttaagaccgtggcacctgagcttgaccaaagaaacacttttaggattggtttcatggtggttctgaaaggatgatatagagcaagagtcaaaacatccaatgaaactgcatgcgctactgaacccacttgtaaaattacatggggcatcgggttcagagagcagcagtcctacctggaatagggaattcttttattggttgtttaggtacttctagccttctaggaacagctacttaacaagctgtctaaggggttgttatgtagacggcacatgacatggttttcagttttttaaacagctgtaactaaatgctgaagggtcttgccattctc

SEQ ID NO: 25925 - DNA, 328 bp, Sorghum bicolor
  Clone ID: 30968080
gctatggaagggtaggacaaggagattgtcaaggatgaggaggtagctgccaaggtgaagtggctcatggagtcggacggcggcagggagcttcgtgagcggacgcgggcggcgatgcggaaggcgaaggaggcgctgagcaccggcggagagtctagcactgcgctgttggagctcgtaaggcagtgtaaaatgtgaaaaacccctgctttaatttaactagcaaatatgcacgtgcgtcacacacgtgtttgtattatcggatattttttttcttattttcacttattcattcataatagggtactataaacaaggtaaaacgttt

SEQ ID NO: 25926 - DNA, 640 bp, Sorghum bicolor
  Clone ID: 30968098
atcgctcacaacattctcgccaccttgtcgctcaagctcacgggaaactacacagtgatcccacaggttcccagtcccagaaatggcgaccccatccgagagccaagacaagaaggccctcgtggtcatctacgccccgccgatgatgatcagccacctgttctccttggtggacctcggcgagctgctcgcagcgcacagcctcgacgtcgccatcgtccttggcgggcggaccgacgacactgccactggcggcggcgcggctgccggttcatttgccgaaggcctcgcggctgcgcacccccagctctcctttcacctcctaccgcacgtcacgcgcccgcgcgacgtgcccgcccacgattacgtggcgcagaccttctagctcgcccgcgcctccgactctgacctccgtgagttcctccgtgccgcctccccttccccggccgccctggtgctggacttcttctgcggcagcgccttggacgtctgcaccgagctgggcatccccacgtacttcttcttcacctcatccatcgccggcctggaggaattgctataccatcccttgatccacgagcaaacatccattagcctccgacacctcgggggtgaacttttgcgcgttccgggcgtcgcg

SEQ ID NO: 25927 - DNA, 662 bp, Sorghum bicolor
  Clone ID: 30968110
agcgcagacacgccaaaatcctagggaacccccactacgcctgcacgcgcacactagcatagcaagccaccaccttagatcggtcgacacagctaggctgctagctacccgctagctgcaccacctctcgctcgctgctagctagctagctaggctgccgcccggccgggccgcgcgcgtggagagcgctcaaaattcgcgcgcacccgccacgcggcgcggccatgctgcgggcgccggctcggcggcggggaggagaagcgcagtagtagagagagccgccgggacacgggcgatccgccgctgcccgcgcgggcaggctatggatctggccgcatggcgggcttccctctaggcggaggcggaggccacggccgcggcgaccacccacacgtgaacccttcctcctccggctccgagtccgccgccgcggccgccgcctacctctacacggccgccaccgcctccgcggcgccgcgcggcgggttccagctatggccgcaccacccggcgcaggagcaccaccaccacttctacgcgcccaacatcatccgcttcgccgatgaccccgcggcgggatcctcgcgcggcggcaggggctccgcctccggcgccggcgccggcaccatcagctgccaggactgcggcaaccaggccaagaa

SEQ ID NO: 25928 - DNA, 661 bp, Sorghum bicolor
  Clone ID: 30968132
atattgcagaagagcaccagctggctgtcattgattgcttagaggacccagatgatactttgaagcgcaagacctttgagcttctttataagatgacaaagtcaacaaatgttgaagtgattgttgataggatgattgagtacatgatcaatataactgatcatcattacaagacagaaattgcatcacgttgtgttgaacttgcagagcaatttgcgcctagcaatcagtggttcatccagaccatgaacaaagtctttgagcatgctggagatcttgtcaacatcagagtggcacacaatttgatgcggctaattgctgaaggctttggagaggaggatgaaggtgctgacagtcagctaagatcatcggctgtagattcctatctccgcattgtcggagagccaaagcttccttcttcgttcctgcagataatatgctgggttttgggggaatatggaacagcagatggaaaatattctgcatcttatattatcgggaagttgtgtgatgtggcagaggcccacctcactgatgacactgtcaaggcgtatgcgatctcagcaattctgaagatatttgcgtttgaaatcgcacttggaaggaagattgatttgctgcctgagtgtcaaacactggtagatgaattgtcagcttcaca

SEQ ID NO: 25929 - DNA, 645 bp, Sorghum bicolor
  Clone ID: 30968135
gttcatccgtcctctgacttctcccccggctgggctgcccgcgactgcgaacccgatctcgaattctcgattcgatcccatggcggccgccctctcctcctcgcggcgcgccctgcacaccctccaccgccgcctcctcctccacccctccccctcaccagccgccgcgcgccgcgccctacccacactcacacccactcgcactcccatccccgcccactcccccacccccactttctccttctcctcctcctcccgattctccaccaccgcgcgccccgatgcgaggctgcggcacggggtgctgccgcagggcccgcagcagcggctcgtgggcggggtcaggtcggtggctagcggcgggtcgaagctggcgccgctgggccagggggtcaaggggctggggcggcccgtggaggcggcgaggagcgccgccgcgcggtaccgcgcggccgtcggcctgcaggtcgaggccttctggcggcgcaactacatggtcctcgtcggcgccggggcagtcatcgtctgcgtcgcgctgtggaggatcatgttcggcatcgccagcaccttcgtcggactctccgagggcatggccaagtacggcttcctcgcccttgccaccgccattgtcgcctttgccggtat

SEQ ID NO: 25930 - DNA, 281 bp, Sorghum bicolor
  Clone ID: 30968142
gtgagctttacaatgctgttagaagcttttgcaactaactgaaacacgccctttgaatatactgcatcaagctatatccgtggctttattgttatctgcccttcaagcatcatcttggaacaggatttttggcagtcatatggataacatctgatcaagtgaagttaaatttgtttggtgctattggagttttgggagattttgtgtcatgatgattggaacatgatagctaattataattaattttggtgattccatcccaatatactacacgggattgg

SEQ ID NO: 25931 - DNA, 662 bp, Sorghum bicolor
  Clone ID: 30968149
acataatttcagtggtccaatcccagggtccctgacaaggactttcaacattgtagggaatccactgatctgtgcagcaaccatggaacaagattgttatgggtctttacctatgccaatgtcatacggcctgaataacacacagggaactctgatgcctgcgaaagctaagagccataaagttgcaattgcatttggtgctacaactggctgcatcagcctcgttttccttgccattggtttgctattctggtggaggtgtaggcgaaaccggaagactctttacaatgttgatgaccagcacatagagaatgtcaacctcggaaatatgaagcggtttcaattcagagagctccaggctgcaacagaaaacttcagcagcaagaacatattaggaaaaggcgggtttggtatcgtttaccgggggcagctcccagatgggagtcttgtagccgtcaagaggctcaaagatggtaatgctgcaggcggggaagcacagtttcagactgaagtcgagatgatcagcttggcagtgcacaggaacctcctgagactctatggattctgcatgaccgccagtgagaggctactagtctatccatacatgtcgaatgggagtgtcgcattgcgcctgaaagggaagccaccactggactggatca

SEQ ID NO: 25932 - DNA, 226 bp, Sorghum bicolor
  Clone ID: 30968164
tttagtatgcatgtgcagtatgtgatttagctcttgatgtgttcgttgtaatcagaaagctgtaacatgtaagatactatactatccaaacttgtacgggcaggttggtagtccaacaaccaaggggtaatagaaatgggggccccgtggtttcacaacagcttgtccggtagtagtttataacattgttcacatagacaccggacgcttagaatcaaatagaaag

SEQ ID NO: 25933 - DNA, 569 bp, Sorghum bicolor
  Clone ID: 30968166
atctttggggcaagttaggtgagactggagaatcatactactttgctgattctcaattgctttgtgccgttagctacaaaccgaccatagagaagtagatgcaacagaacaggctactatagtgttttgtatctgaacatgtggcacatcttgcattcagtaataagcctatagcaactggcttatatgtgctcctctgttcaccgatcagcaaatcaacattgttattagagaaaaacagctgcagggtggaaattggcatggataacagttaacaggacatgtgtggaagaatgttctaaagtgtagaatatgatggactgttgcccagttccctatttttcattgctttatgatttgtgggcatatcaagattgtttgttgcctgcgcatggaaaccattgcagaatccatggtaagtctcgttaatgttccagatccaagtgtagtactcttgttcgtgcttttgaatcttttttagtatagaatttttcttctgtgcatgacactgctgccatacttacagaacagttcttgccagacatttttagtgtcatatttgtgagagc

SEQ ID NO: 25934 - DNA, 623 bp, Sorghum bicolor
  Clone ID: 30968170
cgcgtgatttgcagccttaggagggagacgtgggtgcgcaaggtggcgcttttccagagcttcggggtgtccgaggctcacctgctcagagcgttcaagacgcagcccaccatactgctcgtcggagaagagaccttgaagaagaagttcaggtttttcctggacgtgatgaaggttgagatggatgatgtgatggcgcagccactgactctggcattgagcttggagaagaatatcatgccaaagtgcgccgtgctgagcgtgttgatgagggagggtaagattaggattgagcggtcacagaagttgattccgccactgctttccaattctaaggtcttctcgcagaggtatgtgttgaggtatgctaaggatgtgcctgatgttgttaaggcatttgagggcaagattaaatttcaagggtttggctgtttggggatcagaagttaggactttcgtggcactgaatgactgaagcccaaagctcagtcttctgtaatcatgcttatgtgttagaggtaaggttatatagcaacatttttaagaacaatgcacgtttgcaattgtaaccttgttccattcatactcatagtgaaatgtccattcggttgtcatagttttgc

SEQ ID NO: 25935 - DNA, 593 bp, Sorghum bicolor
  Clone ID: 30968172
ccatttgactgctccttgcaggccactccatccaaaccaaatgatccagctctcgcagatctcatggagaagaagctgtccaactcgatagagcagatcgaaaagatggtcaggcgaaacctgaagaaaactccgaaggccgctcagccttccaagaggaccatccagagtcgcatcctgatgtccatgcgatgagctgaggaagctgtgctctgtcatggtttccagagtcgcatcctgatgtccatgcgatgagctgaggaagctgtgctctgtcatggtttcctcttgtctgctgctttcttagcggctagtcctaaccaatcattatttcagttttgcctgaaggagggtgagggttcctggttctctgcttgaggaccccaggggtatgcggcttactatagctctctgcttgagggtacatagtattatggtgactacgatttctatacgtttatagcttgaactgtgtatagcctctctacaattttaagcaccatgaataagtgatgcatggtctttttagtttgagaaattagtagttcctctgtatagttatggtgtagaacggatgtgagaagtgttaaact

SEQ ID NO: 25936 - DNA, 648 bp, Sorghum bicolor
  Clone ID: 30968174
ggttgcaggaaagaaaataattcgcaaagtctgcctcaaaagctatgaaggtaggcatgtgaaccgtcaggtcacagtgcccttggcgccagaatacaacaagagctaccggcttgggcatggtagaaacccggtgctccctaaggaaaggaccgatggttggatggagttggagatgggcgtgttctacaacaaggaaggtgatgatggcgaggtgcgctttagcctcctgcagacatcaggtacttcgaaggagggtctcattgttcagggcattgagattagacccaagaaactaggctaagggtttgtactgttatggtcaaagactcatgaggatgcacattcatcgttatgagtctttgaccaaacagtacaaatcatttgccatgctatgggtacaataagtttagtaccttgttataccaccggatgtctaatggattcaacatgaggtgaaatgaggggtagctaggatgactagtacctctgggctcactatctaaccgttcatagacggtttggccggactcggaaacggttgaggctcgagttatgccttatgtaccaacgggttatatgggttgtgaccgttgtctttgatgagaaaaacttgtaccgaaaaactcatacccctttgcaaagatt

SEQ ID NO: 25937 - DNA, 514 bp, Sorghum bicolor
  Clone ID: 30968197
gttgataaaatggtgaaactatgggatctatcaaaggacaaaccatcatgcattgcctcccaaaatccaaagcttggagctattttttcggtatcattttcaaatgacagccccttcctattagcatgtggaggttcaaaaggcaaactaaaagtttgggacacgctaagggagcctgccgtagctcacaagttcagcaaatagatctgccgcaatctgccgctacaagttatttccggcatacacatgtttgggtagattgttgaagagttgtagtggaagtcttgcccttgtgagttttgagagcccagttgtataatgaatccaagcatatgtattagtggtttgtacaacaaaaaattacactggcccaaggttttggagtggagttatcaagttatgacactgcgtgttatggctgtgaacccgtggctgcatttccgattttggaaagaaagttagcttcttcactcttcacagcagagcactttaactcggatccagttgaagcttt

SEQ ID NO: 25938 - DNA, 660 bp, Sorghum bicolor
  Clone ID: 30968208
ccatttcgacatggtggtgcccattgcaagcagtgcctagtaagtatgattcaaactgttgtaaatattgcccttggccctctgtagcagctgtctaaatcctgcctgcgggtgtcattgttggatgctgatactgccatcagaaggggagttgcctcttggggatattcagagggtgggtgaaagtggcatcgatggcaagctgcttgtccaaggaatcgggccgacggcgacgacgatggcgacccggttgtcatttgtgccgggcgcacatgtcgaaaatggccgccagctctgcccggggccctaccgtggctgcaagctggtgcttggagctttggatgtggagtcccctctcactctgcacttcctgacgggatgcaatgcaaagagaccaagggccaatgaatgagccatggccggccggcctctgcctctctcgtctcataggcaggcaggcaggcaggcaggcagaggcgtacgtctaggtgtctctctcgtcttgtccttgtggcgccaatgcatgcaacaactcatgtttggtctcgctcatgtttcctcgttttctctcatgctgtctctttgcctactgctcagtctcactcatgatattaccttgtgattggtttgttaaaatctgaatatctcagtctcacaaga

SEQ ID NO: 25939 - DNA, 615 bp, Sorghum bicolor
  Clone ID: 30968215
tcccgcggcgggcggttcgccatcgacctgacggcggcgcagccgttcgggtcgcccgggtgcagcccgcgtgggagcggcgacttgggccactaccacggcggcggggtgtggccgttcggcacgttcaggggcttcgtgatgtcggcggctgtgcagggggaaggacggtgcagcaggccgacggtggaggtcggcgtggcccacgtcgggtgcgctgaggatgccgccgcgttcgtggctctggcggccgctgttgacctcagcatggacgcgtgccggctcttctcgtgtaagcttcgccgggagctgtcggcgtctcgcgctgagctggtccggtgacccctcgggcattggagggagtggaagctaagtgtggaggactggagggaggggcttgccggtctgcgggagggagagagagtgtgtgtgtgtgtgtgatgtcgtctggtcgcaaagttttggggaggcggtgatcggacgagcttgttttttgggctgttttggtcgattgtggcttgcctgtaatttttcggtgagtagggatgagtgttgttggtcttctaggtgctttttaaagtctagaagaagcaatgaaactggggtgagtggtgg

SEQ ID NO: 25940 - DNA, 662 bp, Sorghum bicolor
  Clone ID: 30968220
gtcactgacaatggagccaattttaagctagcagggaggcttttaatggagaggatccctcatctattttggacaccatgtgcagcccattgcttggatttgttgctggaggatattgggaagatcaaggaattcagcacttgcataaacatggcaaagaaggtgaccagattcgtgtacaagcatgggagggttctagacctaatgcgagataaaattggaggagatcttgtgaggccaggtgtaactcgctttgccacttcattcctcacattggcaagcatgcataggcataagaatgcattgaggagtttagtggtttgtgatgaatggcataacctcagcttttcagctactcaagaaggccggcgcgttgagaacattatcctttcagcgccatttttgagcaaagtggaattatgcctaaaagcttcacaaccacttcttattgctctgaggatagctgatggagatgagacaccagcagctcctgagattatggcagccatggaagtggcgaaggccacaattaaggaatctttgaaaggaaaaccaactctactcaacgaagtactaaaatactatgacaatcgatgggaaaaccaaatggagcaggacctgtatggagcagccctatacttgaatccaaacaagtttttgtc

SEQ ID NO: 25941 - DNA, 525 bp, Sorghum bicolor
  Clone ID: 30968234
gctttcatgtgcgatcctcaaggagttgactattgtgtaaggatcatttccctgcttgttgctgcaaatagatatcccagggataggttgaaattaatgtgtgaagacatcctccccaagatgcttaacaaggaggctgctgggactactctggatatagctcaaagccatagcttgcataagcttaaagaagattgtatagagtttatggcatcccagtgtgagagggatgttgttcaagcatgcccattgctcaaaagatcgtgtccttcctttgttacagctgtattaactagaaaggagaaactggagttagtaaacaaagatgcagtgatcatcctaaagtgccccttgacaagagggagcctgggattctattaattgtatggtttgaggactaaggagtatatctgctgtagtcttatgaatgataagccatttcatgttgtttttggatgaacattaataacttgttttgtgaatttgaaactattatatcttttgtgtgacaatataatgttatgt

SEQ ID NO: 25942 - DNA, 653 bp, Sorghum bicolor
  Clone ID: 30968240
atcgcgaagaagaaaatcgaaaacacacccagccgccgtgccagcctttcctcttccccttcccccccccttccggtcttcgtctccgattccgcccgccattgccgccacccacccgcattgcctcgcctcgcatcaccgattcgtcgtcgtcgtcgcaggcattgcgacctgcctgcctgccgccgtgagcgatggacccgtgcccgttcgtgcgggtgctggtcggcaacctggcgctaaagatgccggcgtcaacaaccgcgccacgcagcaccgccgcgtccggctccggggtgcgcccgaccacggcgccatgctactgccgtatccgcctcaacaagctcccctaccagacggcctcggcgccgctgctgccacccaccgaggaaggcccggcgtcgtgcacgggcgccttcgccgccgcgttccacgtctccaaggccgacctggaccgcgccgccgccaagcccgcgctcctcctcggcgcccgcctccgccgccgcaccgcgcgcctcaaggtcgccgtctacgccggccgcggcggcggcgcgtcctgcggcggaggcggaggcggggtcaactccggcaggctgatcgggaagctcgtcgtcccgcttgacctcggtgctgctatggcgaagcccgtcgtc

SEQ ID NO: 25943 - DNA, 657 bp, Sorghum bicolor
  Clone ID: 30968242
cacatagctagaacacgagcagcaaattaaggcaaccaattaaagatggctaggccgtcggcaagcagcaaggcgtcgtcgtcgtcgctggtgatcctcgcgatcgtcgtcgccgccgcgtccctcgcgcagcccggcgcggccgacctgaagctgaactactacgcgagcacctgccccaacgtggagaccatcgtgcgcggcgcggtgcagcagagggtgcaggccaccatccgcaccgtcggctccaccgtccgcctcttcttccacgactgcttcgtcgagggctgcgacgcctcggtgctcatcgactccacgcccggcaaccaggccgagaaggacgcctccgacaacaagtccctcgcgcccgaaggcttcgacaccgtgcgcagcgccaaggccgccgtcgaggccgcctgccctggcacggtctcctgcgccgacgtgctcgccctcgccactcgggacgccatctccatgagtggcgggcctttcttccaagtggagctgggcaggctggacggcctgagctccagggccagcagcgtgccaggccagctgcccgagccgaaccagaccatggaccagctgctggcggtcttcaaggcacacgggctcgacatgtccgacctcgtcgcgctctcagcggcgcacagc

SEQ ID NO: 25944 - DNA, 674 bp, Sorghum bicolor
  Clone ID: 30968245
tactggaatagaggggctgcaggggatacccctggaagcagccgcaattttcttccaggctggtcacctcacgactcctctccttgcgactccacttctctggtcttccctcttccactgttggtcttcaccatgagctccgacgacggtaagcttttcccctttccatcttcttccctcctcccctcatctctcactctagatgcttgctgtcattatgatgtccctctcctggtggttttcggtgctctcctccccccatcttttcctagtgcttgtgatgtccctctgcttctgtaatctgtagatgtggatcgacgatgtgcaaacgtggaagtgataatgcctgtgcctgaccttgaagaagttcaaccacaaccagaatctgttgggtcaggtgctgctactgttgcctcagcctcatctgctatagatatcccctccctaattgagagggccatagcaaaactacctccagaccttgctgctcaagctgttgacaaaaagaggaaggcaagaagtcaagatccaggatggcagtatgggtggtggccagatccttccaagaaagattttgtgcaatgcattttttgtaagaaggtagtcccttctggaataagtaggtttaagcaacaccttgctgggggggtttggagatgctattggttgtcctc

SEQ ID NO: 25945 - DNA, 656 bp, Sorghum bicolor
  Clone ID: 30968246
gcggatgtgagagcgagcgagcgagatccctccctccgccgctctctcccccactcttcctctccattcaatcattcctccgtccgccgcaccgcacccccactcttcctcctcctcctctgctccgccccccgcctgcctcttcttcaccctgcgtcgtcctccgattgccgacggatccctcctcgccaccgccgtcgcggacccaccggggtgacaggagaggagaggagaggagaggagggaagggcacggggaggcgggagcgatggaggccgccgccgccgccgccgtcgccgactacgggaagctcttcgtcggcggcatctcgtgggagacgagcgaggaccgcctccgcgactacttcggccgcttcggggaggtcaccgaggccgtcatcatgcgggaccgcagcacgggccgcgcccgcggcttcggcttcgtcgtcttcgctggccctgccgtcgccgagcgcgtcaccatggacaagcacatgatcgacgggcgaatggtggaggcgaagaaggcggttcccagggacgaccacagcatcgtgagcaagagcaacgcgagcagcatagggtcgccggggccgggacgcaccaggaagatctttgtcggaggcctgccctcgaacgtcaccgaggcggacttca

SEQ ID NO: 25946 - DNA, 672 bp, Sorghum bicolor
  Clone ID: 30968250
tactggttgtacagcactgctcagcaacatacctgatgtgtcttcttatgctgacatacctcaaaagatcgcagatctgcaaaagcaagcattgacaaatttgaacaaagttggtgaggtaacatcaaggttgaaagaattagaggttgcactagaatttgctgatctcagcaagcaacgtgcagaaggtgaagccacccttgctaaagagagggctgaaactgctactagggaggtcaagcgccttgagcttatgcttgctgcaatcagtgaagaaagagataagctgagaaaggaacatcctacagagtcggatcagtctgggatggaaaaaacaataagagagctggagagcattatacacgagctgaaagaactgattagtcacaaggacactgaactcaatataatgaatgaaagattaagccttgaaacaaggaaagtgaagtctttggagagagagggagatcagctacgctctcaggtggccttactagagtccaagttaggtcatggagattactctgcctcgagcacaaaagtactgcgcatggtaaatactcttggagtcgacaatgaagccaagcagacaatagaagcactacaagctgaactaaagaaaacaaaagagaggctgcaggcagttgaggaactgaaaggacaagctgatgc

SEQ ID NO: 25947 - DNA, 664 bp, Sorghum bicolor
  Clone ID: 30968256
aattccgtcactcggccggcaatcgcgcgagactcacagaggcgtcgtcgtcgtctccaagcagtccccaccagtcccccccactccccaccgcgccgcacttggttggtcgcgcgaacaccgcgagcggcgaccctaatcgacgaccgatccccactgcaactaagtatgcaaggagaaggtacttcaaggatgtcacagacacctagaagaacagcatcaagtcacaacattaaggcccatactagcacgcacgtcttcgagatcgatgactatagtcaaaagaaggagacaaatgttggtgaattcataaggtcatccaccttcactgttggtggcttcgattggtccatccgcttctaccccaatggcattgatgaaaacagtaaggatgacatcattgtcttcttggagttgatgagtagcgatgtcaagctgagggcgcactacaacattcaattcattggagaggatgatggtgcgaagaaggacagcatgatatcatggtattcgacaggaggaatgcatctgttcaagtcgaaaggaggtgaatatagaccaagacacatggggtacttgatgagggacagtttggaggaggagtttgtcaaaaataaccacctaaccattcaatgtgacctcactgtgatacgactatacagct

SEQ ID NO: 25948 - DNA, 662 bp, Sorghum bicolor
  Clone ID: 30968257
acttctttgatcccatatatacatacacacagtgactctgatccggcacacagaagacgacgacgacgtccattgataccatagctagtgcttgcttatttgtatcgatacagaagaatctatctgctagcatctccatcagtcgtagcagcagagatcgttgcgtcatgggttcttgggtgcgaaccatcacgtcgcccttcaggaagatgctgaacccgcagcgtgacggcaagaagacgccgcgccaccatcgccaccaccaccaacaacgacaccaacaacaatctccttctccttcttcatcagccatggagcacagcggcgagatggagaggtcgcagctctacggcgaggtgatggcgtgcacgtacgaggacgtgcaggtcatgtggtccatgctcgacaaggccaggatctgcagcgccgccgcctcgtgactgccacgcacaaaccttcaaacccatccatcccatccgattccgatccgtccgtgcccgtccatggcgacgaggcggcgagacgggatcgatccgggcaatccaccagtatatatactccaacgcagccatattattcttcattgcaaagcaaaagctcttggcgagacaactgcagctatatatgtatatatgcatgcagatcgatcgactgccgaggcg

SEQ ID NO: 25949 - DNA, 598 bp, Sorghum bicolor
  Clone ID: 30968265
gttgcggttgtgaataccaagttccctgagattgggcggttgcttcttgttcgtgttgtgctccagctcaagagggcatataagcgaaatgacaagcctcaattgcttgcggcaaccaaattcattgcgcacttggtaaatcaggtggtggcacatgagcttgtggcgctggagcttcttactgtactcctggaaaatccaactgatgatagtgttgaggtcgctgtggggtttgtcaaagagtgtggggcaatgctgcaggacttgtctcctcaagggcttcatgctatttttgaaagatttcgaggcattctacatgaaggagaaatagacaagagagtgcagtttcttattgaaggcctttttgcaattagaaaggctaaattccagggtttcccagccatccgtccagagctggatctagtggagcaggaggaccagtttacacatgagatatcccttgaagatgacctagaccctgagaccaatctaaatgttttcagggcaaaccccaattttgttgaagatgagaaggcatatgagaatctaaagagaagcatcctgggagcagagtcttctgaagatgaagaaggatcag

SEQ ID NO: 25950 - DNA, 545 bp, Sorghum bicolor
  Clone ID: 30968270
cgcgttcgctcgcgcggtctccgctcggccgctgccatcctcgattcctcgctcgcagtagctgtgcatcgcgtcgcgtctcggcgccgacggatccgcccctgcgtgcgctcggtgtcccgtgctccaccaccacccccacacaccccaatcgccgtccggccgcccgccgccgcaccctgctagggtttcggccaggcccccggacccgccgccgccggtggattcgcgtctccggccgcggtgcctcgagccgcacgggcaacctcggacctgatacgctcgctgcacttctgcaatccgaaggactcggactgcagcacgcacaattcttcttcagtctgctggactgcagccacgcacaaaccgtagctgatgccaaggagaacaggaaatgctacttcgaccaaatcagttgaattgatcaaacaagaccaattggagtttgatgatcctgatgaggtagatgaggaggaagaagttgagtatgaagaaattgaggaggaggttgagtatgaagaggtagaggatgaagatgataacga

SEQ ID NO: 25951 - DNA, 662 bp, Sorghum bicolor
  unsure (1)..(662): unsure at all n locations
  Clone ID: 30968276
acaaaaccgccaccagtctggttcttctgattccattgcaatcattcttctccaccccagtgaatttttgttgcgatccctagcaatccccgtctcgctcacagaatccctagcaatccccgtctcgctcgatggggtcggcgacgggcacctgcgagatcgcgcgcctcccggaggacctcctctcggcggcgctcgccctcaccacgccgcgagacgcctgccgcgccgctgccgtctcccgcgccttccgcgacgccgccggatcctatgccgtatggacccgcttcgtcccccgggacctcccgccgatcgctgacggggagctcgccggccccgcgccgccgtccaagaaggagcggttccttcgcctctccgaccgccgttgccccgtcttacttgccgatggcctcaggatacagccggttcccaaaaatcctctactggcctatggcctcaagagcatgtggttggacagggggagcggcgccaagtgctacatgctgctagagcggggcctgcacatctcgtggggctgcacgccatgctactggcactggatgaatctccctgactccaggtttgaagttgctgaactcatgtcggttcgctggtttgaaatacgtggcaagatacacagcanaatgctttctcgagacaca

SEQ ID NO: 25952 - DNA, 512 bp, Sorghum bicolor
  Clone ID: 30968278
tggcaccttacctgttcggtttttctccccacgctaaccttcaaccaccaaggaccgaagccacaccacaccagccgtcctcgcgatctctccgtctcccatccctcaccgcgctcttctccgcgcgcctccccgccggattcggaggcgactcgcggggccggtgcccaggctgctggcggcggcatccgcggtggcgggctaccatggaggatctgggcatcgaggcgaaggaggccgcggtgcgcgaggtggcgaagctgctcccgctcccggagctcctgtcctctatcgcctccatcaaatccgactacctcgcgcggcagcagacaaatgatgcacaactcagtacaatggtggcagaacaggtcgagcaagcccatgatggcatcaatgctctagcattatctcaagaaacaataaacaaactacgtgagaacttcattgatatagacaagttgtgtcaggagtgtcaaactttaattgagaaccatgacaagatcaagcttctt

SEQ ID NO: 25953 - DNA, 620 bp, Sorghum bicolor
  Clone ID: 30968284
agctttcattcttctgaacggattagccaagcaaggtcaaagtagcagatcaagctagctgtcatggagatggagcagggcggcaagacggcccacgggtgggctgccagggatgcctccggccacctctccccttacagcttctcagcaagggttcagggggacggcgacgtgacgatcaaggtgctcttctgcggcatctgccacacggacctccacgtcatcaagaacgagtggggcaacgccatgtaccccgtcgtcccagggcacgaggtcgtcggcgtcgtcacggacgtcggccatggcgtcaccaagttcaaggctggggacacggtgggcgtgggctacttcgtcgactcctgccggacctgcgagagctgcagcacggggcacgagaactactgccccgaccttgtcctcacctccaacggcgtggaccaccaccaccacggcgccaccaccaagggaggcttctccgacgtgctcgtcgtcagccaggacttcgtcgtccgcgtcccggagagcctccctctcgacggcgccgcgccgctgctctgcgccggggtcaccgtgtacagccccatggcgcagtacgcgctcaacgagcccggcaagcacct

SEQ ID NO: 25954 - DNA, 670 bp, Sorghum bicolor
  Clone ID: 30968289
ggcctatttgagaaaggtgtcttccactgtatagcctttaagtttatcattttcatcattacaactgtaccttctttttcattgttgtgtttggtgtacactatcagaatgtttttttcttgcattagtttcatggcactcatttggtttaataaaaaaacaagattatggggatataaaataggcttttactttagtttattttagttttgttccataacttatgttatattccacagagatatttgcatagcatgtgttcattctttgtcatatatataatctgaaactcggtatgagtcatacagggttcaccaatagttacaccttcatctttggagtaggtaccccttattttgggtgcagatggttaatttgagcacactgttaaaaattagaggcatggcaaatggcaacaaccacgaatttcatttggtttgtgtcagctttgaatgacaggcacctgtttggacaaagtgtcaaagcatcggtacttctgtataacatggctagactgcttgtgtatttgtatcttcagttacaatgtgttgagtcgctaaatttaaccaagttatagtttcaaaggatgtacaaattagactttgagaaagaccgtaagttttaggatttactaattagattttgatgtaaacagggtttcacaatgcaa

SEQ ID NO: 25955 - DNA, 635 bp, Sorghum bicolor
  unsure (1)..(635): unsure at all n locations
  Clone ID: 30968299
tggacagccaccacctcctctccatactctctctctttctccctcgccgccggccgcctccgcttcccgccacgcgccacttccgcgacaaaaccatcagagaagagagaggactcgctcatctcgtccgatggaggaggactcgctcacggggatgatctccgccatatcctgggtgcccaggggcgccgccaagagcatgcccgtcgtcgccgacccgcccacgcaggaggagatcgccgaggccatgaagaccttcgccctgggcggaggccccgggagcgacgctgtcgaggacgatgatgctggcaccatggaactcgatggtgcgacagaggtggaggaggttgatgaggctgcccgggccaaggccgtagccaaggcgcttggcaagggctccagtaaggttgacgacgttgctgatgggctccgcgagctcaacatggatgcttacgatgatgaggacgaagagattgatgttatcggctccggtttgggggacttgtactatccggacaacggaatggacccctatctcaagaagaacaatgaggaggaggaggatgacgacgacnactactattcggacattgaagataagatgatcatgcctactgattttgttattgtctgcg

SEQ ID NO: 25956 - DNA, 659 bp, Sorghum bicolor
  Clone ID: 30968310
tgactgtcatcctgtgggggtgggcgggcttgggggaagagagagagagagaaggggaggcgtcttccggttgggcagggcaggggctccctccgctctcgattctttccaagattgaggagttcaatcatcgccgccatcatcaccgagcaagcagcatggcagcattagcagatggagatgcggcttattcttctttggatagtgacgatgagtacgagaaatttattcaaaagatgaaccctccaagggtcactattgacaacacctcatgtccaaatgctacagttattcatgtggacagcgccaacaagtatggggtactgttggaggtagtgcaggtcctcactgacctcaaactcatagtcaagaaagcatacatatcctcagacggaggatggttcatggatgtcttcaatgtgacgaaccaaggtgggcacaagataatggacgaatctgtgctagaaggtataaaagattgcatttacaagtctatcgggcctgattcttgctttcttccctcgcggaggagagccattggagtggagccttcctccgactacaccttgatagagctaactgggaccgatagacccggtcttctctctgaagtgagcgctgtgctcacaaatctggagtgcaatgtggtgaatgcggag

SEQ ID NO: 25957 - DNA, 510 bp, Sorghum bicolor
  Clone ID: 30968345
cccaccggagggcctcgacgcccgcgccgactccaccttggacgccttcatcagcaagttctacgagaccctccgcctgcagcaggccgacgccacccccgacaaccgcgcgcgccgccgcggctagctggctggctggccagctcgtaccgacgacgaacgcctggctgccgcgccgtgcatgggcgcggattcccaagcacggggggacctatataaataatatatactcctgctactgtcaatcactgtcatgcgggcccgggagttttactgctggcctgcatgtgtaatttcttcttctttttttttttactttcctcgtccgtgataatcgatctcgaatatatagggtcggtcggtgaggagacgagatcatcagttgagataaaaacaagggagggctacctatatggctgatgctgcagcagcatagctagcccaaacctgtgtgtatctgtcaatgtcatatactatctgtcttgatatgcatatgatcagatgaaatgg

SEQ ID NO: 25958 - DNA, 223 bp, Sorghum bicolor
  Clone ID: 30968387
gttgaaaaggggcaggagcaaaagcaagaacaatcggcgcaaaataaagtggaggcagaggaggaagatagcgaatcttgctcgagttccgatgaagatgattcgtggcacgaggttgatcccaagatgggccccgaggaaaggaaggctgctcggaaggcaatccagaagaaagtgaaggaagagaagagggaggctcgcaagaccaagatcccaaaggccg

SEQ ID NO: 25959 - DNA, 585 bp, Sorghum bicolor
  Clone ID: 30968437
gtaccctgcacctgccatttccccccgttcccctccgtgcgccgccgccacgccacgcccagcagacagcgcagccatgccgctccacctgctctcgtccccggccgccgccgccaagctcgccgcaggcctgcgcgcggcgcctctccgccgctgccacagcttcgccccggcgccgcgccacacggaccgcgtggccctggcgtcgtccctctcggtggcggcgcggtctgcaagccccgccgtggctgcggcgcagaccgagctcagcgtttcaggaaagaaacaagtattgatatcgttgtcggataaaacggacttggcttatcttggcaacggtcttcagggtttggggtattccatcgtctccaccggtggaacagcatccagcctggaagcagcaggagtcagtgtaacaaaagttgaagaaatcacacatttccctgaaatgcttgatggacgagtgaaaacattgcatccaagtatacatggtggtattcttgccaggagagaccaggagcatcatttgaaggcactgaaggatcatggaattgggacatttgatgtggttgtggtgaatttgta

SEQ ID NO: 25960 - DNA, 438 bp, Sorghum bicolor
  Clone ID: 30968456
gcagagcagagccctcccatctctttccctctttcttcctctgatctccaaagcgatcgaagggtaggtcacgtgagaagatcgatccatcatccattgctagctgactgactcgatccatccatcgctcctcagtgatcgatcgacgacacaacgaccccagacagacacaaccagatcatggcggtggagcccgacagcggcagccgggcggtcgtccagcccgccgctgcggcccgcggcggcggcggaagcatggagcccgggctcgggaagcgcctcatgacggtgctccgcgccgtctaccacatgctgcgccggggcctctgccgcaagcgcctcatgatggacctccacctcctgctcggcaggggcaagctcgccggcaaggcgctccgcgacctcctcgccgccgcgcaccactcccactcccaccac

SEQ ID NO: 25961 - DNA, 647 bp, Sorghum bicolor
  Clone ID: 30968492
ctgccactcagccacaaagttgatttccaaggtgtacaatagagagattgttgttcgagaccggaatagatttcatcatttcaaggatggtacttgctcctgcaatgattactggtgataccagttctctgtctattagatgaggatggacatcaggcccacctacccaatttgaggggagtggaagacagattgacatagtaacatgtaaatacaagatggcattttagcgtttctggaaagaaaacctccaccttcatcaggttcttcaattgtagaccaatgagagatatgatttcagaagggtgaatgctctcggaattttctttctaatatctggtcaggcacacactgtaggtaaatagcaaccatgtgccaatatttaatggagtttaggttgttcagagaatgatgtgcaataatggattaagatcagacgtgtatgcacgactgcgtcttcttgacactatatttgcagtggccacgtcttcttgacactatattctgtgttttgttttttgcggttggtctaggaaagcaaggacacagttggttttttttcctagaaggagcagacttttatttggtaataaactcattttgagccattgtaatttcctcttagacaatatcttttcaatgatttg

SEQ ID NO: 25962 - DNA, 537 bp, Sorghum bicolor
  Clone ID: 30968493
catggctttacatactcgggccatccagtttcttgtgctgttgctgtggaaaccttgaagatatataaggaaaggaatattatagaacatgttaacaaaattgctccaaggttccaagagggaatcaaggccttctcaggaagcccaattgttggggagatacgtggtgtgggactgatacttggaactgagtttgttgacaacaaatctccaaatgatccattcccagctgaatggggtgttggttcgatctttggtgctgagtgtgagaagcgtgggatgctcatcagggtggctggggacagcatcatgctgtcacccccactgatcatgactcccaatgaagttgaagaaatcataagcaaattcggtgatgccctgaaggccacagaggaaaggattggagaactgaaatccaggaagaattagccaatgctgctggttgtaacgttggtgaggatgatgacaccaatgttcagcatacagtgtaatttcaaactttatttcaataaagtgctggaaccaactgttcctgtt

SEQ ID NO: 25963 - DNA, 401 bp, Sorghum bicolor
  Clone ID: 30968502
tcaggaagctggtgccagcgccggccaagttcatccatggtgacgtcgccgtcgacggcaaagcgcagacacaagggcgtcctcggcggcggcgtccaggcctcctatgcgggcttgccggccggacgcaccaccatgcagaaatgtgaatacagaagaattactgtcatggacccaggatcagatgggcgcctgcttcaacaatggcaaataaggaagtgatgatgtgcaaatttgtgatatactaggtcttatgctcgtcaaagttatgtatgatcaatcattcccttgcctccattgtggtgaacatttgctcaatcttttgttccgttcgcagactgaaactcatgttcaaatatatgtaagcttatagcgctatgaccttgagatgtcatagcttc

SEQ ID NO: 25964 - DNA, 512 bp, Sorghum bicolor
  Clone ID: 30968505
cgaggtccgcgagggggagatgctcttcggctaccagcccatggccaccaaggacccgcgcgtcttcgcgcgcgccgaggagtacgtgccggacaggttcctcggcgaggatggcgcgcagctgcttcgacacgtcgtctggtccaacgggcccgagacggtgtcgcccacgctgcaggacaagcagtgcgccggcaaggacttcgtcgtgctcatcgcgcgcctcctcgtcgccgagctcttcctccgctacgactccttcgacgtccaggtcggcgcctccgcgctggggtcgtcggtgaccatcacctcgctcaagaaagccaccttctgagctctgaatctctgatcgatcgcccgtcaaagtcgctggaggcgggcacgtgcactacccttttttttttttcctttaccgtaggatatactgcgttgtccatgtctgtctgccccacccccaaatccttcctttttcctagtgccgtgatactgtgtgatcgtcagctataacaaaa

SEQ ID NO: 25965 - DNA, 665 bp, Sorghum bicolor
  Clone ID: 30968527
gttgccagatccccttacgtttagctttaagcttgctaagaatggaactgtgatcaatgatgattcttcaaaggattttggcagtgttctgaggtgcaaagatcctatatctgctcatgaaatgacccatatggaagttcaaattcgcaacaacacaaaggaaattattcagatgaaccttagcatttcatgcaaagatgttgcaggagagaattgcttcgatgaaaatagtgcaactgtcctctgggctggtgttcttagcgatatacacctggaagttccaccgttgcaagaggtgatacatcctttttccatgtacttcctcgtaccaggtgactactcgctccaagctgcttctgttataatcgacgccacagatgttctccgtgctcgcgcaaaggcagagtcaccagatgaacctatactgtgtcgcggatccccgttccatatccgggtagtcggtacagcataggcagcttcttctgagttagtttagaggcctcattttgtaccgtgacaattgtaggtgtgaaaaatcttgtacaagagtgttccctggcgacctgccccccgtgcgattttttttttagcctttttgtaggcttccttgtaacagtcatgtcatgtacagtgtacaagcatagtgagtatttttcaagcaccgg

SEQ ID NO: 25966 - DNA, 176 bp, Sorghum bicolor
  Clone ID: 30968530
gtctccaggagacgcgcggccggacgctggaggagatgggagagctgttcggcacaattgacgcgggcaccgaagcagatgacgcttccgcgagactcctttcgtcagagttgaccacatgatactgtttttgcgctttggtttgtctgcacgtaagtgtgcaattatatgtggta

SEQ ID NO: 25967 - DNA, 563 bp, Sorghum bicolor
  Clone ID: 30968539
tgacgacgacgatgctgatggaaagagctctgtcagaagccagtccgttaagaagaggaagacttccagctctggatgggcctacactggccacgagtacaccagcaagagggccagtggtgatctgaagaagaaagacaagatggaaccttttgcatactggccgatggatcggaagcttctcaaccgcaggtcggaccgcaaggcgtctgcgcgcaagggcatgtccagtgtcatgaagatcaccaaggggcttcaagggaagagtgcaagtgctgcgctttctgctaatcggtcgggaaaaatgaagcacaaaaagaacaaataactgggggtagtggtgattggtgacgaagctttggaggagccgaccagacgatgttgtggggaaaattttgatctgtacagtgccaggatgcagaactcagaagctcgacacttgggtttctcgagctgtgttttggtcttctcggattagtcatgtattagaagctcgacacttgggagttgtattagattggatcgttctgtttgtatgatggctagtaaatcattattttttt

SEQ ID NO: 25968 - DNA, 632 bp, Sorghum bicolor
  Clone ID: 30968558
tgtcgtggcggccgtcgggggctcctggaactggaaggaaggagacccggtcagccggcccctcgtccggagaaacctctctcctccgggatctcatgtcgcctcccttcacctcctagtccccggtggatgtggatccataccgtgtcctaaccccaccacgcagcgcgagggagcaaaggagccatggcggcggcccagcatcgtcaggcgtggtggccggggcggatggcggcggcgttcgggccctccttcctctgcctcgtctgcctcatctacttcatccagggtttcaggtctttcgtctggacagctgtctcctaccaaatgaaggacgtgatgaagctatcaccctccacatcacagtttcttgtctcccttgcatatttcccttggagcattaaacctatatatgggatcttgtcagactgcattccaattaagcagaggaagcgtataccctatttgatcatttctagctgcctttctctacttccgtggcttatccttggactatcacaaagtttaaggagctcagccaatatgctaactgccttgctcgtagtacagaatctgggatctgcaatggcagatgttgttatagatgcaatggttgcggaagcagttcgatc

SEQ ID NO: 25969 - DNA, 653 bp, Sorghum bicolor
  Clone ID: 30968563
ttttgaaggatcatctacggttagaaagagagaagttattagttcattcatcactgaaatacttcttgcattgaaggaggccaacaagaaaaccagaaacagagcttatgatttgcttattgaaattgcccgtgcatgtgaaaatgctggaaatgacgagaggaaggagggcttgcaccagttctttggcatggttgctggtggtatagtggctggtcaaacgccatatgcaattagtgccgttgtaactgggttggctcggttgacttatgaattctcagagcttattggagtcgcttacaagctccttcctcagactttcttgcttatgcaaaggaacaaccgagaaatagtcaaagcgaacttaggttttgtcaaagctttagtggctaaatctaaagccgacatgctgcatgaacacttgagtggagttgttgaaggcctgttaagctcgcaaagtgatacaaagaattcctttaaagctaaggtcaagtcactcatagaaattcttgtgaagaaatgtggtttagatgctgtgaaagctgtgatgcctgaagagcatatgaaattgctcacgaatattaggaagattaatgagcgaaaaatgcggaagacaaaatcttctgaggatggggatgccatgtctatggcct

SEQ ID NO: 25970 - DNA, 486 bp, Sorghum bicolor
  Clone ID: 30968574
cggtccgctccaccgcgtgccatcggtgaaaaaggaaactcccgaacccacctcatcccgtccccgagcgtctccatcaccgccatccgcgctcccttccatcctccctcgccgccgctacctgcgctcccctccatcgtcccccgccgccgccagccccggccctcgtgactcctccaacgatggcggccacgatccccgtcgccgcctcaatccctaccgcagttgcgccatcacccgctcgatctccgttggccgcgccccgcgccgcgagctcggtgcccgcggcgcgctccgcccaccgcgagctgcggcgagctgcgggatatactggagggagttcgaaaaggacggcgaaggcggcggcggcagagggaggaagcctacggggagcaggcgcccgccgcagccgcctccgcccaggcagcagcaacaggagcaggagcagcagcactggcgcgcggagatgtggaccgagccccagca

SEQ ID NO: 25971 - DNA, 630 bp, Sorghum bicolor
  Clone ID: 30968596
aaagtaacccaaggcaactcgaatggccaccgccgtccccacggcggctctccccacaccggccggcgccgggccggcgccgccgcatgctccacttcgcacagatccccgctacttgccacagctccacgcggcactaatcaagtccggggagctcactggctcgcccaaatgcttccactccctcctcgaggcggccgccgcctctccaacgctgctcccctacgcggtcagcctgttccgtttgggcccgcggccgcccctttccacgccgtgctacaacgtccttatgcgggctttgcttcacgcgggccacccggaggacgccctgcacctgttcgtcgaaatgctcgacgtggcctcggtctgccctgaccagcacaccgtcgcctgcgccctaaagtcatgctccaggatgtgcacgctggatgtggggcgcggcatccaggcgtacgccgtgaagcgtgggctcatggctgatcggttcgttctgagcagcttgattcatatgtacgcgagctgtagggatgttgcagcggcacagcttctgtttgatgcggtggaggagaatggcgtggtgatgtggaatgcaatcatcacggcgtacatgaagaacggaaattggatgga

SEQ ID NO: 25972 - DNA, 680 bp, Sorghum bicolor
  Clone ID: 30968597
aagagcccgtgaactgagtgaagtggagtgaggaggttggcggaaccggaaccccgggccccggcgagacgagatgatcgcacaaggcctccgcagatccagtgccgcctcctcccaggttagcaggctggtgaaatacattgctagtgctggaaggttgcaagggggacatagtttttcagagtcacctgccagatgttacagttctgaaccttcacttcaggcgacagaagaaaatgggtttaaggggcatagcatgctggctccattcacagcaggatggcagagcactgatttacatccattggttatagagagatcagagggttcttacgtttatgacatcaatgggaagaagtatatagatgctcttgcaggactgtggtgtacagctttaggtggtaatgagcctcgactagtcaaagcagcaactgagcaattacacaaattaccgttctaccattccttttggaaccgtacaaccaaaccctcattggaccttgcaaatgaaattctcagcatgttcactgcaagggaaatgggaaaggtgttcttcacaaatagtggttcagaagcaaatgactcccaggttaaactagtgtggtattataacaatgcactgggaaggccagacaagaagaaatttattgctcgctcaaaatcgtatcatgggtcaacct

SEQ ID NO: 25973 - DNA, 647 bp, Sorghum bicolor
  Clone ID: 30968598
acagagacacttcgctgcctcctgttaatcttccctccttgcctagctagcttcgaaagccgcgtaccccgtacgtgcaggaattgccaagaagaaggaaggaaccaagcatgtcgaagcttgctgtgctagtccccgccgtggtcgcggtgatcgtgctgtgcgcgtgcacgacgccggcgcgcggcggcgacgactatacggcgttcgtgtacgccgggtgctcgcaggggcggtacgaccccggttcgcagtacgccgcggacgtggacaccgcgctctcctccctcgtgaacagcgcaggcttcaccgcctacggcaactacacctcgccgccgtcgtcgtcgacgggccagctggccggtgtgtaccagtgccgctccgacctccccgccgcggtgtgcggcgtctgcgtgaagtcggccgtgtccaagctctcctcgctctgcaacacggcggcgggcgccgccgtgcagctgcgcgcctgcttcgtccggtacgggaacgactcgttcctggggaagcaggacacgacggtgctgttcaagaagtgcggaggcgacagcggcggcggggacacgggcgtggtggccatgcgcgacgcggcgctgggcgcgctcgtggccgccgccgcggcgcccgccgac

SEQ ID NO: 25974 - DNA, 651 bp, Sorghum bicolor
  Clone ID: 30968633
tgttggcctctggcctggtattccacaaaagtcggacaaatatcaattcctgggtgcattgttcattgctttggtgttattacagaacacctattcaaagaggttggttgtttgctccttggagctgcacaagggcttgtcctttctgatcctttcagatgctgtggctctagcaagtttaagagtgtcaactttcctagcatttctgttgttcctcctctgccattgttagttgccaatgttgtgggtggagatggttctattcttctttatgaaggagaaattcgtgatgttctgataacactgacaaatgccggaaccgtacctgctgaagaagcaaatgttgccttgtcagggaagaatcacgattctgttatttcgattgcccatagcacatggaaatctgcgctacctattaaaccaagtggagaagtgacatttgcagtaactctaagagcctggcatctcagctcatcagatttggaaacagatggcagtagatctcctgcaaattcaaggagaatagcaagagaaggaatcaatccattcttggatattcactatgctggtcctgctgcgaatcttgaaaacggagacgtttcacttccacctggaagacgcctggttgttcccttgaatatctgagttgtg

SEQ ID NO: 25975 - DNA, 519 bp, Sorghum bicolor
  Clone ID: 30968636
cagactttcctctcacagatggagcactactactgctaatcgcactataccatcagtagtactaccattttctgatactgcagcacttcaagcagaaagcaaggagctaggtgccagcgatggcttcggcggagctcccggaggtcgtcgagcgcaagaagaagagcaacgtcatgtatgccttcatgtgctccatcctcgcctccatggcctccatcatccttggctacgacattggggtgatgagcggcgcggcgctctacatcaagaaggacctcaagatcactgacgtgcagctggagatcttgatgggcatcctcaatttctactcgctcatcggctccttcgcggcggggcggacgtccgactggatcggccgccggttcaccgtcgtcgtcgcggccgcgtttttcttcgtcggcgccttgctcatgggcctcgccggcggctacgccacgctgatgttcggccgcttcatggccggcgtcggcgtgggctacgggctgatgatcgcgccgg

SEQ ID NO: 25976 - DNA, 599 bp, Sorghum bicolor
  Clone ID: 30968646
taagcaaattttgaccgcgaaccccgacataaacattattgagttatgtgatgacgacgaattcatggttttggcatgtgatggcatttgggactgcatgtcaagccaacagttggttgatttcatccgtgagcatataaacacagaggaaagcctttctgcagtatgtgaacgagtgcttgatagatgcctggctccatcaaccatgggcggcgagggatgtgataacatgaccatgatcctggtgcagttcaagaagctgactgctcagcacaaggacgccagtggtgcacaacaaccagctggagacgcgggatgctccgagacccatggggccgaggagaacggatctggtaagcaggtatagcaaagacgtggccgttggagtcttggtacatggcctgacgctggacttgggtaaaaacaggagtatgatgacgatattgcgatgtacatacaaccgagtgccgaattggcgtaaaggattattctttgttccattgttgtctgtaacccaatctgctggtttcttccggttgtgattttttgccatctgacaacacctaattgtacatttggggtgcaaatgatgttacaat

SEQ ID NO: 25977 - DNA, 559 bp, Sorghum bicolor
  Clone ID: 30968703
ctacagtggttgtaaatactaatctatagtcagtcaagaggatacagtaaagttgatgacaatatttggtactatttgcatctacaacaagatgcattttttgttttaatgcttcatctgaactgtttgttttatatgcattttttagacttgctttctctgttagtgtgtctattttgtcctctatgtgttagtgtagtaacttttgatagcaaaagacaaggacaagtttgaggggttgtggaggtccctcttcttctttacattaccatcagaatgatggttgggatcagacgatggaagctgctgcactaaaatccagggtggtgtatgcaaagtaccatctcatcaggttcaaggagcaaagaggaaggatttgagagcaccacgaatgcttacaactcaccccattagccatgggcttgcttatgccacaaagagcactcatatgtgtaagtatatcaagcgctatgtttcagcttaggaaaccttaatggttgcaaaatatgttgtaacacaatctcatacacaaaaacatctaaagaaaagcatagctggc

SEQ ID NO: 25978 - DNA, 673 bp, Sorghum bicolor
  Clone ID: 30968720
aaacccgtctctcccgaaaatccatcccgcctccttccccttgacggctaccctccgctccgatccgatctctccggcatggccgccgccgccacgccgtcgcagcgcgcggacctgatgccgccgcagcagcccgtaccgccgccgactgcgccccgtccgcgccgccgcggaagggaagtcagttcccggtacctctcaacgcccgtcccttcgaccccgcgcctctccaccgcctccgcggcctcctccacgcggtcgcgctccccgacgccgtcgcctcgtggacggcagcgggcggccacgcccttcgccaacgagaaccacccgccgccgcctcctacgggcaccgtcgcgcgccggcgggccgtccagaagcttttcgatgagacgggcgccggcaacccgcgtgcctcggtggtcgccaactcctctgcctccaccgtcccagcaccaactccgcggccgctcccgcgctccaccagccggccggccgcgcccaccgcgcggagagggtacccgcgccttccgacgcccgcgcgtgctggctcctcctgccctccctccgccgcggtggaatccgacgccgcctcgtgctgctcttcgtctgatacgtcgtccacggccactgagttctctgaggccgatgtggcgctcgggatggccccagccg

SEQ ID NO: 25979 - DNA, 653 bp, Sorghum bicolor
  Clone ID: 30968729
atcccactttcccgcaacactcgagtggaagtagttcgtcctcggcgatttcaccggcaacctcgccgacgttgccgctccggtgcgccctgtctcgtctccccacttccttccctcgcttcgtcggtcgtcgtctgccccagagagtaggagccgcctcgtccctcccggccccgtccgcgccccccgatcccgtctgtcaccatgaatcccgagtaatgtggacactgcaagaagcttgctccacagggctctggaatgaagctcaaggacataccctatggcttctgacggcaccaggaactcccctattcccatctgtataagttgagtccaaaaggtccccggtgagccaagctggaacgccgaagacccgtccaactaccttaaaatctaggctttagcaatgatagtggtatctttgcaatgaagaatcttgagctttgggacctaaatgtcaatttggtggacaagttttgtgaagatgatgttgaccatcttcgtatcaagtacgtcaatgacatgattttcaatgaattcaattgttctgatgttggtcgatcaaaagtcatggaatatgatgccgaggtaatactagttgcaatgtcacttttttgtgtactgttccatcatgtactcaattgatagttgat

SEQ ID NO: 25980 - DNA, 679 bp, Sorghum bicolor
  unsure (1)..(679): unsure at all n locations
  Clone ID: 30968749
cgttcacatcacacctctctgtctctttggcttcatttcctgctgacgactgagcgggcgagcgccggcgccctttgccaggtcttcgtcggcccgttcgccggcgactagcgtctccctttgccaggtctcgacgcccccttcgccgtcgactggcacccagcaggtacatttggaagaatgggggtttaccttagcactccgaaaaccgagaaggtatcggaagatggggaaaatgataaacttaaattcggactttcttctatgcaagggtggcgtgcaactatggaagatgctcactcggctttgctagatcttgacaatgacactgcattctttggtgtttttgatggacatggaggaaaagtagttgccaaattctgtgcaaaatatctacacagagaagttctccatagtgaggcctatgcagctggtgacctgggtgctgctgtccacagagcttacttcagaatggatgaaatgatgcggggtcaaagaggatggcgggaactccaagcacttggagataagataaatcagtttactggcataatagaagggttgatttggtcccctaaagcaagtgattcanatgatagacatgatgattgggctttcgaggagggaccacactctgattttactgggccaaattgtgggagtacagcctgtgtagcat

SEQ ID NO: 25981 - DNA, 654 bp, Sorghum bicolor
  Clone ID: 30968832
atagaggccatgctagcgctccaacgagctcaagttgggcagcgcaaattgcgcaaacgagtgcgcaaacatcgcaaggcttttatggatgcacaagctgaaatccaaaactatcacaccgctttgcaagcccgccgcaatcaagttgcgaatgcagttagagagcgcaatgaggcacaagcccgcatgatgcaaatgactagagagagagatgaggctatgcgcttggctgaaaatagagaaactgctagagttagagccttgttccatgctgaaatgagagaggaagagctgattactaggattgctgagttgcacttggatgtccatcgcttaaataatatcataaatcctatcccacaaccagccccttttgatcatgaagaagctcttagtgaggaagatcagggtgatggcatcatctctaatggagaatccgaggaagatatgaagcctagcaatgattttatgaccatgtatcagtttccatctctttgtgtaatggacatgtaatctgaattttagttgagactctatgtatttggccagggtgcccctcctgtaaaacttaagttgtggcaatgactctatgtaaccttatgcacttatctgtgatgctccatgtttatgttgagctgaaataaatctctgcaa

SEQ ID NO: 25982 - DNA, 254 bp, Sorghum bicolor
  Clone ID: 30968855
gaccgaggaaatacccactgtaaagtttccacagcaaagacgctcgtcaagtgattgtcaacaagaaggtttattctgtggtgctggagagatgtgtctgggtgttttctgcggttctgtgtcatggatagcttttggggtggagggtggattacttacagctcgatttgttcattatattatatgtttgcctaatccagttcttttgctgaccttgtgctcgtgtaatttgattcattctagtttgcaacagc

SEQ ID NO: 25983 - DNA, 653 bp, Sorghum bicolor
  Clone ID: 30968870
agatcaatagctatctgaactatgtatgctttgatttgatctgtttgcagtcactaaatgatgtccccagtggcaatgttgatcccaagttctggaaggaggaggctggctgtattgattgcgtccagaggcatgtgaagagatttgtcttccaagagtttcggggtaagagaagtgagctagcgttcctcaagttcattgctgagagagcacaagtcctggagaagatggtggtcacggtggcctctaaatgcttctcttcagcagatgctgtcaatgctaagctgaagcctctgatttctgcaatatgggccagtaaagactgtaaactgattgtcttcaagagtccatcctctgatttggcatcccctgtttgggcttccaaaatggcatctaatttttcatgcagagacccgtttgatcttctgaccgctaatgctgaactctgcagcctctgtgcttcaacattctagcactctctgagtctgcagccaacaacatataagctaagacaaagaacattgggaatgtttctgtgagcatagctgatgtaggtgttgaagtttcttagcagcaccatgtcttttgcaaaattgtactgttgcctagaattgtttctatatgtgagacaccaactgatatatgcagttctt

SEQ ID NO: 25984 - DNA, 589 bp, Sorghum bicolor
  Clone ID: 30968879
tacagttcaagtacttaaatcagcagacaaattagagaaggaccttgttaatattgctgtagaagattctgtggatagtgatgatggaggcaagtcactaatcagagagatgccgccatatgaagctgaaaatgcaattgctaatctggtgaaagtgtggataaaagaaagagtagacagactcaagggatgggttgaccggaatttgaagcaagagacctggaatccaggtgccaacagggagaattttgctccctcttcagtggagatgcttcgggttattggtgaaacgttggatgcatttttccagttgcctataccaatgcatccagttcttcttcctgatcttacagctgggctcgacagaagcctacagctttatgttgctaaagtaaaatctggctgtggaacacggagttcttttatgccccaactacctccactaacgcgatgtgaggttggctcccagttattattcaagaaaaaggagaaaccacagaatctgcaggttcgtgtatcacaaaatggagcagccaatggaaatgatcccttgggccttcctcaactctgtgtgcgcctgaatacgctt

SEQ ID NO: 25985 - DNA, 227 bp, Sorghum bicolor
  Clone ID: 30968882
ttactggtgataatcttcaaaccgcaagagccattgccctggagtgcgggatacttgatgatcccaatgtgtcggagcctgtcatcattgaaggaaaaacattccgggcactgtcagacttataaagggaggaagctgctgaaaaaatctctgtgatggggaggtcttcaccaaatgataaactattacttgttaaggcactgagggcaagaggtcacgttgatgct

SEQ ID NO: 25986 - DNA, 582 bp, Sorghum bicolor
  Clone ID: 30968896
gcgcctccactccactccgctccagcgacgccccagcccccaatctccgctccgctccagcgcagcggcgaccatggagatggaggagcagcagtttcaaacgaacgtggacgtcagcgtgagcaacatggagcgcgacctgcagcgccacctgcggcgcaagggcgtcgacgttcccgacccgttgacgatgggcacggccctggtgctcatgtatgcgtacgacgccatccccgacccacccgtgtctcccgccgcgcctctctcctccgccttcgccgcgcgggccccagccgacggcgtcgaccgcatcagcctcctctccgacgcgctgctcaggaacgtcgtgtcgcgcctccccgccaaggacgccgcgcgcaccgccgcgctcgccacgcgctggcgcggcctctggcgctccgtgcccctcgccgtcgtcgacgcccacatcctcccggactggatcccggacgaccacgcgatgcccgggggcgaggacatcctgtcctgggccgtcgccgtcgtggcgtcccgcgtcctggacgcgcacccgggccccttccgctgcgtccacctctcccg

SEQ ID NO: 25987 - DNA, 647 bp, Sorghum bicolor
  Clone ID: 30968914
tctgggtgcttctgcttctcgatctttctttcgctcgctctttctctctctcttcctcaacgcagacgctggcgacggcgacggcgacggcgaccacacccttcgcaggtcacgcgtgtgcccccggttgctcatccccggcacgaagacgcgcgactgggccctgctggtggccgtcggcatggcttcccctcggcgctgcatcctcccgtcgatccgcattgtctcggcgaaaccctagctgcctctttccggtcaagccgacctagtcagggcctccatggcgcaattgtgcgggcctggccccaacacgagcggtgcgctggtgtagcctctgagagtctcggtgcacaccagcgctgcctccatccacgcccccggctgcgtcgcgccggcaacgtacgtccagcggctcggcagcgacacaaaaccagctggaatagaagcatggaactactggcctgtaggtaaaaaattgattattttgcaatactttctcaaaaataatgtatgctatgagacttagatatctttcttatatcttgtgagcttttgaatttggaggacatgactgctgactgttgcaacggtcatgctttgttgtgtggcctattggtagatatgcagtcgctggaacaactgctaag

SEQ ID NO: 25988 - DNA, 276 bp, Sorghum bicolor
  Clone ID: 30968915
ctgggctggagcaggcagcttacgtcactacgccgcgggcgccgcggcggccaggccattccgtgaagcgagctgcggaggcggaggctttgtcggaggcgacgatcggcggcaggaggcttgacggaggcaaggggtacgccgctcctttcctgaggagccttaagctcacggcggccgccggctggaccaaacaaccaccaagctcaccaaccctagccggctaccccgaccgcaagttcaccaccatatgttggaatgagagatgcagacaag

SEQ ID NO: 25989 - DNA, 297 bp, Sorghum bicolor
  Clone ID: 30968930
ccgttccttttctggaggacggctggacgggggcccttcccggcgacggccacaccgcatccatggcggtgcccttcctgctgctgggcctgggattcgtccttggcctcctctccctggcgatcgcggagggactggcgctcctctgggtcatccgcagcctcacgcgccgcccatcggactcggaggccacactgccgtcgccaccactccccgaccacccgactctgccgcgggctgtgtctcgccacggcctcaaccgacagggcttcttgaggatgctggagcaacaaaaga

SEQ ID NO: 25990 - DNA, 611 bp, Sorghum bicolor
  Clone ID: 30968936
tctggttgtatggaagatgtcagaggttctggtattagagactgaagttttgcaagcgcgtgttgctgctttggagttttagcagctgtgttgtgtggttgggagccatggagtcacagatggatctgtacgaggttatagagcagaatggtcatggcgcctttggtgctgccatcctcgtgaaccacaggactgagaaaaagaagtttaattgctgagtctgtttccccataaatttcttagccgagagttgtttgctttgctaatgcaggtatgtgttgaagaaaatacgtctgcaaggtagacataatgatgccacaagtctggtcaccaagaggtcaacagaatttttcgtgtccccatgaatttgtgaatgtcgtgagcttgtatcccggctctttgctccatccttttttggttctggtctgataactaattttgactgctggtagagacttaagaactatacgtgaaaaccaagacatgtatatctacatccataatcctgtaagctttattttttctgaaatgtatgacacaagcttcaacatcggtttagttaatgtccattctatggggtagtataattcatttgtttggatgcaacaaat

SEQ ID NO: 25991 - DNA, 586 bp, Sorghum bicolor
  Clone ID: 30968940
gcactcgtcgccagggccaaagaggacagccgccgccgccatggatgttgctgaggtgtacccaagggcatgaccgtgttggagtacgagctgccggagccggaagaacagcaaagggagctacctcatggagctgaggaggaggaggacttgccggagtgccctgaccatcgtccctctacctacgtcgaagatggcagccccgcacgccagtgagacttttctggacatgtttggcactcctactttgttgtggagggtgctaagttcagttggatatgaggaaccacctaggtacacttggaccgagtctgagcatgcaggggccttaccttgggtagatgtccaaattacagttcctccttgtccaaataacccacagtggcttgggtggttagttgactgtgatggccaaactccttgggagggcgcccaagtagcagccctagaggttttgctagaaatatgtcaagagtttggtgatgagttagtgaatggcccagtaggatctatccccagagtgagtgtgactgacacatttgtgtcccagatagggaatgagtccttagagatgagagaaatcttg

SEQ ID NO: 25992 - DNA, 507 bp, Sorghum bicolor
  Clone ID: 30968955
aagcacaaagcggcaggagaacggcccggcccctgccccggccccggccggacgccaatcctccgtgtccggtggcgcaacccgaccaaacaaccccctttttaagccgttcgcgttcctgacccccgctccccactcgcactcgcccccgtctgttctctctctcgctctctgatcggcaggagagaaaagtggatgctccagcgaagcgagcgccacaatcgtcggcccgccatggacaggtctctcgacagaaactcctccatcaaggacgtcacttatagctgcgggtactgcggctacgcgctgaacctgagctcctcggcgcgggacacggagggcatcgggtgctccaagtaccgcaagcagatcaagaagggcgtcgtcgccttcgtcgcggtggacgagacccggttcacgctcgccgacgaggtcacctgcatgccctacttccgctccgcccgctcctggggcctcttcaggaggcgggcgcgcctgctctgccgc

SEQ ID NO: 25993 - DNA, 461 bp, Sorghum bicolor
  Clone ID: 30968960
ctactgggtggcattcgccgtcttcggctcaccctgtcggccgccgtctcgtctcgactgtagcaagcgggggttgccgtccgccgcgttcaggagccatgcgggaggggatgagggagagggacagaggcgggagcccggatgcgtcgggccctcctcccttccgcgggccggcgtacaagacgaagctgtgcgcgctctggaggggcaggggcggctgcccccgccccaactgcggtttcgcccacggcgaggctgggctccggaggccgcccccacgcgcctccttccagcctcgccctcgacctgggagaagggactacagagatcatgagtttagactcaggcctgagagaagacactcacctaggtattcccccgaaagagatgccaggcgtcgttcctttcgtgataagagaccaagttctgaagagaggggatctagtcgttcaagatcacct

SEQ ID NO: 25994 - DNA, 487 bp, Sorghum bicolor
  Clone ID: 30969017
catccctccaagcatttcaacccaatctaccagacatcagcaaacaggtctccattctcagcaaaagcaagcgtcagtgaagctcctatctgtgaagtcaccaatgcagggagagggaggtcctaccccccaccacaagcggacagatcctcccggtcatctgtttactgggatcaggaagctggcaggttcgtgtctgcgcaggcaaaccagggatccagctctcgctctggccatcttgaccttctatacaccgggcagtctatattctttggtggacctctgatcgcagaccctgcagcaagaagcttcagagatcctggtggttcgagccaaaggtctgccgggcctcggccgcaccagctcccggtgttcgatcccagtaacccccagaaagatcagctgtccaggttaccgtgaaatactactatatcaaaatttttttggagtagtcttccgaaacacatgtttctctgctcgattatga

SEQ ID NO: 25995 - DNA, 671 bp, Sorghum bicolor
  Clone ID: 30969024
gacgacgatgaccatggctgctgatcaaggacaagaaggactggagcagcagcttctgcacgagctgacgacggttaaaggagccagcttcactttcactctcagggctctgtacagtctgttccggttagtgcagcgcatgggtcctctagggcatctcgtctccttcctaccagctggattattgggggacaaggggaagcaggaggaggaagggcagcaggacaagatcaagaggtacatgacgatcatggactccatgagtgctgcagagcttgatggggcggacccgatgaagctgatgatgacgaaacagcagcagtcacggatcaaccgggtcgctcggggctccggcaggcccgtcagccaagtagtggaactgctgcaggagcacaagcgaatggccgaaatgttgagcgaactcgcgcctgcccacgtcaagagaaagagacctaataataaacatataaagcgtagattattcaacacctcttgctgaaacaccaggagggcagttggattttacaagttgtactttgtctgtcagaaaccagatgttggtcctcttgttatcatgtaaagacagtatccttgtgtgtaatcggaatgggttgtccattactgaaacacaataatggttctttagcttgattttatttcatttgttcatt

SEQ ID NO: 25996 - DNA, 508 bp, Sorghum bicolor
  Clone ID: 30969045
tgaggtcgtgttgtgtccatctgaaaaagagctatatatagccctatactagccgccacgagatcgaggtcgagccgccgatcgagatggtgctggcgcagctgggagagagcctcgtcggcgcgctggcgcagatggccaagtcgaccgtggtggacgacaaggtggtggtcgactgcctcaacgacgtctcgcgcgcgcttctccaggccgacgtccgcttcgagacggtccgggccgtgcaggccagcatcaggagcgctgtcgtcaacctccagtccctcgccgccggcaccgacaggcgccgcgccatcaagcatgcggtcgtcgacgagctgcgcaggatgctggaccccgcggccggcggcgggaccgggaagcccccgcccttcttcgtccccaggaaagggaggaagcccgccagcgtggtcatgttcgtcggcctgcagggctccggcaagaccaccacctgcgtcaagtacgcggactaccaccgccggacggggtt

SEQ ID NO: 25997 - DNA, 597 bp, Sorghum bicolor
  Clone ID: 30969095
agtacaatatgcaagcacaaacttaactgcatcaagtcattagccgaagctaccacccacccttgtatcccccatctccattgttagactcttggctagaattcttgccatgtgcggcggggccattctcagtgatctctactcgccagtaaggcagaaggttactgctaatcacctatggacagagagtggcagcagtaagagtgggaagaactggaaaaggaagagttcttgggagtttggtgaagatgactttgaggctgatttcgagggatttgaggatggtgatagcgaggaagatgtggattttgtacatgagggccaagagttccaaacgaacagttcgaatctcgtggtggggtccaatgttcatactgccaaagtcgccagcaggaagagaaggacacagtatcgtgggatccggcggcgcccttggggcaaatgggcagctgagatcagagacccacgcaagggcgtccgagtctggcttggcacctacagcaccgctgaggaggctgcaagagcctacgacacggcagcctggcgcatacgtggcaagaaagccaaggtgaacttccccagcgccatcacaaatcc

SEQ ID NO: 25998 - DNA, 204 bp, Sorghum bicolor
  Clone ID: 30969120
gtccagtcctcggctccggctgccgtgccgcctgacacagccacgcactgcggcggccgtacgggcgctagggttttccctccacttcggccgcgggctcgggatctcgcgccgcaccacaatgcagctcacgcgccgctgatcccgggcagggctccatcctgacctcctcctcccgccgccgccgcttctgctgcagcgggc

SEQ ID NO: 25999 - DNA, 638 bp, Sorghum bicolor
  Clone ID: 30969127
atcagatgttgaagaaggaggtgagactattttccctgatgcaaatgtgaacgccagttctttaccatggtacaatgagctttcagagtgtgccaaaagaggcctttctgtcaaaccaaagatgggagatgcacttcttctctggagcatgaaaccagatgccactctggacccactaagtttgcatggggggtgtcctgtgattagaggaaataaatggtcctcaaccaagtggatgcatatccatgagtacaaagcttgaggcttggagagtcgaacatacaaaagatggacctctatgcatgtgacttggggctctctacgggattgacactcatgtatgctttacagaccctctgaagctgtattctttgctcctttgttggaggggagataataggggccaataagctggggccttgctcgtccctgcagtattttttggggctgatccttgctgacttggtcttttgtcttttcttttctttttcttcctttgcagtaccccaactatagaggaatggtgtagtgtctgggggctggggcatagagtttgagattttgtttttgtgccatacccctaatattagtacatgaatgctgtattgctatgatacttataagctttcgtactaatt

SEQ ID NO: 26000 - DNA, 643 bp, Sorghum bicolor
  Clone ID: 30969145
cgttcagcgcgtccagcgacctgagcccaggcgttctggcgccgctgcagttcgatccgtgccacgacgggttcggtgagtggtcagcagcaggcgggccagtgggcagcactggcccctcgagtacggctagtactaccgccgcaaccaccatgctgtgcgctgacgtgagcgtgcaagctgcgttcggcgagctcaacttcgccatggatcagagctgcttcgactcgctagggttgcccacggacgacgtcgtcggcaacctctcgtcgtcgtggtgttcgatcgtgccaggcttgtcgacgttagaggacaccaagtatgactcgttggattcgttccctgacgacgccctcagccttcacgaggacatgattagcgggactgatcatgattggagcgtggattgccaaggattggaggctctctacatgccgtaactacacatatgcatgatccaaattcttcttcttcttgctaatttgatttgatgttgttcttgtgattggtttcctacattttttttctctttaattttctttcattcaattcggtttggaagaaatatatatagaggtatatgtatgtttgaagagaggtacagtgagggacaatcgctcatgtaatgaattaaggattcggt

SEQ ID NO: 26001 - DNA, 148 bp, Sorghum bicolor
  Clone ID: 30969149
gggtttacttccaaacttttttgcaaaaggggggtgtaataaatgccccccatgcccctccatgcacatgggtcccttgcatgttgttacaggtgttttgcatgccctgcatgcctgcatattttcacacatgacaagtttttttttt

SEQ ID NO: 26002 - DNA, 489 bp, Sorghum bicolor
  Clone ID: 30969203
ccccccctcacctgctgccgcaggccgcatcccccctctcctcctcctcctccccccaactgccccccgctccgcccgcgcaagggaaaggaaaaaagggctcgacgactttgccggacgcggcggcgcatcccccatcccgtcccacccccagccccccatcgccgcgtcccatcgcatcgcatggctgaggacgccgcggcgggctccccgctcctggacctgccggagccgctgctgctccacatcctgggcttcctcaccgacgcgcggtcgcggcaccgcgtcgcgctggcgtgccacaggctcctcgcggcggagcgggccacgcgcgccgcgctctcgctgcgcggggacccgcggtcggacgtgttcctctacctcatcaggccgacgttctgcttcccggcgctggagcggctcgacctctcgctggtgtcgccgtggggccacccgttcctctcctccgcggcgccgtctgccgacgcc

SEQ ID NO: 26003 - DNA, 478 bp, Sorghum bicolor
  Clone ID: 30969230
ttcccgtccactcgcgtcgccgtcccccgtttctctctctctctcttcgcggagaaaaaacgagaccagcagcaggagagtggggagagagaaaggaggaaaaaaaattatccgaactcgctcgcacacaaatctcgcgcacgggttcgggggccgccggctcgatccgcggccgaaaccctaggtggtgacgaaggtgacagtggtgctggaggaggagaaggaggagggctgggagggatgacgtcgccgaggaaggacggggggttcctgacgcaggaccagcgggagaagctgcggatcgcggtgcagaacgcggagacgcagtcgctcgcctccccgcgctcgcccacgggagggaccacctccgcgccgctgcagcagtacgagcagcagatgctggagcagaagcgcgccgccgccgccgcagcagcggctgccgcggctgctggtggtggcgggaggggcggcggaggag

SEQ ID NO: 26004 - DNA, 660 bp, Sorghum bicolor
  Clone ID: 30969232
acctgacacctcccgcgcgggagatccgcctcatggcgccgtcgcggccgctcatgcgggggatccgcccgccgcgcgtcttcccgacccgcggcggccgcgcctcgccttacgccgtcgcgctcaccgccctgctcctcgtctccgccgccctcctcgcgctcatcgccttcggcgtcttctcgctccccgtgtccgcgcccaacgccgccactaccggcgccggtggggagaccgagtccgccgacgctcgacccgcgcgcccccgcgcccgccgcgacctgggggaggggctgggagagcgcggtgcgcagtggaccgaggtcatctcgtgggagcccagggctttcgtctaccacaacttcctgtctaaggaagagtgtgaatacctaattggattggccaagcctcacatggtcaaatcaacagttgtcgacagcactactggtaaaagcaaggacagcagggtccggacaagttcaggcatgtttcttcaaagaggaagagacaaggttattcgagcaattgaaaagaggatagcagactataccttcatacctgcagatcatggtgagggactccaagtgctgcattatgaagttgggcagaagtatgagcctcactttgattattttcttgatgagttcaacaccaagaatg

SEQ ID NO: 26005 - DNA, 632 bp, Sorghum bicolor
  Clone ID: 30969234
agcacccccatttctctccacagtcctcgatcgtcctctccaacatctccccccccccccccattctctgccttcttcgtccacgagatcgaggctactttgaagaagaagcctctggtctttgtctgcctttgaagaagaagcctcgatcgaccatgcaggaagctctcatctctccgggcaatgcctgccgctttcgctcagccttggagctgaagccgttcgccttcggggaccagcgcctcgcctcgccgccgggctacctcaacctcgccgccgtcggcggcggcgacgacgcgctgttccgctgctcgtcgccgttcagccccagcctcggcttctcctcgccgtcgccgctcgcgaccaccccctccgtctcgctctcgccgtcctcctccgcctcgctcgtcgacgactgcgacgacgccgcggccgccgacgtggacgccttcgccacgggccacaggctccagctcgcccgcctcgcgctgcagtaccaggaggtggccgaccgctacgagctctgcctcgcccgcctcgccgacgccgcggacgaggccgccgcgctccaccgcgagaacgccgagctccgcgtcgccaacgccgacctcacgcgccgcctcgcgctcctc

SEQ ID NO: 26006 - DNA, 645 bp, Sorghum bicolor
  Clone ID: 30969240
agaaacccacttccagctccattgttgatttctcaagcttcgcctctccatcttacccaatgtgatccccccctgaccaccaataccctagtcacgcgtcgccatggccacgcgcccctgcgtgctcacgctcctcctcctactcgccatccatctccctcccgccggcgcagccgccgccgccgccaagcaccgccgcgcgtccgaatccgccccagcaccacccgcctcctacctcctcgtatcgtgggcaagcaacctcacgctcctgggctccgcctccctccacccgggcgccacagccgtcgcgctcaccaccccggcgtcgacttcagggcaggcgtacccatcactgcctgggtggagtaccgcgccccacgccgccgcctcagcgtgtggctctcgtactcgtcgttccgccgaccagagaagcccgccctctctgctgatgccgacctctccggactcctgcgcacatacatgtacgccggcttctcggcgtccaatggcaatggcgcggcgcttcatgtcattgaacgctggaccttccgcaccttcggctttgccaactcatcccgcgcgccgccaccagcacagcccaacaaggcactgctgccgcccaacaaaccactgctgcttacagga

SEQ ID NO: 26007 - DNA, 663 bp, Sorghum bicolor
  Clone ID: 30969253
ctcgatcgccccacctccatctctcatcgaatctctggcgtctccaaggtcacctccgacgatccctctcacatcacaacattcttggccaagatcctcccagctgctcgctccaagctccagctctgaccaccacaccgcgtacgtggtggtctagcaaacatgctgtcttcacaccacgaggccatgctgccgtatgcgccggggccgccgccgtcgctgctggtggatcggcggtacaagcagggcggcgaggcggcgcccaactgcccgcgctgcgactcgcccaacaccaagttttgctactacaacaactacagcctcagccagccgcgctacttctgcaagggctgccgccgctactggaccaagggcggctccctccggaacgtgcccgtcggcggcgggtgccggaagaaccgccggggcaagtcgtccttgcgctcggcggcggacgccgccatcgcgagcggcggcggccgcgatgcggcgttcggccaccggttcccgggccctgtccggccggacctggtcctggaaggcatggtcggcaacccgtcgaacccagctggccaggcgatgcccggcggcgtgcccgctgctaccgatggctccaccattgatctcgcaatgctgtacgccaagtttctcaaccacccgccg

SEQ ID NO: 26008 - DNA, 515 bp, Sorghum bicolor
  Clone ID: 30969259
aagaagcaaaagaaatcccgagaaaaggcaactgtttgccgcgggagggagggaggagagccccgtccgatccggcgcagccgcctacgctcgtcaaacccccccggttaactgtgacatatgataccagatcttgatccactcgaagtgttcagtacatacaactgcttcttgtagttggtttcaagatgacaagtaagaaaagtaacagatctacagtcacatcacgcactgctctgcatatggaatgggacaggatttcttgccctatttgtatggagcaaccccacaatgccgttttacttatatgcagttcatacaagaatggctgcagatgttacatttgtaacacaagccatcgacactctaattgccttgaccggttcagaaaaatgaatggtgatagtaaggtccgtgcttcacactcaacctattcggtgctttcaaactccaatatcagaactgtccaaccaagagctcactataatatgatttccagacgttcacggagccca

SEQ ID NO: 26009 - DNA, 196 bp, Sorghum bicolor
  Clone ID: 30969290
atgcggtgctgccgtgcgggagcgctggattccgtcccgttccctttcggttcctgtactgtttcggaaggcgttgcgatgagatgctgctgccgcggcggcgaggagttgttcatccctcggcgatgagcacaatcaccaccggcatcttaatctcccccgcctccttcctcgttcccctctctcccccccgcac

SEQ ID NO: 26010 - DNA, 642 bp, Sorghum bicolor
  unsure (1)..(642): unsure at all n locations
  Clone ID: 30969316
gacgtacacgagaatgttctggtcagcggaatcactttactataatccagcttggcacatcattgtttcttcctgggaaatcattgtgtacagccctattcttgatctggacagatgggctatcccaattgtcataatgctgtcatttggggttttttacnggagatgcttcggtggaagaaggaagcggggaaggggttcgctcctcccattgtacaagaattcttacaagaactcgagtcgctcgagatcagactagttatacgtgatgcgtgagtttttcttttaaagaatggtacaaaatatctacttatagaagaggctaaactgcccgttgtggatcatctccctgtgcttttggatgggcatattttgatggtgccctgcctatgtatcgccaattatttttagtggatgaagagaagcagtgaagctgctagcgatagggaacctgcacgagcctctgttgtgaccagagttcttttgtcttctgtagctaggctatccttacatgtcacggtcccaattcattgattattgttcacatccaccgcaatttttgcaaggattttgtttgtaacaaatcatatatacaaggtagttgttagagcctgtaccgtgacagtaatgtgaaagttataa

SEQ ID NO: 26011 - DNA, 400 bp, Sorghum bicolor
  Clone ID: 30969324
tctggttctaattattgtgtatcctacatacagaagaggaggttaggttaagccaaatctgctgcttaatccaaacctcctggggtccttaaaagcttcgggtccaccactgagcccatcttttatgattttccatgtgcagagacttaacagaagatggtgctattttgtgataagtcgttttatgagcattatatgtcaatgatgtgtctgactgaaattgtgctcagtaccaagaatcgtcaaaggatagaatgcttcttgtattccttactttgcgtagcacttttatacatcgctgtgctctatgaaataatcaggttcggattgtcaaaccatcagagattaacataactgcttcctttgcagcacttcaataccatatttggctttgtgcatc

SEQ ID NO: 26012 - DNA, 667 bp, Sorghum bicolor
  Clone ID: 30969336
gcttgctgtatactgcattgaggaccaggcgggcaaggtcatggctatatggcataaggcggcttagaagctttatagctgattacggcgtcccacttatggtgattgtgtggacagcattgtcgtatacactgccaggcaagctgccttcaggagtccccaggaggcttttctctccacttccctgggagtcaagttcacagggacactggaccatagcaagggatttgttttccgtccctccagcgtatatacttgcagccattctgcctgctttgatggttgcaggactttacttctttgatcatagcgtagcttcacagttggcacagcaaaaggagtataatttgaagaagccttctgcctaccactatgacattttggtccttggaatcatggtcctgctgtgcggtttgcttggcatccctccatctaatggagtccttcctcagtctcccatgcacacaaaaagtcttgctgtccttaagaggcagctgctaagcaaaaagatggttgatactgccaaggatagcatagggagaagtgctaccactttggaaatatatggcaagatggaagaaattttcatcgaaatggatagcgaacagaatactggttctgttgacaaggagttgaagaactttaaggatgctttctgcaagaaggc

SEQ ID NO: 26013 - DNA, 644 bp, Sorghum bicolor
  Clone ID: 30969338
cggcagggccgcgccgccgaccgctccattggcccgctggagatcagggtggtgtcggacggcacgttcgacaagctcatggactacgcgctcgcccgcggcgcgtccatcaaccagtacaaggcgccccggtgcgtgcgcccgggccccgtcgtggagctgctggacgggcgggtgcaggccagctacttcagccccaagtgccccaagtggagccccggagtaggcaagcagtggagcagcgacgccgccgccgccgccaagaaggcggccgccggcggcagcaatggtggaggtggaggaggaggggcggtcgtcgtcgcctgatgatcgagctatactagtagggagttgtttaattagctggctaattccggaaccgttagtgggagagagagagagttgtggtcgatcgaatcgagtatgatgagtgagctgatgtatgtatccacatgcatatgcatggggacgagtgattagcagcgagctagcgctaatcatcgtcgtgtggtagcttaagtattgtacgcgtcgcgctatcatgggcttttggttcttcctctcgtttttttctttgttttttctgtggttttgtaataaagctgtacgtacgtagtagtgaccttgggaacctctgtcccttt

SEQ ID NO: 26014 - DNA, 300 bp, Sorghum bicolor
  Clone ID: 30969341
ccgcggcacgtgcaccaccgcggcgcgtccatgccgtcggtgggtgaccaccccgcgcgcatcgcctgcgacgaggggttccggtacctgcactcgtcggaccccgacgccaacgtgcttgttggcgccgtagtcggcgggcctgacggcagtgacgccttcactgacagccgcgacaacttcgcgcagacagagccctccacctacaccaacgcgccgctcgtcggcgcgctcgccttcttcgccgccggccgccaccgctgaagcaaattgaagtcagcacgtgagaatgagatcgat

SEQ ID NO: 26015 - DNA, 644 bp, Sorghum bicolor
  Clone ID: 30969361
catgttaacccacttggcattaagtctgatgccccttgggatgttatttgggacatcatgcgctgctgggtgaagaatcatcctattaaggaacagccccgtgattcaccgggcacggcgatcctttcaaaatcgccaaagctagaagcaaatttttcaagagcagttgctgccctcagcaaggctcaggcgaagaagattaaacgattccttccaaacccagaacggcactggggtccaaaggtcagagcaggcaggaagatcacgagcaaacatatctctctgttgggccctgacgctatcaatggcgctctgaatggtggtgactgccacgaagaaggaaacggtgctggtctagataatacagccccagaacccgaggggatcaaagacgttgagaatgaaccctcaaacaaacgccaaaaaaccagcgacggcgaaccagcaagcgaaccttgatttgtttgaaatctttcgtgtggttcctttgtgtctgtgctttgctagtttgtggccgatgggttatttatatcacctgttgaattttgatggaacaaatttgcgccaagtttttgtcatcttttgctgcatgtgtgatgctcctgtttaacagagggaaagccctattaaagcgtaatatacat

SEQ ID NO: 26016 - DNA, 669 bp, Sorghum bicolor
  Clone ID: 30969371
cgaaaccctaaccctctggatcccgccgctctccaatctccactcgtacctcacacccctcctctgatggatcctcgctagcccctgagaccgtcgccgccgtcgacttctcagcccgccccttccgcgtcgtctctgacaaggccacgaccgtcctcctcgccgacgccgtgatcgtcgccacgggcgccgtcgcgcgccgcctcagcttccccgggtccgacgcgtactggaaccacggcatctccgcctgcgccgtctgcgacggcccgaccccaattttccgtgacaggcccctcgccgtcgtgggcggcggcgactccgccatggaggagtccagcttcctcaccaagtacggctcccgcgtctacactatcttacccgatcttgtgtggtagccatatggcgtgggatgtgggtccaacgcgggtggcactggattttgtgtagtcgtattgcaacatttctgcctgcatatgtagttctgcattagtaaagtgtagtgtcagtatgacagtatcaatttcatatgctgtttaatgcctggtgacagacatgccaccatttgagctcttgtttccattgtgacatcatgagggcttttgagccaaaaatgtgtatacctgtatattaaatttgatttggatttctctacagactacatgtgtt

SEQ ID NO: 26017 - DNA, 650 bp, Sorghum bicolor
  Clone ID: 30969387
gctggatccacgcgccgccgcatctccagcctccgcgtcccagccgcaaaaccaggtgcttacccgcgcgcttcttggcacgcctggcagccctatccgtgccagggttcggttctggatttggagacatggcggaagtggaggacaagctcaaggactacgagatcaagaaggagggagaggcagagatcctcttgcacaagaagaacgccgtcttctataatcccgtgcaggttcacaacagagatatgtccattgctgttttaaggacctttgttgccaagcgcaaggaagaacatgaagcgctggtggacaagaggaatacatcacatgaaaaaaacaaacagagtgaaacatcgagtcaaactggagaggatgcgtcaactggccagcaagatgaaatggatgttgtttgtgaaaaggagctaaataaagctgaagatcaaattgatgatctgccaaaagaagcaacaaaaccttcctggaaagtaaccagggagcttaggccaccacttgtcctcgaggctttggctgctactgggttgcgatctctccggtatgcccgtgaagttgagggcttaggaaaggtagttgctctggataatgataaagcatctgtcgaagattgcaagcgaaacataaagttcaat

SEQ ID NO: 26018 - DNA, 612 bp, Sorghum bicolor
  unsure (1)..(612): unsure at all n locations
  Clone ID: 30969422
gctttcgctgctccgtgtccgtgctcccccgaattttgtcctctccccttccgagttccgacctcgtcgccccgcggctccagagctcttcccattcattccctcgcgccgaagcaaccgcccgaatccgccttcgcgccaaaaccctagccccagatcccgcgcctcgccgcccggtgcccaggcagcggcggccattgccgctcgccgcattgggggcgcttacggcgtcgcctccgctcccggggcagagatctgcgtcgaggagacctggttgcccctgggcagcgtaggggatggggcgggggcgggggcngggggcggtgggccccggggatccgcgcggcggcgctgatcctgctcgcggtcgcggctgctgccggagccgccgcgggggatcccgatccggacgagctcgagcgcgcgtttccnatagtggagccagatcacggacacactaaacttcgtctctcaaaacaaggtctggaagcaattcgaaggatcgaaactcctattgctgttgttggtgtcattggtccctatcgatctggaagatcttttctcctcaaccagcttctctccttatcttgtgataaaggttttggagttggt

SEQ ID NO: 26019 - DNA, 647 bp, Sorghum bicolor
  Clone ID: 30969426
agtaccacacccatctgctctcctggtttcgcttttcccccactcctccgcgtcatgatgtcctcggcgccgccgtcggagccggccaccgccggcgacgacgacgatatggagtctctcccccttgccgccgcctccgactacgcctccgttgcctccaccttcgacccccttctctcctccacctccgccaccgccgcctcgccccgctcccctccgacgcgcgccgccgccttcaccctctcctcgaccttctcctcctccttcgttgacccgccctcctacgccgacgccaccggcgccggcgccggctcctcctccccgcgctccgcctcctctccctcctccgtgtcgccgagatccgcgcgcttggcggcctccgagtactccctcctcgccgtctccgacccagagaccgaggccgagccagccgccacctcgctcgtccccggatccgggcccacctttgtctcctacctcgtcaccagcgtccaccgccgggaccccgaccagcgccgccattcggtgcgccgccgcttccgcgacttcgtcacgctcgccgaccgccttgccgaggccttccggggccatttcgtgccgccgcgcccggacaagaacaccgtcgagagccaggtcatgcagcggga

SEQ ID NO: 26020 - DNA, 620 bp, Sorghum bicolor
  Clone ID: 30969444
gacagcccaccacgccgcccccccactccacccgcctagggctccgcgccgtccccgaggacaggaggacgcgggcattgccgatccaaacgcgccgccgcgtcaacttttcccgccaactcacctccgccgccgcgtgaactcgcctccgccgccgctccgaaactgattatggatctgctaaggcatcccttcaagggagttgtcactgatatcaaaggaagggccacttggtacaagcatgattgggttgcaggagtccactctggctttaggatattggcacctaccatgtatatcttctttgcctctgctcttcctgtcattgccttcggagcacaactgagcacagcaacaaatggtatactcacaacagttgaaacattggcatcgactgcgatatgtggcatcatacattcaattcttggagggcagcctttactgattgttggagttgctgaaccaactattatcatgtacacttatctctacaactttgccaagaatcaacaagctctgggtgagaagctatatttggcgtgggctggatgggtctgcatctggactgccatcatgttgtttcttttggcaatgttcaatgcttccaacgttattagcag

SEQ ID NO: 26021 - DNA, 233 bp, Sorghum bicolor
  Clone ID: 30969449
tacgtgcatattgagcttgctagcaactaccaagccaatggcgcccatgaggaggagctcttacaaggccatggtgtcctccctcgccgccgtcctgtgcttcttcacggccggcggcaacggtgtggtggcgttcaactacgcggacgcgctggacaaggcgctgctcttcttcgaggcgcagaggtccgggaagctcccgccgccgccgttgcagcgcgtgacgtggcgcg

SEQ ID NO: 26022 - DNA, 632 bp, Sorghum bicolor
  Clone ID: 30969467
cgcgaccggtcctgcagtcctgcacggcagcgacgggtggagccccagacggcggacggctgctgctcttctccacgaggacggcgaagtggcgaacaagttgatctgctccacgagcacgaggacggcgaacaagttgatctgctccacgtctccaccggtcaccagcagagatcacgagaagctctcaggcaaccatgactggaatgtctcctaccgtggctactgctggtgagttcatcagatcaatattgatcatttcttactgacaaggatgtcaacatgctgctgtttttatgtgaaaattgattgttttttcacatacagtggattcttcaggcactcctattccagttagcactgaaaattctacccagaattcaactgcatcccaacaagaggttgccacaaaaataaggacaagaaacaaaactgatctagcatggggatattgtacacaggttgtggaaggaggcaaaacaaagatcaagtgcatgtattgcaacatgactttaacaggaggaggaatccatcgtttcaaggaacatttggccaaagtgcctggtaatgtagttgcatgcaagaaggttgatcctgagtttgagtatacaatgtgaaaaatatgaagatgg

SEQ ID NO: 26023 - DNA, 659 bp, Sorghum bicolor
  Clone ID: 30969469
ccctttcaaacagggaaaaggaagaggatttcctggtgttcaaaggatccaaactgcctcaaagacccaagaaaagagccaaggtcatccagagaaccgtcaattttgtatgcccaggaacgtggctatgtgacttgactctcgaaaggtatgaagtccgggagaagaaggtttccaagaagcgccctaggggattgaaagctatgcatgacatggatagtgactcggaataaagaagaaaagagcactgaacatgagaagctgaatattagaaagaaggccaggacagatccagcatatggaggtcgatgataaagcatcctgattgaatgaatggcctgatcaacaggtcaccatttctcacgattgctactggagatcaatttgttccaaaaggactagcttgtggagatcggaggacaaaccaaatgtaaggaactgcacagaagaaaaagagaggagagaagcaggagctggaattcctgaacattagcaaaccattcagttccctgtaaagcagcaacgctgttttgcaaagcctctcatgttaatttcgcactgccaaatatcaacgtgatcgcgaagctagccagtcctggcgcgtctagtttgccgggttatctgacaataaaaattaatggactctgaaagggccttcc

SEQ ID NO: 26024 - DNA, 629 bp, Sorghum bicolor
  Clone ID: 30969476
cccgaagccattcaccacattctttggagaggataacctgaaggctatgagggttgaaaagtatcttctgccagtgccgaatgctcaagtactggaagaaatcaatcaagaagttgtaaggcaggagctcatgaatgtcgacgatgctgccgaccatgcagatgcaggggatgacgatgatgctgctatggatgctgacgatggaggtggcgatgattgattgtgagattcaaaggattgaatggcttgggtagagcagttatgtagagtattggtatacaaagaggaattggcattcttggatggacgaaggttgttgagggttgaaaaatagaaattggaagtagtgtttcttttctcgtacctaattttaagaaagtgattatctcagatgacactatgaaaattgtttattgtgaaactacacagctgatagatatgtctcttaactcttatgtatgttttccatgattcgcagttaaatgtcacagtaacatcctgtgatgtgtctttcgcatgcactggttttaggtgaagtagaagcatacggacatagagaagtttcaactgaagcaaatgctgctattctcgatacttcactgatcaatatatatgtttttctttcacct

SEQ ID NO: 26025 - DNA, 611 bp, Sorghum bicolor
  unsure (1)..(611): unsure at all n locations
  Clone ID: 30969477
cgaagggcaaatcagcggcggcgcaggccgcggcttcgggccagggctcctcttcccaccaccacactnccggcggtggcggtggtggcggcggcnccgacgcgtccgccaccaccctcaagcgcaagcgcggcgtcttccagaaagacctgcagcacatgatgtatggctttggggatgatccaaatccacttccagaaaccgttgcacttgtggaggacattgttgtcgaatatgtcactgacctggtgcacaaggcgcagaatgttgcctcaaagagagggaagctactgacggaggattttctttatcttatacgcaaggatttacgaaaactgcaccgtgctactgagctactgtccatgaatgaagagctcaagcaagcaaggaaagcttttgacgtggatgaagagacgctggctacgactaacatatgatgtcttcgtagttgtacaatctgcatgttagagtaactagtacagatgcactgcatgtgtcggacaactgttggcatcgacttgtaacttttctggtacaaattttagttactttcctgacagttactgctatggttgtatgccctactcagtgaagatgaaaggtttgctgtt

SEQ ID NO: 26026 - DNA, 660 bp, Sorghum bicolor
  Clone ID: 30969478
aacccaagttgaggatcagaagtgctgcggtcctgaatctccaatccagtatgaaacacttgcactgattagtgaagatatgaaaagtctagaaggaacgaactcgccagccagccagccagacgctgctctagcagagcaatcagataaaatgatccattgcaatgatgctggagatactcagagtgggaggaaactagaaaatgaaagtggtgcttgttcagttcctgacacccttagtactcacgagcacctgaagcccgagactaggaagagagtagcatttgtcgcagttggaaatccaaaagtcacaggtgcagactcagaaacaaaatcatcagaggtgaacaagaagcagagactagacatgatttctccttccaacatacaatctagactgtacaacaaattgctggattgtgatactagagataattccatactttaatatgttcgcttgttaaggggacgagcaataggtaggaaagtgcgcttgtgctaatgcatctcaagacacggttctgaagctgtgtgcactatcagaagtccagaagttgtgtgcagtatcagagatttaaattgtgagctgcaagattgttttgtagtattcagtcattgtcacgccaatgttcagcagcacacttttatacaactgagttt

SEQ ID NO: 26027 - DNA, 612 bp, Sorghum bicolor
  Clone ID: 30969480
ttgggggaaagcaagatgagggccttgctaaggctgtagaaactgttctaaagaaagcaactgactgtgagttggcatctattgatgctatggctgcagcagcccattccctggtgatccctcttgcaatatttagagaaaggttgggtattgaggaggccattgagttgatcaggctagaagaagaccaccaggttgaccgatggggcttggtggaagggggtcatgacgttgatattgctgatcttaaagtgcagatgtcctcggctgttgtatttcttgaacttacacggggactgtgaacgatactgtttctaatctatatgttggttagttgttgtttatttccagtcttgtattaatctaatacgaagagttgtagaaaataattgctgcaggagctggatagcaaacgaagtatatgtattcaccaatcagctgttctgttgttagattttggattgcgttgagaaaatgctgttaaggtatggactagggagcccagcattcctttggctttgtactggtaatggtgtgagaataagaacataatctgcgaactagttttgcagtggcagtcatgtgtaacattctttttatggagtagaactc

SEQ ID NO: 26028 - DNA, 137 bp, Sorghum bicolor
  Clone ID: 30969487
ataaataggtatgggtatttgtcaatgattccttttttgcctttgaaaaaggttaggattttaaaagaaattcagcccttgtgtagtttcagttcaagaattttcatcttcaataaagttgattaatattatatgtc

SEQ ID NO: 26029 - DNA, 577 bp, Sorghum bicolor
  Clone ID: 30969504
tgcacggagcacctcgccggcaacagccacggcggcaacggcgccgacctctggtccgtggcggcggggatggcgaaggcggccgcggacaagggccctgccggcggaatgctgctgcctggtggtggtggtggtggtggttaccctcgtcaagggcacctggcctagctgactgcggacacacttgctttacagattatgcgaagggtttagggctttcagtaggctcttttgggggctaatcagttccggccgtactccataaccttttgcttgtctaaagtaaacttttggggggccgggtgctgctgcttttggtgggtaaaaaaggcgcagggatccatatttgatcacagatgccacagcagccaggatgcgatgcaaatgcaactatgcaagcgtcaagtgtgcattgttttggatggggggttttggttgtcttaactttagcttaagcttaagagagaagggtggtagtagtagaagacagtgatgtgaggatgccgagatctttgggcacgaatgtccctgtgctgtcacgcccattgaatgaatgctactcctccgtcgatgttcc

SEQ ID NO: 26030 - DNA, 615 bp, Sorghum bicolor
  Clone ID: 30969522
atcttgttgccacacccctcctcgcttgtaactcgtcatctccttctcctctgcagtggcagtagtaccagctgcttctagtgatcatggtgaaggaagaggagatcatggcggaggcaggaggaggacgcggcggctacatggacctgcttggtctcggagaagacgactacctgctgtgcctgtccccttcctcctacttcgcttccagcgtcgtctctgccacgaccaccagcgccaccaccactgctgccgcgtcgtcgcctacctgcgcctcctacctggacatggctcctgcctaccaccacatgctgagcttcgctggccaagatcagcagtaccatggcgacggcgtcctcggcttccagtactacggcgccggcgatcatgcgattccggcggctgtcccgcagaagtccagcccgaccaccgagtgctcctccatctcctccatgtcgtcctcgccgcctgcgacggccatctccgccgtctcctgctcaaagccacaggctttcaagaagaagggatcaaggagcagtgagcaaagaaaggctgcgtctgccgccgccgccgcccccgctgctccggctgctgctggtggtggtgctacgaaca

SEQ ID NO: 26031 - DNA, 653 bp, Sorghum bicolor
  unsure (1)..(653): unsure at all n locations
  Clone ID: 30969523
aggtatcgaacattatggggatcgaccctaaaccctttaatccaaaacatatgtggaagaagatgtttttgttacagatgaatctgggactaagaaaaggatacggctagaggacaatattgtgcggtggagaactgttaggaatgcagatggcactacatcttgtgaaagcaatgcacgctttgtaaaatggaaggatggaagtatgcagcttctgattggcaatgaggttcttgacatatctgtacatgaggcacatcatgaccagtcccatctgtttttgaggcatgggaagggaattctacaatcacaaggaaggcttttgcgcaaaatgcgatttatgccatcctccttgtcttcaaagtcacatcgcttattaactgccctggttgattctcagaataagaaaaccgttaagatgcaaaaatggtttgagactaaggatcctgagaaagcgaaaatggaaagagaaaggaatcagagccaaactattcgagcccattcgatccttcaacgcanaagagaaaaagtgaactgcaagtacacacaacctgcccggccaaggcgacaactttctccagggttcttagaagacgctctagatgaggatgaggagccagactatggttctcggcgaatgacaggtcgtagac

SEQ ID NO: 26032 - DNA, 660 bp, Sorghum bicolor
  Clone ID: 30969535
ccagactgggaactattgtaattttgtcacaaagtaaccttagccagtacatagttgtgtgcaccaattttaaccccaactttgttgcaatgaacctgaaatacatgtcaactttgtccctctatatggttgcccggatgatgatatgactagaggaacatttcactttaccctacaatatcaatgcataacaaataatatggttagcccattccaaaatgtagttcttttagttttgtactaagtcaaacttcctaactttgactaagttcatataaatctgcactaatatctgcaacatcaaattaatttcactaaatctaccatgaggtattgtatatattaatacattttttctcgaaacttgatctaagttagagaagtttgacttaagataaagttaaaatgacctagtgaactacatttcagaacggagggagtaactactttgccggcccacttaggctttcgaccactagcctgcgtagttgcatcttcgttttcactatagcgcttttactgagattgaattggcggcacatatgaatgcatcttagacccctttttttggcaacttattgtcagttgaattaatacaggctctttcttcatcttgctgcaagagaatttcgatgtgttcaactgttcattcatgtatat

SEQ ID NO: 26033 - DNA, 629 bp, Sorghum bicolor
  Clone ID: 30969536
agggcagagtgggttttagagccctcgtacgcggccgctaaaccaccggatctattggtcgttccccggcgccgacaaggccaaaccctagaaccctgccaagatgaggtcgctgcgagcggcgcagaccctagtctcccgttccctcctctccgcgcgccatctaaacggcgcagcctcccccgccacggccgccgccgccgcgggcgcgcggtggtgcgccacgccggcgccggtgccgccgcctcgttcgccgcttccgtcttcgaaggtgatgcctgccggggttgccggcgcagtatccttctcccttaccttcgctactgtagcggcggcggaggccaaggccaaggagcggccacagccggatctgttgccgcagaacgtggtgctgtaccagtaccaggcctgccccttctgcaacaaggtcagagcctttttagactatcatgatataccatataaagttgtggaggttaatccattgagtaaaaaggaaatcaagtggtctgattacaagaaagtcccaatattgacagtggatggtgaagagcttgttgattcatcagatataatcaatatactacagcgcaggatcaaccctgatgaacccactaatgatgaggaag

SEQ ID NO: 26034 - DNA, 616 bp, Sorghum bicolor
  Clone ID: 30969549
aatacacagcagcgacgaggaccagagccatccagcaccgaccacggatgacagagtggccgggaagaggccaatggctgtggagccatcctctacggaagcaattccagcgaggacggctgcagacccttcgatgggccaaggctcgactagccatgcccccaagcgtcgccggcttgtgaggattgtcgacgacgacaacgaagaggacaaggcggcccaatccttggtccgaagaccacgcagccgccctgacgtcgcgccgagcgacgctagtcgggtaaccagggacccgcctgccgcgcacgtcgagccgatacgtcctggaggaacagaagcagcagcggtggctgggtggaccaggagatggttcttcacgcgacgcaccggagctccgacctgtaagttcaaaaaagtgtctctacaatctcttttttgtatgaggtttggtgtcgatatggcaatttgcattaactcttctttgttagtgcggcctcggatgttgatccgggcaacgttgcctgcttgaggacaaccgagccggtagttgccgatgataatgccgccgagcagaccgtccgtgagcagcccgtggagcggcccgcagttgtggcta

SEQ ID NO: 26035 - DNA, 616 bp, Sorghum bicolor
  unsure (1)..(616): unsure at all n locations
  Clone ID: 30969551
acctggcatccagagaggaaggggagggaggaactcggggacacagaggggcgtccggaatttcctctgcttccgtttaccgcgaaacctctgccttgaaggaagaatccgttcctctgcttgatctgtattcttctggaggagaagagaaggggaagcggaggaggattgatagagctggaaggtgaattgggcacagagacgcgcagtatttgaagctcgtcgcgaaatggagaaggaggggaggaaccactaccacacgcggggctcctcgcgcggcggcggtgggggcaccgctacggagcgcgacctgctgttacagtggggcaaccggaagcgccttcgctgcgtcaaggtgcagcgccgcgacgtcgaggccgccgccaccgcggctgtcgagaaggcccagcgccgcgccgcggccgcagctgccgcagccgcccagcaccacccaaccggccacacccaccgccgtgttctcaggaactcagaagagtttgcaatcatgaaatcgccagcacgccnacnacagaacaacaggatccacacggttgcttcaccagacagggagtgccctggtagaggtaacaacaacaatggagttccacagacctat

SEQ ID NO: 26036 - DNA, 661 bp, Sorghum bicolor
  Clone ID: 30969553
aaaaaaaaactctttgccttccagcctcaaatcccgtttccccatcccaacaatccccgcgaggagaaccatggcgcggtactctccaccgtcgctgcgccgcttcttccgctgcgccgccagctccgcctctcgagccggaggcagcggcactgggaagaagaaccttgtattcttgggctcgccgcaggtggccgcctcggtcctggacaagctgctgggcgcgtctggctccccggaatccgcatttaaggcggctgccgtcgtgacgcagccgccggccgccaagaacagggggaggaagctgttgccgtcggccgtcgcgcagttggcgctcgaccgcgggttcccagaggaactcatcttcacgccagaacgagcccgggaggagtcgttcctgtcggccctgaaggaagtggaaccggatgtttgcgtaactgctgcttacgggaacattctgccccagaaatttcttgatatcccatcgtgcggcacagttaatatacacccaagtttgttgcctctatatcgtggtgcagctcctgtgcagagggcactgcaggatggtgttgcagaaacaggtgtttcccttgcatatactgttcgtgcattggattcaggtccagtgattgcgtgtgaaaggttttctgttgatgaatgc

SEQ ID NO: 26037 - DNA, 659 bp, Sorghum bicolor
  unsure (1)..(659): unsure at all n locations
  Clone ID: 30969562
tagatcgcacattagatggtgggagacgaggtgctggtgaatatgatcgtattagagcttcaatactggacgaagcagccattgtattttctactctgagtttcagtggatcctcaattttcagcaggatgtcccgtgcttttgatgttgttataattgatgaagctgcacaagcggtggaacctgcaactcttattccattggtccatggctgcagacaaatttttcttgttggtgacccagttcagttgcctgcaactgtcatttcacagactgctcagaagttgggatatggaacaagcttgttcaaaagatttcaagctgctggctttccggtgcaaatgcttaaaatccaatatcgcatgcatccagagattagtatgttcccttcaaaagaattttatgaaggtgtactacaagatggggagggtctcagcaggaaacgtccatggcattcctacagctgctttggaccattttgtttctttgatgttgatggcattgaatcccagccatctggaagtggttcttgggtaaaccaggatgaagtggaattcataactctcctgtatcaccaattggcaatgcgctatccagaactcanatctagtcctgaagtgggtgttatatcaccatacaggcatcaagtaaaactattg

SEQ ID NO: 26038 - DNA, 658 bp, Sorghum bicolor
  Clone ID: 30969564
aaccgcactcccacacgctgtcggccatgtcgcaggggtcggaggcgggcactgctgctgctggggagggcgacgaggagaagcggctgcgggctgcgctgcgtcacctgcaggtggaggcgggggtgctggagcgccttgtgtacaagcaccggaaccagcaccgcggcgccgcctacttccagtacctcctcaaggtgaggagggacctgaagcttctgctcggcgccggcctcgcggaggtcctcaacgccgtgttcccagttctcgcatgccgcaagccggccaacacgatcctcgtccccaccaagcagactaagaagaaacctggtgcaaaccacagccatcatgagaggcttttgggtgttgcccgcttgttatcccagatgtctgaacctgttatgaaggcagcaattcagataacttttttacttgctagatcattcttcgttgatctttgcacggctgtgttctctttgcttgcacgagtaagggtcctgatccaacagatgttacttgatgttgtgtcagtatacaataaggtcaccgatcttactgataggaagcaggctgttaagattagcatcagtggagtgcaggctttcagagagtactacccctctatgaatgatgcatgtacagttctggagtgtgtatg

SEQ ID NO: 26039 - DNA, 656 bp, Sorghum bicolor
  Clone ID: 30969566
aggtgaaccggcatggcgacggtcgcagcccgccgcctcctccagcagcgatgggtggccggcgggcggtgccggctgctgggcacggcggcggaggcttctcccggcggggagggtgcgcgaggaggaggtggtggatctggcgacgcgatctacgtgaagaagccggcagccgccgcggccgtgacgacgcgggacgagacgtcggtggcgatgccgacgtcgttcatgacggggtcggtggttgggaagcgcttctaccgcgacgccaccgtgcggcgcgccgacgacggcaacgggtggaccgtgatgctggactaccgcacgctcaagtcgccggccaagcggccgctcaagctgccctcgcgcgcgctcgccatggccatcgccgccgagtgggagtaccaggaatcagatggaattcgacctttcacaatgcctctcatgaagcttgcttgcactgcattggagagagttcctttgacacggagaaaagtaattgataatttgatgaagaaatttcatcaagatttggtattctgtcgctcacctgctgatagtgaactgaccattggagttcatcaaaagcagaaggagaaaattgatcctattctggagtgggtagatactgaatttgggttcaagcctattgtcta

SEQ ID NO: 26040 - DNA, 629 bp, Sorghum bicolor
  Clone ID: 30969594
ggtatgccgagttcagggatactggtttggagagatcagagccactcaggaaggatttggaatggttcaggcaacaaggtcacgcgattccagaaccatcagctcctggcattacgtatgcttcgtctctggaagagccgtctgggaaggatcccccggcatttgtttgccatctctacaacgtgtacttgggtcatactgctggaggccgaatcatcggcaaaaaggttggtgagaagatcaatctccagaaagagctggagttttacgagtgggagggtgatctgtcgcagatgcagcagaatgtccgggcgaggcttaaccgagtcgcttccggttggtctcgagcagagaaggaccgctgcctgggcgagatggagaaggcgtttacctgctcaatagacctccgccgccatatgtttatgctcccctgattttgtctatcaatacggtttacatgtctgcttccatgtttagttgttattgtcaataatttaaccctgttgctcaggaaacgtcagatactgtgtgtttcataaaatacgccatagaattgggcaactagcatggagaatgtagatgattgtatctctttctgctttctgtaattctggaaattaacagattat

SEQ ID NO: 26041 - DNA, 321 bp, Sorghum bicolor
  Clone ID: 30969636
caagttcctccgcaagcccaagacgtgccccgtcaacaactacctgccgtgccgcagcaaatcccacagctccagcgagccggccgccgacgccgtcacagaggaggaagcgcccgcggagtacaagtcccggacctactgggcgctgcatccttgagggcactgcactgattgataaagcgcagagcgctgtgcgtctcgtgagcgtgaaacgactgatcactcgcctggcccgttgtgctcggcgggttgtgttgatgtgtgtgtgtaccaatgtcgaatgtttccccttctctcataatcgatccacggttgaggccc

SEQ ID NO: 26042 - DNA, 637 bp, Sorghum bicolor
  Clone ID: 30969643
ggtgacatgagacaagctttgaacaacctgcaagctacatttagtgggttccgctttgttaatcaagaaaatgtgttcaaggtatgtgatcaaccacatcccttacatgtcaagaacatggtgaaaaatgtgcttgatggaaagtttgatgaggcctgcgctgcactgaagcaactttatgatttgggatactctcctactgacattatcactactctcttccgtgttgtgaagaattatgacatgcctgaatatctgaagctcgaaatgctgaaggaaacaggatttgcacacatgagaatatgtgatggtgttggatcatttcttcagctttctggtctacttgccaagtttgcgctcgtgagggaaattgcaaaagcaccatgaactcgtgttgcagatgataatagcttgtgtcgagttgtgttacttggtaatctagttatttcagttagcagtgctgtcatgcatggcttaatggcttcagacgtaatttatctctgtaatatagtgctttctgtagaaactatcatgtttatccaatgtggcagatctaactgtcgtgcggcacccatgaaccatcctttttcttctgttgccccgaatgccagctacgttttaaaatggattggtgttt

SEQ ID NO: 26043 - DNA, 544 bp, Sorghum bicolor
  Clone ID: 30969645
cggtgccgtcgcgcaccttggggccacgttcctagcgtccaagttcgccaagaacaccaagcgtggcgcggcgcagcaccagaagaggatcgacgacgtgtccaccatcaagttccccaagctcgccaagcccgacgagccggacttctccttgcataccgacgacgcgctgtgactgacgactgacgactgaccgactgactcgatcgatctcatctgtgatgtgagtagcgcgcggcgttaattatattggcgtcatctccatcgataggtctctctcccatccattccagttccacccgtcttattcaactcttgtcctcatttccttcactcacgaaggtaagagtacaagccatgcatgctgccatatgagatcgatcgatcaatcgaatcgaagcatgagccggccgcttgtagctgtagatagatatgcatgatgatcgatggagtcgccgggaatgaaatcaacgtcgccgcgccgttgtactgtatactacactagtgctgatgtagtgaagttaattgaccttaccgattggtc

SEQ ID NO: 26044 - DNA, 633 bp, Sorghum bicolor
  Clone ID: 30969664
ccccaattttccctcccaaacgcgcgcccctccaagctcccgcggcgcaagcgcagctacccaagcgccatggccgcctcctcagccgccgcccacgccgacacctacgacatcccgtgggtggagaagtaccgccccaaccgcgtcgcagacgtcgtcggcaactccgatgccgtcgcccgcctggaggtcattgcccgcgacggcaacatgcccaacctcatcctctccgggcctccggggaccgggaagacgacgagcatcctggcgctggcgcacgagcttctggggcccagctaccgcgaggccgtgctggagctcaatgcctcagatgacaggggtttggatgtggtgcggaacaagatcaagatgtttgcccagaagaaggtcaccctgcagccagggcggcacaaaattgtgatcttggatgaggctgacagcatgacaacaggagcacagcaagctctgagaagaacaatggagatctattcaaacaccactagatttgcactagcatgcaacacctcatcgaagataattgaacccattcaaagccgatgtgctattgtcaggttctcaaggctttctgaccaggagatccttggccgcctcatggttgttgtggcagctgag

SEQ ID NO: 26045 - DNA, 656 bp, Sorghum bicolor
  Clone ID: 30969666
gcatcatgggcctcgtcttcttttcccacctcatcggcaacatgcagacctacctgcagtccatgacggtgaggctggaggagtggcgggtcaagcgccgggacatcgaggagtggatgcgccaccgccagctgccgccggagctccaggagcgcgtgcgccgcttcttccagtacaagtggctcgccacgcgcggcgtcgacgaggagtccatcctccagtcgctgccgctggatctccggcgcgagatccagcgccacctctgcctggccctcgtccgccgcgtgcccttcttctcgcagatggacgagcagctgctggacgccatctgcgagcgcctcgtgtcgtctctcagcaccaaggacgcctacatcgtgcgggagggcgaccccgtcagcgacatgctcttcatcatccgtggcgagctggagagctccaccacggacggcggccggaccaacttcttcagctccatcacgctgcgcccgggggacttctgcggcgaggagctcctcacctgggcgctcatgcccaacccgagcctcaacttccctcagtccacgcgcacggtgcgctccgtcacggaggtggaggccttcgcgctccgcgccgaggacctcaagtacgtggccaaccagttcaagcgcctgcacagc

SEQ ID NO: 26046 - DNA, 593 bp, Sorghum bicolor
  Clone ID: 30969693
actctcctgccacatgccacccgcattgctcagctagacagcctctccctgtccggctgtccctgtgctgtgttgatcgtacgtggttccatccagcacttcgtcttcgtcgccatggccatggcgctcgcatggctgtccgctccccgtgccgccctctcccacctcgatggcgtcgtcgtccccgcggccgcgagtcgcttccgctccgaaacggctgcccgtgtgggggccgtcgtgttccggccgaggacgaccgtggtttctgccgcggcgcagaggagcctggtcgcggtggcggcggcgacggcgacggtccctgctgctgcgggaggggatgatgaggcaggcaccccgcttatcgaggagatgcgggcggcggccatgcggctgcactcccgggaccaggccagggacgggaggaacgaggctcaggcgcccatggagcctcctatcgccaagtggcagcccaccgtcgatggttacctccgcttcctcgtcgacagcaagctcgtcttccacacgctcgaggccatcgtccaccgcgccgccgtcccctggtatgccgagttcagggatactggtttggagag

SEQ ID NO: 26047 - DNA, 615 bp, Sorghum bicolor
  Clone ID: 30969698
caagatgacaaaagctatgggacatggactgcccatagctgttgctccaggcaaaagaaggcctcatgaacctgttcaagcagccaagtttgcatctgagtctggtgtcctcattcgggacaacgttcctatcctacctcattggaagaactacaagaacgatgaaaaatattacaacgagtttgtgtcaaagctttgcgggcgcttggccataaacaaaacggacgagccaaccaaggaagcttgcaccgatatgctgcgctcttcggtgcgacaaatgcgctatcggctgaagaaaaagtacttcaatggtgtgcctgcaaatgaggttcggacatcttctccagtttcatgcatgtctgatgatgagtggaatgcactgactgcaaagtggaaaaatccaaagaacttggaaacaagtgaaaagaacaagactaatcgcagtaaagtcaagtatcatcagactaccggctctcgtagctatgtggcacacttgcatgcatataagaagcaaagtaacaatgcagaaccaagcactcaccaaaatgaagaacttgatgtggtggaggccttcaagacctgccataccagctccaaaaaaggtcttgaggaatc

SEQ ID NO: 26048 - DNA, 508 bp, Sorghum bicolor
  Clone ID: 30969722
accagtctttctggctgccgtcgctttcctgcgctcccacagtccccctccacacctcccctccccttccctcccctccacggcgtcgctcgctcgctcacccgcccgcccaaagctcccgtcccgagggtttcaggtctgttggcccctagctcctcgtccgcttcccgggccgccgcttttaggtgtgacttccgcatctgctcctgacggggatcgctggttggtttcttcctccagagatcgcatctctggtccgcgggatccgatgagatgcgcggctactcccgcagtccgagctcgtagcaggcatggctgaaccggccgcttcttcttcttcttcgtccggatccttcgccccgcgccgcctctatggcgccggcgtcgtcagggacgagctcccgtacagtggcctcgccgccgcacccccgccgcctcttccgccggtgcaggtgcaggttgcggcttccggcggcggcggcggaggaggcggaggaggaggaggagg

SEQ ID NO: 26049 - DNA, 603 bp, Sorghum bicolor
  unsure (1)..(603): unsure at all n locations
  Clone ID: 30969724
aacagctacagcgtccattagttggcccggcaatggctagggctcagcgccttgctgcgctgctctgcctcgcggtcgcggcctccctgctgtccctgggcgcacaggccaccaccggcccccgcgcgagggtcggcgtgtacgagctcaagctgggggatttctccgtcaaggtcaccaactggggtgccagattaatgtccgtcgtccttcccgactccaaagggaatttggctgatgtcgtcctgggcagagacacccacgctgaatactttaacgacacttcttacttcggcccgataaccgggcgcgtggcacaacgcatatcaaggggccgattcgtcctcgacggcaaagtctaccacctgcaactaaacgacggcaacaacacgattcacggtggtggcacagcgttcagcaaaagcgcctggacggtgaaggagtacgtctgcggcggcgactccccgtacatcaccttgtactaccacagcttcgacggagagcaaggtttcccggggagcctcgacgcgtacgtgacgtaccgggtgacgagcccgtacacgctgggggtgcacatgaacgcgacggcncgggacaaggcga

SEQ ID NO: 26050 - DNA, 377 bp, Sorghum bicolor
  Clone ID: 30969753
gcaatggttatggtacacatttcctcctttataaacaaacttggtacctgttgtctttttgtttattgatctgacacatgtttcttctgcttattttttataggttttccttgtcattggtgaattgtgaagcattagtcaatgtccattcactgatgtccttagtgttaagtctctagaaaataagagacgcaacccacccactgtacatatgtagctgtagcagtgttctgcaaatgcagaaacgggagccaggccagtcgtctgaagggtgtgagccatgttgttaaccttatcattccaccatcttgtggacatcgctgtgtatttctttcaacactgttgcatcgaacagtcattttttatgacaatttagt

SEQ ID NO: 26051 - DNA, 522 bp, Sorghum bicolor
  Clone ID: 30969775
cataaaaaatacttgaactttattcgatgtgatatttgttggtgggtcatatgtactgaatctgtgaatgttttggtaggtaacataataaatttcaacattggtccattagttgatttagacgtccctcggagcttttggagtcaggtttcagggaagtatgggaacatgttctactggaaagaaaagggagaggacgcctcaattgaagctgctgtgacggcaatatcacgctgtttaagaaacccccccgggacaaataactgttcggaggtattatagaaagtaaataaagagttatctcgcccaaagaaacacggaaaggacaagtgcatgtgtacagaagtgaaccattagaacaacagagactatagatgtctcatcgtctccagagcattaaaggatttactttttcaaattgagagcatttatctggttgtgaatatggatattttaacaatgcaagtgtggactttaaaaagtctaaataagtcattacaaataatcatgctagaacgtttt

SEQ ID NO: 26052 - DNA, 542 bp, Sorghum bicolor
  Clone ID: 30969788
agaaatttgtggaaattcctgggtgcctgtacacggtcaatcccattgctgtgaatagcaagtattgcaatgtattcactgagaataaaagagttgtctcaataatatcaacttccgagtttggaaaggtagcatttgttgcgattggagcaaccatggtaggaagcatcacgttcttgaaaaaagagggtgactacatccacaaaggagatgagtttgggtatttctcctttggagggagcacagtgatatgcgtcttcgagaaggatgcgatccaatttgatgctgatctcgtggcgaacagcgaaaggtcactggaaacccttgtttctgttggtatgactctgggcgtctcgacaaggaacaaggggctgcaagtcccggatctgcagaaattctcacttgaatgacttaagtaatatatgatataattaggacgacgtccaacatggtagatggctgtaaattgcgtgcaggttaacagtagggtgtataggcagctactagcaaccaccacttgattgaaaacaaggagattgaag

SEQ ID NO: 26053 - DNA, 565 bp, Sorghum bicolor
  Clone ID: 30969793
tcgccaacggcctcaacgtccgggggggctccaactccaacgacacggtccccgtcgcgtccatcgtcttcggcagcccgcgcgtgggcgacgaccagttcaagaaggcgttcgagtcgccgtcgacgcccggcggcggcgcccggctgctccgcgtccggaacgcgccggacatcgtgccgaccatcctgccggccgcgttctacagggacgtaggcgtggagctgctgctggacacgcgcaagtcgccgcacctcaagaggcccgggccgggccccgcggcgtggcacaacctcgagtgctacctgcacggcgtcgcgggcacgcagggcgcgggggacggcgccgggttccggctggaggtggaccgcgatgtggcgctggtgaacaaggaggtggacgcgctcagcgacgagtaccccgtgccggcggcgtggtgggtggaggggaacaagggcatgacgagggacaagagcgggcgatgggttctgcaggatcatgaggagggtaatctcgccatgtgagatgatttttttttggggggtagcaaataagaatttcttcg

SEQ ID NO: 26054 - DNA, 529 bp, Sorghum bicolor
  Clone ID: 30969803
ggtatgttaagaatggtggtgtccatggttggaatctcatgcgcaagctgactagcagaggtgcaaatgtttttgcacaaacgttactacagcttggagcttcagatttaaccggatcatttaggctatataagcgagatgtcctggaagacttaatctcctcatgtgtcagcaagggctacgtgttccagatggagatgattgttagggctactaggaaaggttatcacattgaagaggttccaataacatttgtcggcagagtatttggaatttcaaaacttggtgggtccgagatagttgaatatttgaaagcccttgtttatttgctgctcacaacatgattgaagatatgtagtaggcttctggtttgtgggtacaaccgtgttatagagaattttaatgatgtgttattattgcagcttgagctgtatatcagtacaattacgcatgtttctagtgggtgggttatggtactcaagtcttgctttctttgtacattttctcacacaacatagcgcccctcctt

SEQ ID NO: 26055 - DNA, 618 bp, Sorghum bicolor
  Clone ID: 30969830
atacatgatcagaaactgagagtggcaagcgccaagtagtagttagagctcagtagggatacagtttgtgagtcacttctctgacatccacgggtaccagtttacactaggtgaggaatgaactccttccttttgattccactctgatttgctcatcaagtttcaatgctcccttcaatcattcttaagctctggaagctaggagtgaggtgctttcaggcttacctagccttgcttctcattgtagaaagcatagtttttcatgacacattcaaataacagtcacaatgatttcagccttctattttcagaaagctgctataggcagattttagccttgtgtacagttattcttctctctttcttttccttcctctgaatgtaatgttgcatttctcgattccagttcagaaacttccgttcttaaagttgcatagtattcacctcttgtttaaattcacttcattgcaggttgagagggataggagtgagaagcagtactgtcagaatgcccatggagcaagcattcaggcactgcgataaagacacgctgaagatggccatgctgaaacatgaagagactttcagacagcaagttcacgagctccatcgcctata

SEQ ID NO: 26056 - DNA, 341 bp, Sorghum bicolor
  Clone ID: 30969849
tgcttgtttatgctgcttattggtattgcacacaaaatattctgcatatttatcgttttgagttggttttggtaatcttacctaatttgtacaaggggaaaaagaacgttagtacacgagtttggtgctgatagcatattatcatcctagcgatgttttccttcgatccacattggcattatttgaactgtttgctatacaatttcagtgcttgtatgtttggaacctgtcagatacaccacatgagtgaaagtattatcaatactagaaaatctttcaagaaatgttgaaaaagtttaaatgacataaataattgtcatgcctcttgatgaacacttcaa

SEQ ID NO: 26057 - DNA, 613 bp, Sorghum bicolor
  unsure (1)..(613): unsure at all n locations
  Clone ID: 30969859
caagccgaggtagcgatgcaggatgagttgaaggcaatacaagaagagaaggatgcagtgctaacacaactgaagcagtcagagacttcagtacagaatcttgagaatgaggtgacccgactgaaagaggagctttccgtccagctagaaaacaattccaccttgaacaagcagttggaagaggcaatgttgaaagtgtctaatctacatgagaatcttgagaaggcccaggctgaagcagcttgtcaacttgatggcatgagtacaaaaacaaaagatctggagaagacaatcaatctattgtcttctgaaaagactaagttggagaaggatctgaaaattatgattgaagcatgcacagaaaacatgtcatttctggcaggatttgaagatagagttacacaaaaaatttctgatcatgaggcaggactgaaggttctccaccagagccttagaggggctgttggtagctgtcagaggcttcagtacgcatatgatgaggtgtccacaagggcatcacatcttgagatacttgagaggagtcagatggagcagataggtcagctagagcagaanaacacagaaactttggagaaacatcggcttctggaag

SEQ ID NO: 26058 - DNA, 650 bp, Sorghum bicolor
  Clone ID: 30969867
aaccgttcgtcttcttccctaacgtcttgcagaacaaccgcaccaacctcgtcgccgttatccgttcgccgcccacggccaagagcgctttccatccctcgcgtccactgctgcgccagccggaccccgcaccccctcgatgctgctgcttcctgggccggggagctcgccggcgctgtgccatggaaggccgcggcctccggcgtgctcgccgtcgccgtctccttcacctgccttgttggttttgccaatgccagaactggggtaaacaaaccagaattgcttcctaaagaatttactaccgtcatcgatgttgctggttttctctcgtcaggccaggaaaaccgtttgcgccaagagatagaagacctggagaaggatacaggatacaaactgcgagtccttgcacaaaattatcctgatacacctggtgagctttttttaactatatatatggtactcccttggcttgctttccgttgtttcatcactatttccattaaagatacttacaatcttggtatcttatttacagtttcctaacttggatagtcaatctcttcttacgataacttgattaaccacgtgaaaatgaccaaatatcattaccttaatgaagtatggtattgttgtttttgtgctacagcaga

SEQ ID NO: 26059 - DNA, 626 bp, Sorghum bicolor
  Clone ID: 30969868
acaggcgcacaccaacaagcgcagcgatggcggccgccggggacggacagacacagacccagccgcagcaggagccggagccagtggcgggagcggcgactggaggcggcgtggtcgcgaagctggaggaggagtggcggaaggcgaaggagcacgcgcagacctacccatacgtgtggagctcctacatcctcgtctacggcggcctcggcgcctacctcgcctggcgctggcgtaagctccgccgcaccgaggaccgcgtccgcgttcttcaggatcgcctccgcaagctctccgcggccgaggaatcgcaggtctccgcccccggctccgcttccactgcctcgacccctccccggccgcagcagtcggcttctgggcctggaaagcccgcgtcaagcccgtgaaggagtaagcttcttctttttttcagcttcttgagatgacggattgcaagttacagagcgatttcggaatcatttgagcttgttgctgtccttgttacttatttggttggtgatctagttcagaagtaaaggtggaggattacaatacaaagtgctgagacgtaatcgaatcatttgggggaagcttaaaattttgtagatcacgtgtggtcattccca

SEQ ID NO: 26060 - DNA, 202 bp, Sorghum bicolor
  Clone ID: 30969886
acccgccgcggtcccgcggttcgtcttcaccaactttgtccgaaccggatgggccacgcggcgtcgcggcccaacaatggctgcgccggcgacggcgacggcgactgcgaggtggtgctgccctcgcgcttcgcgcgcttccgccgccgtctccgccaccgcctccaccgccgccgcggcaacggcgaccattcggcctccg

SEQ ID NO: 26061 - DNA, 648 bp, Sorghum bicolor
  Clone ID: 30969891
cttgcaccttgcgcccgcccggttggccgcgcctgcgcgcccccggcctcggcctcgccccgacgggggggcgttggcgttgcctcctcccccacctgcaccccatttcagagcccgctcgccacttgtcaccgcgcgcgccccgcctccgcgtctccgcccgcccgccccatccggctataaaagcctcgcccgccccaaccctagacgccgtcgtcgtcgccgccgccgccgccactgccgctgccgctacctcctcgctcaccggcatggccggcatcaacaagcgccgcacctcgccggcctccacctcctcttcctccggcggcgacgtcttgccgcagcgggtcacccggaagcgtaggtccgtccgccgcggggcccggaccgccgcccggaggccgtcgtcggcgcctcgacctataaatgaactggacttgaatacagctgctcttgatccggatcattatgctacaggattgagagttcttcttcaggaggagctccgaaatagcgatgtaagccagcttgggagaattgttctcccaaagaaggaggcggagtcttacctccctattctgatggcaaaggatggaaagagtttatgtatgcatgacttgctaaatgcacaactttggaccttcaagt

SEQ ID NO: 26062 - DNA, 613 bp, Sorghum bicolor
  Clone ID: 30969920
aaggaacaaaagctccgatctgaaattgccgaggcagaaaagaagtaccaggaattgttagtagagctcagatcactggacgtgaagaaagagaaataacgaactctccacttcattgcctgctatacaatggattactcttgtttctttgctgacttgtgaagatgatgactggattacttcccgagacctgcagctgtagttacggaaggactggtcccttggacaaatgttgttatctactgattaccattcacttggttccgttggacagctgtaggtgtgtaatttcgtttcactaatcttcctagggtcctgtgatgatggaaagtgagcatgtatttttttttgtaaaagtatgtaacttttatccgagtgtacagcagcggttttcaatgttaatggccctctgtttccagcaacactgcatttcggtttcgtgtcaaaagaggtgtattttgttccggcactctgcagtggatagagttagaattagactatatacattgtgcagtatgtcaagtgacttttcgtactcgttacagtcttaaattcgttgtgctgtattatgttatgttattattgagacgagggggttagtcaaccctttttc

SEQ ID NO: 26063 - DNA, 658 bp, Sorghum bicolor
  Clone ID: 30969937
cgccggacacgccgacgtcgcgcggcggggaggccaccaagaccgacgtgttcacgtcgccgctcggggacatggacatcgacatcgacatggaggcggagcagagcgcgatgcagcggcagatcatggagatgtacctgaagagcatgcagcagttcagcgagtcgctggccaagatgcaactgccgattgagctcggccgcggcgacggcatcggcagcggcgtccagaaggaagagacgcccgacaagaagaaggtgatcgagcggcagcaggcgaagaaggatggggcaagggtgttctatgggagcagagctttcttctgaagtctgaactgaacaaaatctgcaggaggaacacaaatcccttgcaaacttgtagagttcatggtttgttcatcattactttctgcttgccaattggtattgttaacttaattcgttggatcagtagaacaacatcacataatttaggagagagtaacatgtgagctagaatttggcggcgagaaactgtagacactagacagttggattcgttcacatgttctgaaaagccaagtaaagagtgtgcagtgtgtgagatatggcaaagagctagtattgcctagggtgtttaggtgtattctcatctcatgtatcaaatcaaagggttttgg

SEQ ID NO: 26064 - DNA, 677 bp, Sorghum bicolor
  Clone ID: 30969938
tctccaaatggtcaagcacatgctgtgtacgagctgacctttagtctgactggctttcttcacaagttaggtgttttttcccctttaacacacaggagagctatgtgtcatttctttgatatgtaaagtatctatgatttaaagaatatatatacactctgcaagatagcaaaatacaatggcaacatgttagacaaatgagatgaatctcaatatgattaattctcatataaactaacttgaaaatttccttttctggctctgcttattttttgtaacattacaatcaaactcaagtatctggcagctatatatgtatttgtgatatggaggcaggtgagattcccaaactacgatgtcaaatttgctataaggtttaacactcccagtcccgtcaagaatatcatgtaatgttattttgggagcttcttcattcacatgtgctatgcggtcatggttgtgaactacacaatattgagtagaatcagacactctctgtagaagtatatgatcatcattcatcttatggtcgcttagccttttcctgaatccaggttcattttgccgcctgttgttcttgaagcattcgagaatcctgttccagttctgcacattaacactagactttaaacccgtagctgttttattcaaatatagaaaggtccagcaaaagactt

SEQ ID NO: 26065 - DNA, 646 bp, Sorghum bicolor
  Clone ID: 30969950
ctcaaggagaagctgcagccggtggtggcgaccctcggtacgcggaagaagggcgccaacctgcagggcgtgttcagcaagatcctgggcgcggcggtggcgggcgggctgcgcagcgacatgatggtgaagagggtgctcgtgctgagcgacatggacttcgacggttgggctggctccgcggcggcgtgggagacggagtaccagggcatcagcagtcggttcacggacgctggattcacggcgccggaggtggtgttctggaacgtggggacgtcgaaagcttccatgccggtcgtggcggcacagaagggcgcggcgctggtgagcggctactccaagaacctggtgcgtctcttcctggaggccgatggcaacctcactccggctgccgtcatggccgacgccatatccggctcggagtacgacgcgctcgaggtgttcgactgatctccaccccgtccaaattatgctgctgattgctgttgcctagttatacagtagtaaagtaaattttcttgtctagcttctcctatccggcaatggcaattgtcatggtctctgaagtttagttgccttctggcaggacaggataggactaataacattgtctcggctgttagtatgaatgaatcgatgaatgctg

SEQ ID NO: 26066 - DNA, 666 bp, Sorghum bicolor
  unsure (1)..(666): unsure at all n locations
  Clone ID: 30969959
ggcgacgatgagcgcgctggaggagctgttccgcatcgcgcgtgcgcagtctctgatcgcgctgtgcggcacggtgccgggctactggttcacggtggcgctgatcgacgtggtggggcggttcgccatccaggcgacggggttcctgatgatgacggtgttcatgctgggcctcgccgtgccgtaccaccactggacggggaaccaccacatcgtcggcttngtcgtcatgtacgggctcaccttcttcttcgccagcttcgggcccaacgccaccacgttcatcgtgcccgccgagatcttcccggcgaggctgcggtcgacgtgccatggcatctcggcggcgtcggggaagctgggcgccatcgtgggatccttcgggttcctgtacctggcgcagagccgggacccgggcaagacggagcacgggtaccccgcgggcatcggcgtgcgcaactcgctgttcctcctggccggctgcaacctgctcggcttggtgttcacgttcctggtgccggagtccaagggcaagtccctggaggagatgtccggcgagaacgacgagccggccggcgccgccgcgagctccaaccgcacggtgcccgtgtagtagccagagtagatgcatatgcatgcatgcaaatgctatataagtaaggaacaatt

SEQ ID NO: 26067 - DNA, 644 bp, Sorghum bicolor
  Clone ID: 30969973
tcaggggcgagcgcgacgcgttcaccggcatggactgggagatcctcaccgagctctggaggaagcagcgcgagagcggccaggtggatccggccaaagcaacgcagcaggggatttacgagtcactgtgccgcgacgcgacgatcctgttcagcacatgggagttcgatcccacggagatcaagaacccgttccccggcggggagggcgtcgtcagcatctggcaggggtacgaggacaagatcgtccaggtggagatccagcggtacgtggcgcagaagctgccgtgggtgcggtaccacgagcaccccgaggccgggcacgcgctcccggacatggacggggtcggggacaagatcatcagggagctcttgctcggtgacgacgaggcgccgcgaggcttgcagttgcagaacgacctgcaccaggatggctgagctgaacgttgggagaggtttggtgaagaaattaaacgagtagacattcgcatataactggagaataaacggtgttggcccaaatcagtgcgatggtcgcttgacgagagtttaagatgttaggcgtgccgttacggtgattcagattaggctgtggcagacatatagattcagattcagaatgtgattgaacaatggcatattatc

SEQ ID NO: 26068 - DNA, 620 bp, Sorghum bicolor
  Clone ID: 30969974
tagatgttgaaggtgatgggatggcagatatggcattccgttgcattcaggaaatggatatcgacaaccggatgacgctctatcaacatattgtcctgagtggaggaagtacaatgtaccctggtctaccaagtcggttggagaaggaaattcttgatcgctatcttgatgtagttttgaagggaaacaaagatggcctgaagaaattacgactgcggatagaggatcctcctcggagaaagcacatggtgtacctgggaggtgcagtgcttgctggaatcatgaaggatgcgcctgagttctggataaccaggcaggagtatcaggaagaaggtgtagcgtgcctaaggaagtgcggacagtcataagtcgcaaccgtccaatcctaccacagaagaaatggaggggctcccgatgctgacggaaacaagggccagagcttacaaagccggccatggttcgctcatgaagcgaaggttacatgtgtaaagaagagctcagcactacagctttgttgttggtgtatattgtagtgagctgtcctgaacatgctcgggggtaatactgttctaggggatcatgtttgtattggctactcaattcgacctctgttattgatc

SEQ ID NO: 26069 - DNA, 663 bp, Sorghum bicolor
  unsure (1)..(663): unsure at all n locations
  Clone ID: 30969995
attctggaacagctccttgacaacacccaaattgatgatttcaagcttaatattgatcttagcgttgagttacgaaggtatcagcaggaagggatcaactggctcgcattccttcgtcggtttaaattacatggaattttatgtgatgacatggggctcggtaagacgctccaagcatctgctattgtagcaagtgacattgcagaagcacgtgcacggaatgatgacaaaaatctcacatctttgattatctgcccttctacattagtggcccactgggaatatgaaatagagaagtacatagacacctctatcttgaaacctcttcagtacgttggttcttcgcaggacagagtgacactccgtagtgagtttgataaggttaacgttatcataacatcatatgatattatacgcaaggatattgattttcttgggagtatcccttggaactattgtgttctggacgaagggcatataataaaaaactcaaggtctaaaataacgtctgctgtgaaacagttgaaagcacaacaccgccttatcttgagtggcacacctattcagaataatgtgttggagttatggtctttatttgacttccttatgcctgngtttcttgggacagaaaaacaattccaagctacatatggaaaaccattg

SEQ ID NO: 26070 - DNA, 632 bp, Sorghum bicolor
  Clone ID: 30969998
atcttcggtcggcagcttaacgtcctctcctccgttggaagagaactctgatcgtctcatgtgtgcagcaggcagaccgacgagtggaaatggtcgctctctccaagctagccttggtgtctgcagtggcgctgctggtctgctgggcgtaccaggccacccagccgccggccccggcgatcctgggcgccccaggagggccgccgatcatctcgcctagaatccggctcaaagacggccggcacctggcctacagggaggaaggagtgcgcagggaaaccgccaggttcagggtcatcttcttccatggcttctcctccaccaaggagagcggcttccccgtgtcccaggagcttgtggaggagctcggcatatacatgctcttcttcgacagagccgggtacggcgacagcgacgccaacccgaagcgcagcctcaagagcgacgccacggacgtcgaggagctcgccgacgcgctgcagctcggggacaagttctacgtggtagggtgctccatgggcggctacccagcgtggagctgcctcaactacattccgcacaggctggccggagtggctctggcggcgccggcggtgaactactggtggccgctgctgcctgccaacgtgtcg

SEQ ID NO: 26071 - DNA, 673 bp, Sorghum bicolor
  Clone ID: 30970027
tgttggcctctggattcacctttggttcatgatgatggggatatggagcttgatttcaactctgacaaaaaggatatcctcattactggggcccacaagatggtgaaaacaaataatccagagaagattgctgctcagaaatacgtctcaactcggcttcgcttttctcttagagcatatgcatctatcttgtatcttcatgtacccgatactttcagaattatcctgcgtggacgtgatgtggagccacataatatagttaacgatttgatgtatcgtgagtgcgtgttgtataaaccacaacttgctggacttacagagtcatctgtaatcacaaccattgggtttgttaaaggtgcaccagacatagatgtacaagggtttaatgtatatcacaaaaatcgtttaatatcgcccttctggaaagttgcaaacaactcatacgggaaagggcgaggagttgttggcattctggaggccaactttattaaacctacccatgacaagcaggattttgagaaatcagtcctctatcagaggcttgagattcgcttgaaagaaatgacttatgaatactgggaccttcattgccatcgtgttggttatgacaataaaaaattacctaaagcaatccgtgctgttaatcgcgccaatcatatgaatggtggcagtt

SEQ ID NO: 26072 - DNA, 633 bp, Sorghum bicolor
  Clone ID: 30970039
agagctagcttaattagcacacagcattccagcatctccatctccttcaagttttgttcaagttgaagctctgcagcatccttcagattcatttggagcacgtccagggctgcactgccacaaatcccgccgcgcgcgggggctgcgctgcgcaaggaaatttcttccatcaactcaactcggtcttccgccatgtcgtcatcgtcgggccagcagcacgagaccggaccgccgccgccgacggcgttcaagagcgcgtccacggacggcaagagcggtagccgccggagcacgcggttcaaggacgaggacgagtacgtcgaggtcacgctcgacgtccgcgacgacggcggcggcgacgtcgccgtccgggccatcaaggacgtcgtccttgccggcggccccggcgtcttgggcgacgcgcaggacgccacggcgctcctggaccccccacccaccggctctgctgctgctgctgcctcggggggactgtcgtccaagctcagggccgcgcgggcgcacctcggacgcatcgcctcggtcaagcgcgccgccgtgccgctctcggcgctgctccgccgcgaccgcgaccgggaccgggaccgatccagcaggctcgacaggagcgtcgtc

SEQ ID NO: 26073 - DNA, 641 bp, Sorghum bicolor
  Clone ID: 30970044
aaaaaaaaaaaaaaaaaaaaaaaaaggtggtccaggcaccagcacaacattcttcttcctagctacctctctctggcttgatttctgactgccatggagtcggcggcgaggtttctgcgcagccggccggacgaaggcggaggaggagcagacgagcagagcgccggcatcgtgcgcctctcgctcgccctccgcccggagatccccgaagacgacgcctgcgacctgccggcgggtcgcggcgccgacgccgagccgtccatcgcgtcggaagttgtcatccttggccccgcgccgcccgtggactactcgaggatcgagttcacggaccttagagtggagcaggagaacgacgccatggctgtgcagtacctgccgttcctgcgcaccggggagaccgtgctggcggaggactgcgagatgagcgcgagcccgcgcgcgcgcggagagaagtcatcgacggcggcagcgtcctcggacggcagcatcagcaggaacgccgccgcctcgacggccagcacggtcagcgaggacagggccgtctcttcttctgccgatgcggcagagaagccgccgtcgctgcacgacgtcgacgaggccgccacggcgcccgtgtcccgccgctcgccggacacgccgac

SEQ ID NO: 26074 - DNA, 665 bp, Sorghum bicolor
  unsure (1)..(665): unsure at all n locations
  Clone ID: 30970045
aacaggtgggcgtttttgcaaatattccgggccggcggcgtggcgccctccgggcaaggtcgctcggccccagcgacggcgaccgccgctagccccgccactaggaatctggcctcgcctctgtcagatccacgcccccagcttccgtctccagcgggcacctcgatggaaggccgcccccaactgctcttccgcagcagcaccggccgggcgcgctgaggcctaagagcacggtgccgagagccgcagagacggacggcgacggagcgaaacggcactcacctacaggatacatgacggtaaggtggcgccgccgcttccggcgagcggctctgtcatcgccccgcaatgaccggcggcctcccgattccgggtattatttcttccataatactctgcatcttgttaccctcactctgaactccgatgtcaagcatgactcttcgttgcaatttaccctgcaagagtattatggggggtttgggactgttgtgctctacgtttttcagctccgctctatattgtttagccaaacggtttcagctccacacacttagttcgagaaaaaatagtggagttatgagagcacctaanaaagatactccacaaacttttttttagagctgctccatagtggaggttgtggagcagagtttgtggggcag

SEQ ID NO: 26075 - DNA, 659 bp, Sorghum bicolor
  Clone ID: 30970053
aacgctctcccccctctctctcattcctgtcgtctccacctaggttagttttccccctttctccttagttcatgagagagatcacttgagcaaaaattcatggttgttttctgagatttttggaagttgggaatggaggccctaacctctttttttcctctggacgtagagatcagagcagagttggtttgtgttcctgttctttgctctcacgagctactgttcatcagttttccccatcttgattcgtgtttgttttgagttttcttttgggatgtgtttggtcagattgatgctttgtcaagtgatgaacaagatcgctaagtgatttgagctaattccacttgtgcatcaagaaccaagcagatttgcgttttgagagaaaaactcgttcttgtctcaaatctgaatatttcctagagtttggattaatcctaggcgatgatttcttgaggatagattcgtaataagtcgagtttctcttgtgcaatttttgggaatttttcatggagatttggggaggttttcgttgaatttcttggagccacctttttctgttttctctttaccatcttcgtcgggttcttactgtgctttcgcgaggacacccgtgagccactagtgctagtttcctggtcgtgtgcatctcctggccaagt

SEQ ID NO: 26076 - DNA, 649 bp, Sorghum bicolor
  Clone ID: 30970055
catcttctacgtcttccagttccaggcttccaaagttgcaaccctcgcctccctcccctcgatctcgcgtctatcgaaaccccgccgccgcgcgccatggccccagccgccgcccttgtcggccctccgatcgctttcgtcgctggtgccaatctaccgccgaagccgatccgcagctcatcccctgaccactcgtccgatgagatctcaccctcacccatggacgaagactcgcctgcgccaggacggacgatgaaggaggaggtggtaccgcagtccgggcggccgctagcgtacgcctcctctggggacccctgcgtcgacttcttcttccaggtcgtcccaggcgtcacctccgacgccgacctcgccgtgctccttgacgcggcctggtcccacgacgcgcgcacggccctcaagctcgtctgccatctccggggcgtccgcggcctcggcaagtccgacagagacggcttctacgctgccgcgctctggatgcacgagcggcacccgctcaccctcgccgcgaacctcgccaacttcgccaagttcggatgcctcaaggacctccccgagatcctctacctcgtcctccacggcccccgcgacgaggatcaggaccagcgcaagggtgacgaccgtcgccatc

SEQ ID NO: 26077 - DNA, 555 bp, Sorghum bicolor
  Clone ID: 30970067
ccatggtcctcaagttcctgattggcccgatcatcatgctgctcgcctcgctggccgttggaatgcacggcacccttctgcacattgctgttgtacaggcggctctccccctggccgtgacctcattcgtgtatgcggaggagtacaaggtccacgccgacatcatgagcactggggttattctcgggatatttatctcgctgcccgtcacaattgtgtactacatactgctcggcctttgaatttggattgaatttatgatggatgagtatatgtctagctagattgattaagaaaagggctcccgtcatgtacaaaatctgaagcgggcacaaccgcagaagaattggtggttacacagctcagatgagtcagatcgagatgcaacaccatgcagggaaatgttgctgatgctaccaaaaatcaataagattaccgtgtgctagctagacaataccttaactacatatgttctttttagaaatagtcccttgtaatatgttccaaaatatctcaatgtatatatagcaggcatgcaatagaaacaattcatgc

SEQ ID NO: 26078 - DNA, 602 bp, Sorghum bicolor
  Clone ID: 30970084
tcgggcttgatatgctgcggaaacatcagtgcatgattgacctaaaggacaatgttctcagagtgggaggtggtgaggtttcagtgcccttcttacaagagaaagacatccctgcacacatacatgatgaagagaaattgtctaagttatcctctcttggccaagcaactggagaatcatcaagggcacgtgagggtactcccaatccgccacaacaaacccctccttcaggagctccagttgcaaaccctccacagggaggagattttgaagcgaaagtcacgaagcttgtggagcttggttttgacagggcatctgtaatacaagcgctcaagctgttcaacgggaatgaggagcaagctgctgcattcttgtttggtggttagactcgtgagagcagccgtttctggctttctatttgctcaaccctttccagggttgaatatttgatatttaagtgattaaagaactaggacattgtttggccagttaaagggcttacttttagagatccttcatattctcttgtttctgagaacaaacacttttctgtacctgatatatagactttgtagacacgtgaatgcagacaaaactgtaac

SEQ ID NO: 26079 - DNA, 646 bp, Sorghum bicolor
  Clone ID: 30970097
cataggagcaaagaaggcaggagatgaacagactgcctctgtgccccaagtccatgagcatatacacatctctgccgcactgccagctccacaagcgttccatgactatgcaggccccgttgcggcagaagctgatatgctcgcgatcgtgccacaagctgatgagatattcgacggcatactgaactccctgccagaaataccagtagcgaacgtcaggtactccgacttcttcgacccgttcggtgactccatggacatggcaaatcccctgagctccaataacccctcggtcaacctggccacacatttccatgacgagaagatcgggagctgttcgttcccctacccaaaatccgggcctctgatgtgagatccaggcagaaaagcaatctgctgggtcaaaccatccattcccccctgcatggaactcagagatcccctccttgacgccattgctgtacatccaaataattggcgtcctcattttgtatgtttactagtatatgattgggtaaccgtgttgtttatgtgtaaaagggtaactctgcaaaactgaactgaacattttacatcagatgcaacgctgcgacgaggctctggtgtttctcgcacctcgtgaatgtgcaggtacaatggtagtcat

SEQ ID NO: 26080 - DNA, 465 bp, Sorghum bicolor
  Clone ID: 30970101
gactttcgtgcttcatgtttctgtcataagaagaccatcgacatgggatatgtctgttcagtttgtttgtcaatattctgcaagaatcagaagaagtgttcaccctgtgggtcagaattcagtcgtgtcatgcctgatttgaattccatgccagatcaaagcaagtagtactctggaaagttaaccatcaagagacatgcttttttcagtgtcacaggacggaccatgcccccctgtatatccaaagggatggtggtttaaccgaaggcaataagtggtgtagcataggcagtgacaattttgttaaggaatcgattttagggcaaacactattgcttttggaacatagttctggcaagaagaaatttgcaaacttggtgatagtgatctgttatgaattgttgtaaaaaagaattaagacatactactgatgaaaataccatggcatggttgcccttactgctt

SEQ ID NO: 26081 - DNA, 561 bp, Sorghum bicolor
  Clone ID: 30970103
tacacacagctccagctcgcgtccggcaatataaagtacttctaccagtctcggaagagccagcggagcctgaaggtggcggtggtcggcgacaaggtgcccctgtacggcggcgggtcggggctgagcagcacggcgacgacgcttccgccgcccaagaagcgcgcgccgccggtggtggtgccgccgccgcccgtgccgctgcagctgacggtgcggctgcggtcgcgcgccttcgtgctggggaggctggtgaagcccaagttctacagcgaggcacgctgcagcgtcaccatggaccagaccaagctcggcaagcccgtctccctcaacaaggcctgcacctacacccactagctaatactcctgccgccgtcgccgtcgtcttgaacttcgccgttgttcttgaattctccgatctccatcgtgttacactgcctgcgtgcgtgcgtgcgttatatctggattggatgggagcattgttggtcggttgtgtttgtacagaggaatttttggtattggagagttttgttgagatggaataagaatcaaacctttctg

SEQ ID NO: 26082 - DNA, 415 bp, Sorghum bicolor
  Clone ID: 30970107
gaaagctgggatagatttctcccaaagttcaagaagaagaatgtcaagcagaagaagcctcaaactaaggagaagaaaccatacacaccctttccaccgcctcaacagcctagcaagattgatcttgaacttgagaatggtgagtatttcatgagtgacaaaaagaaatcagcaaagaaatggcaagagaagctggagaagcaatctgggagagctgaagagaacaaaagaaagagagaggctgcatttgttcctccaaaggagaacactgcaggtccatctgaatctgacaagaatgccagtgacaacagtgagatagctgatatagcaaagtcattaaagaaaaaggcaaaggaatttagaaagaatgaggcccaggagagtgttatagctgaatcatatctcgcaagtaatg

SEQ ID NO: 26083 - DNA, 657 bp, Sorghum bicolor
  Clone ID: 30970138
acggctccaccactcctccgtggctccgtccgtcccgtcggtctgccgctaggcgctactgccgccagcccgccactcctccgttcgcccagtcgccggccaccggccggggcctgccgcccccatccactgcagccgccggcaccgcttgcagccaccggacggtgtggtagcttgcgagctaaacagccagagctagtcaccgagccgagctggccccaaaccaaaatcgcgccgccactaatctaaagccctaaacccatgacgccgccgccgcagccgcagcacctccctctccatccccagaaccccagcctcgcctccctcaccctcacctatggcgcgacatcctaagccgcccgcgcccccgtccccgcccccgccgccgtgcccgccctcggactcggaccccggcgtcggcttcgaccccatcgaggagtggctcgtggacttcgacccggccatgtcgggcgagctagcggccaagggtctcggcgccgctgagcaagcggcggcggttccgcatacgctggtggagacggcggcgggaaagagcttcgagctcgagtttggtgtgatggacgagaaggtcgaggtggtgagcagcagcggattggacgagctgcttgctccggatcagcttctggtgtcggggat

SEQ ID NO: 26084 - DNA, 657 bp, Sorghum bicolor
  Clone ID: 30970139
atggcttctcctggattcatttccgattaccaaaaacccttccgcccaaacacaaactttcgccgtccggggagaagcggcggcgccggatacgggataccatggcggtggcggcggtcgcggggaagctgggagcgggaggtgatccggtggcggtggaggttctcctgccgcctctgtcggaggcggatccccttcacgcagagaagaagaggatactggaaaataggaacctatcttgtgaaattcagattcctgttacatgttctgctgccgatgccctcaaattactggatcagattattgaagctgctagggtagtgtacatggatgagctagagctttattttgcaggagatgatgtcggtccattctctgcaaggaatgaacttgaatctctaaatgttttgttcaaaacaatgaaaaaattgcttctaacttccaatgccgctgccaaggaagtactacagatactacaggatgagatagttgttaagctgaaatctgttggaaagtcagacgatgcttggatggttgttcaaacacagaaccatgatgctgaagatcctcttctgaaatggggggagcatcttggtgttaaatctatattgcagatagccttttttcagggagctggaagaggaatggtagcttctg

SEQ ID NO: 26085 - DNA, 650 bp, Sorghum bicolor
  Clone ID: 30970141
cactgaccccagagtcccagtgccagccgccagcgctcgctctccctagcccccgccaccgccgccgccgccgccgccctacgccaggtgccgagtccttcgccggcgaagagcgcccactagatccgagcttggaagaggaggagggaagcgaagatgctacggcggaatatacgtcagcgtcgggagtacctgtacaccaagagcctcgagggcccccagcgggcgctcttcgagaagaagcgccgcatccgggcggcgctcgaggagggcaagcccatccccaccgagctccgcaacgaggagcacgacctgcggaggcagatcgacctcgaggaccaggagcgtcaagttccgaagagcatcgttgacaacgagtacgccactgccaccgttcgggagcccaagatactcttgaccacgtctcgcaatcccagcgcgcccctaactcagtttgtcaaggagctcaaggttgtcttcccaaactcacaaagaatgaaccgtggtggtcaggtcatatcagaaattgtcgagtcctgccgctcccatgatataacagatcttattttggtccatgaacaccgtggtcaacctgatggtttgattgtctcgcatctacctcatggtccaactgcatactttgggttgct

SEQ ID NO: 26086 - DNA, 646 bp, Sorghum bicolor
  Clone ID: 30970151
aactatcacctgaaacagtaaggatattctgggagtccaaaaaatttgaaggatctacgagttctgctgagccctggtacaacacaccatattcagttgaaaatgtcactccttctgtgatacagcaatggattaaaaaagctcctactgagaaactccatctcccaaaatctaatatcttcataccaaaggatttatctcttaaagaagtgcatgaaaaggttatttttccaacagtgttaaggaagagcccactttcacagttgtggtataagcctgatatgctgttctccacaccaaaggttcacattatcattgatttccactgtccattatccagccactcccctgaagcagttgttgctactgagctctttgttgaattgttagtagattatttgaatgcttatgcttatgatgctcaaattgctggtttattctattcaatatatcttacttcagctggattccaggtttctttaggtggttacaatgacaagatgagagttctcttaaatgccatactagtgcaaattgcgaattttgaagttaagccaaacagattttctgccttgaaggaaacttctgtcaaggactaccagaatttcaattttcgacaaccttattctcaagctccatactatgt

SEQ ID NO: 26087 - DNA, 662 bp, Sorghum bicolor
  Clone ID: 30970161
gcactactaccataccataccacaacaatcagtcacaagatccagagcagcaagcaagaactactgcttcgttctgtctagtctagttatatatatatatatatcgacgacgaaggtttagtgagggttcctttggttgtcgattgctagattgattgttaatttgcagctggtttgaaagggccgatcgacagccatgatcccgggatccgcggtgtaccacgtcgtggaggcgatggcgccgctgtacacggcggcggtgctgggctacgcgtcggtgcggtggctcaaggccttctccgacgagcagtgcgcggggatcaaccacttcgtggcgctctacgccgtccccgtgctcatcttccacatggtctccaccaacgacccctaccacatgaacgagcgcctcatcgccgccgacacgctgcagaaggccgtcatgctgctggcgctcacggcctgggccttctggtcccacttccgcaggcggcgtgacggcaaggcgtcgtcggcgtcggcggcgtcgccgatcaagtgggtggtgaccaacttctcggtggcgtcgctgcccaacaccatcatcatgggcgtgccgctcctggacggcatgtacgggtccgtctccggcgggctcatgaagcagatcgtcgtcatgcagttct

SEQ ID NO: 26088 - DNA, 634 bp, Sorghum bicolor
  Clone ID: 30970197
agcgccaggcaccgcacctccacctacctattctactactacctgcagtgcacacagccagaggagccagccgcgatgcagcagcagcagccgccgcaccggcacgccaagacggactcggaggtgacgtcgagcatggcggcgtcgtcgccgccgcgggcggcctactacgtgcagtcgccgagccacgacgacggggacaacaagacggccgcctcctccttccactcctccccggccgcgtccccgccgcggtcgctggggcgagcgtccagggactcctcctcctcctcccgcttctccgccagcgccaagagcgccggcggcgccggtgccgccggaccgggaggcgtcgcggccgtccccggcggccgcggccggcgacgcagcagcccgtggatgaaggaggcggccatcgaggaggaaggtctcctcggcatggacgacgacgacgacgacgacggctccggaggccacggcagcgggatcccgaagcgggtgcggtacgcgctcggcttcgtgggggccttcttcgggctcttcttcttcttcgcgctcatcctgtggggcgccagccgcaaccagcggcccgtcgtcaccctccgcgccgtcacgttccaccgcttcgtggtgc

SEQ ID NO: 26089 - DNA, 562 bp, Sorghum bicolor
  Clone ID: 30970201
ctctcccagtcgcccggccatccccgttctcttctacctgccggcggcaccctaatcaaccctaatctgtacggcgaccctagcctcatcacctcatcttcctgctccagttcctcgaaggtccagccggcactagcccctctttcttctcagccatggcgtcggaggacgaagcgaacgccgcggcggcggtggcggaggatgccgaggcggcagagggaaggaactggcggcggaaggggaagcacgacaagcccaagccgtgggacgaggaccccaacatcgaccgctggaagatcgagaagttcgaccctgcctggaacgagggcggcatgctcgaagtcagctccttctccaccctctttccgcagtaccgagagaagtacctgcaggaggcgtggccgctcgtgaagggcgcattgaaggagtacgggatctcgtgcgagctcaatttggtggagggatccatgactgtttcgaccaccaggaagacaagggaccccttcattattgtcaaggccagagaactgattaagctattgtccaggagcgtccctgcacc

SEQ ID NO: 26090 - DNA, 435 bp, Sorghum bicolor
  Clone ID: 30970208
atgtgaaatcagaagttggaaacagttttgctggcccaagtaggctacgtgacatctgttttgtagatgaaaggataaaatccagcaaggaggaatttatggagctacaagcccttgttaaaccaaattcgttaatgcttggtgtgtggcttcccccagaactgcgaaggtccaaatgataatttgggatcttagtttcttatgcatttactgccagcatatcatgaatccagctctctgatctgtgatatcaatatctttttcctggagtttcctgttggtcacgtgaaatctttacactcttttgccaactaaaggagtttcattgtggtctaccattgtccatgtaaacattttcatggagtgtatatccttacccacacccattctgtgactttttttaaatcaaagttcaatgaaagaattccgtgggcc

SEQ ID NO: 26091 - DNA, 644 bp, Sorghum bicolor
  Clone ID: 30970224
aagaagtgatcatccgtgcactgaaatccgccttctctatcaaggcaacaagagtagaaggtctcactggtgtttgggttggggatcagaaagttgctgcgatagggattcatggttcgcggatgatagtttatcatggtctcgcactaaatgtcacaactgacctagctccgtttaaaatgattgatccttgtggcataaaggaccgtggcgtggggagcattaaggagatactacagaaggcatctggtgcaagagaaattgatgatgcatcactgatggatacagcatatgattccatgatgaaagagtttgctgaacttttccaactcagtctagacttcagccctgattgcagtttccagtaaagacaacaatttcaactaaccgtatgatgttctagtctggacgaaatgtttgccacagcctttcatgctgaatcattctatgttgtagtatagcacatccacctttcaggcgcaggatatctctggaatctggagtagtcgtgttggtttctcgtcatgggctctccggtgtttatatagcatcaatgctctctctcttttttttttcttggtatgcaacagtgtatacttaccgattcttccattttacccggtaataatatcccattgagcgtt

SEQ ID NO: 26092 - DNA, 646 bp, Sorghum bicolor
  Clone ID: 30970261
cgtggacgatgtgagtctgcagatctgggtgcgtggagaaggaggagagtccaggtggagcgacagggggtggtggctgcagagggagatttgcatgaccaaagtgctcgacaccgtgcctgggctacccaaggacaggatgatgcggatgctctgcacctggctcagcgacatggactacgctcgcaccgggaaggtgttcatctgtacatggggatatgggcgctactcgttccatctggagaccggcaagctggagcgcttggtgatgaaagatggcaaggagcatggagaccctatctatgcctacaccttggcatggccgcctcagttcctcgctgctccaagaaactgactttctggttgttgaccagtgagagaagataacagtgacgcatacaaatcagctcacctctttggttctgggggttacgagtgccgttcactaagctctttgttccgtatgagactgaattaatgttgaacttgtcttttcgcattttcggattagatggcattctgaagaccgtagtagggtgtgccacgtacgttatgctggttcctggcaaaacatttctatgcttgcttgtcatgagatatttgtccctttagactaagatgccattttgaagacattagggtggaa

SEQ ID NO: 26093 - DNA, 459 bp, Sorghum bicolor
  Clone ID: 30970262
gcgggggcgatggaccgggagatgcagacgaaggcggaggggatgaggcaggtgctggagatggcggacgggctgcggctcgagacgatgcgcgaggtggtggcgctgctccgccccgcgcaggccgtgcacttcctcctcgccgccgccgagctccacctcgccgtgcatgacttcgggcgccgcaaggacgggcacgccggcaacgccgccgccgccgccgccgcgccgccggagtgacgctgacgcgcctggctgctctgctttgcgtgtatcgtgtaatggctcccctgttccaagcggcgcatggctgcgcgccttcgcgcgttcgtagccgtgacgccgcgcttgtcccctagctacccataaaggctgctggcttggtcagcacgagctgtcgcgataagcttttgaacattttgttcctctagctgttttgaacatgtcgattttgtaaaa

SEQ ID NO: 26094 - DNA, 657 bp, Sorghum bicolor
  Clone ID: 30970284
ggatcctcatggcgccccgaggcaagtgccgaggccgcaagcaccaaaccctagcgtcctccgctgccgcttcccctcgcccccgggtgttggcgcctgcaccagcgatggagactacgacgacgacgacggtcgccgacctcacggacttcatcctccaggccatcctcgtccgcctcacgcccgccgacctcctccgcgcggcgctcgcctgccaccgctggcgccgcgccgccaccctcgcgctcccacgcgtgccgccgctcctcggctacttcttccaccccaagggcccctccagcccacccccgatgccgacgacggacaagacccaccaccccgccgtcttcctcccgctcgacgccgccgccgccgcctccccgcgcctctccctcgacctcaccaagggcttcgccagcaccctgtccatccaggacgtccaccacggcctcgtgctcctcacccctcactcgcgccccaagtcgccgctcctgccccgcatcctcgccgtcgacccggcgtcgcgccgccgcgtcctgctctcgccgccgccgcgcgacgcggtgcccgagcgcggggacctctggcgccgcgaaaggtgcgtcattggcgtcgccgtcctcgcgcgcgcgcacccgagcagcctcaccttcgacg

SEQ ID NO: 26095 - DNA, 573 bp, Sorghum bicolor
  Clone ID: 30970285
aacgcccaccgccagccagcagcagagcagagcagccccagcccagcacccccacaggccacagcacatcgatcgccatgcccgccaccttcccgccgccgccgccgccgccgcctccctctcacaaccttcctccgctgctgtcttccaacgagtccttctccaagttcttcgagtcctggatcggcgagcagtcccgcgacctggaggagctccgcgccgcggcgtccgcggagccggccgcccccgaggccgacctccgccgcctcgtcgaccaggtgatgggccactacgcgcagtactacagcaccaaggccgcggccgcggccggcgacgtgagcatgatgttcaccccgtcctggacctccaccaccgagaacctctacctctggtgcggcgggtggcgccccaccgccgcgatccagctgctgtacaccaagtgcgggatgcagctcgagcaccggctccccgtcttcctcgacggcggcggcctcaataaggacgacctcagcgacctcagcgtcgcgcagctccgggccgccgaccagctgcagcaccgcaccatcagcaggg

SEQ ID NO: 26096 - DNA, 671 bp, Sorghum bicolor
  Clone ID: 30970296
gctggttcgagaagatcgccggcgacttttgccattttggatcgcatccatttcctcctccctccggtaacgactcaatctcccgctccgacaacgtccatggcggccgccgcctccgtctccggcaccggcggcggggcgcggcttgtagaccgctgcatcgatgcggcagcgcgcggccccgccactgtggaggcctggcgccggcagcgccgctccctggagcgcctcccggccccgctcgccgacgcgctcttccgccgcctcgccgcgcgtcgcctcctcttcccctccctcctcgaggtgtttagccggtcagtggaggaggttgacctgagtggatttctgtctgtggacgctgagtggctggcgtaccttggctccttccggttcctgagggtcctgacgttggcagactgcaagaacatcgacaatgacgctgtctggtcactctctggaatgaacacattaaaggatctggacttgtcaaggtgcaaaaagatctctgatgctggcatcaaacatatagtgaccattgaaagcttggagaagctgcacttatctgagactgaattgactaacaatggagtgatgctcatttcttcactgacaaatctaagtttccttgatctgggtggaattctcatgacagacaaaagcttacagtcttt

SEQ ID NO: 26097 - DNA, 667 bp, Sorghum bicolor
  Clone ID: 30970313
ttgcgctcgcctcggcgcctccgcccatcgccgccggcgcacgggggagcatcaaaggggccgtacccgtcgcgcgcgcccccatcgccacgcgtgcaacgaggctggcgccgtcgccatggccctgctgccgtcacccctctgctccccgtgccaccaccgggccgcgcccgcgcccttgccggcgcccactgccgcctcggcgcgccactggaggggaagcctgcgcctcgctgcggccggctcccgctcaggccctaccgccgagacgaagccccgtcccacctccgccgacaggaggaggtgcgaatgctttgacctccatcggcagttgattccttatgctgaggcttactgttggcagaagtctatcgttgagaggaggaaagggttgatagacacccgcgaagaccactctgacaccttgattgctttgcaacatccaccagtttatacgttgggcactgatagcaagaaggaatacctccatttcgacaaggaagatgctcctttcgagattcaccatactaatcgtggtggggaagtgacgtaccatggccctggacagcttgttatgtacccgattatgaatttgaagtatcacaaagaggatgttcgctggtacttcaggtcacttgaagaagtgatcatccgtgcactgaaatcc

SEQ ID NO: 26098 - DNA, 657 bp, Sorghum bicolor
  Clone ID: 30970344
cagctctagctacatgatgaagcaccagcagcttaaggtgttcctttccatgctggttaccacaggcactggtgttcgagtagccatctatcagtctacgtggttgttttcctacaaacgaagattgcatctgcatggtatgaaatgctcgagacagcatgaattcaaatacctcctgtccatgagatttcttgcttttccattgcattttgagaaatttaggctagagcttcagtcctgtattgtccattcaatttgttgttattttctcttgccatgcctttatgcttcttggacttggatattgatacagttataactaactactgacactgaccttggaagccattttgaactaaagatgcaggtttagtttataattactgcaactaaccagtttataacatctgaagtttattcatagactcctctgttgcagtttataacatctgaagtttaatttatagacttctctgttcaacagagcatcgatggcatctgagtatttgtctatgattctgatcgtgaaactaatggtgcctattggtgaagacagttgctagtgatgataactccatcataaactacttgtctccagcttgagtattgactacggataacttgagtaagggaagaaaagtagaagatcccagttgt

SEQ ID NO: 26099 - DNA, 625 bp, Sorghum bicolor
  unsure (1)..(625): unsure at all n locations
  Clone ID: 30970357
tcgccgcagtntactcctccacccgccgccattctttcgccgccggcggcggcggctccctctcagtggtcgtagtcgtcgtcgtcgtacccgttcagcggcgagctggtggccgcgatgcaggagatgatccgtgccgaggtgcgcaagtacatgtccggcgcgggcctacgcgccggctgcggtcccggcgccgtcggcgaggcgggcatgccgcagctggtggagggcgtcatgcgcgccgccgcggagcgcgtcggcgtcgtcacacggccgtagaagaagaaaatcccaaaccaaaccaaaccaaatcagatcgaaccaatgcgaagcattgtgttaattaagatcccgtccgtcctgtgtagcagcaactacgtagactactactactacaactgctagtcgttcttgtatggacccttcttgtatttaggaagagaagcacgcgttgtttattcgtcgccggcgggtgccgctctgaattcagaaagaaacagagcggcggcggcggcgaaagccggaagcggaaacggaggttggcaaataatcatcgagcctgccatttctatactcgggccttgtttagttcaccttgaaaaccaaaaaattttaagtttccgtc

SEQ ID NO: 26100 - DNA, 660 bp, Sorghum bicolor
  Clone ID: 30970360
ttgtggcacaatttagcaacaaggctcccagttttgcaagatttaactactacccaccgtgtccaagaccggatcttgtctttggcgtcaagcctcactcagacagtggtgttcttaccattcttctaatagacaaagatgttagtggactgcaagttcttagagatggtgtgtggcacaatgttccaacgagtccttacaggttgctgattaacataggagactacgtggagataatgagcaatgggatcttaaagagcccagtgcacagggcggtcaccaacacggagaaagagaggatctcattggccatgttccacggcctggatcctgagaaagagatagagccggcagctgctctgttaaatgagaagcaaccggcacggtacagaacactgaaagccaaggagtacctggctgggttctatgaacatttctgtaaaggaactagattcatcgagtctgtgaagatataaacgaggtttgatgtctctcattcccgactatgtaacaaagaattgtttgtctcacattacggtttactcttggagttgctctgatggtccctctgtaagggtacaattactgtttactccctccttatgaaaaaacataaaatgtactttttggacatgttgtccataaatatactacgtattc

SEQ ID NO: 26101 - DNA, 582 bp, Sorghum bicolor
  Clone ID: 30970362
agatcgagcagaacgtgacgaggacgtgggcgaggcgccgcacgacgtactaccgctactcggtgacggtgaccaacaggtcgaggaagaccgtccgggagctccacctcggcgtctcggagctccgtggccggctctggggcctcgacagggcaaggtacgggtacgtgccgcccaagtggctgccggcgttgcgcgctggtaagagcctcaggttcgtgtacgtccagcacgggacgccggccaacgtctgggtcaccggctacaagctactctgaagttcagtagtcgccaagtgatcgactgtggcactgtgctagtagcatgctaggattggagtttggtgagtttgtttagctgcaccggcaccgcgatttggttaggttgctatctcgctgaggatggagtgaagagatcgtagtaaaatatgcgcgagtgctcatcctcttcctcccaagaccaagagtattagtattcagtgtgtcctattttggttaggatggcaagggaccttgagagatgaagtaattaagtgctcatcctcttgcccttgcgagttatcgaatgttatatcagaaattc

SEQ ID NO: 26102 - DNA, 629 bp, Sorghum bicolor
  Clone ID: 30970374
gataagaagtacaagcgagaaacgcgattcacatcacaatgtcctccgaaagaaatcatcgatagaatagaagaagctgctaagccacttgggttcgatatccaaaagaaaaattacaagatgctaatggagaacccaaaagcaggaaggaaaggaaatctaaatgttgagactgaggttttccaagtggctccatcgcttcatgtggttgagctgaagaaggcaaagggagatactctggagtttcaaaatttctacaaaactctgtccacagagctgaaggacgtcgtttgggcgtgtgatgatgaaatccaagacagaagctcctcgccatgaaacagttgcaggctttcaggcttacagaacttagtggggggcccaaatgaggaatacagtgttagttttgcctgtacatagctcttgtttgttccaacttccaaacgataagtttagtgcccagtgtacatataggcttcgctagacaaatacagcagaaggttttctgccaaatgatggtctggaatgaatgaagtggtcgatgtaacatagatcagaaggctggttaagttgttgcagtgaaacactgaatatggtgttgagctattgatattaattggttcaatttctcc

SEQ ID NO: 26103 - DNA, 664 bp, Sorghum bicolor
  Clone ID: 30970393
cttcatatgtggtcaatgaagatggagacagaagaagctgtagaatggctacaatatagggtcattgagctggaaaaaataatacctgttgccaatcctaatgatgcaagagttgttgttgttgggtctgcagagggtgtgggagtcatctttgtaagcacagatgttggcttattcagtatagacctcaagtcagagcgggtgaagaaggttgacgaacctggagtccactttagtgtcctaccctacatgagcttttatactccagatcgtggcagattgttgtcactagcgaggggtcagtgatcactgatgtgtggcacagcggtgacacattgcaaaacagacgtatccatttgtctgagtctgctactgtttggcttctccggtgctatactacctatacctaccaaagcacacagctggtctgttttctgttgatcagtttatgtgtgcaagtcataatggtcaactttggttcttgttcggttcatcaagatcttatggacagaaaactgtaattctgtttagtatgttgttttcttatctgttcagcagtttaagtacgagtggtgtaagccatcatgttcaatcctgtttgtcctgcgaattcctccttattatatcaaccacatacagattttctgttcgatagtcaagcagt

SEQ ID NO: 26104 - DNA, 622 bp, Sorghum bicolor
  Clone ID: 30970394
acacggtgctccggccggacgtgtacgcgccgttcgtgagggcgttcgacgcggccacggccgggaggaagcgggtgaccccgccgacgccgccgttcgagctgtgctacgactcgcgggagctcgggtcgacgcgcctcggctacgccgtgccgcaggtggacctgatgctggagagcggcgccaactggacggtgttcggcggcaactccatggtgcaggtcagcgacgacaccgcgtgcttcgcgttcctcgagatgaaggaggagaagcatgagggagggcacggctacggccacggcggtggggcggggacggcgccggcggtgatcatcggagggttccagatggagaacaacctgctggtgttcgatgaggagaagaggcagctcggcttcagtggcttgctcttcggcaggcagacgacgtgcagtaacttcaacttcactctcgctggctaggtagggtacaccgagcaccttcttcgacttgctcatgtgtatgtgccggttttgtatttctcctacgctttttgtatttgtcataaacttgtttttttgttgctgtgtgtgttataaagcatgcgtttaataataaatataatgaaactagagacacttct

SEQ ID NO: 26105 - DNA, 651 bp, Sorghum bicolor
  Clone ID: 30970416
gtcacagacatagacaccaacccatcccgcccagctcaagatggcgcagctcctcctcctcctcgccgtctcggcgctcaccctcctctcgccacgcacggcggcagcagcgacgtcgacaacgtccggcggcaagcccctggtgacagccatcaccagggacgctgccaccaagctgtacacggcgccgctcaaggacgctctgccactggtcctggacctctccggcccgctcctctggtccacgtgcgccgcggcgcacccgagctacgagtgccaccacgcggcgtgcgcgcacgcgcacgcgcaccacccgccgggctgcccgcgcacgggccacggcgtggccgacgaggacgacccgttccgctgcaggtgtagggcgcacccttacaacccgttcgcgcgccgggcagcgtccggggacctcacgcgggcgcgcgtcacggccaacgccaccgacggcgccaacccgctcgcgcccgtctccttcaccgccgccgcggcgtgcgcgccgccgacactgctcgctggtctccccgcgggcgccgtcggcgtcgccggcctcgcgcgctcatggctcgccctgccggcgcaggtcgctcgcaagcagaaggtcgctaggaagttcgcgctctgcctccccggcgc

SEQ ID NO: 26106 - DNA, 646 bp, Sorghum bicolor
  Clone ID: 30970437
aggcgcgcgcttcctgaggctgcgggtcgtccccaacctctcgtccgcttccggccgtgttgacctgacctaataaccacccgcctgcctgcctgccgcacccgcgagacccgtcgtgctcgaggggcacgtcctagatcggtggcgcctgcctctcgccgccgctaccggtgcctctcgcggtctcgctcccgcccccccgctcgcagcgaccttttgtttttttttgtttattattagttcctcctgttggttcttggaggggtttgttgccgtctcctcctccccgcggttcttgaggcatgcagagccagatcgtgtgccacgggtgcaggaccgttctgctctacccaagaggtgctccgagcgtgtgttgcgcggtatgccatgcagtcaccaatgtgccgcctccagcaacagagatggctcgacttatatgtggtggttgccagacattattgatgtatactcgcagtgcaacaactgtaagatgctcatgttgtgacacagtcaatcttgtcagaccagtgagtagcatagctcatgtgaactgtggccagtgccaaacagtgttgatgtatccatatggagcaccgtctgtcaaatgtgctatttgcaacttcattacaaatgttggcggggtgac

SEQ ID NO: 26107 - DNA, 665 bp, Sorghum bicolor
  Clone ID: 30970442
gctcggtcggccggggttcccgtaggggcaggcaggggcggccaaccagggatcgcacgcgctcctcgcggtcgtggctctttcctcattcgctcccgcgcgctctcgcactcgccggcgccggcacggcgaaacccatccggccagcccgcttggccccgtggccctcgcctgccggtggccgccgtcggtccgttgcccttgcaggcagcctgccggagccccgcgtcgccacttgccggcagcaaggttacttgattctgctgcaagactcaactactcggcggtggtgatggcggcggccggtggcggaggaggaagcggagggggaggcaccacatccggctgtggtctgaagcgccgctatgcaccacgcgaccaggaggaggagacgatgaatcaagatcagccttctaaggaagattggtgtgggcgaatttggaatgggatggacttgctcaaggacgccactgaaaacaagcatgtcctccctactggactagaaggcatcgacacacttcttggaggtggcctgcgccaaggtcagctgacagaggttactggaccatcatcttctggtaaaacacaggtctgtctacattctgcttcacatgctgcagtgaagcatatgggtgtggttatgtacttggatactagtaattcct

SEQ ID NO: 26108 - DNA, 557 bp, Sorghum bicolor
  Clone ID: 30970444
gtacttcgttggattagcgacaccggcgcagagaaggtgtcgctggtgcgctgcagaggagcagccaccagatcagaagaggacgagagccagagcccagaggtgaacctcgcggccactcctcatctttatctgaattataatcatacaaatgaaaaaagaaagaggtggatctgaaatccttatgacaaaaatcttcaggtgcttgcatgaccacaatgattcaaatggattggaactttggaagtcccttgggccgtggcttagttatgagctaatagaggaccattatttcatatagtctgcccacctcagtattgcacttcaacttttagttttatcttcagttcttcatttcctgtattagcaagatgcatgcttctataattttggctatacatagacatagatacatagttccaattacccagaaataaacatagctccatttcacatcataaaatcacgtatagattatgcaaaccccatctgttactgtgagtgctcagcaaactaaatttattcacatctcctacattgcaacaccgggacaggtg

SEQ ID NO: 26109 - DNA, 657 bp, Sorghum bicolor
  Clone ID: 30970462
atctcggtaccgcgactcctcgtcgacggcgctgggggaaccggtgcggcggatccgacatgtcggtgattgtatccagtactccagtaaccaccgcaataagaggtgcatcgatctttgatctggagtgatagtagcctggccggccgtcgcgtgctcatacctgctctcttcgggcaccgccttccgccgccaagaccggtgaccggcgaccggtgttacctgtctacgctgcttcatgcctccagcatctcccacaaggccaacaacggcacaaatcgcctccgctcgtggttgattttgaagtctagtttgccgagtggacgaccccaagcctcttggctcttgctaaccagtgaaattcagcaataaactcgaaaaaaataatttcaagagagcaattatggcggatgaatcatggaggattcctatgttagtgcaagaactggcggccaaggtgcagcaaccaccaagcaggtacgtgcagccggagcagtatcatcctgtcagcctagatgttggtgccgagacgccggagcccatccctgtaatcgacctcagccggctgtcggctgctgatgatgccgctgatgagagtggcaagctccggttagccctgcagagctggggactcttcctggtcgctaaccatggcat

SEQ ID NO: 26110 - DNA, 241 bp, Sorghum bicolor
  Clone ID: 30970494
gtttccagtatatattagcttattcttttcattcatattcagttaccaatttggggacatctgtagcaaggttattttttgagccccattagaggatacaattctcaatccatccaattttggggtcagtgtttgtgatggtaatccggactggcgtttccgggctttgaagtgtaatggtttcatttttagacccttgtaataaaaatgggctcacaaaaactcgccctacctcttctcc

SEQ ID NO: 26111 - DNA, 653 bp, Sorghum bicolor
  Clone ID: 30970505
gagatgcgcaaggtccaggacgagatccgcgcggccgtcgccgtcgccggcggcgacctcgtcgtcaccgaggaccacctggagaagctgcggtacctcaagtgcgtcatcaaggagacgctccggctgcacacgccggtgccactcctgctgccccatgagacaatagaggacactgagctgctcggctaccatgtcccagcgcgcacccgcgtggccgtcaatgcctgggcgatcgcacgggaccccgcgacgtgggagcgcgccgaggagttcgtgccggagcggttcgccggcgacgacctcagtacggactacttgcccgggcaggacttgaggttcgtgccgttcggcgcagggaggagaggatgcccaggggtggggttcgctgtgccaaccttggacctggcgttggcgagcttgctgtaccacttcgactgggagctgccgaccgccgcggggtccaagctggagatggacgaggtgagcgggctatccgtacggctcaaggcgaccctgtatttggttgctaaaccatgggctcctcggtaagatcacacagctagcctagcgtgcagtggtttgtctgaatgcatgacgactgactaagtacaaggaataagttagagtgtcaaatgaaaggcataagaatc

SEQ ID NO: 26112 - DNA, 645 bp, Sorghum bicolor
  Clone ID: 30970524
gctgcaacagaggaaacaagatacctgtattgacggaatatgattcgtgtactattccttggggagcctgaacttatcatatggagttgtaaattattttgtcatttcgacttatgttcacttcatcattattgccttgtatgatcatgtaattcagagaccgcagagccaaaggttggctggggcttatgtgtaagcctaggactatattatttattatattcaatagggggcagcggataagttgcccatgatgatccaagaaacatgtgttgtagctgtatgaatacttcctatcagcctcgtatgacaatcagtcgagttataccggtagtcaatttgaagaccgtggcgtcccaaagttgcagcagtggaactgaagctactcacgtcgctgctctatttatgtatgggtatggccttaaactaggtgggctttggaaatttgttctactactagtgctcgtcaacgatgaacctatttatttgtctacttcctatgttctaaatgtggattgttctagcttttctaggtacataggtttttttttttggctacgtatcttgatatatagtatgcgctatatagtatctaaaacagtcagaataatttataatttaaagtggaggaagtataaataggag

SEQ ID NO: 26113 - DNA, 658 bp, Sorghum bicolor
  Clone ID: 30970532
cggaactgccagtggtcgctggacctgctggacgcctgggtgcccatgggtccgcgaggaccgtcgcgcgtcgaggcagggaagctgctgacggcgagcttgacgggccggccggcgttcgaggccgacgatcagtcggcgctcatccacctgctgctgatgcagaaggagaggtggatggacaaggtgcacgtggagacggagttctacctccatggattctggacggggctggtggacaggtacgaggagatgatggaggagcaccacccggggctcggcgacgaccggtggccattcatcacccacttcgtcggctgcaagacctgcggcaggtacgaggattacccgctggaccggtgcgtcaggggcatggagcgcgccttcaacttcgccgacaaccaggtgctccggctgtacggattccggcaccgctcgctcaccaccgccaaggtcaggagggtcaccgacccggccaccaacccgctcatggcaaaggaggcggcgctcaagatggacgccaagttctccagcaactagaagacacagagttatacgagttttgaattttgattgagcaagcagttcttttgcgttttgatttgtcttgtcttagctttctgtttgcaaaagctatagcgcactcgacaggaacttg

SEQ ID NO: 26114 - DNA, 616 bp, Sorghum bicolor
  Clone ID: 30970537
agggtggatggcggtgcgcggcgcggcggcgaggcggcaaagaggaagaaagggggagggttcttcccccagatcgtgctgtcgcttggcggcggcggtaacaggaggaagggtgccccccacaggtcccctctggcttaagctcttggtaacttcgttcatgtccctgctactgctgctcgttatcaccagctatagctagctggtagtagcggttgcagtgacggtggcgtggctattaattagtagtgtgttataatagtcttaatggtgattacccttgtagagatcagacgagagctggttggtcggttgcttggggaagggcctggccttgtggatccgtctagcagctttgctagggccatggccacctcaaggcagttgtgtgtgtgtgttgatgagacttaagaaagatggagagggagagggagagggagaggagacggttgtaaagcagttcccttgttacaggcctaggtaggcactggaaagtggggcccacatttgcaggatggggcccatacgaggtggctaccaattttgtatttgatgtaacaagggttacttgcatacacttccacacctatatataagtaatatataaaattccccc

SEQ ID NO: 26115 - DNA, 653 bp, Sorghum bicolor
  Clone ID: 30970542
cggccgtacgtggcgcagctgccgtggcacggcggcacgcgggcgtggctgtcgaagctgttcccgcgctacggccactactgcggacccaactggtccagcggcaaggaggccggctccgtgctctgggaccgccgccccgtcgaccacctcgacttctgctgctactgccacgacatggcctacgacacccacgaccaggcccagctcctccgcgctgacctggccttcctccgctgcctcgagggcagccgccgcacgcccgcgcgcgacggcatcgccgccgcagtcatctaccgcgccatgtgcatcttcggactgaagacgatcctgatcccgtaccggacgaacctcgtgcggctgcagacggggccgaactacgctgatttcttcgccgattttgtgaagagggtcgcgtcgtcgtcgggcaggccgaccggcggtgagaagcagaggctgtgagcaaatttgctcgcctggtcctacatgtaaggtggtagatcgagccgtagtaatttgtctatatataaggtagctgagtttttttttttatccacaatatggcaaggcaaactgtgtctatttgatttgtagcaaatgatgagaaacttgatgtttctactgtgaatatagcgcaaatgcgatgcccttgg

SEQ ID NO: 26116 - DNA, 543 bp, Sorghum bicolor
  Clone ID: 30970548
ccgccgccaagggcccccacaagaccccgccgccagcgcagcatttcccgcggacgcctcggccgtcgttcctgcagtcgccgccgatgctgttcgcgttccggaaggaggggcagggcgccacccgcgtggagcgcgagcgcgagtccttcctccggtacctgcgcttctaccgccggccctacgacgagatttcctaccgcgccaagatgcgcccgccgctcggcggcctcatatcaatcgtcggcgagaagttcaagcagaagccggtgcagcagccgctgcgtcggcacgccgggctccaccaccacaaccaccattaccaacagcagcagaggatctgattctcatctcggtactgcatctgcaatgcatggcgaccagagaattttctccatacagcataaatccaatgctatattatgctaagttaatcttttgccaactctttttcctctctctccagtacttagtgcctatgatattcttgaagccatgtataataacgtccccaaaaatgtgagtaaaatcgccccctttcgc

SEQ ID NO: 26117 - DNA, 648 bp, Sorghum bicolor
  Clone ID: 30970573
tctggactccccttctttccctctcatcagttctctctcgccagttcgccgctccgcttcccccgttcacactccctcctctactcccactcccaccatctcctcttcttcgtcctcctcttcgtgcaaattgctgagatggccatcgacaaggtggatgccaaggagagggagaagatcgaggccgtccgcaagctgctgcgcaagcaggcgccgctctccgcaaagcaggcacagtactgcaacgacgcgtgcgtggagcggttcctgcggtcgcggggggagaacgtcaagaaggcggcgaagcacctgaggaccgtcctctcatggagggagaccgtcggagctgatcacatcatggccgacgagttctccgccgagctcgccgacggcgtggccttcgtctcgggccacgacgacgacggccgcccagttgtggtgtttcgaatcaagcaggactaccccaagttccactcgcagaaatcgttcgtgcggctgatggtgttcacactggaggtggcggtggcgtgcatgtcccggttcgtggaccagttcgtcctcctcttcgatgcaagctttttccgctcggcgtcggctttcctcaacctgctcatgggcacgctcaagatcgtcgccgactactacccc

SEQ ID NO: 26118 - DNA, 655 bp, Sorghum bicolor
  Clone ID: 30970579
ctggtacttgaatttggtcttttcctggagatccacatcctggaaatatttttgcaatgcgtgatggtcgtattgcttatgtcgactttggcaatgtggccgttcttagccagcaaaacaaacaaatcctaatcgatgctgttgttcatgctgttaacgaagactatgctgaaatggcaaatgacttcactaggctgggtttccttgctagtggtacagatgtagccccaattattccagctctggaatccatttggcaaaactcagctggaaaaggcttggcggacttcaatttccggattgtgactgggaagttcaatcagcttgtgtacaactatccaatccgcatcccagaaaggttttctttggttattcgttcattgttgacgcaagaaggaatctgctttacactaaagcgtgattttaagtttcttgaggttgcctatccatatgtagcaaagcgtctgttaacagatccaaaccctgctctccgtgaacgcttgattcaggtaacttgtttagaccctattaacacaacttaaggactatgtgaaccaaattgttaatttaagcatcagtactggaaaaggaaaggaaactttatggtgtggaagtggaaagtttccaatgcatgctcaagtgcattactacaaat

SEQ ID NO: 26119 - DNA, 645 bp, Sorghum bicolor
  unsure (1)..(645): unsure at all n locations
  Clone ID: 30970591
tggaccgttgttgccgttccggctgccaccacccactatagaattcccgtgagaccaggatacccaccgtcgcctcccgcgtacggcgtacccccatcgttttccacgtctgattgatggagtctctcctcgcatcgcgatccattaggtcttccttctccgccgtcgctagcaccaggggcgcttcctccaggccctcgcgcatcgccactctcgccggcgccggcgccggcgctcgcccgctccgtgccggccccaaggactcgattgttgaggcgctggcaaaggatgatatgctgaacgcaacagaggtggtccaatgggagaatggcatgacagtgaacggcatagcggctacgcaggggattcgcatctgcaggcactgccgccccactgcctccttgaaggagatagaggaggagctgggagcccctcgtaacatcctagagaagatcatttgggacaaggagattgaagtagccgaggggcatgctaagaagcctctggaggaggtgattcaggctgcacagaaggcacctccttcaagagacttctatggtgctttagaagctgcctacaagcgtaatggggtgcctgcgttgattgctgaggtcaagaaagcatccccaagtangggcgtgctca

SEQ ID NO: 26120 - DNA, 581 bp, Sorghum bicolor
  Clone ID: 30970614
tggacactcgcacatctcatggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgtggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttcca

SEQ ID NO: 26121 - DNA, 561 bp, Sorghum bicolor
  Clone ID: 30970624
tctgaaccccacaacagtttaacacgggcggacacactcactagcttaagctaaacctcgctcgccacggcagcaatggcgccgctccccgcccccgcccccgcctccctcctctgtctcttcttcctctgcctcctagcggcgccgtgccccggggcgcgcgcggcgcggttcgcgtgcaacgccacggcgccgcgggcgtccacgtgccaggcgctcatctcctacgcgccgcccaacgggacagccacaccaacgctggccgccgtgcgcacgctcttccagctccgctcccaccgcgcgctgctggccgccaacggcctcccgctctccacgccgcccacggcgccggcgcccgcgccgctgcgggtccgccttccttgcctctgctcgggcggcgccggggccacgttccagcggcccacgtaccgggtccgcgccggggacacgctcgacgccgtcgcgcggggcgtcttcgcgggcctcgtcacctaccaggacatcgccgccgccaacaacgtctccgaccccaacagggtcgccgtcggacagcagctctgg

SEQ ID NO: 26122 - DNA, 605 bp, Sorghum bicolor
  Clone ID: 30970643
tggatagccatagccatagcagcatgggggtggccggcggcggggggcggctgcgtgcgagcagcgcgaagaagcagcggcagcggacgctgaacaacatcaagatcacgctgctgtgcggcttcatcacggtgctggtcctccgcggcacggccggcttcaacctcctgatcagcggcggcgacctggacggcgcggcggcggcggcggcggacgccaaggtggtggaggacgtggagcgcatcctggccgagatccgctccgactcggaggcggacgacgtcgtgttcgtggtcgaggacgacggctcatctctgccgtcgtcgccgcggcgcaacgagacggcggcgagcttcggcaacttctcggcgtcggcgacggtggtgaaggtgcgggagtacagcctaggtcccaagctgacggactgggacgcgcagcggcgtgagtggatgtcgcggcacccggagttcccggcgctcgacccgcggcgtggtggccggccgcgcgtcctcctcgtctccggctcccctcctggcccctgcgacaaccccgtcggcgaccactacctcctcaaatcgaccaagaacaagatcgactactgccgt

SEQ ID NO: 26123 - DNA, 233 bp, Sorghum bicolor
  Clone ID: 30970648
ctgaattatgatgtagcgagtcgttggcattccccgtctctatctttggttctcgtctcgcgagcgcagctacgagacaaagcacacgtagtactagtactactgcgccgttgcctgcctgcctgcctgccttgcaccaccaccaccaccaccgcaggcccggtccggtccggtccgctactatacaaaccagcccagcagcgagagaggggaggaagaggaggaggaggagg

SEQ ID NO: 26124 - DNA, 645 bp, Sorghum bicolor
  Clone ID: 30970659
agggaaggcggactgggagctggcgctggtggacacggcgagcaacctgtcgaagcaggcggcgtcgctgggcggcgggatggacacgctgctgctgggcgggatgtacgagcagggcgccgtgaggcagcaggtggccgcgcaggcggcgtcggggagcgcgagcagcgtgctgcccgggcacggcgcggcggctcccgtgctgatgctcccggcgcccgacggcacggtgcagactgtgggcggtgacccgttcgcggcgtcgctggcggtgccgccgccgtcgtacgtgcagatggcggagatggagcggaagcagcagctgctggtgcaggagcagcagatgtgggcgcagtaccgccagggcggcatgcaggggcagcccgccgggttcaacggcctcgccggcggcggcgtggtcccgtcgaacgccggcatggccgtgccatatggggggtatggcgggatgcccatggcgtacaaccaagttggtgggtactattagtgttgctttgctattgctgtgtccgtgatgatcgggtgcgtcaataatggtcgtgatgacaacaagttaatagcgcgtgtctctcgatcgattctgaatgtacgtacatcggaaatgagaactccggtcctgtgaaggtc

SEQ ID NO: 26125 - DNA, 589 bp, Sorghum bicolor
  Clone ID: 30970683
tgcagaatcaacacatcaagaacaatgacattgtcactctatatcttaaagtcaacttcttcatcaagacatatgaaggtaggacactagtgatgtcaatgtggacttgtgacacggcagaggaagtcatgaaggtgattgaagaaaagctggaggtcaacacaggtgtctactacctgcactacagggggcgtgttctgtctcgtggggatactcttcggaagcacaagattggcaacaattccacgatcgatgtccgccttcggaattcacatgtaccgcagtgaaacaaaaggaagccctagggtcttttgggtgttaggccaaggggcaaaactttaaaagtttcttagccccaaagagaactataactttgccattttgtggtctagaatacactgcggttagtgaatgtttgtggctcttgactgggttaggtcttgtatttgcctgtctggtggttacactcgcgtagcctctgaagcatgtattgcctgtctagtggttgtacttgtgtagcctctcaggaacggtggctggtgactggtggtggagaagatacaattctgttatggttctaattctattc

SEQ ID NO: 26126 - DNA, 664 bp, Sorghum bicolor
  Clone ID: 30970734
atatgtaagaagacggaagaagctgccagatccagttgagaaagaaaagggtgtaagtttgtggtcaatgatcaaggacaacataggaaaggatcttacaaaagtttgtctgcctgtttacttcaatgagccactctcatcgttacaaaaatgttttgaagatcttgaatattcctaccttattgatcgggcatctgaatgggggaaaagggggaatagtcttatgaggattcttagcgtagcagcatttgctgtttctggatatgcctcgacagatgggaggagctgtaagccttttaatccccttcttggggagacatatgaagcagactatccagacaaaggcctccgttttttctctgaaaaggttagtcatcaccctatggttgttgcatgccactgtgagggaactggctggaggttttgggctgatagcaacctaaagagtaaattctggggtcgttccattcaactcgatcctgttggtgcattaacactggagtttgatgatggtgaagttttccaatggagcaaggtgacaacttcaatttacaatctcatattgggcaagctatattgcgatcactatggtactatgcgcatacaaggtaatcgcgagtattcatgtaagcttaagttcaaggagcagtcaattatagatcgc

SEQ ID NO: 26127 - DNA, 625 bp, Sorghum bicolor
  Clone ID: 30970766
agtatgccagcgggcgcgggtgctgctagtgctagcaaggggaggaagaagacggcgtgcgtcaccggaggcaacggctacatcgcttcggcactggtgaagatgctgctggacaagggctacgccgtcaagaccactgtcagaaatccagatgacatggacaaggactcccacctgattatggagctgcagtcgctcggccacctggaggtcttccgcgccgacctggacgaggaaggcagcttcgacgacgccgtcgccggctgcgactacgccttcctcgtcgccgctccggtgaacctcacgtcagagaatccggagacggagcagatcgagccgaccgtgcgagcaactctcaacgtgatgaggtcgtgcttgaaggccggcacggtgaggcgcgtggtcctcacctcggcggcctccaccatctgcatccgtccactggagggcgacggccacgtgctggacgagcactcctggtccgacctggactacgtcaccgccgagaggccgccagcctgggtatatgtctgtctatacgtgcacggtgcaccactacagtacgtcttcactacctatactatatatgtgtgtttgcactgcgtcgccagggatatgtcatctc

SEQ ID NO: 26128 - DNA, 649 bp, Sorghum bicolor
  Clone ID: 30970779
gatgaaaaggggtaaagcctagaaggaagaacgaggaagccttccgccgcctcggctccttcctctgcaagtaccctgctaccacgccagccgcttgcccacgagcttgcgcggcgactgcggcggcggtggacggagcgggccgccatggactctcgctatggccagccgccccactacaagatctatgttaagatgatgaaaactgtgccacttgatgtgaagtccactgataccatagatcagatcaagtctcagatcagtgctttagaggggattgacagtagccagcaagcgctcttttttgctggaaatcagttggagaaggacaacagacttgctgattacaatatcatggcaaactcttgtgtcgatctttatgtaactgatgggatgcagatctctgtcagtatcccctctgttgggaagaccatcaagctcaatttgaagaaatcccagagtgttgctgatgtcaaggcggtgatcgaacagaaggggggaattcctctggatgaacaaatcctgatgtatggatgccaaaagcttgaggacaacaagttgttgagtcagtgtggtttgagcaatggccacaccctgcatgttttggtctgccccactgacaagctgcgtatctctgtggatgttgatg

SEQ ID NO: 26129 - DNA, 583 bp, Sorghum bicolor
  Clone ID: 30970813
aaagagaatcataagctacgttcaaagtatgacctcatagcaaacattgtccatgatggcaaaccaggcgaggggtgctacagagtatttgtacagcggaaatctgaagaggcctggtacgagatgcaggatcttcatgttaccgagactcttcctcaaatggtagctctctcagaaacctacatgcaaatatatgagcaacacgaatgagagtaatggacagtgatcatcacatagccagtctgtttcttaacagagatcagaatgttgcgaactaatccttatcgttggatcattttttgtatcttcacacatcatcaaaacttaatttcttgacaagtagagcttgaggaactgtacttgggcagtcaggtcgatgctatggaggctgaaacgtgctgaattgtttttagagctgcttcgatacctggctggttagagaggaacgcctcccacatatttcatactgtagcccagcctgctgtgaatcagtaagctttcaggttcaaccgttaccagctaacgtttgaagctgataaagtgtaattttatatgcatctcagggattatttatggtcaacaa

SEQ ID NO: 26130 - DNA, 561 bp, Sorghum bicolor
  Clone ID: 30970824
gatgtgtcgattccacgtaagtctggtgaagggtatgtatggaaaaaaagcgccacagatcgacaaacagggtccaccaccggcaacagaggacatccaatcttgccacattgatctttcagtgatcaatctcggcttggtatctttcagtgatcaatcccgtcgtatagctgttgtttagccctcagcgaactggctggcatctagaagacactgacggtcaagctttttatttattttggattttggatattgagaaataggagaatgcctagaagcagcaagatgaactgagaaagttgaacctcagaaactgttgctgctttaatctctgtttttcagcaaaaaaaagaagtagcatggatttcaaagcagaaaagaggagcaaatgaatgtgccatgtcaaaacaaagatgacaatatgctgctacagatgttttcttttcatgcattgatgctgcttagtaatttgcttctatagttagttgtgtttcacttctcaactccaacggacaaaactaatcttttttttcttaaataagtgcatactaatgttgggtg

SEQ ID NO: 26131 - DNA, 636 bp, Sorghum bicolor
  Clone ID: 30970826
gatgagctatcgtccagtatcttcagcctggaactggcaaccaaatcccccgtgtaaatatgcaatacggacaataccgcacgcataatcccgtgggaattgtaaatacaactcaacttgcccatccatacccagtaaatcctgttaacttggcaggagggcctgcatcagctcatgcctccaccagattcccttctttaacttctatgcaagaagcattagcaaatctgggcagtactgcattgttgccgcgtgctgcagatcatcaatacatggttcagcaacatgcagttcaagtacaaaataatactttccccaccggatatgaaggaatcagagggatggccacgactgccaacacatatggcttaccttcgatggatcaacgtttggctgctcaaaatatacaggccatgaaccacagttctttaccccgagttggcacaaacccgtttgcttaatctgttaccccagttctgtcgttgtatatagtttttagcatttgatgctacgttttgtccgtgagaagatgttagtggaataatgtagaggatcaagcagactgctaagaaatgcctgaccatgaccagttttgtgtataggattttattttcgctataaaagatgtgattgctc

SEQ ID NO: 26132 - DNA, 663 bp, Sorghum bicolor
  Clone ID: 30970832
tatatgtaggaccattcctttgctggaaactatgtgtgctgaaaacttctgtacagacattttttccagtaatcttactcttattggtcaatcacgggggcaattgtattacttcaatacgagggaaagggatctctctgtattgtcagtctggattcttgaggactatgacagtgatgaatggatatttaagtacaacattagtacttcacagctttttggagagaagggtcttgggtttgctttgatcgctatccatccagaatgcagcttgatttactttgtttggaagtgtgagggaatactgatgtcatatgacatggaacgtgggaaagtttgtgttgtatgcaatgccatggagcatttgtatgacccagttctttattatcttccatacgttccatttctctcgggctcagcaaggctagaagcataatttcagcagtgtgaagaccagcaattgttaccctgaaatcatatggatgtcttctgttgtgacaaacttcaacaatgtagctgaagcttgggtacctctacctgtcttttcaccccctgttattgtgttaatgttttagtgtaatatttgtgatcctttttaatttggaagaaatattgtgtcatgtagaacctgtatcttatctttgctgagatagcgtattaaat

SEQ ID NO: 26133 - DNA, 507 bp, Sorghum bicolor
  Clone ID: 30970852
tcgcgtcgctccggcagcagacgtgcccgcaggccagcgacggcggcgccggcgacgccgcgctggcgcccatcgacgtccggacgcccgaggcgttcgacaacgcctactaccggaacctgatggccaggcaagggctgttccactccgaccaggagctcttcaacggcggctcgcaggacgcgctggtgaagaagtacggcggcaacgccgccatgttcgccgccgacttcgccaaggcgatggtgaggatgggcgccatcagcccgctcacggggacgcagggcgaggtcaggctcgactgcaggaaggtcaactagcgtcaaaactgctgctggacgatggaccagtcattcgtgtgtgttccagcttccgatccaaagtagggtcggcgaactgaatggtggtctggtggatatcttcagagtcatcaacagtcaaaactgcgtggctgttggtatcgtgtagcacgcttatacttaattaattgcttctgattatcctatc

SEQ ID NO: 26134 - DNA, 664 bp, Sorghum bicolor
  Clone ID: 30970853
tatgtattttgatggacatcatgttgactgtagtgatgacgcaaaagaatctacttccccaaggaaagatttgacaaccttagttgattccttgggagcagataagaatgaagatcataacgttgatgagtgctgcaatgctcggtcttcttccatgtatagcatggaagtgctagataatgagcctgtagactttgaaaacaatagctcactttgggtacctccagaacctgaggacgaagaggatgatcacgatggtgaacatgatgatgatgagggggtggatgctacaggagagtggggatatcttcgctcaaacagctttggcagtgggcactgtcgaagtagagataaatcagctgaggaacacaagaaagccatgaaagacattgttgatggccattttcgggcgttagtttctcaacctcttcaggctgaaaaggtaccattagttgataaaagtggcaaagagagttggctagatatagttacttctttgtcttgggaagctgcatctcttttgaagccagataccaccagcaaaggcggtcagatggaccctggtggctatgttaaggtgaaatgcttagcttgtggtcacccaagtgaaagttttgttgtaaaaggagttgttgtaagaagaatgttgctcaccggcgtagtc

SEQ ID NO: 26135 - DNA, 645 bp, Sorghum bicolor
  Clone ID: 30970862
gtatttgaagcatatatattcgttaggtgtatgttgagcataaaggtgcaggcccgtcatccctgatggaataattaattaaaggcaaaggaatatgttctccagtagccatgagccgtgcgattctatctgtcacattgaggacggcgagcaagcctttgcattgcggtaatacatactttaatttgctgttaggtacgcgaatgacagtcacagtcatccttttccttgatggaggagaaaggttcaaaggacttatcttcagtggactcagcttgttcgtcgaggaaagccaagcgactaaccaagcaatatacccagtggcgcggcactggttgaacgattctgagtcatccaataaattattaaatcacaagagctcgtcaccgttgctgggcacggttatataggtgtgctttgtttgtatggggtgaacagtgctcttgacattgtacaaactctgtagagtggcgagctgtaatggatgttaatagggaagagacgaaagagtcgtggatctgctgaacaatgtgtagagtcggtatatacaacttactccctcccttccaaaataactgtggttttggatttccatgtcacaagtttgactagatttatagaaaatatgtgcaacatttatattcc

SEQ ID NO: 26136 - DNA, 645 bp, Sorghum bicolor
  Clone ID: 30970892
gcgggtgatcaacgacaaggtgtcggaggcgctcgttgggatggatccgcagcagcaggcgcagatcgaccaggccatcatggacttggacaaggcgcgccacaaggctgagcttggagcaaatgctatgctggcagtgtcaattgcagcttgcaaagctggtgctgctgaaaaagaggttccactctacaagcatatagcagatcttgttggcaaaaccgctacaactcttcctgtccctgcaattacagtcattaatggtggaaagcatgctggaaatggtcttcccattcaagaaattatggtccttcctgttggtgctaagaattttgaagaagcaatgcagatgggttcagagacctatcaccatctgaaggatattatcttggagaaatgtggctcagacagctgcaacattggagatcatggtgggtttgctccaaatatttccagcatatctgaaggcctggatcttgttattgcggcaatagagagggctggatataatgggagaataaaactggcaattgatgttgctgctactgatttttgtgtaggaaagaaatatgatctagagttcaagtcaacaaagaaatcagggcagaacttcaaaactgctgatgatatgattgagatctatagcca

SEQ ID NO: 26137 - DNA, 682 bp, Sorghum bicolor
  unsure (1)..(682): unsure at all n locations
  Clone ID: 30970898
ctacccccactctcccactccagatctcctcctccaccccgtcgccgtcgtcgtcttcctcctctccggccggccgatgcgtcccaaaccctagcccccggtgcaaaaccctagatcccgccgccgccgagaagcggccgcgcgcagagggcgcgtccctgctggggctggccacctacgaggacgaggatgaagacgaagcggccaggggccacgcgaatggccggcgcgcggtggagcctgatgaggaggaggatgacgatgaggaggacgacgtgaggagggctccggagaggaggcccaggcaggcggagctgcgccgggactgcccgtacctcgacaccgtgaacagacaggttcttgattttgattttgagaagttctgttcaatctccttgtcaaatttgaatgtgtatgcatgcttggtctgtggaaaatatttccaaggaagagggttgaaatctcatgcatatacacacagtcttgaagcaggccatcatgtgttcattaatcttcaaaccgaanaggcttactgtcttcctgatggatatgagatcaatgatccatcgttagaagatattcggcatgttctcaatccaaggtttacaaaagagcaggttctaaatcttgacaaaaataagcagtggtctagagcacttgatggctccnattatctacctgg

SEQ ID NO: 26138 - DNA, 246 bp, Sorghum bicolor
  Clone ID: 30970904
acgcagaaagagagaaaagagagggacacaggagggaggcgctctcctcgcgattggacagggcgcgagcaccccgagggcgcgcgcgcgatccccgaggcacggggaggtgccagcctcgccgtcgccgtctctgggggcggccgttccgagctccgtccagccttggcccggctcggatttgctgggatccggtccggccaagaaatcccgcggttggtgagggaggagaggaagggagggggg

SEQ ID NO: 26139 - DNA, 673 bp, Sorghum bicolor
  unsure (1)..(673): unsure at all n locations
  Clone ID: 30970905
gatggcgagctccccactcctccctggcatcctctcttgcctcgccctcgctcgacaccgcgagaacgccgccgcgtccgccatggccgacggtccaagctcgcacccgccacaatgctcgctgctccgcgccttctcagcccaaaccaagtatttcagtgcctccgccgcgtcgtgctgcgcatctcgcgcgcgctcagccgaggtggaagcccgccggagcagccgaccaccggtcactcccgccgtcgccgacgtgtgcacgtggccaggccaccacgggccctgtcccggccatccaaggtgaccagcggttgcgcgatgacctcctggtgcttccccacccctccatcgccgccgacgatgcctcagccggccggaaaaggaagctccggcgagctcttctgttttcctcgcgaccagggacttcgggtttgaattcgactaaatccagggggtttcctgcactgtcatggactcatatgaatagttttactaggctgttgcgtgactcatggaaactccagggtccccggtgaaagatctgttttcctttttccttgtttttgcagatttctggttgaactttggaaatccatagtaattcatagaanagtcgtaaaatagcaaatgtagactttttggaatacttatgaaattctctatgcagtag

SEQ ID NO: 26140 - DNA, 557 bp, Sorghum bicolor
  Clone ID: 30970910
gtcagtgagagcgtcgtccgctgcgagaccgtccgcgacagctccgtccttgagcaccgtccgtgcgagctccgtccgcgacaactccgtcctcaagagcgccgtccgcgacagctccatcctcgagcgccgtcctccgacacggtggatttggccttcctccgacgtcgccctcgcccgccgacctcactagacatcgcacccgtgttgtcaccgtcaccctcgctgttgcgagccgcggctgccctcgcctgctgcacgagctctgtgatcccgatgtaataggcagaggctatggtggcggtggtccctgtgcattcgcctggctccggtgaggaatcggcgtggggccaagtgcaggggccgtgtggggccattgggcgctggacggggcagcagggccgcgggcaccgccgcggcgcgcgggctcagaggaggacgaggaccagggcccagcatgctacatccccgtcaaggcctacttcctgtccaccaggtccactcatctatggatgcactaaaagcctgtgtttgaacaaattcagagccaaactaag

SEQ ID NO: 26141 - DNA, 670 bp, Sorghum bicolor
  Clone ID: 30970911
ttaagaagtgcatatgttggaacttatgaagataatcataatctaaagcgcgccacagaaagtctctcggaaaatcgaaacagttctaatatacatccagtgggtagtacaatagaccaaaataatagttctacaatggcaagagaaaaggtcgaccttagaagccatctgcatccagatgatctcttgaaaactgatggaaagtcagaaaataatcagaaggttgtggccccatcagcttcttctgcagtacaagcttccaaagaagcaaataaggcggttctgcccatcaaacttcctgatcctcctaggtctcagaaagcaacagcatctaatgcctctactgaagcacagaaaccgtcatctttgaggaccgatgatcctagccctgcaaccttgaaggatgctaaattatatatgtcaaaaaatctgattgacttcgattcagatctggaacctcctcaaggtgtcactcagactgatattcagaagggctctttacctccaacagacgttggttgggcaacttttgatgatgttactcacagaaacactacaaccatgccttcaacttccagtactaattctgtggagggtccaatgctacagatccctgatttgacatcagcaccacaaattagattttcaaatggcaagtccttgtcttttt

SEQ ID NO: 26142 - DNA, 671 bp, Sorghum bicolor
  Clone ID: 30970917
ttgccacagtgccacgagccgccagccaccaaagtcgaaaacatcgccgcccctcgccttccaccatggttgtgcgatgcgcctctccggcagactggtgatggatccttccaagaagagtgcctgcgccgccgccgacctcacggatgatatcatcgtcgagatcctgtcgcggctgccggtcaaatcgatctgccgtttcaagtgcgtttcctggcattggtacggcctaatcacccactccgagcaccgcaagaagatcccccagacgctatccggcttcttctacggcttcgtccaccacagaggcaggttcaaccgcgaggagaacgacataataatattttcagatttcatggacatcacagtacgcgaagagctgctgtttttggacccctcgttgcccttcctgaccggctacaggcagattattccaaagacctgctgcaacggcctcctgttctgcctctgtaggaaggtcttcccccgtgatgaagctaattatgttgtgtgcaatcctgcaacagagaaatggtttgtcctgccggagtctgactatgatagtggtgcttgcgcataccgattccgctttgacccggctatctcatcccacttccatgtgttccagattctagaagaagaccagggttatggatttattgctgttgctg

SEQ ID NO: 26143 - DNA, 619 bp, Sorghum bicolor
  Clone ID: 30970938
atcgatcaccattggtctataatcttctggttgcatcactgctagctgctcaccagcaacctttgcaagtctcaatccacatccacaggtcgatcgggttagctttaggccttcagccatggtggtgagagcatcatcagtgataaggtgcttgctgacggtggccgcggtgctgtctctcctgatggccggtgccgctgctgccggcggcggtctgtcgacgagcttctacagcaagaagtgcccgaacgtgcagagcatcgtgcgggccgggatggcgtcggccgtggcggcggagaagcgcatgggcgcctccatcctccgcatgttcttccacgactgcttcgtcaatggctgtgacgcgtccatcttgctggacgacacggcgaccttcaccggcgagaagaacgccgggcccaacgccaactccgtgcgcgggtacgaggtcatcgacgccatcaagacccaggtcgaggcgtcctgcaacgccaccgtctcctgcgccgacatcctcgccctcgctgcccgggacgctgtcaacctcctcggcgggccgacgtggacggtgtacctcggccggcgggacgcgcggacggcgagccagagcgacgcgaacggc

SEQ ID NO: 26144 - DNA, 661 bp, Sorghum bicolor
  Clone ID: 30970939
tgctgccgcctccgtctccgcctcggtttgtgatctgatctggtgggcgggttgcggcgcggcggcggagtggttttggctctaggggaagctagctatgcggattgaggcgtcgccggattgagcatgaggggtggggctgctggaggtggaggaggaggtggtaagcgtggcgcggatgatgggatcgccggatgggcggctcgtggagttgttcggtgcggtgaagtcgtggatgccgcggcggggcgaccactctccgccgccgcccgcgtcgcagtcgcagtcgcagtcggccgcggcggcggcggcggccgggcagccgcacgacctctctagagacttttggatgccggaccagagctgccgcgtgtgctacgactgcgacgcgcagttcaccatcctgaaccggcgccaccattgccggcactgcggacgcgtgttctgcgcccggtgcacggctaactctgtgccacgctcgccgggggacgccgcgagggaggacggcgagaggatcagggtctgtaactactgctttaagcgctggctggaggaggaagccgcagcgcgcggggacgcggcagggcagcagccgaccagcccgtccctatccgcagctagcgttggtagtgacaagtccagcttcactgggatgaacggg

SEQ ID NO: 26145 - DNA, 572 bp, Sorghum bicolor
  Clone ID: 30970951
gatggtagccaatgattccaataaatggttttcttgagagttcaaatgattctttcctttttcagtttttttttaaattcatatgaatttatcagggctacttgaagctattattgttgctttgttatctttgcaagatactgggcagtttgacacagcggagctgaggtttctgacagctaaatctgagtgcaggacatgggaacacagggatatactgcaagtctgcaatgcccttctcttgccatgataccatgcagtccagagactaaaagatctctgcaatgcccttcttttgccacgatattggtttccatgcactcctgaaagtgaattttctgcaatgcccttctcttgccatggtttccatgcagtcttgaaagtggaaagatctctggaagaaaacgtagctagagaatgtgcatgatggcacgaggccactgccaggactagagcgaccagcagcaacagatcttgaggaagatgtgcattttcaatattaatttcagtttcaattgtgcatttagcatgtaatgatataatgataactaatggtaaaagcactttttgcc

SEQ ID NO: 26146 - DNA, 528 bp, Sorghum bicolor
  Clone ID: 30970965
ctaggagagggaagctgttgcaatggcatgatcaggagatagggagacaggcaagtacgatctttcaatttctcaacctgtgggttgcacatgcgcctgtccagctgcagggcacgattgtcgactggattcagaaagaaaaggaaagtcagttagcagcactgcagctacatcagaaattccaaaccatgtaacatggatggataagggaaatgaggaacacaagactggaaattggatgttaggaacaaatcaaatattgggagttattattaatagctgagcaaaaatatgtggaaaacccataaatgctccaaacaaagaggcatgaggagcaaagccatagcatgtagatcacaaactgacaattagaaatactatatgttgagcacataactgttttttagtgtcttatggtgccgagtatttttctctagctgatcctatgctgacatagttttaccatcatatatcaactgtaatgtgtttttaagagatgtgtaattaatttctatgacttttaagagg

SEQ ID NO: 26147 - DNA, 585 bp, Sorghum bicolor
  Clone ID: 30970975
taacatggctgagaattttggtagtctgttggaaacagacttgggagcggatgtcacattcagtgtgggagatgagactttcaaggcacacaagattgtccttgccacacggtcacctgtgttcaaagctgagctctatgggcctatgaaagaggaaggaatgaagcctataaccatcaaagatatgcaaccagatgttttcagggccttgctgcgtttcatctataccgactctttacctccgttggatgatcttgaggcagatgatcatagtgaaatgatccgtcacttgcttgtggctgcggatcgatatgccatcgagaggctaaagctcatttgccaaagctttctttgtgaaaatcttaatgtgcagaccgtggcaaccactctggctttagctgaccagcataattgtgacatattgaaggatgcttgcattgattttatcacctgttcaaatgagatggatggtttgctgtcaagtcaaggttacaagaatctgaaaagaacctgtcctgctgttgtgatagatgtgttgagaagacaagcaagtttcgtaaggcgtgagcagtttatcttaagctt

SEQ ID NO: 26148 - DNA, 621 bp, Sorghum bicolor
  Clone ID: 30970984
aatagagatggtgggaaaattaaattccaaggtatgcggttggttgctatacgcacagtaagatgtttaacaaacgttgaagctttcgtactcagagcaagtgatctggaagaagtcacctcacagtttgctcgattcttgcgtaatccacgagtgcagggagcgatcagatatgaatccccctactggcgaaccattgctgcaactcgtattcaagttgcatggaggtatcgaaaaaggcggctgaagcgagctgagaagtcgaggttgagcgaagaaacttatacctcacatgggatcttgacacctgattcttttcagcgtggacagaggggatgatctctacctgactaggcactaacttatcagtttcagttcagcatctaaagcttctagagctctgaaattatccgaacatgtctacttggtggaacctagcgcatggggcaaatatttttggatttggtgttcagagtacatgtaagagaatagtttttttttcatgcatggttgcccctgttagagctagtacacgcacatatatgttgcattcggattactaggagatcagttatttgcctgccaaccaggatgctcatcagctgtaaataaatattcatt

SEQ ID NO: 26149 - DNA, 609 bp, Sorghum bicolor
  Clone ID: 30970996
tgggaaagtgaatgtcattggggatgtgattcttttgttgggcaagctttgtgttagcctgttgtgtgcactgtttcccttccttatgttggatgagcacaagtacagatctggccataacaagatatcatcgccactagtccccgtgctgttgtcgtgggtgctgggttatatagttgcaaagcttttctttgcagtggtggagatgtcaatcgacactatggtcctgtcattctgccaggactcggaagaacatcaggggagcgctcagtatgcgcccccgctactgatggagacactggatgaagagagcgagttgcgaagactgacacagggacaggggccatgaagcatgatcttctaaatacgtgtagggatagagctagaggtgaaactgaatggtgtgttatctgtactttatttatatatgaatcactggggtggatggaggtgcaagtaattaaggtggttatggttatggttatggttatggactggttatcagctaaatacgaggaatagggctagagctagaattgaaactgaatggtgggatggcagatactgttggctgttggctgatttgttgtgagagaaaaatctttctgc

SEQ ID NO: 26150 - DNA, 663 bp, Sorghum bicolor
  Clone ID: 30970999
acacgttcagtatggaattgccgataagtacatggtgctgtggggttctgctttgggtgatgcaatcaaccagttcaagatgatgccgttcctgatcctgtcaggacagctttgcccgcctggaatcgagggcacactgtttgctctcttcatgtcaatcaacaaccttggttcaacagtaggttcattcctggggtctgctctggcatcagctttgaacctcaccacaggacagtttgacaatcttgctctgggtttgggtgtacagatgatttgtactctgttaccgattgggttcctatctctgattccaaaggaagtcacaggactaacatcgtaggttgaggggtgtgggcctgaccatacttgttttattcctgacggaaggtaatggtctgtgcttgaacctcaaattcctgactcatgcacaaatatacttacagctctgtaccagagtgaggaatatacagatcataggaaggaaattaaagatggaagatagacagttttgttgacagatgtatacaactctgtaccgggatgggaggaaagaagagtgcaatagatttttagggaaagatgatagttgatgctacttgacatgtgtagaaatgagaacaaacatgaaagtgatgaataaatctgtgcacgtctttggttttc

SEQ ID NO: 26151 - DNA, 625 bp, Sorghum bicolor
  Clone ID: 30971022
agaccctgcgcgagaggactggagcacctgctgcagcaagtagtgacgaggagcgtgcgtgcagccaaggaaaggagttgagcaatggagaaggccatcgacaggcagcgggtcctgctgcggcacctcagccccgcggcggcggcggagagccccgccccgcccgccatctccgcgagcgcgtgcgcggcgggcgacagcgcggcgtaccaccggacgcctgccttcgccgacgacgtcgtcatcgtcgctgcttacaggacggccatttgcaaggccaagagaggtggtttcaaggataccttcgctgaggacctcttggttcctgtcttcaaggctttggtagacaagacgaagctggacccaagtgaagttggcgacattgttgtcggtactgtcttagctcctggttcccagagggcaatcgaatgcagaatggctgcactctatgctggtttccctgacactgttcctcttaagactgtaaacaggcaatgctcgtctggccttcaggcagttgcagatgttgctactgctattaaagcagggctctatgacattggtattgctgctggtttggagtccatgacagtgaataaagttagtcttgatgggcaagtgaacc

SEQ ID NO: 26152 - DNA, 643 bp, Sorghum bicolor
  Clone ID: 30971024
aaatctcatcctccgcttgagtcttgccttctcgcccccaaattttcttcgccggcgaccaccaccttgccggcgatcttcaccctcccttccatcgaagtacgttttccagaatttttcttcttcattctcccgtttatccgtgcggccctgcctttcttctcctgctccccacggcctgcgcgcgcgttctctctctctctcctctccccctttctctcggtctctccgccagtctccgggcgaccgcgccgcttctcccgtttctccgtgcggtcgcgcttttcttctcccattccccccggcgtgttctctctctctgtctctcggggcgacggctggagtaccgcgccgccgcagcggcctccctacgacaggtgtcgagtctccatcgggcgccatgtcttcttcgtgcccttcactggcgacgagcactaccagggtctggagggaagcatagatcttaagaggggtgaaatttggttgtaatttctgagaatttcaagaggacaagggtacggaggtagttttggagggatttgtgagcaaagcttcagaaatttgaggttggaggtaaccatggtggggaaggagctggtggtgaaaaggaatggccctgttgacatacgtgagattgctgcga

SEQ ID NO: 26153 - DNA, 615 bp, Sorghum bicolor
  Clone ID: 30971039
gctggctgtgcgcatgaggggaggaaggagaggccgctgcctgcccgtgggagcaagattggggctccggtgggcgggcgcaggggcggggcagcgctccaggcgtccggggtcgaggcaggtctcaaggcaggcgttctgatttgggattatccagacttctttttccaattgaaatattaggcctttgtctctgtttccatgttgagaattattttgcagataaagatgagaagatatcaaagtggcttagtaaccgtctttggagaacaaaatgttctaaagatctagttagcaactgatccaccaggggcatgtaaagaaaggaaaaaagcatcactgattattatttcaagaatacgatgagctataattcatgtgccacattattgacatcgagaagcttatactatgtactataaatgaaaggttcaaacataagcctgcttatctttcttttttggaactgccagtgtgcacaatttctcaatctttccaagagtagctaggatttcaataaattgggttaaaaatacagtgtatctgagctaagtcccatgcacttgggtattgcaccaagaaatgtgcaattgtcatttcatgtcttgtattatg

SEQ ID NO: 26154 - DNA, 660 bp, Sorghum bicolor
  Clone ID: 30971040
aacctaacctaaaccgtccacaaattccattcctctcagcagccgccgccgccgtcagcggtggttgagctttttgtctcgcggacatatcccaccagatccagatcccgtatccggcgcagccgtggacatgcatccgccccgcgaccgatgcatgctcccggagctggcctgtcctgggaagcaattcgtcgaacagctgcagcgcgagagggtggtaggcctcagcctcgatcacgcgcacgcgagctgtttggcgaattgctttacccatgtcaggccctgcttcggttatacttacaccgtcttcaaccagctagctagctagccgtgttcacaaacttattttactgaccatcttattgcgacatgttattttgtttgggtaattgtatgtattcgtcacctgatctatctgatttactggccatgctattcggtctgctttgtttaaactttgaagaaactctctggataaaattgtttcaactttgaagaaactatctgtcagactctgtcctgttagtatgcacttgagcgtcaagttcattattaccaggtaaatatgtatgcatcacatatactggctggatttgctcacttgtaaaacacatgaacttttattgtcaaaattagcatttgcctgttgcttttttctag

SEQ ID NO: 26155 - DNA, 674 bp, Sorghum bicolor
  Clone ID: 30971048
cgtggctgctgcggcaatacacggtgcgtgtgggggagcaaggcggcggcgacgagggttttgctgctccgcacaccgcgcgcagcggcgacgcgaccgcagctcgtcgccgccccggatcgaggaggcggcggaggcgcctgtggtggctgcggcggcgggaccgtgagcgggagcgccatgaggggcggcggccgtggcggcggcgggaggcagccctcctacgcggcgccggacgggtcggatgcggcggcgattccggccgcctccaggaagatggtgcagagcctcaaagggatcctggccgaccgctcggagggcgagatctacgccacgctctgcgactgcggcatggaccccgacatagccgtcgagaggctcatctcccaggatacttttcatgaagtgagaagaaagcgggataagaaaaaggagactaaagttaatcaggatacaaggcctcgaccattccagaaatctatatatcgaggatataaggctggttcagatcgaagtggacgagactcaggcggtttcaaaggccctgtcaagaaggagccagagttacatgctccactaaactcatcagccttggatgtcaagacaagtgacactacagaaacattttctgctactggcaatgttgcccaggctgatgctaagaacactacttc

SEQ ID NO: 26156 - DNA, 673 bp, Sorghum bicolor
  Clone ID: 30971056
atctttatttggatagctgtccatacatacaaaggatagctgtccatgtggtttagtctaaggtaggttcctacagttgctacgccaaatctttgcttgtgatccaaagttcatatgtagtctctcatgtatgctgtcctatattggattttttttgaagagggaagggataccgcagatccttgaatcctgatggcggaggttgtcagctctgcacttgtccatgagacagtcagccaacttctatccaatctggttcagaaatatgaggacaaggaggaatcgagtgcgaacagaaatctggagaggctagagatggcgcacatcaggctggaggctgctctcgagacgtcagagaagtggcagatcactgatgcatccttgttgcgttggcgcaggaagctgaagcgtgctgctcaggagtgtgatgacacgctgcataaatgcaagcagaggatcctagaagacgaacagacagagaaggaggtgaggatgtcctcgtttcctgtacgtatagcgcatactaccaagtcatttgttttctccatctttggccccaacaaagacgagtcgaacagctccactgttcgaaggtttgagtggttcgcagatggtgctagcgagtttctcagattactagagcttggtggcaggccacgccaccacatgccct

SEQ ID NO: 26157 - DNA, 651 bp, Sorghum bicolor
  Clone ID: 30971062
accagaattccgcgaaaccgactctgcgactcatccccgggcaataaaaccctagcgtgtcggcgccgccgcctcctgcctcctagagcaattcgattcccgcatcccgatcccgatctcccgaccacatctccccgcgcgcgctccgcgatctcgacccggcggctccctcgatcgattccggcgaggccgcaggtgctcctcccccctcgcccgatgtccgcaggtgctcctccctcctcgctggatcccctctcctctcgagtcgtcgccccttcggcacctgttgcgatgccgagcccacctccggccccacccacgccggcggcggatgagaagcgtccctcactgtcactgccgttgaagatgaagcggctatttccgtacgccgtgaactgcgtgttcggccgcacctgggtcatggctctcgtcgggctccagttttgcatctgtgtcggcagggtcgtctcttttaccacagacctagaggtggcccgcttctgggtaaccatcttccgcttctggctgtacctcggcttggccgccatcgtgctcatggcgtgcgtggacatcggtaactacgtgtatggggtgtacgccgtgaagttggatccgccacagcagcagccggcagtggcagcagtgcagctc

SEQ ID NO: 26158 - DNA, 660 bp, Sorghum bicolor
  Clone ID: 30971070
tgggctccgagcaccatggcgaggatcaggggcccgcgcctcgccgtcctgctcgctctcgccgtcctcgccgccgtggccgtggccgcggtcgccgcggcggcggcggcagaggagcgcgcgcagtccacctacatcatcccatcgatgagaccaaggagtccaagtcgccgctggacactgagggccatggcacgcacacggcctccacggcggctggctccccggtgcccggcgccgggttcttcgactacgccaaggggcaggccgtgggcatggaccccggcgcgcgcatcgcggcgtacaagatctgctgggcgtccggatgctacgactccgacatcctcgccgccatggacgaggccgtcgccgacggcgtcgacgtcatctcgctctccgtcggcgccaacgggtacgcccctcgcttctacaccgattccatcgccatcggcgctttccacgcggtgcgcaagggcatcgtcgtctcctgctccgccggcaactccggccccggcgagtacaccgccgttaacattgcgccgtggatcctgaccgtcggcgcgtccaccatcgaccgcgagttccccgccgatgtggttctcggcgacggccgcgtttttggcggcgtgtctctgtacgccggcgaccccctggactcca

SEQ ID NO: 26159 - DNA, 668 bp, Sorghum bicolor
  unsure (1)..(668): unsure at all n locations
  Clone ID: 30971074
atatactactagtcctattcctgatagttttagaaatttctccaattaacggaaagatgcttggttctcatcatgcgcattctcgaagaagaaaagatgttgaattcggaatataatcttgaagaaccacaccatctggctgctttgaatctagaaatgcacaccacacgatcgaactgatagttcatgagttgatgatgtcaatctgcacagccttttttttctggacaacacgtgaacctgtagacgacactgctcagctcatcatcagcgctagctattattctcgcccccatgccagcagaactccaaaaataaaaccatgcatctatcgtttgtgtacgtgcatctcatctccatctacccgacgatccttttcgtcgcctgtccttttaattaatttgctccggacacttctttccgcacgtcgcanaattgtcaaacgaaacggggcctatgcacattcgctcgacgttgatttttaagctttttttttcctttcaattcanaagatatatatgtgtctgatttttatccgaatccaacagcgccactatttattattacctgcggctctnaattagttcacgtgaataatatgtacgacatgttcacctcataattttgcatgcaataacgtacgtactacacgccagtatatatgtcta

SEQ ID NO: 26160 - DNA, 196 bp, Sorghum bicolor
  Clone ID: 30971084
gttttatagtcttcggggatcgaggtttcttccggaaagaactggttcgtctgtatggccattagcagtggctcagtaaagtggtatgtctatgtttgttggacaacatgtaatgtgatggtgtccaagcaaattaatgttgatttgagactgatgcttgcttctcatggaatgctaatttccattttcgggtctt

SEQ ID NO: 26161 - DNA, 664 bp, Sorghum bicolor
  Clone ID: 30971095
ggggattgcaatgatgagcactgccaagggtgttatggcctggaaggtgatagtttgaatggtagcaatgccaatggcgccaaaaagaacaaatctgtgcttcttaatggtttatcagaagctaagagtttggtcctgatagatgaatcccacaagttcattttcaaacgagatttgaaatgctgccccatgttcagaatgttgaagactttgttactaaatgaatattggtgtgtgcctcctgacttccgtgaactagcttgtcttcttgaatattcaccagttctagagaagctcactcttcaaattcttttcaagggacctgaacataagtttgaaattattggaagctacagtcagatggagggatctgctgcaatatcaaaaaaccttaagattgttgaagtcaaatttgaagtggctgacgagggagttctgaaagtttataacttcctgcaaacacttaacatagatttcaattttgatgaagaagaggagagtttggtagaagatgtatctcctacctcttaactgcatcaagaaatggaaggttgaatttgatctggcaagggttctgtgttttgtatgtgaacttttcatgttgcttctgcttgtaataaactaggactacaacttaattgcaatcagtatgagctattaggtc

SEQ ID NO: 26162 - DNA, 655 bp, Sorghum bicolor
  Clone ID: 30971097
gtatggttagagatttcctggtggaatacaaggcggcaaaagagaagacaaaagaggaagagaggctcgcaagggagcagaaagcagaggagcgtcagaaacagaggggaaaagagtatgatagtgggggcagggatagagataccagaagggagagatctggggagcgtgactatgaccgtgatcgtcaatatgagcgaagccgtggaagagacaggtcctatgattacagacagagaggatcagagcaccgaagcaatccctactacagaaatgggagggattctgaaagaggcggacacagatacaggagtggtgatatgacaagcgaacgagggagaatgaggagcagatcacgttctccaaccagacatggctatggaagatctagaagtccagatcattagctgaacatttagatagttttattcacagttgggactcatgaggtagaccgttcccttctgctatttattactgtacaatgggttttattgcagtgtcgcacctgtttaagtttctgctctgctgtaacagctctgttggaaccctacagacttccttttttacatgggaaaaaaaaattctcaggtaggtatccattgtcattcccacaatttttgtgcttctgatattctatatgtatgctgaagct

SEQ ID NO: 26163 - DNA, 565 bp, Sorghum bicolor
  Clone ID: 30971123
acgacagattggtcgatcctagacaagctcctcgcctcgcaccagaacctcgaccagctcttccatggcaaggtcaccgcggcatctgcctccccgccaatggcggcataccatcagcagctcatggaactcggtgggtcgtcgtccttgcagaggcttccactgcagtacctcggcggcgagacggccgatctcctcaggttccccaagtagttggatcgacctcaagtttagctatcttgttgggcagtgaccagatcaggtttttggttgactactagatctgcttaattcgatctacttcgtatggagtttagtgcttctaaatgtatatatatggtgcaactgtttgggggcatggaggcatgaattgccatctactttggttgatcaagaggatctttttgatgtttccattttggcttagggttgctcgttattaattaggtgcttttggagaaaaatagtgaagagagatggccccggtcaatcaagaacttctatttttttctcgaacatactattgcttatgtttcaaacctagttcccactgtttggtcatctc

SEQ ID NO: 26164 - DNA, 365 bp, Sorghum bicolor
  Clone ID: 30971139
tccggttttagagactgacggacggatctccagcccagccaccgggggcgccagatcggcgtggcgctgccgccgtgcgcgcgcccctgcctatgaattgagcggctccattacctgattattagctctcgattaggactagtactggtctgttcatctgttttttttttttttactttttctctcgtcttggttgctcgtgtttggtgctgtacttgtaaataccggcggagtgctctgctctgatgatgatgatgatgatgtaggagcactctgcccctcgcagcagtgtctgtattgtacaggctttttctttcctttgggaaaaaaatgcgaagagatgagaagaagagattttaaaaaat

SEQ ID NO: 26165 - DNA, 535 bp, Sorghum bicolor
  Clone ID: 30971140
atgacgcgctcctcgctgccaactgggattcccccgcgcagctgcgccgcgtctgcgtactcggcaacagcttccggtggtatgcgctccaggccgaggagaaccgctcgggccccgccgccaaggctccgcacgtcctcgcggcggagcggtttgcgtgcgaggagcggatcggcgagacgggggatctggatgacgacgattggtttgcccacgcgttcaacgagacgagctggcatttcttccagctgcacgacgacgtcgacttggccggcaccatgctggaggaaggagataagttcattgagcagatttgatcttttagttggatatattgcgttgcttgattgaatgcaatgttgatcaagattctaaatttgtagacatactggctccaattcgaaggagcactgtagatgccaagttgccaactaggtacctggctgttgttctgatatttgctaaagagcttgaaatgtgttgttgttatattatttccaccagagattgagttggtaccatcaattcgtaccgt

SEQ ID NO: 26166 - DNA, 666 bp, Sorghum bicolor
  Clone ID: 30971170
agcttggaagcgcagagagacagggagatcaccacaggtcccaagacccagaggggaggaggaggaggaggaccgccccgaagaagggagggaagcgcgaatggagagcaggaacgtagtggtgtgcgacaatggtaccgggtatgtgaagtgtggctttgctggtgagaactttcctacatctgtgttcccttgtgttgtcggaagacctctacttcgctatgaggagtcacttcaggagcaagaattgacggatattgttgttggagcagcttgtgctgacttgagacatcaacttgatgtatcatatcctgtcaccaatggcattgttcaaaattgggatgatatgggccatatttgggataatgccttctacagtgagctcaaggtcgatccatcagagtgtaaaatcctactgacagatccaccactcaatcccgtgaaaaaccgagaaaaaatgatcgagaccatgttcgagaaatataattttgctggggtcttcatccagatccaagcagttctttcgctgtacgctcaaggcttgctaactggacttgtgatagattctggtgacggtgttactcatgtggttcctgtagttgatggatactcttatcctcatctgacaaagagaatgaatgtagctggaagacatataacctctta

SEQ ID NO: 26167 - DNA, 638 bp, Sorghum bicolor
  Clone ID: 30971194
agcgcagaggtttcaaacccacccacaccacaacgggtccgtccatccatcccaccaacactgggagcagcagagcccacgcgcgcacgcctcccgatgctcccgctcctcctcctcgccgccttcctccatgggacggcggcggcgcaggggcagggccagggcctgccctctctgcccatcggagtcaactacggcgcgaacgccgacaacctgcccacccccgccgccgtcgcctccttcctcgccaagagcacgaccatcgaccgcgtgaagctcttcgacgccaacccagccttcctggacgcgttcgccgccaacgctccctccatctccctcgccgtctccatccccaacgccgtcctcccgaccttcgccgacagatccagcggcctggacgcggcgcggggctgggtccgcgacaacctctccccacacatctccgcgggcgccaacgtgacgctcctcctggccgggaacgaggtgctgggccccaccgtggtcccggacctcgtcgtcgccctcctccccgcgatgcgtcgtctcgcccaggcgctccagctcgagagcctccccgacgtccgcgtcaccacgccgcactacctggggatcctcgccccctccgacgggatcccgtc

SEQ ID NO: 26168 - DNA, 660 bp, Sorghum bicolor
  Clone ID: 30971209
aaaatccattcggcctcttctagtttctctctctgccgccgtccgccggcctcgcgcaccccgccggcaaccgatcccaggacgccgccgccggccgtcaatcgtgccccactggactcgacccggggagtccgttcaggtcctccaccgaacgcgcactgctctccgttgtttctgttaaaaacatgactgctcagacaaagaagaggggcgctgcggaaaatggggatggtggtgttagtttgggccttgctgccttcattgcaaacaatgaggatgtgggtcccatagtccggcatgcttttgagtctgggaagcctgaagccctcttgcacagcctccacaacatcgtgaagatgaaggaggttgagattgaagagatttgtagactccactatgaggaattcatccttgcggtcgatgagcttcgtggtgtcctggttgatgctgatgagcttaagggcacattgtctgatgagaacctgcggttacaagaggttgctagtgccttgctactgaagcttgatgagcttcttgagatctattctgtaaacagtaatgttggggaagccctagctacattgaagatttgtctgcaagtaaccaatctctgcaagatatgcaacagggacattgccgaagcaaaattgctttctgcat

SEQ ID NO: 26169 - DNA, 645 bp, Sorghum bicolor
  Clone ID: 30971219
ctggagatgcagtcttcaagatggatggttatatatcaaatgcaaattatgtggcaaagaagatcacgatgatccttttcataaatgataggcttgtagactgtacttctttaaaaagggcaattgaatttgtgtactctgcaacgttgcctcaagcatccaaacccttcatatacatgtccatcaatcttccatcagaacatgtggatgtcaatatacacccaaccaaaaaagaggttagcctcttgaatcaagagcgtattattgaaactataaaaaataccattgaggaaaaactgaggaattctaataccacaaggatattccaaactcaggcagtaaactcctcggcacttactcaagtttacacacagaaggacaagggtactgacgtcaaaatagcctctggaatgaaatctcaaaagactcctgtgagccaaatggtcagaactgatccacgcaatccatctggaaggttgcacacttactggcatgggcaatcttcaaatcttgaaaagaaatctgaccttgtttctgtcagaaatgttgtaagatcaaggaggaatccaaaggatgctggtgatctatctagccgtcatgagcttcttatggaaatagattctcactaccatcctggtcttttag

SEQ ID NO: 26170 - DNA, 643 bp, Sorghum bicolor
  Clone ID: 30971235
gcacgaaaaggctcgaccacatccctctcgtgagcgcgcacttctgctagcctgctgccgtgccgcagtgtgattacagctcgtcgctcgaggtgaactccggcgtgcggaaccctagcgccgcgcgggcgtggagcccaccggcctcggcgccggcggcggtactactaggatggctccgcccgtgaggccgtgacgccatggtgaggggcttgcggctcggtggccgcgcggccgccgcggcgaggtggtgcacctgccgccgcgtcgccgtcgccctctgcgtgggcaacctcgtcgccgcgctgctcgtggcccgcgcgctctacgctcccggctccttcgcatttgcacccagacgtggggagctgaggtattccagggagcagatgaggtgggtggaggagtcgatccggattcgccgcgcggccgagcccgtcgagctcattgaagcggtgaagaagctgcgcaaggcattcgcgagggaagagaagaggcgaagggagctgccgctggagctgaagcagaaagtttcgcttgagattttgcagaggctgcacgatttgggggaaaatgctaataccacggaacaacgagaagctgtagaagcatggcgtgttgggaagcttaagtacatgagaag

SEQ ID NO: 26171 - DNA, 654 bp, Sorghum bicolor
  Clone ID: 30971238
ctgaagccgaacaatgccgtagagcagagctgagcagcgcagccccgccatgccgctacgcctacgcgtcgcgctccagctccgccgcttctcctccaccgacgccgccctcgcacccccgaagctgcggaacctgccctaccgcctccgccacgtcgccgtccccgccgcgcgcgccgtcatctccgagtacctccactcgacgcgctgcctcgcgtcctcccacgccgactccatcgccgcgcactccccgcgctccctcctctccttcctcgccgcgctccccaccgtgccgcgctccctccccacctcggagcttcccgcccacctccgccgccacctcaacttccacccgctcaatgagctccccttcttcctcgaatcaatcggcgggcccaccgcggcggccccctgcttcaactccatgttcctctccgaccacccctccctgctcggcgccgtcgccgcgctcgcgcacttcggattcccgtggtcacgcctcggactcctcttccctagcgtcctcctcgacgtgcccccggacctcatctccgcgcgcctctccgctctcgaggcccgcctccaccggctccctcgcgccgcgatcatcgccgcttgccttaccttcccatcgcttcttgagggggatctatc

SEQ ID NO: 26172 - DNA, 655 bp, Sorghum bicolor
  Clone ID: 30971239
tgttggccggcgggcccaactctgcgacgcggccggaggaagaagaggactggctctacgcaatcccgctatcctggcggcatccacgactccgatttccgttgtgcttccttctgctctaaaaggacctcatgacttgctctgctcttcagttgtctctctttctcggttctatatgccatagccagatagccttctagccttattttcctgctactttacttaagggcattcattcctacattttcctgttactttacttaagggatttatacctaattcattgcgcattggttatcctgacaaatgggagcattgctagcagatctctcttctctggataaccacaccaatcatgagggaatcgcctccaacgcagggggagccatctacatcttctgcggttgatgatagttactcagccgacagggttgaagattcacaactattcctctccgtacctgctttaaaccaagctgcatcttatcttgctcagacggcttcattcctcacccaatgcctcccagtacctggttatgtgggtctgtctgaggagggccaagaattagcaacacttccacctgcatcggcctcaggcaggctttctgttcagacttcttcagtagagcctgctggcaccaattcatcccttggt

SEQ ID NO: 26173 - DNA, 550 bp, Sorghum bicolor
  Clone ID: 30971259
ttttgatttggagaacaggaccaagcctaggtatacaatgctttggtggctccaagagcatggcttgcttagaaaaaaattagcccctgcaacagtgcttgctaactcagagaagaggttcattagtaccctttaccttgtgcatcctgcagttccaaagttgtggcttgagtgtttttcttcaagaagacatatggagtattatctcaagaacatctatcagtatgcagacaacatataattagatgtctggaattatattgacattgattgttaatggtacagagtatttgccatgtgcatccttttctctgttgaggtagttgttagatgtagcagctttatatttggcaaattttttttgctcctgcatacgtagcatgaaagggatacaccaattagatagcaatccttgtaacttgattgtggtaaagctgtgctgtaaatttgaactctgtggagtccaatttccgcgttcctcctgtggctatgcacttactggaacagcatggtgtattcatcacattcttgacaatagttaactaccatc

SEQ ID NO: 26174 - DNA, 120 bp, Sorghum bicolor
  Clone ID: 30971261
gtcatgatatcattaggtagttggaaagggaacaaatgtcctcctcccttgattatgtgcggggagatttggtactggatttgggttccctacccttgaatgagagtttggagacccctc

SEQ ID NO: 26175 - DNA, 582 bp, Sorghum bicolor
  Clone ID: 30971278
atccttccaaatccatcagggagtggcgttcagttttacaagaaaaataaagattgcatggcgagtggcgaacatgttgatagtacagatgaagatgacattgatcacgaattacttgcggaagcagagacagcatggtcccaacgcgagtggaccattcagcatgtcttgttcccatccatgcgacttttcctcaagcccccaaagtcaatggcaacagatggaacctttgttcagattgcttctctggagaaactttacaagatttttgaaagatgttagctcacacaagtaacaacttacaagaagccgaaggaacactccaatgaaacattttgtgctgtatataattttgtacttgtagcatcgtaagtgtttcttttttgacaaaacataaacgtatttttagtagtatagacagattaactaatgaatttggaagcgtatcctaagcaaatttgcatgtagtgtcagttacattatcctcttgtttgatggctcaatttaatctgagtttgtgatgtgtcggcaccttgttgaaattagcagtatggtttcggagtttaataaaatacatcttcc

SEQ ID NO: 26176 - DNA, 559 bp, Sorghum bicolor
  Clone ID: 30971285
ggtgcactaagccacatctcagattctataacaacggtacttcttagtgaccgggtgaaaaggttcaatgcaaatgctgttgctagtattgacattgatttgaaagtgttggaggggtttgctgatgacacctaccacatgactgggttttcggacctgagaaaggaaacaagtttcagagattgtctagttgaaataaggcagctaataaatcttctgctaagcaaccaccctgaaagcttcgtgaatcctgtaaccagggagcagagttatggagccttagaccataagaaggtggcaataatttgtgacaagttcaaggatgccccagacagtttgtttgggagcctttcaagccgagccacagtgcagatgcagagcgcccggaagaaatccctggatgtgctgaagagaagattaaaggattttagctgagattagttgtgctacatcattaaataagctagtactcagttttaggaaaaaaatggtccagtgcaagtcttaccatttcagacttcttaccatccttctttatgccctttttaatcaactcccg

SEQ ID NO: 26177 - DNA, 582 bp, Sorghum bicolor
  Clone ID: 30971296
agcacggctcaaaccccaactacttagcagtgcttgtcgagttcgaagacggcgatggcgatgtggtccaggtggacatcatggaggccaactccgggtggtggacgccgatgcgggagtcgtggggatccatctggaggatggactccaagcgccggctgcaggggcccttctcgctgcgcatcaccaacgagtccggcgagaggctggtggcttaccaggtcatcccggcgaactgggcgcccaacacctactaccgctccaacatccagtatgaggcttttggctctgctgctggacaggctattggctttggctctgctgttggactggtcattagctctgctgctggactgcacacggtaattaccggcatcattggcttgatctgtttggtattgtatcatttgcatgggattgaggtgcctcagttttaattagcacttgagaggtgacatgtcaggtgtcctacgctgtaggtggtgtcttgtgagatttgacgaatgggatgtctgcctgggccgtcgtcggtccagagtttcattttctcgaaaaagaatttatgaacccaaatattttcct

SEQ ID NO: 26178 - DNA, 672 bp, Sorghum bicolor
  Clone ID: 30971298
gagggacttgactatcggcatggtacaggccatggaattggatcttatttgaatgtccatgaaggtcctcatctaattagcttcagaccttctgctcgaaatgtaccgttgcaagcatcaatgactgtgacagatgagcctggttattatgaagatgggagctttggtataagactggagaatgtacttatttgcaaagaggccaatgctaaatttaattttggagaaaagggttatttagcatttgaacatataacatgggctccataccagaccaaactgatagacaccgagcttctgactcctgttgagatcgactgggtaaacacgtaccactcagactgccggaagatcttagagcctcatctgaacgagcaggagaagcaatggctgatgaaagccactgagcccatagctgcaagcagctgaaccttttcgtccaggttgcatgtcgcgatggcagatcaccaccagtcctctctgctgatcttcacatcatcatctgtgtggcatacgctgtgcgtacatagattggctccccccgctggttcgttagcttaaataatagcggcgaaggaacaggataggttattctcatcgttgattgtgtttggctggaataaagatgacgacagaatgttttttttattaagttgattgtacagttttctt

SEQ ID NO: 26179 - DNA, 529 bp, Sorghum bicolor
  Clone ID: 30971313
acctggagctcccaattgctgccgacggcaattccaccaggatcccagttgtaatgccactttcaggggcaatggcagcatgctcgcaactgctggtggcaaggtatggcgagaagagtgacggttttgtgacgcggaaggatgctgaggttcctgggtcagtggtggtccgtcctgagcggaagctagaccacgcatggatggtgtattcgtcgctgaaggaagagcccagggatcaggcggacacgtcgcaggtatgggaagccctgctgactttacttgtcgaggttgcacagaagagaaggcatgagatggccatgaaagacgagtgaaagtagctttttggtagattttcggtgttggccggagatagtgagatgagatgtgtatcctccctgtaatcgtacactggttgttgccgactgtacagagttgttttgctcaaagtgcttggggacatttttttgtttggctgacagaagacttgtgaataattttcttgcatatatcatgtgaagttcagaggtgg

SEQ ID NO: 26180 - DNA, 567 bp, Sorghum bicolor
  Clone ID: 30971316
gaatgcaatactgagctgcatactgattatggtggcactgctgttagatggggcttaacacatcacaaagaaagtgccgcagattgctgtcaagcctgtatagatcaggctaagagggctagaccaggagctttaaagtgtaatatttgggtttactgtccgtctgagtatggatgctactcgccagacaaatatgaacacaaacatcaagaatgctggttgaagcaggctgaccaccctagattaaacttcaaagaccgctactctgagccatacagagattctcatccgactgctcctgttgttgtgccatggatgtctggtgtcattactgcatgagctgcctgcccacaggagcccatctccaatgtgcatcccaactgaactttgtacattttctgcaaactcagaaaaccatttttcttttccttctttagcacttagtctttaggttagtctacttgatagctgaagttagtctgagctggtgcctgggtggtaggatttgggttatgctggtggcttactcttgaaattatacagagctaaatgcctaaatcaattctt

SEQ ID NO: 26181 - DNA, 660 bp, Sorghum bicolor
  Clone ID: 30971324
ggcggtgcagcgcgagggcccgcccggctccgcgcgacctgtcttctgtcagattttgcgttcagagagtggctgagtgatcgatcagtgagtgctactccgtatttcacagatgtgccgagggccgaccattggcaagcgccaggtggtcaacggccccgggcacttttcctaccagacgcagaggcagagcagggatccagttccgaaccaacccatggccgccgccgccgccgtcgccgtcgcgaccggtgccagcgactggaccatagtccgccgacgcggccgccgacgcggcgacgacccacgccccgcctcccagctcgacgccccgccgccgctccccgtgatacccgtcccctggtccccctccgattcctccctcgatcccgcccgcgtctcccgcctcgtggcgcgcgcccacgccgccatctcccgcgtcgccgcctcccgcctctaccgcagcctcctgctccagggctcgtcgctccgcagccgcctcggcgtcctcgcccccgcccgcctctccctcctcggcgtcggcagcttcgagtcctcccccgccgcgcgcctccagctcgcgctcgccgcccttctccgccgcgacctcctcccggaggccgcctccgcggacctcttcgaccccgtcctctccgccgt

SEQ ID NO: 26182 - DNA, 643 bp, Sorghum bicolor
  Clone ID: 30971439
aataaatatcactctgttgagtctttttctgtatttagtaatgtatatgacagcagtggcctctttggtatctacttaaccacgccatcagattttgtggcaaaggctgttgatatcgcaataagtgaattagttgctgttgcaactcctggagaagtgacagaggttgaactgcaacgagcgaaaaactcaacgatttcatctgtattaatgaatcttgaatctagggtagttgttgcagaagatattggaaggcagatgttctcttatggttgcaggaagcctattgactatttccttcaatgtatggaagaaattactctagatgatgttgcaacatttgctaggaagatgctagcttcgcaacccacaatggttagctggggaaatgttgacaaagttcctccatatgaatttatttgcaagcggctacaatagtacccctacacaaatgacctcaggtggacttgaaggatccttttgtggaaaactaaacaatcacttgtatgaagtgccctagctcagagactgcttttcttctggacatgtaatttagtgagcttaggatttcagcatctacattcaattgtaactgttcaaacagcacatagtaaatgagagaggctgacgaaaggggaaaaaa

SEQ ID NO: 26183 - DNA, 388 bp, Sorghum bicolor
  Clone ID: 30971441
catcacctttatcacatccgccgctttaccctcccagaggcccaaggggaaggtggtcgagatggaggccattacccgggtgtcccagctgttcctggacgtgaagcggtcgacgcagtccctgatggagtcccagacccagtacatgttcaatgaggtcccgggggaggcagatggagatggagaggacgctatgcaatcctagatgaacttccctttacacaggtgtctgggttagtatgtactgcgtcgtgtatttctgatgcgtcttgcttgtttaggttgctgttaccctgtcaaggcgtggtgtgtgcgatggactgtctgttagctgatgtaggtgactatgcaactcaatctatcttattaaaattccccccttcccccc

SEQ ID NO: 26184 - DNA, 659 bp, Sorghum bicolor
  Clone ID: 30971483
tctggaaaaaccaccctgacctcgtcgtctctctcccatcaagctggtggtttggctccgctcacgcaccgcgtggcgaccacgatcgcgtactcccctcccgctacaccataacccgcgggggacctttttcgctgcgcgatctcttcttcagtcattccgggggcgcttgcgtacgcggcaagggagtcaccagcagccgtctcaaagcagagcccgacggccggaccgagggttttgagaggaagcaccccgcgcgggaccgatggcgatggcggcggcggcgccggcggcgttgtcgccggggacggtgcctttgggggtgctactgcggcgggaggtgaccaaggagcggatggagcggccggacgtgctgtgcggggaggccaaccgcagccgcaagggcgaggacttcacgctgctccgcgcagacgccggcctgcgcatccccggggacccctccacctccttctccgtcttcgcgcttttcgatgggcacaacggatcaggagctgccatatacgcaagggagaatctgttgaagaacgtcttgcgtgccattcctacatgtttctgcagagaggagtggcttgccgtgctcccacgtgcgcttgttgcagcgttcgtcaagaccgataaagatttccaggcagtagctg

SEQ ID NO: 26185 - DNA, 661 bp, Sorghum bicolor
  Clone ID: 30971497
tctggatgctcctccaccaccgcctcctccctcgcctactcgttccttcccccacacatccacactcctccgcccctcccgtttgccgctccgtctctctctctcgccgcgcttctccgcgctgtcccacctcgcggcaccgcagaccgtcgaccagtccgacgacgaaggggcgccccaggggaaggtgcaggtccagctcccgctcgaccgcctcttcgtgccgcccggggcaaccgtggatgcgggggaccaggacgccgtgagcgcacgggtccttaagggctccaacatcgtgctgggcccatacgcgcgcggtgacgcacaggtggtcaacgcagattttgtgaagagcagcgtgcgtcccgatgactgccctcgggacggcctaccggagttcgcactcgttggccggtcgaacgtcggcaaatcgtcgctgctcaactcgcttgtccgccgcaagcgccttgcactcacctccaagaagcctgggaagacccaatgtatcaatcatttcaaagtaaatgacagctggtatcttgtcgacttgcctggttatgggtaaactactgaccagcagacttttagttttactagtagttttccaaaaaaaaaaatcatgtagatgaacatttttatattttcttgttgaaaatattct

SEQ ID NO: 26186 - DNA, 580 bp, Sorghum bicolor
  Clone ID: 30971536
ggaaatggaatgctggtatggggaacggacttcatcgcctgcaagtggaaattgctatgcgtgtgttcagctgttgatcttcttgcacaagtgaactgttgtcatcattctttgattatgatttaggtccttgtggttgtagcgctccattaaatatttcatgaatttgattgtattaccaatttgatagcttgctccttcagaacttgcaaatctctttatatatttactctttatatataggataacaataacataatcataaaatctggtttgtttcataatcaatcatgtattgtggaaactgacatgaaatttatatacgtatatgtttctccaactatggtgagtagacgctatcttatttctgctattagggatttgttactcatgagattaggtttgcatgtttgattatttgttgcttgttcaggtatgggtttgctcaaagtgggtgggaggatggtttattcaacatgttcaatgaaccctgttgaaaatgaagctgttgttgctgagattttgcggagatgtggggactctgttgaacttcttgatgtttctaatgagctacctgaat

SEQ ID NO: 26187 - DNA, 636 bp, Sorghum bicolor
  Clone ID: 30971548
tggaggatgctgccgcggctgcgctcctccgcccgagtgtgcggacaggaacccgcggcggcggcgcgacggctctccgcagctgaagccttcgctgagtgtgagggctcactcctgcgccctcttcccgggctggacctcccgccgtgcctccccgacaacctgagccgcagtcccacccgggtcaccacgctccccaacggcctccgcatcgcctccgaggacatcccgggtccttctgcgtgcatcggtttcttcgtcaactccggctccgtctacgagtccggggagaccaccggcgtctcgcacatgctggagaggatggccttcaaggacaccaagcaccggagccacctcaacatcgtgcacgagctcgagcttgctgggggcaacgtcggcgcctcagcctccagggagcagatggtctacagctatgatacgctcaagggatacatgccggaggctctcgagatcctcattgactgcatgcgcaacccgctcttcctccaggaagaagtcgaacggcagctggtccttgctcgagaagaagtccaggagctgcagaagaaccctgagaggtttcttcatgaacagcttaaccttgttggattttcgggtgctcttgcaaatccgcta

SEQ ID NO: 26188 - DNA, 575 bp, Sorghum bicolor
  Clone ID: 30971568
tcaagattttatgtgggattgatagggttgagcatgctctcaaggtattccgtatgatgaaaggttatggccatgctcctggagtaaaatcatatagcttgctcattgagaagctggctaggcacaatttaggggatcgttccagtgcactgtacagggaggcagttgcacgtggtgtacctgtggctcaaggagagtatagtattgacaaaaggtatgtcaaagcaaagaaggagaagaaggtgaagaagaggctgactttgccggagaagatgagattggagagcaagaggttatacaagctcagaatgagctttgtcaagaagcccaagcgtcgaatggtccgcgtttaagcataatttttgtttcgttggagcggatgatcacgggaatggacaccaccagatccagttataacttggaagatcagaaaattgttgtccctgaattgtggctatgcaacatcatttttcaaaggcgagggctctgtatggtttcactttttttttggttgatgggctggtgactccggtatgtttgatgcaatagcaccaataatgtatcatttcacttaa

SEQ ID NO: 26189 - DNA, 513 bp, Sorghum bicolor
  Clone ID: 30971606
gctagcggaagtttggatcatgaagttcgtctatgggatgctaatacgtcagactgtattggatcacaagacttccatcggccaattgcatccattgcatttcatggaagaggggagattctggcagttgcatcaggtcacaaattgtacatatggaactacaataagagagatgacacttctttccctgccatcatgtgatttttaggcttacttccatggaagttttctatgcaggcttcatctgtgtgatcctctaagggaaaacattagatccatctccaactagattatgacagataattctcaatgagttcatttcaagtgccttggggattggtctgtgcagaggcggtaggagatgtaaatctacatggccatcgtcgtggctgccatcacgatgctgtaattatacctttgtacatgtatattccgatcagcttaactcgtttgctgttgtatttcagaaagggtacggtgctaatccgtttaaaatcaaagttccttttgctt

SEQ ID NO: 26190 - DNA, 569 bp, Sorghum bicolor
  Clone ID: 30971616
caatgacaacactaaatcgctggtcctcatgaactacttcccatcggtccctgtgaagtttacagcatgtctgcagcattcccagaatcttattgacatggtgaatacatgctacggcgcagcggggaatcgatgggctaattttgtcgcggttgattactacaagagaagcgatggaggcggtgcattccaggccacagacttgctcaatggtaaactgttatgcgggtgccaggacatcagggcatgctcgcaaggttctggtgtagtatgttctgcataagtctataagaaataggaatttgattggagtggtacattcatacaggattacagaaatgcaatatttacttggtggtgtgatgatggtagttttaagggaggacacaattagaaagtagattacctgagagtgatgcagcaatacagcagtgtaaacaataggaatatggaagaaacaaccagaagtttcatgtttgtgaatgagagtttactttcaattcatctagttttgaactggaaaagcactgtgactccagagtccaatcatttctgaatatgcagaaaag

SEQ ID NO: 26191 - DNA, 634 bp, Sorghum bicolor
  unsure (1)..(634): unsure at all n locations
  Clone ID: 30971638
gagattaaggatgctgtccagactctatatagcaatggtagcaaaaactttnggatacatgggacgggggctctcggttgcctgccacagaagcttgccataccacggaaaaacgacagcgatcttgatcagtatggctgtctcaagacctataacagagctgcagttgcgttcaacacagcactcggcagcctctgcgatgagctaagtgcgcagatgaaggatgcaacgattgtatacacggatctgttccccatcaagtatgatcttattgccaaccacactaaatatggttttgacaagccgctgatgacatgctgtgggtatggagggcctccctacaactacgatttcaacaagggttgccagtctaaggatgtgacggcctgcgatgacggctcaaagttcgtcagctgggatggcgtgcacctaacagaggcggccaatgcagttgtggccaaagcgatactgagctcacaatactccaagcccaatctcaagtttgatcagttctgcagagtctgatacttgttcatacctgatacctgtgccttttagtttaggcaaatttactgaacagaacttggcacttcaaagtctaaatgggtggatccgcttctgataaattgattac

SEQ ID NO: 26192 - DNA, 598 bp, Sorghum bicolor
  Clone ID: 30971665
gcctctgaggacagaatccagcgcccgacacagacagggagcgaccacatctcttctcccgagcagcacgtcacgtgccacggacaggggtcaagccgagcgctcgcggtccggtcgccaatgtcggcgggcggcagccgcgccaccttctcgctgcccgcggcggcagtaccgctgctctcggcgctggcactggcagcagcagcagctgctgcagtgtcggcggcggcggcgagcgggttcagctgccgtcctggctcccggccggtgctcttcaacttcggggactccaactccgacacgggcggcatggcggcggccagggggtggcacctcacgcgcccggagggccgcgccttcttcccgcgccccaccggccgcttctgcgacggccgcctcaccatcgacttcctctgtgaaagcttgaacatcagctatttgagcccatttctgaagacattgggttccaattacagcaacggtgcaaattttgccattgctggtgcagcaacactaccacgagatgttccatttgcgttgcacatacaagtgcaagagttcttgtacttcagagatagatccttggaactcatcgatc

SEQ ID NO: 26193 - DNA, 600 bp, Sorghum bicolor
  Clone ID: 30971676
ctactgggcttcggcggcaccatggaagaagcagagaacggcgtgaggaactgctctccgacgcgcgcctccagcaacggcgtggggaagctacctccttctccgacgagggagaacggcgtgaggaaccgctccccgacgcgcgaccctggcaacggcaggaggaagctatctccgtctccgacgaggtcgtccgccccggagcagaggaagccctctgcctcgcctccgccgccgcgcgtctccaagtggctgatcctcgaccgcatcgtccaccggagcagcaggaggcattgcggggtcgtcaaagacgacgccacggcctcggcgccggcccaagactgcgccggccgccctgtccgcgcctccctcaggatcgccgaccctcccgcagtctcccgtctctacctccacctgactggcaggccggcgatcagcttccaggagcccaccgccatcgccgcccaccgcaactccattctcttccggctgactgcccccttcgaggatcctatgtggtggcacgaccgctactccttccccatcgactacttcgtctactcctgccgctcatcttcaccgccttcactcaccctgctt

SEQ ID NO: 26194 - DNA, 583 bp, Sorghum bicolor
  Clone ID: 30971680
tctggagcagagaccgcagaaccgaacatcgcaagtcccaaaccctcccccgatctccgccgctccaaaatgtggcgccgccagctcttccgccgcctattcccatctccggccaccggtggcaccgccgcgcccccttcgcctttcctgcgccacctatctacctcaagcaccccgaccccggccgcctccctcgcctcctcccttgcgtcggcgctcaccgcgctctccacgaccccgccgcccgccaccaccccggacgcctacttctcgctccacttctccgacgtgcgccccaccaacgcgctcctcgccgaggcgcttgcgctctccccgcccgccacctcccgcgccgctgccgagctcttccgcttcctcgtccgccgccgctcgctccacccctccgacggcgcgctcgcgcccgtcgttcgccacctcgctcgccgccgtgacttccccgccgtgcgcgcgctcatccaggagttccccaccgctctcgggcccgccacgctcgacgcctatcttcagcagctcgccagagccgggcgaccgacggacgctgtaaaggtgttcgacgaattgc

SEQ ID NO: 26195 - DNA, 643 bp, Sorghum bicolor
  Clone ID: 30971683
cctactggtgatatggaggaaggagatatggcacagcatagcgatggtctggtagataatgagggggagcatgttgaagatgcaaacacagaagcaggtgagatggatacacaccaattggataagaccgattcacttatgcctccatcacaaggcctacagcctgacaatatgcaagtagattctaacggagaatctgaaaccaacttggccaacagcagtgacatgcacggcgctgttgctccttcagtaaatttttcaggaaatgaagtgcccaatatggaaatatctatgcccaatgctggtgatgattcaagactattatccaactctatgccagatatgcaaaatgatgctcagcagcacatcaagcagacaaatcctttcaggagcattggagatgcattggaggactggaaagaacgggccaaagtctcagctgatacacaggatcatcaagcagaaactggaaatgatagtaatgagaacactgctgaatttcgttatgtgcctgagggtgagcagagcacctctcaggcattgggtgctgcaacagctgaccagatcaatgatgacaatcaaattaatcaatctttcttggaagatgaaagccgtgccaggaaattggaacaaagtgatgaga

SEQ ID NO: 26196 - DNA, 269 bp, Sorghum bicolor
  Clone ID: 30971692
gattggcgaggcccaccaccacgcggccaccagaaccagacggcgaggcgaggcgacacccctctcccctgtcctctccctcccctccggcctccccctccctctctccctctcctcccaaaacaagagcagtgacagcgcgcgcgcgcgcgccacgagagcgggtggaacctcgccgcgtcccgcggcaaatctcgcgccgagccctggtttcgacgcgagatccgcgcccgccttccgccgcccccccggggtgggtaggcagcgcc

SEQ ID NO: 26197 - DNA, 488 bp, Sorghum bicolor
  Clone ID: 30971723
ctcgttccgctagacccgacggagccgagcgacggttcctttgcggcggcggcgacctcgagctgagggcagcgagaaggcagggacaactcgatctcccttagctggctagacccgatggagccgagggttccttgcggcgacggcggccccgagctgagaggcacgagaaggcatcgacgggagggcgagcgaatccacgtcctcgatcctcgaattctagagcctctgcgacaaaggtcgaatccattcaggaacatctttcatctattaactcaacgagaggtctcacctcgaacgaaacaccacgccaaaagaatatggaataagtctccaaaatacgatcctgatttaattgagttaaggtttgccgatgcagatgctaaacttgatattttttcttgggcagaatcacagtccctgcatcgctggactgccaagtattgccctcttttgccacctcctaggtcaactattgcagctgcttt

SEQ ID NO: 26198 - DNA, 607 bp, Sorghum bicolor
  Clone ID: 30971733
tggaccttccacagatttcacaggaagtggttggggttgggcggaccagcaaaggcacatgggccgctcccgttcctttacagcggcgcctgttcgggttgtgctcgcgccgccgctcctgctcctcctcttcttgctcggacctcctccgacctgcggctgccaatgtgggggacacctgctccacgaccgccgactgcggcgccggccagtggtgcttcgactgcgagcccaagttctccggctcccactgcgtccgctccgccgccaccaaccccttccagctcattaacaactcgttgcccttcaacaagtatgcctacctcacgacgcacaactcatacgccatcgtcggggagccctcgcacaccggaatcccacgcgtcacctttgacaaccaggaagatacggtcactgatcagttgaacaatggagtccgggcactgatgctcgacacatatgacttcaaaaacgacgtatggttgtgccattcaagtggagggaaatgcaacgacttcactgcattcgaacctgcactggacactttcaaggagatcgaagcattcctttcggcaaatccgtccgaaatcgtcactataatcctgga

SEQ ID NO: 26199 - DNA, 494 bp, Sorghum bicolor
  Clone ID: 30971758
cggggcaaccacagggtgcactagagaacctagatcaggttacacccaccgtgtttgacaacaagtattatggcaacctcttgcacggccaagcgcagctatcgtccgaccaggttatgctatctgaccctgcggcaccgacaaccactgcacctgttgttcaccggttcgcgagcaaccaaaaggatttcttcgcgaactttgtggcatccatgattaagatgggcaacatcaacaccctaacaggaaaggatggggagatcagaaagaactgccggagggtcaatactcatcaataggaaaggctattgacgaagactctcattcaattggtttattttcttttttaacctgttattgttgtgaagttcgtgcaaatcattcttgtgtcattctttgaaaatgtgtccgtgtatgtacccttttcccgttgttggaaagcaaatgtgaaaagtgtttttacaccacttgtatatgcattcctcgtaaaatat

SEQ ID NO: 26200 - DNA, 519 bp, Sorghum bicolor
  Clone ID: 30971777
ccaactttcatttgaaacagcacttgacttgattgtggagctagcaaattcaaggtcaaaaatgttagctagtttctcccagttaaaagagtgaagcttgacattctgttttgaggttttgtaccctgggcaccatctattcagcactcatgggatcgcagcaactgtaaactaagttttgagatccagtatatttaagaacagctaaatagcatataatgcttgctatgctgattgctgatgtgaaggtggagctcacatacctgtgaatgcgagaacacatgctggaatcagtcagaaattgcttgaggcaaccagaaatcaaccaaccatcaaaatgattcctttcaacacccgatgcaagtcatgtatggatatggtttagagtatgcgtttggcaccctggtgggctctgcttgtctatactgttggattgaattattcagacggacactaacggcggcagacatctggacactccaataaaaaaaatgaaatctgtacttgtatacttctatc

SEQ ID NO: 26201 - DNA, 272 bp, Sorghum bicolor
  Clone ID: 30971782
ggctcagatcccctgatggcagtgtcccgtcccgtcccttgctgtactcgatgcagaatgctttagaagcttggtgttgcaccctcctggaaccctaagggttcataaaacttgttttacagttcgaggttactggtatgagaccattgaactacttttatggttatcccagagttcattctggttgtagtttgtagacgaacgggagaaatattgactttgctgtttctctgctattcatgttatatcgtctcggaagcaataaaatttct

SEQ ID NO: 26202 - DNA, 592 bp, Sorghum bicolor
  Clone ID: 30971796
tcgtgctgacctggacgtgcttcgtccgcggcaggggtttggccgcgaacgacgaggacgtgttcctgttcttcttcgcggacgcccgcgaccggcttgaccctccggccggggcggactacttcggtgcctgcctgaccggatgcctggtgaggctgcccgcgcgggagctccacggcgagggggcgctggcgaccgcggcgtcggcggtgcagggagcgatcgagaagatggtggaggacccactcggttgccgtcccgggtgggagttctttaggttcgccggcgagccagggcttcggcttgaacggttcatgaacgtgtcgggttcgccgggcttcagggcgtacgaggtcgccgacttcgggtgggggagacccaggcggacggagaacatcaggatgaaccacgacgggcagctggcattgatgcgcgccagggacggcgacggggtgcaggcgtcggtgtccatgctccagcagaagcacgtggacgctttcaaatctgagttcctcaagctgctcggttgatttgttggtcttgtaattatactttgcaatagcttttcaagagctatgacgtcaatcttgcg

SEQ ID NO: 26203 - DNA, 531 bp, Sorghum bicolor
  Clone ID: 30971805
aaatgaagcagaagggacaactcgtagcttcaacacctgcaggtaacattgtgcgcaccaccagaggcagtcttaaccgaaatcaatcacaaaacaaagaagggaatgctgcaccaaatttcattactttaaaaaatttgtcggatgctgtggcaaagagacgatcaaccaaaaagaattgaatgacgacagagtttcagtgtcgggatagtctaaatcaggcacatgtaaggctatgcaggtgaggcagtggagtgtcaggtgcaggctaaggtgctatgttgtgtgaggcaatagggagtaaattaatttaggctatgaaaaatgcaagtgatgaagctagagtttgatgtggagcaaacaagtgatatgatcgcctgcagtggtgtgtaggcatcttatatgttttggcttaggaacaaatgttttggatatctttgtttcaataatgtgtgtgtaatctgagtttgaatttggattatttatttctagatgtgaaaaattaaacaagttaatatttggtttaaggtt

SEQ ID NO: 26204 - DNA, 642 bp, Sorghum bicolor
  Clone ID: 30971810
cgtagcgatggacgaggacgtggacgactgggacggcgtcctgcggagcgagcccgcggacgccggtctgctgcaggacgcgctgcacgacttctacccttttacgcgtccgcgcgccggcggcgatggcaggcgcggcctgtccgcggccggcgccgacgacgccagggcagccgcagctgcgttggtgccggtaatgcaggaggggttcgtctttcccagccctttcgcgggcgtcgacgggaacggcgagtacccgatgatgccgcagggcctgctcgaggacgtgatccaccactccccggcgttcctggaggtcgtggccgcgccgtccgtctccgtcccgacgcgacgcggccgcaggggctgatggctccggcgcccgcgctgtgcgtgcgcgcgtgcatgaatcgcgtgcgcgcggggcatgaaatggaggatctggttcttttgggattcacgattccttgctcatgattgcatgactgccaaatcaatcatctagtcgtcttgggttttactagtagttagtgtagccagcaagtagtagatcgatgtgatgatatgcggggtgtcctggtggtgtgctctgtagttgtttaactggagtggcaatgcatggaatcaaagtttttttcgggg

SEQ ID NO: 26205 - DNA, 554 bp, Sorghum bicolor
  Clone ID: 30971823
aggaacagagaagatttgttcagacatacctttgctctgcaggtgaaaagccatcagatggggaagttgaaaaactactagggttgattgcaaagtacactcctgcaagccatctcttttggggcctgtggggaataatctcggcacatgtaaacaataatatcgacttcgagtacaaggaatatgcaaggcaacgcttggatcagtactggcaaacaaagcctggaatgcttgggcccaactgactagtcattgttttgggggtccttggctagctagtcctgtgaattctgtttgtcattagcggctagtagctgccagttttttactacagtttgttcagctcgttgtgacttgtgaccatattcttggcttagagtacgcgatctgtaattaatgtctacccagtagccttacacggttctgaacaaaattcctggctgacagttcggatcgttttgcggttcaactgattgctattctgacaattttcatatgcggtcatgtgatcaaggtatggcatggcggcatgtgatttgcatgttgcttatgag

SEQ ID NO: 26206 - DNA, 628 bp, Sorghum bicolor
  Clone ID: 30971828
tctggacaccatcctcactcgccagcagccgcctcgccacaaaaccccacctcgatcgatctccgttcgcctgcggagcgcgccgctcaaggctcaagccatggaggacgtggccaacgcgcacctctacgcccatgcccacgcccaccggagcaagcgtcccccgtcgtcggccgcgatgaaagacggggacggggacgtcgacttgtccatgaagggcgcgcggtaccgcggcgtgcggcgccggccgtggggccggttcgcggcggagatccgcgaccccatgtccaaggagcggcggtggctcggcaccttcgacaccgctgagcaggccgcctgcgcctacgacatcgccgcgcgcgccatgcgcggcaacaaggcgcgcaccaacttccccggccacgccaccgcgggctactggccgtggggcacgccgcagccggcggcggtcgcggtcgcgcacccgatcaacatcaaccccctcctgctgcacaacctcatcatgagctcctcccaccacggctgccgcctgcttaaccaagcaggccacggacacggacacgggcacggacacggacattccgttcccaccagacctccggcgccggcgccggcgacggatgacacg

SEQ ID NO: 26207 - DNA, 627 bp, Sorghum bicolor
  Clone ID: 30971830
tggtcgcagctgctaccgtgcacttgcgtgtcgtccctttccgtgtctccttcgcccctctgcttctcggagacgctccactgacgtgctgctggtggtgctggttggggctgcggcggcgcaacagagagcgccgccgagtgcgggatcccttccctatacggagagatggatgcaaacacacagtgagagcagcccgtggattgatttccccagtcgatccgagccgccgtcgcgtaacggggatgctgaatctgagtccgcccatgttcaagccgcgcccgcggcggcgtcgccaaatccaaacccgcaacggaaggactggttcgcagactaaacgtaaaggctcaacctctcagcaagatgagaatccacttgagagtcaaataaatggatattcaggaccaaaccttccagaggacatctggtgctacatacattccctaatgtcaatgcgagatgctgccaaagttgcctgtgtgtctcgggcctttgttcattcttggagacgccatcctgacctccatttcagcaaagaaacattgggcttagatgaaaatgcttgccagaaggatggaatagcagatttcgacagcagagttgacagcattctgaaaaaacactcag

SEQ ID NO: 26208 - DNA, 666 bp, Sorghum bicolor
  Clone ID: 30971833
gagagaagaaagccttgttcacagaattgacaatggtgtatcggagattactccgcgcagtatgccagaggacagaaatggggacacaaatagcagcagtaatgagtatgatgtgtatggttttgaggatgctcctgtttctacatcatctaaagatgatgaacaagatctgtctccagttacacaatctgctgttgagcatgtcccaaaaagaggaagggaaagggcttacaataaacaccctaatcagatcgttcctggtaaggcaaaagaaccaccaaagagaaaaaaagcacgccgcagctccactgttaccgagccagatgcacgcagagttgttgatgcaccagaaaactcaagaaatttgattcctgatatgaatagactggatcaagtagaaatccaaggcaggtctaaccagattgtcatttttgaccatggggacaccacaactgaagctttacaacacagaggagatgctcaagtacaggtccaccttcctggtgctgaggttaataacttcaatagtgccccaactgcaaaccctactcctataagcatatgtatgggtgaccagcctttaccttatcaaaataatgacagcgcaaggtcgagatctgaaaatagttttccagtagatgctcatcctggtttaaataatctgcc

SEQ ID NO: 26209 - DNA, 571 bp, Sorghum bicolor
  Clone ID: 30971842
accgtcttctaggtgagatctcgcctcctccccgcgcgcccccttcctgctcggctgctcgagctccgagtcgcccgggacgctccggtgactcccgcggaggctcagtatatttccctttcctcaaattcttccgtggttacgttgattttgcgtgcggaggttagaacctaggaatctaaccttcctagggtcgctgtccatatgcttatcctctcatcggcggctggaggtcttgcttccgcccccaaatagggacgttccgtacttgctcctctggtccgccgttggcgctctgtttactaggaaatttggtgggttccgccttgtattttgccgctcagttaattgaaatggtggtttgctaaggttccggtctgccctcccggactcttatgttaggttggtgattgtccccgcggatccaaatatagcaggagctatttcccaaaccagaattgagactttatctgggttaattgcatgagcttcctgtcttctcttgtaattttttcccctgtgaagaagacttaggtagaaccgtagaaatcccttaggcctcgttttggat

SEQ ID NO: 26210 - DNA, 595 bp, Sorghum bicolor
  Clone ID: 30971844
actcaaaccgacacgactcaccgccccgcgcctctccacctccgcagatcgccgccgcttccttggccccctcctccgcgcgccgatggccgccgtggacccgccgccgcgcggcgaggccgcgcccgcgcccgcgcccgtgctgaagcggagcaccagcatcgaccggatccctgaggacgcgcgccgcatcctgcaccgcctcgccggcgacctctggggcagcgacgtggaccccagcgcgcccaccgtgtcccagctcaagggcgccatgaccaacgaggtcttccggatcacctggcccggcggcgagggcgacccgcgcaaggtgctcgtgcgcatctacggccgcggcgtcgaggtcttcttcgaccgcgccgacgaggtccgcaccttcgagtgcatgtcgcgccacggccaggggccccgcctcctcggccgctttgccaacggccgcgtcgaggagttcatctacgccaggacgctctctgcggcggatctgcgcgacccggagatatccgcgctgattgccaagaagctgcgggagtttcacgatctcgacatgcctggacctagggatgtgtcattgtggcag

SEQ ID NO: 26211 - DNA, 524 bp, Sorghum bicolor
  Clone ID: 30971850
tctgggttaccccggccgggcaaattaaattgaacatggcgatctgccatgccagctgggtgctgacggtcgtcgtcgtcgtcgtcgtcgtagcgggagctgctcctcaccacctgctggtgcgcggcgcgagcgacgacgacggcggcccgtcgtcgccgtcggctcttgccggctgcgacctgttccgggggaggtgggtggcggacaagtcgtacccgctgtacgacgcctccacctgcccgttcgtgccggacgtcttcgactgccgccgcaacggccgccccgacgacgcctacctcaagttccggtggagccccgccaactgccggctgcccaggtttgacggcgccgatttcctgaggaggtggcgcgggaagacggtgatgttcgtgggggactcgctgagcatgaaccagtgggtgtcgctcgcctgcatgctccacgccgccgccgccgctcccgtccgcgccaccttcaccagcggagagcccgtctcgtccgtgcgcttcgaggactacgac

SEQ ID NO: 26212 - DNA, 602 bp, Sorghum bicolor
  Clone ID: 30971882
ctgggcttttgcgttttgctcggcaaagggaggctacttcagcgagacaagggtttcttcttccagtcccaagcgtgcccggagacaccactcccttcccttccacaccacctgaccagcaaggtagcaaccgttctgacacggcggggcggagcggccgagcggggcaggatctagatggcggcggcgacggaggaattgcagctcctgggatccatcccggcgccggaaggcgcgggggaggtcgacggcgcggtggcggagaaagggcgaccgcgaggcggcgacgacgaggagatcctgcgattcatggactcggtggacggctacctcctcctcatggactccctatcctccgctcttcgtcagggctggcttgatctggcaagtgctcgccattctatgggcccatcacgtgtttcgagtacactgtttgatcacaaggagcagtctgctgccactaagcttcaagttgttgatcatgatggcctgaaaccatcagagccaaaaccacactttgctctatcaaagtggtctttgcaagaagaatgtccctccacctatgatgtcagtgaaagagcttttactgagccaaagatgag

SEQ ID NO: 26213 - DNA, 576 bp, Sorghum bicolor
  Clone ID: 30971929
gccgcggccgggtcacgtgcggagcgcgagcgtcgtggggcggcggctggactccgagagcgtggcggtggtgacggagtcggaggacccgctgggcgacttccggcggtcgatggcgcagatgatcgtggagaacggcatcaccggcggcgccgagctgcgggagctcctgcggcggttcctcgcgctcaacgccgcgtgccaccaccacctcatcctccgcgccttcgccgacgtctgggacgagctcttctccggcggcggcggcggcggtagccacgtggcggcacaatcgcacggcagcggcggcggtcgagctagcaaacgtccacgcggtcgcgctgacacgttgagttagccacgacccacagtcgtctcgctagctcgtccctctgcgatgcaatgcaaccactctcctcgggaattgttgctgtcgtccgtgtccgaaatacggcgcggtggtgtacagtgtaccagtagatgacatgccctgcacgcgtggctttctgtgccgtcaccagaaaacctgtgactttcattgcgattttttcgtacagatcatacgtagctttcgcc

SEQ ID NO: 26214 - DNA, 523 bp, Sorghum bicolor
  Clone ID: 30971934
ggtggtcagctcaaaaaactgttcatcgcaaatgtcccagtgaactgggacgtactatggattctcctactgcttggtgcagcaccagccttggaatcgttccatgttcatattgacaacaactcggagcagcgaagctcaggtgatctctgtgacagtctggacgccaatgcgcatcagcatcagaactgtcgcctgaaagacctcgttgtggcaggctttgaagggttggggtggcaaacaagctttgtcaggctgatcatgaagagggcgccgttgctgaggcacgtgcatctgctcgacggcgaggtcagggatgacgagcaggagcttggggcgctgcagattgtcccacgccgcagggtgtggcacgagtgtgagcgagctgaggtgctagatgacctaaccgctgggtttcgcttcccgcctcgaataattctggaatgagctgcatagcttcttgtttaaataacatcattctatgccttgttaaaccggtttatattatgaaaaaaagaattag

SEQ ID NO: 26215 - DNA, 638 bp, Sorghum bicolor
  Clone ID: 30971941
gccaacaactacctgctcaggaccttgatggagatcctcaaaagcgccttcaagcaacactgcaattggcggcaaccctgcttaagcagatacaaaatcaatcaaatcctggtggccagaaatagatgtaaggtattggtaatgtctagctgcaaggatcatcattggcgccatccttctttgttctgatctgaggagcttgaaactgatgactacatacttctgtggttttataccatcacctcctgtgatgtgaatgtttaggacgagtggtttccttttaaactactctctccattccaaactataaggagttttggctatatttatatacatacttttttgctatacatttagatatatatacacaccatatgtctagatatatagtaaaatgaatgcatatagagaaaggcacaatgccttttaatttggaaatggagggtgtatagattagctgttgtctgcattgttgttggcctggtacagatggtggagcgtaactgagtaactgactgtctcctttccagagggtatgatggtatggctagcattagtaacaatagcaatgcagttattactatggatgttcaccccaagtttgcgatttttgccaccttatatcatcaggcgttgcg

SEQ ID NO: 26216 - DNA, 648 bp, Sorghum bicolor
  Clone ID: 30971947
cggagctgtacaggatgggggccaggaagttcgccatcatcaacgtggggctagccggttgcctgcctgttgcacgggtgctcagcgcggcgggggcgtgctcggacagtcggaacaagctcgccgccggcttcaacgacgcgctccggtcgctgctcgccggcgcaaggctgccgggcctcgtctactccctcgccgactcctacggcatcatggccgccatcttcgccgacccgccggcgtcggggttcgcggacgtctccggcgcgtgctgcggcagcgggcgcctgggcgtaggcggctgcctgcccacctccagtgtctgcgccaatcgtgaccagcattacttctgggacgggatccacccttctcagcgagccgcgttgataagagcacaggccttctacgacggcccaacacagtacacccttagcagccaagttcccgcaacatagggtacgtggtacggaaacgtggtacgcggtacgacattatcataaactatggaacgtagggggtatatagctttgtctcgttccttttaagttgcggaacgcgttccactttctaaaggaacgtgtttggaacgtagtggctggctcaggtagttttacgtgttgtttgaaccaaatgaattcgattcctagc

SEQ ID NO: 26217 - DNA, 634 bp, Sorghum bicolor
  Clone ID: 30971955
gttgtaacactgaagctgctgctgaaatactaagagtaatggtatcaagaaatgtcaaccacaggagtgcattttatctgtctatagtcacaagggttgccaagtcaggtcgggttaaagaggctcaaattctacaccaggagctagtacagagcaaggttcttaaagaggattcccaatttattttgagcagctagttgctggattgcaagatcctcatgtcagagtcatggaagtgatagaacacacgagtcagctgacatagcagataattcctggaagttttgcagcacacaatctgcataatgtcttcggtccatatttttgaagatgttggccagaaccagaccatgatgcatttcttgatggttcatgccttcatggcatagagtggaggtcatgctccgcatttctttttgtctcaccagcagcagcattgttcagataccgaggttccgtgccatagttctgcatgccactaaacatggttattggctgatgatggattgcagagtaaattccctgaatgccattagaatttatatggcttcccccactgccatcgaagttcttttttatgctcgttgagcaacctcaactgaaccttgattctctaaataaagatggccgcctc

SEQ ID NO: 26218 - DNA, 528 bp, Sorghum bicolor
  Clone ID: 30971960
agtttgtcaggtttcggaaggcattccatgttgaggatagctgcatcatcaaccctcccttttatttgttctctatttacctcggagacaaatgcaaagcaaggtcttcaggctataagaagaattttcacatattaggctgatgcctagaaattttcttctagatatggcagctctgaaggtgacatcaacattgtgcctcagcctgctggtcatgacactcctcttggatccaagctgtgggaataaggaaccgtgtgacgagtggtcaagtgacacataccgaatgctgctcctgtgtagcagcaaaacgtgcagcaagcactgcatcagcgagggcgccaccagggggaagtgtggctccctcatcttcaggtcattctgcttctgcaccaaagaatgcgactgaacacagtcatctgaactgcaccgttgacttgccattttcagcagtaatgatgacttgcttatgaataagagcaaggttgtgatgtgatgtggctactcagatcttgattcgatcaataa

SEQ ID NO: 26219 - DNA, 441 bp, Sorghum bicolor
  Clone ID: 30971984
ttcgagaaggtagccaagctaaagatatcatttgatcagtttgagaaatccaggaggagtgttgacatcttcgagaggccaaagaggaccattgagcagctggactgtggtcggaagagtgtcgacagattggacaggatttgggctagttaaatttcctttttttccatgatatccaggttatccatggggttcggttgttttgggggattttacaggtgtggcataagagttgattccccgccccaaaaggagcgaagcatctttgaggctttgtgtagagatgtaatggcttatgtgtggtgggagaagtgtatgttgttattcaaagaaattgttgctctcttctgttaggggtgagtagtccatggcagcattgtgtataatctgatgctttgtagcaacaatgcttttcttgtatttcattgacttgaacttctc

SEQ ID NO: 26220 - DNA, 638 bp, Sorghum bicolor
  Clone ID: 30971994
agaagaagtggtgcgtgctgaagccggcggcggacctcgccgaccagaaggtgggcgacagcgtcagctacgcgtgcgggctcgccgactgcaccagcctcggctacaagacctcctgcgctggcctcgacgccaagggcaacgtctcctacgcctacaacatctactaccagaccatggaccaggacgaccgcgcctgcggcttcaacgggctcgccaccaccacctccgtcgacccgtccgccgggacatgccgcttcatcgtcgagatcgacgtcggcgccgccgccgcgcccagctctgccatggccggcgtcgccgtcgggtgggccgctgccgtgctcgcggccttcgtgctgtccgtggtgttgtgaaactgaatcaagctttggtttccctcgatcgtcgtcacatagataagaccgatcgtggtcttcgcgtgcccttttgtcttgagctcgcttctggtgatgccaggagaattattgactagtatctagtattaatttgtttatcttaatcgctactgttttctcttggttttggatagctctttctttgatttcaatttcgaaatgtatgtgttagttatatattgttagccgttttttaattttttttaatataagacgcattac

SEQ ID NO: 26221 - DNA, 446 bp, Sorghum bicolor
  unsure (1)..(446): unsure at all n locations
  Clone ID: 30972011
aaaaatcagactatctaggtagaaagtcaccacgctcaatgagcgaataagcgagagaccgaggagggacggatcgggatgggtggggtgacctcgagtgtggcggngaagatggncttcttcccaccgacaccgccgtcgtacgcgctggtggaggacgctggtgcgggggtcaccacgctcagcggccagccgcaccgggagaacgtcgagttgctgcgcctccgcacccgcaaggggaacacgctggcggngatgtatgtacgacacccggacgccgcgtccacggggctctattctcacggtaacgccgctgacctgggccacctttaccagctcttcctgcacctgtccttcaacctccgcgttaacatcctcgggtatgactattcaggatatgggcaatcatcaggaaagcccagtgaacacaatacttatgctgacat

SEQ ID NO: 26222 - DNA, 667 bp, Sorghum bicolor
  Clone ID: 30972022
atacttccacgagttcttcttcttcttcttgcctgcgagagccttgctctgtttaatttcttcgcctgcctgcttgccccttgctcctcgatctcctcggcttgagcagttacatacaccggcttcttgatcgatacatccttcacccagacagcaacatcgtctagttcaatcttccacatagtttctacggacaattcaccgaaaaccttggccatcacgcactttcctgccgatcggccgggccagttcacggtcaccacgaacacagaccgtacaagtccacaagaaattccccttccgccttgattcactgagcagtgagcacaaccccgccaccgtcgtccatggcgcgcggcgggcggtccgtgtcccagcccgtggcggcggagctgctgctggtgctcgcggtggcgctgtgcgcggcggcgaggcgcacgagcgcgatcggcgtgaactggggcacgcagctgagccaccagcttccggcgagcacggtggtgcggctgctgcaggacaacggcttcgacaaggtcaagctgttcgacgccgaggacaccatcctcggcgcgctcaagggatccggcatccaggtcatggtcggcatccccaacgacctgctcgccgacctcgccgccggcggcaaggccgccgacaactgggtcgc

SEQ ID NO: 26223 - DNA, 534 bp, Sorghum bicolor
  Clone ID: 30972041
gtaccaatgctcctccatttcaccgtgctcggctgctcatagagtcatagtcatagctccccactagctgagccaccgagctcgtcacgcgcgcacgcttgttccaggccgccgccgccgtccgccgagggccagggcatgaaagcgacgacttggcgcggcgcgccggggactctacccgccaccgccaagaagaagaggaagaagaaggcgcccgcgccgcgcggcttcatgtgcggctgcggcagcaccagatcggtctccgtcgacatctccgctgtcacgacgacgccgatgaagagaggcgcttcaacggcggtggctcccgcgggggagccagcgtctgcggcgaagacaacggcgggccgcggccgcgacgccgacgccgacgcgagcgccgagggcacgcccagcgtagactcgctgctgcggcagctgcgggagctggagcgtggcgtccgcgcgctgggcgtccgggagcgggaggcggacggcggcgtcggtggcagcggcagcagcacggcagggacgacg

SEQ ID NO: 26224 - DNA, 435 bp, Sorghum bicolor
  Clone ID: 30972047
gcgtgatcttcctcgacgtctgccgacatcctataacatcgctgttgatgacatcctcccaccacgctatcaccgcctgaaacgccttaacatggaggctatggcagcatacgaggcagagaagaacatgcacaagctgactgacatctatgccataaaggctcggcatgagcgttggatggccaaaatcaggccttccacagccatcctggaacgctacgagcgtcgggccatgaggcgctacgtcaagcaggtgaacgcattccttttggccccaaagaatgtgcgtcagcgccggcctgtccacaagctcaggctacaaatgctggggcgttggcatgaaaacattgatgaatgggtcactgcagccattgccaagtggggcgttgaggactttgagcttgttattgatggcgattgtgggggctataacct

SEQ ID NO: 26225 - DNA, 659 bp, Sorghum bicolor
  Clone ID: 30972055
tggctcctatgttgtttctcaattaccgcaagaaaggccaccagcggacctccctatgggtattgcacaaggtgaacaccagcaactcccaaacaggttgccctcaggatggtccaataacctggatgatccaaatccaggttctggtaactccagtttggagcagggtgcaatctctcgtgcgctaaataacaggacacatgatccgtacacatttgcttctggagtagtaccaactgggacagcttcagggtatgcaccaggtgaagcatccaacagcatgtcctggccttccatgcaacccaactcacagcaggtagctagatctgatcaacctactattccagtatcactgccacctgatcaacttgcacagctggctgcccttcttgcacaacaaaaccaacctagaaaagttggtttgcctgtggacagctcaaacaatcaatctggattcatacagaattccaatcctcatggacatgctacaatgatgccaggcaactctggctccatccctgtccagaactcactgccacctgttccaccatctatgcaacaattacatgcccatgtgccagtgccaccaataggctcactacctgcaaatccacttaatgcgcttccgaccagtgctcctatacttggtaacaccactt

SEQ ID NO: 26226 - DNA, 567 bp, Sorghum bicolor
  Clone ID: 30972058
agaccccactcggaccaccacgcgctgccgcatcacccgtcatggaggtcgccgccgcccgcgggaccggcagcggaggaggaggaggaggtggtggcggcggtggtggaccggccccgttcctgctgaagacgtacgagatggtggacgacccgtcaagcgacgcggtggtgtcgtggagcgacgcctccgacgggagcttcgtcgtctggaacccgcccgagttcgcggcgcggatgctgcccacctacttcaagcacaacaacttctccagcttcatccgccagctcaacacatacggttttcgtaaaatagacccagagcgctgggaatttgctaatgaatactttgtcaagggacagaagcacctgctgaagaatatccacaggcgaaaacccatccacagccacagccatcaaccaggtgccctgcctgacaatgagcgtgctttatttgaggatgagattgaccggctttcacgggagaaaagctgccctgcaggctgacctctggaaattcaatcagcagcagtcaggggctgtgagccagattgaagatcttgagcgg

SEQ ID NO: 26227 - DNA, 584 bp, Sorghum bicolor
  Clone ID: 30972077
tctggtttatcatatccagatgtggggatttaagaggcgagggattgttgtctctactcgcccaaggccatctcaccacattatctgtcttccaaacgcccaatctctttgttgattccgatccctcacaggtgcatgaacaggagattctatcctgttcctccaaactgcaggagctccgaataaatgatgtggctggattcactactgcggccattcatcgtagcctgatcttttcctcgctcaccaaattggatatttttcggtatgataaggtgaagagcattaccgaggagcaagaggcccttctgtttgtcgactccctcgaggatgtcacattttttgactgcagtaacctgcagttcctgactgaacggctacgtacacttcacaacctcaagaggttatacatcgacatgtgcgactgcgaagcaatccacatgctacccaaggatggtatcccaagttcacttgaagaattgtatatcaggacttgtccagaactccagtcactgcccaaggattgcctcccagattcactgccaaaattagtgatcagatactgcccagcaatactgtcgctg

SEQ ID NO: 26228 - DNA, 632 bp, Sorghum bicolor
  Clone ID: 30972116
agtatcttgagctgaggttcattgaatcaatcgccaataactcaaagattttcttcggtgaaaagattcctagtatgatcatggatcaaaggttgctcaagaattaccttgatgctgttcctaggaaggaccattatgaaatgtagaagcgtttccgtttgttggaagcaagagacctttttttgtgtgtggtcccacgcagtaggtaggattcccacggagccgttcagtacatcagtaagctaggagtcatcaggatcctcttgaagatgaaattagcagttatgagatttttggcttgttttgtgtagtagatgcattagggcaactggagcattcgcatgtgaccgacagtgatgcaatgcaagcagtgcaaatcctgttgggtatatcttgctagtcttcaaaactgatggtcaaggctgctggggtaggcctgctacacaagctttgtaaccactgacccgtttgctagggctctagcacctaaaagaactccggctctggtttcttacgtggagttatgtggagtgacttctttgatgggagtttgaaggtgttttgaaaaatgtaagacaaaaagtacgtctagtgatagttctgcaataatttatattaggttgtaaatggtc

SEQ ID NO: 26229 - DNA, 154 bp, Sorghum bicolor
  Clone ID: 30972122
tgcctgtccctgaagagcactatgggaaaggtgtaccgggtgttttaaaatttccatttagccatagaacttccaggagacttgagtgcttggcccattttgcaattttccctacgaaccattttttgtgcaactatcgaggattaagtagtta

SEQ ID NO: 26230 - DNA, 558 bp, Sorghum bicolor
  Clone ID: 30972136
cgcatctgacctcaaagccgctgcgaaagcagccaggaccaatgccgaaagggtaggggatgctcaggttgccacatctttcttggcatccgggacgtgccatccctccggcaagtgccagcaggcgcgtggtgctcagcatggtggcgagcaagagcaaccatagtggtgaacgccagggcatggctggctgtctcatatctcccttgctatgtatctgttgagctcatttggtttcatctggaatgcccattacattggtgcagacgggtggagagcaagagaagagatgatatgctgctgcaggccattacatattctgcattggtacctagaggtcttgcttcccggcaaggagaagacctgttgtctgtcggcttcgagttggccttcattgataatgcttggtttaggcttgtgatgcaagacggctatgttgtttctcaattatgaatcttggacaaatgtactagtgctgtcatcaagtagtagacttagggcactcccaatacaagactctatcacagagtccaaaacaattaattatatattatttat

SEQ ID NO: 26231 - DNA, 604 bp, Sorghum bicolor
  Clone ID: 30972176
agcggcttctcctaattctcttcaccttttcgacttctcctcggtttctcccccatggcggcggcgcggggcgagggtgagagcgccgccatcgctccccagtgaggtcgccacctccaggctcctcgaccccctctccagcccaaagaacgtcgtcctgggcggacaaccacacacgacggtgacggacacccccgcacgacagtgatgacgacctagggtttcggcgattcctcgctggcggctgcggctcagctcgggagccccatatgctggcccctactgcggctgtcccagcgcagcagctcctgcacgggtgccccacggcgtgggtttctggccggagtccaccgctcgcaatggttgtcactgctggccacaggcggatagtcccgacggtcctctgcactgcactctgttcatgcacagttgcgcccttctgctctgtttgcttgttggcttcttcaggcatataccaagaaatgtggcacaccattggatgttgtcttccataattcagagataagaaagaagaagaaccatgacgattgatcaacaagggactcatgacggaatgcctagacaactcaaatatgctatgtca

SEQ ID NO: 26232 - DNA, 474 bp, Sorghum bicolor
  Clone ID: 30972193
acgagcgaggccaggcgacttcatactgctcgcctcgccgtctttcccccccaatctgtcgctcctcccagctgcgagcgatcgccgtaccccgcgccgccgtagggagccccctcgccatggccttgcaggggaagaagctcatcaacaacccggacgatgtggtgacggagttcatcgaggggttggtgcagacttacccgggtctgcagtacctcgacgggttccctcatattaaggtcgttcttcgtgctgatgtccagcgcggttcctatgacaaagttgcagtcatctcaggtggtggaagcggccatgaacctgcccatgctggatttgttgggccagggatgttgaccgctgctgtttctggagatgtttttgcttctccacctgttgattctattttagctgctattcgagctgtaactggtcccatggggtgccttctaatagtaaagaactacactggtgata

SEQ ID NO: 26233 - DNA, 593 bp, Sorghum bicolor
  Clone ID: 30972207
ccgcacgccgccgccgccgctcgctcctcgcccgctgtcctcgcccgaccacagccggaaggaacgctgctagcacttccggtagcggcgacatgagtaagctgcagagtgatgctctgagggaggcgattgcctcgattaccaatgattcccgtgagaagcagcgcaagtttgttgaaaccattgagctgcagattggtcttaagaactatgaccctcaaaaggacaagcgtttcagtggttctgttaagctgcctcacatccctcgccctaagatgaaggtttgcatgcttggtgatgctcagcacgttgaggaggcagagagaataggtctagacagtatggatgtggaagccctcaagaagatgaacaaaaacaagaaactagtgaagaagctggcaaagaagtaccatgctttccttgcgtctgaggctatcattaagcaaattcctcgtcttcttggtcctggtcttaacaaggcaggaaaattccctaccctggtgacacatcaggaatccctcgagtccaaggttaatgagacaaaggctacagttaagttccagctaaagaaggtgctttgcatgggtgttgcc

SEQ ID NO: 26234 - DNA, 650 bp, Sorghum bicolor
  Clone ID: 30972222
gaaggcttctacgcgcggcggcggtggcgcgttgaaaccgtcggcgacgaggaggtgcgattcgagcccccaccccacccgcgacgcgtccgagtctgtgtaggatcctgataaggaacacaatttatcatactcgcatcagtgctccgagttccctttggacatgtgcagctgtagcttcctattgtgttagtgcattggccaaagcagaggtactgctcaggaaaggcacattcatcgatgtctgttaatgtaaccagagaaacaaggatgctcattaaatcaacctggcatattatttgaaccaacagaattgaaggctgattgttgcttaccttggcggccttcttccagatatggattccccccatagccactggaacagttgcagagataccctgggctattgactgaagggatgcactcactgttcttgctaagacatgcataggatgacatatttttctttgcttcatcacatgattcttccccaacaacccagttaagcacaagaggcactccatcactgtacttgtcagcaaaatggtggtctgcaaggtcagagacatcaaacctgaactgttgggtctcaatcacgaaggcgtaactgcatgggttgaactccagcacgcttgtactccgccttgttg

SEQ ID NO: 26235 - DNA, 596 bp, Sorghum bicolor
  Clone ID: 30972230
ggcgcccgaccggccgattccacctccctttccactatagcgccaaagaggaagagaccacggctggtaaaatacgacgaagatagccgtccggcgagcccagcgaagccagagttggcggagccgtcctcaaagccggagccacctcctgtggccagatcagaagcaaagacggcaacgtcggtagcagcagaaagtggcaccagcaccgcccctgcggctgccgcccagcatgagacttcacgggagccagagaagacggaggaccgtggtagaaacagagactcggatttacggccaagcgaatcagatcggcgagatcacaggctggagagccaagccgagccgccggcgccggcgccttcagtcaagccggatgctgaagcaaagccggtgggctccgaggccaggaacggcgaaactactgccacgacaaagattgagctggcatcggatggcgctcggcaagacaagaagttctccattgatctcatggctcctcctcctgggaagctatctgatgatatagatggctcctccgaccctgatgcagataagaagggattggattctgagatggacatgttggggagagg

SEQ ID NO: 26236 - DNA, 604 bp, Sorghum bicolor
  Clone ID: 30972233
gttctcccgttaagtatgatggatttagggcacctgttctcccgttaagtatgatggatttaatatcctatagtacagatagatacacccctctgtttctaggtaccacttgtgcactaacagactaaactgccatggcagccatgagcccatgacctgaatgaaatactgaaaatgaaatcagttaaatgaactggtatacggtgcactcttcagcttcattcattttagtggttgcttgagatcattttagctgagtacaattcaggaatcgagcatgtaatcatttttgcaactgaacccggaatcaggagtgcattgttcaataggaataggattagcccacaaagtaaaaaaggttaacaaaatatgttcacaccacgcgccactgaggccttgtttagttcaccctaaaaaccaaaaaactttttaagattttctgtcacatcaaatcttatggcacatacataaagcactaaatataaacaaaaataaaaactaattgcacaatttacgtgtaaatcgtgagatgaactttttgagtttagttagtctataattggacaataaattgtcaaataaaaacttaaatattacagtactc

SEQ ID NO: 26237 - DNA, 620 bp, Sorghum bicolor
  Clone ID: 30972238
aggatggacaatggcaaatgctgtgcccataaagactgcccgagaaactgtaaacatcctgcagaatcattatcctgagaggctggccattgcatttctattcaatcccccaaaagtattcgaagcgttttggaaggttgtcaaatattttgttgacctgagaacgatcgagaaggtgaagtttgtttacccgaaggatgaagagagcatgaaggtcatccacaagttcattgacccggaagtccttcctattgagtttgggggcaagagcagtgtggtttacaaccatgaagagtactctgagttgatgaccaaagatgacactaaaatatccagcttttgggcaacagatgctcaaactgaccatgttaatcatgtcatcgatgggaccttggcccctgaggttacacctgttgtcaccgctaattgctgataaaattagctgaggagtatcattctgctatgataagagttattctatatctcatatagctttattggaggaaacagacaagtagaggactaatggaatcacaccaaacataagtgaataaaataacaaataagttatgtactttttcattctgaaatttgttcgtgtaataaaaaatagtatatcc

SEQ ID NO: 26238 - DNA, 294 bp, Sorghum bicolor
  Clone ID: 30972242
ggcccaagggtacatgatttttttgacatcctttttgggggtgagcaacgggtttttaaccgtatgtttccttacaggggcccccaaaggatacaatgggccagagcaaaatgcgctggggaatgtttttgttgttttcctcaagattggaatgttttttggggttgtgctcgattggttatggctgatagggaaaggttggtgataactaaagtcccctcataaagggggttacttttttgctaagggtatcctgttggtccatcgatggaaaaaataataataaatccgatt

SEQ ID NO: 26239 - DNA, 678 bp, Sorghum bicolor
  Clone ID: 30972284
tcatgtccctttttttaacaagaaagtgatctataataaatgaacagtagtgatattgagtcaagtgacatatgtcctaaatatttcctacttgcttatctattacattttctaaatatatgttgtgtatttcaaacatgcatgaaacatatactgtacaacaaggcataagtcaggacttcttatctaacttagctctggttaaccatagaggtaaagactatttcttttacttgcagttccctaaaacatatcggtggtggcggtggcaaggacaactgccaagagaatggtcttctactagatggaagtgccattgccaagttctcgctcccttatacaggtagactacaattttacatatagtgctgtgaaagactgggctgctggaagagaaagaaattgtccagttagatgatgctctgccagatccaaaattactacgagatgttgggctactaggactccggcaaggacgttggcaccttcacagcggcatggcagtagactgcaaaactataaactgagatttctttacagccctggcacagtgtagtcttttttcgcaaccctatcggcctatttggatggaattgagattgtgaatcttgtattgaatgagtggatcttgtttgaaaaagtgtggatttgtttgctattttgctgtatataaaatca

SEQ ID NO: 26240 - DNA, 662 bp, Sorghum bicolor
  Clone ID: 30972308
ctctccctcactctctctgcaatggaggacgaggactaggctagcaccctgcagcccaaatcagatctgggggcgcacaagtgtgaatcaggccttgttcactgatggttcaccggatccggtcgttcacaggcaaccttgccctccatgccgccaacgccggctggatggctttgtcggcggcgtacccgacgcggatgagaacctggaggcattcatcacccgcatctaacagaagtctcgaaagatcgagaccctccttaagcagttaaagccagtggaggccatggaaaaacggcactcgaggggtcgctgctccagacccgcgacgagcgatgcaaagttttttttcttctcattatatggctcgtcccgtttcattccgtggattcaatcttgcgtgctgcgtgctactgctagtgcgttctagagatatatagttcattgtattccattgttttttcagaagtcactgaacgaacttgactgttcttttctttttaaacctaatctgtagctcaaagatacattgagagttttagtataagttcttgtgttaaatcttcatctcacgtttaagtattaagtgaatacttgtgctgaaaaaaagaaagaaaacagttcttgttctggcaacaattagctcatatttttcttgcagc

SEQ ID NO: 26241 - DNA, 164 bp, Sorghum bicolor
  Clone ID: 30972320
atctaaactccgttcaacatccctttcgttggatggcctcctagactatactgccaacgatatagaggagtcagtatttgagctttctttgtttgctgagtcatttggtgaaatgcttcaacacaaaatgggttgtgttatcctgtcttttcttgagaaactgt

SEQ ID NO: 26242 - DNA, 569 bp, Sorghum bicolor
  Clone ID: 30972334
gcctactgagacgacgcccagaccaagagagagatagagagaagggggggcagcggcacgcagccggaaagagaggcaggcgtggtggagaagggcagggccggggccgaggccgagccttgcgccgcgcagagaagagaagagaagcgagggggagcgcctagtagtagtagaagagcagagagagggaggcagggaggaagagcgacgagagccgaggagctctcctccgcccgcctaatccttggccgccgctgctagattcgtgaggattaccgagacgctgttccccggatctacggggcggcagcggacctcgtcggaatccggcgaggcggcggtgatttgcctgggatcggcgccgcatgtctcagatctgagatggacaggatccgggacggcaggaggggcggcgtgtccgtcggaggcgggccgccgcctccgaggaggcgcctcaggagcaacggcggagggggtggcggcggggggcccagggactcgccgcgctccgagcgtcggcgcggtgagcgcctcatgctcaacggcggcggtggcggtgccggccgcga

SEQ ID NO: 26243 - DNA, 664 bp, Sorghum bicolor
  Clone ID: 30972342
tctggagaacccctcccctgcctgcctctcacacaagtgcgttgattcctgctcccacgagaggacagcaacgagcgaggagagggcggaaaattccagttcaattcgttttcttctcctttctccgtcgccggcgccggccatggctagtcgtctttccgccattgcgtgactcgcaggttcctggactgtggcctcagctgccgggctctgtgtaagcataccatcaaccgaacagctcgaaggacacaggcaacagctcgaaggacacaggcaactgttaggttgagcatcattgggagtggaagaaatcatgtttaggagaaagcatgcctctcatttcgattccaacgatgctgatcagcgaaaagcaaagattgctgaactgaaatctgcacttgagcctttgtctgcccgtagtgagaagtactgcagcgaagcatgcttgacaagatatctagaagcccgtaactggaatgttgctaagtccagaaaaatgttggaagacagtctcaagtggagggcagcttacaggccagaagatatacgctggcctgaagtttctgttgaaggggaaacaggtaaaatgtacagggcaagttttcgagacagagaggggagaactattgtcgttatgagaccagcaaagcagaacacatcatcc

SEQ ID NO: 26244 - DNA, 632 bp, Sorghum bicolor
  Clone ID: 30972379
agatgccaatgccatacgctcccggcctcctgtcgacgacccaactcattcactcaaaggctcacgggcttcttccagtcggcgagttcagatcgcgacttctccctccagcagcaactcctccctcccccaaagttctgccttccaaaagggaaaaggccgtagcatccgcctccacgcccggctctgatgttgccgtgacgccgccgggctcgggggaagcgcggcgcgtggcaccgtcgcttgcctgcagggaagcttttgtggcaagtgaggcctccgtcttcatgaatcagccccctccacatatgtctagaccatcaattattatcaagctcattttggggttgctgtggaccatcacccacttagcaatcagctttttaaatttatggtcacatctgatttatagtttagaatgctatgttatttcatctggattgttgcggaagtatcagaatcttcatctgggtagactgaagtgcttggctattgtggtagatagcaaagaagctaaaagtactgcaaaggtcaagcaactgttatgctggctctcatctatgggtgtgaagtatgtatgtctctacgacatcgagggagtactgaagaaatcatttgaacctgctgtgaat

SEQ ID NO: 26245 - DNA, 634 bp, Sorghum bicolor
  Clone ID: 30972396
cggccgctggcgatgtcgcagctggcaacaagcgcaagagatcgtcagcagaggcgagcacagctagtgccagtgcgctgtcgagccagcagcaggcgtcagcaggcaagaagccgaacggctcctgtttcggtgcaacgacgacgttccaaataggcaacgggctgcagctgcaggggtcgtcgctgggccaccagatgctgcttcattcttctaacatggggatgaactgactgacagattgctgttctccactgaaagctatactttgagcattcaaattgtgatttcaacatcgggatctattgcaccaaatacatatataggctttcctaaaaaaaacatatataggcctaaaatataaagcaatggttactatatattagtaggtaatcattaaagggattgtacttgtagagtccagtagtagtgtgtcaactagctatatagttgctagggacgccatagttgattggggtttgcggtgtgtaaacattttgatctcctgtacatagtacaatactatgtactactcaatcttattactactactactactactagtagtagttcaaagctaactagataaggctttgagatcattgaagaattggaagtcaagaacaggagaaat

SEQ ID NO: 26246 - DNA, 133 bp, Sorghum bicolor
  Clone ID: 30972404
tgtgggcttcattcaggccaatcagctgggccgggagttaggccgctcggctcccgcatccaatgcctggatgcttaagccgctgtgatttcctttcttcttaataccgatgatgatgatgcacgttgcaggg

SEQ ID NO: 26247 - DNA, 667 bp, Sorghum bicolor
  Clone ID: 30972411
gttatgctcacatgcaccattgtgacaatagttactgttgcacttttcatgaagttgctgcagagacctaccagacaggcaccatcaaggaacatggcagcatccacaccagtacgagcaccagcagccaatcctgcagccatggctgatcctgcgtccccggctaatggtcagttatctcctcgtacgccgcagcctttcatggagtacgtgaggaggaccatcgatgacacaccgtactataagcgcgatgccaggaggcggttcaaccctcagaacacttactgagcttgtgtggcagtctgtagcgtggactggttggttgtaacgtttctgatttagttctccagctggattgaggttctggttcaactctcagctgtagtccttgcctgcgtatacccatgctgtgagaatgctgtcaattttgaggttctggcagcacctgcgattggcaatgataccgtgcaccattttggcaatagatataggacatctattttggtagaagcctgttgtttgccatttagcaaatagttataggacatttattttgttagaagcctgttgttaattctgatggacatgtaattttaggtctgtacatgggagtatgtaacatccaagcccttggtatagacatcttgctttctatggcatgaacatg

SEQ ID NO: 26248 - DNA, 642 bp, Sorghum bicolor
  Clone ID: 30972455
ctactgggtatatctgcatacgcttatcatttgcccaccggccaccgccgtcggcgaagccgacgcgatttcatcccccgacgggaccggggctccgctgccgcctcttcgaccctatatggcggccccgaggcctcgaatccgcgccgtacgtcgaggcctgctgctcctcttcctcctcgtcccgctcatctactccgtgtccaggctgcacccctgggtgccggagaagggcgtgtgcttgccacccccaaccgcgccgaagcggcctgaccgtctcgtgctcggtcccgccgccggacagggccgccccgaccgcctacagtgccaaggacttagagctctgaacaagattggcctaccaagtgaagagatctattctggagaacacatttcttttgttactgtattcacaacctacaattctgtctcagctggagatggcaatgttccatctgattctgtaactgttggaaatcattcttatagcaaaatagaaagatctatggccattctgaacactttcatcagtttcataaagaaccctgcaggtatcgatgccaagaagcaacgtgatcatattgactgatcctggttcaaaaatttcagtaaatcaagggagtgctacactgttgcctattg

SEQ ID NO: 26249 - DNA, 648 bp, Sorghum bicolor
  Clone ID: 30972490
tggtagtgattcatttgagcacagcactggatcatctgtgagcccaattaatgtcccctttgaatgcaaggttgacccttcttttgttgggtttgttgagccatggattgaccatgccacaaagaaatcgtactgcctgtttcatccatattcacctgcacagctgttgccggtgaagttgaacccgaatgaaggatttttacacattttggttcgcgcaaatctaaaggaagacccaaaggtgacaggatctgcacgtgcccttttcgtcaaagggttttacattaaagaatctgggaaattaaatttgactccaagttgcaatcatagtgtcattactattgatggaaatactgatattgagttgttctggaatgctaaagatttactcagagtcagtcgtatcgacacaagtgagaacaatggtgttcttagtcgaattgtttaccgggttgaagcgctaaaaaggcaatcattctctgacaaggttactatcgttcttcctgccactggtcagactgaagaagttgaagtcagctacgatacaggagagaaggctgagccaccatcatcatggggcctaaccacatctgctgttatgctcacatgcaccattgtgacaatagttactgttgcacttttcatgaa

SEQ ID NO: 26250 - DNA, 109 bp, Sorghum bicolor
  Clone ID: 30972524
tgtcttactttaaagttatatcaatcagtgcttgattgcttctctaagcgctgcaaggggggaaattgggccttcaatttcccctcttgttagttcagtcatctatcta

SEQ ID NO: 26251 - DNA, 569 bp, Sorghum bicolor
  Clone ID: 30972525
ccggggcaaaattttgcactgagattgagctactacctcctccagcgcctcttcttgcgcacctagaatagaaagagaactactgtagaaatatacagctacgagaactagaaggcggcgagcacatcggcggcaatggggtcggagacgttcctggagatcctgctggccatcctgctgccgccggtcggcgtcttcctccgctacggcatcggggttgagttctggatctgcctgctgctcaccatcctgggatacatcccgggcattatctatgccgtctacgtcctcgtcgcatgattatgattattatatataattatgatgtgtgataatgaccggccgggagctagattggttcgagaccacgggtttctgaattctgatccatccattccatacatgtagcccatgctgtatgttcttgtatcttctaaattagcttagctagcggttgtttctcttgtgtcctgatccattttgttgtgcccatggacaaggatgggagaaaggaactgtagcttcgatgcttcgtctatgcaagtgtgctagatctagtctagagtttc

SEQ ID NO: 26252 - DNA, 403 bp, Sorghum bicolor
  Clone ID: 30972532
cttcggcggggccggcggcgtcggcttccccgacgtcccggcagcggcggctgcgaccgttgcgagcgccattggcgtcggtccgcccgtgtcgctgtccacggcatcgtccatggaggagctccagagcgctatcgagggcgccatcgcgcactgcaagaacacaatgggcggccccgtgtcgttgtgcccgcgcaaggcggcggcggcggcggcggtccccgataagatttgccccttttgagcgcgcgagcgcgttaggattcaagcggcggagagctaagtaaccaggctgtttaatcggtagcagtacttatctgttgttattagtaattttaatttcattcgtctcgttttggtaagcctctatgatcatggtcgtaaataagggtagttcgaaggg

SEQ ID NO: 26253 - DNA, 276 bp, Sorghum bicolor
  Clone ID: 30972533
cgcgctcggcggttgtcaccggggccgtcggtggggttcttgctggcgcctccgcggctgccaagcaggttgggaagagatacgtccctgccctatgaatctgattccggtacttccccctgccttgccgtgatcaaagtcaaaatcaattcgtcgcgtggatgtcatttcttcgttttcgttaattatttgggaagagtctctcctcaacattcctatatatgctggtactatatatgtcaatgatctggtctcatcagatcacgaaatttttgg

SEQ ID NO: 26254 - DNA, 504 bp, Sorghum bicolor
  Clone ID: 30972540
ccgtcgtcggaggctacaggagcccaccacgaggtgtttcccatgacgccgtcgaactggacgtgggagcagctggagggcgtgttcggaagcctgtcgccgctgtcgccacaccagcagctcggcttcccggaggtcactgtcaattaagcggttatcgagatcggccgcttaataagcatcgataggtgtaaagacgttaataattgttagcggttcttagttatgcacggccttggctttggactcatcttgaggatttggcgtggctttggagctccatgtgtgtgtacagaacgaagggaggtgatagactattagggtgtatgtgtcggtgaattctgaactacacacgtggacatagatcaacggcatagatgtggaaacatatacataaacacgggagtaattacatcacaaatggtagtacgtgtataaggtgtttgatgtgattttgtacattgctaagtaaagaaaagagtgtacatgcatgcttatttaata

SEQ ID NO: 26255 - DNA, 660 bp, Sorghum bicolor
  Clone ID: 30972575
gagcggtggatgcagtacagcgtgggagagtacgaggcgtacctgctggggctcgccgaggccgccatccgccgcgtgcacgagctcggcggacggaagatggacttcacggggctcacgcccatgggctgcctccccgccgagcggatcatcggcgaccccggcgagtgcaacgagcagtacaacgctgttgccaggaccttcaacgccaagctgcaggagctcgtcgtcaagctcaaccaggagctgccgggactgcagctcgtcttcgccgacacgtaccagctccttgccaacgtcgtcaacaagccggccgactatggatttgacaatgctgtgcaaggttgttgcggtacggggctttttgaggcaggttacttttgcagcttcagcacctcaacgctatgtgaaaatgccaacaagtatgtgttctttgacgcaatccatcccacagagaagatgtacaaattgctcgctgatacagtcatcaacaccacgttgcatgtattcatgtgaaattattgatcttcttagtggaaaagaatcatagattggtctacaatgcacatagacaccttctccacagacaattttgaatgttgaaactatatcatatccagttattgcagcacgtgtgctataaatcttgtattccagatc

SEQ ID NO: 26256 - DNA, 550 bp, Sorghum bicolor
  Clone ID: 30972599
agggcatcgccatcggggtcgccgagaccaaggctgacgcatggaaggcgctgtggaccatcagcctgcacaagatcttcgcggccatcgccatgggcatcgcgctgctccggatgctccccaaccggcccctcctctcctgcttcgcctacgccttcgcgttcgccatctccagccccatcggcgtcggcatcggcatcgtcatcgacgccaccacgcagggccgggtggccgactggatcttcgccgtctccatgggcctcgccacgggcgtcttcgtctacgtctccatcagccacctcctctccaaagggtacaagccccggaggcctgtcgccgtcgacacgcccgtcgggaggtggctcgccgtcgtgctcggcgtggctgtcatcgccgtcgtcatgatatgggacacctgatccgatgagagacacgtacatacggccattcgggtggctcttgcacgagggatcggatatattgtagcagactctttttagctgatatatactatagcactacaacggtatatacacattcgtgattcgtg

SEQ ID NO: 26257 - DNA, 635 bp, Sorghum bicolor
  Clone ID: 30972623
tctccggcgactccgcggctgcgcacttccaagttccaactacacagccgtcgccccagcgaagctgtggaggaccagcaagcgtcccttcaccggcccccctccctcccttctcttccctccggtcgaccagatggcctgccgcgtgaaggtggtaggacaggtggagcgggtggacggagcgtcgctatcctacgcggagttcgtccgccgcttcatggcgtccaaccgccctgtcgttctcacggggctcacctcgtcctggcgggcctgcaaggactggacgctctccgggcccggcgaccgccgccgccctaacctcggcttcttcaccgaaaacttcccttcccctctcgttcaggtcgccgactgctcctcgagggatttcacggaccagaagcggcttgagatgtccatgcaggagttcatagaccactgggttaggggtgctcaccgtggctcaagcgatggttctctgttgtacctgaaagattggcacttcgttaaggagtaccctgattatattgcatataccacaccaaccttctttgttgacgattggctcaatatgtatcttgacagtcaccctatacatagagattctgacatcgccaatcataaaaatgaaataaact

SEQ ID NO: 26258 - DNA, 660 bp, Sorghum bicolor
  Clone ID: 30972657
cctaaccgcgctgccttctttcttaagctcgttgcgaccgatcttgagtggccggccgggcagccgcgcgcagcaccggcggcaacaaggtcgtcgtcattattccagatgaggtcgtacttcttcttgccgtgcttgatgatcttgttattcttgctgctcgtcgtcgtcggaggtgcggtggtggccggggagaagaagaagaagacgaaggtgccggcgatcatcgtgttcggcgactcttccgtggacacgggcaacaacaacttcatcccgaccatcgcccggagcaacttctggccctacggccgcgactacgacgatggcctccccacgggccggttttccaatggacgcctcgctaccgacttcatctccgaggccttcggccttcccccctccatccccgcctacctcgacaagacctgcaccatcgaccagctctccactggagtctccttcgcctccgctgccactggcctcgacaacgccaccgccggcgtcttgtccgtgatcacactggatgagcagctggcctacttcaaggagtacacggaccggctgaagatcgccaagggcgaggcggcggcgaaggagatcatcggcgaagcgctctacatctggagcatcggcaccaacgacttcatcgagaactactac

SEQ ID NO: 26259 - DNA, 647 bp, Sorghum bicolor
  Clone ID: 30972676
tactggtaaccaaacatggatgagttgtactacgggggctggatgtgcaggcaaccaatcagcctcatagtcttcaagcatgtgcttggagccaattgtttgagtcactcttatctttgattaggtgacttgtgtagtttattaaatcacatctaaatctagatgcacttgtaaagtttagttggctttctgattgatatactatgagtctgtgacattaaaggcgaaacaactttttaggttcttatttttgtggaatataacaagctgatttaatcttgcaagctgtttaatataaacattgtacttctcagtttctttattgtcgtgggatatctgtacttgaatgctttactatttgtgttctgtaaatacgtgactcattttctgttgcttgatttttacttcttttgttagtccattttacatgcaagctgctctttcttatcatcttttccctagtttctctgtggaaacacgcgtttcgggagtaaggatgtcagaaaacgctcttaggcccacagttaatatttaatcagatgcgttggatatttatccaacggaaaagatctaaggtgggtaggatggttttagatgacagatattttacaattcgtttgctcctttatagtatagatatgttggtt

SEQ ID NO: 26260 - DNA, 629 bp, Sorghum bicolor
  Clone ID: 30972686
tggcccgggttcgcggaccagtacatcaactgccggtacgcgtgcgaggagtggggcatcgggctgcgcctggacgagacgctgcggcgggagcaggtcacggcacacgtcaaggagctgatgggcggcggcggcggcggcgacaccgacgacagggccagggaaatgcggcgccgcgccgccgagtggaaggccaaggccgaggccgccgccacggcgcccggtgggtcgtcgtacgagagcctcgacaggctggtggaggaccttcggctggcggtgggggaggcggacgccgaggccgagctcgccacggccacgccgacgacgcagggccggcggtgatcgaacggtgtcacgcgcgcggactacttcaggttggtggacgtctccttccgtcgtgtccatgcatgtcgtcagctctacaggagttgctgaacaaggagttcagtgacaccagaaattaaagcagcagtgcgtggcctgactgaccggttttcgtacttgctatgtcttgtttcaaccacgcagaaatagtacagtagtagtcgtaatttgtatcgtagcaggttggttgcttttcgtctcagcgtggacgtcgttattagtgggcgaattagtcaattcgattg

SEQ ID NO: 26261 - DNA, 604 bp, Sorghum bicolor
  Clone ID: 30972695
attagtctagggtttaaactgacaatttccacgagttttgcatattttatgattttcagggattattttataaagtgctgaaaagagggattaaggtgctaattcgccacaaaagttatccacaatggaagggcgacaccagaggattcaggaagactccagaagacaccaggcacaacaggggagcgaacggctgccaggtggggagcgccggctgaccccctgcagttagggttcgcctcccttcctgaagcttcttccaccgcctttgaggagccatctcggccgcttgttaagtaggtttgatccaacggcgcgtgtgcactccaccaggctataaatagaggggcagaccccccctcctagagggcccccagagattcaattcattccttgtgcttcatttgtcaagagtagtcagaagttagggtttctagagattagaagtagagctctagttcttcaagttcttagtataggcgtctagtgaggttcaagtagagatcgggcgctccgccctcaggattccaaatctgtcttctagaaattagcaatattatcttgtattttattatgacttgctctacttcaatatatgctattt

SEQ ID NO: 26262 - DNA, 628 bp, Sorghum bicolor
  Clone ID: 30972700
tgtccctggtggacggcttcaacgcgcccgtgtccatggcccccgtgggcggcggcgccggctgcggcgtggccgggtgccaggcggacctcaacgtctgctgcccgtcggcgctggaggtcagggacagggaggggagggtggctgggtgccggagcgcctgcagggccatgggaggggacaggtactgctgcacgggggactacgcgtcgccggacaagtgccgccccaccatcttcgcccacgtcttcaaggccgtctgccccaaggcctacagctacgcttacgacgacgccacctctctcaaccggtgcaaggccagccgctacctcatcaccttttgcccaccgccgacatccaggaaatgaccatcatcctcatccatgcatcgatgatcgatacctcccatgggctgcatctgaatctatcagaatataactatagctagtgtggatgtggatcctactgttcagtccctgtgtatcatgcatcttattaattatacagtactagtagtagtatcagaatgacagcaaccactacagtttttgtagcatgaacaagctgccagtcagatgcaatcctatcatcatatactctctaatagtaatggcacaagacagttttg

SEQ ID NO: 26263 - DNA, 644 bp, Sorghum bicolor
  Clone ID: 30972740
ttgctgattcgccggtgatcccctccgtccttctccggcgccggcgccccacctcgggtcctcggctgtatcctccggctcgccgctggagtcgcttccctgactcagcgtctcagcagctgctatgaattacatcatcggcgccttcaagccgccctgcgacatcttcgtcactttctccgatgagaggacccggaaacaggtgcagatcaagaaggacaatgacaaggctgtcatggtgctggcattccagagccttgagaccatagccggagaggtgtcgattgctccagttccaggcaaaaggcttgagcacacgggtgtgaagattaagctgctgggtcagatagagctatattttgacagaggcaacttctacgacttcacttcattggtgcgtgaattagatgttcctggtgaaatatatgaacggaagacttatgcatttgagtttgctacagttgaaatgccatatgagtcatataatgggacaaatgttaggttgaggtacatcctgaaagtaacaattggcagaaattatgttggcagcattgtggaatcgcgggacttctgtgtaagaaactactctccagttcccacaatcaacaacagcatcaagatggaagttggcattgaagattgct

SEQ ID NO: 26264 - DNA, 658 bp, Sorghum bicolor
  Clone ID: 30972769
cctactggttcagctgcagcagcaaacaagcttcctgctgtgcgcgcgcacgcccgccatggagaggagagcgcacgcgatgctgttcccgttcccgtgctcgggccacatcaacccgacgctgaagctggcggagctgctgcactcgcgcggggtgtacgtcaccttcgtcaacacggagcacaaccacgagcggctgcggcggcgggcggcgggcggcgggctgcgggggcgggaggggttccggttcgaggcggtgcccgacgggctgtcggaggaggaccgcgtcgcgcccgacaggaccgtcaggctctacctgtcgctgcggaggagctgcggcccgccgctggtggacctggcgcgccggcggaggctcggggacggcgtgccgcccgtcacctgcgtcgtcctcagcggcctcgtcagcttcgcgctagacgccgcggaggagctcggcgtgccggcgttcgtgctctggggcaccagtgcctgcggcttcgttggcacgctccggctaagggagctccggcagcggggctacacgccgctcaaagacgagagcgacctgacgaacgggtacctggacacgcccatcgactggatcgccgggatgccggcggtgcggctcggcgacatctccagcttcgtccggacgctg

SEQ ID NO: 26265 - DNA, 638 bp, Sorghum bicolor
  Clone ID: 30972776
tagactagagaggagcgataaggcatctctctcacagcaacatctccctttaatttctctctccaccccggccggccctgagacaagaaggccgccgccacaacatccagcggccgccctgatccttcttggtgttttgatattgcagattagcggaaggaaattaaagatccatggacatgagctccagcaccactgcagcagcatcggctccccacaaccaccagcaggaggcgatggtgtcatcccccaatattaaggaggaagctaggagcccaaaacaggcagaggccacgcaacaaccaagtggcagtggggagcgtaagccacggccacagctagctgaggcgctcaggtgcccacgctgcaactccaacaacaccaaattttgctactacaacaactacaacacaatgcaaccacgctacttttgcaagggctgtcgccggtattggacacatggcggcaccctccgcaatgtcccagttggcggtgggtgccgcgagaacaagcgtgcctctagatctgtctcaggctctggttcctcttcgtcctcggctgcctatgcaccattatcccccgacaccaacaccagctctagtaagatgagcatcaacacacaaccgatgatggtgcct

SEQ ID NO: 26266 - DNA, 292 bp, Sorghum bicolor
  Clone ID: 30972788
ctgcgactgcgagcgcgcgaagccaaggagcgcacgcacacggcacgcgcgatgcacgcggcgccctcacgccgtcacctgctccgctccgctccgctgccgttcgggtccatttagccgagcgcggaaagggaggaggcgcgagccgagccgaggggaacccccgacccgacccgacccggaacagcaacaggaggagaggaggagagagagagagacacagaggggcgctgcgaggaggaggccggcggcggcgcgcgctcgcggcgccggcggcccggcgatgggggag

SEQ ID NO: 26267 - DNA, 656 bp, Sorghum bicolor
  Clone ID: 30972794
ctcttcaaaactatgtccacagcatcagtgtagacaccatagtcgtccatgtcctcgatcatgtctacaaaaaaaaatgtgagacagcagcagcaaaaaaagttgtgagctcatgttggtgatcggcagcttctaaattgatgtcaaaattatcctgttcatgtggagcatcaaagttgatatctccatcttgttgatggccgtcttcaacagcaagaactgcaatagggtgggagatgtcactgatggctgaaagaagcaacaatattgagatatatggcatgcagagcaccgtcttgctctttctgaagatagtgggactgacctatgagtggatgcacttcttcattaatgagatgaaattgatcttcctggaggtataggatttcatgtcctgtatcatcagcaagctcttgatttaggtctggttgatggaggttggtgcagcatttagataaggttgatagaggttgtaacacttcggagaatgggggaaggctgtcattgttggagtctttatagtgccgcaaagtggcgcccagttcaaatttcaggctgaagacaaatgggcgccagaatggggactagaactttctgtagtactcctggccacattctactctgtgtattgctactgtttctattttgtctgttgc

SEQ ID NO: 26268 - DNA, 588 bp, Sorghum bicolor
  Clone ID: 30972798
tccacactaaaccacacttcaaagagaccagtagcatccagtcgtcccgtctctctgaactgttctgatccacacagtacagtagctatattagttgcattcgccaccatggcctgcttggcctctaacaacaagccccagctgcacctcatcaacatttttgtcacagtggcactgttattagtcaccagtactcatggtgcaggtagtactgggaataatgggagtggcaacatccagctgatcttggtgaacaactgcgcggaatccatctggcctgggcttctgggcaccgccggccacccgacgccgcagtctggcggcttccacctggcccccggcgacgaggcggccttcgacgtgccgctggggtggtccggccgcgtgtggccgcggcgcggctgctccttcgacggccgcgagcgggggctgtgcgcgacgggggactgcggcggcgtgctccgctgcgacggccgcccaggctccaccccggccacggtggtggagatgacgctgggcaccccaaagtcgccgctccacttctacgacgtgtccctggtggacggcttcaacgcgcccgtgtccatg

SEQ ID NO: 26269 - DNA, 635 bp, Sorghum bicolor
  Clone ID: 30972806
accctctcgccgcggctcgtgccaggggtgatcgccgttcgtgctcgtcgatcagggcgctgctgtgttcgtcaagctagccagccgccgccgccgccgccgtctcggagctcgagctgttagttccccggggcccaggcgcgggcacggccatggaccagttccatcacgaccgggcgggcgcgctcgagatcgagaagacgacgacgccagctgccgagcgcgcggcggcgccggacatggagtcggagcccgcggcggcgcgcgtggcggagctcgtcccgccgtggcgggagcagatcaccgcgcgcgggatggtggcggcgctgctcatcggcttcgtctacacggtgatcgtcatgaagctcagcctcaccacggggctcaccccgaccatgaacgtctccgccgcgctgctcgccttcctggcgctccggggatggacgcgcgccctcgagcgcctgggcattgcctcccgccccttcacccgccaggagaacaccgtcgtccagaccaccgtcgtcgcctgctacaccatagggttcggcggtgggttcggctccttcttgctgggcctgaacaagaagacgtacgagctctccggggtgaacacgccgggcaacgtggcggggagc

SEQ ID NO: 26270 - DNA, 576 bp, Sorghum bicolor
  Clone ID: 30972849
gcttctaccgagcgagcagcagaaaatgcagctgttgttaggactgaacagcataaggcaaattcggaacttacgccaggtgtgaatgcttctagaagttctcatgatgcagttgaggcggctggtgaaagcaagactggcaatgaaacattactttctgctgagggaggggagacggggaggttgggaccatctttaaatggcaccagcgagggaattaaagggcgcctaaataatgatggttctgtgccccatacttcaaaagtcgaaagagaagagggtgaattgtcaccaaatggggattttgaagaggaccattttgttcctttcgaagatggaacatctaaaggaaaggaaggttctacaagccgatcgttccagggtaggcctggggaagtggtaccgtcttctgctgaggcagctggtgagaatgatgctgatgctgatgatgagggtgaggaaagtgctcagaggtctactgaggacagtgaaaatgcttcagaggcgggtgaagatgcatcgggcagtgaatctggtgatggcgaggaatgctctcgcgaagatcatgatgaggaa

SEQ ID NO: 26271 - DNA, 458 bp, Sorghum bicolor
  Clone ID: 30972863
atctcagccgccgtcttctccctcgctccgccactccccccaccaccccactaaaaccctaatccctcgccgccatggctgctgctgcggcgggggccacctcgctccatctacgccacaaccgcaacccccacctcctcctcctccgcgccgcgatctcctcctcccgcgcgctgccccagcagccggagctgtctcctgacccgaccgccggcgcccccgaccccgccccactccccccaaaccccagcacggggagccccttctacagccagaactggcgcaaccccgccgccgccaacccgccctcctcgcttctgcccaccgtcctcgccggcggcgccttcggggaggagcaccgcatggacgccttctacgatacggccaacgccgcggggctcaaggagacgttcgccaaggatatggaggagcaacggtgggaggacatcaagcatctg

SEQ ID NO: 26272 - DNA, 328 bp, Sorghum bicolor
  Clone ID: 30972866
gaacgcaaacctcgaccaagcaagcccttgatcatcttgatggggtccaccgaggagcagcagcagccggtgccggtggtggctgccgccgtggaggaggaggaggcgacgccggagatcatcttccggaccaagctcccggacatcgccatcaccaacttcctcccgctgcaccgctactgcttcgagcggctccccgaggtggccgaccgcccctgcctcatcgacggcgcgaccggcgccgtgcgcacctacgccgaggtggaccgcctgacccggcgcctggccgcggcgctccggagcgcgccgctggggctgggccgcggcg

SEQ ID NO: 26273 - DNA, 162 bp, Sorghum bicolor
  Clone ID: 30972873
ccaggcctacccttttgactatcgatgtgcacaggaaagtacagatcatcgagaaatggggcaaagaggaaaatttggaagaactctatcccagattggtgtctcaaggtttgatcctaaggaaggatggcaacagaagttgaatgaccaaagaagcctaga

SEQ ID NO: 26274 - DNA, 635 bp, Sorghum bicolor
  Clone ID: 30972889
tggccggggagagcgcgggcggcaacatcgtgcaccacgtcgccaaccgctgggccgccgcgtggcagccgtccgcacggacgctccgcgtcgcgggcgtcttccccgtgcagccctacttcggcggcgtggagcgcacgccgtcggagctggcgctggagggcgtcgcgcccgtggtgaacctccggcgctccgacttctcgtggaccgcgttcctccccgtcggcgccacccgcgaccaccccgccgcgcacgtcaccgacgacaacgccgacctcgccgagcagttcccgccagccatggtcatcatcggcgacttcgacccgctcatggactggcagagacggtacgccgacgtgctgcgccggaaggggaaggaggtggtggtggcggagtaccccggcatgttccacggcttttacggcttccctgagctccccgaggccaccaaggtgctgcaggacatgaaggccttcgtcgacagccacagggccacgcccaagctcgccgacgcgtgatgcacgaacagaccaactcttttccctccattctagtgtcgtgttggttggttcatcacttcatcttatctgctgtcaacccaattatactgtatgaaatcgctcattcaaaactcc

SEQ ID NO: 26275 - DNA, 255 bp, Sorghum bicolor
  Clone ID: 30972896
ggggatacaaatattgatgtttgcaaggctgtgttctcaggtatgaaagctaatttatgattttaagtaagtggtatgtttgcttcatcatcccataatgcagcaaacgttgctgtagtgtactctcataagagtttcagatgtgcttgtttttcccaatcttgttgtcggtattgggctggtaactactggttcctcaggagcttcagtggattgactagtttccatctgattattatcgggggactgggttcc

SEQ ID NO: 26276 - DNA, 591 bp, Sorghum bicolor
  Clone ID: 30972901
cgtcgtcttgctcgaggtgctctgcgcgcgccccgtcatcgacccgactctgccccgggagatggtcaacctggcggagtgggccacgcagcggctcaagaacggcgagctcgacagcatcgtcgaccagcggatcgccgggtcgatacggccggagtcgctcaagaagttcgttgacaccgcggagaagtgcctcgcggagtacggcgtggagcggcccgccatgggggacgtgctctggtgcctcgagttcgcgctgcagctgcaggaggcgtcgctggacagctccggcacaaaggcgtcgccggacagctccggcacagacaacacgcagctagttctcaggaatgcgtccagattacatcgcaaccagtcgaacgccagcgacggggcagaggccaacttgggggacctcgatggtatgtccgtgaggagagttttttcaaagatgatcaagagcgaggagggtaggtgaagctaaaattatcttgcatcttcgcatcatcccatgtacaggacggcaaaacggcaaagacaatagcccatttcggttccatatttgtcaatttcaacaagtatagaagaaacaat

SEQ ID NO: 26277 - DNA, 603 bp, Sorghum bicolor
  Clone ID: 30972908
gcgtggaagctgtggaacgaggacagggcggcggacttcatggacgcgtcgctggcggggtcctactctcgggacgaggcgtggcggtgcttccacgtcgggctgctgtgcgtgcaggagagcccggacctccggcccaccatgtccagcgtgctgctcatgctcatcagcgaccagacgcagatgccggcgcccgcgcagccgccgctgttcgccaataaggccagcaagaaggcgtccgtgtccgatttctcgctggccatgaggacggagaccaccaagacgcagtccgtcaatgaagtgtccatctccatgatcgagccacgatgagtgagataaccatgcatcgagggccttaattgcctctgatccccttttttaactccctttttaatccctttttatctcttgacttgatataagtagtgccgtagttattaaaggtggaaatcgagatgttttacacacgcgcgcgcgcagcgcaggatgacaaaggccgagagagaaaattccagcatccattcattcacataagaaatcctatgcgtacgtgcatggtggggagctggcgagatttttcattctttgagcaatggcaacagg

SEQ ID NO: 26278 - DNA, 497 bp, Sorghum bicolor
  Clone ID: 30972930
attccatccgatattacttaacaaagctagaacattcttgctctacccgcatcacataatttcctctgagcctgccactgttttaacaccgatccatcagcatggaattcaagacttgtctagtaccgctgctgctccctactatggccctgctgcttctcgcttttggcagctcgcccgcggcggctcagctgcaagtcggctactacagcaagacatgcccgaacgtcgaggccatcgtccgcaacgagacggcgaagatcatcgccgctgcgcctagcctcgccggtccacttctcaggctccatttccacgactgctttgtcaggggttgtgacgcctcagtcctgctggagtccaacgggggcaacaaggccgagaaggacgccaagccgaacaagagcctgcggggcttcggttccgtggagagagtgaaggccaagctggaagccgcctgccccaacacggtttcctgcgcggacgtcctcaccctcatg

SEQ ID NO: 26279 - DNA, 593 bp, Sorghum bicolor
  unsure (1)..(593): unsure at all n locations
  Clone ID: 30972933
tccctccctccagggttcgatcccgtgcaccctatctttttttctcggggaaaaaatgaagggtacatcgaactcctctctgcttgagcgacaaaagccgcacgcctctcgacatccgccgccgcgtcctacgccagcggcaagctccgccggctcgccagccagtgatagggcgaatctggttcccctctacctccctcgccctcttcttcttccttatacctccggaggttcgcgtgcgaggggccagcactgctgctacggtttcggcgacaaagaagtggcagcgtgctgctagaggtgagcaggacgtttgtaacgatgtcaccgacgaccatgacgagggcgttgcgtggatgaggatctccgattgaggggcggcggcggcggtggtcaatgggcggagcgcagaagccggagtagcgagaggctcggattcacgtactgtgacatctccagcgaccgacgctgttctcctccagccccagccccgatccgcaaccatgcacgcactctgcacgccccaccgtcccacgacgccnatggagcatcagagcaggacgccggtgttggtcagcttttctgattttttt

SEQ ID NO: 26280 - DNA, 635 bp, Sorghum bicolor
  Clone ID: 30972972
gcgcgccttctcctcacccctgcttcctcccgcgccacgctatggccccctcgccctcctgccgcaaaccccctctcgtcgtccttccctcgcaagcgtctccacctcgcgcgcccgccgcgcgcctacatctccgcgccggcgccgggccccgaggccgcctacgcggcgcccaccctcgacgccgccgcggcggcagccgatgtcgccgccgcgatctcatcctccgacgccatcacctgggccggcgtctgggcgctgctctcgcgccacagagcccgcatcgcggtctgcctcgccgcgctcgtcgcctgcaccgcctgcaccctctccatgccgctcttctcagggaggttcttcgagaccctgattgggagggggaatgagccgttgtggaggctcttgtccaagattgcggcgctgtacacgctggagcccatcttcaccatcatattcgtgatcaatatgaccatcatctgggagcaggttatggcaaggctgcggagccagatatttcgaaggattctgatccagaagatgttatttttcgatcgtcacaaggttggtgagttgactggtttgttgacatctgatttgggttccttgaagagtattgtaagtgataacatatccag

SEQ ID NO: 26281 - DNA, 611 bp, Sorghum bicolor
  Clone ID: 30972979
acctccaatattacctccatggctaaccaaatctccaatcaccaagcaccaccggttccgcgttcctgtgggtaggctgcttactagtagctgctgtagtgctgtgcctgtcctgccagttcgcagattcactttcagcccgccgccaaacaagaagctccaggtttctgagcaactcctgtgctaatcatccgccatgactcccatggggccttgatgccacctgccaccctcgacgacgtctctgttccagggagacatccatgactcccatggggtcttgccgtggttcatctcccaccacgtccatggctggccccgttcttgacatgctcctgcgggtcgccgtcgtgctgtctgctctgttgcccgcggcgcgcgccgcgttcaccccggcggacaactacctcgtgctctgcggcacggcggccaacgccaccgtcgacggcaggacgttcctcggggacgccagcctacccacctcggtgctgtcggcgtcccggggctccgaggccaacgcgtcggcggcgggatcggccaccggctccgacgacgcggcgctgtaccagtacgcgcgcgtgttcgccgcgccgtcctcgtacacgttcgcg

SEQ ID NO: 26282 - DNA, 624 bp, Sorghum bicolor
  Clone ID: 30972991
tgaggccgctgtccaactcagacctgccgctcatggacctgtcctccatccatgaggccaccaacagcttctccaaggagaacaagctcggcgaaggcggtttcgggcccgtctatcggggcgtgatgggcggcggcgcggagatcgcggtgaagcggctgtcggcgaggtcgcggcagggcgcggcggagttccgtaacgaggtggagctgatcgccaagctgcagcaccggaacctggtccgcctgctgggctgctgcgtcgagagggacgagaagatgctcgtctacgagtacctccccaaccgaagcctcgactccttcctcttcgataccaggaagagtgggcaattggactggaagatgaggcagagcatcatcctggggatcgctcgcggcatgctgtacctgcacgaggactcgtgcctcaaggtcatccacagggacctcaaggccagcaacgtgctcctcgacaacaagatgaaccctaagatctccgacttcggcatggccaagatcttcgaggaggagggcaacgaggttaacacgggccgcgtggttggcacctacgggtacatggctccggagtacgcgatggagggcgttttctcggtgaaatcggacg

SEQ ID NO: 26283 - DNA, 496 bp, Sorghum bicolor
  Clone ID: 30972999
ctagcttgggcaggcagcagagtctagctaaggcggcggcggaagaggatcgggtcggaggaggagatctcaatcgaataagccgcgcccaacctacatgatgatggcacagcagccacagacgactcagctgctgctgcacggggtgatcgacgccaggatcctcgaggccgacctgtccgtcaccacggacggcaagctgcagccgaccaagaagactttggtgaagaagaaggtcttctcatggatcaggaagctgaccttctgcaaaggccagcaacagctggagaatgccatcggcctgggcacggacggcaagctgtacgcgacggtggacatcgacaaggcgcgcgtggggtggacgcgcatggtgccccccgtgcactcccccaagtgggacgagtccttccacatctactgcgcgcacgacgccagcaacatcatcttcaccgtcaaggccgacaacgccatcggcgccacgctcatcggccgcgcc

SEQ ID NO: 26284 - DNA, 601 bp, Sorghum bicolor
  Clone ID: 30973011
tactggaagctcgtacgccgcctcagcctcgcattgccaccacaaaaccgtacttgccaactacttgccgacgcgaatccctgccgtgcctgcgtcctcgtcgatcgaagccgccgcatgacgacgccggcgacggtgagcttcggtgctcctggtcctcgtcctggcgctgctgcagtccaggcccagggcgggagaccacccgcggcgcctcagctaccaggcggcggcgtgccgcgtccgccgcgtctccagtacaccggggtgacacgaggcccgagcggcggcggtgtgccgcgtccgccgcgtctccagtacaccggggtgtcacgaggcccgagcggcggcgggtggatggcgcgcgtgctggtggacccggagcggggctcgtgccgcgccgtcgggccgttcccggacccgcacgcggcggcgctggcgcacgaccgcgtggcgatcgcgtacctgggcgacagggcgcggcccaacttcccgccggcgttccaccccatcgagcagcggttcctgcggctgtgccgggagcgggagggccagatcgacgtgtgcgcgctggtggcggaccccggcacgtacgaggcccggt

SEQ ID NO: 26285 - DNA, 572 bp, Sorghum bicolor
  Clone ID: 30973033
tactggacttgctgctgctgctgctgctagtcagtagccgaggacccgccccatacccatggcgtcctcctcggggggcggcgggggccgcaggttggcccccgggggagacgcctcccccgcctccgccggcgccaggaggatctaccgcacccagaccgccggtaacctcggcgactccatattcgacagcgaggtcgtcccgtcgtcgcttgtcgagatcgcgcccatcctgcgtgtggccaacgaggtggaggccagcaacccgcgagtagcctacctctgccgcttctacgccttcgagaaggcgcatcgcctcgaccccacctccagcggccgtggcgtccgccagttcaaaaccgccctgctgcagaggctcgagagggagaacgatcccacgctcaagggcagggtcaagcagagtgacgccagagaaatgcagagcttctaccagcactactacaagaagtacattcaggcgcttcaaaacgctgccgataaagccgaccgggctcagctcaccaaagcttatcaaactgccgccgtgctctttgaggtcctcaaagccgtca

SEQ ID NO: 26286 - DNA, 644 bp, Sorghum bicolor
  unsure (1)..(644): unsure at all n locations
  Clone ID: 30973043
tactggatctctgaacgattccgcttgtgtgagtgatgagcctgtgagtgtgactgtgagggggcacgtcgccttctctcccctccctcttccgtgttgattcatcgctcaggcgctcactcacgtctcgcacgccactctcggtcaaatgcttccctgactcgatccgcctgcgccggtttcgcccgactccgtttctccgattggttcctgggttcatctccgtccgatccttcagcccattccgcgatgcgatttcgccgcgtcctgtagatcttcgtcgcctggattgatttcttgaatggaaggccacagttcaaacctcaagcgttgtgccaagcttgaattttttattcaacagtgcttgtagaagtccttttgatctctgcagtctgagccagggtataatttggtctgtgagatacaatggctacagagacattgcctgaaacacttccagtggtccctgatactcaaacactgaagttgcattctcagattggntcctctttggaggcttccaggctcaataaaccttgtgcatcggtgcgaacaaggctgcctgaaccaaacaacttgagcaaaccaagttctgaagcggagcctaaggtccagaaaccaagcaacctactaaatgagtcagt

SEQ ID NO: 26287 - DNA, 443 bp, Sorghum bicolor
  Clone ID: 30973050
cctactggatttcaccttggcttgtgtttggctttggctctcctcctctctcccagtcagtctcctgcctcctctgcttcctcctcttctcttgccttcgcttcatcactccccttccctttttggaccctcctctccctcttgcggctgtggcaatcctaaaattaaggctcccatctgcccctcttctctgattgatccatcgatctggtccctcctcttcctcttcctcttcatcttcctcccctccccctttcttgcttcttgcttgctcaggtaaaaaaaaaaggtagcaggagctgctgcagcacaagcacaacgcccccaggcctctccttcttcgcaagattctccctttcttgtcatatgccccccaaaggttttgtttccactgtcgacgctccggtcgaccaaagcacctgctgttcttgccatttccgatc

SEQ ID NO: 26288 - DNA, 486 bp, Sorghum bicolor
  unsure (1)..(486): unsure at all n locations
  Clone ID: 30973052
gcgtcttgcctagcgcctcgcctccctcaaaccctagccacacctctcttcttaccttgcggtttctgatggcggcggcgcacgcggccccctgcatctgttagcggagacgcatgcagcccctcttgactggtgcgccgccccgacctccccatccatggtgttggcgttgagcactccgacggggccgaggaccnngatggcgttgtacgagcgagtgcctcgacgcctccatcgtaaaatgccgccacatcgttgacgccgtccgctgatccactcgcgcggcctcatggcaagcacaacgacccacctccatcgtcccgtcacaggccaggaatgagatgtttttagtgttcagtgtacacgtcgagcnnngaggacnactcttttaggacaagctcggcaagggtggtccgagcgtcgtgcgaccacgcgcataggtggtgaacgtggatccttaaggtgtgaaaaatcagaaaaacatta

SEQ ID NO: 26289 - DNA, 312 bp, Sorghum bicolor
  unsure (1)..(312): unsure at all n locations
  Clone ID: 30973054
ttgtaataaataagatggacgaacctactgttaaatggtctaaggaaaggtatgatgagattgaagcaaaaatggtttcattccttaaatctttagggtacaatgttaagaaagatgagcaattcttgccaatatctggtcttgtgggaaccaatatgaagaccaggatggataaaagcatttgtagttggtgggatggcccttgactctttgaagttctggaccggatggaagttnctttacgcgaccccaaaggtccaggaaggatggcgattattgataaatataaggatatgggnaatggtgtaatgg

SEQ ID NO: 26290 - DNA, 316 bp, Sorghum bicolor
  unsure (1)..(316): unsure at all n locations
  Clone ID: 30973061
ctactggaactgcctcccagtctcggtggaaggactcgactcaggaaggcggagcagaaggcggccatggcggacgaggcggagctcgccgcggaccagcacgtccgctacatcgtcaccgtggagaagaagaaggactcgttcgagtcgctggtgatggagnacatccgcctcaacggcgcctactggggcctcnccacgctcgacctcctccacaagctccacgccgtcgacgccgccgaggtcgtctactggatcatgtcctgctaccaccccgaatctggcggatttggagggaacgttgggnacgacccgc

SEQ ID NO: 26291 - DNA, 298 bp, Sorghum bicolor
  Clone ID: 30973065
ctggaaaaaaaaataaaaaaaaaaaaaaaagcctcttctcgttgttacctttcctagtctgctctttatttcttgtgcccctgcaaacttcctggtcgtcttcctatatatgcttctcttgcttttctagggccatcaaagtgactaaaaaacatggtatacgaaaaaaaagaccctgcacttgctgcaaatcagggaaaacattggggcattttcatctgctggcttctggggaatggatgcctctttgggttcaacagcttgcttactattgaagattactacaaatacctcttcc

SEQ ID NO: 26292 - DNA, 505 bp, Sorghum bicolor
  Clone ID: 30973076
actggtttatctgatgatgagaagcgatcaatctatgataagtatggagaagcaggtcttaagggtgctggcatgggcacaggagattactcaaacccgttcgatctctttgagtccctgtttgaagggttcggtggaatgggcggaatgggtggtggccgtgctgctcggaacagaccaatgcaaggtgatgatgagagttacaatctggtactcaatttcaaggaagcagtgtttggtgtagagaaggagattgagataaccagattggaaggctgtaacacctgcgatggaagtggtgccaagccaggtacaaaggcaacaacatgtaaaacctgtggaggtcagggccaggtagtctcctccacaagaacaccacttggaatattccagcaagtctccacctgcaatacttgtggtggcactggtgaattctccactccttgcaacacctgggggggtgatggccgagtgcgaaggacaaagaggatcagtctgaaggttc

SEQ ID NO: 26293 - DNA, 425 bp, Sorghum bicolor
  Clone ID: 30973089
ctactggccattgacgtttctcggaaccgtgccgactccaggagatcgccagtcgactcgctgccgtcgtgtccacaaagatggggggatcactagcagctaccgaggaacacgagttgggtccccggtggagagactctgttgggttcctgaagattagctcagggtctgttgtacttcccatcggaaagttatcaattggcttttgctgccaccgagcattactattcaagaccctggcggactccatcaatctgccctgtcgcattgtgaagggatgcaaatactgcaaagctggtgctgccaattcttgcttggtgcgctttggtcatgacagggaatatctaattgatttaattgggaacccaggattcttatctgaacctgactccctcttgaatggactatcatccatctctgtttct

SEQ ID NO: 26294 - DNA, 631 bp, Sorghum bicolor
  Clone ID: 30973090
tactggacattctctacgacgacgaggaggaggcgtcgccgatcgaggaggtgcggctgacggtgccgacgacggacgacccgtcgctgccggtgtggacgttccggatgtggagcatcgggctcttctcgtgcgcgctcatgagcttcctcaaccagttcttctcctaccggacggagccgctcgtggtgacggggatcacggtgcaggtggcgtcgctgcccgtgggccacttcatggcccgcgtgctgccgcgcaccaggttccgcgtccccgcgctgctcggcggcggcgagtggagcctcaacccggggcccttcaacatcaaggagcacgtgctcatctccatcttcgccaacgccggcttcgccttcggcggcggcagcgcctacgccgtcagcatcatcaacatcatccgcgccttctacggccgccacatctccttcatcaccgcctggctcctcgtcatcaccacgcaggtgctcggatacgggtgggcagggctcatacgcaagtacgtggtggagccggcgcacatgtggtggccgggcacgctcgtgcaggtctccctcttccaggcattgcatgagaaggacgaatccgccaaagcctcacgtcagatctctcgttc

SEQ ID NO: 26295 - DNA, 392 bp, Sorghum bicolor
  Clone ID: 30973096
ctggacgcctcgccaccttctcgacgcgcgtgtgtgcaactgcgaggctccgtcgacgacgagctcgtagaactaagacggccccgcaacccacgcgcgtcggcgccgccatggtgatctcggtggccactccccggcgctccacctccatacgcgacgccgtgctgggcggcgtgctcggcggcggcgggcgccagctgtaccagcccctccgctgcgccttctacgacggcacagccgggggcggtggcggtggcttacccggggacggcctgtccgccgcgctctccgaggagcccgcccgcgtctccgctgccggcggcggcaataagcagaagcaggcggcgaggaacgtgctgatcctgatgagcgacaccggcgggggccaccgc

SEQ ID NO: 26296 - DNA, 583 bp, Sorghum bicolor
  Clone ID: 30973106
tactgggtggtgcagccagctgagctacaggtgccggccaaacttccccaactgaatgtcttgcaggtgactgaggaggctgagctgcaacgcctcttcagagcccatgccatggccctccaaggagctgtgcagcgcatcgtggaccgtgcgggtggagagacggcctccctgctgaagtcactcatgtacgactacatcgacaaagcctctgcgctagctggcgggctcgggctgatccaagccccgccggaagctgctacgccgggaaatgaagcctggtccaagtggccaccccagccagctccgacacaccaagctactcacgccacggtacccgtgcgtgacgtcttcggccgcatcctcagcacgctaccaccgaaggcaacagtggaagacaactccattgctgcggtcgagaaagcactggcgcgcatcgagctctctgcaagggagagccccacaattcagggtgacagcagcggtggccagcagctaaccagcagtgtcgtagcactcttcagcaagccgacggagccgctgctccaacaacctcagcacgcagctgctgtcgtgccaacac

SEQ ID NO: 26297 - DNA, 656 bp, Sorghum bicolor
  Clone ID: 30973108
cctactggatcgactctgtttagctccgcacctccgccgctatggccgccgcaaccttctccgccgccggccgccggctcctctccaccgccgcggcagcgaaaaccgagctccccgtccctatcgcccgtcttcgccagctcgcccgcgctggccgcctcgacgacatcgacgcgaccctcgcgcccctgttccgctcccacaccgtcgccgcgctctcggccctctcctcggtgggcctccccgaccgcgcctccacgctgctcggcaccatcacgtcgcccactaccgcgcacctgaacgcggtcctcggcccgctcctgcgccgccgccgcctggccgggctcgtgccctccatcctcgccacgcatgcctctatcccgcgggacgccgccacggacagcatcctcgccaagtcgctctgcctcacctccggcgccgactccgcgctccacctcctccgggagccatcgtcggggtcgccgccgtcgctccagctcttcacggccatcatcgactccttctacaagcagcgcctcccgcaccgcgccgaggagctgtggcgcgccatggtccaggaccacggcatcgcccccgacaccgctgcctacaacgcccggatcacctacaagtccgccaacggcaccgtggaggag

SEQ ID NO: 26298 - DNA, 535 bp, Sorghum bicolor
  Clone ID: 30973116
ccagctgtgacggcgcgaggtaaactcccccggtttaaaggtaggtcaactccccctccctctagtcgggaaatcgcctcttttctcctggtcttcttcgggcgacttcgccgtcggcgagcatccaccaggaccataatgaaggcattccatcaggcaccagtagttggccatgcatttccttcctgtcaaaggccatgtgtttccttcagcaacagaccttatcgccaatcctcacatcagtatcagcttgtagcagctaaggacacctttatgtacaataagaagtatagaaggctaatggtaacagttagtagcctctcagagatgccctatgaaaagttccatgaatcagcctacgatcagtgcaaagattcttccttagagtcacggaagatcgtgcaggctgcagaacagaaggtgttgccacaagatatggacgctcagtttattgagtccattttatttgatagaacgctctacaaatatgagattcttggcagaatggctatcacgggtttgatgtctgctggtg

SEQ ID NO: 26299 - DNA, 584 bp, Sorghum bicolor
  Clone ID: 30973132
tactggctttcgagacatagtgctgctcatgcttatggacggcaacaacatgaatacattttggacaataaagcaactgataaacataaaaatcagtatataacaccagaaaaggcttctacaccctcggcaacaatcgagtcagatccattacctctggtatggggaaaacaaagagatcgcccattaagtgttgaagagtggacagctttcttagatcctgaaggtagagttatggattcaaaggcactgaggaaaaaggttttctatgggggagttgatcatgctttgagaaaagaggtctggaaattcttgttgggctatcatgaatatgattcaacatatgctgagagggaataccttgctgccatgaaacgagcagaatatgaagccgtaaaatctcagtggaagagtatctcagccacccaagctaaaagattcaccaagtttagggaaagaaaaggcctaattgacaaagatgtggtgagaacagataggtccattccctattacgaaggagatgataatcagaatgttgtagttctacgtgatattctgttaacatatttctttctacaatttcg

SEQ ID NO: 26300 - DNA, 472 bp, Sorghum bicolor
  Clone ID: 30973134
ttcttgtggaggaagaatgttagctttgctatttccaggcattacagacgcttcgatgtttttgaggaagctgaggccaacaaggctggtggaaaatatgataacacatcaattgactaccagatagagttctacaaaagagagggtctaacccattattcgtcagctaagcttcctataacgagcgatgtcccggagggctgtgtgataattagggaacatgtccccataacaaacttgtttacatgcctttggttcaatgaagttgaccgcttcacgtccagagatcagctaagcttcagcacagttagggataaaataaggtcacgagttaattggactgcagacatgttcctggattgtgaaaggcgtgattttgttgttcagtcataccaccgagaactgttggaacagaggcaggctaccttacgaagttggcctccccagcggccacccattgtgcgcgtccacc

SEQ ID NO: 26301 - DNA, 613 bp, Sorghum bicolor
  Clone ID: 30973144
aatgaagacaggacccgaccgcctccgtcgccaccgcagtgcctccccttccctctcgagacgccgccaacgacggcggcgacgatccccgccgtcatatcgatccccgccgcccctgcaccaacgccgagtcacgcggagaggatccagcaggccaggcagcagcgggatccagcagggcgcgcggccctccccgatccgagcgaccgccggcaaacccagcccgccgccatcctggtcttcgaggccgtgctctccctcgccaggccaggacgccatgatggatcaagcctcgaggcaggcggtgtgaggccaagggcggtggcacctcaccagcaagcgtcacctcctcccacagatccgtcgacaccttcaacttctacgcccgtaaacctaccacccccgcatccttgtttctttgtccatcactagggtttgcgtcctcagggtgcacagcatggattgatttgctctccccagtcatgccgatctgtggtagaatgggaatattgatatcgattttggtttagaatattggtttagtagaacaactgtctttaagcattcaaaacctgaaaaggtaggccaatattaaagatattaatagctaaag

SEQ ID NO: 26302 - DNA, 658 bp, Sorghum bicolor
  Clone ID: 30973156
tactggatgttttcctcggggaacaatccacgactcattggctcgggagggtttcccgtgcgctcgcgagccgcgcggctcctcttcttcccctcgcgacgccgcaggctccgccgccgctcgcctaggttctccaggctccgccgacgggctccatccagatcgagacggggaagctcaccgcatcacggcgagtcgcctccgccctgacatctcatcgacgctgccccgacatcccatcgacgacgcgccggcatcccatcgcccccgccctggcaccccgtctcctctgccctggcttcccgtcgcctgtgccatctcgtcgttttggtcaagccaacaatccagcgcctggccacttgcctcgttccaagatctgattctgtcgggagagattacacatcgtggggtttatattctgcaagtgtaaccagattccgctagtgtcagaagattctgcaagtgatcagccgcaatcccgcaaatctacttcagctctaacattatctcaggagtgattttctgctgctcttgggacgaggtgacactggtgtcagatggcttcttgggaagaccttgctaggaattttttgttggaagaggaagaagaagatgaggagctattctttgttcttctccctgttataatgccctttct

SEQ ID NO: 26303 - DNA, 497 bp, Sorghum bicolor
  Clone ID: 30973158
tctggatgtcggccctggagctgagcaagagcatgagcttccgctccagcgagagggccaagcagctcatgctgaggtacggtcaccccggtctcgacggcggcttcgacccagccctcttctccccgctgcacgagtcggtcgacggcgacggctacgagcgatcgccggcgagcaactacgagcctcagcggagcccttgtgctaggtccgagacggggacggcgatggccgcggcctcccccgccgcagcaccggggaagaaagccgggccgcgcaataagctcaagcttctcggtaacatcaagaagctgctgccaggcggcggcaagagaagccactcatcaagccacgtgcacgggcacagacacgaccacgccggcggccgcgatggcaggaaggcggcgccggctccaagggacgagtacctccagaaggctatgcagtggctgtcgacccacgacgtgctcgacggtgaccactcgtatgagagcaca

SEQ ID NO: 26304 - DNA, 254 bp, Sorghum bicolor
  Clone ID: 30973168
ctactggacttttcggggcaagcagtctatcctcatcacgccatcggtagggttccggcgattccccatggccggccgccaccgcaacccgctgcccccttcctatccccgcggcggcggcggcaaccatccgcctcccccacttcaccacccgcttcacccccacctcccgccccaccaccccctcgacgacttccgcgacccgccgcgccttcccccggaccaccacctcgacgacttccgcgatccgtccc

SEQ ID NO: 26305 - DNA, 503 bp, Sorghum bicolor
  Clone ID: 30973173
cgaacttgtcccatccctggcacaaaaaatggacatcaagattccgtttattctagccttcgtcttcctcaccctcctccttctcaggctcatccgttgctacgtcacatcatcacgcacaaatccatcagtgcttcgcctcccaccgcggccatggcagctgccgctcatcggcagcctgcaccatctcctcctgtcgcgctttcgcgacctgcctcaccgggcgctgcgcgagatgtccggcacctacgggcccctcatgctgctccgcttcggggaactgcccacgctggtggtctccaccgcggaggctgccagggaggtgatgaggacccacgacctcgccttctgcaaccgctacctgggcgccaccctcgaggccatcacctgcggcggcaacgacatcttcggctccccctacaacgcgcagtggcgcgagctccgcaagctgtgcatgctcgagatcttcagccaccggcgcgtgctctcgttccggagcatcc

SEQ ID NO: 26306 - DNA, 590 bp, Sorghum bicolor
  Clone ID: 30973175
aagacttgaacacggccgctagcgtctctcatcggctgggcgtggttcactacacgcacactcaccagctagccaccgcaagcgaatcgatcgaaacggagcctaatagctagctagaacacaggacaccccccctgctagaataggaatctaagagcgagagcgagagagaccatggcctcggaggccaatgggggcgtcgtcgccaacgagaagggagcggagacggtcggcgtcgggcggtacgtggaaatggagcaggaccaggagtccaacaccgtcaagtcgcggctctccggcctgctctggcacggcggctccgcctacgacgcttggttcagctgcgcctccaaccaggtggctcaggtgctgctgaccctgccctactcgttctcgcaactggggatgctgagcggcatcctgttccagctcttctacggcctgatgggcagctggacggcgtacctcatcagcatcctctacgtggagtaccggaccaggaaggagagggagaaggccgacttcaggaaccatgtcatccagtggttcgaggtgctggacgggctgctcgggaggcactggaggaacgt

SEQ ID NO: 26307 - DNA, 178 bp, Sorghum bicolor
  unsure (1)..(178): unsure at all n locations
  Clone ID: 30973203
tactggcctcttttcgctgcaacttcccaccaccgccttcgtccctcccctatccgcgtcctcccccgggcgatcgatcgaacgcggctaacttcgccgccgccccatcgaggcagccatgggcgnngagatcgccgagcgggccgtcgcgggcgagctgccggaggagccgcggccg

SEQ ID NO: 26308 - DNA, 642 bp, Sorghum bicolor
  Clone ID: 30973230
tactggtttgcacaatatgctgggacctcagctggcatattagacggcattgctctgaaatgtggatctaaggtggagtacaggtcaacattatgtgatactgcagaactacaattctctattgaggtttggattgttggggaaaaggttggtgaaggaattggtaggacaaggagagaagcacagcacaaagctgcagaaatgtctttaagaaacttggccaataaatacttgtcatctgatccaaataagttgactgatatgaaagaaaatggtttcagtggcaacagaaatgtctttggttactctggaaataccagggatgatatgttgcctctttcaagtacttcagaggaatctcgctttatgaaaatggagaacaattccaggaaaacaggaggttctgttgctgctctcaaggaactttgcacggttgagggatataacttagtttttcaagagcgtccatctccagcagatggtttagttgggaaagaatcttatgctcaggtagaagttgggggacaaattctaggcaaaggagttggattaacatgggaagaggccaagctccaggctgctgatgaggctcttggaactttaagatccatgctaggtcaacttgctcataagcgatctggc

SEQ ID NO: 26309 - DNA, 561 bp, Sorghum bicolor
  Clone ID: 30973239
tactggctgctcctcttccctccggccgaccccgacgccgccctgtctcctcggctcggctcctcgctccaatccaatggcctacgccgcacgcctcgtagccaagatccaccccgccgcctaccccgccgggacgccgcgggccgagccgcgccgcccctccagcctccgcgtaggagcattcagtggatccacaaccgttaaacagcaaaagtttgttgctaaatctgctatctcgggagtggaaggtggtgatgcatttgttggagtaaagcaaaatactagaccaatcatagtcatagacaactacgatagcttcacatataatttatgccagtatatgggagaggttggagctaattttgaggtttatcgcaatgatgagatcacggtggaagaaattaagaagatctctcctagaggaatacttatttccccaggccctggcactcctcaagattctggaatatccttgcaaacagttacagagcttggaccctctatacctttgtttggggtttgcatgggtttacaaatgcattggggaggcatttggaggga

SEQ ID NO: 26310 - DNA, 398 bp, Sorghum bicolor
  Clone ID: 30973247
cctctggagcaacattacatctcagctgctcacaagaagacatctgaagattcaacacaaagggaggcatgagccgcatgaagaacactgccctcgcccttgtcgcatggctcatgcttcttgcactcttcatcacaatggcgacagcctcactcccatgccaatgctgctggctggtgcagcatccgaaggtgacctgtggccacgcctgctgcggcgataactgttgcccgcccaccccaccaccgtcagcccgctgaattcgaggaagatcttcaggcctgtgcctgttcatagatcatgaacattatgatgatacagaataaactcagctggaatgtcattgtagtatcccgctacttttctgtgaccataatatacatgctgcagcatgcatg

SEQ ID NO: 26311 - DNA, 392 bp, Sorghum bicolor
  Clone ID: 30973248
ctactggttctcggtcagcgccttcttcgtgctcttcgtcttcaccaggctgctctgcgcgcgcctccacctgtccagggcggccgccgccgccgccgaccgcgccgccgccggcggcgccttcgtcgtcaacgtggagcgcggcatccacggcctggagccgtccgtggtgacgaccttccccaccgtcaagctcggcgacggcgacggcgacggtggccagcaaccgccgccggtgcaggaggagtcgcagtgcacggtgtgtctggaggagtacgaggccaaggacgtggtgcgcgtgctccccgcctgcggccacgccttccacgcggcctgcatcgacgcctggctgagggagcaccccacctgccccgtctgccgcgcctccctgc

SEQ ID NO: 26312 - DNA, 670 bp, Sorghum bicolor
  Clone ID: 30973282
ctactggggagcatacaagtatgcagatgtcttcaaggaaagattgggagtcagccttgaaaaggaagatgaaatggactgtcttgtggctggagcaaactttttgcttaaggctatacgtcatgaagcttttacacacatggatggtcagaagcgatatgttcagattgatcagaatgacttgtttcccttccttcttgttaatatcggatctggtgttagtataatcaaggttgacgggcatggggaatttcagcgagtaagtgggacaaatgttggtggtggtacgtactggggattggggaagctaatgacaaagtgcaagagttttgatgagttgctagagttgagccagcgtggagacaacagcaccatggacatgcttataggagacatatatggtgatctggactactccaagattggtctttcagcatctacaatcgcctctagttttggaaagataatttcagaaaacaaagagctatcagattatagacctgaggatatatcgctctccttgttacggatgatttcatacaacattggccagatttcctatctaaacgcacttcgttatggactcaagaggatattttttggtggattcttcatccgtgggcatgcctacaccatggatacaatttcttttgcagtgcatttctggtca

SEQ ID NO: 26313 - DNA, 638 bp, Sorghum bicolor
  Clone ID: 30973304
ctgggcagtcatgctcacgcacagccgcacgcccgcacaggtcgcgactcggactcgcgagcggccgaacgccgccgcggtttgccaggcgccagcgctcccgtgactccgtatgctcccggctcccgcacaagcgctcccgtcatctgctcccgtccggctccggtccggctgtcccctctgctcgacccccaagccgaggccccgagcacccgacggcggacggctcatggccgggcggccggcactcaagcaatgtcgcagcgggcagcggcagcggccaggccacggcacacgaccagcacaggggaattggtgagtttaattttttccccaaatgaccagatggctatggctttatggtttagggatttgattttatctagatcggtgaaactgttattacaaaagagaagtgtgtattggtattattgatagaattcatcgagagcttgagaatcggtttgatgaggttagtagggagttgcttatttgtatggcagcgttgaatccttctaattcatttgcctggtttgatgctaaaaaatcaaataaggtgagaaatagtatgagtgataggctattgaacgattgtttggttacctttattgagcatgatatattctcttctgtaagcg

SEQ ID NO: 26314 - DNA, 477 bp, Sorghum bicolor
  Clone ID: 30973312
cctactggacaaaccttcttcctttcttcgcaattcttggctatcttctcctcttccctgattcttaatttcttctcagattagacgttcgaaaacttgtgatttcttgtcccaattctattgcatcttcttctttgaaggacgtattatagttctagttaataaacaagcagttcaaaaaagttttgtggtttatgcacgccattgacactctctgctgtttgggttgtccaaaacgatctcgtcggcgcagaagccagcatgtccaccacgctcgggagcggcagtgttagcccggctgccggtgctgcgtcggcggcgccggaggtggaaggccactgggctccgcacggcgcggtgctgacggcctgcgtcgtgggcatcaacgtgctcgtgatcctcctcatcttcggtttcttctggcggttcttctctgggagagggggcccgtcgccgtccgcgtcaggcggcgccgcc

SEQ ID NO: 26315 - DNA, 630 bp, Sorghum bicolor
  Clone ID: 30973315
tactgggggccccggcgcgccggcggcggaggaggcgagcccggtgggagctcatcatcatcctccttgccccagcgccccggcgagccgaagcggcagaggatcgcccttcgcgatgtgatcacggaggtgatgcggaacaccaacatcgagaagtttttaattgctctcgagcccctcatcaggagagtggtaaaagaagaaattgagtcggcttttgcaaatcatgcctctatgatggcaagaaacgtcacagacactgttccatgtgcgtcaaagaatttgcagctgcagttcatgactagacttgctcttccaatatttactggatccaagattgaaggagagggctccttaagtataactattgctctagttgatgctttgacaagacaaattgtagcaccaggcaaggagttccagataaaggtcgagattgtagttctggagggggattttgaaagtggagaagatgatgactggacagctcaggaatttaacaataacattgtcaaagaaagagaaggcaaaaggcccttgatttctggggatgtattcattgccctcattgatggcattgggacagtaggggaactttcgttcacagataactccagctggacacggagc

SEQ ID NO: 26316 - DNA, 359 bp, Sorghum bicolor
  Clone ID: 30973365
ggagtctgcaccaaatctttactccttgcatcactgtgcagatttcctcttcgaacctgcgctgcagtccgcaggtggagctcctgagcacgagaccagagcgagcgcccggggagctgccaccactgcggtcctcgttgccgcatcatcaagatggctgaagcagctctcgttgctctctcaaagatcggtttctatttagcaagagaagctgcaacttttgtggcgaccaagttttctaatttgacagagctaccgaacacagtgcagcgtgtgcgaaggcaacttttgatgatgaatctcttcatacagaagacaagtgcactgtatctcagtgatgaactcctgaagggatggat

SEQ ID NO: 26317 - DNA, 628 bp, Sorghum bicolor
  Clone ID: 30973375
gtttccgtttccctccccggcgtctccctctcctcgccgccgccgccagagatgggccgtgcgccagcgaacggtaagcactcactgccgccgccgcctcctcctccaggacgttgccacttctggctccccaacaagcgccgccactgcgccaacacccctctcccgtcctctcagtattgcggaaaccacctccctgagtccgcttccggggccggccgccgcgtcccctgccccgtcgacccctcccacacggtgctcgaggagaacctggaggcgcacgtcggcaagtgccccctgaagaagcaggtcgccgcgctcaccgcgcagccgtactactccaagggcatcaactccggcgcgggtgaggcgggctgcgttgtgacgtcggcggagaagcgcgcggccgtgtacaggcttaccgaggaggagttccggtgtctgctcgggaagatccggtcggtgcatgtggccaccgctgcggccatacgggagtcctacctgatcaccggtgctaccgataagtggatgaacggccaggtcgataggaagatgccgtaccaagagaagcatgtcgctcagcaggcatccattgttggaaacatggaggcatttggcctgctgcgga

SEQ ID NO: 26318 - DNA, 586 bp, Sorghum bicolor
  Clone ID: 30973380
ctgaggatcaggaggggaagaccagctttctgtacacaccaggggatgtggatgactgtgttggcaagatcgggcagcttctgtcaagcgaggagctgagggaggccatggggagggctgccaggaaggagatggagaagtttgactggcgagcagcaacgaggaagatccggaacgagcagtacagtgctgcgatctggttctggcgcaagaagagggcacagctgctgcgacccctccagtgggcgctgcggctgctgaggccgacaacgtctggggctgccattgccgatgccatggcgaagcaatcataggaggcggctattatggttgatggtcccttttccttgtataaaatgggcgaagggcgctatgggcagaggggaggaagctcaggcttcagcattccgattcactgaagatgtaatgaacagtttaggattgttagatttgtaaatcgtccgtgtcaatgtaatgcttcttcttggcttgctacactatatagtagtagtattgatcctttagtaggaaattggtctgcagttgacaatgataataataaatagtttttttttttgtattcatc

SEQ ID NO: 26319 - DNA, 573 bp, Sorghum bicolor
  Clone ID: 30973393
tgcgccccgtgaacgggcgcggcggcaactgcagcaccgccgggtgcgacggcgacctgcgcgagacgtgcccgtcggagctcgccgtgaaggtgggcggccagaccgtggcgtgccggagcgcgtgcgacgtgttcgacaccgatcagtattgctgccgggggaagttcggcagccagcctacgtgcccgccgacgccctactccaagaagttcaaggacgcctgcccgacggcgtacagctacgcctacgacgacgccagcagcctcttcacctgctccggcgccgactacatcatcaccttgtgcgccagcaggaagcaacaagcgtgctcgtaccacaacaatcagctggtttgcagtggtgccagcagccggcggccatggcagatcacgtccaagatcctgctgcttctagtactgccgcaactcatcttttcggcgctgcagtttgcagtctgaccatccaacaagagcaaccaacctgcctgatatatattttcctcaattgttttcttgtaaattacactaactattggttatcataatatatggccctattcgtttttagctt

SEQ ID NO: 26320 - DNA, 488 bp, Sorghum bicolor
  Clone ID: 30973402
tcccaaaggcatggtgcgatcagcatggggatggcgtgatcaccgccgctaagaaagagttcaaggagcacgtcgaagagatggagaagcagagggacatcactgacagtgagggctgggctacctttgaggacatcgacctcgatgacaatttcaaccccaggaccttctctcagcatcagtcggactcggtggtgaaagggaagaaagtcaatgaaagcctcaccagcagtttcacaaatcccttctacaacgagaagaacccgttcttgaacacaaactacaactgaatgatgttggacccttttgcgttgggatgtatcagttcgttttatattttcgttactggtataatggcattactgtacttagggttcaattgttacattggaccagggttgctgtttatggcgtaagaagttgtatgattggagcttgtacgtcccttgattatccttgatatctatgaatgcacatcatttttttcc

SEQ ID NO: 26321 - DNA, 563 bp, Sorghum bicolor
  Clone ID: 30973405
gtttccgggactgcgaggggtggccgttcgggctgtgccgccggccggccgtcctcccgctgccgccgctgcccagcacgccggccgactcgtggaagtggcgcaagagcgtcagtagcctcgccgcgagcccaactcctgcttacagacacaaaatcgctgctgctagcagtaaataaccgcgccggcgccgccgttggcgttagttcattaacaaagaagaagctcaaaccgtccgtgttagcagcagcgacgctgctgatgagacgtgacgacgacgacgacttttgcaagatttcagctagtacgtgttagcagcagcctagtagtagcctgcgtgcttgatgatgcgtgttcgtccggccggcctcgtctagaatgcgagagtttcataagaaacctagagggcacgaaacatataatttgctccgatgaattgtgaagcttccccgcaaaattcctatgaagatgttgcgtgcttgtttattcgaggcggccttgatcttttgcaaggattttttttcaggtgtacgtgttctgaataataaactctgctgtctttc

SEQ ID NO: 26322 - DNA, 615 bp, Sorghum bicolor
  Clone ID: 30973440
aagagtagtggaattgttggctttgaagaacatattgtttctggtggaaatttccatggtgagtatcctgctaaagcgttggactatttggcaattggtattcatgaacttgcaaatatgtcggaaagaagaattgcacgtttacccgataccaatttgagtggattccctgcgtttttggtacgtgatggagggctaaccagtggcttcatgattgctcactgtaccgcttcttcactcgtttctgaaaacaaagttttagtccatccagccagtagtgatacactttctacttctgcgtccaaagaagatcatgtttctatgggtggaatgtcggcaacaaaaatctttaactgttgttgaaaatgttgagcatgttgtcgcaatcgagttgttatgtgcttgccaagcacttgactttttacgtccattgaagactactcgtgctttggaagctgtatacgagttggttagaagtaaagtcaagttctttgacaaggataggcatatgactccagatatcgaagctgtacatgagttattacgcacaggacaagtttggggcgcagttaagaaatatttcccagaagaatgtcattaaattgacctttttcc

SEQ ID NO: 26323 - DNA, 515 bp, Sorghum bicolor
  Clone ID: 30973444
tcattgtgatccccatgctgccaatatgatggtccgaccaatgccacatgacagcagaaaactttttggttggaagaggccacagctagttcttcttgatcatggactttacaaagagcttgattataatactaggataagctacgcttctctttggaaggcgcttgtttttgccgatgcaaaagcaattaaggagaacagtgtcaaactgggtgctggggaggatcttcatgcactctttgctggtgttctcactatgaggccatggaaaagggtgattgacccatctcctgatcatcttgtcctaggaaaaaatactgattattcagaactacagaattatgcctcattgtattttactgagatctcggagctgctgaggagattaccgagggttatattgttgatgcttaaaacaaatgactgtttacgtgcagtcaatcatgccctggtaagcatttggaagtgctagcaatctagttaaatatatttcttctcgtttttccattcttttc

SEQ ID NO: 26324 - DNA, 368 bp, Sorghum bicolor
  Clone ID: 30973449
acgcccccagtaagttaatgcccccaatgtgcgcagacaagttgtggcatttttttttttgtatatgggcatccaaatgattacggactataaatgttccgatgtcacaatagagttttggtaacttttgactgacccctgttttgtactatacttaatcatcgaacagagattagttggagtgttggtgtcctagttttggccatctttgttttggtttctttgaaattcccttttggtgctaataggtctaagttattgatttattcgtttgtcgttgaatggagtccagttgtattaattcccactccgctgggagatacatccatccatttggtaacgttaattcggtgacttgtgttgctgcc

SEQ ID NO: 26325 - DNA, 555 bp, Sorghum bicolor
  Clone ID: 30973451
ggtcagggtcccgtctcctctcatcagatcacgagccacacacaagtgtgggtgtgggagcccgatccgatcgccagatccgccggcctctgcgccgatccgggcgtccttccaccgctcctcttccttctatcgtaggcgcgccctcgccgctcgctggagcggagatccctccctgcagcccggactgcttgattcctttcttattgcctttgccggctctatggataagcaggagccagtagccaatgtcgaacaaaagataggtctctctgagaagcctaaggagcagcctgttgccagtaaggatgagaaagcagctgtaccaccaatttcagttgattcaaatgctatcgatctaccaagtgaaggccaaacccaagctggcacatccaacatggatgggggccataatggtgcacacaacttctatgcttctcaggcacagccattctattaccaaggctccggatatgaaaacactccacaagaatgggacacatatcctccctacatgagtgttgaaggattggaagtgggcccaccagttgtata

SEQ ID NO: 26326 - DNA, 657 bp, Sorghum bicolor
  Clone ID: 30973461
ggttttcaacaatgccacacacgattgtactagacggtgataacttggactgcgaaaccctttacacaataggttacaacccatcagtcgtaatcgagttggcagaagagagtaaagaacgtatcaaacactctcgtcaaatcgtacaagatattgttgataaagatgccataaaatacggaatcaacacaggttttggtaactttgcaactgttaaaatcggcaaagaagatcttgcagacttgcaaagaaatttaattcgttctcacgctgcgggagtcggccgtcccctaacaaacgatcgtgctcgtatgttattggcactacgcatcaatgtcctcgcaaaaggttttagcggaatctcgttatcgattgtggaatcactcatcgccgctctcaacaagaattgtatttcatacattcctgaaaagggaaccgttggtgcaagtggtgatttggctcctcttgcacacatggcccttggaatgatgggagaaggtaaaatgtacaatccaactacggaaaagtatgaagaagcggcattagtactgcgcgaacatggactaaccccaatcgacttgggagcaaaagaaggtttagccatgattaacggcacacaatttattacatcattaggagccgaagcaacattccgcg

SEQ ID NO: 26327 - DNA, 247 bp, Sorghum bicolor
  Clone ID: 30973465
aaagagaaccgggggaagaggagtcgcggctcccgacacatgtggcggcgcgcggcgacggcggcgctgtcgctgggcgctggcgccggcgcggtcgcggtcgccaactccgatgaccccgccgcgacgctcaaggtctgcgcgcacctgcctccgcgcctcctccgctactccgccacggccgccaccatcgcgttcgactacaagtggtccctctggggcctcgagccgggcacccccgcgtggc

SEQ ID NO: 26328 - DNA, 696 bp, Sorghum bicolor
  Clone ID: 30973476
gtgctgtgcggctgtgccgctctgtcagtctcggctgtgagcctgcctgacccagacacacacacacacacgagggagagggagagggagggccggccagcgacaccacagcatggcggcggccatcctagcgcccaagccgcctccttcgctgcctacaagcgcctctccttcctccttcccctccccctcgcggctctgcctctccccgcggcatcccctgacaagattgctcctccgccccattccgtgcgcctcatcgccgtcctcctccgtcttgatgccggacccggacccggacctcgagcctgagcctgcccacgatagagatggagcccaagacgaggcgccggagtccaggccccgccgcatcgccctcttcgtcgagccttcgcccttcgcctacgtctccggctacaagaaccgcttccagaacttcatcaagtacctccgggagatgggcgacgaggtgattgtggtcaccacgcacgagggcgtgcctcaggaattccacggggccaagctaattggctcatggagcttcccttgcccctggtatcaaaaggttccgctgtcgctggccctcagtcctcgaatcatcggagaagttgctagattcaagcctgacattattcatgcctcttcccctgggataatggtatttggcgcgcttatcatagcaaagttgctctgcgt

SEQ ID NO: 26329 - DNA, 683 bp, Sorghum bicolor
  Clone ID: 30973485
aaatcgcttccttctttcaacattgcgggagctcaagccaaagagctagctaagctagctgctcccaaagacccaatgatggccgcccccgccaagcatgtcctgctgttcccgttccccggtcagggccacctctccgcgttcatgtccctcgccggcctcctacacggcgctcttcccgacgctgccatcaccctcgtctccaccccgcgcaacgttgccgccctccggactaccgaacgctctaaagccaactcgtcgttcctcggcttccacgcgctgcccttcaccccggcggaccacgacctgcctccggactgcgaatcctccgacgccatacagcccatggccatcttcgacctcctcgaggcgttcgaggctctcgaggccgcgttcgacgactacctcttcgccaccgtcgccatggccggcggcagtggccgcgacgtctgcgtcgtctccgaccccttgacggcgtggacggtgaccgtggcccggcgccgcgggtgcgcgcacgccttcttcgcctcctgcggcgcgtacggttccgccgtcctgcactcgctctttagccacctgcccgtccggcccgacccgaacaccggccgcgtccacctgcccgagtaccccgaggtcgtgatccaccgctcgcagctcttctctgccggcccgcccgccgtcag

SEQ ID NO: 26330 - DNA, 529 bp, Sorghum bicolor
  Clone ID: 30973490
acctgccattaattggagaccgacgacctcttctgctcgatctcgcggagaggacgaccggccggcggcaacggcggcaagatgaactcaagatcaagatgcgctcctcgcctcgccgtgctcctctgcttcgtcctctcctcaaccaccgtcgagtcagcgggagtcttcaccatcatcaaccagtgcaaggacaccatctggcccgccgcgacgccgggcgacagcttcggcggcggcgggttcgcgctccggccgggccaatccgctgtattcaaggctcccgccggtggctggtcaggccggatctggggccggacggggtgcgccttcgacgcgtccggtaacggctcctgcgccactggctcctgcgggacgacgctgaaatgcggcacgtcgggcgccacccccgtcagcctcgccgagttcacgctcgccgccgaccgcgacttctacgacgtgagcctggtggacggcttcgacctgcccgtgacggtgcgccccgtgaacgggcgcggcggcaactgca

SEQ ID NO: 26331 - DNA, 548 bp, Sorghum bicolor
  Clone ID: 30973498
accacccacctctcctctccctccagaaccatcactctgtgacgctcccttgctcagcttctcgagagatcgccaaagaagcggcgccgacagcaaagctctgcggcgatggggtacacgtacacgccgacgtactactcgggcctgcaggacaccatcgcgtcgctctgcaagtccatcctgccctccttccgcgtgggccggcggctcaccgccgaccaggccgcggcgcggcgccacgccgagcagctcaagtggcagcaggagtccttccaccgcatcctccacctcgcggcgctccaccgcgagggcatcgtcccggcctccgacgtcgccgccttccgcggcaccatgctcgcggcgctcgtcgcgccgccgcagcaccccgagcagcccgcggtgctccgcgacaagctcctcttcctccaggagctgctctacgccaagtgcgtctccgcggcggagtacaacgcgtccaaggcgcccctcgtgcagcggcttgccgcgttcggcgtcgtcgtcgactgccccgacgccgaggtctcggc

SEQ ID NO: 26332 - DNA, 483 bp, Sorghum bicolor
  Clone ID: 30973502
ctggggaaaaacaatcgatcgagcgcgaggacgaaggggaaggagacttgtgcggcggagtagctgctcgcttcacacgggtgaggaggaggaggagcagcagagctgcggccgggggcgaggaaaagtcaaaggctcgcaatcctcccccggcgccttctcgtcaccttctccttcttcctcgtctgctccgcctaccccgcacgtttcgcttcccctcttttaacaacgcccgccaccgccacctccgcaggcgagcagagcgcgcctcctctccctccctctctccctctctttcgctgcccacttgcggctgtctcgctcgctgaactggttgcgccgtagcggccggggagctgcgctccgcctctcctccacagaaactgctgatgagtctctagcttctctgtgggcgcatctgcaattgtgttgataaagatggcctgctgctttctgtttggaaagaaagctaaacaagctgtt

SEQ ID NO: 26333 - DNA, 484 bp, Sorghum bicolor
  Clone ID: 30973520
gaccccatcgtcatcgtccccctccgcgaagagatcccttcgtcggggaagagaacgagacctacccttcctcaatcctccgacccccatggcctcctcctcctccacctcctcctcggcactccctctcttctcctccctcctcctcgcgctgctgctcctctccgccccctcgccgtccgcctccgccgagctctctttcctaaccgtttcctccaacggctccgcctccatctccgccgacccggagctggaggacgtggccccggagcccacctttctggaggaggtcatcgacgccgtatcggagaagtacgactgggacccggacgccgaggtcagggtgtggccgctcgacgccgacgccgtccgcgtcggcgtcgtgcagcggtacgagttccgggcacgcgcgggcgggtcggcggctctggcgcggttctccgacgaggccgtgcagtggagacgcccctccgcgccggccctc

SEQ ID NO: 26334 - DNA, 643 bp, Sorghum bicolor
  Clone ID: 30973521
tgggtgcgacgcggacgcgagccgcgcggctcctcttcttcctcgcgaagccgtcccagtcgcgaggccgccgccgttcagccaagtgctccgggctccgccgccggctccatccagatcgagacgggaagcgccccgcatcacgtcgagtcgcctccgccccagcatcctgtcgacgccgccccgtcatcccagcgacaacgtcgcggcaccccgtctcctccgcaccggcttcccgtcgcctgtgccatctcgtcgactcccgacttcacaggttgaggttgctagcgtggaccctgatcctctcccgtggatgcgtagcagcaagttcccaccagtactccgactgaccgatcttgtcgcaggatctggtgagttcttctcttttgatggccatattttgtatgacactctgaatttgcccttttgatatcctagtggaagaatgcgatagtcagtccacaaaaacattcttgcatcaaatatgccattccatccaaataaagctgctggtgggtcgatttgatggtagttccatgcattctgcctatcattttgtgcatggccatttgctgcctacaaagctagattagccttgcatcacgtacagattcacagcacagtacatatatgtgtcattgaa

SEQ ID NO: 26335 - DNA, 353 bp, Sorghum bicolor
  unsure (1)..(353): unsure at all n locations
  Clone ID: 30973545
ttaatcctatggactatggtatgaccgtacgtcatttcaaagaggctgttagcagaatagaccttgtggtacttcttgcttgctgataatcgaggagtgggcaagcaaatgaaaggacgtgtgagtccctctttttgtttcgtgggaggggaaagtaaccatgatcatttgggataggatgaagatgcccgtgtattttatttggatccttcttaccattttatgccttgtgtacgctttaatctgacttgttttttttatctgatcataatactacttgatttttcagttttggtgggatgtaaaaaaaatgagacncggcttagggggactagaatgtttttttttcaatt

SEQ ID NO: 26336 - DNA, 568 bp, Sorghum bicolor
  Clone ID: 30973564
gtaacccagaggcagacttgggaccagtcatctcattggagagcaagaaacgtattgaaggtttgattcaaatcgccaagaaggaaggctgccaagtacctttggacggtagcggtatcgtcgtcaagggatacgaaaatggatactttgttggtccaactgtagtaactggagtcaaaccacaccacaccatctacaaggaagaagtattcggcccagttttgtgcgttatggaagctgccactttggatgatgccatcaagatcatcaacagcaacccatacggtaatggtactgccatcttcactcgttctggcccatgtgcaggacacttccaacatgaagtagatgcaggtcaagttggtatcaacgtaccaattccagtgccacttccattcttctcgttcactggatctcgcgcatcaatccgtggtgatctaaacttctacggaaagatgggagtatacttttacaccaaactcaaaacggttacttcacagtggaaagaggatgatgtaacagcgaagctaagcacagcaatgccaacatacaaataaatatcgtcgaa

SEQ ID NO: 26337 - DNA, 563 bp, Sorghum bicolor
  Clone ID: 30973566
gatacattcagctcagaagtgaaaagattacccaaagatagaataggtgctccatattttagggagcctggagaattcccaaagctagaagagtctttctttgcgaatcccttgcctgactgtatatgtgagaaacatagtgaagaatgaagatgcaggtgtgctgatggttgttaacccgcgcctctcaagtcagaaaatatactgcctgccagatggtacttacactgttgttgagtcatgatcagtgaattcattccaatgaatacagcactgctgagacattagtttcagcttcagcccttattggagttcacagtatggacaatggacgttctgcaatgggcatgactgttaatcagttttcgcacgactgtagtatgtgagtggctatgcctatgatggctatgacatttgccgcaattggtacatagaaggtacatacactggaggacattatgcagagggcttataattttccacagttttttttttgtacttgattatttgtaaccagattgcagaattgcacaactagatttgcaaatataatggtatataca

SEQ ID NO: 26338 - DNA, 525 bp, Sorghum bicolor
  Clone ID: 30973571
caagcgcctgtgcaagtgccccgagggccggctcgccttcgcggagcacgcgctggcggtgtcggccgtggcgcgggcgatgctgcgcgtgtcggtcctcgccagcaggctggccgtgagcgtgctgtggctggtggcgtgctcggcgacgcccgcggagagggtgctggatgacatgctggtgagcggcggcgtggggaagctgctggcgctcctgcaggtggagaactccgcgtcgaccaaggagaaggcggcgaagctcctcagggtgcacggcccattctggaggcagtacccgtgcttccccacagacctcagggactacctgaaattcctcaactgatctctgtatgtcactgcaaatgcgcagagaaattccgagtccgttgagcacgattgtgagcacgtattttgtacagttaaaatgctagatttttgggttttgatccattcatgatttgtagtattgtgtgcagctgtacgtatgacattgacatcattttatgaggctaaaaggaacttgga

SEQ ID NO: 26339 - DNA, 616 bp, Sorghum bicolor
  Clone ID: 30973574
ctgacatggctagctactcccctcaaaaggactgtcaagtttgccgatgtcaggcctcccgaaacaaacaggccttttgtcacctttaaggctgaggggaacttctactttgtcgatgctgaacacttctcaaacaaggccttgttggctaggctaacaccccagaagcttccccatgagtctgcgttcaagaacttgtgattggaagttgttccacttgcccatgccttcacttttggtcgtgagccttcgtaggccgtttgaaaacatctctgtgataattcttcctgctaatactttcctgaagacgtgttgctatatatttgtaatgttgcttacattctatatgtggagatttgctagctgttctagcagtttagtttaggaaacactatgagttctggtgttgacagttgggtctgcactttgaataagtaggtggtaagatatctgcctgggatctttaaatgtctttttatatctgaaattgtcatacttcgccttgctgccggcaatggcttgaaatctgattgctcaaatgtaagctggtgctcctgtgttgccttggggcagcatgataactatttgcgttgggggcatgataacattagagtcg

SEQ ID NO: 26340 - DNA, 549 bp, Sorghum bicolor
  Clone ID: 30973575
ggcatcagcagtatgagttagcccttgtcatgacagacaaagtcttagccttcaacgaaccgtgtcctgttgaaccagcagaaccgatacgtgaagagaatgagactgaggcaacgtttgcgacacgcaagcgtgaccatgccacaatgagaatgagctatgaccttgcaaagaagcaaggagacaattcaaataagaaatgtctgacactggctaaggcgactatttcagagcctataggggatcacttcctgagtgtgccaccatcactgagtacttagagaaggtcaagaactactttcatgggatcactaagacccaagcaagcattcttattagagaactcattactaaaaagtacacaggtggtggtgtcagagagcacatactaagattgaactccttagcatctaagctcgcatcgatgaagatggaacttccagaaccatttgtcattcatgtgattttttcctctctacctaaggagtttgagacttttgttgtgagctacaacatggcacctgaggaatgaaacttagataagtcaaa

SEQ ID NO: 26341 - DNA, 481 bp, Sorghum bicolor
  Clone ID: 30973583
tgtttcacttagaaaaacctgccaatactcacatgcttcaacgtggtgtaaaacttgctcgcaacaaagcgctaagaaatgttcgctcattccacccctcaatcaccactatgaaagaggtacgcaaagtcccaatgattatcaatggtgaacttcgcatctccaaaacagatacctggattgatgtaacaaacccagcaactggtgaggtcattgcacaagtaccagaatgcacacaagacgaaatgaacgaagcggcagaaaactcacacgaagcatttttgaagtggaaagaacaatccgtatcaaaacgcgttcgttatattttcaacttgagacaactcttggaacaaaaatcaagagagattgcctctatgatcactgaagaacaaggtaaaaccatcaaagacgctgatggtgatgtattccgtggtttggaagttgtagaacatgccgcctctatgaccaccattcaaatggg

SEQ ID NO: 26342 - DNA, 704 bp, Sorghum bicolor
  Clone ID: 30973585
ggttgctgttgctaagatcctgaaggcaactctggttcttccttcactcgatcatacatcctactggggagatgacagtgaatttaaggaccttttcaactggaggcacttcattgagtcactgaaagaagacattgatattgttgaaacacttccccctgaatacagcgacattgaacctttggctaaagctccgatatcttggtccaaggtgcattattacagagatgaaatcctcccccttctgaagaaacacaaagtcatttactttacacatacagattctcgccttgctaacaatggccttcctagttatattcagaaattaagatgccgagttaactacagatctttgaaatattctcatacaattgaagatcttggtaataccctagtttcaaggatgcgtcaggatggaagcccatatcttgctctccatctaaggtacgagaaggatatgttagcttttactggttgcagccataacttgacatcagaagaagaggaggaactgcgtaaaatgcgttatgaagtcagtcactggaaagagaaagaaatcaatgctactgagagaagaagccttggtggctgtcctttgacaccaagggaaacttcatttttactcaaaggattgggtttcactcgtaacaccagaatttacttggttgctggtgaaacttttggcaatggaagtatgaatgctc

SEQ ID NO: 26343 - DNA, 605 bp, Sorghum bicolor
  Clone ID: 30973594
gaccgtccctctcagacatgctactttgttttctgtacaaacctgaagccaagaatcctgctttagtcttgattggttgccagtttcagctgcttggatttgccccagatagagttcgattcaggtgatggccatggaggagccgcctcagctgttcttgtgtcccatctccatggagctgatggaggaccccgtcacggtgtccaccggcgtcacctacgatcgccgtagcatagagcggtggttcttcaagtacggcaagacgacgtgcccggccaccatgcagcggctgaattccttcgacctcacgcccaaccacactctgaagcgcgtcatctccacctggcttgaccgcgcctcctcctcgtcgtcgagcacgccgctgtgtactaagctggcgcgggaaaacctaccgtcggtgctcgccggcattgaggccacgccgttcaaggtcaccgcgctcaagaacctcaggcgctgcatggatgaagacgtggcagcgcagcaggacttcgtcgcctacggcggcattcaggtgctcggccgcgtcatgacacaggcgctggcggagagctgcgccggtgtagatttctcggcgttccgga

SEQ ID NO: 26344 - DNA, 636 bp, Sorghum bicolor
  Clone ID: 30973615
caatttcctcctcgccttcgtctcgcacgcttgccgtccaacagctcccacggatcgaggcgggaaggaggtgggtagggtcaccgtcgctccaagcctgcgatggcgggggcgaagctgacccccaacgccgtggcggcggcgatggcgggggacaccaacctcaagccggtggtgcaggtcgtcgacctccggagcatcgcggtcaccgggggctccgggcccaggttccgcgccatcatctccgatggcgtcgccacggggcacgcgctcttcgcctcgcagctctgcgacctcgcgcgctccggcgtcgtccgccgcggctccgtcgtgcagctcctcgactacatcgtcaacgacgtcggcccccaccggaacagaaaggctattgttattctcaacttggaggttcttgctgcagagtgtgagattattggaaatccagcactacctcctgattctggagattctaattccatgagagcagaccagtttaatggagcacttcaaaatggttcaatagcagggactgctttgaacaaagtggcaaggccctctgacaatgctcaagtaatccagagatcaatggcagggaactctttgaacatggtccctaggccaagtgaaaatgcacag

SEQ ID NO: 26345 - DNA, 578 bp, Sorghum bicolor
  Clone ID: 30973619
gactgacgtgtgggccacgaacatgtcgcctcgcctcgccgcggccgcggccgcttccgcccttcctctccctcttcctccgccggcggtcgccgcgccttcccgcgccctccgagctctggtcctgtccccgggcgccgccgccgccgtatcctccagcctgcgccgccgcggcgcgccggcatgcctcgtacgccgcctgtgctcccaccaccactcctccgctgccgcggcgacggcggcgacggcggtggaggaggcgcggcgcgggcggaagcagctcgggatgacgccgccactctacgactacctcctcgccaacgtccgcgagcaccccattctacgggagcttcgcgaggagaccgcggctatgagagggagccagatgcaggtttctcccgctcaggctcagctgttggcaatgcttgtgcaaattcttggggcgaagcgttgcattgaagttggtgtgttcactgggtattcatcattagctgttgcactagccctacctgaatgtggtcacttggttgcttgtgagagggatgaaagatgcctagaagttgccaagaagtactacc

SEQ ID NO: 26346 - DNA, 629 bp, Sorghum bicolor
  Clone ID: 30973623
gggagtgattccctgctgtgtcctgaagcaagcgcagcagcaatgccagctcttcccgctttccccctcacccgccgcccatccgacgccagacgccgcggtcgcctcgtcctttccctcgtcgtcctcgtcgccgtctccgccgccgcagccctcgcctacctctctttcccctctgctgggcggacatcgcccccggcagcgttctcggcggtccgggcggaggccgactgctgcaggggtatggagggcctcgagctctggggcccggcggtcaagtggggctcagaccaccgcctgccctccgccgctgcctgctgcgctgcctgcaaggccatgtgccctcacctcgaggacggggcctgccgctgcgactcgtgggtcttctgcggtgacgagcgcaaatgcaaggacaggttcggggagtgctggctgaagaaacagaaggatgtgatggctcctgctgttattgcaaggggggaggacgtcatgtggacttctggtctaatctttggaaaaggagagggaattgtggggcttgaaacaaatctagggacacttcatattcaattgctgcctggttgcacgccccgttctgtggactacttcatcgagcttctgggcttgcg

SEQ ID NO: 26347 - DNA, 484 bp, Sorghum bicolor
  Clone ID: 30973651
gcgtgatgccaggcactgcttcctctcccagctcactaacgccaatagagatagcgatgaggagggatcggcattggagtggatctgtgggacgaggcgtgggacggagacgaagccaacggcatcattgtcatgtcatgccatggcgtagagatatggctcctggccacggttctcagcacttgcggggctcatgttgcatgggtggcggcggccttgagctcctcggcttgtggagcagaccaccggttctctctatttctgagctctcatttagctggtccagtctgggttccgttggcatattggtgctgtgcttggctggtggtcatcggcctcattgccagaattggcagacagatttgatctcttcctgcatggcccaacggccatgcagaaagatccgttttcccctggatggcccaacggccagatccgctcctgatcggggatccccagctgttcagtggctggtgggcccttg

SEQ ID NO: 26348 - DNA, 568 bp, Sorghum bicolor
  Clone ID: 30973652
agcatcaccccggtggaggcctggatgtcggcagcagcgacggcgtcgccacggacggtgggggcggccagctggccggcgaagggagggaccaggccaccggtgcagccgcggagcagtggcaggcgattgatggtttcagcaacggcgggagtgcggcggtgcagcagatgactggcgccatgagttccggcgcccaacgaggtggggagatggatttgtggggttacgggaggtaaaaacttgatgaccacacctgcgatggaaaacatgcatgaacggtcaagtgtgcatgtatatatcatgcatgcatgcatacgtgatctagctaagacgatggtgcaacttgatgcatgagttcttgggagtttatatatatagcttgatgatgatttgtttggactagttttggtgtttacaatgtgtgtgtatatgttgtactatttgttgttggttaatttgttggtacaataagagccaaggatacataatggcgtgtaattggtgattaaattgtgtgtggtcggtcatggagaagaagctaataagcagaaggattattcaactt

SEQ ID NO: 26349 - DNA, 623 bp, Sorghum bicolor
  Clone ID: 30973658
cggttccgagaggcactgttttgttacccaacaatgtttgacatgttagacgcaattgtcccacgggacagtgaacaacgattggtgctggagcagggcatgcttgggcgttgggcactgaatgccattgcctgtgacggtgtggacctcattgaccgccctgagaagtatagacggtgggaggtgaggaatcgacgggccggtctgaggcagctgccgctcgaaccagacattgttaaggaactaaagggcatggtcaagaagcaccaccacaagaactttttgctcagcgaagatgatcagtggctattgcaaggatggaaaggtcgcatcctctttgcccattcaacatgggtagcagacgaagcatcttctgaatgaagctttagtttcttgctgctgaatgataacacggtcttcagatgctctctgagaaccatttattcatgtacactgttggtagtttagtcattcagtgctggtgcagcgactcctgaaaagcagtttatgttgttattatgtcattgatgtacctggtattcaggacgtacgttacactagataactgccagtgccaatgttcagatcagattatcagaatgttgcactttggtcttaactct

SEQ ID NO: 26350 - DNA, 226 bp, Sorghum bicolor
  Clone ID: 30973689
cattttttttgctgtaacacattggttgccacattttacaggccaacacgtttcacttgttcaataatccccattggccagccgtcacactccattgttaggagtgattttcagggaaaaaaactgagctcccttaattgtcttcccctgttttctgtttttcctgttcctttttttttccgctttttggcagctcaaccctcaaaagtggtttgtgttcgggttt

SEQ ID NO: 26351 - DNA, 511 bp, Sorghum bicolor
  Clone ID: 30973690
cgcctaccatggcctcctcagctccgatgaggtgctcctcaccggcagccccgctactgccgaccttgtcaagctctatgctgccaaccaggatatcttcttccagcacttcgcgcagtccatggtcaagatgggcaacatctcgccgctcacgggggccaatggcgagatcagaaagaactgcaggagggttaaccacagctgaccgatccatcggctcaacgtgataacattggccgactgccagttgcttattatgcatgtctcagctctccgtgtttggttggttggtttgttgattcagtggccacatcttgctgagatttattatttgttttcttcaaactgtatgaattttccttgtccatgcgttgttttctttcaaaattgttgctctcgttagaggattctattttcgattgtcccttggattggaggtacattataatatatgtttgttatatatcagttccagtcaagaaaatttggtgaataaactataattttagcc

SEQ ID NO: 26352 - DNA, 449 bp, Sorghum bicolor
  Clone ID: 30973695
gagagctacaaagaagcccttgatgaggacccgtcgttcttcttgtcgtatattcctccaccgcaccacagccaccaccaccaccaccatcatcagagccttctccggtgcttccctcgcaccatgcgaaggtctgcatctctgaaagtatgaggccgggatattgcctttgttaatcgatgccgtgtacaatatgcaccccttttgactttctttgttttctatatgcgcacgccggccctctattatgcggcatttgcatgctatgagttagtttttctctctcttttttctccttgttggtaaattatttccgtcattgatgccttgagtaatgtagaggtgacaggcaggcagcttccggttattatctatggatgccatttgcttttggtgatggaaaacatgaaagagcctcagtaaatgtaatataatttagctcttccttc

SEQ ID NO: 26353 - DNA, 441 bp, Sorghum bicolor
  Clone ID: 30973710
atgttactctctctctctctctctctccacaagcccatcatcatccatcgctcttcctcagtcccagccccgggcgcaacgatctgtgttcgcatcttcctcttcctccatttccagccccatgcgtaatcttctttcggaattgaatctctccgtctcatggcgctctgagcaagtacagctccagttagtgagagaaatgtaggcaccacaaatcaacccaacataccagaaatccaatcttttcttttcccagcccaaatccgcctcttccggtgctgccataaagtttggactttattacgaggttttcacgacgtgcgagatttctgttaccaatctccacgaaccggagagtctgccataaagtctgcacagaccttcgcattgcttcaaccaaagatcccatcctacgatcttgggggcacatgaagagcctgc

SEQ ID NO: 26354 - DNA, 549 bp, Sorghum bicolor
  Clone ID: 30973715
atcatcgaactgctcgcttcatccagccttcaatctccgtgctgcgcgcctgcgccccgcgaattctttacgctctcgagatctctctctagattctctcggcttccctcttccgaattcgtgcaagaaatccatggcggctacgacgatagattggcacggccgcaacgccgccttgtatggcgtggcggacagggacagcaaggagctggtgcgcgcgcttgctccgcccatgcaacaggcggccccgaccatctcgttcgcgtacccctgctccggcgtggagcagcagagcgcggcggcggcggcgggctcgtttctgggcggcggcggtagtagtggcctgctgactccggcacagattctccagctgcagtcgcgactccagttcctgcgccggccggcggcgggcggcgccacgctggccgcggtgaccacgcagcagatgaagcggcagggcgtgccgcaggctccggcgccgcttacctcaaggccggcggtgtccaagctgtaccgcggcgtccggcagcggcattggggggaagtggg

SEQ ID NO: 26355 - DNA, 587 bp, Sorghum bicolor
  Clone ID: 30973716
ctggaaaactgatcggcttgacttgggatcgatcgagctgacaatcgcatgcatggcggccttctcatccagcaacggcgtgccgccgggcttccggttccaccccaccgacgaggagctgctgctgtactacctcaagaagaaggtcggattcgagaagttcgacctcgaggtcatcagggaagtcgacctcaacaagatcgagccatgggagctgcaaggtaattaagttacagcttgttctttagttgttcgtcgtctttgtttttcttctaagttgtaacacagtatagattaattggatccagagaggtgccggatcgggtcggcgccgcagaacgagtggtactttttcagccacaaggaccgcaagtacccgacggggtcgaggacgaaccgcgccacgacggccggcttctggaaggccacgggccgggacaagtgcatccgcaccagctaccgcaagatcggcatgcgaaagactctcgtcttctaccgcggccgcgcccctcacggccagaagaccgactggatcatgcatgagtatcgccttgaggacgccgacgacgcccagggcggcaccagcg

SEQ ID NO: 26356 - DNA, 576 bp, Sorghum bicolor
  Clone ID: 30973751
agctgcagctgcaacctcctcctaccttggtttctctatcacctcctctggtccgtctggtccccctgcttgccatgccaacctcatcaacgtttcttaactctagcagcttgccagtagccacacctccctctgctctagctacaatcctccacagtgtcgccattagctgttagctgcctaagctgctcacctatagtagtgtgtagtttgtgtacatgtgcttagttagttcatccctgacctaacgaacaagaaagactcgagctttcgtcccaaagggaatcggccggcatggatagataatcagccagtcacatcaaactcaaaggaagtttgttgctagctagctaggagtaggaggaggttgttggtttcagcaatcctgagggtacgccggccggagcgcggcgttgggttgtatcttgtatgtatggagagccagcggggtggtggtggtcgtggaggacgcggccgccgcgcggtcggcgctgcagtgggccgtcggcaacttcatccgcagcagcgactccatcacgctgctccacgtctgcccgccggcgcggtcgcgccgga

SEQ ID NO: 26357 - DNA, 378 bp, Sorghum bicolor
  Clone ID: 30973758
aaaaaaaaaaaaaaaaaaaaaaaaaaaaaaaaaaagaaaaaaaaaaggtagcggattgggttttcccctccgcctccctcccccctcacaaaagggcggcagcacagcacagcacagcgcagcaccccccctcctcctgttctgtggagttcggagcgcagcgcaaggcgggggggaggaacaagccgccgccggccgccctcctccggttcgccaccagcctgtttcctctccgccgccgccacggggaggagcggcgtccaattcgggattcttataagcggcttcagccccggggttgaaccaaagctattttctaaaaaaatggcggcaacaatggtggcaatgactgcaaggagcaaaaacagcgcattatct

SEQ ID NO: 26358 - DNA, 615 bp, Sorghum bicolor
  Clone ID: 30973775
gagaccgtgcgctatcccggcctcgcgtcgcacccgcagaaggagctcgctgaccgccagcaccgcaacaacctccacggtggtatgctgtggttcgaggtccgcggtggaacggaggctggccgcaagcttatggacaccgtcagcaagccgtggtgcctgtgcgagaacctcggtgccgccgagtccatcatcacgtgccccgcggtgatgacccacgccaacatgctcaaggaggaccgcatcaaggtcggcatcaccgacggcctcgtccgcgtctcctgcggccttgaggagtccgaggacctcatccacgccctcaagacggcgctcgatgcgctgtaatctcgacgacgtacgcacacacacacagtgaccgtcggaccgaaaaaaacaaaaagcactcagcgatctcgcgcttcgtgacacgcacacacctttcccgtcagggggtgctgtgacgactcggagtgtgcggggcgttatatcccaaggacgaagtccgcgcgcgcgtaacaactcgacagtttccccctcccttccttctttctacggtcgacctccatcgccgcacacggcatcatttgtgaacgcttcagaaatggtgtccggttt

SEQ ID NO: 26359 - DNA, 479 bp, Sorghum bicolor
  Clone ID: 30973787
cgctcaaaggcatcgagaagacctccggcggggtgcagctggtgcacgtcgacgacctctgccgcgccgagctgttcgtcgccgaggaggcggccgccgcggggaggtacatttgctgcagcctcaacacgaccgtcgtcgagatcgcgcgtttcctggcacgcaagtacccgcagtacggcgtggaaacaaatttgtccaccgacgacgacgagcagctcctggagaagccgagagtgagcctgtcgtttgcaaagctggttggggaagggttcgagttcaagtacaagaccctagacgagatatacggtgacgtcgtacgtcgagtacggcaaggcactgggaattctgccctactgatatagcgtggatagtttgatgtgtagcccgttttgggatagtctattttgtcaatatctatatctattctacttctacatccatctaatattaaaagaaaaaaattatgtcgtctattt

SEQ ID NO: 26360 - DNA, 489 bp, Sorghum bicolor
  Clone ID: 30973791
atgagtcatgtctaccatgcaaattctttaattggcatacttttggacagtaaacatcaaagtgcatggacacacaatgggcttcagtgttaaacaaaaaagtagggatgcaagaggtttgtccccgagcccgcaaatgtcatttttaagcgggttttgaaaccgtcgtgtttcagaccttcgaagtgtatcttattgtaatctctgtaacttatatggatttgaaattcttgaaggaaaaaatttctatatgccactggctaggggtttctttggtatggctccaatagctgactccagctttgacttctgcagccataccaaacgcagtgtagaaaatggcttctctagcttgaggattatcgatgtaaaattatcttctatattttagtaccaagattttaggattgttgaagaaacttgacaactatactcctaaattttttagccatttgaaaaactcattgatttaccaattgttttttggaa

SEQ ID NO: 26361 - DNA, 621 bp, Sorghum bicolor
  unsure (1)..(621): unsure at all n locations
  Clone ID: 30973804
atccaaaatttntaatgcaccccttccatgccgcaatgcctacatgaggatgagatgcctgaaccactgcttgtatgttatgtcagtgtgattaattttgtcgcggaagctttgttatggaggcaagttgcaaaggcatctcgtcggcatgatttgataactaggaaattgaaaattggtgtgtaccaaaaggttagccatgacaataggtagctcaaagatctttcaatacctgaacatctcttgcgcaaaaaaagtacttgaactctacctgatatggtctatctttgcataatagctgttttcctttgagcgatactctgtcaatgagtcttctgaagtacgtaagaacatctactgatggcactcacacggtactcacacggtactgaaggtatagtgtataacatctactttttgtgacaactaatgtttctcaatgatttattattttagaaaaaaataaaaatcatcatccaatgtataacaagtttgtgcttaaattatccgggtattattcgttcccgttgcaacatgcggactatgataggattttaggtcatccgactcaaatgtcgaatgcttgctaattaattatcacccacaactattcaaactttc

SEQ ID NO: 26362 - DNA, 290 bp, Sorghum bicolor
  Clone ID: 30973809
ctgcttcacaagtacaaggcccggtcggaggacccgcagagccccccgacgtctccgggaaggggtcgggggcaggagctcggggacatgtacccggtggccgaccaccagcggctgcacaggcttgacccagagaggaagagggcggcttcgtccaccgccatggacattgacatcgctgatgccgatttttcgtttagcacgcggtgattttgaacgaattttgtgcagcatgtttggtatttatttactttggtatagggaaaaccatagatgaaaaatccaccacc

SEQ ID NO: 26363 - DNA, 560 bp, Sorghum bicolor
  Clone ID: 30973823
gaagcatccgccgcctcatccccggctcgcccacgatgctcgcgaccgcctcgccgcacctgcaggcggcggccgcgcgccgcctctctttagcggtgcccgtgaatcagggctgcagcagcgtccgcctcccgcgccgacggcccggccggtacgcgtcggtgcgcgcggcgtcggcgtcggcgtcggcttcggcttcggcggccgccccgccagcgaaggagggggcggaggacctggggttccaggagatgtcgtccgggacgcggcggcggtactacatgctcggtggcaaaggtggggtcgggaagacgagctgcgcggcgtcgctggccgtgcggttcgccaacaacggccacccgaccctcgtcgtctccaccgaccccgcgcactcgctcagcgattccttcgcacaggatttgagtggtgggacgctcgtgcaggtcgacggccctgattcacctctgtttgcgcttgagataaatcctgagaaggcccgcgaggagtttcggacagcaaatcaaaaaaatggagggactggggtaaaagatttcatggat

SEQ ID NO: 26364 - DNA, 574 bp, Sorghum bicolor
  Clone ID: 30973824
caaacccaggtgcaaatcccaccctccctccctggctccctccctcaccgccggcgccacctcctcacctgcgaggatgctgctcgtcagccaggccgcgaacggctccctctccgcgcggcggctgccgtcgaagccgccggggccctccaccaccaacccctacccgctcttcgccaaccctcgcctcgtgcgccgccgcctcgcgctctccggcactggcgccgaccaagccccgcgccgtcccacgtcgaccccggccgccgcgggcgagggcccctccggctcctcccccgcggcagccgccaccgaggacccggtcctcgtccgcgtcgccgacgacggcgtgccgctcgagggcgtcatccagattgagaagcccggggacgcgggcgccgagtccaagctcgtctcctacgcgaagctgggtcttctcgccggcggggacgtgttctgcttgctgctgttctccgcgattgggaggttcagccatggcctgcccgtcctcgacgccgagacgttcaagacggccgaccccttcattgctgggtggctgctgagcgcctacctcctt

SEQ ID NO: 26365 - DNA, 683 bp, Sorghum bicolor
  Clone ID: 30973826
agcatctttatttgcgagttctagtctttaagtcaaaagctaagcatagcagagtgtggcctctctcctgctgctgctcgccaattgatcgtccatggccgtccatcacccacacctgctcgacttctcgccacctccgaacacggtggccatggaggcgccgcccgcaccccacttcgaccatggtggccaccaccaccaccaccacctcctcgggctccatgtcgacggcggcgtcggcatgtccgtaggaggaggcgtgcctcaccgcgccctcgccgacgacgacacggtggcagcatgggcgccgcaggccgcggtctccctgtccttgtacaactacgacaacacggcgggaggttcgtcgtcgtcgctgttcggccatgacgagccacagttcggcgccatgcccccggcggcggcgttggcactgcctaaccaccagcagctgccgacgacgacgtcgagcatgcagcagccgttccagctcaggagctccaagtatctggcccccgtgcaggacctgctcagcgagttctgcagccttgaaggggacctgctgcacgccatgaacaagagagctccgagagcaggcaacaagtgggacgacgtggagacgtcgtcgtcttcctctggcctctgggggcacccgtccctgagctccatggatctcttggagcttg

SEQ ID NO: 26366 - DNA, 604 bp, Sorghum bicolor
  Clone ID: 30973845
cttctcctctctttcccttccccatagccagaatcatcgagtcttctccatccagatcgagctcctgtagttagagaacacggaacatcatgcctctccgttggccgctcctaatggaggcgacctgaacttcgggtatgtagctctagatctggaggtgcgcgcgcacacacacacacaccaagagatagatagagagagagagagagagagagcaatatggctggtgctatagtgagtgcttcgacgggtgtgataagtgccctgcttcccaagctctccatgttcatagagcaggagtacgagcttcagaaaggagtgaagagcaacatcgcctttctagtggctgagctgagcagcatgcacaccctgcttgtcgagctggccaacaacgaggagaggctggatgtgcagctcaaagattggaagaacaaggtgcgtgagctcagctatgatatcgaagactgcatcgaccgcttcatgcacaagatgagcaaagaagatgctggagtcaaccttctatagaagacaataagtatgattgaaaagatatgggcacgccacaagattgctaacctaattgatgaactcaaggctcgagtta

SEQ ID NO: 26367 - DNA, 403 bp, Sorghum bicolor
  Clone ID: 30973848
gcttttattgctgctccgttctttcttactatttcttcctcgtttgcttcgtccccgcggcgacaacgaacgatccaccagcgccacttccagccaagtcgtctactccgcgtgagcgcgtccacgcccccaatcccaatcccctctgctcgcggccgcccacgcttcctccgccgccgccggctcccgcgccatgatgaaggacaagatgaaggagttcatgaagaaggtcacttcctccgggtccgggaccgccgcctcctccttcaagggcacatcccacgtcctcggctccggatccggctcctccccctccccctcccaccccgctgcccgcccctcaaaccctagcccaaactccaggcctgttgcctctaagcggccgtcgccacctcctcccccg

SEQ ID NO: 26368 - DNA, 699 bp, Sorghum bicolor
  Clone ID: 30973855
aacgctaaaaaagtaacagtttctgtactttattgatccccccgcgcgttagctctttagcttcacacacacgatggcttcggaaggcaagatctccaagaacttcaagtccgccacccccgccggctccggccactgggaggaggcccgcgagtacggcttcaacaccggcctcgtgcacgctggtgtcctgccggaccccatcactggcgccgtgctgacccctatctaccagtcgacgacgtacatccaggagtccatcgacaagtacctcgctaagggcttctcgtacacccgctccgccaaccccaccgtgaaggccttcgaggagaaggttgccgccgtcgagaacggcgctggcgccaccgcgttcggcaccggtatggctgcgacctgcaccatcgtcgcctccttcatgtccgccggcgaccacgccgtcgtcaccaactgcagctatggtggcacgaaccgcgcgatgcgtgtcatgttcacccgcttcggcatgaccttcgacttcgtcgacttcactgacctgaagcagatcgaggccgccatcaagcccaacaccaagctgatcctgtccgagtcccccgccaaccccacgctcgtcctcgccgacctcgccgcgatctccaagctcgccaagtcccgcaacatcatccacgtctgcgactcgaccttcgcgacccccgtcatctg

SEQ ID NO: 26369 - DNA, 627 bp, Sorghum bicolor
  Clone ID: 30973897
aaaaaagccgttccaaactagttgctgccatacaaattttatcgctttagcctctccctagcaacttttgtgaacaaattaccaggcttccgccagtcgccggcagcatagacgaggtgtttggtggctggcggcaatgtcgccgtccgcgggcgaaaagaagaagatggcgtgcgtgaccggcggcaacgggtacatcgcctccgctctcatcaagatgctgctggagaacgggtacgccgtcaagacgactgtcaggaaccccgatgacatgtccaagaactcccacctcaagaacttgaaggcgctcggccatctggaggtcctccgcgccgacctggaccaagaaggcagcttcgacgaggccgtcgctggctgccactacgccttcctcgtcgccgctccggtgaacctcgcgtcagaggatccagaggtgagcaaacaccacgaatgataatccggactccggagttgatcgttcccatgccacgatcatcaatcagtacgtacttcgccggtggttatttttatttcagaaagatgtgatcgagcctgctgtccggggaacgctgaacgtgatgaggtcgtgcgcgagagccaggacgttgcggcgcgtgatcctgacct

SEQ ID NO: 26370 - DNA, 434 bp, Sorghum bicolor
  Clone ID: 30973901
gcgccggacgcagtctcaattcatcttcccgctgcgcgttcgccgccaccgccatgacttgcgccacccggcgccccggcttcctccgtgaggccgagctccgcctcctccgctgcaccctctccgccccgccctcgaccccgcctccacccgcttcccctccccctgcgcatccgctcggccccgccgccgcctccgcgctcgccgccgttgagaccggcgactacgaggctgtgctcgccgccgctgcgccgcacctcctcccggcctccgcctcctctgggcctcccggctccgccgcgcagttctacgccgaactaggtgccgccgctcgggcgttcctgctgggggatggggacgggggaacggcgggagcggggttcgagtgcaggtgcacggttgtgctctccgctgcggtggccgcgctgctcgcg

SEQ ID NO: 26371 - DNA, 628 bp, Sorghum bicolor
  Clone ID: 30973902
tcccctgcgcctctcggtcgatcaaacgcgcccaaccccccattcctccggcactcgaaatcggaagcgccccgccccgaaaccctaaccctacctttcctctcccgccaccgcccgccccaatggcgaagccggtgaagtacgacgacgaggaggagatctcgtcctccgccgaggaggaggaggaccagtccgacgccgccggctccggatctggcgaggaaggggaggtcgaggaggaggatgctgcggcggctcccgcggaggaggaagaggaggaagcttcgggcgaggggcagcaggaggaggaggaggacgacgagtccgtcccgagggacaaggacgacggcgacgagactgatgtagtggttgggaagcgtgagaaagcaaggctaaaagaactccagaagatgaagaagcagaaaatccaagaaatactagatactcaaaatgctgccattgatgctgacatgaacaataaagggaagggacggttgaaataccttcttcagcagacagaaatatttgctcactttgcaaaaggaagtcagtcaaacgagaaaaagccacgcgggaggggacgtcatgcatcaaagatgactgaagaagaggaagacgaagaatacct

SEQ ID NO: 26372 - DNA, 620 bp, Sorghum bicolor
  unsure (1)..(620): unsure at all n locations
  Clone ID: 30973914
ttctggcacgccgacaagccgctctaccagaactccgtcgccacgcgcctcgcgtccgccgtctccgcgccgccgtcccccgccgacggcgccgccttcctcgccgcctgcctcaccacgctccgccgcgagtgggcccacatcgacgtccaccgcctcgataagttctacctcctcaaccgccggttcctccaccacgccttcctgctcctcagcgccagttccttcgcccccgacgtcacctcccaggtcgtgtccgtcctgtcggataaggccctgctcccggaagccgataacgtggctgccggcacctccaggggcctcggataccatgtcgccgaggcgttccttgacgagctcttgcccgtgctccccgtcagcctggagacggtggacgcactgctggctccgttcttcactgtgttggagaagtcgacggatcgggtgatggtgagtaaggtgaaggctggcgtgtttgagaggttactggagagcggcagtcggttgcttgagatggtgaagaaaggggagganggtggagaagggtancgctgaggagaagctcgggaaaattggattgctatttggactcagcaagaggttcctggatattggtgcaa

SEQ ID NO: 26373 - DNA, 562 bp, Sorghum bicolor
  Clone ID: 30973918
gcgcaccaccacggcggtggagacgcgaggttcgtgcaggcgtacggcgacatggccggcctcggcggctacggcggcggcagcgtgtcgctgacgctgggcctgcagcactgcaacgacgccggcgccgtgcccgccgagcagcagggcggtctcctgtacggcaacgccggcgacttcgagttcatcaacggctccgccgaggacaggcagcggttcggctcgtcgcagctgctgcacgattttgtcgcgtgagcggctgcggtgcgccagcgcgcgcgtggggaataacgcggacggcgtcagaagcctgggatggccggccggcgccaccgcgtgggtatacgatggtcacagtttctcaggatacatggttccttttcaaatttcaaattaacgagtaagttcaagcatacatatatatacatatatactggcgtggtaagtgaggtagcagtggggaattaaggagggtatacaaaaactgtatatggtatatgaggtgtggtataaggtgtaggttattgttgtaaagaagattagattattggtacgtactatt

SEQ ID NO: 26374 - DNA, 197 bp, Sorghum bicolor
  Clone ID: 30973921
ctatttactgtatgggatacttgttaatggagaaccgctacttttcggtatttattactcctccggtatgggatagataactgcttagctggacagtttttgctgttaaaaacatgctccacgtttgtattttgtaagactggtttgtgaagaatttattagaaataattttgtcaaaagacatgccattttggttc

SEQ ID NO: 26375 - DNA, 510 bp, Sorghum bicolor
  Clone ID: 30973950
acccggcgctgctgcggcccggccggatggaccggaagattgagctcggctactgcaagggccccgcgctgcgcgtgctcgccaagaactacctcggagacggcgatttcgagctgactactaatggtggccacaggtacgaggagctggtcggagaggcagagaggttgctggaggaggtgcaattgacgccggccgacgtcgcggaggtgttcatgggcttcgacggcgacggtgacctcgccgcgctgcagaagctcgtcgacgatctcagcagcaagagagttgttcagaaatgtgccgcgagcgacgtgtgacgccatgtgcgcatgtgtggttcgcgttcgtagtcgctttcaggttgtcacctatcaaagtgctagatggaaaacgccatgagtagaagctttgacatatatggtagagagtaaatctggtgaaaaacttttaactattattggaaagttgcaccaattacgaacatataatatatctccactataatgaaaa

SEQ ID NO: 26376 - DNA, 300 bp, Sorghum bicolor
  Clone ID: 30973959
accatcatcaggtgtttcctgttaccagcgcttggaatttgttggtgatgctgtattggatcatctcattacgaagcacttattttttacttataccgacctacctccgggccgcttgactgacttgagagctgcagctgttaataatgagaactttgcaagggttgcagctaggcataagctgcatgtacatcttcgccatggatcatctgcattggagacacagattcgagagtttgtgaaggatgtccaggtggagcttttgaaaccaggtttcaattcttttgggccttggggatt

SEQ ID NO: 26377 - DNA, 607 bp, Sorghum bicolor
  Clone ID: 30973964
ctactgggatttgctttgctgcctcaaaaaaagtttccctccaaaaacctcgcgtcactttttctcacgctcctgactccagaggcagagggcgtgcgtggtgcgtgctggatgatgagccggcgtgacaggatgcagccgccgccgccggtaaccgcggtgctgctgctgcttctgcttctggccgccgcgccggcgacggggcagattgcgacgtcgtgcacggcgtcgctgataacgacgttcacgccgtgcctcaacttcgtgacggggagcaccaacggcggcggctcgccgacgcagcagtgctgcggctcgctggctgagatggtgcgcacgggcgccgactgcgcctgcctcatcctcaccggcaacgtgcccttcagcctccccatcaaccgcacgctcgccatctccctccccaagctctgcagctccacctccgtcccgctccagtgccgagacacggcgacgcaaatcccagctccaggacctgtcgcgttcgctcccgcgctgcctccactgccaccgattccaccggaatcgtcagactctccggtggatcctacggcgatgtctccggcggtggactcgccgcccttctctc

SEQ ID NO: 26378 - DNA, 531 bp, Sorghum bicolor
  Clone ID: 30973966
ggatgcgagcgactgcgagggagatcgaagtcgcgtcacacaccaagtccgccatggatacagacatacagtcaaaccactgcactgccagagaggaaggcttgagctttgcgagctacgacacatgaagacggtagctctgagctggagctccctgggctcgctcgtggccacggccatggtggtgcgcacggcggtgcgcgacgtgctcccgccggaggcgcacggcgcactgcaggcgctcctggcacgcgccacggccgccttcgcccagccgctcgacaccatcgtggtgcacgagacggacgccaacggcgtgcccaacgagctctacgacgcggcgcagctctacctcggcgtgcgctgcctcgcgtcggcaccggccctgtacctccacaaggtgcacggcgcgagtgacgtcgtggcgtcgctgccggacgaccacaccgcgtgggacaccttccgcggggtccgcgtcctgtgggcgtcgcggcgcgcggagtcgaacggcgcctactcctcgtccggctt

SEQ ID NO: 26379 - DNA, 495 bp, Sorghum bicolor
  Clone ID: 30973971
acgagcacggcccggcacgaggccgcccctgcctgcctgccagtgccagtgccggtccctccctctctcggctcggctggtgctggcctggatcctccacgcgacggacgccgcctgccccgcggctttagcgccccactcctgccccgcccgcggctctcgtctcgtcgtccagtggtggcggtggtggtggagtgcagatccgccatccgtacgtggattgcctttcgtctttgcccattgctgttggccagttggcgtggatttgagagctgcgtgtcggcatcatccgtggtttgattacttctccggcactcaagatcgagggaagtcgcagcaggacttgtttcggttcaactggacgaactcccgtgtcctgcgccaggaccgccactgatgagcccactcagatttaggatggtttctcattgctgagcttctccaggaaagactggaatttttgcgccgcgccaacctttaactgtatttcatgat

SEQ ID NO: 26380 - DNA, 522 bp, Sorghum bicolor
  Clone ID: 30973986
gattctgaatccttgggatcagctctgtctgtccccttgttaggtggtttctgttacagccaagaactcttcctctttctaagtctcagcttcagtttcttgcagaggtagatatcttaaaagctttggtgaccgtcttcgaggaagtgcagtcatctgaagtttatcgtcccagccagctgttatcgtggagccgcatacagtatctttgaagctttgataacaccaatctgattctgatgacaaaaacagtcactatctcccgccatccttgtaacgatctgtcagctggcctcatcttgtgcttctgaagacgatggccacattcttctccacttccacgaatcagagggacctcaccggaggcggcggcgacatgtcgttccaccactacacctactcagactcaccagccggcggcctcatgcctttccccgccaccatcgtgtcggaaggccacgtcgcgcatggcggtgacgacggcagggacgagccggccgcgttcgtgaacgtgaacgtaaa

SEQ ID NO: 26381 - DNA, 524 bp, Sorghum bicolor
  Clone ID: 30974006
ctggatccccccagccgccttgcctccattgcctccccactcctcccttctcttccctctcacctcctaaaacctcgcttccccggtcgcacctccagctcgtgcgtccgtgcgagcgcgcggtttccttgccaagaactgtcgcgcgggtcgggggattgaggaggacggtgggcggcggcggcggcggcggatttgtcgggcccgagattcccggacaaggcgaaatgaagtacgtccttgtcaccggcggggtggtgagcggcctgggcaagggcgtcacggccagcagcatcggcgtcatcctcaaggcgtgcggcctccgcattacgtccattaagatcgatccttaccttaacaccgatgctggaactatgtctccattcgaacatggtgaagtgttcgtgctggatgatggtggcgaggtggacttggatcttggtaactacgagaggtttctggacattaaacttactcgggacaataatataaccaccggaaagatctatcagtctgtaattgac

SEQ ID NO: 26382 - DNA, 515 bp, Sorghum bicolor
  Clone ID: 30974012
ctggatcgtagtcggggcattgaattgccggttcggcttaattaaccgccgggagctgcataaatacctggcacgcacagctctcaagttgcagctgcaatcaccataggagcaagagcaatcaccatgccttccccttcctcggcccactggctgagcctcgtcgggagcatctggctgcagaccatcaacgggcccaacgcggacttccccgtctactcgtcgcagctcaaggacctgaagcacatcacgcaggtgcagctcaacttcctggcgttcgcgtcggacgcgggcaagctcttcggatggttctccggggtggcggcgctgtacctgccgctgtggctcgtggccttcgtcggcgccgcgttcggcctcgtcggctacggggtccagtacctgttcctcgacagcgcggggctccggtactggcacctcttcctgctcacctccctggccgggaacggcatctgctggatcaacaccgtctgctacctcctctgcatccgcaactt

SEQ ID NO: 26383 - DNA, 507 bp, Sorghum bicolor
  Clone ID: 30974014
tgccatgtctcactcagtacttaacttgcagtagtactttaattgcaatcttacgcctaactcagctcatatctctcagcagcttcaattcttcccaaatttattcaacagacgtactgacagaagtaggcttcgcaagtcaaagcgcatgggttccaattccatggaaggactcccccgtaccgccgtccacttcttgctcctaattttctgcatagccagcaaatgtctagcagcatcaggtctgaattcaacccagatggtaaccctcaaggttgatgcctcaccaaagcttgctcgaaagatccctgatatattccttggggtgttttttgaggtgatgttgtttcttgctgtacaccaagttttatgcataatcggatcaatccaagtatacatgatcccctagctgtgttcttggcttcttgcaataactagccaggttatactgcaggagatgggcaacggaggagctggtggaatatgggcagaactggtcagtaacag

SEQ ID NO: 26384 - DNA, 311 bp, Sorghum bicolor
  Clone ID: 30974050
tcaggagacactggcgaagctggtcaggtacaggagtaagttttgagatgagatgatgtccaagaccctcgcatgctccttgtataatgtgacatccctttgctttaatacaaagggttcagaagttatcccgccctttttttttttttttgaatctggcaataccactagctacagttttgttagggatcatcagtatattagccgaggtccatgatgccatgtgtaacttattttagcgcaggttggggcccatgtgtaagtggaggtgttatgtacagtacagtccatttgctatttggtagaccttc

SEQ ID NO: 26385 - DNA, 606 bp, Sorghum bicolor
  Clone ID: 30974057
gtcgccgggctcaggtcgctctttgccacgggcacctatagaaagtggtggttccctgatcgcgtcctcagagactatatcaagctgatgatttttaaccgtaaggaaagggcgcagctgcttgaacgcttggtgatcagcgacgaagacgcagctgttgtcgtcccttgttttcggcaggtacgacatatacaagtactctactagtccctactgcatgatacgtgcagagaagttttgatatttaagctgcgtctctattcatttaatatctaattcatacgtctttagaaatttaaccctgaagatgcgaattggataccaaatatagagatgtgcacatttattgatggttaaatatcaaaatttctcgtgcatgcatgtagggttcagatttagaaaatctcagtttggcccagaagtcgtgcatcactgaagtcgtgcactgtctaataagcagcaaagggagatctcaacgaaaaagacgaccagcaggtcgtcccagtccctgcgcgaagacgccatattctctcttttcttttttttcctcctgctttaaatatttgcatgcaaaacttcttttgtttatctctttttttaagagca

SEQ ID NO: 26386 - DNA, 535 bp, Sorghum bicolor
  unsure (1)..(535): unsure at all n locations
  Clone ID: 30974067
aagttccaatgccaacattctggttaagattctgctccctcatattttcaccggctgctttgtttcttttcttctcttganatcgttgttgttactcacgattcattgcgcgtagttcctctttgttctgatcaatggccatcaatactacatatgcagaacccaattgaacctaataaaaaaatgaatttgaatttaagaaatgcttattttgactgacctttaatgaattcatggatgaggatggatatcaaatggtggtccacaaagattgtcagtagaggactccacaaagatcggtagaagaggaccaaccgaatctataatattgtacaggatagaagaggaccaacacaatctgtaatataggaagcagatgtagttcggttgaagaggacaccaactcaatctgtaatattgcatagaaagcagatatacgtgcacgtgagactgaacctgtgggattgcttgaattatgagtgaggattgtacgtgtgcatatatgggattgcttgaaatatatgtgcgaggatgt

SEQ ID NO: 26387 - DNA, 166 bp, Sorghum bicolor
  Clone ID: 30974074
ttttcctattgatactttgtttcccccttgggtttgtccccgcaactgttatcgctgtaaaaaagttactgcttgtgcggggtagacattttttgagaggggtttttcaaatttgcagggtaactatattatcggatttaatgttagttatccatttttttttttt

SEQ ID NO: 26388 - DNA, 651 bp, Sorghum bicolor
  Clone ID: 30974083
ggaggtcaagaagctccgtgcagccaatcagcagctcctgaggcggctgcagggccatgcagctctggaggcggaggtggcgaggctcaggagcctcctgctcgatgtccggggcaagatcgacgcagaggtcggcgtgttcccgtttcagaggccgtgcagtgtgggctctgtggcgtgtgctgatccagctctgtgcttcaatggcaactcggaggtaggaggctgctgggaggagagctcaagaccagcagttgcggatgtttcagaaggtttgcgtaattccatggatgttgttgcaagcttcgtgagttctgatcctctcgctgaatgagcaagtttgcctgattggcagttttggggcctctaccagcttctttgggcttgcttgaaagatcatttttttttcatggaattaaaaagaatgaggattgataatcagtataactatcttcgctgtggtttatgcttcttgtgctggtgttcagtgtgtatataggggtacagaacacttacatatgagcactgaagaaatcaaaaatgcaaaattgtactgcaggtatgtcaatgaacaatgaagtgcacttgacttctgatttggagtttgtttgtacttagctgaaattatattaaactattaatacaaaatgc

SEQ ID NO: 26389 - DNA, 570 bp, Sorghum bicolor
  Clone ID: 30974101
gccccaaccactaccaggatggtggcccacgaggcgctgccccttcaaagcgcaacatctcgaagagttcccacaggagcaagccagacgtcaccccaaggatgccaacagccaagatccccaagcacaaaggagggtacgtagcaccgttgccagctgtgaacctccctgaggagcagcagtggccaaggaaagggatgtacgaggttgacagcgaggagaccgaggaagagggggacaacaatgtcgaagatagatggaactacaacagggctgttagcagcgacgacgaggaaaccgaagacgaagaatgagctgctagcaggcattcgttgtactgtagttgtgcaatgtgcatatataccataatttttaaactttgggggggttatagcttttgcatacatgtacaattttaaaataaggctagcttatagtagacaacagaggtagctggcctgccccttcttctttagtagacatgccacgaattgagaaaagataatggatcgttgttccggtacgcttgtgtttgtgtctgagccttttggtttgttatcacaaatgagt

SEQ ID NO: 26390 - DNA, 249 bp, Sorghum bicolor
  Clone ID: 30974109
tcgcaattaactgatatggatttcaccttttgagagaaggaatcagcagttacaactcgccggcttctcctccaattgtaccaatgaggtgtatttaccctgtcggctctgtattgtgctgtcatctttgctccattgctccttgtagtagccaataaaagcaggagcgtttcttgtggcagcttgcctgttgtgttagtaggttggtcgatcagagtagaattaagtatgtatgttattttggcggta

SEQ ID NO: 26391 - DNA, 530 bp, Sorghum bicolor
  unsure (1)..(530): unsure at all n locations
  Clone ID: 30974117
ccaacgaaatctcccgtccccaaatcgaccgagcgaattcaccacagcctcaccgtcggcttctccgccgacctcggccgactcttcggcgacgacgtcaccccgggctcaacgcgcctcggcgccatctgcgtctacctcgcctgcggggtgcagttcggctgggcgctgcagctgtcgttgctgaccccgtacgtgcaggagctgggcatcccgcacgccttcgccagcctcgtctggctgtgcggcccgctgtcgggcctcctcgtccagcccctcgtcggccacctctccgaccgcctcgcccccgccgcctcgccgctcgggcgccgcaggcccttcatcgccgccggcgccgcgtccatcgccgcagccgtgctcaccgtcggcttctccgccgacctcacagagaacgacccaaggaggactcggatcgctaatgcatacttttcactcttcatggncctgggaaacatacttggatatgccaccggagcatacagtggatggtattcgatatttcctttcac

SEQ ID NO: 26392 - DNA, 542 bp, Sorghum bicolor
  Clone ID: 30974123
ggcggtcaccaccatgcccaatcctatcgcaccaaggaggactccgcctcgtgctcctcctagtcttccccttcctacccacccctccacgctcccctttccttccacggtccccaatccctagccctgcccctctcctccgctgccgcccgccggctctctgccctcgccgcgcccggagatgcaggtcgcacgccgccgttaccgctgggtgaaggagtgggtcccgcaagatctggtcgtcgccggaggcccctgcacgctctacaagtgggtgcgagaggatagactggccgctttgaaggctaaggacaaggagcagggagcagagtctgcaacgcctgaaccgaactccgaggttctgttcctgtgcagctacgaaggatgtgggaagacattttttgatgcaggggctcttaggaagcatgctcatgttcatggggagaggcaatatatctgtcactatgagaactgtggcaagaaattcttagatagctctaagttgaagaggcattttcttattcatacaggagaaaagaatt

SEQ ID NO: 26393 - DNA, 503 bp, Sorghum bicolor
  Clone ID: 30974141
ctggctgccgtccgttcctgtgctgttcttcacttgaaccatcatgggaaccatcctcgcctgcttctgatgtgcctggattcttgaaagcccgctcgctgccgcccccaggaagggaaggaaatgaggtgcgccagatcgtgcggcactttccagcaagcttccgaagctttgtgattcggtggtagccaagccatggaggacgacgaccgaaaagcgccgagctttcttgatgtgcccaaggatattcccattgccaccaccaagcccctcaccatccggaccagcgccgccgccgcgtccggatgcggcggcggctccgaccggtcctgccccatatcaccggccatctccatcacgccgcacctctactcgccgtcgccgccgtcgtccgccttcgtctccgcgctgcagtccccgtacatctcgcctcgggttctcgacccgccgcctcctccttcgccggcggcgccggagccggagcctcagcggcggcaggaaac

SEQ ID NO: 26394 - DNA, 497 bp, Sorghum bicolor
  Clone ID: 30974144
gatctccaatccaactccgacgattcctgccgtgccgtctgttcgcacgtcgtccggccggttttcgtcgtcgcgcggcgtctcgatcgcagcagcaaggttctttcagttcgtcgcatgttatactgcgaaccgccagcaggctgccatcatcagccaacggcgtcgtcgtctgcggcgcatgggcggcgtgctcggcgcgttgctccaccggcggtctggcggaagaccgccggcgcagggcacgaggaaccagcaccggggactcacccgggagccttccacctacgacgccaccgccgccgcagccggcggtcatcggaaggccatgctgtccaagaagtactcctacataccggacacctacacgtcgcttgatcaggtggcggcggcgctgcgggagcagggtctggagtcgtcgaacctgatcctaggcatcgatttcaccaagagcaacgagtggacagggaagcagtcgttcggcgggcagagcctgc

SEQ ID NO: 26395 - DNA, 389 bp, Sorghum bicolor
  unsure (1)..(389): unsure at all n locations
  Clone ID: 30974149
gattccctcaggactcacgcgctcttcaatcgctcgccccccgtttcttcctcccctcgccttccttccttttccttccatgttcgatccagcgctgtctgtcgtcttcgcccgcccccaaagcagctccgaccttttccccactttcccttggcgtccacggccttgtccggtgtagaaaacaacggacttcgttgtgttgctttgctgcggntcttggccgctcctgcaagctcaatccctgctccatctcttaagagcgcccccctctctcctcccactcgncgaagctttgttgttcgctttggattccgcggntacgaaaggctcggctcctgggttgggaaggcgcccccttttccaggcgaggaatttggtgcgggttgatg

SEQ ID NO: 26396 - DNA, 575 bp, Sorghum bicolor
  Clone ID: 30974150
gagtctagaactagaaaggtgctcatcgatcttgcaggatggtgaacttagtacacgtagccatgcaacagctggtgcaccgcctggcgaagatggccggactgtgggcgcgcaccgtcgacgtcgatgatgccggcacggtcatcagtatctgggtacccaaggataagctattacgtgcccccgccgctgaggagacggagacggagaggaggaaaaaggaagagaagcccgacgccgacggcggcaggctctccgtcgtgctcctgcacggcttcgccggtgatgggattctgacgtgggtccttcaggttggcgcactggcgaggcactacgacgtgtacgtcccggacctgctcttcttcggtggctcgacgtcgccggcgggcggccgggacctgtcgccagggttccaggcggagtgcgtggcggccgcgctgcggatgctcggcgtggagcggtgcgtcgccgtcgggttcagctacggcggcttcgtggcgttcaagatggccgaggcggacccgggtctggtcgtgtccgtcgtcgccacggggtcgctcgtggacatgagccgc

SEQ ID NO: 26397 - DNA, 215 bp, Sorghum bicolor
  Clone ID: 30974157
ctactggaaattcttgcctactgctgttcctgatactgttcgtgttcgggaggagcacttgtcaattactgtcaaatcccccttcgccgcttcctcgagaccccaatttttgttgcgtaaaaaacccgcagtgatccgcccaactcccaactaacccaccggattggagcgcgcatggtcgatcgccgcggccgctgctgagctgcgggctgcgg

SEQ ID NO: 26398 - DNA, 453 bp, Sorghum bicolor
  Clone ID: 30974160
ctggatcacgaaggtcctaaggactcggcgactcgcgaggttgcgccgccggctgtctcttccggaactccactgctccatctccgcccctcgccgccgtctgtcccctcttgacctcggctgctccatatctaccactcgcagttgcagaccaggatggctattgctacttgaagtgagagggtttgtgcaagcacgggacctgctgctgcctctacaccggttggcacaggtcaatcatcggtccctcaatcaacaacatcaagtctctaatcgttgcgatagcaaaaggcaggaccttcaccagggaaccttttagcatgacagaattcataattgggcacattttttaacacaagatgatttccaggaatgcctcgatatacaaagacataaggatcaggttcttttgccactgaattgggtctcatatggtactcatagcgaatatct

SEQ ID NO: 26399 - DNA, 530 bp, Sorghum bicolor
  Clone ID: 30974172
cttgactatgcagccgcgtacttgactatgcagccgcgtttccggggagagaaatggccgccatctccaagtgcctctctcggtggagcaagggagtccagtgaagaacccgctgtaccagaagcctctgtcgcccaatgaggcaaatccgatgaagtcgtgccccagtaaagaggtggggaacttcaaggagaagctggttgaagaaaatttctacctaatcactgagctaagtgaacaacgacgagtacctgtacttctgctgaaacttaacgaccctattcctaaaagaaaaccagctattgtattcttgcacagctcttacaaatgcaaagaatggttgcgcccgctgcttgaggcatatgcctccaggggttacatttgtgttgctattgactctcgctatcatggtgaaagggccagcaatgaaaccacttatatagatgcactgaaatcggcttggtggaatggggatacgatgccttttatttttgacacggtgtgggacttgataaagcttggagaccacc

SEQ ID NO: 26400 - DNA, 624 bp, Sorghum bicolor
  Clone ID: 30974179
gatcgtccgtcgcctctccctccgtccgtctcctccacccccacaactcatccaatcacgtcctcctcctcctcctcctccacacctccctttccacgattctcccctcctccaatcgccgctaaaacgcaaagcactggatcggacgtcaccaaacaaaaagatcggtggcgagacgagacgagaaagaaagaaaggagccgagagaaaaggcgaaaaggggaggtagaaactaaaaagttggttttctccccgctagaggcagaggtagctagctcggcggcggtgagggagcgagagagacctgtcgcctgccctaccgtcgattccatatcgtctccccccgaggttctgatgccggaatcctgcttttccggctagtttgtttaccgataccgcctgggacgggtggtttccagcagtcctcagctcactcttccaacctctaccatcttgtgaatttgtctttcacccaattcggccggcagctcgccatctcttgcaggagtttgcttgctgtcctgtccgttctcgagtgcatgctcccgggttctactgttgttcagtggtgaggtctgctgccctgccctgccctgcacctgcaagttagtttcatctgtgatc

SEQ ID NO: 26401 - DNA, 537 bp, Sorghum bicolor
  Clone ID: 30974198
cgcgcgggagcatgccgtcgtactgggtgttcatgcactacgcgtcgccctacaagtacgcgctggacgcgctgctggcgaacgagtacacgtgcgccgcgaaccggtgcttcggcggcgtggtcggcggcggcggcgccgccgacggcagcgagtgtttggagactgggcgcgacgttctggtggagaaggggctcacggcagaggagcggtggaccggcgtgcaggttctgttcggcttcttccttctgtaccgggtgctttactgggtggtgctcagccggcgagcgtccagggctaagagatgagaattgagaagatgaggtctcagcggccgccggccggcaaacatcggttgcgcttgcctgactgtacgtgcgtgtgaacacgtgcatgtacgcatgcaaacaagtttagccagcagaggtatgtcaaattgccaactttggagaaggccatgaagaaaggtgatattaactagtatgtaataattacgctgtcatatactgatgtaaattgtgaagataaaactccttt

SEQ ID NO: 26402 - DNA, 597 bp, Sorghum bicolor
  Clone ID: 30974207
cctccagctacattcatcaataggactgccactagggatatcaagctgggtaaactagacatcccggctggcacacggcttgacttccctattattgccatccatcatgaccatgatgtctggggcaccgatgcagaggagtttaatccatcaaggtttgcagatggcaagagctatcacctaggtgcttacttcccctttgggattggtcctacaatctgcgttggccagaatcttgcaatggttgaggccaaggtggcacttgcaatgacccttcagcggtttgcatttactgtttcgccatcttatgctcatgcaccgatgcagatgttaaccctccaaccccagttcggcgctcaagttcttgtccggaagatatgagctttctacgtgataactaataaggtcataaaggcttctatatctttgtgagtagtctgaagaagccacgaggcctataattttttcaatcctgtttatgaaagacttgtatatagacttgttctctacagtaatccgccacttgggccaaagtgacatgtgttgtacaaaaaccacatctaagaacctgcatgaatctaccacaaatacgatttt

SEQ ID NO: 26403 - DNA, 573 bp, Sorghum bicolor
  Clone ID: 30974217
ttgggctgacagtacattcgttgcaattccggacttacaacagcaggtgcccatgtgccctgtcctcagcctgaaggaacctaacatggtttccttcttcttcagtgacattggctatgtggatggccatgtcgcgaccaaaggcgagtatgtgctcagtctgaatatgaagagtaagaagatccagtcatggagcatatgcccaccagggagaagcctagagttcattccacgtgtcatcgcaactgacttctgtgcttacaaacattggtcctgcatggattatcagggaaatgtaacaagcagcaagcgcgaaggagcatgccacagcagttcaagagcacctcgcaagcagaagaagtagctgccccacgatgcccttcagcttatatgccttggtcatgcccacatgtgttgtgtgtttcttcccctgacaaacatgttcattgtcgcctgtctttccttaataccagttttcttggatgtgttaatccgtgatgtgaaaaaggaaggcatgccgttatggtcccacacgataccatgtcctttggacgacgttatcttttgcaaaga

SEQ ID NO: 26404 - DNA, 623 bp, Sorghum bicolor
  Clone ID: 30974230
agcacatgtacaagacattgatggatcgtctttttttttttcacactgctgggctgcctggacgcccatgcatgccacagctgttcacggtcggcgctctccatgcatgcatgatgcccccggctccatactgactggtccgccccgtacccgcatgaaacatatctgcatatgcatacacatctcgtctcaggaaaaccttgattcattctactaatcccatgtggacgtttaatagattgttggattagttgaagatctacatgaaccaccagaacctcctcacctccatttgcttagcggatttaataaatctataagcagacctgtagcctgtttgatcctcgcctactatttttagctgataactagtattaatctattggattttttttttgtgttagcacatcatcgtcgagggtgattcatggaacgagtcttggtttctcagccagtctctacagcattttaattcacaaaacgactacatcagtttataagtagatttttattttcgcaaaaggacaacaggcacaacagcaacatccaaaacgcacacaaactcacaaacgcacaagccgaaacagtaaccaaaccagaacgacacctccaagagcctgccg

SEQ ID NO: 26405 - DNA, 372 bp, Sorghum bicolor
  Clone ID: 30974241
aagatagagtggatgaaatgccctcagatgagcattagactcgagccagtttgctcgacattccttttttttccgttcagcaaaacactgggattttccctttcccaatgtttccagtgttaatgatattatgttgtgtaatgctttagatcttatgttgtgtaatgctttagtgcagagtgcagataggataaaatccaaggactagtggtactttttagcagcagtagttgggcattagtccgtcgggagcaatttttggaaacctgtatacaagaaatgtatattttgctaacatggtgttggttgggtgtgtagactgtagaccgttattcatttatttatgcgtatatggtcgagtaatttgccgtc

SEQ ID NO: 26406 - DNA, 719 bp, Sorghum bicolor
  Clone ID: 30974248
acgagcccgagggagccccacccactacggacctcctcctcctcctcctcctccccctagcagcgccagccagccatcgctagcttcgcccagcctgccagccaccaataagaccccggcgcccggcatctcttggctcgtgatccacgcccccagccccaggcagcagcagtcagacgaggacctagctcttcttccacctctcgatcggtcggcagacagacgagggggacggacacagaagtggccgcgatccggctgccggctcgtgcccggcctcctgctttcagttccagctttggcgcgcggcgtggacgaggacgatgtgtgaccttgacatggcgatgcgggtggagaacgacgggcgcccccatcaaggtacgcccgtgtccgtgccctccttcctcgtctcgcttcggcgaccgtccccttttgccctgcccgcttccggttttttgccttttcctcgcttctgctgctgctgctgcttctgctgtgcttgtgcatctgcatgccccggccggccgtgtcgtcgtcccgtcagatcaccgcacagttcgcgtgcatgattgtgcgccgctacgcgctagcagagagcgcggggtcggcacgggcggggcctccttttgaccgcgggcttccggcaaccggcatccggcatggaggaatcgcgctcgtgcgtgcatcacgtcggtccctttgctgttgtcgtctcggcg

SEQ ID NO: 26407 - DNA, 640 bp, Sorghum bicolor
  unsure (1)..(640): unsure at all n locations
  Clone ID: 30974262
taacaccggagtgggtgctgtattgcttcaagagggccatccattggcatatatcaataaacctttgggcatcaagacacaaggtctttcaacatatgagaaagaatatcttgcaattctcatcgccgttgagcagtggcgctcctacttacaattggcagaatttgtcacctatactgatcaaaaagcgctagtccacctcaatgatcagcgcctcaatactgtctggcaataacgggtattctccaagctcttggggctcacctacagagtggtgtataaaaaaggaagcgacaatagcgctgctgattctctttcacgccgtcagcatcccgttgnatagttgttgtgccatttctgtcgtcacccctcaatggtgcactgacatagtgcagggttacagtacagatagtcnagccaagaagttgcttgctaaactggcaactaatgctgctgctgttcctcacttcgagttagttgatggacttttaaagttcaacaacgcatctgggttggcaacaatacttccatgcagcaacagatcattcagtccctgcatagctccccctctgggtggacactcngggcgttctggccacgctgaagcgcatccaagtgttgttcgcttggccaggactcc

SEQ ID NO: 26408 - DNA, 738 bp, Sorghum bicolor
  unsure (1)..(738): unsure at all n locations
  Clone ID: 30974271
atccgcagccctagcaaatcgaccccgcttcgtcttccccttcctctccccatccccatcgccatccccacccttccctcccggccgccacggtgcgcgcccacctccttccgttccggctggaggccactccaggattctctccactggtcggggaagcagccgtggatccgaacctgggctgatttctccccgtgctctcgtggtcgtcggaatcatggctgatggnnggtattgtggtagccatttgccaatatggtggagaattcacttctggccccaatggtaatttgacatacaaaggaggcgaggcgcatgctgttgatgtttctcgtgatatgccactggagagcttcaaggatgaggtgtccaaggtgttccatgttgatgtcactgacatgtcattgaagtacttccttccgaataattacagaacactcatcactatatcatgtgatcgagatttacaaaggatggttgattttactatcagtgctgcacaagtggaagtcttcttgattagtagagtagaaaancaggagtgttgttacttactctggagcttctgcaattaagcctggctctaatgctcctggtgacaaaaggaaaaagccaccttcaaaaaacaaggtatccaaaagtaacaagaagactccgactcccagtgctcctggcacttcagtccaacctagtgccagtaatgtgaaacagccaagaccaattgttactgataatgat

SEQ ID NO: 26409 - DNA, 660 bp, Sorghum bicolor
  Clone ID: 30974272
gtgccaggtcttcctcggtcctcctcctcctccagctcactctccagtgtccactccactgccatcccatcctcctcctccaaagttgcagacttgcagtgctcgacgacggagagagtagcgtggcgtgggcggcggcgccatgaagtacagcaaggaagataagcccgagagggcgggaggcgccggcgcagggtccagggcggtgccggtgacgctcgtcgtcatcgtgctctgcgccttctccttctacctcggcggcatctacagcacggggcggagcctcctggacgccgtccagccggcgccaacgactctggtcaccctcggcggcggcggcaccaccaccacaacgacccgtcgttcctccgacaacgaccaagcacggccggcactggccgccgtggcgttccccgagtgccccgccgacctgcaggactacaccccctgcaccgaccccaagcgctggcggcggtacggcaactaccgcctgagcttcatggagcggcactgcccgccgccgcccgaccggcagcagtgcctggtgccgccgcccaaggggtacaagccgcccatccggtggcccaagagcaaggaccactgctggtaccggaacgtcccctacgactggatcaacagccagaagtccaaccagcactg

SEQ ID NO: 26410 - DNA, 527 bp, Sorghum bicolor
  Clone ID: 30974275
tggtcgccaaaaattcagtgcagtacgtctggctgcagtcgcgcaagatctcgactcccttgatctgttgatgggtccggcgaatctggagcgtccgctctcgggatgaacggcttgcatgcattgcagggccgccgccgtggtcacgggtcggaatcccacgcgcgcccggggtcgtccaaccgtccaagccgtgcgcgggagtagagtacattacacacatcttcctctggcacactccctctcgagctccttcgcttcaccacaatggcaaccaccactactactgtcacggaagaaccgaacaatgccgacgacgacgcatcatcgcctccatctccgacgacgtctccaccacccaacaacaagaagaaggtcacgtacgagctcgccgcgcggaacatctactacgccaagccagccgccgccgcccccgcgccgcggtcgctcgtcgcgcatctcctgaagccgtgcggcgcgtccccggcgccgccggactacatcctccgcgacgtgtccctgacggc

SEQ ID NO: 26411 - DNA, 608 bp, Sorghum bicolor
  Clone ID: 30974276
gtcagttggttcgctcgttcccgcgcgcgcatcctcccgtaacgctgtctccgccgcgcgactgcgcgagcgcgtccggcggcggcggaggctgggctgtggtgcggacaggaagtagcagcagcatgccagcatgtcgctagatatcctctccggcaagttcgtgttctcttcgtgcgccgccgcaaagcccccgagcaagaaaatggtcacgtttctcgctgccggtgtttcgccgtcgacgccgtcgaggtcaacgtcatccaatgccccatctcttcggccgcggcgcgtacggaccgtgccgtcgagccccaccaagcagcccccccgacctgccgtcagcagcaccagcggcaccgcgaagaggcgggtgcggaggaggaaggtcgaggaagaagagaaaggttaggaaggaggtggaggaggggggcgaatgcgtgccgtcgatggaggaggcgcccatcagcgtggcgacgctgtaccagaacggcgacccgctggggcggaacgagctcggccggtggcgtggtggagtggctcaggcagggcatgcggtccatggcgtccaagctcgccgcggccgaaatggcaggcgacctcgttcc

SEQ ID NO: 26412 - DNA, 616 bp, Sorghum bicolor
  unsure (1)..(616): unsure at all n locations
  Clone ID: 30974287
accaagaattccacagatttcaacagatgatgggctcgccctccggccggcgcactcgcccgtgtctagcgcgtcgcaccgccgaggacggcggcccgatttgccctccttatttaggcaccgtcttttgtccccgtcccagccgaaccaaggcgcaatgagctcccccgtggtgcgccgcgcactcctcctgtcactcatctgcgccggagcgctcggtttcttgccctgctcccatggcgccgcggtggcgcccggctacgtcaccgtctccgctgccagattcaggccgtcctcaacgtgcagctccctcgacccagttgcgcagcggcggcggaacggcacgtccgccgtgttgcggctgacgcacaagcacgggccgtgcngccccctcgcgggcgtcctccctgggnaccccgtcggtcgctgacacgctgcgcgcggaccagcgccgggcggagtacatactgcgnaggggtgtcggggcgcggcacgcctcagctgtgggactccaaggccgaggcggcgacggcgacggtgccgtgcgaactgggggttcaacatcggcacgctcaattacgtggtgacggtgagcctcggcacgccgggcgtggcg

SEQ ID NO: 26413 - DNA, 625 bp, Sorghum bicolor
  Clone ID: 30974290
ccccgttgcaagcaccgaagtctgtaaagtaacaggagtagcagtagcactagcaagcaatggcggccctctcttccgctctcctcttcgccgcgctcctcgcggccgcccagtacgtgctcggcttgctccactcctccctgtgggtcccgctccgcctggaacgccgcttgcggcggcagggaatccggtggccaccgcgcagcctgctctccggcaacgcagccgactaccgcgacttgctagccgccgccaggtccgcgcccctcccgtccttccgccacgacggcgtcgtcgctcgcgccacgccgcagtacgcggtctggccggcgcggtacgggcggccgttcgtgtactggttcggcccccggccgcggctggtgatctccgatccggagctcgtgaaggccgccatgaccgactccacgggggcctttgataaggcgggcgccggcggcaacaacccactcgccaggcagctcattggcgaggggctcactgggctctctggggagacgtgggcgcgccaccgacgcgtgatttcgccggcgttcaacatggagagggtgaaggcttggataccagaaatagcagctaccacctcatctgttcttgataaatggga

SEQ ID NO: 26414 - DNA, 614 bp, Sorghum bicolor
  unsure (1)..(614): unsure at all n locations
  Clone ID: 30974292
tcccttcatcctctccttctccacctcgtcgtatcttctgcgtgccgaatgcctccacctcgtgctcccaagctaccggcggcagtggtgctggtgcagcatccaggggcagggaaagcatagggttcaatcggagtatcgggcgcgaccctgcccgccgctgcctcctcccaccaccgtccgccccacggtcgccgacgagtccgagtccgagtccgcggccttctcttatgaatcggagtcctagggtcctactccagatcacctcgctatatattttgcgagccggggcttcatcgattcatcttattttgtgcacatcgcgtctccggaggaatctgtagcgccgcctcttgtagtcctagcgcagcggctgtagcgcctcttgcagcggaagaatcaaaatggaggaccatcttatgcgcagaacgaaaagactgaagcgttgccatgagaagcctgtctgcagacagaggggtgcaccaatccagttttcggaccttcctgtggatgtgctangcacgattctgtcaaaattgccaccaaaggaaatggtaagaactagtgttttatcaaatgagtggaaacatatctggacagtttgccccaaactc

SEQ ID NO: 26415 - DNA, 432 bp, Sorghum bicolor
  Clone ID: 30974317
gccctctgcattgttttttcatgtctcctcctggccggcgtgccctcctcgcttgtggtggcgcaggacccgtcaaagctgagcctgaagcactactccaaaacctgccccaacgtggagcacgtcgtccggacggaaatggagtgcgcggtgcgtgctgacacgcgcaacgccgcgctcatgcttcgcctccatttccatgactgcttcgtgcagggctgcaacggatcagtgctgctcgacaacacggcaaccttgatcggaaagaagcaggcaaagcaaaacgtcaactcgctgaaaggtttcaagctggtcgacaaaatcaaggagaagctggaagctgagtgccctgaaaccgtttcctgcgcaaacctgctggcgattgcagctagggacgccgttgtgctggttggtgggccttactgggatgtc

SEQ ID NO: 26416 - DNA, 717 bp, Sorghum bicolor
  Clone ID: 30974322
gttctctgcctccgtccactcccgacgccgtgcctccatggccaccgccacggcgaccccgccgcaatgctggcgagggctccccgcctcggcgcgggcacctccacctctctcctctcccctcaggccgcgccccgtagccgctaacttctatcccctcaggcgccgcatcgccactgctacagccagaggaaggcgagccgcactggcctgctcccccaggtgtacgctggagacggccggcccgggcttcgaccctctggggctgtacgaggaggggtctgattctccgtcgcggtctcccctgtctaacttcttcggtatcctggcgccggtgtttgggagctccagcggcgggggtgccaggagggagaaggcgtcctatggccgaggagcagcagctgcaattgaggatagctccattgacattggtgacttcttcaagggccctctacctgggaagttcctgaagctccttggatttttggccttgtctaggcttggtgtgtatataccactgggtggggtcaaccgagaagcttttgctgggaaccttgaccagaacagcctgctgggcactttagattctttctctggtggaggtatcggccggcttggaatttgctcccttggcattgtaccatttatcaatgcacagattgtgtgtcaactccttgcgcaactctacccaaaattgcaagaccttcaacggaaaga

SEQ ID NO: 26417 - DNA, 573 bp, Sorghum bicolor
  Clone ID: 30974333
ggggagttcggagaggccaggcgtggagggattgggaggggaggaggcgtgagcgcgaggaaagtgaagagagagttgcttccggtctcgattaccccggttgccgaatcgagaatccaattcggttccatccaaggcctcagatcggattcctacccccaattcgggccgctcgctttccccataccgatcggctttggggattttcttttctgagcgatttttctggggccccgatcggatcgggctgagttgtgttgatcgcggagcgatgcgaatcgaggagcttccgggcgatccgtgtggaggacgaggtggagagggcggggaggatgagctgctgctgccgcgtcgcgaggatggcgacgcggcggagggcgagaggggagtggtgatgcgggtggccgtcgacgcgaagcgcgcggcggtgggtgtcggcgcccggatgcttttctatccgacgctggtgtacaacgtcgtgaggaatcggttcgaggagcacttccactggtgggatcagatcgatgagcatgtcctgctgggtgctgttccattccctagcgatgttctccg

SEQ ID NO: 26418 - DNA, 574 bp, Sorghum bicolor
  Clone ID: 30974334
gagtcaagtggcagtggtgatagtgaggttcagcgcaccatgcttgagcttctaaaccaacttgatggttttgaagcaacgaacaagattaaggttctcatggcaacaaacaggatagacattttggatcaagccctcctgaggcctggacgtattgacaggaaaattgaatttccaaatccaagtgaaactttccgctttgatattttgaagattcattcaagaagaatgaacttgatgcgcggcattgatctgaagaagatagctacgaagatgaatggagcctctggggcagagctgaaggctatttgcacagaagcaggaatgtttgcccttcgggaaagaagggtgcacgtcacccaggaggatttcgagatggcagtggcaaaggtgatgaagaaggatacagagaagaacatgtctctgcggaagctctggaagtgaggggctcgtgtctctgcgccaggcttacactgccatgtccaaacagctgaagccccggctgcgcgttgccggattttctgttagactctggaaaaacatttctggagctcggaagctgaaacttaacaat

SEQ ID NO: 26419 - DNA, 652 bp, Sorghum bicolor
  Clone ID: 30974373
ggcatcatcataacttcgataggttcatgccattcaagggaactaacacaaaggttcttaaccaagtttcaggtgtggaagcttcggcgaccgcttccaactctaataacggagccccagaacctgggcgtgctctctctcttctgtcagacggttcttggggctcaaattcagccgtcatccagcagcctccttctcacgcagatgctggtgcattgccgcccctcgccaccgttgctgtctccaacaccgccgccaggcatcctcttgacccgtccctgggaaggttctggcaagacgatcatcccccactcgacggacctgcacctcagattcaggaactggcgcacctccgaacatggtgaaagtgaaagataaatgtatctgatgccatctcgaggacctggttgggaacttctggctaggcattttgatggcaatctgcggctctggtttgaatttgccggtgacagtctttggacaatgtttaatttagctgttttgatcagaacgggcacagacatgtttgcacaatgtgagttcctctatcattggggatgagtgaggtgaagatgcaggaacaataggagacaaaatcttaatttttttgctcgttttcccaccagtatttgaattataaattactaggacc

SEQ ID NO: 26420 - DNA, 584 bp, Sorghum bicolor
  Clone ID: 30974381
ggcggcagcctcccgtggttggagctgggagcaaacgcggtggctgacgccggccacgtcgacagttgttacgccggcgcgctggacgagctcaggtggtcggagtacttcgacagtgccttccaggccgccgcgagccagcaaggcgcactgcaggcggcggggcagtgtgtctacggcggcaaggatgacgtcccggtgcacttcgacgtccatgggttgagcaacgggtgctaatgcatctctttcactgtgtgctaatgcaagaacccccggaagaagaaccagttcgcagatgcaaattattattcctcgcatttcatgtggtgttattttcccctcttcttattctgatgttgctgttaatgagcagcggataagttcgagtgtgtggtgagtacatttgaagtgtttaacacacatgtaaagtccatataggatacgctgtggttaattagtaaatactgcagagagagagagagagagagagagagagagagagggacagagagatgaacgggccatgtggttaaataaaaatgtgaattattatgtgattagctcagcacattatatacatgtgc

SEQ ID NO: 26421 - DNA, 626 bp, Sorghum bicolor
  Clone ID: 30974393
ggacccttgagtggataagcttggcgttggatccatatcctagagcggagaagctcggcaccgaatgcggagcctggagcagtcccatccccacgtaaaggccagcaacgagcgcttcaaggaacaactggtcgacatcgagctgctcaggtgattcgtgtgttccccaatgtggtcctatatctatcttttctgcaggaacatgctggcggtaggggatctgcgtatccagggtctgcggttcaacagaatgtgatctgaatgaatcgaagtgccatgatgccaatattgctggttgtgctcaccgagtgcaatgacaagaacttgcatctggattcctaaaaatctgcgtggccagaacttatattctttgtatgaatcagtttggatgtagtttcagttaccagttgtatttctgtctagcttattatatgatagtgtgaagctgctataatattatacattttggctgtatcttttgtcatcacaattttagatgattgttttagtatgcaacacatgagcagtgctctggtctggctgttaccatttattcaacatttctccatgctagttgtctgaatattttgcctgatttattctctgcacaagttgtggaagtttac

SEQ ID NO: 26422 - DNA, 559 bp, Sorghum bicolor
  Clone ID: 30974411
atgtgcaacataagataaaggaacatagttcaagagtgtggaacttattactgtccgatgcagttatttacattgcgggctcttcgacgaaaatgcccgctgatgttacagctgcactggaggaggttatttgtaaagaaggtggtgtcaaacaagaggatgcttcaaaatggctcagggatcttgaaagagctggtagacttaacatcgagacttggtcatagttgtgatggtttctatctgccatggcaagaaagtacatattacaagaattttgcgaatgtttgctgagtatggactagggagaatgtcattgtaaatcaaaggcattgaaaatgtggaaatttgtacatgtaaaagcatccaatacggaagagaaatagttagaggatgatctaacatttcctcatttagccctctctacggaatgtcatttcatttgattgaggacagtaattacatcagcttttgttgcatctgattgttagtgtgcattcaacttatctagccctgtttcagttcagttaacgaacttataatgactttggaactattttgt

SEQ ID NO: 26423 - DNA, 505 bp, Sorghum bicolor
  Clone ID: 30974423
gggagaaggctgtggagatagatgatctatgtggaaaggatgatgcatggtggggtgttaaaggttatatgcgagacaatttcaaccatagcaataaggccatctcgcacaaagagcattttcaaaacagcaggctcgtggaatcagtgatggatttgtattgggagcttcctcctgttgctggtccatccttaacacatcaaacaaggtatgccccagcacgtgcagttgacccaatcattgaagatggtcgctatggcttgtttcgaaaaatcggtctagcaagattggatgcctcggtgttcaatggttacactcagatggcatatgtgcagatatcaggttcaatgttgagcacagacgatgtttaaagattttctgtggtgagcttttcttttcttttgtttttttttttttgctaactgttgataggcttttgtacaacactgatgcacttccatgcttactttgtttcttgtgcacccttccaaatattaatgctccc

SEQ ID NO: 26424 - DNA, 664 bp, Sorghum bicolor
  Clone ID: 30974427
attcacgaagagatggaaatttcgttgagcattttgttacatgaaagtttatttagaaagttgacaatatagagttcactaatgaggaaaggctgcaagtcatgcaaagtattgctgaagaatcattcgttagttttgatgccaaataactgcaactcaagttatgggtcacataggaaacagaacatgatatgcttgagaagggttcaaagaagcctgtggaactagcaatgcctttatccaacaagcagagatgggtcttgaggggccatgcttgctaaggttggtctaggaagataaactattggaggaaggatgatttcttaggcgtcgacgaaatatttttgcacaacggtgatgagaaggcacctttaaaacctccgatgacaaaggcactcatgttcagtgggaaaaaaaatccaacgggcaccacttttctcgcaaatagaaaaaagctcccatctgtcctcttcttgtatacacgcttatgatactatagtttgtaattttagcatgtaatggttaaaaagcagagtaactaatttcttattaacccagagagtcatcatattcatacataggcaagtatgtaagctatacagtttttgcaacatctatgtatggtttatgtgctactgtttctccaattgattaattgaagttg

SEQ ID NO: 26425 - DNA, 119 bp, Sorghum bicolor
  Clone ID: 30974434
gtaaaatgtctgttggcctgtttcaagaggttaatatggaggtggcgaagacttcaaattcgtactgtacgtcggcagtgtcacgagcatgtacagtagagtacaaaagctgcctcgtc

SEQ ID NO: 26426 - DNA, 716 bp, Sorghum bicolor
  Clone ID: 30974438
gaagaactgcacgcatgggagccaaagggaaagttacaagcattgtggctaagaaggacgtagctttagctacacggatcgaagaggccatgaagaaaaatgagagcttggaagctctgacgactaacaatgttagaagggcagccagcccgcagagtgtgagcaccaaaggaaggccctcaaggttggttaagacttcaaatgctcttaaagttgtcaatcagaagggtagaaggggggttgcgctatctagcaagtcatcccggactcccaaggatacaacttcaacccaaaggcgctcaccgctgaagagccaggccaagacaacaaaatcggcagccccgcggaaagccaagccgttgaaaccttctcagagcagcacaaaggcctcgaagagcaaagcaaaacctgagggtcgaagatcaaagagtgatgctctgaacaagctcggaactaagctcagtgtggtcggattcagaggacgcagctcaggcaaatcagcacaatcttcataaatcataagataaaaaggttcttggaggatttggatagtgcagcctgtaaatagctgagacttcgtttcttcatatttttttttccttgcgggcttataagtgaagaccacaatcttagatatgaacacagcatagctatgtaatattgtactgtattcagcagaatgttggaataatacctttcattacctgtattcacgt

SEQ ID NO: 26427 - DNA, 515 bp, Sorghum bicolor
  Clone ID: 30974440
gcgcaacatgatcattgtgccagagatgataggtagcgtaattggagtgtacaatgggaaaacattcaaccaggttgagatcaagcctgagatgattgggcactaccttgctgaattctccatcagttacaagcccgtcaagcacggaaggcccggtatcggtgctacccattcctccaggttcatccctctcaagtgaagaatccgagggcatgctcgtgtctgcgtcaaagttatctggccctgctgcaatctgttattggataaggctttgttatttagcatttagtgctttgtcggaggaacgtttgtccaccaatgaattctagttctttttagtgaaattttgacatgtgcgctacttgcgatttggaattgaaagtagagatatatattgcaatcccaaccctgttatctgtcagggtattttgtattccttcctgtctcgcttgtcaactgaaatggttgtttttttcatagtgttgaatatatcaatggaaggactattaaattgt

SEQ ID NO: 26428 - DNA, 563 bp, Sorghum bicolor
  Clone ID: 30974470
acattttgtttttctaaatctacagtacatgcaaactcagagtgtacgtcggcacacgtgaatgaataccataggtcccatcctacactgagtgtagagaagccatcactgagtagctagcaaagatcgttgcagagtacaccgcttacaagagaaatgattgccacgacggggagctcggcgaagacggcggcagcggcggctgtgggcggcaagtcggcgcgcgcctgtgacgggtgcctgcgccggcgggcgaggtggtactgcgcggcggacgacgcgttcctgtgccaagggtgcgacacgtcggtgcactcggcgaacccgctcgcgcggcggcacgagcgtctgcgcctgcagccggcggcggcgtcgtctccgctgcacacgccgcctcgcagcacgggggcggcggcgaataataagcgcgagcgtcacgacgaggcggtgcccgcgtggttcaggcgcaaggcgcgcaccccgcgcggcgggcacgccaagagcgtcgggcaggcgttgtcgcggtcgcggcgccccggcgtcgtcgtgccgcatgcggcggc

SEQ ID NO: 26429 - DNA, 608 bp, Sorghum bicolor
  Clone ID: 30974483
ccatgccacatcacccacgccgcctccctcctccttgggcagcgctgctgcacacgccgccgcccctgcctccgcacgccacagcaccaggcgcccctccggctccgcacggcgctgctccagccgctctccccgaccgagcccgactacccctacccggcccctgctggccgactggccgtccccgttcccgtcctgctccggccatccgccccagccgccccggcgactgctgctccggccatccgccccggcgactgctgctccggccggccgccccggcgactgctgctctggtcatccgccccggctgctcctccgtcctcggacctgcggctgccggccgccgtcctttccctgaccctgcctgcgccgaccagtaccgcagtacgtcctcgtggtgaccctctacatcgcctactctgaggcaattgctgggtgaaggtcctgagcaccctctgcaactcctgcaacctcctctgcatctcatccccaattcttctaaagactgcccacctacagaccttgttcaaatcatcccgtacgagcaaagtgacttgtgaaacaatcatagcagccgccattcgttactaagaagttattggtcg

SEQ ID NO: 26430 - DNA, 504 bp, Sorghum bicolor
  Clone ID: 30974489
agttccagatgcacgcgtgatgttttgtataattgcctcggcctgattcttgtatctgaaacaacaaactgagaccaacaatccttagctcaagaagcaggagctgtaactgcaagccaccatgctcatcctcgttttcctgctcttctccagcgtggacctccaaataagtggagcaaccgacacgctcaccttgggccagtctctcccatggaaccagacgctggtctccaagggcggcaacttcgagctcggcctcttctccccgggcaactccaagaagcactacatcggcatctggttcaagaaggtctccaagcaaaccgtcgtgtgggtggcgaaccgggaccgcccgatccttgacccgtcggcctctcgcttcactctcagcgaccgcggcgagctcctcctccacacgacgccatccaaacaccctgctgtggtcgtccaacgcgtcctccccgtcctcgccgccgcgcaccaccgtcgccacgctccaggacg

SEQ ID NO: 26431 - DNA, 546 bp, Sorghum bicolor
  Clone ID: 30974505
tttcgccctcctacggtcgtcctactcttccccctctcgcagtctcgcttggcaaccggcggcgccgctgccgccgccgcagtcggacacaagggaggcacgtgcgcccagcgaacaccaagctcaaggtaggagaccgtacgggcgaacctctgcagcggcggcaggagcttgcgtgacctgggcggagtgagccgattgaggcgcatattggctgcgcttgttggccgcctctaggttacttgcaggccgcggattctgagctcttactccatggcgccctcgtccgcagaggctgactcgccggcgtccgccagcggccgcctcctcgtgctctacgcgtcacaaactgggaacgccatggacgccgcagagcgtgtcggccgcgaggcggaacgtggtggctgcccggccgtcgacgtgctgtccatggatagcttcgatcccagtcgcttgccgagcgagcggttcgtggtctttgtggtgtccaccacggggcagggcgatcccccggattccatgaaggggttttggagatacctgctt

SEQ ID NO: 26432 - DNA, 590 bp, Sorghum bicolor
  Clone ID: 30974518
acacttccctctcctgtggctccttgttcatctttgtattctctgtaagggttagctggatcgagagctagcaggggcgatcgagaggtgatcgagccatatgggggtcagggtggtggtgaccatgaccactgcggcagccgccgcctgctgcttgctgttgctgcagctgtttgttggttgcgtcgccgtcgcggcggctctgccgacgaagggcggcggcgccggcggcgacgactacttgaggtacaaggacccgaagcagccgctgaacaggcggatcgacgacctgctgcggcggatgacgctggcggagaagatcgggcagatgtcgcagatcgagcgggagaacgccaccgccgacgtcgtcaacaagtacctcataggcagcgtgctaagcggcggcggcagcgtgccggcgaagaacgcgccgccggaggcgtgggtgaagatggtgaacgggatgcagagcggagcgctgtccacgcgcctcgggatccccatcatctacggcatcgacgccgtccacggccacggcaacgtctacaaggccaccatcttcccacacaacatcggcctcggctgcacca

SEQ ID NO: 26433 - DNA, 624 bp, Sorghum bicolor
  Clone ID: 30974523
ggcctaccgaattttctcctattcccactcgcgcgcgcacagttacatcgcactcgagcccggccaatcttccaccaccgagaaactttccccccgatctgttgtcgtctcctcaccgtcgcatcggcatgcacgacattggcctctccgcccgcgcggccggcgcgacgtcgtgctcctccgccgccgcaggggacggcggcgacgagtccaagacccggaaggcgcaccccggcttcgtcgccgcctacactcgcctgcactcctcccaccgcgcggtcgtctccctgctgctccttctcaccgtcgccgtcgctgccttcctttggggccgcgcccgccccagcgtcgactgcgcgccgccgcgcctcgatgcgcgcttcctcgccctccccgacgccgccgccgcctctgactttggctccctcggcgtcccctggtgcagatcaaaaacagggaagactgtggaatggatgtctaaagacctacttaatggattggaagaatttgtaccaatatatgagacacgccccatcaaaaataacatgtatggaatgggctttgaccacagttttgggctttggtttatggctcgctggcttaaccggatctgatgattgagag

SEQ ID NO: 26434 - DNA, 336 bp, Sorghum bicolor
  Clone ID: 30974529
caccgtaccgcccgtccgctcccctcgctccccgtgcgatctctcgctcttcgtgattcatgcggtgacctagatctcgatctctttctctgcgccttgccttctcccctgcaattctcactgtccttgcgctcgtcgcgcccctatctcctccacgcaagctgcacaccacaccaagaaagagcgcccactcctagctccctaagatgccgcacccaatccaagctgtcggtacgcacgccggccgccgccatgcctccactccgccgggcgctgccacgacaccacaccaccactctgtcgggccgccgccacacagccatcgctgcccatctc

SEQ ID NO: 26435 - DNA, 623 bp, Sorghum bicolor
  Clone ID: 30974551
gtgttcccaccctttccccctgcagttccaccagcagtagctcctgtagccccacctgctgcaccagcaaccaatgttgcctccaacacctcaaagaagcgaaagaaaagaaaggtgaatagttgatcttctaatgctattgaagtgatctaaaacaagatatgatcggtgaagtacaaaaagagtttgatctcatactacgcatcaggccttggcatgagagtgggctatcgatttatctcttctgcgggtttggtctttcgagaaaattctcttctgcgggttgtgctacccatgagactgcctactgcttattcctggggttgttctttcgagaaaagtctcttctgcggcttcagctagatacttctgcggctgaggcagttagtctaaggtaatgttgtgatcaaaagatgcagcaaacaggcatgcatttggcctgagcatactttactgatctcaattagtgtagattactagattagattgcctgtaatgtacattatcgccctcagtgccggaagtaatctaacatgtagtccagtttatgaatgtaaagatccatttatgactatggattgcatgtatggggaaggatctgtatcttataaagaattatgatt

SEQ ID NO: 26436 - DNA, 630 bp, Sorghum bicolor
  Clone ID: 30974557
taatcatcgccccttttcaaattcacacagttcaaccaaagttcaaaattcaaatgctaattcgccgtcttcaagtcccagcagcaatcctggcccccagatagagggtcctcctggagccaatttgttcatatatcacattccgcaagaatttggtgaccatgatcttgcaaatgcatttcatagttttggtagagtactgagcgctaaagtttttgtagacaaggcaactggtgttagtaaatgctttggttttgtaagctatgattctccagcttctgcacaagcagctattagtgtgatgaatggataccaattaggtggtaaaaagctgaaagtacaactcaagagagacaacagcaagcacaataaacctttctgacaaagagaattcgttgtatgctcacacgatcaggaaaatcggtacatatgtgtcacaattgatcattacattgtttcctctggcctcccaccaatgtgtcgccggtggtggctcttgtatctttgttcaattcacattcttgaaaactgtcacattgtgtattttcgtcgcagcgtagttgtagcatttgtaccatcagatcttgtacatcagacattaattcattcaattgtttttttattctcatg

SEQ ID NO: 26437 - DNA, 552 bp, Sorghum bicolor
  Clone ID: 30974576
ccgggtgcgcgcgtgacgccgacggccacatcgactgccatccgcgcgccgcgcaggagcgcgccgagcagctcgccaacttccagttctttggactcgtcttcctcgccttctgttatgtgcttgggtgctacgctgtcgctgcggcgaggtacggccacccggagctcgccgcgatgcacgacaagcacgtcgccgcgatggagggcctcggcgacgccggcggcggtgaccgccaggaggagtgcgcgatctagtggccgatggacattggtgttgctctagactctggttcttggatttgatacagctgtataggaaaattcagagtacatcatgagatcagaggtagcttggccattcagagttttcagactttcagaatcagggtagggagtgtacattttgggatcaattcaggcaaaattaccaaagctttttctcttgttatttatacatttatacaaggtttcacgagttgcttaacttatgatgtaactgttactgatttttgatgagggagatgtaaactgagaggaatacttgtagcgc

SEQ ID NO: 26438 - DNA, 613 bp, Sorghum bicolor
  Clone ID: 30974580
tgcagcagcagcaggagccgagcaccagcgcccgcgacaacaagcagctggcgacaacggcggctgcagcacccgccactgcacccgcgcgtgacaccgccgccggtggcgggagcggcaagcagcagcagcagcagcaggcgcgtgccatggcggcgggcgtcggcgcgatgaggaacgtgctgctgcggagccccggcagaggcggaggcgtgctcggggtggtgaaggggatgggggaggtggacctcagggccgagctcttcatccgcaagttcagggaggacatgcggctgcagagccagcgctccgcggaggagttccaggccatgctcgcaagaggcctatgacatcaactcacgacgacatcttccttaataattgatatctactagcatagcataggggattggttaaaggtttaagctagtatagtttgcatggatttgtggtttggtaaaaatgaagaagaagatttagggcctagattactggagtagatagatgatcaatcacggtgtgctagtagcctaatataaactctgttagttgtggctttggttgagaggttggttttcttcgtgttctagatgtacataaaggatgttgttct

SEQ ID NO: 26439 - DNA, 551 bp, Sorghum bicolor
  Clone ID: 30974592
ttgttcagtactatgagaaaagggggaagcttcgaaagatcgatggcgccaaatcccctgatgcagtttttgaagatgtgaaggctatattctctcaactgaacactactcaggaaaaccaaggtagcagtatgagcagcagagtacagagcaatccactgaagcggttcctggacctgctctgtggatgctttgggacgcaggaagcgagaagctaactgatgagatggtagttctgaattcttgtgtgctagtggtgtatgtacatccttgttcagtcctcgaggctgaagcaacaacatacgtccaaaaaggattcagagaacacttgctgtgtgtggttgaagacttgaagtgtgtccatatctgagtgtgcgtgttgtgtagattcagtctgtcgagtttgctgtgatccatccattgccagtatgccattggcggagtgtgtgtgtgtgtgtatgtacaaactagttgaaaaaaaaaacagagaatggccctgcccagctgcacctgtaacacacagattgcatttgtaattttaagtgcaggcc

SEQ ID NO: 26440 - DNA, 562 bp, Sorghum bicolor
  Clone ID: 30974605
atgcaattttattatcacctcagctctcagctcgtggaggagaaagaagcagctccagttctctctggtctgcacacgggcaaagatgaaggacttggcggggctggggcacctgttcgtggtgacgttcctgttccacttcgcatccttcatggtgatcccggcggtcaccgacgtcaccatggaggccgtctgccccggccgcgacgagtgctccgtcgccatctacctcaccggcttccagaacgcggtcaccgggctgggggcgctcgtcgtcacccccatcgtcggcaacctgtcggacaggtacagccggaaggcgctcatgacgctgccggtgacggtggccgtcgcgccgctgtttatactggcttgcaaccgctcggaggtgtacttctacgtgtactacgtggccaagatcatcgccgggatcttctgcgagggcaccatgcactgtctctgccttgcctacgtggctgaccacgtgggccccaggcgtcgcgcggcagcgttcggtctcctctccggtgtgtcggcagcggggttcgtgtcggggaccttg

SEQ ID NO: 26441 - DNA, 639 bp, Sorghum bicolor
  Clone ID: 30974611
ccgacccggaggcggacgcagcgtgccgcccgtccctgcctgtcctcgctggcccgcttgccccgtcgcccccgcaccgtcggcatgccccgctgcgtgagcaccgtccgcgaccggtgcttggagctggagcgcatcatcgccgcccgtgcacgctcgggaagcctcggcctcgacgacgcgctgaagctgttcgatgaattgcttatccacgccaggcccgcctcagttgttgccttcaaccagatcctcaatgctgtctcacgtgcctcacgtgcctcggggcgacgctcctcctccacctcagagtcagagctcgtcgtctccctcttcaaccggatggtacgtgaatgctccatcaaggtggcccccaccacttgcacctacagcatcctcatcggttgcctctgccgcatgggccgcctgaagcatagcttcgccacctttggcctcatcctgaagacgggctggagggtgaatgacatagtcatcaatcaactgctcaaaggactttgtgacggaaagagagtgggtgaggccatggacgttttgctccaacggatgcctgaacttggctgcacgccggatacagtttcatacagcatacttctcaaaggttttttgcatgaaaacagagct

SEQ ID NO: 26442 - DNA, 662 bp, Sorghum bicolor
  unsure (1)..(662): unsure at all n locations
  Clone ID: 30974613
atgtcacttttcttcttctggagggctcccgacaccaaaacctctcctccgccaccattgccggccaacataagcaagaatccctccttctccctctgctggcatacatgcatggtttaatttcgcattcagtcgatttcagtaattgagcttcttttctactcacccacccatattgttgttcatcatccacacgccgcccccggatggcagatgcgatcaagagtcaagttgggtcgtttcctcctgggaaaaagataacggttgtgtttgtactaggtggcccaggcagtggcaagggcactcagtgttccaacattgtcaaacagtttggcttcacccatctgagtgctggcgaccttctgcgtgaagaagctaaatctgatactgaacaaggtacgatggtaaagaacctgatgcatgaaggaaaacttgtgccgtctgagctgatcatcaagcttctgctgaaggccatgcttcagagtggaaatgataagttccttgttgatggatttcctcggaacgaagagaaccgccaagcatatgagagtgttattggtattgagcctgagttcattctgttcatcgactgcccaaaggaagagttggagcggcgcattctacaccggaatcagggaagagatgacgacnacattgacact

SEQ ID NO: 26443 - DNA, 629 bp, Sorghum bicolor
  Clone ID: 30974628
gtggtctccttttgtagttttgtgctcctttctccgggctcccatcacggtggcggcggcgacagcagccatggtggagatgcggcagcggaggaagccgctggtgctcgcctccacgcaggcgctcctcgactcgctcccgggggaccgcccgccgccgccgccgttggagccggtgtgccttaggaccggcgtcctccgcttcccctccggccccggcgccggcgccgagttcggggagctcgcgtccttcgtcgccctccctgcctccgcgctccgacggctcacggtcgtcaccggcacgccggtgcttgtcaagaatactgacaataatgttgggaggattgtcaaagcagtattgtttgatgacatgtcccttcgcaagtcccactcagaatatactgatcaagtggtctctgcttctccttctgatcgtgcaatgggcttcttaccttgtcgcatgttccctgctactggtttggcatccagggatgaagttgttgcttatgtcagcccacttttggcattcaacttggggttgcatgtttcttgccctcagcttcttattcaaagaggagggcagcctttcaagttctgttctcgagctgaagagattgatgcaactgctg

SEQ ID NO: 26444 - DNA, 648 bp, Sorghum bicolor
  Clone ID: 30974638
acggccccgtctcatgccgcccttcgacccgtagacagacacatgcgatgcacctgcaggcaggcggcgccgtgcacctccacctcctccagtatttcatgccccagcaccaaccgcaggaatcagccaccgacctagaggcgcaggagtcggccgtgtgcaggcgcagccgctcgtccacttcgccggcgccggctaccatgtgggagtatcaccagcaggcggcgcatgcggcggcggccttgcagacggcctcgtcgccggcgtcttctttcccttcctggagcccctacgccgggactacggctgcgctcctcggctccagctcggccttcgccaccgatgccggctcgtcgccacccggcatgcgccttccggcagccggggagcacgccgtgcacggccacgcatggagccagcacggcgaacaaagcaacatcacatgctacaaggagaacttcctcgatctgctcgcgtcgaagaacgtgacgcaggagatgttcgaggacgtccccgctggtcactacgccgcgcaggcgatgtcaggaagattcggggcagcaggctctgatgttgcaccgatcaagtacgaggtcaccgccggctcctccccgctgttcttcaggagcactactactggtatgcacc

SEQ ID NO: 26445 - DNA, 707 bp, Sorghum bicolor
  Clone ID: 30974650
attattccattgatggggcagggaagactggaaagttgaggtttgcagagggtgatgttgaggcactcttagttttctttgataagatgcaagctcaaaactccaacttcttctacaactgggacatggatgatgaaggtcggctcaagaatgtttgctgggttgatgctagatccagagttgcatatcaacatttttgtgatgttatttgctttgatactgtctatttgacatatcagtttgtcattccattggtcgcgtttctgggaatcaaccatcatgggcagtttgtgttgttaggatgtggtctacttggagatgagtctccagagactttcgcatggttattcaaaaaatggctaaaatgtatgaatgataaagcaccggaagcaattgttacgactcattcaaggccagtagtcaaagctgtcagtgaagtatttccaaatactcggcacagatacaacctttggcatataatgaaagaacttcctgaaatgtctggaagagttgaggataaagaagcagtcagtctgagaatgaaaaaagtagtctatgatacaattacatcagctgattttgagagggagtgggttgaaatgatcaatcaatataatcttcatgataaccagtggcttacaaccttgtttgaagagagggcaaaatgggtaccagcatatgtaaaggatactttctgggctggtatc

SEQ ID NO: 26446 - DNA, 684 bp, Sorghum bicolor
  Clone ID: 30974656
gtctccctccttccctccccttcccaggctcctccgccgatgcgaccaaccccgtcaacccgagcactcccacgcaaaccctagccagccagccagccagctagctagccaccccggccgggtccaatggcggaggacggcggcgacagggaccaacagcagcagcagccggcggcggccgccgcggcgtcaggtggcgccggggtggaggcgcgcagcagggagagcgtcaagctcttcgtggggcaggtacccaagcagatgtcggaggccgagctcgccgccctgttccgcggcgtcgccctcgtcgacgaggtcaccgtcatccgcgacagggccaccagggtctcgcgaggctgctgcttcgtgatctgcccatcaagggaggaggctgacaaggctgtgactgcataccacaacaagcgcacactacctggggcctcaagtccattgcaagtaaaatatgctgatggggagttggaaagactggagcacaagctctttgttggaatgctcccaaaaaatgtaacagatgctgaaatgacggatttattttcaaaatatgggaatatcaaggatttgcagattttgagaggttctcagcaaacgagcaaagctggctgtgcctttctaaatatgaaacaaaagagcaagctgtggctgctatagaagctctaaatggaa

SEQ ID NO: 26447 - DNA, 499 bp, Sorghum bicolor
  Clone ID: 30974659
atcccgcctctctccatatatatccatcgttccggccggccggttgacgacagcgagccagggggcgcgcgcgcttccgatcccagccagcaaacacatcaagtcgtctgatttcatcgtaagtttcggcgatcagttcgcgggaaggaggccggccggcgaggaaagggagcggcggcgcagcgttggccgcgcggtggtggtgccccagtacctgcttgcagtcggcgtgctatacggagtgtaaagccagcgcagctttttggcacgaggcatacatcaacaggttaactcagctaagtttgctcgacgtctacctgcataataacttggttcagaagatggacgctttcacacatgttcctcccggctttcgtttccaccctaccgatgaggaactcgttgattactaccttaggaaaaaggtagcaatgaagaagatagatttggatgttataaaagatgtggacttgtacaaaattgagccttgggatctgca

SEQ ID NO: 26448 - DNA, 538 bp, Sorghum bicolor
  Clone ID: 30974675
aaatcgcatctcatctcatccatccatctgcggatcactcccctgctctgcacctcccacaccccccgctcgccggagcacctgcacctcagtccgatcgggcctcggcggtggccgccatctagtctctctctctctctctctctctctctctctctccgccgcccacccacagtcgccgacgcacgcgtcgtcgcccaccgatccatcgcaaaccaagccaagccgccgttcccggagcgcggacgaacaagaaaagtcaacaactccctccacctcctctctctccgccaaccacgcccgccccgttcgtcgggtcgggtcgcacgcgcgcaggtcaacgccgccggagtgcgcgcgcgcgcgtcgccgtgcggtgcggccgaccgaccgactcagtcgacgaccagccgatccatccgtccgtccggccgccggacaaccatagggtcgttcaagggccacgtgctgccggggacgctattcctgctggtgggtctatggcgggtctggtgctcggcgtcgcgacacgccgcgt

SEQ ID NO: 26449 - DNA, 500 bp, Sorghum bicolor
  Clone ID: 30974679
aactgacaaacctaagcaatcaatctctctcctgcacccgcacacacgcacgctctcgctctcccggtcgcggatcatcagtttcaggcatcccatgtcttgcttcggcgtaaccaccatgccgacgacgacggacacctactattacgcgtcctcgtcgtcgtcggggcggccggcgggcccaggcggcggcggcggaaggagggccgtggcggtggtggcgtgccaagtgcgtcggcatcgcggcggccgtcgggtacaggctccggaggtccgtcatcgggggcgtcgacgtccgccgccgtcggcgcacgtcgtcgacctccgtgcactactcgcagaacggctggtgccaccaccaccaccaacggagcttcgcgccggtctacgtcgacgacctctacagccaccaccaccacctgcagcagcagcagccagcagccaaggccctccgcggcgtcgtgcagcagcagcaggagccgagcaccagcgcccgcgac

SEQ ID NO: 26450 - DNA, 615 bp, Sorghum bicolor
  Clone ID: 30974690
ggatccggtagggaacctgaggaagctcgcggcgttcatggggtgcccgttctcggcggaggaggagacgcccggcggcggcggcggggtggtggatcagatcgtggagctctgcagcttggagaacctcaagagcatggacgtgaacaagaacgggactacgacagtgctcggggtcaccaacgatgccttcttcaggaagggcaaggtcggtgactggaaaaactacatgacgccggacatggcggccaggctggataaggttgttgaggaggccactcgaggttctgggctcacctttgccgactccatatccgtgtaattagtaaataagctttcacacacaccatccttttaattaatggaggtgaccatgcatgcatatcgaggttttgggctcccctttgtatcgatccataggtttggcgctttgcatacggccaggagctagggcttcttccgatgcatggaggtgacctttccatagacgacagcgagctagcgcaggcacatagtctactccagtatgatgagtgtgaatgttgtggtgtgtcgtctaggtgtttgtggttgtacaagaaaagacgcatgccctacttccttcaaaataaaatt

SEQ ID NO: 26451 - DNA, 669 bp, Sorghum bicolor
  Clone ID: 30974696
atgaggaagaaagcacaggagaggaagaggaacatgtctccatcatcgtcctcatcttcgctgacttaccagtcaggctacccagatactccatcaacaattggagttgagggacaggagcttcatggtggcagtggctgcatcacaagcatcctcaagggcacccctccggacatggatggctaccccatggaccagatatggatggaaattgaggcgccagaggtgccctccgaggtgggctttgttggagggaacgagaatgtgtgcagcagccttgccacacctctgccaccacctactgtctgggaatactacccagaggcctgctggaagattgatgatgagatcaagatggcaccacagttcagttatagtgaaggagctggcccctgcttctgatgccatatattggatcagatcactaagttatacacctacctagcagaagtgaagtgcttttgtagaaacaagctttagcatgggtctgagtatttatctctgcttagaattgcaggtctatggctctatgcatgatttctttagtatctatctagtgtgcaagacaagatcatcttaatttgtccttgatgctatggaatacaagggcaaaggtactatgtactgtttactcacagtataattagctatcctgtgagacttttctgt

SEQ ID NO: 26452 - DNA, 648 bp, Sorghum bicolor
  Clone ID: 30974702
cgacgcgctgatgagcacggaggacggcgacgacgaggacgacgtgctcagcacgggccgcacgccgggctgccgcgctggtggctccccggactccacgtgctcgtccggcgggtatgctggcggcggccggaagcacgagaccggcggcggtgagaagaagaaggagcggatgaagaagatggtgcggacgctcaaggggatcatccccggtggcgaccggatggacacgccggccgtcctcgacgaggccgtcaggtaccttaagtcgctcaaggtggaggtcaagaaggccggcgcgcgtgggtcaagcagctagctagcttagctatccagcggcaactggtggtagtctggctctggcagtcaaaataggagtacgagtatctctctgcgcatcggcagataagacgagacggcgatcatacacgcggcggcggtggcgacgacgacaacgacagcctcacattttgattttggcatcagatgccattctgtgtatctgactacgtcccttgttggctactcgacggcggtttaggagaagatgatgatggtcaaggaggccaacggtgagcaggcttcgacatccatgagtggtggggagacaagagtggtaatggattggaggaatctaaatccaaatag

SEQ ID NO: 26453 - DNA, 688 bp, Sorghum bicolor
  Clone ID: 30974706
gttgctgctcatcagccaaatgaaataacttttgatgacgatgaaaaccagagctcgtttgtcccacagattggggataaagtgtatatacaagggctgggaggaggaacgatggctactgttgttgaaacttttggagaagatgagagctgtatggttcaatatggaaagataaaggttcgagtcaagagaaacaaaataaaattggttcaaagaggcataaataatgaggcaacaacttcctcttctgtaaaagcaaagggccgaacaccgaagcagcgatcggcaacgacagccgaggcggaccgaaatcaagacggcggcggcagcatctccttcggtcctgtcgtgcagacgtccaagaacacggtggatctgcgcgggaagcgggtcagcgaggcggcctacgagctccagatggccatcgatgcgtgtagaacgtaccaggtgctctttgtggttcatggcatgggcaccggggcggtgaaggagcgcgccattgacgtcctccggaaccatcctcgggtggccaagttcgaggacgagagccctctcaactacggctgcaccgtcgcctacatccagtaaacgagggcagtcagtacgaaacctgtttggaattgaatacagaaatttcaaaaggattgtagaaatcaattctgtttcataggggaagaaagtcatgaac

SEQ ID NO: 26454 - DNA, 629 bp, Sorghum bicolor
  Clone ID: 30974709
ctagaaagatggagatgcgatgatttcacaatatcagattcggattcattcagcacatacaacacatcaaggaagtaccattgacaattagtgagtcactctttgtcatatataaatgcggaaccatgatctgatgcatcaagtggctctctacagcttgtggatcacggacagctttgaaggtcaatgtgccagcctgtcaggtgttgtagttagcccattgaaaacaaggttacttgataatcagcatcttccatcattaaagtctgctaaccaggctcaaactcgagggaagtcatgatacttgaaacttgtgctgtatctagcttatctagtttatatcatttggtcactggggacattgagaaacagtttgttcttgaatggtcctgagggaaaagagatgaaagaaaccatagcttccgaagtgcattctggtggttagtttttgtagaccgtagagggttgctttttgtgtaccacaaaccttgatttgttattatttatctagtatttgtatttgctctgtacaaccaaccgtgagggttgcttccttcgaatacctgaacatgtgaaatgatgctacctaacgttgaagttttgcgttagttttttgggttgtcaacccg

SEQ ID NO: 26455 - DNA, 206 bp, Sorghum bicolor
  Clone ID: 30974721
gcaatggggatttgggcagcatagtaatggtaagtagcatgaggtttatggtggggacaagatttttgcatcagtgagattggtgttggctggcaacttttgtgtttctcaagcatcagttttttttaaaaattttagctttatttttctccaggttttattaggcttgtatgtaagctgttaaccgatacattgccctactttat

SEQ ID NO: 26456 - DNA, 538 bp, Sorghum bicolor
  Clone ID: 30974741
ccattgcctctttctacaaccgggcgcgcttcgccaccatcgctccggcgatccccgttgcggatgccggtggtgacaactacccgagcttcgtgttcggcgactacatggaggtgtacgtcaagcaaaagttccaggccaaggcccccaggttcgcggccatggcggcggcggcggcgacgacgacgaccaagtgaccagcagcagctagctagcagagagctagcttgcggcgcgtgcagcgacatgcatgatctcaacttgcgaggagcctaatgaataaatgttcataatcatcaagttaatcgtgcgatcacggtacgggcttgtacgataagtaggttgttaagtgtgtggtttaatgtaatgtgtgtgtagaatggacatgtcatagaaatgtgtgttggtgtggatgccctgcagcgagcagtcacgagtatatatacctgattgtgacaaataagcttgcggtgagctgtggatctgtggtcagtgggtgccagagtgatttgtagcttaaaatggcatctgccagatt

SEQ ID NO: 26457 - DNA, 541 bp, Sorghum bicolor
  Clone ID: 30974755
tgctcgcctgcgtgcttgcgctcccggtcttgacgctgatcagcttcgcgctcggcctcgcgtcctcggcgttcctggccgattctgtctttggcgtcagcgtcagcatcattttggagtcggcgcgcagggcgctgcggccatgggacttgatcagctccttgctgaaatctcaggtgtttggtgccattatcgcggtggtgagctgtgcctggggagtcacaacccatggaggagccaagggcgttggcgagtctacaacatctgccgtggttgtttccttggttggaatcttcgttgcagactttgctctctcgtgcctgttcttccagggtgctggtgattccctcaagtatgcaatgggttgaggtgagtcattgcagaggaagtattttgctttctaggagatagcatagtcttgtacattaacaagaatggtgcactggattccaataggtgaacattgcaacatctgccgccgtccaggtgacatgtatcatttttttttcccttgatacctacgagaaatcatttagagtgt

SEQ ID NO: 26458 - DNA, 567 bp, Sorghum bicolor
  Clone ID: 30974773
cctactggaagccatttctagttatatatataaccaacccacaagtgcacgtttcaggttctgatctctgttcgtttaatttggtgtctcagtctctagctagtagctatatactccccgatcgtcacatcacgccgccgcccaccgggccatggctcccggtgtcggcggtgctctccgtctctggggaacgacgacgaccacgggcgcgcggccagacatgtcccgtctctggacgacgcggctccagaaggagctcgaggggctctgggcggacccgcccgagtggtgcgtccccggcgccgacgccacggacctcttccactggcaggtcgtcgtcgtcggcccccgaggaagcccctacgacggcggagtcttcgccgtccgcttcaagttccctcgccactaccccttgaagcctcccaaggtcaccttcgcaaccaaggtgtaccacccgaacatcgatccgaggactggacgggtttgcctggacttcctgactgacagtaagcactggtggacgccggcatggacggtggacaagattctcctggccgtagtctcgct

SEQ ID NO: 26459 - DNA, 523 bp, Sorghum bicolor
  Clone ID: 30974777
cgttcccccattcgccgttccccatctgtccatctcttcccccacccacgcactcagtcaccgctggcgccaagccgatctccgaccaccgcagccatgacttccggcgccgcgctcctcctccgccccacctccgccacgacacacccgctcctccaccaatccagccccaaaccatacttcctccgcctacacccgtcttgccgccgccgccgccgcctgcccgtcccgcgcctgtccctcacgcccaccaccgccagcaacaactctcctcccccgccgtccccttcggcccctccgaccgcccccgcggccccgccttccctgttctccaactggtccccgccgcgcgcgatctggcgggggctctcggcgctgctcctcgcgggccaggtcttccaccgcgtcctcacgggccgcgtccaccgccgcaacctcctggcgcagctccgccgggtcgggcccgggagcgcgggggtcgcgctcctcaccgccgccttcgtgggcatgggcttcaccatcc

SEQ ID NO: 26460 - DNA, 615 bp, Sorghum bicolor
  Clone ID: 30974779
aacagcgcaccgccgagaccttccctccgcggctccgccttgtctctccccgcacggtcgcccctcttccggtcctccctgatggatcccaaggcggcggcgaagtcgaagcgctcgcacacggtgcacggccgccgcgtccaccagacccccgccgccgcggcagcgcacaggcagaagcgtgccgccgccgccaacacctcgtccggcccccgcagccgcaacctcccctcgaactgggatcgctacgacgacgagggcgaggcggaggagtccgcggccgtcggggaatggacaggcgaggtggctccgcgcagcaagggtgccgacttcggattcctgctagagcaggcccgagcgcagccccccggggcccgggacctcagcgcgccgtgtctcccctcccaggacttgccatttgattttatgcaggcttctacctctatgttcgaagctaaaagtgaaggaatattgtcttggtgtgctgatgataactttattttagaggatgacctagcaccagatttgaggtgccttttctctccatggatttgaatgcattggccaatcacctttcaaagattaagctttctcggagactttttatagaagaag

SEQ ID NO: 26461 - DNA, 571 bp, Sorghum bicolor
  Clone ID: 30974789
ggaggaaggaactcgaagagagatcatcgacgacattggggcacctacatacgatacgaaacacaccagcaggcagcagcatgagtactactacttgctactctgcgccagcagccgtcgtccccggcgccggcggtgaagtggcggtggttactgcagtggcatcggaagccggagcagcagcagctcatgaccagtcgaggaagaagaagaacaaccaccggagcctgtacgccaacctacctgcagccgagatcatcgactcgctgcccctggagacacggttcccggtgccccatcgcctgtacgggggcttctggaaagccgagttcttgctcaagggcatggcagccgctgccgctcgcaccacgtcgtgcttcgagttcgagccaaacccatcggacatcttcctcgccagcttgcccaagtccggcaccacctggctcaaggccctggccttcgcgacgctcaaccgccgcacgcacccaccgtccaacgccgacggccagcacccgttcagccaccgcaacccccacgactgtgtcagcttcctggagctcatggcttcccc

SEQ ID NO: 26462 - DNA, 528 bp, Sorghum bicolor
  Clone ID: 30974795
aaagtggcgtactcttctctgtactagcttcttcttcctcctctcctcttccatccaaacagactggatttcatcaagataatcctgaaactggagccaacaagcacacagagaaagaagagcaagaagaccggctcccagccgatacaaggtaggagtgagcagcgttaggcagttttcatcatatcacagggttgatatggtgacagtgagagaggagactcgcaaggggccgtggacagagcaggaggacctgcaactggtatgcactgtccgtctcttcggtgaacgtcgttgggatttcattgccaaagtatcaggtttgaggggtggggatccacaaattaggtaggtaaattgaagtcatggcgctaagtcgcaaaagctagtatcaacctctctaaccgactctattcttgcttcccctctccccttctgtatcttttcttgcaggactcaaccggacaggcaagagctgccggcttcgctgggtcaactaccttcaccctggcctcaagcgtgggcgca

SEQ ID NO: 26463 - DNA, 536 bp, Sorghum bicolor
  Clone ID: 30974805
gcggaagagacacccgcttcctccgtccatggctgccacaggcaagcttacccttctcctcccagtgaccctctcctctaggtcctcccactgcacgcgcggcttcatgcagagtccacgtcgtcagctgccgcaacgcctcacagtcacagcggcggccaccgaaacctcctcctacaacctaccatctcgctcctcgccggaaacgccggaggccaggcagatacgcctggagacggagtcagcgctggaatggggcggcgtgtgcgagcggctcgcccactttgcgtccactgccgccggccgcgccgcttgcgagggacggcgcgtccccgtcgggcggagccgggaggagagcgagaggttcatcgaccagacggcggcggcggtgctgcttccgacgccgctcgattttggcggcgtagaggacgtatccgcgctcgtcgctgcggcggcctcgggccgggcggttgcggtgagggagctttgcgcagttgggcgcagcatccgtgccgtgcgggcggtgttcgaccagt

SEQ ID NO: 26464 - DNA, 676 bp, Sorghum bicolor
  Clone ID: 30974808
ctcctgtcgttgcccccacctctgctcccttctcgccttccgccgttgcagtttgcagcttggcagtctccaaccccaacccgtccgtctcccctagccgtcgccttcaccttcgccttcgccgcgaaatctagggtttaagccgcgcatcgggtcccgcgcacgcaccgaccgaccacccggcggtcggcgccgctggacgaggtcggtcagccagtgtgcctcgcgaggaacggcaaaccatgtcgtagacgaactgggaggcggataagatgctggatgtgtacatatatgactattttgtcaagagaaacctgcaggctaccgcaaaggccttccaagcagaaggcaaggtctcatcagatccagttgctatcgatgctcctggtggctttctctttgagtggtggtctgtattttgggatatattcatagcacgaacaaatgagaagcactcagatgttgcagcatcatatatcgagactcagctaattaaagcaagggaacagcaacaccaacagccacctcaacagcagcagcaacagcagcagcagcagcagcagcagcagcaaatacaaatgcaacaaatgctgttacagagagctgctcagcagcagcagcagcagcaacagcagcagcagcagcagcagcagcgtagagatggttctcttctcaa

SEQ ID NO: 26465 - DNA, 520 bp, Sorghum bicolor
  Clone ID: 30974809
tactggaagctagatagagagagacaagagggagaggggaaacagaaccaccgggcggccggagacgccaaaaatacatcttcccggccgaggcaagaaatcaaaatcctccgcaacaatccgtcgcatttgcgccccctgtacggcgaatccgccatggggagggcgagatttctccttcccctcctgctcctcgccgtcgcgggcctcgcccccgcccccgccgccgcggcgacggccatgaccgcggatgcgggcgtcatcttggacctcgccaagtcgctgaccaacccgccgccgtcctggaccggcaccgacgtctgcggcggcgtctccttcagcggcatcacctgcgacggcgccggccgcgtcaccggcatcaacctcgtcaagctgcatttatccggcacccttccctcgtccttcgccaatctcaccgcgctccagtcgctgcagctccaaggcaatgtgctggagggcgacgtgccctccctggcccggatgggctccatcgagaccc

SEQ ID NO: 26466 - DNA, 284 bp, Sorghum bicolor
  unsure (1)..(284): unsure at all n locations
  Clone ID: 30974811
gtctcacacacccccagaacatcgacgacgtggctcggcttgctgtggcgcatcgccggggtggcacgcggctgaccgagcggtccgtccagcccaccatggaggcgccgccgggaccggagcccatggagctcgacgcgccccctcccgccgccgccgaggccgcggcggcggttccccccgccgggagcgacaagaagaaggaaggggaagggggagacnnncngnnacgggacatatcatctccaccaccatcggtgggaagaacggcgaaccgaagcgga

SEQ ID NO: 26467 - DNA, 638 bp, Sorghum bicolor
  Clone ID: 30974813
cctactggatctcagatccagaccaaacgaactccgcactaaacccccccttgccccaggcggcgcacgcatgaaaccctagtgaccccatacagatctccgcgtccggatcactgcgcggcgccaccatggcgacctctgcgctggactccctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccctacttcaactaccgcaccacgctcttcctcaccgagaacggcttcagcgagttctggaactggttcgactccgagagctggtacccgctcggccgcgtcgtcgggggcacgctcttcccgggtctcatggtgaccgccgcactgctccaccgcctcctccgcgcgctctccctcgccgtccacatccgcgaggtctgcgtactcacggcgcccttcttcgccgccaacaccacgctcgtcgcctacgccttcggccgcgagatctgggactcccggggcggggctcgtcgccgccgcgctcatcgccatcgttcctggctacatctcccgctc

SEQ ID NO: 26468 - DNA, 509 bp, Sorghum bicolor
  Clone ID: 30974819
aagaactccaatcatcctaccattacctcttctgggcggcgatcctgctgctgccgctcctcgccgtcaacgtcaagctccggcgacgcaaccacggcaataaaccgcctcccggcccatggcagctccctctcatcggcagcctgcaccacctggtgggagcgctcccgcaccgcgccatgcgagacctggcgaggcggcacggcccgctcatgctgctccgcctgggcgagctccccgtcgtcgtggcgtcgtcgcccgacgcggcacgggaggtcatgaggacacacgacgccgcgttcgcgacgcggccccggaccgccaccctccgggagctcacccgggacggcctcggcgtcgcgttcgcgccgcacggcgagcactggcgccagctccgcaagctctgcgtcaccgagctgctcagcgcgcggcgcgtgcggtccctccgcggtgggcgcgaggccgaggccgccaacctcgtcgcgtccgtcgcgtcgtcgtcgtcgtcg

SEQ ID NO: 26469 - DNA, 547 bp, Sorghum bicolor
  unsure (1)..(547): unsure at all n locations
  Clone ID: 30974845
ccgccgccaccnnacctccgactcggactgacctcccaccntcccaaacagaaaccctnaaccaaccccntcccccngtccccccgccngatggcgttcgncgccgccgcgcnctcctcccgctaccccctccgccggcggcggcaccggcatccacgcgggccgtctcggcgcgccaccacggggggcgcacggcgccggagctctcgggcccgaccccgcgcgtggtggtcgtcacctccgggaaaggcggcgtcggcaagaccaccaccaccgccaacctcgccgcctcgctcgcgcgcctaaatctccccgccgtcgccgtcgacgccgacgccggcctccgcaacctcgacctcctgctcggcctcgagaaccgcgtccacctcaccgccgccgacgtactcgccggggactgcaggctcgaccaggcgctcgtccgacaccgcgcgctccaggacctccacctactctgcctctccaagccccgctccaagctgcctctcgcgttcggatccaagaccctcacctgggtcgctgacgcgct

SEQ ID NO: 26470 - DNA, 547 bp, Sorghum bicolor
  Clone ID: 30974852
gccctgctcgccaagttgggtatccgccccttctcatacggtcttcagatcgtcaatgtctatgaggatgggtcagtcttcagccccgaggtgcttgacctgactgaggaggacctggttgagaagctctccgctggtgtctccatggttgcctctctgtccctggtggtctcgtacccgacccttgctgctgcgcctcacgtgttcatcaacgggtacaagaatgtgcttgctgttgctgtggagacagactactcgtacccgcacgctgacgagatcaaggagtacctgaaggatccaagcaagttcgctgttgctgccccggttgctgctgctgactctggtgcttcagctgctcccaaggaagaagagaaggcgcctgagtccgacgaggagtcggatggggaaatgggcttcagcctttttgacgactagagctgatcgtatcagcaggctgttttggcctttgcttatgagcaacaaataactatttagcttgttatgtgcttttagtagacagagaattggtatcgttccttgtgaataa

SEQ ID NO: 26471 - DNA, 378 bp, Sorghum bicolor
  Clone ID: 30974862
accaccactcccacaggtgcctcctctccctcgcttcccaccactaccatcactgtattcaccgccacctcctccacctccaccaccacctccgccgccgtcgttcccgtggacatttccgccgttacctttcttccctcctggttcttcagggccatctcctccacctttgagtcgttctcgtaaagatccaggcacttggtctccttccaataaacaaccataaataaagtaaataatagttgcctcctgggaaggataatgtgcaatgcaaaactctgtgttacatggattttttttttcttttttacatctcctgagctgtatgaacacgaatgtaagtttctgcctgcgcccaatacgtatatgtatacataa

SEQ ID NO: 26472 - DNA, 505 bp, Sorghum bicolor
  Clone ID: 30974899
tattcgacacttctccctggtgttccggaagcccaagcgcgaatgctcgtcatcgcttcggtcgccacgttggagaacctcaataacggtatggttcgtccgaaggaaagactggacgccgaactgttctatttgcaacgtgctttgtctacacccgtcgaagggcgcgacgctgagtacccgcgctggacgttactcaaggagaaatacgcatcggtcgttctatcgacggacgagaaatcagaaggcggcgcactttcagtcatgcttcggttgtctttccggtttatcggcaaagaagtggtgacaaggacccttcccagcaccttgacgatagcaaagctgaagagtctgatcaacaccgtttggaaggacgccgatcctcgaaaacagcagctacgcttcactccggcggacgcttgcggtgcacccccgcaagacctgaacgacgatttgtcgactctggggtacttcggtgtcggcgatggtgccgtgatagacgtta

SEQ ID NO: 26473 - DNA, 686 bp, Sorghum bicolor
  Clone ID: 30974907
aagatcggttcctatgctgtggttggcaatggctctcatgtttgcatatctgtcgatggcagaggcacctatttcctggacacggcaaggcacacatgggacaaggtcggcgactggactcttcccttcgttggcaaggttgagtatgtgcctgagcttaaactctggtttggcatctctgcctatgaccagcatttggctgctgctgacctctccaccacagactcccagccacagctagttcacggttggatggagtttcagcccccagaagaatggtttcaacatggagaccctcaacttgtgaaccttggctcaggcagattttgcatcgcaaggttcttcacaagtttctttgaagatgactatgcccaggaggtttctgtcttgaccggtctggaggtggtcctgcgtgaactcaatggcaatggtaaagtgaaactcgaaatggtccgtcacaaatcgatgcgtcacacctctattcctggctgccgaaattccatcgatttagtgttctaatgagtctggggctttgcttccaaactctcttgtcaccatgtgcgctctgaataattctaggactggacagttaatacagactatgtgtgcttttgtatttttcttttaaattttaaggacttgcatgtgaagtctcagcgttgactgttaatttagtcgcatgtatt

SEQ ID NO: 26474 - DNA, 604 bp, Sorghum bicolor
  unsure (1)..(604): unsure at all n locations
  Clone ID: 30974921
gcgaggaaggaatcaccnggcagcgcggtgggaaaagctctaccntccacgggngcacagggcaggcggccctgcagccatgcatggaggccgcgtaccgggtctgtttcnggctcatgcctgngatctggggngagagggacgcgcgngcgccgcngcctcgccggatcccgtgcgtcgngcgaccgngatggtgaccagcgngttccagggtttacaagtaatgtttgcgcaacaataatgaattaggtatacactacaagatggcaactgaggtcaatcaaaacttttttgcatggtcacaggaggaaacttccatgcaagatctttcacagggaacatcgcaaatgtttggtcatggttccatatcttttgggagatttgacttggaatcattanaatgggagaagtggtctgtatttaccaatgacaggcgtcatgaagagtttggaaagttcaatggattagtagcgaagaagaaggcatactttgaagaatactttaagaggattagggagcttaaggctttacagcaacagaaccagcaaactgagcttcatctagagtactgtggtgatggcagcgattctagccaaacaggaga

SEQ ID NO: 26475 - DNA, 377 bp, Sorghum bicolor
  unsure (1)..(377): unsure at all n locations
  Clone ID: 30974923
aagtaacagtttctgtactttattggagagcatgacaagttttctgaccgcacttcgagatcggtatggtgcggttgacaccactgcttacgccgagagcgattttttggtgagcacgcaaaagaaaaagatccagaagaagtgggagatggttggcctggaacaaacgcgagagaaacaatcgcaacacgccaagctaactgtggtgagccttcctcnngctggtattcaagtcgccgaggaagccgcaggtgaaatcgcagaggccaaactcgctcgattgcgagacttggacctttcccacaacccatttgcatctttctctgaggtcgagcgcatcttgctcagcttgccgtcnctcaaggagcttcagctca

SEQ ID NO: 26476 - DNA, 617 bp, Sorghum bicolor
  Clone ID: 30974934
tggaatatcctttctactcccctcccctcccctctgcgccgccattctggtccggcacaggtggagcagcacgccggcacttcccctcccggagcgggcttctcaggctcaggctcctggttaggtcgttcgcacaggatttgttagtcggatcggatctctttgctgccttcttctggagatttttcagatcgaacttggagttgacgtccgatcaaccatgagcggcctctcgcggcgttttctgaatctgatcgttaaaagccacgattcagccgttagatcgctgcgctgcatcgacctgaagcgccttcaactctttaatccaacgataccaccacgaacgccgccgcgtaccatgcagacctttgggcttccctctccgaaccccaactttaaggcctgcagcgcggatgctgtggacaagcagggagttgcctgctacacacttgcacaaggaaaggtgctctgcacggatcagtgtcggcgcaactttctctatgatgccagcacgcaccaagtggtaactatgcccgagttccacaggcctaggttgaattccctctcgctcttcatccccagtggcgaaggcaaagacaaagacgacaacgaccgtg

SEQ ID NO: 26477 - DNA, 589 bp, Sorghum bicolor
  Clone ID: 30974938
tactgttatctttatttaatggtccatgcatgcgaccaaagattcgatgcgagaaattttttgcgaactaaacaaggccatgttcatgaagaacacatgcatagtagtaccttttcatgtaccaccttgctaagtactccagtatgtagttttaagtaaagacaaaatgattagtaggttcatgcacactttttcgtgctatgctagattattttgggacgtccactagctagctaccagaatattccagtcgttccattattgatcgtcaaccattagatctgtttctagctagcttcgtgaattggcaagagcagtacagtactacgtagtccgtacttcaataacacacagatcgacacagacagtacaaaaatatcacccgtctagaattacctgagaaatatatatgtttctgagctcaaattcgtccagaaaaaaagaaaatgtgaaatctgctgctactgtcgcctgatgtctccatccatctctgatcccctgaatcaacgacaggctagagagggtggaggtgaggaggcctcggagcctcgccaagatcttcggcacggccgtctgcgtgagcggcgcc

SEQ ID NO: 26478 - DNA, 173 bp, Sorghum bicolor
  Clone ID: 30974995
gcacaggatgatgacgatgtccctgagcttgtttcatatccattgttgtgaagggtcacttggtttaagtgtttccgttacccatgggagagccctgttcatttatgaattttgacatccctcattggtttacatgtgctccagttttttacctggagtgtgtttcgggttcc

SEQ ID NO: 26479 - DNA, 599 bp, Sorghum bicolor
  Clone ID: 30975053
atagaaccccatttcagctccagctcaaaggacgaagactcctccagccttgagaccattgtgaagtgcaaggaagctgaggcaaaactgttccagaaactggccgatgatgccaggaaggaggtagacagctaccggcagatcgtgcgcgccaagacccagaagctagaggaggagtacgccacgaaggtggcgaagctgtgcttccaggagacggaggagaagaggaggaagaaagtcgaagagctgaagctgctagagaactcgcactacgactaccacaagatgaagctgcggatgcagaccgaaatccagggcctgcttgagcggatggaagccacaaagaagatgtgggtataggctccagttaacaattgtgtatgttgctgctgctgaaattatcttcgggtatagagtccagctaacaactgtctgctgctattgctgaatacctgaaatttggtgttgttcattaggagagattgtccattgttgtatttttttttcaccatcttgtgttataatctatacctgctgttgtaactttgtaagtggatgcctagccttgcgcttgctgatataacttgccagcattcatc

SEQ ID NO: 26480 - DNA, 594 bp, Sorghum bicolor
  Clone ID: 30975072
gtgtcggaccccgtgcctgccatggctcaggtcctgcaggattttcctagtgaaaccctggaggtgctgcgggagactgtgcggagcatgattgatgccccggagaagagggacgagctgtcaagcctgcagcggaagctggagcgtcgttcggacctgactgccgaggtattggggcgtgctaacaagacgcagctggagatcctggtggctatcaagactggtatgaccacttttgttactggtaagggacgagtttcgagcagcgagcttgtggagacgttcctactgaaacggtgccgcaacatgaactgcaagagtgtcgtccctgtggacgactgtgagtgtaagatttgctccaccaagaaggggttctgcagcgcgtgtatgtgcccggtgtgccacaagtttgattgtgctgcaaatacatgcagctgggttggatgtgatgtctgctcccattggtgccatgctgcatgcgccctggagaagaacttgataaggccagggccgacactgaagggggcgatgggcacaaccgagatgcagttccagtgcctcggctgcaaccatgcttctgagatgtttgggttt

SEQ ID NO: 26481 - DNA, 546 bp, Sorghum bicolor
  Clone ID: 30975104
atctcgaatcaagtgattcagaggatgaattagatggccaggttgccccataccgcttaatggagaaaagggacctagcgaagagcattcttcttgagctggagcgcgagcatcatctaaaagttcaagaagaagttagaaataagttagcttcattggaggtatgccaccaaaatgaaattcagagaacaatttctgcattcgcacggcttcagaaatatgcagaatcaagaaaagagatagacagaagactcgatgtacacttccagagaagaattgcagaagtgctcgataaacacttatctatggtccaaagggatcatgaacaaaaatcccagattgttgaacgtcgaatcagagatgatgcagctcttgaagaagctaaaagaaaagagcaagctgtcaaggaagaaaagttaaggcaggaaagagcccggcaagaagcagaggctaggcagaaggaagctgcaaaattagcagctgaagcacggaaaacagcatttgaggctgctaaaaaggaagcagcagaaaaggaagcagcggaaa

SEQ ID NO: 26482 - DNA, 142 bp, Sorghum bicolor
  Clone ID: 30975166
gagaagtggccaaggcacccaagcccaagagactcctcaagcccaataccaattcccaaagtttgccagagtaactatatatgacgagaggagtgtggagagagaacatatgaaaatttgtatccaaaactggaaccaatat

SEQ ID NO: 26483 - DNA, 242 bp, Sorghum bicolor
  Clone ID: 30975170
ggtttttttcaaaccccggatcacccttatgaagatgccccgtgcaggataggctaaatcagtggtgtgaagattcaatatattatatagattagagtagatttttactgtttgaggcaaagttggtttgtgcccctacttgtgatattcctaactgttggtgccatttttgaacttgatacaacgtggataaattgtattatacttgtcatttgaagaatttagtaatgtgtgcctcgtgt

SEQ ID NO: 26484 - DNA, 692 bp, Sorghum bicolor
  Clone ID: 30975177
gggatcggtgattggcgagccatggagcaggatgatgctggggaccacgaggaggacgaagatgatggggttcatacacaggatgcatgggaagatgttgatccagacgaatactcttatgaggagctaattgcattgggtgaagttgtcggtacagaaagcaaaggccttgctgctgatactattgcttcattaccttcggtaacttaccatgcacaagacaagcaagatggcaacatggaacaatgtgttatttgtcgtgtggagtttgacgaaggcgagtcattagttgcacttccttgcaaacatccttatcattctgagtgcataaaccagtggctgcagttaaacaaggtatgcccgatgtgcagtgctgaagtttccacctctgcgaacaatgtgaacaagcaggcatgactattcaattggaagaaaatagcggcggcttgatttatctgccattgctgaaatgaaagtagtgccaactgttgaattgttctgataagcaagggaaatggatgggtctgtttccctgttttctttagttcaacaggcttagtcccccctgtacctgctgctaattttatggccctgccgctggttatttatgcattccattagacttattcattcatgattcattgcttgtagatgtaaaacaacaatcataccaatagccagtagccatgttt

SEQ ID NO: 26485 - DNA, 633 bp, Sorghum bicolor
  Clone ID: 30975190
gctgcagttaaggagaggaaaagtgatatgcagtccaaatctagccatactggaaagaaacccaaagcaaaatcacatagaggtgctagggacaacttgcccgaaggatcttatggaagcaaggaacaggacacattggagaatggaagtggctttggagatacccgaccaaaggaaaaaccatggaaatatgacagtgagagggattctgatgcacctgggatctcaaggagggagatttcttctagtgtaaagcatgacaagcacttggcttctgaggagcagaagatgcatatacctccacctgtcactgtatcaactgctaatgcagctcctacacatgcagccccagttgtaatagaggaacattgggtgagctgtgacatatgcgataaatggcgtctcctaccttatgaaatgaatccttcaaatcttcctaagaagtggaaatgtagcatgctatattggctacctgggatgaataggtgtgagattagtgaagaggagactacaaatgctctgaatgcactttatgtccctgcccctgcaaatggtattcctgcagtcggtcatcctcatgttgcttcatcaggactagtaacatccaacattcccaatatgaatggacatatg

SEQ ID NO: 26486 - DNA, 737 bp, Sorghum bicolor
  Clone ID: 30975192
gaatattatggctgattacccaacggttgaatgtacttcctcagtgatggaagctttggtactatttctggaggtaaatccagagtaccgcagtaaagagataagagagtatgtcagcaaagctgccacgtttatagagaataatcaaaagaaggatggatcctggtatggcacttggggcatctgttttatctatgggaccctgtatggaataaaaggcttagttgctgctgggagaaattacgagaacagtatttgtattaggaaagcatgtgagtttttgctgtcaacacaactcagaacaggtggttggggagagagctatatttcttgtgaaagacaggtctacgtagagggtcctagtactcatgcagtacaaactgcttgggcgatgctagctttgatgtatgccggacagatggaacgggacccaacaccattaaacggtgctgcaaaagtattgatcaatatgcaaatggagacaggagattatcctcagcaggaacatgttggaaacaccaattcttctgtttatttcaactaccccaactaccgcaatttatatcctatttgggctctcggagagtaccgccgcagactacttgctaagaatgaatgaaggctactcaagcaattcaagtgtgtcatgctcagaattctgtcataatggagcatatataaatgaaagtgttgtaaagctacttgtcttttctatatgtcatacgagtgatatgctt

SEQ ID NO: 26487 - DNA, 675 bp, Sorghum bicolor
  unsure (1)..(675): unsure at all n locations
  Clone ID: 30975194
gcactgcgccgccgccaccgccaccgctctgccctgtccgctgctcgccgctctcttgcccgctccctttcccaacgttattgacccacgcaatcggaccggcgcacacgacgccgccctcccatctctcgaatcccaccgtgctcagcgcgatggacggctcatccaagcggatcgacggtggcggcgccgagaagcccagccccgacaacgaccagaaccagaacgctagccccaacgtaccggcggcgtccgccgccggagacgacggcgcctcggtcgctgctgcggcggcggcggctgccgcgccgcccgccgacgggaggcggccgttcaccagcctcagccaagaggaggccgacctcgccctcgcccgcgttctccaggagcaggagcgggcgtacatgatgctgaccggcggcgagtacgcgatctcggacgccgggagctacgactacgacgaggagggggaagatgacgacgatgggagcgactacnaggaggaaggggaggcgctcgacgaggacgagcaggttggggacgcggaagcggagggggccgagggggaccaggacctggaccttgaccctgcgcagtacgaggacgacgaggccttcgcgcgcgccctgcaggacgccgaggagcgcgacgtcgccgacaggctcatggcgctcg

SEQ ID NO: 26488 - DNA, 697 bp, Sorghum bicolor
  unsure (1)..(697): unsure at all n locations
  Clone ID: 30975199
ttctggtgcttcacaggatggcttacatgccaatagctttcctttatggcaagaaatttgttggtcccattacaccaactatattggcactaaggggtgaactctacagtttgccatatgacaagattgattggaataaagctcgtaagacttgtgcaaaggtggacacacgctatcagctttcagcaatattcaatgccactgcaagttgtttgaacacgtttgtggaaccattcttgaactgttggccgcttaacaagttaagagaaagagcactgagtcacatcctagaacatatccattacgaggacgaaactactcagtatattggcctacacccagttagcaaggcactgaacattatagtccgttgggtagaaaacccaaatccagatgtgctcaagcgacatattgcaaggatacatgattatttgtggattgctgaagatggcatgaagacaaaaatatatgatggtacccaaaactgggagatagcacttataacccaggccttcttgtcggcagatattggcaatgattacggttcaaccatcaagagagctctcacatatatnaagaaagcacaagttattagaaatcctccaggagacccaaattattggttccgacacagatcanaaggctcatggacactttcaactgtagataatggctgggcttcaagtgactgtactgc

SEQ ID NO: 26489 - DNA, 701 bp, Sorghum bicolor
  Clone ID: 30975211
ctgggagggagggaagaagggagggaaggagggagcccgcgtccgcgtccgaatctcgcgatccccaatccggaggcctcgattcgccgatccgggcgcgcccgggggagagatcccgccgatcggggagctcgtgctgctccgattcgagctttgctccctgccctgctctgctcgcgcgggccggccgcccagcccttcctgctgacgtcgctcggccgcccgcccgcctccgcgccgggccgggagcacctgctgtgtgctgcctggtggtagaggtaggtaggtggttacgcgaggcgggggtgcacccgggtggatgctgtccgtgaggcggcggcaggaggatgcgggcgtccgcgtagccgcagcagcgccggcgcagcagccccggggtggactcggtatggacgacgacgccgagctcgaggagggggaggcctgcggggacgacaccgccttcgtcgaccccgacgtcgcgctctcttacattgatgaaaagcttcaagatgtacttggccattttcagaaggactttgaaggaggtgtgtctgcagagaatctagggtcgaaatttggtggatatggttcatttttacctacgtaccagcgctctcctcttcctcaaactagaagtccaccaaaggcagcaaatgttacctcgaaatctcccttccaccagtctagtgagggcatgtctc

SEQ ID NO: 26490 - DNA, 617 bp, Sorghum bicolor
  Clone ID: 30975220
aggtcgcccagcgcacgtcgacccaagaaccccagagaatcgcccgtcagccgtcgccacgctgcgccggggccaagaaatgcttctcctgctcctcatcgctgtcctcaccgccgtcgctgccttcctcctcttcaagttcgccaccgtcgtcgatggggacttgacgctcgtatcccgcggcccgccgcggcgggatagggtggacggcaaggttgtgtggattactggagctagccgcgggattggggaggttcttgcaatgcaatttgcaaatttaggagcaaagctgatactatctgcacgtaccaaggatgagcttgagagagtgaaaaaaaacatcctcagcaagaatccagatagcagagttgaagtgttacccatggatttatcagctggtgaagaatctctaaaagaagtcgtacatgtggcagaatcatttttttctaatgcaggcgttgactatatgatccataatgcagccttcgaacgtcctaaacggggggctctggaagaaagtgaggaaggtcttaaggctactttgaatgtcaatgtctttggaactattactttaactcgccttctagcaccttacatgctggatagaggaacgggac

SEQ ID NO: 26491 - DNA, 744 bp, Sorghum bicolor
  Clone ID: 30975235
attataaattaatcaaacaacgacttagttcaaaagagttttgtttgttaaagcttacacgcatgatttaatcagtaaacacccaaccccaagtgttgcctaagacaagaaacctacttaatgacttaagtaagaagacaccaatttaaaatgactagagagagacacatttaataccaatctactgaggatttttcagatcaggtcaggataggaggacccgcctttgctagacattgaatgcccgccccgcccaggaactaagaactgaggaagacttttttggcgatcatgcatgattgagactttttgaagattttggagattttgccagtgaaatttaaaaagggcgcgattgcattgaaccaacttaaaaatccattttacggatatttaatcagacttttgaagaagactaagacgacttaatgctaagctacgtagcagatttaatggaaatgcttgagtgttgatcccagtttggtcacaaaagattggcagctctaccattatggcagaatcagcttcgcacaatccaactcgagtcaatttccaaatttaatttcaatttaagcttgtaccaatttaagcaggctagccagaatttaaatgatggtaagatgaggatgttgtctaggcgtaggctacttatgcaatagctacagaaaaaatagctaagctgtatcaagtagtttatatgtctatatcaatattagatacgatatatactctatatccttatct

SEQ ID NO: 26492 - DNA, 226 bp, Sorghum bicolor
  Clone ID: 30975249
tatatacatacatcatcggcttcttgtgctttctttacgccggcgccgcggtgtctttccgattggcatcgatcgacaggagagctatagctagggtcgatcgatagacgatgggggtgcatgcgcatggggctgttgccaaagccaaaccctgcagcagcagcagcagcagcaggcggcttttcctcttggctgttgtactcgtcgtcctcataggtagctactg

SEQ ID NO: 26493 - DNA, 634 bp, Sorghum bicolor
  Clone ID: 30975250
attgtgcatggaaattttgctgaagcctgctttccctgcagctcactgacagagtaactgatagaggagcagctccgccggagccaggagctttctatatggaagcggccgacgaggagaacgctttgctgcttcatctccaacctactccgcaggctgtagcctcggggtacgcaagtgatggatcagttgacatcaacaaacaacctgctctcaagcacagtacggggaactggagggcatgctataccatcttaggtgttggattcagtgagtgcatggtgttctctgcaatcgcgacgaatttggtgaccttactcaccactgtgctccacgagagcaaggtggatgcagccagaaatatctcctcctgggccggagtgtgctacctcacaccacttcttggggctttcgtcgctgacagttacttgggaagatactggaccatggtcgtattcctcccagtctacatcgtggcaatgctcgtcctgatagcttcagcatcactaccaacgttgttccacagcgatgttcaccctgcagtggtttaccttggtctctaccttgccgccattgccagcggcggtgtgaagccctgcatctctgccttcggggctgaccaatttgacgtcaa

SEQ ID NO: 26494 - DNA, 510 bp, Sorghum bicolor
  Clone ID: 30975326
gagggagctcgcggagagggccgtgctggcggtgcccttcgccacggacgggaacacgcccgagctgcggctcgacgacggcggcgacgaggacgtcatcgacgccggcgacgacgttgccaggaggagcaagaggctgtggcagctcacgccggtgtacataactgaatgggcgcaatggttagacgatcagaagaagctggccggcgtgccatctgattcccccgtgtacctctccctccggatggacgggcgcgtccgcggcagcggcgtggggtacccaccgtggcaagcgttcgtggcgcagctgccgccggtgaaagggatgtggtcgggtcttcttgacgggatggacggcagggtgctataggccaacaacgtgatgactgataagcagccatcccgtttttccgtacctactagtttagctagatgtgaccagtgcttacaacgatgtgtttattacttgttcataagagttgaaattgagaaagcactgctttgtgtata

SEQ ID NO: 26495 - DNA, 540 bp, Sorghum bicolor
  Clone ID: 30975379
tactggacaaccgaagaagcttcgacacccaaaatcctccccgttccttccttccctctttcccagtcccagagtcccctagcaccagcgatgaacgccgtataaaccacaccacggcccccgctttctcccccgtgtgatttcgtccccgcccgccccgccccccaccagatctgctccgccgccaccgacaccccctcctcgcctgctcctcgccggagcagggccgggcgccacaaccgacccatcgcccaccgcagatcctactgcagcggggcccagatccgcgcgccccccgtcgatccagatccatggcccgccccgacgtgctcctcctcgtcgccgtcgcggcggccgcgctgctcgcggccgcggtgccgggcacccaagggttctacctcccggggagctacccgcacaaatacaaccccggggactacctcaacgtgaaggtgaactcgctcacttccatcgacaccgagatgcccttcggctactacagcctccccttctgcgagccccgagacggggtcaaggaca

SEQ ID NO: 26496 - DNA, 483 bp, Sorghum bicolor
  Clone ID: 30975399
tctcgcgacctctcgaaatgagcggaaccgggagcagtgtgtagcgcgagacgaacgccgccgcgaatccaaaccctagagccgggaggaagacggcgagcgaacccagcaacgatctctgacctccgaaatcctagcgcggcggtcgccgcggtcggatctcgggggtgacgaaggatgtcggattcagcatcgatggcggccgccatcgaggcgcggttcagcagccgcgacctcatcggccgcggcaacttcggcgacgtctacaaagggtttgacaaggaattgaataaagaggttgctataaaagtcattgacctggaagaagctgaggatgacattgaagacatccaaaaggagatatctgttttgtcacaatgccggtgcccatatattactgactattacggctcttaccttcaccagactaaattgcggatagtaatggaatacatggctggtggttctgtagctgaccttctt

SEQ ID NO: 26497 - DNA, 737 bp, Sorghum bicolor
  Clone ID: 30975400
tggctgcccaaatgaatgaatgcactatgatattactgcatatatataatttgttgtagtagtctcgtttaggttttttttgtctgtttttatttaggcattgtttggatgatgtcggattcacctcaatccacatatgttgaagtggattgggatgaaatttaggaaggaaaaaaggattgcttaataaaatagatactaaaatatatatgttggcatgtgttgatgcatgtgcaggtcacccttgcgttacagccaatgttcaagcgatcggtgacgttcctgacgcgcgacgactcggacatgacggagaaggtgtccgtttggggacgcctccacgagttcggcgacatgacatggctaccataccagcgcaaggtcgtgtaccgccaggatgaccgcgtcgacgtcgccactccgggagacgccatcaacgacttcctcggcttccgcgcccaagctaagcttagccaattcaccgccaggctcctaggtactgcatatatatttccatattggttcacgccttccattccaaattataagtctttttggtacattctgatttactatatatgtagatataatatataatatatctaaatacggagaaaaatagatgaattaaaaaagtcaaagcgacttataatttggaatagagagagcatatatagtattgatcatatactctgcctacatatagtttattaaacggtcacatgcccatatatattgat

SEQ ID NO: 26498 - DNA, 405 bp, Sorghum bicolor
  Clone ID: 30975409
aaaaaaaaaaaaaccagggcaagcggaaggaggaaatcaggaagaatccgatccatccaactatccaagccaagcaaaagcaggactacagggaggatcatcggccggagtactgcgtccgtccatcgatcgagtttcaccgaagctagcaaaaaagaaaaagaaggcaggcagccatgtcggaggggacggccaactgcgtggacatcctgatcgccatcatcctgccaccgctgggtgtgttcctcaagttcgggtgcgggcaccagttctggatctgcctcctcctcaccttcctcggctacctccccggcatcatatacgccgtctacgccatcaccaagtagttgtagtcgtcgtcgtcgtcgtcgtcttaattagccgctgctcctgctgctgtttgtt

SEQ ID NO: 26499 - DNA, 585 bp, Sorghum bicolor
  Clone ID: 30975422
gtatgatggtgaagtgcgacccgcgtcacggcaagtacatggcgtgctgcatgatgtatcgcggtgacgtcgtcccgaaggacgtcaacgccgccgtcgcgaccatcaaaacgaagcgcacgattcagttcgtggattggtgtccgaccggcttcaaggtgggcatcaactaccagccgcccaccgtggtcccgggcggtgacctcgccaaagtgcagcgcgctgtgtgcatgatctcgaacacgacggccgtcgcggagtcgctctcgcgtatcgaccacaaattcgatttgatgtacgccaaacgtgcgttcgtgcactggtacgtcggtgagggtatggaggagggtgagttctcggaggcccgtgaggacttggctgccctcgagaaggactacgaggaggtcggttcggagtccgtcgatggcgccggtgagggtgagggcgatgaggccgccccgcaggacgccccggcgggcgctgacggctaaatgcaagtgcgcgagcgcctgcgtttttctctcgctcttttctcatctgtttggtgcttcttttcgcatcacacacaataaacctgaataaacc

SEQ ID NO: 26500 - DNA, 573 bp, Sorghum bicolor
  Clone ID: 30975441
agagtgacaaagccttgcctagctgcttatgcccacctgtcaacagaggacttcaagaaggatttagaagagtgccagcggttggagcccacagataacacaaaccttgagcttgacagcactaatgagtttcgactgagccaaattgaattttcacaggatagctttacaacatgggcagttggcaagatgactgacgactgacgctgctctgctgcactcctggcaccgcttggtacatgaagaaacagctgatctgttttttgtgagaccgcagtgaaatctgcaccaacagtggtctcccttttgcattgagttgctctggtgcacatgaactgctttatatgaaatatgaaaggccgaggaatcatgctgtaccactgtgcagtactgttcagtgtgagattggcctttcttggttgcatcagcttgtacattttgtaataaacacctttattttagtcggcagaccaattgcctgtttggaatgggtattgctctactaattttaggatatctaagggattggcattttagtctcattttaccatgcaggtcctgatgaaccaaagc

SEQ ID NO: 26501 - DNA, 490 bp, Sorghum bicolor
  Clone ID: 30975449
gtatgcaaactggcaatggttcaaatttctgcatcataactaacctggtgacaacagcaacagagatcttccatagttttgaggaaattatggatcacgtcaaagagtatggcacctaatgtagcagaacacatatctgtcaattgttgactatgcaaagctgaaccatcactagaggacctgttgaagtcgaatactgaccactggtggtagcactccaccctccataaccgagcatcaatcatggagaagtatactggacaggcaacttcatccggcagccaaaataagggaaatggttcctggctgcagaacattggtgtttcgaattgcctcattcctagttccccctggagtgaaatgttgtaatatcattttatctgtctgtagaatgtagcttcattgcattcatattctgtcaaacacgagtcagagcactccgtggcaacaacacggatctgtccatgaaatagtttaagaaatttggctc

SEQ ID NO: 26502 - DNA, 266 bp, Sorghum bicolor
  Clone ID: 30975454
agaaaatttgaggctcccattccccccccctctggtccccgttttcggcccttcagagagaggaattaatagctcaccagatctgtcatttggttaatagatttgactatgtctgctagatcatagttttgcgggtctcttttgctcctctcataagctagctatgagttaccaatgctgggaactagatcatagctagaatgcttagattgtattataagccttgagaagctttttaggtgtaaataaaccaggtgctcaagttg

SEQ ID NO: 26503 - DNA, 532 bp, Sorghum bicolor
  unsure (1)..(532): unsure at all n locations
  Clone ID: 30975469
ctggctctctctgattttcgtttttcattttagacttaggttttcttaccaacgtgagcactagagagatccttagactgttctgtgtattgttgtgtttggaacctgtgatctgatgggaagtgaggcccttacctcacgttgccctctggggttcgtttcctggtgttgggtgttctgagtctgctgttcgtgactctcgtttccttcctgcttcttgcttcttccatttgtggagttgttttggtgggtttcgattgatccatgacgagctatgacatgtgctgagntnntttatttngggaatcacttcaatttcccatgagctcatagatcgatccgatattcggtttggggagaaaaactcgntctttgtccaatcaaaatattttctggagtttgggtcagtctcaaacaataatttttgtggaatagaatcgtggcctgttgaatctcatttatccaaattttgggaatgaatcgttgagtccttgtccaggtttgtgggatttttggagccgctttcctctgc

SEQ ID NO: 26504 - DNA, 576 bp, Sorghum bicolor
  Clone ID: 30975505
cctactggacttttcaaaagtttgttgatcgtcagctcctctctgctgtacgatctcgtacttttaaagcacaaccaaagctaagcaaccatgcgtgaagttatctccatccacctcggtcaggccggtgtccagatcggtaatgcctgttgggagctgtactgcctcgagcacggcattcaaccggatggtcagatgccgtctgacaaaaccatcggcggtggcgacgatgcgttcaacacgttcttctctgagaccggcgccggcaaacacgtcccgcgctgtgtgttcgtcgatctcgaaccgactgtgatcgatgaggtccgcaccggcacgtaccgtcagctgttccacccggagcagatgatcacgggcaaagaggacgccgccaacaactatgcgcgtggccactacacgatcggcaaagagatcgtcgacctggcactcgaccgcatccgcaaactcgcggacaactgtacgggtcttcagggcttcctcgtcttccactccgtcggtggtggcacgggttcgggcttcggctcgctcctcctcgagcgtctctctgtcgattacggc

SEQ ID NO: 26505 - DNA, 413 bp, Sorghum bicolor
  Clone ID: 30975536
gccctactgaacgcctgcaatgcaaggctgcaacggacgaaatgccggcgccgccgctcccttccctcccgaagccgcaacccatcctccacgtagccaaagccctggtcctgtcccctcggcaggcgcagccccaggctcgagggcgaggccgagcccagccggtcatgtgcgccagctccaagcgcctcgacgacgcgctctccgccggcttcgtccgcctcctcaacgccggccacgtccaggatgcggactctgctagcggaaccgaccggcgctacgaccccaagccgggcgacttcgcggtcggggtcgtggtctccggcaccgaggcgcgcctcgacgtcgcgggcggcgccgaccgtctcgccccgctgctcgccaaggagcttctcccgctcgaccgccacagt

SEQ ID NO: 26506 - DNA, 252 bp, Sorghum bicolor
  Clone ID: 30975550
tgttatatatatacaaagttgggtgggtttaaatatgaggtatagtgcagagtccaaatatatagccatggccatgcatgtgtgtgtacaggtttttgtgcttcagtgcttgattatagcccacgtgggagaagatatgtcccctgattttggataaagtatggggagagatagatagatagatagatatggatggcaaagactgaacatgttgaataatgcccccccaatgtatgcatgtatacatgtgat

SEQ ID NO: 26507 - DNA, 650 bp, Sorghum bicolor
  Clone ID: 30975563
gccgccagggaagctactgtaccagattcccaacccacagaaataaatgctaagcgagagaaagatcatacgacatgcaaggctgatcttccttgtgaaagatggtggaaaaggaaaacgacttatctatttcatcatataaaaggagtgactacagtctgctcagttgtggcagctggtgctgttgttggttttgttgtaatgggtcagaggtggcagcaggaccattggcaccttcatcaatttaagttcagtgtcagtggtgagagcatgagtcgagtcattggagcattcagtcgtttgagggatgggcttcccgggagtgagcagctaaggtctctgctgccgactcgcgtactcccgcaacagccactgagcgcttgagcacaggcaccaaattttggtggcagggactgcttctagtggcaatttttgttgcttatattatatatgattttgagtcagttcatttttttcttgtgctactttattttatcttactgtaaattagatcgagattttcatggtgctggaatattattatctttagtacgtagcaactgtaaagtacatggtggaaacacagggggcacagcaacaatatgtgtaattctgtatccggtcttgttacattacaaacctgttttact

SEQ ID NO: 26508 - DNA, 525 bp, Sorghum bicolor
  Clone ID: 30975603
gatacatggcacgctacaatgcttctttggctaaagaagcaacattagaatatgtaaagcttgccaagaagcatgggctaactccagtccagcttgcccttggctttgtgcgtgaccgtccattcactgctagctccatcattggagcaaccaccatggaccagttgaaggagaacatcgacgcgtttaccagcactccacggcccctaccacaagaagttcttgacggcattgaggatcttttcaagagatataaagatccggcaatcctctaggtgttcattcaccattcctctaggtgttcacttgccattttgacaaagagaaacagcaatcctcagacaaaacatagacccagcaaacatattacaacttatgatcataccattttttttcatgctgatacaattattgctttgatcttccattggctctacagataataccagcagaattgtttttttttttccttttgttgtataagtagaatgtaggttttacacttcatacaattataaagtgaat

SEQ ID NO: 26509 - DNA, 561 bp, Sorghum bicolor
  Clone ID: 30975605
tccataccctcaaatagccagaggataccaatcatcactgtggacagattgttggaggctagaaatagcagggacggcagtgatatttcttccccgccgcttactccgctgtcactgactgatctgtcccagcagcaaggaacaaaaacaactacaagtcgcacaaggatgaatggagccttatgacacacaccaaccaaatccatactgatcttagttgattttgtaagtagtgatgtattgtaggttcatattcattatattctttcattcattgtctgtgttgcaaaggaaaaggacggaaaaagtaatatatactggttacataatgcaagaacatcgaacctccggttcagttttctgtgctagtgtcagatgaaaggggctgtttcctcagttccgttttgtttcgtttttggatgaattttccatttcttgacactacatgatttgggtccagaatccagatcgtatgggtgaagagaaatgaaagtatgaaaccctgtacagaagcatgatgcatgctggtaatgtaatgttatccttaccattcttctcgac

SEQ ID NO: 26510 - DNA, 686 bp, Sorghum bicolor
  unsure (1)..(686): unsure at all n locations
  Clone ID: 30975623
atcgtgtcctccctcactggcgtcgcgcaccaactccannattcctcctcgtctccgagcccccacgtcaacaacgcccttcgccgtcgagatctcacgcgcccgagcccgcgctcggcccctcgcgcctgcggcatggcgacgcggaatcggacgccgctctaccgcaagcaccgaggacccctccagaggtgctgtgacagtcgggctacccccagcctgggtggatgtttcagaagagatatctgcaaacatgcagcgggcaaggacgaaaatggcagagctggctaaggcacatgccaaagccttgatgccatcctttggcgatggcagagatgaccagcgagccattgaggttctcacacatgaggtaacggacttgctcaagaggtccgagaagaggctgcagaagctgtccatgaaagattcgtcagaggattcaaatgtccgcaagaatgtccagcgttctcttgctacagacctgcaaaacctgtcgatggagttccggaaaaagcagtcatcatatttaaagcagcttcgccaacaaaaagagggtcaggatggtgttgatttggaaatgaatataaatgggacgaagtctacatttgaagacgacgagtttgacgatgtgggtttcactgaggttcagatgtcaaaacttaagaaaagtgaagcgttcactagag

SEQ ID NO: 26511 - DNA, 498 bp, Sorghum bicolor
  Clone ID: 30975627
ttggccacctcatccgcctcgtcggcttcggaaaggtcatcgccgcggccggcgcctcctccactcgcctccctctactccagcaattccattcttgagctcgctagccgcgcttctccggttcgccggttgggttcggcgggaggccgtgaaaagggaatttcatcagtgtgcaacaaatggccatgccgtcgttcgccgtaacctcccctccatcgcatggtggtaccttatcagcgctccatgctcgtcatcctcaaagattgcataagaggaaagttcacagccaagtcaaggcagtggcgcaaacacagctgcagtaccagaaacttggagattcagacctccttatcagtgaggtcactcttggaacgatgacttttggcgagcaaaacacagagaaggaagcacatgatattatcgcttattctttcgatcaaggcatcaatatcctagacacagcagaaatttacccagttccagtcaacaaggaaactc

SEQ ID NO: 26512 - DNA, 564 bp, Sorghum bicolor
  unsure (1)..(564): unsure at all n locations
  Clone ID: 30975629
tccaaaatccaaatccacnggctagctntttacgcnttacgcaaagatcagaggccagaggggnngattggttgatcgngggcaaggggagcgtctggttgcaaggacgcacgcaggagattgattagagggagaagaaaccacacaagagagagtgctcaatcatatcgccggagggaggagatgaagtcgccgttgcggaggctcaggggcttcggccaccaccaccccaaggagcggaggggccacgagccgccgccggccaagctcgacgagctcgtctgcgccgcccatgaggtggaagacatgagaaactgctatgatggcttgatttcagctgcagccgctacaacaaatagtgtatatgagttttctgaggctcttgaggaactgggtggttgctttctcgcaaaaactgcactcaatggtgatgatgatgatagtggtagagtgctgatgatgctgggaaaggtccaatttgaattactaaagtttgttgatacttatcgctcaaatatcatttatactatcacaaccccatcagagtctcttctcaaggagcta

SEQ ID NO: 26513 - DNA, 352 bp, Sorghum bicolor
  Clone ID: 30975637
ggcgcccgtcgcgcagtgctccaccgcgtcgtacctggtgccggacgggctccgcagcgtggcgccctcgggggtcttgtagtccagcacctcgtcggcgcccagccccgcgatgaagcccaggttgcgcgcgccgcaggtggccgtgacgtggagccccgccagcttggccagctgcacggcgtagtggccgacgccgccggaggccgcggtcaccagcacgttcttggggacgttactgtcggcgccggagccggagccggagccgccgtcgaagctgcggacacccgcggccttgagctgctgcagcgcggtggacgccgccgtgggcagagacgcgccttccgccgcg

SEQ ID NO: 26514 - DNA, 399 bp, Sorghum bicolor
  Clone ID: 30975638
cgcggccacagccagcaaagcgccgccgccgccacatccacaaggtggccacaacgagaggccggcgacgcctccgagcagacagcagggcagcaacagccaggagccgagcccgcgacctaccaagcccagacccaaggcgaggcccaaggcggcggctactaagcccaacaacccgtacgactcggctccaagctggccgagccagagatggagctgctcatggaggccgtaagaagaaaataagcatgactctctctcctagcttcatctcattatatatattgtgcatgcacgcagttaattagacacaggcttagagaacatttcaacccttaaagcccagaactcgatcgaaattccaggccgacgtgaacggcaacgggtacctggactacg

SEQ ID NO: 26515 - DNA, 455 bp, Sorghum bicolor
  unsure (1)..(455): unsure at all n locations
  Clone ID: 30975641
aaatttcactntttattgcaaaacttgtnccctacccctngtagaaagataaaccatatgttaactctcatggttgtttgatttaataggatgcatagactagaaggtgtattttctggagattggaggctatggattagttgacatggctatggaacttagcacaacctattagttaaattgtttacttttctctcagtttaagaggacatgataatataatgttgtaagaatcaggatgcaagtagtctcagagaattctataggaggttgtcgactagggtactatttgggtgagggtggcagtcatgttgcatactcgagggaggataccggaccttatatgccaactctttggaattatgaaaagattatatttttgtagttagttcttcattcttggcctgaataatctttgcacatttgtttccttatctcttcagtgcttgctacct

SEQ ID NO: 26516 - DNA, 659 bp, Sorghum bicolor
  Clone ID: 30975643
ggagttccggagtatcggccctgcgccgattccgatcccagctcctccgagcatcagatcattggtcgactcggtttctgatgagagagtaaatgtagatatcgtggcctcacatcaaagtgaaaatggatccatctccacagctagttctactggttcactagaatcagagaaggcagcatatgaatttcttgctcaaactcctgtcaggtcaactgatgcacaccttgttgagttttcagaagccatgagaagtaaggatagacatagtttctactttgattgaagcctaaaatgtactacaaaaatacaaacatatgtagaaccttccatttactactaaaataataatagttataaatttatgttaatttgaagctgttgcaaaagccttacgacgagtggctgaagggaaggctgctgctcaagcagaggcagcagagtggaaacgtaagtatgaattagagacagcgcacaagcagcagagtaaaatcaaaggctacaacagttgtatcagtaacgacttggacaaactggccagccaactaaccctggagacacctgcacccgatcaattaggatgttgcggtaagcatggtatatgtgcacatgaggttctccaggacgaagttcctggacctatcccaagatctaatcac

SEQ ID NO: 26517 - DNA, 564 bp, Sorghum bicolor
  Clone ID: 30975658
cggaggaacaaaaagaaggaaagctcccattgccgaattgctggctctggctcctccccgcccccaactcaatccccccgcgccgccgccgccgccgccgctggcggaatcgaccgaccccgcctcgccggagaatccaccagcgtcggtttcacctcaggtttttatgcatggcagatgacaatgacgtcactggagtgtcacctgtggctgatgaatgggatatgctatccctgacttcatcaatatatgctagcccgttattccgaagaggatttgatccaattaatttgcctggatacggggatgtgattaatattcaggaaggcacacaaactggattagttatgtcagatggctttgtgttccctccaagtgagcatgaaaatttgccaatagaaccagagcatgacaatttgccaatagaaccagagcatgatgaatcaaatacaaacagcgatggaaaggaaagtagttgtgctggaaataacgatgatgactggtgtcatgtatcacctgaagaaattggtggcataagtaatgaaaatctatctgacaacagcg

SEQ ID NO: 26518 - DNA, 636 bp, Sorghum bicolor
  Clone ID: 30975689
gccgatgctcaaggagcgtggtggggctggggcgtcggcggcggcgacgctgtaccgcgcgctgctgctggccatcaccgtcgacgggaaggagctgaacgtgcccgcggaggtgttcgcggcggggacggtgatggactcccgcaccatcatcaccaggctgcccgtgacggcgtacggggcgctgcgagcggcgttcaggaacaggatgaggtaccgcgtggcgccgccgcaggaggagctggacacctgctacgacctcaccggcgtccgctacccgaggctgccgaggatcgcgctcgtgttcgatgggaacgccgtcgtggagatggaccggtcggggatcctgctcaatggctgcctcgccttcgcgtccaacgacgacgacagctcgccgtccatccttggcaacgtgcagcagcagacgatccaagtgctccatgacgtcggcggcgggaggatagggttccgcagcgccgcctgctgatcggaatcttagcttaattggttccttttgcatgttaattgtagtgcacgcctatgcacaaaactgatgagcatgttctgttagtgccagtattgaccttgtgtaatacgtattgttaggcaataatggaaattctattcgtcgagcaa

SEQ ID NO: 26519 - DNA, 597 bp, Sorghum bicolor
  Clone ID: 30975704
agggattccatgttgaagtacttgaggccagtggcaaggaacatgttcctacaatggcctcttctcttcatgtgtggtgtaagcccacatatacatgtcaattcgaacactgagtgtctcaatagtcttggagaaggcagacaatgatgggaggttctgcgaatcaccaaaaatgtttgctaagcatttttagtcagcaaggactaaaaatatcagtgacaagattacctggaagctcaatggaatccccaaagtttcaataagtcatgtacaattgtgcactgaatttttgctctattttggtgcctctatcaaatttggctatggatatctacagacttccatgagacctatggtactgaaaagatatgctaactttcaaacaagttacaaattactctttatatgtgtttttccctttgaattcttttagctgaccaccagttatgcttcatagaatgatttaggttgcttaggatctttttttcacctgattaaagtagaataatgtactcaaataatgaagcttccaacttgggtctatgctgtagcacacttcattcagacatagccaaagcattttggtatgtatatgat

SEQ ID NO: 26520 - DNA, 536 bp, Sorghum bicolor
  Clone ID: 30975748
cataacgaaccatgtccaaagactccagagatcacttgatgtataagggccaactcaagggccacgatggttgggttaccagcatcgctaccacctcagcaaacaccaacatgattatttcaggttcaagagacaagtcaatcttgatctgggatttgactcgtgagcaaaacaactacggttatgccaagagatccctccgtggtcactctcacttcgtttccgacgttgttctttcatccgatggtaactttgctctatccggttcatgggataagactctacgtttgtgggaactcgccaccggtcaaaccacccgtactttcattgaccacaccaaggacgtcttgagcgttgccttctccggtgacaacagacaaatcgtctcaggttcaagagatagaaccctcaagttgtggaacactttgggagagtgcaagtacaccatcacccaagacggacacaacgactgggtcagctgcgtacgtttctcaccaaacgctctacaaccattgattgtttcagctggctgggat

SEQ ID NO: 26521 - DNA, 127 bp, Sorghum bicolor
  Clone ID: 30975749
atgttactgcgacagagaggaatgtctctgctaatgtaaatagcactgtttcgaggcctgtgccacagcggtcttggcagcagacaggctatggaaacacctatggaggatatggtggatctaacat

SEQ ID NO: 26522 - DNA, 315 bp, Sorghum bicolor
  Clone ID: 30975767
cccttcccactccttcctctccctctctatcagcgccgctgctgctcgccggcgccgcctgccaccaagccccggaatccgcggtcgcgggggggacgggaagcgctcgctcgctccccctgttttcctcggccgtcggagcgcgtcgtctccgggcagcagcagctcccctggttcctggtggttcttgcctcctcgtctgggtgtgtgtgtgtgtggtggaatagcgtcgtcgtcttcgctggaatccgcctgcctgctccgcctccgctcgcgcttgagccagagctactgattggcttctaccgaccagcg

SEQ ID NO: 26523 - DNA, 611 bp, Sorghum bicolor
  Clone ID: 30975787
ctactggcatgcatataatacctaactagactgtgtcacacaaaggaagtttgaatatcacatgcaaatagctataaaattctaagacctaccagcgcagctgtatacctgtacctattctgatgattttggcacctactattggttatcaagagtttgtgaaggctggtagcttctaaatggtcggtgagtttctatatctgcaacctcataaaaagatataggtacaaagtgatattcgttaggatataaaagatctttcctacttcttgcatagatgcttagtatacattttatctgaaatatatttagccgagttgaaagttgcaaacgatatctagcttacatcttgcattgtaaaatagatatgtacaggtgagggataggaaatactcctccgttttccctatttttttcattcagatggtgtctgaaaatcaaatgtagatcactataaattctacgagtggtggaacacatgctctatttttatgatttcagagccaattattggttagtacaagtttgtataggttgggaccttataagcagccactgaatttctatatctgcaacttgattagaaaaatactggtgtgaagcgatattca

SEQ ID NO: 26524 - DNA, 502 bp, Sorghum bicolor
  Clone ID: 30975793
gcgcacccaaacatggccgcttccaccgccgccgtcgacaccaccgccccgcctcctcctccctcggcagagcccgcggctgcacccgcaccggatcaaaaggtctctcctcctcctcatgcccctcagcccgatgcgcctgcgcccgcgggagcaccggctcctgcgcccgtgcccgcgccagcgccgaggaagcggaagctcgaggaagcggggttccacacctccgaatactacaagatccgtgctgttgtcgccgacctgcgtgtccgcttcgtccaggtttaccaagctactgatttccgcaacacggatgctgctcgtgagattttgaaagaaataaatgtggtcatggatctatccaagaaaatgaggctcaagcttggtgctacttctgagcccgtgaaaccattggagaaaccttcagctggatttgtgaaggatgagcttgtgaaaccatcagagaagctttcagctggacctgtgacagaagagtctgtga

SEQ ID NO: 26525 - DNA, 394 bp, Sorghum bicolor
  Clone ID: 30975811
gcctgcctgcgtgcctccccctccttccccctctccgctcatgtgctggtccatccctgcctcctcctcggtttgtcctgaatccttggaccgaccacgcatacacaagctcagctcaggctgtggttggattctttggtgttccattccatccggccaagaatcctgcgagagccttggagccagtcaagcctgctgccgtcgtcgtcgtcgtcttgggtgaggcaggcaaccgtcagcttcaatctcctcgccgaggcaagcagcaggccgccgccatgatgagcttctatggccacgaggggtttggtggtcaggtgtccgccgccaccggtgccgggagccaggtggcggcctcccatggcgctgcggctgccggagcaggcccgctgcc

SEQ ID NO: 26526 - DNA, 625 bp, Sorghum bicolor
  Clone ID: 30975837
caaggaaatatagaatccgaatgaggggcattgatgcaccggagcttaagatgccgtatggaatggaggcaaagaaagaattaataaagctcattggtgggaaaagtgtcacaatttatgtgtatgagcaagaccaatttggacgctatgtgggtgacatctattgtgataacatgtttatccaggagcaaatgctgaagtgtggccatgttcatcatttcaagaagtacgacaaacgcccagagtttgaaaactggcagaaagaggcaaaatctacaggcctaggactctgggcatcaaagaagccccctcagaagccatgggattggagaagaaacaaacgacatgcaagacacagtgccattccggtttactgatggagctttcgagctagctctcagggatctgacagccacgtagtttggtactgaggttcttaagtagcttgctgcaaatgaatgtgttatgtgtatcagtaaccaaaagacaaaatgtacagttgatgtttgtagaaagggaaaacaccttattggaggttctctcttctgcagtgataatgtacagatgacctgtagtccgcaagaaccaagtggtgaatttgtaacaagaatgatgaactaattca

SEQ ID NO: 26527 - DNA, 512 bp, Sorghum bicolor
  Clone ID: 30975852
cccagaacaaaactgcagcaagaaaccaacgcacctcatggacgtctacagcttcggggtcatcctactggagctggtcaccggaaagccagcagagcagccagcgtccgacgacggctccgtcgacatcgtcaagtgggtgcggcggcgggccaacgtggctgacggagcgtcgcagatactagaccccagcatcgccagcgcggcggcgcagaaggggatgcaggccactctcgagctcgctctgcgctgcacgtcagtgatgcccgatcagagaccggccatggatgaggtcgcccggtcgctgcaggcactatgtttcagcgttcatccacaggcgccgctgctcacttaaatcgctcaggactctgatggcactggtagctcgtcaagggttcacacttcacagtatctattactgcataggccttgctttttgtacatacatggcgataggatgtagggggatgcaaacataataaagagaaataaaggatcagcagatctcaaaa

SEQ ID NO: 26528 - DNA, 616 bp, Sorghum bicolor
  Clone ID: 30975857
cttttacaacattggtgatcttgagattcaagataatctagcacgagtatgggtagacattggcattcatgagccattgcttttggacatcctgcttaatgccttaacaacgataagttcagatcatgttggtattaagcaagtacagtttggagggttagagtttttgaactggagtgaggacttgaaaacagaagaagttggatatagtgtgtgcaaaatttaaaatagcacgatcctgagatttgcataagcagctactgttttagctaaaacgcaaatacagcatttggttccagaacgtagggtttcaacccccttgatcctgcaaatgagaagaaaaatggtgacaacccaatggatgaaaagttgatgtccaagcatatgaacttttgaaaagaggttgcggtccttacaggactttgcaagctactcatcattggtaatccttttggatgcatgtaatatcccaggtcctttgatgtacaacgtttggattgttactccacaatttgacactagctggtaggtgaaaacttgtaaaattatgttttctgtttggtacagctcagtttcactgcaaatgagaacaaaaatggtgagaacccagtgttgt

SEQ ID NO: 26529 - DNA, 534 bp, Sorghum bicolor
  Clone ID: 30975863
ttccaagtgcaaactcacagggacaattcagtgaggagatgcaaatgatgctgctttgatgtcatttgattcgatgatgcgtggtttgtcgattgaccttgctgagttcagagttccaaggaaatggaattgccaaattgacgaatggtaatgagcatgtatagataaacttgcagatttcgctctttcatttcatttgaagagattaggatggttgagcagatggtgaggctggtgattaccataacaatttgtgggaagacaagaagcaatgcagcatagttactggcaagttagatggcaagcaggcgggtgtacatgcaaattgatgtgaatttgatcagctcaataaacacctgaggctgggtggtaagtacagccagttttgccattaggagtagctagcattaagcaaaaccagcaaatttagatttttggcaatgtgggtatgtcagggctgtagatgttgttcccgtccttgtaattacacagtactgttgcttttacactggaatatacattgccattgctggg

SEQ ID NO: 26530 - DNA, 405 bp, Sorghum bicolor
  Clone ID: 30975869
agagaagaaatacgaggaaagaacaggactagcgagtcctgaaactgttgagaactacgagggtgcaaaagatgtctttagtttttcaagatgatggctgtagcagactcgggaaattttgcaaatattggaacagatcatctagctgagcattagactgaagagtttctgggacagctggttataccagtaccacacccaatactttagttgcagtgttggcagtcttgctatttctaatttcttgcaatatcaatggaactagagacaacaaatttattagttacaaatgaggttttgtgtgtggtgcttatgtctataatattttctcatatttgtgactcttaggataaggacatagtgtaccccctgttttatccatttttaataatataatgagttctt

SEQ ID NO: 26531 - DNA, 555 bp, Sorghum bicolor
  Clone ID: 30975872
ccgcgcttatttatctttgtaattgggggtgctactcggtctgagttgcgtgttgcccacaagctgtcaagcaaactgaagagagaaattatccttggctcctctagtcttgatgacccaccgcagttcatcactaaattgaagatgttatcaaccgaggagctgtcgctggatgatttgcaaatataataatgtcaagtacaatggccttacattctccactgtaattatttacttgcatcactacaacgggtttagttgtactcccttaaccttgtatcgagccacaggctctcttacacaggctagaggggcatgatatttattcggccaccgtcagatactaaccatccagtgtacatacatgacagcgaccagagactgtaacataggtggcaactttattagattggtggatcagcgaaattcaatgtccagaggacttcaatttttgtcctcagattgctgttattttgcggggaaaatagatctatgtatatttttaactcaaaccggaattcatgtctaatataagagcaaagaaagcacaacaaa

SEQ ID NO: 26532 - DNA, 647 bp, Sorghum bicolor
  Clone ID: 30975875
atgcatccacacgtccttgcaaatgacaatttagttgccattaattttgctagcactagaggagtctctgaaagttccattgaattggagttgcaaacttccaatcacatagagacaaggaccagatcagggttcctctttgtgatggaaaaggagttccaaaagaaaaatcatttacttcaagttcagttcatgctcctgaggcagtctgagtcaaaagctgcaataccccatcgtctcataagaaggtaaggcagcttgcgaccccaactctcaggagtcaggagtgtttcctgttctgtcttgcctgacagtctggacctgcaggaggaaacctcattatattgtgttacaacatggttgcagagcaaaatgttgattgatacagaatacaaatagtctcatctcagcgattaatttattttcttttgatggggttcatggcatcaaattactaccacttccaataccactggcctctgtgagggcttattcataactagaatagaaacaaaggttatatatatttgtctcggtagtcgttcgatggtatgaaattgatgtcatggtactaacaatttgagtactacaatgcatttaaccatctgatgcatttataatatttcattccagtaagtatttcaata

SEQ ID NO: 26533 - DNA, 264 bp, Sorghum bicolor
  Clone ID: 30975877
ctgcatattcaagaaaaaaaaagcccatgtagaagtttcccttaactattgccccagtagttgtgctcaacttcatggcttttgatgtgtagctttcaagtccatcaaatacgtgctgttgtgattctgttgcagtgtagtttttttttataccaaaaactggatccaggagctgtaagcccacataaattgaatatggtgaattttttgtgaagtacccccattttgattctgtagtcagttgtgtatcagcatccatgtatt

SEQ ID NO: 26534 - DNA, 335 bp, Sorghum bicolor
  Clone ID: 30975886
tttggccatggcgttttttcaggtacggaacgcagcgccccgccccatggaaaaggaaaactagaaaattccctgagttatagtccagtactagaaaagattaccaaccaccctctgtaattaacccggggaaaggtgaatataaatcatgattataatttgtactggtatatcccctttcggttggttcggcacatgcgtacggtgtggattggaatctcccgcgatggccaggctggataaaaaagcatggttttatggggtttgtttgtagtaactgagtagttgcccgtgattaagtccagtaggactgaagaagtgagaataggggtttc

SEQ ID NO: 26535 - DNA, 414 bp, Sorghum bicolor
  Clone ID: 30975896
agcagattccttgtgttgctgtagcctgtagtaccccgtccaaccccgcaccggcggcaaccactgcccgtaaattccattccaccgcgtccggctttcctcaccgcgcgaccattcgccattccctccgctcgaatcggcaagcccccatttcgagtcccggaggcggccgcgaaccctaactctacagggaggcctcgccggcgaggagtgggggctccgttggccatgtcgatcgactcagacagctcgtcgcagaggggcgccgactacaggagcttccgccagataacccgagaccgtttgttagttgagatgctgagatcgactcggaagagttcaaaatcaacatggaaggttctaatcatggacaaacttacggtcaagataatgtcattttcatgcaagatggca

SEQ ID NO: 26536 - DNA, 611 bp, Sorghum bicolor
  Clone ID: 30975903
cctactacttcgatcagttcgacctcaagacagtcaacagtgtagtgtagatcagctgccgttcttgattatagtcatggctaccagcagtttgacgttcggcgtaatactctcatgcgccctgcttttggccacggcgacccatggtctccaggtgggttactacaagaagacgtgtcccagtgccgaggtcctcgtgagggccgcggtaaagaaggccctgctggctaaccccggcgtcggcgccgggctcatccgcatgctcttccacgactgcttcgtcgagggctgtgacgcgtccgttctgctggacccgacgcaggagaacccgcagccagagaagctggggcgtcccaacaaccccagcctacgaggctacgaggtgatcgacgcggccaagagcgcagtcgagaaagcgtgccctggcacggtgtcttgcgctgacatcgtcgccttcgcggggcgcgacgcgtcctacttgctcagtaactccaaggttagcttccacatgccggcgggccggctggatggacgcaagtcactcgccagcgaaacaggtgtattcctgcccggcccgtcctccaacctttccagcctcgtctccgccttcg

SEQ ID NO: 26537 - DNA, 562 bp, Sorghum bicolor
  Clone ID: 30975909
gacggcctggccagtggccatccatcccttcgcttcccgcaccaatcttgtcccggcgcctgccaaatccagcaaggccacatcccacccgagacagggcagcaggcaggaacagagagcagttgcgcactagcagcagcagcagcagcagcagcatccgctgatgggacgcgcggcaatggcggcctcttccgggacgacgacgcgctccgtgcgcctgctgctgctctccctgctcggcttctgcgtcgcgctgagccaccaggagtcgtcgtcctcgtcgtccacggactcgtgcgccacggccaaggtcgccgtcgccagcctcgtgcccttcgactccacctccttccgctgcaccgccgcctggaagcagcaggacttcgtcctcaggtacaagaacacggggcccagcgagtggagcttcatcctctcggcgccggacaagggctcgtacgtggcggtcggcttctcgggcaagggcgccatggtcgggagcagcgccgtcgtcgggtgggcgtccaacggcaagggcaccgtcaagcagtactacctcggcggc

SEQ ID NO: 26538 - DNA, 564 bp, Sorghum bicolor
  Clone ID: 30975915
caccacctcgagcttccccatccggtcatcccccccacccccttcctgctacaaccgcttcgtttcctcctccaacaaatccctcccccaaatcgagctccgattcggcggctcctgccgcatcgctcatcagttccaccccgaaattcgccgccgggctggccccgccgatggagtgacgagtcagggtttcgaagccggcaatggaggcgcagtggctcgccgagtatccgcaccaggggtccgacaagcggccgcgcaagcggccccggctcgcatgggatgtcgcgcccacgctgttccagccccccaaggcaattccgatgctatattgtaggcaggaattaattaatggtaatttcacgactgcatttcttccgccgccaccgatttattacactggccctccacggaatctttcgcctccttggagaccagatgacaaggatgggcactatgtttttgtggttggagagaatctcacaccaagatataggatacttagcaagatgggtgaagggacatttgggcaagttttggaatgctgggacttggaaaaccaag

SEQ ID NO: 26539 - DNA, 497 bp, Sorghum bicolor
  Clone ID: 30975936
agtgacaagtccccccaggagagagagagagagagagagagagctcgaatcgaagaaggaaggcaggggaacgatcgaagggaagggatccatcgtctccatgggaaacatcatcaggtgcctcacgggaagagaccatggccatggtgatgatgatggttactacccctactaccgtgcagcgagcacagcctcgaggccccgctacaagctgcaggccggcgggtgggaggacgacgatgaacctgcagcagccttttggcctcgccagcagtctctaggtcccatccatggaggcgtcagcgtcacgccggcggccaccgccgcctccctggcccaggacctgcagctcaacatggaatccacgtccatgattcctgaagggttcaaacggcatgtcacatcatccaaaaaagcacaaactaattggtacaaggacatggcagaggcatacaaggatatgaaaaccccacaaaaaacacaagctgaaactgccc

SEQ ID NO: 26540 - DNA, 300 bp, Sorghum bicolor
  Clone ID: 30975952
atcatcatcatcatcaccggcagagacgccgcaagagctcctgctcgacttcaaggcgtccctgcaggacccgtcgggcgcgctctcctcctggtcgcgctccactccctactgcaactggccgcacgtcacctgcaccagcgccagcgccgccgcgaacgcgaccgtctccgtctccctctccctccagggcctcggcctctccggcgagctgtccgcatcctcgctctgccgcgtgccggccctcgtcgcgctgagcctcgcgtccaacggcttcaacctgaccatcccgctggaact

SEQ ID NO: 26541 - DNA, 656 bp, Sorghum bicolor
  Clone ID: 30975958
gatcccacctccactcagcgcaccagttattgctgcactagccagtagcctgccgagtgccgacgactcgccggcgtgcggtgcggcgccctcgttgcaagcaaagcaagcgcaggcgcagtacaaacagcaggagcacctcatcgcacgcagagggaccagatatgctctctgcgctcctcggcggctacctgaccgcctacccgccgccgcctctcccacccgcaacagcagcagcaccaagcccgagcgcgcgtctcccggctcccttccctgctcgcctcaggcacgcgtccctccacgtcgcccgacggcgcgcggcgggggcgggggaggcgctgagcgcgtcaaccgcctcggagggcgacgacgagtacgaagcggcggcggcgctgcaggaggaagggttcccgagctggacgggcggcggcgagcaggaggaggaggactacgaccacgaccccgaaatcggagacattatgggggactatttcgacgaccccaagaaggcccaaacccgcatggaggataggataagaaagaagcgccacaagatcgtgcaaaccaagaccggctcgcccaaccccatgaaggtcgtcttcaacaaatttgacttctccaattcatatatatggttcgagttctacaatgctctg

SEQ ID NO: 26542 - DNA, 610 bp, Sorghum bicolor
  Clone ID: 30975969
actgctggttcacgtcccacctctctctggtctctgcgctccgcctttcctcttatccttccccgtctcgcgcgtctcgggtctctcttctttctctcgcctccctcccggttcgagtcgcacgcaggtcgtgggcaccagtgcatttttatgcgccgcgccgctggttttggggcgcggagtccacatcgatggtcatggacgctggcctgcacgagccgtgcgcgctgctaccgggatccaagcgcgacggccacatgccaatctacccccaaatcgccgccgccgcaaatgggttcacggcggaggagctcgagtcgctgctgttcctgtcgcccgatggggttgcttcggccgcgggcggcgttggcggcggcagctatctgaatgtcgcgcccactactgtggttccgcccgcccgcaccgaccgccgcgcgtcgccgccgccctcggtggcgcagccggacgattcggaggcgttctcggacatcgtgctgggctacatcaaccgcatgctcatggccgaggacatcgacgataagttcgagcactacccggagcaccccgcgctgctcgccgccgagaagccgttcctcgagatcctcaccga

SEQ ID NO: 26543 - DNA, 471 bp, Sorghum bicolor
  Clone ID: 30975973
ggaccgcctcttgccggacgcccaaaaaaatcgaagccgaagggagaaggcgccgctcccatggccgctggcctctgcccgcgcctccgcaccttattggcctcctctcgcccgctcctggccgcgcgctccggagcgctgcccctacccctgcgccgcgctggcccggccatgcccctcgtcgcacgcgcacgccgcggcttaggctcctccaccgccgcggacccgctcgccgaagacttcgccacggctactgacctccggttcgaatcgccactcgaggtagtcaaataccccgaccccatcctgcgcgcgcgcaacaagcgcatcaacgcgttcgatgccaacctccgcgccctggccgatgagatgttcgacgttatgtacaagaccgatggcattggtctctcagcaccacaagttggagtaaatgtgcagcttatggtattcaatcctgctggggtgaagggg

SEQ ID NO: 26544 - DNA, 673 bp, Sorghum bicolor
  Clone ID: 30975974
ggtccctctcctccctctgcgccaccaccctcgccgccgccaagcccccgcagcaccctttccccttcgccccggccagccgcgcgctcccccaccgcctcgccgccgccatgtcgtcctcgtcctccccgacccccgctgcgcccgccgcatcgggcgacgccggggcctcggcctcggccccggcgccttcggcgtccaacgccatcgacttcctcacgctctgctaccgcctcaagacgaccaaaagggcgggctgggtgaagcgcggggtgcaggggcctgagtcggtggccgaccacatgtacaggatgggcgtcatggcgctcgtcgcggccgatctacccggcgtcgaccgcgacaggtgtgtcaagatggccattgtgcacgacattgcagaagcaattgttggtgacatcaccccttctgatggtgtacccaaggaagagaagagccgcagggagaaagaagcattggaccatatgtgcgaggtgcttggtggaggttcaagaggtgaataccaaaacttgcaattgtaatacattaacactttatgctgtaggtaattaggcatcttaggttgttaccacaaatcgtcttttcacgatatgtagttatatgaaatgaacttgatgctgttgcgaactgacatcaactttctagattacacaat

SEQ ID NO: 26545 - DNA, 579 bp, Sorghum bicolor
  Clone ID: 30976000
tggcagatcaaggagctcaaggcgaagctgggcgacgacgacgccttctcgtcggtgaaggaggagccagcggcgtccgacgtcgaggtccccgccgccggggcggcgcaggggtcgtccgacagcgactccagcggggtggtgaacgacgcggagaagcctccttctcctccggcggtgcccgccgaggcggaggcgccgcagctccaggtccagcacggcgaggtgttcttgctcaaggttgaggaggacgaggcggcgttcctgggcgacgacgacgcggcgtgcgggggcttcttcgcggacctgcagcctccgccgtcgctgccgtggtggaccgagcccacggagcactgggcctagggcggacccgcgggccgcggtgggctgcggggaacccaataaacaactcggcagtgcccagtggggtgtggggggcgtttctgcaaaattttgtaaaatggaattgtacctactagtagttttttgtgacttctcccgtactatacttcgtagacagacagtccgtcctactagtagtagtactattttgcgtggctctcctctctctggcctatt

SEQ ID NO: 26546 - DNA, 507 bp, Sorghum bicolor
  Clone ID: 30976023
ttgtttgaatgttcctagggtgagatagaaaagttgaaacttggtgcccttatatgtgtatctgatgttcttggtccctctaactcatgacctctcctgtttacaatgcagtcaaaagtagctattagcaaatgaggcttttgccactaccaattgcatcagagtgttgatcaacatgtaactgaaacctcatttacaactgaagttcactaggtggcgttcgtcttcggcgagttgtcttcaactccaagaggtctagcggcgagaatcacaacaacaaggtcatttgttgctgatactcgtgatttgatagggcgttgactactttgttatgatgatgatactcgtgatttgatttttcatgtccacaatggccattgctacaggatgttacagaattatggatgtagatgtatcattaatccattaaatgcataatggatgataggttgtctttggtcttcttttttttgtaaaactgttgtcaacgagtgaattcttcagttc

SEQ ID NO: 26547 - DNA, 644 bp, Sorghum bicolor
  Clone ID: 30976027
aaacagccaacctgtccttgacaagggttgtgatgattaaaaatgttcaacatatggtcatcaaaaatcaaatgcatggctagttttagttgagaagactggctagatctgcttgaagattcgcaatgaattgatgtacaagagtcacgcaactcacacaagtgctacgcaagcatgattgatgcacggcccaaggttcagagaagacctggagaataccttatgggaggtgtggcattaaaattcttgcattgttgccttgttggcatgcgtccaccgatgtgattatactacaagttgcagtgaccactgtcgggatagcagctcactttcaatggcaacatttgaagtaaatcctggcgcagcattcatgaaaattattctaggtatcatatgtgacataggctgcataaaatttcagtggtttacacatgttatatttagctcataaagtgcacaattggaatggctcgtttatgttccttggcattatgtttctctagtttatgtattggtattcaaaataaaaagcttatatcctggattactgatagaaggtagtacattagggggtgtttggttggaggtgttaaagtttaacagtactgtaactcttttgttttatttggtaattagtgtttaat

SEQ ID NO: 26548 - DNA, 537 bp, Sorghum bicolor
  Clone ID: 30976048
cttgtattacaaaatggttatccatgtgcacaatgattctgtttttagacgataccagcaagagatgaggaaaaaccaagggctgtggcctctatatagaggtttctttgttgatgtgaatttgttcaaggcgaacaataagaaagcggctgaactagccaaagatggtgacactttactgaaaaatatcaatggtgccttggactcaaattcctcagatgtggatggtctggctgatgaggattcaaatctaatggttaaactaaaattcttgacatataagttgcgaacatttttaattcgtaatggattgtctacccttttcaaagatggaccatctgcttatagagcttattacctaaggcaaatgaagaactggggaacatcagcaaacaaacagagagagctcagcaaaatgttggatgaatgggctgtcttcattagaaggaagtacgggaataagccactctcatcctcaacgtatcttagtgaagcagagcctttccttgaacaatatgccaaacgcagccctgcaaa

SEQ ID NO: 26549 - DNA, 533 bp, Sorghum bicolor
  Clone ID: 30976050
gaccagcccacccccatggcgctgctcgccgccgccaccgccacagccgccgcggcgcgccgcctcgcccgccaccagcacaacctcctcctccacacccgccttctcaccaccacttcctccacacaccctctccctcccgacccggatcccaccacccccgcgccgtcccccgtccgcactcccccggacgaacagttcgcggcgtgggtcacgcggctgcgcccgggcttcaccgcgtccgatctcgccgcggcgatcaccgccgaggaggacccggacctcgcgctcgcgctcttccgctgggccgcgctgcgaccggggttccgacacgcgcccgaatcctacctcgccgcgctcaccgcggcctcgtccggccgccgccccgccgcagccgaggccctcgtccacgacgtcttcgcgggggcctgcgcgcccgacctcaggctcttcaacgcctgcctccgcttctgctgcgcgcgccgcagcctgttcccgctcgccttcgacctgttcaacaaaatgcgtgccat

SEQ ID NO: 26550 - DNA, 483 bp, Sorghum bicolor
  Clone ID: 30976069
ctactgggtgcgctctatctgtttctggtggcgacgacttggcggtcgccgccgtgcccagccctctatcttcgggaccttcgccggcgacgagcacccaccaggttgctttgcaaaacttgcaacgtccaggatacaactaattaaggttccttcaaccttatctggatttagaggaggttgcagagagcccatccagcagggtgtctcagacatactgatggatggggcatccaacatccttgagaaatcgtcacatgaatgcatgcagtcttggtacttcaccagggaagaactagagaaattttctccatcaaggaaagatggtattactgaaaacaaggagtcagaaattcggcatttatattgttcatttatccgggatgtcggcatcaggctgaagttacctcagatgactctagcaacagcagtcatgctttgccatcgtttctatttacatcagtcccttgccaaaaatggatg

SEQ ID NO: 26551 - DNA, 583 bp, Sorghum bicolor
  Clone ID: 30976101
gatcccatcccatcccatcccatcccaggtaacccgaccagtgacacccgagctccaaaatccccctatccttctccactccgctctcgtattttctgcggccggccggccgaaaatagcaaccggagagaaggaacctctcgctccattcgcgcggtgagacagtcatgagaaacctcccaagtactagctctcacttgtactaggaggaggtgcgatccgagctgagctggggaagaagacaagccagccatggtgatggtcctgggtggtggtggtgctggtggtcacagcaagacggaggagaagcatcaccggaggcgccatcccggcctctccccattcccctttccccggttgcccctcttcccctgacccacacccacacacgagtgtctgtgtctgtgatccttccttccttgcttgcttctctttggttctggatcagaggccctcccacccacctccttctcttgggagggagtctctgagaatttcacacccggccggcagcagcgacagtcatgaagagaccgagcggttccatctccggcggcggcggcggcggcagtcccgacctcct

SEQ ID NO: 26552 - DNA, 665 bp, Sorghum bicolor
  Clone ID: 30976109
gaaaagatcaggaagaagattatacgcccaagtcagccaggagttccatgatgccatttcatgcagttcctgacctgcttagctgggaagatggagatggtagcaacagccttggtgctaaaccttctttccaacttaacacagaagttaaatgcgcagaatgggtttcatcctccaggccacctatggagggtgaatctcattctggggaccttccagagtaccttgacactgaagttgcatcaagctcaaacacagttgtacttggtgcaagcaatacatctgagaaaggtggaaatgttgatctcatgtcctattcaaacaatgaaatgccattagataacctgattcatgggtccatggagctgccttctgaatttgtcacggaaacattgccggtcatatctcgggacctacaccctatcccagaggagagagttgttgagaacttcaacatgcaagaaaagcatgaaacagcaatttttactgattcagctgctgccttgactggccatgtaatcgaacagcactttgatgttggatctgatggaactctgagctctaaagttgtttcctcgtatcctcaagttaatgatgtcatccaatctgcatcaagtgaacatgaagaaatcttgaatccctttgctttgatggctactgaacct

SEQ ID NO: 26553 - DNA, 578 bp, Sorghum bicolor
  Clone ID: 30976122
ggacagccttcccaattccggccacacccacacccgctacgcctgcgccgccgcctccccttctcttctcttcccgtgcaagcttcacagccgccgtctccccctcccttcgcgacgcgcccgcttccgcgccgcgattcttcaaccttccccgcccgcgccgtctgttgcacctgacccaatccgccaatctgttcacctcttccgtgcgagggggaactatagccgccgccggccgtttcgatccggggctgatcggatcagcgtaggcagatgggtcgcgacgccgaggagacctcgccgccggtgtcctcgtcggaattggagcaggaagaagacgacgacgactgctacctgagcgatcaggaggacgatgccctagaagagtccgtcctccaggtcctcgaggacgagcaccacgaggactgccattggtccgcctcatgcgtcatcaccaaggaatccctcctggcggcgcagagggaggatcttaggaaggtgatggagctgctagggttgagggagcaccatgcccggacgctcctcatccactaccgctgggatggggggaggatttt

SEQ ID NO: 26554 - DNA, 526 bp, Sorghum bicolor
  Clone ID: 30976125
ctggcgatgcggctcgccacgctgcccactcacgcgtcctggctcatcgtcgtgctcctccccctcaaccacagacccatggggtgcggctcccgtgggtaacggctcgtcgggcgggcgcggatccatggcgtggaggtgccattagctcagttagttcaccctatctttcctttcttctcctagccgccgccgccgcccctcgttgctcgccgcatgcttatcctggcgccacctgtgctcgagctcaaggagctgcaccaaatcaatggagcataggtcgggcagaggttgcggatctacgctgacccactagcatcgccagcttgtcgcagcgctgacaccgtcgcccgcacatacgccgcagctcgttaaagacatacacccttggggcgacgcaacacgctggtatcaaagttggtgcggtggatccacctgatctgcgatgagaattgagggttgaggaaagggtgctgaaggaacttgagtagcagcaagatctatcatctatggcaaagcagcgctg

SEQ ID NO: 26555 - DNA, 571 bp, Sorghum bicolor
  Clone ID: 30976126
aaggacccaacatatacaaaaggccagccagcggatcgagcctcgcgaaccaaagcccagctcgtgcgcgcggcgcgcaccgcccagctccgatccctcccttcttcctcctcgatcgacctctagctccgtgctcactgccgcgcgcatatatgaactgctagcgcgcgccgcagcagctagctggaaggcgagagggatcggtgaggtccgcgcgcaagcggcgacagtgatcgatcgatggagaccatcaagtgctgcatcgcgtgcatcctgccgtgcggggcgctggacgtggtgcggatcgtgcactccaacgggcgcgtggaggagatcagcggggggcccgtgctggccggggagatcatgaaggcgtaccccaagcacgtcctccggaagccgccgtccacgtgccccgccgacggcggcgccatcgtcgtgcagaagcccgtcatcctgccgcccaatgccgagctgcagaggggcaagatctacttcctcatgccggtcatggccaccgccccggcgcccgcgcccgagaagcccgccgccgcgaagcaacagccgccgc

SEQ ID NO: 26556 - DNA, 597 bp, Sorghum bicolor
  Clone ID: 30976129
gagttgtgccttcgattgggtcatgatgtgcgggcgtatgagcttatcaaactacttaaaagcttccgaagacaaaagcagcatgatttagtttagcaactggaggatgtgatcttggagtcattgaggttcatgacagcttggcctgctgggaggccagttctcaatgtaccatttatggaattgctctgattcaagataggaaatactttaccctggatctagtttaacctggatctggaagcaattgagcaaaccaggttacagtcaagccatgagaatgggatgaacaaacctttccctaggttgctgctctacagttattagaggtgaggcatatgttattagattagaattgctcccttatgcttttggcccgttgaatctgtgtttgggagggcccgttgatcctatcccagtccatttggcacgtggagtggagtgggctaggaatttgaactaaatttctggcccaccaacacaatgggtcaggatggcaccctccgaaaccggccgttaggtgagcggttccttttattgcatagatatgcaatgaaccaggagttgtacttatcttctttccatattccatataat

SEQ ID NO: 26557 - DNA, 396 bp, Sorghum bicolor
  Clone ID: 30976131
tataggtcaaatcaaatggatggaacatgcatggtaggcaatggtgggatcgggagggagtagtcaagaagagcctaggtctgttcgggaaacagcgtcaaacatgttttcttgtcatcgacgacatgatcagtttggcaccgactgtgtcgacttgaatccatttgtgtatatgctatgtagtactggtacccaccagctcaacttgggggatggtactgagtactgacttggtcgacctggttgtgtctgcaatttttgccgctttctctctggacttgtttctgcggtgtccatgtgtgttttagaggttctgatgaagacctagattcctaggatcgatcttccattctttccatgtaaggatgcaattgtggccccaatccctccccctca

SEQ ID NO: 26558 - DNA, 603 bp, Sorghum bicolor
  Clone ID: 30976145
atcaagaagtacacccacgagatccttactctctggtacagggctcccgagatcctcttaggcgccacgcactactccacgcctgtcgacatatggtctgttggctgcatttttgctgagttggtcactaaccagccacttttccctggtgactccgagttgcagcagctgctccacatcttcaagttgctgggcaccccgaatgaggaggtgtggccaggcgttgacaagctgcccaattggcacgtgtacccccagtggaagccgacgaagctgtccactcttgtgcccggtctcgacgctgatggctacgatctccttgagaaaatgctggagttcgagccggggaagcggatccctgcgaagaaggccctggagcacccctacttcaacgacgtgaggaaagagatgcactgactgaagcgatccaataatccaccgaggggtgtgttgagcatgattgccctgaagcagttcttttgctaccagggcctactttaattaatttctgttttctactagactagatgatttttcctatgtgctgtgaaccgttcgctttggttgtgatggattaaaacactagggataaagtaagtgaac

SEQ ID NO: 26559 - DNA, 479 bp, Sorghum bicolor
  Clone ID: 30976146
acattagtagaagatttcatttccccgctccttttccccactggatgcccatattctggtttgatggatcacatttcacaagatattttactatgcttcagggtttacagagaagccttgcgattgccaaacatgaatagctggaacatttcatgtttactggatcgcagtccttgagttaaacggctcattgtcatgttgttcaaagatagatttagagaaaaaaaaaaagaacaggtcagatgactttggtgggtcccattgtcatgcttgacaattgctccttatgctccacaaagagagacattttagaagttggggtagatactaaacttttggcagatgaccaaatatcctaaagttgtctttcatttatgtgttgggctggaaagtatcttaatctatgtgttcgcctataatcacatttttttatgggacaaaatttgatgctataatacccttttatatgacgctttttt

SEQ ID NO: 26560 - DNA, 622 bp, Sorghum bicolor
  Clone ID: 30976174
gatgcacataccctatcagtgatgccttatgatcctacttccatgaagtctattgagcatgctattatctcatcaccattgggcattaatccaacacctgatgggaataggattattgcagctatccctccgttgacgaaggagaatatacaggcactgtgcaaggttgttactaaatcagcagaggattttaaacaaagtattagaagagcacgccaaaaggcacttgatacaataaagaaatctgcatcaagtatgcccaaggatgatgtaaagaggattgagaaggaggttgaagaattgaccaagaagttcataaagtcagcagatgatatgtgcaaggctaaggagaaggaaatcagcggaagctgaagtgttctgtgtcgatgagttatgtttcatttactagttgtgttttgtttacattccaacaatgttgagcagctgcgatttggcagctgagtggaggatataaattttattgccccattctaactatactgatagcagatcagaacagtgagatgacatgaacaggttagctggtggtgatgtaatttccaatcgcacaggctttgattaaaacttgcagaacgaagaaactaagttcagtttgatatac

SEQ ID NO: 26561 - DNA, 667 bp, Sorghum bicolor
  Clone ID: 30976175
gatgaatgggttgttcttgataaaaaggtaaatacttatcctacagttagagggtttacagcaattggtacaggaggtgatgattttgtccagtcaatggttgttgctgttgaatcagtcattggagaacatgttcccgagggtcaaatatcccagaaagtatctgcaaaggggaaatatgtgtctgtcaaaattggacctatccgtgtggtttccaaggagcaggtccaagcggtgtacaatgccatgaggaaagatgagcgaatgaaattctttttgtgaatgacatggcaaatagggtagaggtggtgtatgtctaacagttgaatcatgaaggtactcttgatgtgcaccattaaagcagacttgcttgcgtcaatctcttgcagttgctgtacaggttaccagtattgcattccatttcctgccaagaagctgtctgctgattggggagcacagtatgcacttgccatactagcagttggattggcgtcaaaagcgaactgtgcccattgagttggggaaatcttgagttggggaaatggatgatgaatcctaaatttcatcctttggctaatcgacatgacattttatatatgacatgttgcgctggatgttctgtaagcctacagaatatttattgaaggaaatcttatccattgattgg

SEQ ID NO: 26562 - DNA, 653 bp, Sorghum bicolor
  Clone ID: 30976179
gaggaggaggaggaggaggagaccaccagagcagcagcgatatgagctccctggaggccgagatgaagtcggcctcgtccttcaacggtggcaggatgccatgaccgacccatcggccatcgatcgagcttagacaagacataagttcgcgcacagtaagccagagacttgatcaagcagatgcaatgagaggagtaaggtcgtcgttatatagcgtagcggcaaacaatgcaagttagcaactgagtcgcatgagtgagttcatgcaagggataaagcaagctagctagctagctagctttcatcatccgaagggaccttgggtgagagagaaaggcgtcttctttgactaatggagtaagctagagtgcgagttggacgcatgtgatgacccctttgctcgtggtgggggttggtgttcatgctggtctcgttcttgttggttttcccttccttgtagctggataatctttgttggattaagtatagtttctggtcatagaaccaataaggatgtttgtagctagcttaatgggggcgtgtgatttgcagcttaatttgccccattccccctcctgctattttttatttccttttctcttgtagcaaaacaatattccccttacaatgccattaattatgctagctcaaat

SEQ ID NO: 26563 - DNA, 452 bp, Sorghum bicolor
  Clone ID: 30976183
gcagattagtacaaacagttttcagaaaccaagagcccctccccgagcaagaggccccccagagattaatgaaactttgaaggagcaccctgtgaatgcccataatcagaagagcaggggagttgttgctggaactccccaccctgtgaaaaggcctgtaaggagaagaaaaggtagcgcataacatgagtttgtgttggaacttggaagccctagccggagccatttttttccatgcctttttatttagtaatttcattgttacttaattttaaaattgccatcctttgaaaatagcatcaatagttattcaagtgttatttacatttcccttttgtagtatttcagttactcaatgtattttgttttagtttttgaaaaacagggtatgggtataaatgagttactgaatggccaacatgatgaaattccagtatctgtacttaatgctt

SEQ ID NO: 26564 - DNA, 619 bp, Sorghum bicolor
  Clone ID: 30976187
gggatagtgctgatgcagatggccataccgacgttgcggacacagtcggggctcaagaacttcaacgccgagctcaggtccgccggctacgacctcaacaggtggcggcagagcgcgcggcggagacccgacctgcagatcctggacctcgactctggtcgaggctgggacctcgccaccaagctcatctcggagaggggccccaacggcgggggccgcctgtctgccgcggccgcattgcggcacccttattttctcctgggtggcgaccaggccgcggcggtgctatccaagttctcgctcagcaaatagcatccatccatggctcatgcctgggcagtgccgcagtggacacctacagtatataatatatatacacattggattactggaatcctcccaacaattcatcatcggtgatggtgtacattgcgcattgttgaatccttagcataccagtggggcagtggtcagcaatggcactgtcatttttcgctgtaaagccaatcgtgagaggcatcaagagggagtcatctggcaactgatgttacaacttgttgttctgtatgggacttgcttgaacaatgtggtgcagaattttcagacactagctaacctt

SEQ ID NO: 26565 - DNA, 661 bp, Sorghum bicolor
  Clone ID: 30976201
cggtgtgcacagataggctttggaagggggcgcaaggagaaattccagaaattgatttatagtggggcatataagagtgtgggagaggaaagcagcaggagagaagagaagagagagaaggaaaagtatgacaaggaaatgagagaaatgggagaacagccttcttcttagcccctcctctctccaccaccactgctatctctcctcagtagcagcaatagcaagcaagaggagaggagcaaagctagctgcagtaccagggagagtgagcgaagaagaagggggaaggacgaagagcactgccgccaatcctattcctagcaacgggccaaagcgaccggcaggaaggagaagcagtgtcgttggcgtgctggagctggtggtgcctgcaggataaatcgggaggcggcggcggtagtgatggcatcgaattcatcggcggcggcgttctttggcgttagggatggggaccagcaagaccagattaagccgctgatatcaccgcagcagcagctggcagcggcgctgcccggcgtggcaggcgctgtgcctgcggcgtccggccaaggcgcgccgaccgcggcggcgccgcagccaccgcccaagaagaagaggactatgcccgaccccgacgctgaggtgatcgcgctgtcgcccaaga

SEQ ID NO: 26566 - DNA, 669 bp, Sorghum bicolor
  Clone ID: 30976209
tactggaatgaaatgcaagtagatctcactaataaactaggagaggcagaatcattatccaaagctctgtcagaagatttggcttcagtaaaggaaatggttcaaaagggacaagaagaacttgaagccacctctaatgagctggcatctattgttgaagctcgtgacaacttgaagaaagaattgctggatgtgtacaagaatttggagtccaccacacatgagcttgttgaggaaaggaaaattgtgacaaccttaaatagggaacttgaagtgttggcgaaacagttgcaggtagattccgaagcaagaaaagctcttgaagcagacctggatgaggcaacaaagtcactagatgagatgaaccatagtgcattgttactgtctaaagaacttgagggcactcattctaggaatgacactcttgaagctgagaaagaaatgctatccaaggctctatctgaacaaacgaaaatcacaactgaagctaaggaaaacactgaggatgctcagaatatgatcacaaggcttcagacagagaaggagagctttgaattgaggtctagacatcttgaagaggaattggcgttagcaaagggtgagatactgcgcctaaggaggcagattagtacaaacagttctcagaaaccaagagcacctccccgagca

SEQ ID NO: 26567 - DNA, 570 bp, Sorghum bicolor
  Clone ID: 30976213
aaaatgggatgagagcgccttcctcgccatggccgcctccctcctgccccccgcagccaccctcgtcaagaagtacccagctctcctccacccgtccggcgccaagccgcacgcccagaggctgatcttcaggtgcggcgccaccagtgcggacgatggctgggcgtccttagtggacgagctcaagaggtcgctgcagcaggcggacacgtccgacacggtgaccagcaacgcgggagcgggtgtcacaccgaacgacctcgtgaccgcgctgccactggaaccttccaccaccaccggaccggcggtgggagacgcgactagtgccgccgccggcgcggtgaacgagctcctgggcgtggacgcggccagcagcgacggtggcggcgcggccgccatccccgacgggctcctgagcgcgctgctgcacctggacgcgtcgtccaacccggtggcgcgcgcggcgggcggcgcgctgtctggcctggacgcgctcacgtcggggctgtcggacgcgcagcggtgggcgctgttcgggttcctggccgcgacgtggctgtacctgacggc

SEQ ID NO: 26568 - DNA, 619 bp, Sorghum bicolor
  Clone ID: 30976226
ctggaccggccaatcctcctctcgaagtctcgacgcggcacggcctcagagcacggcgcgccggcgcgggacgacgccatgacgccgccctccatcttccaccaccaccaccgcctcctccccctcccctccgcttccccgactcaaattctaaacccattcgccgcctcgtcccgtcgcctcaaccatcatctcccgaaacccaaagtcctatccttacccccgcgtccagtcttctcctccgccttcgcggtcgccgccgttggcgatgacgaggatgttgtcgtcggggattgcctcgtgttcgatgacgacgctttcgaggaacaagacctggacatcctctcgtccccgccgccgccgactagcgcctcccgccaggactggagggcggaggccggcgagggagagagcctggtgccggagagatggagggatgccgaggaggagatcaacctgacgaagaaggagaagcgccgcatcgcgcacgggctgcgattcgggagccgcctcgagcggcgggcgcccccggccgttgccgcccctgatgaattccgcgcgtaccgcaaggggatgctgagcgcggagcgtgaacatgttgctcatgtataccgggggc

SEQ ID NO: 26569 - DNA, 196 bp, Sorghum bicolor
  Clone ID: 30976280
gcctactgaaaaaccccctcttctgattcccctcgccgccgccgccgccgtcgttgccgctagccggcgtagctgataggaaacctgaccacctgagccttctacttctatagaccaacctcagaggaacccccaacccctgcccttatggccctcctccttcgccgtggcgcggccctcgccgcccgctccttcc

SEQ ID NO: 26570 - DNA, 662 bp, Sorghum bicolor
  Clone ID: 30976281
gtcgcgaggcagcacggagagatatcttctccagcctctgcctctcctctgtgttcgcggctgccggcgaggtgagtcaccagaccggacgatggcgtgctgccgggccctccctctccagctccttcccgcctccgctcactcccgcccccggattaacttccatcgtcgcatccgatgctgcgccgccgcgggcgaccaggtggaggcgccgcaggacgccgtgctcaaggccatttctcgattccactgccagcgtacttctgtgtttctgaatgcacaaatgcatatggaccttggttatgaactactatattacagataggtcttgcttcctaaatgtagaagaatatgtcatcttactattaagcagtattagttacgaatgtttaacatagtggcatgctatgcgcttccctgcttactttgtgttgttacatgctttgaggcctattgcatattttatccaaagcatgaagttatatactccttccagagtctataaaatagtttagcttttttaataacctgcaactcttattcatttccaaaaacagaagtagcaagttctaaaggaaggattgcacaaacaacaaatgttatcatgggtggtactgtgacagatgacacaacagatgaatgggttgttcttgataaaaagg

SEQ ID NO: 26571 - DNA, 120 bp, Sorghum bicolor
  Clone ID: 30976295
ctggaattgcaagtagtaatgaaccatgatcagatggtaggatgatgtcgagtccatttctcctgacatgacatgaatatctatcaggtttcttttgttccaatgtactataaaggtata

SEQ ID NO: 26572 - DNA, 644 bp, Sorghum bicolor
  Clone ID: 30976331
gagacatgctcccatggttgccattgaaaatgctgctgagagggatagaatgatgttcccgtcttcgacttcaataaccaagccagattcaaatggcaatccagagaactgttgtgataatgaaccagcaaaaaggctaaagacggatacaaaagataatgagcaatcgtcatctgaatcattccgtggtgacttgtctgaaacgagtagaccatatctctgcacaggatttgatatctaccttgtttgggaaccatgcacaatgtgtgcaatggcacttgtacatcatagattcaagcgcgtgttttacgctttccccaatcctgttactggagcactcggtggagtctacaggttgcacggggagagaagtttaaatcatcactacaatgtatttagggtttcagtacctgaggcatactcgaatggtttgaagtattgttcgaaggaatgctgatccaacatcctgttccattttatttagaaaaaaaggatccatgacctcctgatttgcactatggatgtcattttttttgcacaagggcttcagattatacttgttcttttgtatcattaaaattttacctatgctgtatcactaaaatatgctccctccattcccattaatataatcggatgctata

SEQ ID NO: 26573 - DNA, 641 bp, Sorghum bicolor
  Clone ID: 30976352
accatcacgctgctgctgcaggacctcgtcggcggcctccaggccacgcgcgacggcggccggacctggatcaccgtgcagcccctcgagggcgccttcgtcgtcaacctcggcgaccacggccacctcctgagcaacggcaggttcaagaacgcggaccaccaggcggtggtgaactctgagtgtagccgcctgtccgtcgccacgttccagaacccggcgcccgacgcgacggtgtacccgctggccgtgcgggacggggaggcgcccatactggaccagcccatcaccttcgccgagatgtaccgccgcaagatggcgcgcgatatcgagctcgccaagctcaagaagcaggccaaggctgagaagcagctgcagcagagtggcaaggagttcgccgtggcgaacaccaagcctctcgacgacattcttgcctgaggcgactgctccattgatccacggtttatatcgtcgcgtgtgatttcatttataattaataagaacatagctatgtgcgagcgcgtggcattaaagttaatagctatgaaataatgtgtggaacttgaaactaaggcagcgctgctcctgctagtgtgcctgtgagacgactatgcatttctttttagtaagtgtttcattct

SEQ ID NO: 26574 - DNA, 622 bp, Sorghum bicolor
  Clone ID: 30976353
tccacgccgccgtccgacatgaaccctggcctcgccgccgtactcaagaagcagtgcccggccaaccccaacttcaccaacgaccccacggtggtgcaggacgtcgtcacccccgacaagctcgacaaccagtactactggaacgtgctgcgtcacaaggtgctgttcaaatccgacgcggcgctgatggcgtcgacgcagacggcgaggatggtgctcgagaacgctggcatccgaggaaggtttgagaggaagttcgcccgggcgatgctcaagatgtcgttcatcgaggtcaagaacgctgccaacggcgagatcaggaagagctgccatgtcgccaactagccattgcgacggtatcagcacggcgcgactctgatacctttgcagagatatatatagcggcaccttattgatctctatattttcttttgttgaagcgagtatgttgtttcattctttccttattgtttcattcttcattcagatgatcagggttggttttcttaattcaattttccagatgtatttcacacaaaaaaagaagaataaaattttccacaagatgtactcatcgactagggacagatgatgaacaaagctacgacttggttttttggcg

SEQ ID NO: 26575 - DNA, 616 bp, Sorghum bicolor
  Clone ID: 30976376
ctgtggcctttttttttttttttttggatcaacaaaattaagataagctacctcaatgggcagtggcatctgttcagagtcattacatcaacaaaacaaaaataaaaaacacaatctaattttcatcgccgaagacacgagcaactatgtctttcggccaaggtaacttgggcgatggcgtccgtgcagggggtgaagtcctccaccagctcctcgacatctttgttgttgtgctcctcgacgaagctcggagtgagggccacttcctggatgcagtgagggacgtcttggaaatgctccacctaggtctccccacgtgtgttaaccatgctggtgaccgcgtcgatggcaaggctgagcgtgttgagctgctctcctagacctatgatcggcaaagaacagacatcatcaacaatgaaaaagagccgattactgaatgaaaaatgcaagagaagcttaacaacaatgacagaatcagattctactagttgttcattagctacttccaagggcttcttagtgctctctagcactgctttcagggtgttgatctgctcgtggagcctctgggatctcttacactccttggagtagaggtctggcaccacagaagcgc

SEQ ID NO: 26576 - DNA, 623 bp, Sorghum bicolor
  Clone ID: 30976378
tgtggcctttttttttttttttttgtcagtttacttgagtagttaggctgtgaacgtcgaccagtacagaagtactcggctaggaaatttcgctacacccctgcagagtacgagcagtaaatatgtaggcagctttcggcgactgagtgcagataatcacgaaaagtatcattggcgatttggggcttaaagtctacatatatttgggcctgtttggcagctcttggaaagccccgccaaacgtttttgtggacaagccgttttgagtaaaagaggagtgagtaaaagaggagttggagccgttttcgcgaaggcataatttatggcttcatcaaaatggctctgactcctccagagaagcctttcgtgagaagtcctgccaaataggctcttacttttcatcctaaagccaataagtatctgtcttttgcttgtttaaaaaaaaaggttgtggattctgttcataaacatgggagtgggaatgctataaaatttttaagatttcctagcttttcatgaatgcactgcacgattagaaagtcatgctattaagacaaagaaattttggattacaaagacattttcctcatccgcagctaggatctgacaaaaaatcataaaca

SEQ ID NO: 26577 - DNA, 658 bp, Sorghum bicolor
  Clone ID: 30976379
aaaaatagagcacagcagcagcggcacgtcccactcccacggcagcatcacgatccgagcggcgcagcacgaggaggaggaggaggacgcagacagagagcaggccacatgctggccccggtgagcatcggcgcggtcccgttcctcccgacggcggcggcgggggagtcgacgctgcgcgcgtcgttcgtgcgtgacgaggacgagcgccccaatgtgccgcacgaccgcttcagcgacgaagtgccggtggtgtcgctcgagggcatcgacggcggaggcgcgcggcgggccgagatccgtgcgcgcgtcgccgcggcctgcgaggactggggcatcttccaggtggtggaccacggcgtggacgccgcgctggtcgccgagatggcgcgcctcgcgcgcgacttcttcgcgctcccggccgaggacaagctccggttcgacatgtccggcggcaagaagggcggcttcatcgtctccagccacctccagggggaggccgtgcaggactggcgtgagatcgtgacctacttctcgtacccggtgaagtcccgcgactactcgcggtggccggacaagccggcggcgtggcgggcagttgtggagcggtacagcgagcagctgatggggctggcgtgcaagctcctgggcgtgctct

SEQ ID NO: 26578 - DNA, 656 bp, Sorghum bicolor
  Clone ID: 30976381
tggaatagagtacctcacacaagaggcgatccagtggcgtgcgttaaaccacagagctatagctatcccatatttggtactagagtagagtttgagctaatatctatttgaatgggtgacgaggcgtccccgacgacgccgccggcaccactgtatctcgatggctgtccggggtgcgccatggaacggaagaaggcgagcagcaagggcatcccctacaaggagttgttcttcgtcgccgtcaccaccattgcctctgctttgccaatatcgtccctgtttcccttcttatacttcatgattgaagatctgcacgtggccaaaacagaacaagatattggactgtatgctggttttcttggtgcatcttactttattggtcgattttttgcctcgctgttctggggtgtagtggctgatcgcattggaagaaagccaatcattatattttcagtcgcttcagtggtcatattcaacactctgtttggatttagtgtaaagtattggatggcaattaccacaagattgcttttaggtgctctcaatggcatgcttgcaccaataaaggcttactcaatagagatttgtcgaccggaacaccaagcgcttggattatcaattgtaagcactgcttggggcttgggtcttattgttgg

SEQ ID NO: 26579 - DNA, 661 bp, Sorghum bicolor
  Clone ID: 30976386
ccagtctcgtgcgcctctctccctccctgtcgcccttctccaatcggcttggtctctcgtcgcgcacgccccatggccccctgctatgctagtgccaacggaaccctaggccgctagtgccgccggaggaaccaaatcgaggggcagtgcaggaaaatcgatccatcgagggtgacaccggcaaatcgtggcggcacatcgccggccagcgtttccgggttccggctgggcgctgcagcgcgcaccgcgcgggataggcggagtgccaacaggcaaaccgcgcagtgaccaggcagctagcaggtatgccccttcaatcaggcacatcttcctgctcagatgattccgatgatagcaatgccattgacccaattggcatatatactatggaagaatacattgctgagcaaagtgtcctgcacaatttaattgagcggatcggtgtgaagattcaggccaaaatcgaagcacaacaagctggtacatctcgccgccggagtggttttaacaggaaattcatagagagagatcatggagagggtcatcaacggcttgtcgctgatttcttttctgaagatgcagtctataatgaaaaattattcagaacaaggtaccgaatgagaaggcctctctttctacgtatcgtccgtgccctaggcga

SEQ ID NO: 26580 - DNA, 624 bp, Sorghum bicolor
  Clone ID: 30976389
caaaagaagagcaaagagggcactggaagagcaatatggtggtgaggaggagctacctcagacaaatcctggattgaacaacactcccttcaagtttactaaatattcaaatgcatacatgcttgtgtacattcgtgaaagtgacaaagacaaaattatctgtaatgtggatgagaaagatatagcagagcatcttcggattagattggaaaaggaccgtgaagagaaggaacgccggaagaaggaaaaagctgaggcacacctctataccataatcaaggttgcaagggatgatgacttaaaaactcagatagggaaagacatatattttgatcttgttgatcatgataaagtcccaagcttccgtatccaaaagcagatgacctttgctcagtttaaggaggaggtagcaaaagagtttggcattcctacacagtttcagcgattttggctgtgggccaagcggcaaaaccatacttaccgacctaacaggccattgtctcctcaagacgaagcgcatactgttgggcagctaaaggaactggtgaacaaggcccacaacgctgagctgaaattgttcttggaagttgaacttggactggaccttaaacctcttcctctccc

SEQ ID NO: 26581 - DNA, 660 bp, Sorghum bicolor
  unsure (1)..(660): unsure at all n locations
  Clone ID: 30976397
attttctgcgcctcggcgatccctgcgtctgcgtctgcgctcccccggggaaacccggccaatatccgcggcgctgaagaagcagccgatcctgtattcgtgttcactgagcactggaatcatatccctgaagacctcaagctgcacaaccagaatccatctacgtttcttctggatactagcacctacctggtaatggccgaaatcgaacccttacaagtggtggtgtatgaaggtaatgcagacctacagatgtctggtggtgaggatgagtttgtcgccttgccaggcaatggatccacagatgcggcgcaggaaggtaacgcggatccagtgaagggaatgatatttgatagcgaggacgacgcgatcgcgttcagtcagagatatgctcaggagaagggattcactataacacggaggacctctaaaaccatggatgagaagttgcagtatttcactctcgcttgcaacaggcaggggaaagctcagtgctccagaaataagttgaatcagaatccctccacaaaaacacagtgtccggctaaactgaattttagacttcatgacactgacaagttctgcttgacttcactcatactcgagcacaaccatgatttgattccnagcgagacagggatcaatgtgtgccggaacaag

SEQ ID NO: 26582 - DNA, 668 bp, Sorghum bicolor
  Clone ID: 30976433
gttactgtcatcccactcctcccacctctctcagatctccccacccctccccgcctcgcgtcgccaccgccccctccaaaccctacccctcagcctcgttggatcgggccagacccggccccgcgccacgaggagtagcggtggcgcccgccgcggcgatgcggagctccatcgcgacctaccgggagagcctctcccggctcgccggcgaggtcgacgacgccgcggccgacgaggtccccgcgccgccgctggccccggcagctaggggcggggacctctccgccacgccgccgtcgtcggggaggcgccgacggtactcccgccctggccccggccccgaagccgccgagcccgacgagatttctaaactgagggttgacatccaaaagcttcaagcttccgaggctgaaataaaggcattatctttcaattatgctgcaatgttgaaggaaaaagaggaacaacttggaaaacttcgtgaagaaaatggatctcttaaaagaagcatggagagctgtaaggcagtttcagccaattctaatggtactttggaaagatcacccagagcacaaaggaatgcagttcaggaaaatccgttgaatctcaccaagcagaatggatatggcggtggttcttttcacggtgctcaggcaaatggtctgcat

SEQ ID NO: 26583 - DNA, 611 bp, Sorghum bicolor
  Clone ID: 30976438
attttctcctcgaacggctgaaccctagcgaccaggtagcagcggccggcgaccctgccttcttccattgagaatcggtcatcatggcttgggaactcattgaggtcccgggcaacctgaatccctctctccaagactctactgttgatgtgctggccaccaagattgatcccaagctagccaatactcttattaggcagttaagccaggtatgccctttggagaatctgaggcatgtaaagcgtgtacgtcgacgtactgaatgtggcggaaaatctgagctatcaataatcctatgtgtttctactgggtctgaaccttgtagcatacagttttctgaagatctacaaaagatagtggatacttatcaactgagtccttttactgcgaaagttgccaagtattgtgctacatcaaaagaggagtgggaggaacaatgcaaactttggccaacatcttaccatcctgcacatgacctcgatattgtccgtggatttcaagaggaggaattaccatcaatatttaattgcatgaagactgctattcagttatcaaaggcgggcaatgctgcaatcattattgatccatcaagcatgcaaataattgcaaag

SEQ ID NO: 26584 - DNA, 582 bp, Sorghum bicolor
  Clone ID: 30976446
cggcgccgccgagcgggtacccaccaccaccggcgtccaatttggtccctccgaccggcacctacccgccgccgccgccggagtcaggctcggcctaccctgtttatccaagatcggcgccttcgccgccgccagggacagtggaccgtgcactaccgtactacccggcgcctcccgctcccggcggctcgtactaccctcctccggggacacggcaccctgagatcgacggcgcgggaaggaacccttactacccaccgccggggagtcgatacccgtaggaggagctcggcgggataattcgcagcgttatggaactgtgatgtgatgtgacaactggcgactgacgacgatgcttccaagatagctccgccgcttcgcgccatgagcatagctcatatccatcgtcagatatcagcggtgggtgcaaggctgcaaagctgccaccaacacttggcttgttcgggtcaataattaacctcagtgtttttcagtctttccaagaggatttgttttttttaacaaagtgagtattgaactattgatactttttttttgcatttgaatccttttgtgggtgcg

SEQ ID NO: 26585 - DNA, 336 bp, Sorghum bicolor
  Clone ID: 30976473
ccacctccgacaccgtcaacaagttttgggccgtcccggaggtttttttcaagcagttctccgattccatggtgaagatgggcaacatcacaaaccccgccggcggggaggtcaggaagacctgcagatttgtcaacacataggattataataatatatatataggagggtcaagactgcagcaggagaaagagaaacccggccggtgcttgtggttgtacttgtacacacctgccccttcttttgatggttgatttatggtggtttggaaaataaataaccctttgctgagaggctattgtattatactatatagcatattatatgttatataca

SEQ ID NO: 26586 - DNA, 672 bp, Sorghum bicolor
  unsure (1)..(672): unsure at all n locations
  Clone ID: 30976503
atgatgctttatttgtttgccgtacgtggattntgaggtgcacctttttctttcattttctcttnatagttaagactgtgtacgtccatgaaacatcacgatcttttacaatgatagttaaatttaatttgtgatgatgggctaaatttggaaaaaccctaaatttcacatatatagtagcaaacagctagctaatggcccaacaaaaaggttatggatcaagatgacattgagcaatgaaattatttatttgtcatgtaatggtaaatgtagaagtgactcgatcgatgatctaacatatatttcataatattcatggcacttgccctacagacaaattaatatgagtatagttcaaggttggagatgtataaatgagaataaagctcctcaagatatttttcctctggcctcatttgtgttcacaattgatcgatgaaataaatgttgtatataattagtggacagacagcttgtggggcaattattttttgttgtgttgtccgtttcatgattatttgttcaatatatgcacaaagtccaaacaaatattaaaagacatgtgccccaagaaattagggatagtgacattgttctttctttggggggtgtgtgtgaatcgtgtatcgatactgtacactaataaataagtatgtagatcctcaacatgcc

SEQ ID NO: 26587 - DNA, 659 bp, Sorghum bicolor
  Clone ID: 30976527
ctctctctctctctcgtcgcgtcgccgtcgagatgcttcgtggctccgccgcgctcctccgccgcctcgcccctcgtgtcttgggcggtggctgcggaagcactcaccggcgcctccctcctcccatcgccaccttcctccaagcccgcttcttgtcttcccctaccacctcttcctcgccgccttcttcgtcttcagctgccggccacgacgaggaggcggaggacagagagctccccgagatctccaatggtgatgcaggtgcccggctcagcatctccgtcgaccgctccgggctctacaaccccccagagcactcgcacgagccgtcgtcggactccgagctcgtcaagcacatcaagagcatcataaagtttcggagtgggccaatcagcatagccgaatacatggaggaggtgctgacgaatccccagtcaggattctatatcaaccgtgatgtgtttggggaatcaggggatttcatcacctctccggaggtcagccagatgtttggagagatgattggcatctgggcaatgtgcctctgggagcaaatgggaaagccagcaatggtgaatctgatcgagcttggcccaggacgaggaacactcttggctgatttacttaggggctcagcaaagtttgttaacttcaccaag

SEQ ID NO: 26588 - DNA, 660 bp, Sorghum bicolor
  Clone ID: 30976529
gaatatatatgcttcagcggccctgctggtcctcctctctccagctagccaagggcagcagagaaaacagctgagctgactgtggatctcatccatatcgtacgtcctgtttggatctaccgctttgcttctctttgaggtttgagcccgtggcctcctccctgctgtctccttgctaactatcagcctgcaagctgcttcttccatggattccaccctcttcatcatcggcgttataggcaacatcatctcagttctagtcttcacatctcctatcaagacgttctggaggatcgtgcggagcgggtcgacggaggagttcgagccggcgccttacgtgttcacgctgctcaacgggctgctgtggctctactacggcgtcaccaagcctgacggcttcctcgttgccaccgtcaatggctttggggctctcatggaggccatctacgtcgtcctcttcatcgtctacgccgccaaccatgccacaagggttaagactgtaaagctggcagcagcgttggatattggtggctttggagttgtgtacgcggtcaccagattcgccatcaatgaattagacttgagaatcatggtgataggaacgatatgtgcctgccttaatgtgctcatgtacgggtcaccccttgctgccatggtaag

SEQ ID NO: 26589 - DNA, 653 bp, Sorghum bicolor
  Clone ID: 30976531
accgcacccatagtagccatgttggatccaccgccccaccactggtagctgcggcggcggcggtggcggcgcggcagaggcatgaagaacttcctcaggaagctgcacatcggcgactccgccgccggggacggcgcggcctcgtcgccgtcggcacctcccgcgccgccaacgaagaagggcggtagcatcgagcacagacactcctccggcaggttgtctggctggctcagctccgcgaccggacggccgcagcacccaccgcctccgcctccgcctcctgcttctgctgcaacggcagcggcggcggtgccggaggtggaggaggagtcagcgttggcttcgtctgtcgaggagaggaaggcagcagccgaggaggacgaggagagggcgaggcgggagtccttgaaggaggaggcggagcagcaggagaggagacgggaggcggagatggagatggagaagaaggagaagcaggaggcggagctggaggactatcacatgcagctggccctcgagatgagcgtcagggaggactcggaggcggtgcagatcgaggtggccaagcagatcagcctcggctcctgcccggtccagagctcgcccgcggaggtcgtcgccttccgatactggagtttcaatgcccttagcta

SEQ ID NO: 26590 - DNA, 659 bp, Sorghum bicolor
  Clone ID: 30976537
actgctccagatccatcgtccaagccggcctcagatttccctcccaagtcccaccgcgtcgagctccaaagccactaagaagcggcggcggccatgtcgttgggctccggcgccggcaccggcggccggcgcatcaccatcaggtccatctcctgccgcggcgtgagagccttcgtcccgttccagaagccgccgctctacgccgcggtgtccctcggcggccgccgggagaagacgcagccggacgccgacggcggcgagagcccagactgggacgacgcggtgttctcctacgacctcgacagagatactggcgcgcaggcacagcagcagctgcgggtggagttcgaggtcaaggcgcaggtgccgatcctcggcaacaagctcgtcggcacggctagcgtgcccgtagccgacctggcggcggccggagacgacgccgggctgcgccacgtcagctaccaggtgagcgcccccgacggcaagccgaatggcacgctcagcttcgcatacgccatcagcggcggccccggccccggcaacggcgtgcgcccgcagccgcagctctacccggcgccgggcggtgcgcggccggatcaaaatccgagcttttgctgcgcgcctcctccgagcgcagcgtatccgccaccacagccgtc

SEQ ID NO: 26591 - DNA, 656 bp, Sorghum bicolor
  Clone ID: 30976554
ggctaaaagtttcctttacgtcatctccctcaggctggccgctgcaagcctgcaagcggagcttcacgcgccgcgtcgcagaagtcgcgacgctgtaggaagtcgcggctcgcgccgctgcagcgctcctgcgccacgccgccactcacgcctccctgagggggcggaagtcgagccgactgccgaggaagtcctgcgccgcagccttcttgcgcctccccggctacttgttccggcactccatccactgctcgccggctttcttcctccagctccaactcccggcgccatgaagatcgcggtggaggggtgcatgcacggggagctggacatagtctacgacacgttgcggaagctcgaggaggccgagggcgtcaagattgaccttcttctctgctgtggcgatttccaggctgttaggaatgagaacgatttacagtgtgttaacgtcccacaaaagtttcgtgccatgaactcattttggaagtactactcaggagaagcagttgctccgtacccaaccatctttatcggtggaaaccatgaagcatccaattatctgtgggaattgtactatggaggatgggcagcacctaacatatactttttggggtttgctggtgttgttaaatttggaaacatacgaattggtggac

SEQ ID NO: 26592 - DNA, 663 bp, Sorghum bicolor
  Clone ID: 30976561
aatgcctctcccaccagccgccgcccactccctcctggctgcctctctgctctagtcatcgccatcgccccaaatcggctttggccctcggcacggaggagaccgaggatggtgcatcgcgcgtggaggaggctagggagcagcacctccaccctagatgccgccctaaccccagccctcgatgtgtctggccgtcggcgtaggggacggcatgctgctcgtggtggtgcacggagaaggccgatgggcggcaccccacctcggcacgttgtagctgtccctcgacatggaggacgccggcacgcagcgtgtggaggaggctaaggacagctggtggcgaactgaggaggatggctggaggagcaccaacgagacaaggatggcatgcggcaggcagggagatcggcacagatgtgaacaaggatcacctgcaggtggatgtgcaatagcatctgtgaagcggaagtaggtgatttaatttttgtttcatatatgtctgaaattaattatgcagaaaaattcattgttgaaaccagggctatttctgtagcttaactgtctagttatagttacctagtccatctgctacactatttggatttaccttcacccgttagtcacgagctattgatacagaggaacagaagtaataaaatagctgaa

SEQ ID NO: 26593 - DNA, 665 bp, Sorghum bicolor
  Clone ID: 30976586
agtgaggactagcttcctgattagcaccatgcatttctgcgtgtttggtttcctgaagaggcagatcatcaagcaaataggtgcacggagaatacggaaaccattatttcagattgctggagaagatagatcaacatcagctgcagatgacaacatatatgaagatgattcggtgaaaagatcaattttgagctcaccattagttgagttcagcactgtttattcagcaacgaacaatttcagtgaaaagcttggtgaaggtggatttggtccagttttcaaggggatactgccagatggccaagagattgctattaagaggctatctaaaagctctgggcagggatcggaagagttcaagaatgaggtgacggtgctatccaagctgcaacaccggaacttagtgaggctttttggttgttgtattcatggagaagagaagatgatgttgtatgaatacatgcccaataagagtcttgactcatttattttcaatgaaggtaagagacttgtattaggctggaaattgcgatacaagattattcagggaattggaagagggttactgtaccttcatcaggattccaggctgaaaattattcacagggatctcaaagcaagcaatattttactagatgatgatttcaaccccaagatatccgact

SEQ ID NO: 26594 - DNA, 646 bp, Sorghum bicolor
  Clone ID: 30976596
aattttgcaagctgttttatctgcaaacagcaaggacatttgagcaagaactgccctgaaaacaaacacggcatctatccaaagggtggttgttgtaaggaatgtggagaagttacccacttggccagacattgtccgaataaagggaaacaagatttgatatcctccagagatgatgattacaacatggaagagcacaatcaggaaggtcctgccgttcaccatggtggagatgaccttgaggatgattttgttgatgacgaagaaccaaaacccgccaaatcaaaaaaggcaaagcaatctggttcaaaaccagcaacagggacaggcaatgacgagaagagcgccagcgcgaagacaaaagcgaaacaaggtctaaaagttgtaaaattctttggttaaagaatggaaattttgttgtagcttaagatacaaatgatatccttctggacaagccgtactgtcaagcggttgtgtaacgctgatgacgatgagaatacgtctgccaactaaatacgcctctgcatggttgcccctaaagtgttcttctgtctaattgtttggcaaaaccagtagaactattacactctgggattcgctctattttcacatccagatcacattcatcaaaatccggtttttcttt

SEQ ID NO: 26595 - DNA, 643 bp, Sorghum bicolor
  Clone ID: 30976605
ccgaggcccggcgcgctgggcaagcagggggtggcgctgcggatatcggcggacaacgcggcgttcgtggggtgcaacttcctgggcgcgcaggacacgctgtacgaccacctcggccgccattactaccgcgactgctacatcgagggctccgtcgacttcatcttcggcaacgcgctctccctctacgaggggtgccatgtgcacgcgatcgcgcggaactacggggcgctgacggcgcagaacaggcagagcctgctggaggacacggggttctcgttcgtgaactgccgggtgacggggtccggcgcgctctacctgggcagggcctggggcaccttctcccgcgtcgtcttcgcctacacctacatggacaacatcatcatcccgcgcggatggtacaactggggagacccaacacgggagatgacggtgttctacgggcagtacaagtgcacggggccgggagcgaactacgccggcagggtgcagtggtcgcgggagctcaccgacgaggaggccaagccattcatctcgctcgacttcatcgacggcttcgagtggctcaagttgtagcactagcacgggatccagtccaggaactcattgttgacacaccatgaccttaatttaattctggaag

SEQ ID NO: 26596 - DNA, 665 bp, Sorghum bicolor
  Clone ID: 30976619
ttgcaaaatttatgatgtgaagttccttttttcttggggtatttcagtggcagattctgtctctaatcctgcttgtggacaaacgcagataattgttatgcttgtgcgaggatcaagagaaaaattgatcatccaaatggtgaggagcacttcggagggcatccacacaagacagatgaaactgaggatgaccgtgattatgaccacacagagtttcagttgtttagcccaactaccattgacgtggactacaggtttttcgatcctgacagagacattgaccttgtgaagtggtatgctgataagatagatcgtgctgaagctatttattccaagctgggcttgaaaaacgggaacacaaatgatgaagatatagccgaggaagatattgaagtttattgcaggcgatatgcctgatgggtaaatgaagatgaattagggaccacgccatgagtttccaaacttggcagcggcatagtcagactgggtgaagagatttgatcttttatactagtactagtatatatagttggcatacaacattgattaattaaatttacttaattttggaattgtggtatccaaaatatttaaatgagacttccattaatgtacaagaacgttcgaacgatatcaaattaatcaaaagttatatagaggcagcg

SEQ ID NO: 26597 - DNA, 650 bp, Sorghum bicolor
  Clone ID: 30976631
agttgaatcataaatggaagaaggcaagaatcaaatcggtgtgaaactgtgaactataaaatgtcagggctgattttttcgccacatttcagtttatagtgaacaaatcaaagacagtcttatgtactctagaaaatatggtggcaaatattgggagctgtagcagtctatatacaacagaaatagcagtaagaataatgctgaaaattgtatgtatgtacctatgctagatagatactcacatcagccacctttggagagctatacatggatctgaaaggcagcaggccaacaaatggtctttatcaaaaataccttctttcctgcaaaaataacgccaataaccaataaatgtcatagataaatgttttattgcagtggagcaaggtaaaccaaaaggcagtgcctgttctttgcttggcaagcagtgagtattgtgatttaccacaagaaaatgcaagattatttccttgccttcgatcatttaccaaggccatctgtttttgtactattctccaagacttctatatttacataaatgaatctcaattgcctgtgataagtctttttttggcgcaagtcttgtaatagatatatcatgtaagcacatatagcaagtatcaaaaaaagagttctgaacctagtggcgc

SEQ ID NO: 26598 - DNA, 122 bp, Sorghum bicolor
  Clone ID: 30976637
tcaattttgtgggttcagtagaactgtaatatatgtccatgtatgagggtgaaatatatttttccctagagcggtaattattatatgatagggatatagggatatgggtatagaccttgccc

SEQ ID NO: 26599 - DNA, 651 bp, Sorghum bicolor
  Clone ID: 30976650
ggggaagtgatccatccgatgcaagagtcctcctcaaggtacacagctgctgatgctgccacattgaggaagtgtgtgaaatgcagaggctccttttgcttgagctgtaaagtcccatggcatgatagcatgagttgctatgagtacaagatgaggtacccccacgctcgcccagaagatgcaaaattacagaacctggcaaggcagaggtgtggcgccaatgtgtgaaatgcaaacacatgatcgaacttgcagagggctgctaccacatgatctgcgtgtgcggctatgagttctgctacacatgtgggaaagagtggaagaataagaaagcaagctgctcctgcccgctgtgggatgaacgcaacatcatcagagaggaagacgatgatgactacgaggaagacgatgatgactacgaggaagacgatgatggtctttactactagatagaaggctgtcacaattccttttcctttatgttattgcagctactacgtactagcctgccttgcaagagttttagtatccctatgtatgcctaggactaatgtactcctatatagaaggttaagtataatggaacctactaataattaagatgcaggcgcaacatcatcagaaaggtatttgtggccctagcttagctcc

SEQ ID NO: 26600 - DNA, 266 bp, Sorghum bicolor
  unsure (1)..(266): unsure at all n locations
  Clone ID: 30976662
tctcctctcctctgcttcctcctatctacagcttcgagccacgcccatcgaagaagccaatacgaagggcattacccaggcaagcatggctcagctgctgcacctgccggacctcgcggcggcgcggccgccggcggggaggaggaggggcgtggcgttggcgccggcgccngcnggaccgggtcgcttcnnacagggggaggcggggacggcgagggggcgggtgatcggggtcgccgatcccgngcgggagggccggatgccgg

SEQ ID NO: 26601 - DNA, 656 bp, Sorghum bicolor
  Clone ID: 30976670
aatgtgtgtgttgaagtggaaagaagaaagaggaacgttcagcccgactcccctgattagagagagagagagagagagagagttcgatcccaggcctgggtggactggttcgtgcgagtccgatggtggccggcggcgacgacctggccgcactccacgagcaggtcgccctcgcatcctccgccgccatctccgcctccgatctcgacctcgcattccaactccaggtcgccgaggccatccaagcctcgctccgctcgcacaatgccgccgccccatcatcttcgtcgcaggccgcccccgtcctccccgtccccgagccctcctccgacgccgcctacgccttcgcggtccaggccgccgacctcacgcgcgccgagcaggaccgccgcgacgcccaagcccgggtcgccgcctccgcccgcatcgccgcgcacgacgccctcttcgcccgcgacctcgccgccatccccgaggatcaatgggcccacgacggcgactacttcgagcgccccgtcgactcctcgccccgcccgctgttccgcgtcttctccaagggtatgccgagcagggacgtcgtgggcccgcggaaccgggatcccagcgtcgccgtgctcgcggtggctgtctccaggacgcagggtggggtggtgctc

SEQ ID NO: 26602 - DNA, 655 bp, Sorghum bicolor
  Clone ID: 30976680
aaaaaaacgttccccaaccccagcagctgccgccagcccactagcgcgcacaaagctccgcggctcagcgatggcgcgccccccgccctacgccgcctgggcccgcgtcggcatcatcggagccagccctgtcccgctcgccggaaggagctccaggtccctgctcacctgaaggccagcctcgccgccagccagagaacccgtccgtgcagcagcgttgcctcgttggccaggatcccgtcctgctgctcccctgcaacgaacgccgcccggtcggctccaccggtcccagcagccgccgccggcgatctgcgtcccggctaggcactccctcgagccggaaggtcaaggacttgccaaagctgcattggactcacaataatctcactgtcatggatgtgacacccttgtggaaccactcatccgatgctctgctatatgctcaccatccttctcacatggtggatttgaataaatcacagaatccagatggttttagccattgtcatgagctaggcaggcaggcccctcatttccttggcaatggggtctcatgggggaatttggatgccaagggttcgattccgaggaagcaagtgttccaaacagatgaggttttgctttcgcaggtggatttgaataaaacacagaatcc

SEQ ID NO: 26603 - DNA, 656 bp, Sorghum bicolor
  Clone ID: 30976719
gcggtaaaaaagtgaaagaagagcccgatccgctcctccacgccaaacccggtaaggccgccgccgccgctccccgaatggcctcctcctcctcgcctcagcctccgccaccggcggcgtcgccaggggcggcttccccgtccgaggagcgccgcgcaggcggaggcggccggcccccggtcccgccctacgtcaaggcggcggcggggtccctgggcggcgttatggaggcgtgctgcctgcagcccatcgacgtcgtcaagacgaggctgcagctcgaccgcacgggggcgtaccgcggcatcgcgcactgcggcgccaccgtggcccgcgccgagggcgtgcgcgcgctctggaaggggctcacgcccttcgccacgcacctcacgctcaagtacgcgctccggctcggctccaacgccgtgctgcagtccgcgttcaaggaccccgacacgggcaaggtctccgcgcacggccgcctcgcctccggctttggcgccggcgtcatcgaggcgctcctcatcgttacccccttcgaggtggtaaagattagattgcaacaacaaaaagggctaagcccagacttgcttagatataaaggtcccatacactgtgcaagaactatagttcgagaggaaggcatatttggtctttgg

SEQ ID NO: 26604 - DNA, 618 bp, Sorghum bicolor
  Clone ID: 30976723
tattcaagaagcgatgcaaaagggaggtagccagcaaccagatgtcggattctgcatcatcatagcccatatcttgttgataacctttagatccatacatgccagtgttccatgggtattatggagcaaatcatcctgcctcttttactcttttaaattcgtcatcttgaagttccaggcaatgtaataataaaataataggttagaagagtccaataaatcacaatatcatttattatcaacaagaggtacgattaagataaaagcgggatctacgaaaactgaatcacattctttctgcagagagctaccaccttttcttggggggggggggcataaaatactgttgtcatttctaagaatccaaggtacaagataatagtggcagcaataggtaacatgatgatattacggaatctaagacaaaggacataataggtgagcaagggcattcatgcgtggcaaccatcacaagctgtcaactctctgcattcaaatatacactcatccagcaacaactttggtgtaaatggtggcatgacattattcacatgcgaaaaaactaaatagtcacagaaatgtaagagtccttgaggaaaatatttcccatgcctgaag

SEQ ID NO: 26605 - DNA, 648 bp, Sorghum bicolor
  Clone ID: 30976724
accgaccgacattccccggctcgagtcgcctcgcctccgacttctcctccgtcgccgcccctccatcgtcgcctcgcccctcctcttgccatcttcgtctctgtgccagccaccgtccctttcgaactgtcgttgtccccacctccacattggcttcatcccctcgctggagagacgtgaccgccacagctactgaaaggcaccggctccgagatccactccagttcttctcggatttgtcttccctccgaacgaaggaaggcagtctcgatctgatccgtgagctaggacactggtgccgccgcccgtgagaagcatcaacgctaccgcctacacgacaccacctcttgcccttcgctcggatctctctgctttacccaatgtttctcaccttcttctcttgtcatactgtttatgtttcttgtggatcctgaaattttgtgtgtgcatatgttaaattggtttctgattcggtaattgattcgcttccatgagaagctgatctgacaatcattgggtggttggatgtctgtttttttttaataaacgttggatgtctgcaattgccacttgggatcttagaaacatcttcgcttctgatttctcaatgacgcatttttgtattctttatgcttattttttctgatt

SEQ ID NO: 26606 - DNA, 651 bp, Sorghum bicolor
  Clone ID: 30976726
aaagcccaccacctgccacagttcaaaccaagatttctctagtctctacccccgtcctccgccgcttcttcttcttgcatccggctcacgatttcgagcggcttcctaatccgaccgcccgaccgccgtaggagcgtcggtatccccgtggctgcggcagtcttctcgaaccccggttggtcccagttggtgagaaacccccgcatcgaattggcggccggggcgcgggatgcgtggttcgattcttggctgctgcttgtgcttgagcgcttgacagagcttggcgagctgggctttctctaggtggaaaggtagggcgtggataggctttgtcggtgggtccttttttccggggagaattcgcctgagttctttggaataaaagaggatttgcgatccttataggccgcgcgtttcttgagctgctgctgtggaagttgatcttgatcctgttcctgttcgtcgtcttcatggataatttgggttggagatggggccggaaatgacagagcaggatggagggtaggaaaaggaagggaaaattcaggaattctctcaggcggatggctatggagtgcctgtgctctggtgagcagctcaagggggcagatgagaccgtccgctcatctgattctacaatcacaaaagatt

SEQ ID NO: 26607 - DNA, 606 bp, Sorghum bicolor
  Clone ID: 30976747
cgccgcggccggcgcacccatcacgggcggcccagccgcggcgggggcgatgccgatggggccagcgggcatgaagcaccaccacccggctccgccgatgggcatgtacgggcacgcgcccatgggccacccggtcgcggggcacatgatggcgccggcggctgtcggcacgccggtcatgttcccgccgggtcaccactcgccctatgtcgtgccagtgggatacccggcgccaccggccaagatgcaccaatgattgatcgtcgatctatcggcggcatttgcacatctgcagagctgcattccgatgcttgtttctttcttgatttcgttcatctttgtgtagccaaaagccatctatacatacatccatccatcctttcctgatctcccggcccttaatttgatgtaatgtaacatagattacttgagtgagtgcagggcaggcaggcgatgaggcgaataatgagtatctgctgactgttgcaatagctagcgtaatcacactcagggaggctcgaggaatgtgtaattagtagcagcctttccagggtgcaaatgttgatcatttgtgcagagttgcaactggggactgatccgattcca

SEQ ID NO: 26608 - DNA, 643 bp, Sorghum bicolor
  Clone ID: 30976750
gtggttcacaaggataaaagtttgttcggtctctgtttttatgtcgcccatgatttgcacaaaggatgtgaactctaattatgacgttgcttattgtattgtatctgtggctacagtttcgcagcggtatgcagagatgttgagagaaatgcgggagcacgacatggaggacaagctcgaacacaagaagagcttgcgggagaagaagctgcagaagaagttgaagcttaagcgcaagaggcaggaagagactgaagcagggtcagaggaggatagtggctcagaatcagacagaggccaagacacagccaacaagggtaaaaagaggtacttcagtgacggcgaagacaatgatgctgcaaaggacggtgacgttctcgcccagcaggaggcgttggcactgaagctcctgagtaaaatgcacagttagcttaggaacctgatggtgtaggggtttgcctattagctagctccaacctggaaggggctgaaattttgaccttgttgcggctctttttttttataaatgttttctgggagttggtttccacttatcatgcatacgttcatggatatgtgagaaatcagtgtgacctgctgtattaccccaagaaatcttatatgaggttttaagtaaatgctc

SEQ ID NO: 26609 - DNA, 609 bp, Sorghum bicolor
  Clone ID: 30976755
cgccgcgctgccccggtggcggttcaaggagcccgggcccgccgccgacgtcccaagggaccgggaccacgatgaccaggagtgctgcatctgcctagcgcagtacagggagaaggaggaggttcggcagctggcgtgcacgcacatgttccacctcaagtgcgtggacaggtggctcaggatcatctcctcttgccctctctgcaagcaagagctcaagtgatgaacaagtgattgatatcgatgcctactccactccttcctacagatatgctgtatattctctctcactctctgctgactgcgcccgccgatcagccagcagggagagctagactagccggccgggatgtgccacctacatataccacgaccgcgcgcccggcacctctctcgcgatcgaggatgtcgactggtcgtggccccgtgctgtgctgtcctattagtagatgatgctgacaaacgatggtacacttgcacttgaagcaggtagcaggagagtttgattcatttttagtctatatatatacttgatagatcaaaagggaaatgtgtaaagaaaaaaaaagggtttattttttgtatgtataatgtgttggtgccctgctc

SEQ ID NO: 26610 - DNA, 533 bp, Sorghum bicolor
  Clone ID: 30976761
gacgtgtcaattttgaaactcgagataaagaaatatgcacttccagaactcacagatttggtgattgtgtggtaccctgaagacatcgaaattaaggtacatggtgagcgtgagtttgtgaaaaaaattgaagaaaaggatgaatccctttatggctgtatcacccaagttccaattgctccaaagaaaatcggtcagcttccagcatgaagcaacgcgtggctagctgaagatcacaggtaaactaagacaccaatatatagtgctacttgctgttgtttagatttgcctgttttgtgaaaatcatgagctttgtcatgaggttattagtgtggatgtggtggcagattcacaagcctacataataattgcatgtatgttatgtatatatattatggaacctgcaaaaaacatttgcacgtacgtgtattatggtgtgtactcctaataaattgtaaaataagtgaaagaaaaaagcttgtggaccatggaggaaccaattattgaatgctgaaggatgtttttggttttgt

SEQ ID NO: 26611 - DNA, 647 bp, Sorghum bicolor
  Clone ID: 30976778
caatgacaagttggatctcccctttgctactgttgccaagaatgcagccttacctcaagaacaagaatccacggattcgagcaaaagcatcagtgtgtttcagcaaaagtgtacctcaccttgatgtggtgggaatcaaagaatatggtatggataaactcatccagattgcagcaacccaacttagtgaccagcttccggaatcaagggaggctgctcgcaacctggcactggaactacaagtattctatgagaagtctcaggcctcaacttctgacgaacacgagggcgagccttctgcctcaccagatgctgaatcatgggaggccttctgccagtccaagctctttgcgttaagcgcccaagccattcttcgtgtgacccctactacaaaagagggtgtgacctctaccactacaaaagagggtgtcacctctgccccaaaagaaggcttggccgtgggttgctagcataagccacaaggagagattgcgatttttcaaccccgttcactttcttgctgtatatgcctttggttggtccttcgttacatccagtcgttgaaaaaaaaaaatcaccggttcaggaattcaggtgtgaccacggtgttaatattggtgtgagatatatccattatagttaactgt

SEQ ID NO: 26612 - DNA, 599 bp, Sorghum bicolor
  Clone ID: 30976784
ccggtcgcgcccgcgccatcgcccaccctggagcaggagatggcgctgggccgctccgagtcggccaggaaccgtgagcgcgtgtcgcggcagctgctgtcgccgcagccgtacatgacgatgtgaaaaggcgcgtgtgcgtcatcctcatccgatccatggcagagatcatcatcatccggcgaactggatagcaaagcaaaatgatcacacgcaggcatccattcccaggaagaggaaaatgtacagatttgtagagcggttagggaatcgacgatatgatttgctctaagctctggctggcgaaccttggcggcagaacaaactgatctttcactggtactgtggcttccatatggcaatactatgtaattgtaagcttcaaattcagatcgagcttgatgttgagcaatgcaatttgtacaaaataaccggcatattttagtatggactgtttgtttcaaaaactgatgcagtagtttttttaataacaattttgtttacctcatcaagggaagttcagagcagctcttgaggcaaatagattgtatcataaataaattcataataataatgcggagctgttagagagtttgact

SEQ ID NO: 26613 - DNA, 576 bp, Sorghum bicolor
  Clone ID: 30976796
cgtcgggtgcaagcgcaacagggagcaccggagcttccagccgctcaagacggccgtctgcgtcaagaaccactaccgccggagccactgcgacaagagctacacctgccgccggtgcaacgtcaagcgcttctccgtgctcgccgacctgcgcacgcacgagaagcactgcggccgcgaccgatgggtctgctcctgtggcacctccttctccaggaaggacaagctcttcggccacgtcgccgccttcgacggccacgcgcccgcgctgccaccggaggacgacgacgctgttaccaatgctgtcggcctcggaactggctctggtcgcctgacgacgatggacaccgaggcagtgagcagaatggcgagcatggagttcttcccggacgccgtgctcgatggtctcgtctgttctgacatcaagggcttcgcgctcatggatggtggacaaggacaatatctggaggacgacgacggacgagggtcgctctcaccattgccaatggggctcgattcctgtgattttgatggattgatctctttggggcaccagcaattgatttcgaactcagg

SEQ ID NO: 26614 - DNA, 630 bp, Sorghum bicolor
  unsure (1)..(630): unsure at all n locations
  Clone ID: 30976802
gtcaaaataaaataatactatgaaaccacttatattntgatagaaagacaattttggaagagagaaatagtagtgccttcaccatttacgacggatggcactaggagatcatccaatgagccactatattgttttagccatgtttacaaactttgcttgatatatgttagttgaattgatttttaattaatgcctaatttagtaacagactcactatatcatggatttgcataatgagccatgtaccaattgtaaatgtttttgctttttaccacatatgggtatgttgaaataaaatcatgcatggggctatttctcgtgttgtcataatgttaggaaggtaagaatagaagtttctaaacccacaggaacatatgtgatgttccctctgtaatgattttcccctttattttaagtaggtccagattgtgatcccgcactggcaaggcagcgacaacacaaagacatgagtacatgagcgtggtgagggtggagagaggatgcaaacatgtggatctagggttaagaagagcagtgttggtatggaatttgtcttataattgacattaaaatcttagtgtgtcactttattacgagggattttagacttttgatatcatctacatggga

SEQ ID NO: 26615 - DNA, 594 bp, Sorghum bicolor
  unsure (1)..(594): unsure at all n locations
  Clone ID: 30976810
tgttggctactgggggacacgagaactagcacaagagagagaagaaaaaaagcttgagagagagagagaggtcgtggtggtggtgccgcggtggtggtggaggtggagttggatcgggctgtgcggatcggaggaggtcatgatcaactaatgcccattcatttattatggacttgcaccagttgttaaagtacagattaactggtgctaacgtcttctacgaatttcctacagagaacaacttagcaaacactccttggccagctagtccactgaagtctgagttcagcggctccccatacactcctctttcatcccagcttgagtgtgataatttgtctgctctcagcaatactccagataaccagagctccacagaaaccatttcagcacaaccaatatcaccactggaagtagatagctcatacagacaagcagctatccttcgggagaacacccaagtgagacctgatccattgtatgcaacatcaaggcataatatgcaacacgctttacgggaaatagagactgttctgatggcacctgatgctgaggatgcagccactancaccaagcatgaatttgaggaacata

SEQ ID NO: 26616 - DNA, 664 bp, Sorghum bicolor
  Clone ID: 30976823
atgagccgagacgagccgagccgaggaagcggggggcctggcactagcaggaggtcggcggagggagcaatggcggaatctagcgggtccgggtccgtgtcggtggacgtcgagcggatctccttcagcggcaaggagcatcttgtgaggacgagatgtggttctgtaaccgttgctgtgtatggagacgaggacaagcctgcgctcgtaacatacccggatgtaggtctgaattacatgtcctgtttccaaggattgttcttctgcccggaagctgcgtctttgctgctccacaatttctgcatctaccacatcaatcctcaggggcacgagttgggagtagctccgatatcatcagatgttccggtgccaactgtggatgatctcgctgatcaagttgcagatgtgcttgatttcttcagtttaggatctgtgatgtgccttggtgtcacggctggtgcatatgttctcactctctttgcgacgaaatatcgggagagggtaataggactgatgctggtttcccctctgtgcaaagccccatcgtggagcgaatggctgtataataaagtattgttaaatttgctttattattacgggactcaaggcctggtcaaggagtgcttgcttcaacgttactttagcaagaaactgcgtggggatg

SEQ ID NO: 26617 - DNA, 664 bp, Sorghum bicolor
  Clone ID: 30976828
agacgaatcatctatctggccaggcctcgcctcgcctcgcctccccgctccctcccctcccccacgctctcggtctctcggaagcggcgccgccgccgccgcagcggcgaggagccagccatggcagcgcacgcgacgctccccttctcctgctcctccacgctgcaaaccctgacccgcaccctctccccgcgcgggacccaccagctccgccgcggcttcctccgcctcccctcactcgccgcgctcccgaggctcgcccgcccctgccgccgccacgtctcggcgtccgcggctgcggctcccaacggcgcctccgccgagggggagtacgactacgacctcttcaccatcggagccgggagcggcggcgtccgtgcgtcgcgctttgcttccacgctccacggcgcgcgcgtcgccatctgcgagatgcccttcgccacgatcgcctcagacgagctcggtggcctcggcggcacatgtgtgcttcgtggatgtgttccaaagaaactgctggtgtatggatccaagtactctcacgagtttgaagagtctcgtggctttggatggacatatgagactgacccgaagcatgattggaacactctcatagccaataaaaatactgagctgcagcgcctagttggcatttacaggaatattt

SEQ ID NO: 26618 - DNA, 657 bp, Sorghum bicolor
  Clone ID: 30976838
ttaacgaaactgccaattttgattgttcacagctgcaggtaatcaagcgtatcttgttctatgatcgtagtgagtaccacttttgtgttgatataatctaataaagtgcttttgtttcatttttctttccctatgggaaaacagctgttggtgcttgacgaggcagatcaaattctcgatcacggtttcagaagccaggttgatgctatcatttctcagattcccaaagttagacaaactttactgttttcagctacacaaacgaagtcagttaaggaccttgcaagggttagcctaagggaccctgaatatataagtgtgcatgaggaggccaaaacagccactccagatactcttgagcagtatgccatgattgtacctcttgagcagaagttaaatatgctttggagcttcattaaaaggcatctaaattcaaagacgatagtcttcttatctagcgtcaagcaggtcaaatttgtttatgaaatttttaagaaacttcgtcctggtattcctttgaaatgtatgcatggacggatgaaatatgaggtacagcaggccatagttgcagatttcaatgaaactacttcagttcttttctcaactgatatatcctctcgaggactggatatagagaatgtggattgggtggtacag

SEQ ID NO: 26619 - DNA, 650 bp, Sorghum bicolor
  Clone ID: 30976844
atgccaatgcgcccctccggcgtcgcaccacagcaatgcggccgccttcctcctcctcctcctcctcctcctcttcctcttcttcttcgtcgtcggcgatggcggcgcctggaggcggccggatgtcggcgttcacgatgcgcgcggtggcgcggatgtcgagggcccggtggttcatcttcctgcgccgggtgtaccagtaccagaacgggcccaggtccgacctgggctccaaccccttcaactcgcccggctggctcgcgctcgagctcggcgtcatcgtcgcgcagatggtcctgaccaccgccgtcgtcgccacctcctccgccgagcgccccgcgtggccgctccgcctctgggtcgccgcctacaacgtcggcaacgtgctcagcctgcccctcctctattggcgccaccggcattcctccgccggcggccgaggcggcgacgcgctctcgggcgacctcgagatgcgcggcgccaatgacgctctgagggacagcaggtcgtatctgatgaacaaggcgcgggcgttcctggagctcttcttcgcgatgtggttcgtgatgggcaacgtgtgggtgttcgacgcgcggctggggtcgctccagcgcgcgccgaggctgtacgcgctctgcatcagcctgctg

SEQ ID NO: 26620 - DNA, 651 bp, Sorghum bicolor
  Clone ID: 30976852
atctttcttgctactatctagctacttgtatccacaactagcagcagctcgatctctggactgctggtagggcagctccaggatggcggatgccatcccgctgttggtctccaagaggtggtggtgagcgaggcgaaggctttagtggcggtgaaggacgacatccgtggcctccagtaccggctcatgtggttgcaggccttcttgcggcatgccaatcggcggcgacgcgacacctccgacgagctcctcagggaattgctcaagcagacccgtgatgtggccttcgacgccgaggacgccattgacgattactacctcaaggtcgacctttctaggtctgcaagttggagccagtccattgctcggtttttctctggattcactgagcaagtaagcatgcgacacaatctgtcaacaaagatcgcagagatcaacttaaggcttgaagatatctttaacaataaggagagatacaagattgaagctgcaccaaatgactttccatggaaaccttctacgaacatctccgaggcaaaaaaaatggatgatgtccaactatctccgatcaaacaggagcagctggagaagaagcttgaagacgcagttttctgtaacagtaagagacgacttgttatatgtgtgactggg

SEQ ID NO: 26621 - DNA, 634 bp, Sorghum bicolor
  Clone ID: 30976853
gaatgcatcaaccaatttgcaagctcctatgcaacctgtacagactcctcaatatgcactgttccaggatagcaagaagataggacaagttcagcatgttaatcagtttatgtttcctggatatgggtatcctgcatatccatttcctacaattccgttagtgtcaaacattcaagctgaaggctatctgacaaaaccaactggcacaagctaccgaactttggaagattccccaaaacagtcaagttccatagaaatgtcacaagacattccatcaagaccactgataatgacaccacaagaaaagatagaaaagcttaggcgccggcagcaaatgcaagcactgatagctattcagcaacagcagcaacagtttggtcaagagggttctggcagtgacacaatggtgtctcaggcatactcccctaggaacaaaaatccggattccttggggagttcaattgtcatagatgaaaacgcaaataaggttttttcgcctgaggtgattccaactaaccatgacctggttcacaagagttctgcaatttcagttgatccttttatagaggaaaaaatatattatcagctacaagatgctcttggcaagttggataccaaaactcgactatgcatt

SEQ ID NO: 26622 - DNA, 642 bp, Sorghum bicolor
  Clone ID: 30976855
ctcgtgtgaactgcggagcaggtagtggggaaccataagacccctgcgcgcttagggcggcggcggcaatggcgcccacggcctgcctccggctccccttcctccccgcccgagcccgctccgccaacgccaccgccaccccgttctcgccccctcgccgcctttctctcaaatgcagcgccaccaacggtgacaactccaaccccaattacatctccatctctcccggcgtcgagtctgtggacgtcaacgggttgcgtcggccgcccgcgcctgtctccacccccaccgtccccggcgcccgcgatcccaattggctgcctcggccactcactagcgcggacgccatggaggcggacgggaaggggctcaaggttgcttaccagggttgcgctggggcatacagcgaagcggcagcaaagaaggcgtacccgaactgtgagactgtgccctgtgagcactttgacactgcatttcaggctgttcaaaactgggtagctgatagggcagtactgccacttgagaattcattgggaggtagcatacatcggaactatgatcttttgcttcggcatagtttgcacattgttggagaagttcgcctcgcagttcgccattgcttgttagccaatcctggcgtga

SEQ ID NO: 26623 - DNA, 656 bp, Sorghum bicolor
  Clone ID: 30976876
gttcatgaagaacgggtcgctggacgcgttcctcttcggcggcgaccgcgacgcgccgccgccgggcgggaagatgccgtggccaacgcggttcgcggtggccgtcggcacggcgcggggcatcacgtacctgcacgaggagtgccgcgactgcatcgtgcactgcgacatcaagcccgagaacatcctcctggacgagcacttcaacgccaaggtgtccgacttcgggctggccaagctggtgaaccccaaggaccaccgccaccggacgctcaccagcgtgcgcggcaccaggggttacctggcgccggagtggctcgccaacctgccgatcacggccaagtccgacgtgtacagctacgggatggtgctgctggagaccgtcagtggccgccgcaacttcgacgtgtcggaggagaccggcaggaagaagttctcggtgtgggcgtacgaggagtacgagaggggaaacctcgccggcatcgtcgacaggaggctccccgcggaggacctcgacatggcgcaggtggagcgcgctgtgcaggtgagcttctggtgcatccaggagcagccggcgcagcgcccgtccatggggaaggtggtgcagatgctggaaggggtcatggagctcgagaggccgccgcccccgaagtcgt

SEQ ID NO: 26624 - DNA, 387 bp, Sorghum bicolor
  Clone ID: 30976888
ccaggcatcaacagatgcatgatccctttcgatcccgtgatcgaataccggcgtaggtgctactaataaagtcaggccccgtcaaatgctttacatggtgattgaagtctggagcttttcagcccccctatattgtgtttcgttcttgcgcttactgccagagccccctttttttttccgttttacgagcttggtgtagctttgtgtcggagattttactactatgtttcctctgtccggggtatgctttaacggagatgtatgttgtacccggggggatgtttttttttttttgttgtaaaaaaaaagaaggctcctttctccgaaatgttataaagagtctcaaaagtgtcaaacatgcgtgactttaattttgaactgtcgttt

SEQ ID NO: 26625 - DNA, 409 bp, Sorghum bicolor
  Clone ID: 30976889
ccaaggacaaggccaaggcgcccaatgggagggagtcaactgtaggggaagtcatgtcatctcctgcgataacgctgcccctgtataagactgtcttggaggctgcagcgctaatgcttaaggagaaggttcccaggatcccggttgtgaatgaccaccaccatgtgatcggaattgtgactcgctcggacgtattccagactcttgagcccaccaacaaagcatgagagtggggtcccctgttaggcttgttctccccagatgttgtccgttgtaaatatcagtggaatcagactgctgctgctgctcgccctggtatatattctagttctagctgctgttgtcccctagtatggacgcgttgagcttgtgtacatgtggactgtaccatgtttatgaactgagttga

SEQ ID NO: 26626 - DNA, 634 bp, Sorghum bicolor
  Clone ID: 30976917
aatctacactctctgatgtgctctctaactttgattcaaatcttgggatcccatacagttcagttctaaatgatgctgtcagagtgagctatgctgttcaccttatgcttgtgttcccaatgatattccatgcattgaggcttaatttggatgggctcctcttctcctctgcaaggcctctgtcttctgataacagaagatttggcataatgacagcattgctcctcctagtaatttttgggtctgcaatcttcattcctagtattcgggatgtctttcagtttactggggcaactgctgctgtctgtattggctttattttcccagccgcgatcactttaagggatccacaaggcattgcaaagaagtgggacaaaattctagcggtcttcatgattgttcttgctgttgtatcaaatgtagtagctgtctacagcgatgcctacaaaatattccacaagaaaagtgctccttccaatgcctgaattggggagtcctggtctgactcaaatcgcgttgagtttcgcgtgtgtatctacacactggggctgaagagttgcacaaactgaagtgcttctgtacagtaaaagcaattgtatcaaatgtcaaattatagagttatacgatcatgatg

SEQ ID NO: 26627 - DNA, 139 bp, Sorghum bicolor
  Clone ID: 30976930
tggcagtgcacaaaagtgcaaggtattgtaggtccgtcgcatgaggatgcatggtgtgattttgagacttgaacagctgcagttttcacatgaattttatccgtagggacaagggagtgaatgtttgtttctccaaaaa

SEQ ID NO: 26628 - DNA, 637 bp, Sorghum bicolor
  Clone ID: 30976966
agcaaccgagagcggggggcgcggggttggtagcgaacggcggccactgattcgagtaagccggaggcagcggcgaaggaggcagctcctctggggcgaagtagcgcgtcaaggtggtgcccaagcccaaggtcgacatgaagaggaatctggaggatctgtggtggtctgcttttcctattgggactgagtgggaaagcatggatagaataaaggaattcaattggaacttcgaaaatttagagaaaacactagaggaagggggggaactatatgggaagacagtttacttgtttggaggcaccgagccacaactattggatgtcaatggtgaattgaagatagtacttgttcctgttgtagttgctgttgactgtccttttcctccatcagataagattggcataaattttgttcaaacgggaaaagaagaaatagtaccaatgaaagagatgaagatggcatgggtgccttatgttcctcttgaggaccggtttgtcaggattgaaagtttgaaaacaaaaatcttcactctctgttgcacccagcggaggtctgtgctgaagtgtatgaaaactgagagagccaacaagttctattactgcacgccctattacatgccactaaatcctcctga

SEQ ID NO: 26629 - DNA, 669 bp, Sorghum bicolor
  Clone ID: 30976973
aaaacgcactagctctccacttccccagccagccgtcgtcccctgtttgttgctgcccgtgctcatccggtcaccttccatccctccgtccgcggccgccagtcccccgttccccaccgaccaccagtctgcggatcaagatccgtcgaggctgaggaacaatattcttggcatggtggctgacacggaaagcgcagattcactgcctggcagttcaaatgctgcttctgagacgcctgctcatgggtctattcaccaaaagtcccaggaaaacccctcaaagaaaacacataaagctgaacgagagaagcttaaacgtgatcagttgaatgacctttttgttgagctgggcagtatgctagatcttgatcgacaaaatactggaaaagctacagtgttaggtgatgctgcacgagtactgcgagatctaattactcaagtagaatctcttaggaaggaacaatctgctcttgtatcggaacgccaatatgtcagttcagagaagaatgagctggaagaggagaacaattcgctcaaatcacaaatatcagaactacaaaatgagctctgtacaaggctgaggaacagcagcctcaatcaaaacagccttgggatgtcactaccagttgcgaacactgtaggtcctgatctggcaactcaccctatgcc

SEQ ID NO: 26630 - DNA, 637 bp, Sorghum bicolor
  Clone ID: 30976974
gacgaaagaaacccaggcgcgggcgcgggcgtccaacgaattggcgggttggctggctagccgaagccgaagccgccgcaccagccttggcctccctcgtaacgtaaacctcgttggctggccgggttgacggcggcaccaacgtttcccctcgccgcctcgttgcctccgcccccaaagcagcccgcccactcctcgtacataaacccccaccggccaccgtgccgtacgccgctcccccccaccctctctctccccgctcgcctagcagtgaccatggccctcccgccgtcctcttcggcgtcttcgctctccgccgcgtcagcacagccgacgccgctccacctgcacctcactagccgggcacctggccgcctcccgctgctccacttctcgcgtgccgcgctcccgctgccgctgcgcgcccgcattccgcgcaccaacaaccccccgggaacgcccctccaccgcgggctcccaccaccaccctccgcctccgcctcgccctccatcgccggcggtggctttggcagcgatgacgccgaagagaaccacggcggagacggcggcagcggcagcggagccggcggcgacgagggtggtggcgacgacggcggccacaacgaccacggcgggg

SEQ ID NO: 26631 - DNA, 636 bp, Sorghum bicolor
  Clone ID: 30976981
atgctcatagtgctcgcccctatcattgcctcattgctcatttggtctactcggcgcagggagcttttttccttgatttccttttacggcggcttgtccatcttttccaggtgcagccatctctccaactccaagccttaggttttgtccaggctagtcttttaaacattgctatctgactatccgagtgttttagcatcttgaataaaggtactgtactggccgtgcttgaaaaattgctatccgaggcgtcttgaataaagatttcttggattggttacagaagtttcatgacttactgaaggcatccctgcacactggggaagacaaacagatgtttgttatcatgtgaaactgcttttgcagtcaggattttgcttaaaaagaaatggacattgagtttagcaactgtgatatgctggagagcatgttacaatatggaagttcaggaccacgcaatctatccctagagtatttgagaaacatcacaaacaacttctctgatgagcggctacttggtgaaggtggttttggcaccgtatataagggagtactaccaaatggtgaatcgatggctgtgaagaaacttaattcgtcaatgcctggagtcaaggataaacaatttgagaatgaagc

SEQ ID NO: 26632 - DNA, 592 bp, Sorghum bicolor
  Clone ID: 30976992
ccatccaacaacacacacctatagctaccacgtactgtgatttctaccgtcgaaacatcgaatctctcctccaggccggccggccggatccagctacagttgcattgcaagctagcaagccagcaaattaaagcaaacaagatgaagagcaaggcgtcgacgttgttgaagctgaagcagatggtgtcgaccctcatggcggcggtcaagtccaagtccacggcggtgcgtgtcaagacgagcgcgctcaagacgcgcctcctcatcttcggcatcctccgcaacaagaagctgctcatgacggccatcaaccacaagatccacgccatcatggggcaccaggaccaggaagcagcagcagcagcagacggcggcgacaacaaggacggcggcgcctgccagcagcggggcgccggcgccggcgacggtgacgaagacggcggcggcggcggcaggaaggccatcgtgctctaccagccccccacaagctacagcttctcttcagagctgggcgcccacgagacggaggcggaggcggaggcggaggtggaggaggacagcgacgactacctgacccactcgctgttcgccg

SEQ ID NO: 26633 - DNA, 657 bp, Sorghum bicolor
  Clone ID: 30976997
gcacccgcccggcctcctcctccgcagtcccatgagccaagccgcgcccgtggcgaaccctcctcgcgccgcgcccgcgcctgcccattccaccgccgtcctcaccggccaccgggccgcctctcctgccccgcggagccacggcgtccgcgtcggcgtcggcgtcgcggagccacagccgcccgctgctcccccctcagctcccctctgacgccggtgcccggtgtgcagatccgtctgaccgcgccgctgctgctcccgaaggatacactgaaaaagatccttgagttgaatgctgatgctgaatatctgaagaagttcggcctcaatggcaggactgatgtagagagctacaaatcctgcatcccgttgtgtgtgcacagtgatcttgagccatacatccataggatcgctgatggtgatagctctccactcctcactgggaagcccgtcacctccctttccctcagttccggaacaacacagggcaagcccaagttcttgccatttactgatgaattgcttgagaccacacttcagatattccagacttcatatgcatttaggaaccgtaagtatccaataggaagaggaaaagcgttgcagtttatctatggtagcaagcaagtggtaacaaaaggtggcatccttgccaca

SEQ ID NO: 26634 - DNA, 486 bp, Sorghum bicolor
  Clone ID: 30977005
tcgtccacacgattcccctcgctcccgcactcccctcgctccccctcacacccgcactccccatcgacgccgcacaacctgcactcccttcgctctcctcccacctagccaccatcgacgctgcactccccttgctcccctcccacctagacgccgacgaggagccacgcctgccaccaccaagggaaaggcgacgagaatctcatcctctcccgacgcacgccctccacggccgccgacgagaggtgaggtcgcagttgtcccctcccacctgcgccacggccgaaaccatcggtcgcccagccgacctagcggcggcctgcggttacccgtgagcgcgcgcgctcgagcggtgaaggcgccaccagatctggggcgcgggacgggatcgcgggcaggacacgaagttaggcaggcggccgggggtgtggcgtggagcggaagcgaagaagattagaggggcgctgcggccgcgtcgcatggtgg

SEQ ID NO: 26635 - DNA, 643 bp, Sorghum bicolor
  Clone ID: 30977023
taagttgacccaaccctaagcagcccccccgcgctaaacccatcatcgccaccatgcgaagaagcatcggcgctgccgccgccgccgccgccgccaggcggcacactccactcccgtactcctgcgcccccgccttctcctcctcctctggaagcgggggcggtgatggcggtttcgggcacgggcgcgggcgcggcctgccggcctcagggcagccgcgcgctcccgggaggcccatttccgacgacgatggcgcggatcccttctccgccacagcatccgtcggccgcggccgcggggagcctgcggttccctcgtcccccagcatcccgtccttcgccatgttctctggcgtcggtcgcggccgcggatccccactgcccccgccgccaccccccgaggacgcccccaagcagccgaccttgaccaagcgcttcgacaacgctcctcagcgccccgatccggagccgccgagtctcgatgcttcctcctccgcgccgccgctgccccgcacgctcccgttctccggcgccggccgcggggtccccaggatgcagcagcctgcgccggataagcctcaggaagagaaccggttcatccggcgccgcgaggcggcgaaacaggctgccgcagtgccggcgaa

SEQ ID NO: 26636 - DNA, 553 bp, Sorghum bicolor
  Clone ID: 30977025
acaacagcacagcagtgctctcttcgcttgcttctgtttccgccggcgtgcagggcacctgcttcttgcacaatgggggaggagacgcaccagagcgtgcaggagctggcggcgtcgctgggcgcgctaccgccggagttcgtgcggtctgagcacgaccagccgggcgtgaccacgtaccgcggggccgacgcaccggtgatcggcatgtcggagcccgggttcggggcgcgcatggccgtagccgccacggaatgggggctgttccaggtcgtgaaccacggcgtgccctccgcggcggtggcggagctccagcgcgtcgggcgggccttcttcgcgctgccgcgggaggagaaggagcgctacgccatggacccggcgtcgggcaagatcgagggctacggcaccaaactgcagagggacgtcgagggcaagaagacgtggaacgacttcttcttccacgtcgtcgcgccgccggagaaggtggaccacgccgtctggcccgagaccgtcgccgtagccgggtacagggaggccaacgaggagtactgcc

SEQ ID NO: 26637 - DNA, 668 bp, Sorghum bicolor
  Clone ID: 30977063
gatacaaaagtatttatatttgaagttgcaaatggaaagcgaattccacttggagcaggtcaacatgtacaaatttgcgtgagtacaaaatctgaagataacaaaccaccggaacggattgtccgcaagtatacaccgattgaaattcatgatggtcgttttgaggtattaattaaacaatatgaacagggaattgtatcacggtacatttttaacatgaaaataggagaaaagatctttatgagaggaccatttggtgcgtttaattactcaccaaacaagtacaagtcaattggaatggttgctgctggaacgggaattacaccaatgtatcaaatcattagagaagttgttaagaatgttgaagatggaacgaaaatcaagttattgtttgcaaatagaagtgaggaagatattctattgaagagtgaattggatacaatggtaggtgacaatttggagatcaaatacttgctaagtcagccaaaaactgaggtttacacgaaaggtaggatcaatcaggatctaatcaaggaatttgcgtaccctaataccgatgcaatgatgttactttgtggacctgatgcattttgcgatttagcaaaggagatcttacagagcatgaaccactccaagtcactgttgcatactttttaataaattgtgcg

SEQ ID NO: 26638 - DNA, 572 bp, Sorghum bicolor
  Clone ID: 30977079
ccccgagctgggcgtcgcggacttcgagatcggcagcttcgacgtggagagcatctggagcatggacgacaacctgtggttcacgcaggcgcagggcgtgtgaataatccaagtgcaacgagccaccacgcacgcgcgcggcgacatggaaatccgcggcatcatgtcgccggtgagtggatcggacacccgcgtcgatcggacacgtcggggacgccgcctagcagaggagcagaggtagctgagacacggattagaagaaggagagagattatttggaggaatcgaagacgacggcgtacacttctctttgttcggttcaagatgctgttcttgggctcgtattcttccgctccagttctactccgtttcttagtttttttttcttgtcttaattccctagccgcctagcggctagtagggtacatacgccaaagaaaattccagaaaaaaaacgtagctgttgtagtagtgtatactatactagcgttaagtgtttgtacgtggcccgtctaattttactcattctttttgagtaaatacatcatatatatgagcaactgaagttatgc

SEQ ID NO: 26639 - DNA, 387 bp, Sorghum bicolor
  Clone ID: 30977082
gtcaaagcccgccgcaactgcttcaagcgcgacgccggcgtcaacatccagaccaccgttgcagctgctggctcaggcgacgacgagagccagcttgcggcctctgcttgatgcatatcagcacaagcagatccaaatctctgctgccattatatatgtggtctgtcgatcgtcaaataagtaacgcaagcggcaatgtttgtccttgtttgttaggaagctaaaccaaaagcttattaattagttggtccaggtcgcatgtacgtagttggtgtacgtttgtctacccaaccaaagcatctaggtcgttgtcaagtcattgttgacgttgagacgattttgggtgctttctgctgttttcctcttaataaaaaatcgtctagccta

SEQ ID NO: 26640 - DNA, 620 bp, Sorghum bicolor
  Clone ID: 30977084
catcacgcgccagcgccccagccgcgcccgctgtcgctgccgctgcatcacttcacggtgcaaccgagcgccgccgccggcgttaccgccgcgtcacggccggtcgttctcgactcggtgccagtcattgagagcccgacgaccgccgcgaagcgcgtgcggctgttcggcgtcaatctggacaataacccgctgtcagaatcagacggcggcgtcggcgaggctagccatcagggcaatgcattgtcgttgcagatgcccgggtggcagcaaaggacgactccaactctaaggctactagaattgcctcgtcatggcgccgcggaatcctccgcggcatcgtctccgtcgtcgtcgtcttcctccaagagggaggcgcgttcagctttggatctcgatctgtgacctaaaggcaaaatcaaaggaaagttctacaattctttctttctgcttgtttcggttctgcttatattactaccttcttcttcttcttcttcttcttcttcttcttcttcttcttcttcttcttcttcttcttcttcttcttcttcttcttcttcttctcttttgattaatcaattataacttttgatgataggagctagaatttgacgttttaa

SEQ ID NO: 26641 - DNA, 511 bp, Sorghum bicolor
  Clone ID: 30977090
tccggaaactgcacgccgacctggattactgccctgatccggagcggtacggtcggcccatcaagcccctggagaggtccgcgccggagatgcccatggagcggttgctggaagccaccgcgccggcgcaaacgccggcgccggcgttaccgttcgatccggagacggacatgagcgtcggcggctggctcgcggaggccgttgactgggtgctcgacaagatcgagtgggtatttggataagatcagatcagactcaggcggtcaggccctcctgtcgtcagcacttccgttcgacgtgcatggtccgttgatcggcaacaggaatagcgtggctagtagaagatggcaacgggtaccaaaccgctggcccaaactcatgccgaagaaaataaaatctacccgttaaaaaatctatgacccatcacgggtttagttttatgttcaaacccatgcccattcgggtcacgaggtacccacgggtcgcccatgatatcaataaaatttaaact

SEQ ID NO: 26642 - DNA, 177 bp, Sorghum bicolor
  Clone ID: 30977092
gatttcgctactgtagcacttttgtttgtttgtggtaaatattgtccaatcatagactatctaggatcaaaggattcgtctcgcgatttatagttaaactgtgtaattagtttttgttttcgtctacatttagtgttttatgcatgtgccgaaagattcaatgtgacaaggaatctg

SEQ ID NO: 26643 - DNA, 664 bp, Sorghum bicolor
  Clone ID: 30977093
aagctgaagaagctagcagagagggatgaagaagtggttcttgcatctggcatcccatgtacaataatcagaactggttctctgcaaagcacccctggtggtgagagaggttccgattttactgagggcatagcaaccaagggaagaataagcaaagaggatgctgctaccatatgtgtggaagctctggatagcattccccgaaagacactcatttttgaggttgcaaatggtgatgagaaggtgagagactggaatgcatggtttgcagagcagatcaaaagagaagaagagatacagtaaaaagaacaaattggaagtggttttcgtttgatagagtgtcagaccgaaaggaaaatagaaaagaggaaaaaaaaaggaaggtgggattttaaagattaaaaggaaaagagctgaagtttacttttgaaactctggcctggctgccaattgaatcatactagtatatctgatgaagaaataaaagtgcgtggagaagtggaggcacgtctacctcagcctccaaggaggctacgaactctgggctcttcagttggactgaagctttgatcctctattgtttatcaattcattatctttgtactatgaaactgcagttcaaactgtgttacaatttcaccaaagtctttaatcgtccacgaga

SEQ ID NO: 26644 - DNA, 625 bp, Sorghum bicolor
  Clone ID: 30977108
gaggaccacgcacatcttcgacgactgcatcgtcgagagctgcggggatttgctactcgagaaggctgacaaggccgcgtccttcgtcgccggcggcgcagccgggacgtgtggcttcttgagctcttgccatgcatgcaacaagcaactcggacatggcaatgacatcttaatctatggaggtgataaagcattctgcagcagtgagtgccggtaccaggagatgatgcttttcgacgaagcagtggacaatttgcgctaggcgatgaagggaaaggagggtgtgttagtggaggagaagagaagccatgatgatcctgaataaccgagacgagatttctttcttcttctttttttgcccctttcttttgtttcctttcgttctgtcacctttgcgagattgcatgctgtttttggtcatggaggaggaggagggaatgatttagtcttttgcggattaaagacctttggcgcccacttttgtaagaggttgaagattgatgacctgggcttcttgttcatgcaactttcccagttagttcccagctatgatgctcctgttctgtgcttcttcgaatgcttgtccatgtgactcactcattcagagtggattctgaagtaaatg

SEQ ID NO: 26645 - DNA, 649 bp, Sorghum bicolor
  Clone ID: 30977110
taagtgtccaacttttgtgtgttaattcaagttcagtgactattctgatgaagatacaggaggcaaggacgaaccaaatcaccatcagttaggaacataccgtgtcctttttcaattttgactgcaaatgaacacctcatccaacagaagggtcaagagaaacaccctgcagcccatctcaaatccatcttcaagagggagggaacacctatgagaaaacaacagagtgatggagctcaactgccaaggctcgtctgcgcttagctttgtgactttggtgatggatcttatggccatccttgaatttgttcatggcagcattcatgacagcctgttctaaccatgtgagctgtattacagtggcaaattcaattagcaataggaggcaaattgagctggaagttgaaaaacagtgaaattcgaaagttttagtattaaacttcgaattggggaggtgattccaacgggaggtaggttgaattaatcgcctctgaagggtgccaactcttctgatggataccggtgaagtaaactgaaagattaatcgcctctgactctgaatgccaatgccaagtcttgtgatggatatccaggtgaagtaaaccggaaacatggatggtctggtacttcgagttaaacacgttttgat

SEQ ID NO: 26646 - DNA, 629 bp, Sorghum bicolor
  Clone ID: 30977118
agtcgcctctcctctacctccctccgtttgcattcacctggtgcgcgcacatactgcatctcgtcgtcgtcgtcaggaaaggaggcgtactagcgcggaggctgccggcgacaatgacgatgatggcgccgcatccgcagccactgccgctggcacagccaccgccggcggcggcagcggcgttcggggacaccacgctcaccaaggtgttcgtgggcgggctggcgtgggagacccacaaggacacactccgcgagcacttcgagcgctacggcgacatcctcgaggccgtcatcatctccgacaagctcaccggccgctccaagggctacggcttcgtgacgttcaaggaggcggacgcggccaagaaggcgtgcgaggacgccacccccgtcatcaacggccgccgcgccaactgcaacctcgcctccctcggcgccaagccgcggccccagccgccgcacatcctccgccccgggccctcgccgccggccaccccggcgccgcacgcgcacgcgctcccctccccacaccagcccacgccagccatcgcggtgggatccaggggcgtgtcgccggtgccatggtactaccacgcctcgacgacgccccctccgccgccgccgccg

SEQ ID NO: 26647 - DNA, 663 bp, Sorghum bicolor
  Clone ID: 30977132
tgttggcctctggtctctcgcggcctgcgtatccctcttccctcggctgcttcctcctccctccgcatccacaccatggaatcctagcgctagctcggctaaatcgaggggcaaccagtggtgcaaacaaatcgggtgatgctgcaggcgtacagccgctcctgcgcgcatggcagcacgtggcgcgcgccgtgctcgtgcagccggacagccgccgaccggcattggcggctttgcgtgctgctggtgagtggtgactggtgagtgctactaatctcatatgggctaggcggctggccgtctcacggaaactcgaaagcacatcagggtctgcgattggcgcacggcagctgcttgtatcgatttacttttttgttgatgccttctgaagtctcaatctcccaatctggcaagtggcaaatccccatgagtccatggaatatcatacttcttcatctctatttcaattgcataaattgaaatcgacgattatatatttgtaccgaatttttatagacttgcacaaactgaattggttaaatgggatcatcatttaatcattcctaaatactactttagttgtcttttgtgaaaaatacatctctgatttcttgtaagtgtccaacttttgtgtgttaattcaagttcagtgactattctgat

SEQ ID NO: 26648 - DNA, 639 bp, Sorghum bicolor
  Clone ID: 30977141
gtgatgaagcaatggccaccaatggcatggccccctccttcttccccgccaacttcctcctccaaatgcagcagcccctccaccaccagcagcagcaggagcaccaccaccaccaccaccaacaccaccatgacgagcaccatctcctggctccccctcccccggcgctcgtcagccccttcctccacgacttcggcggcgccatggccgcgccgccgccaatgctggccggcggcctcggcatgggcggcgacgacagccacctgcacgcggcggagccccagcagcagcaggacggcggaggcgtcgcgtcggacgacgaggaggtgtccgccgcggcgggcggcgggtgcggcggcgagcggaagcggcggctgagcgtggagcaggtgcgcaccctggagcgcagcttcgaggtggccaacaagctggagcccgagcgcaaggcgcagctggcccgcgcgctggggctgcagccccgccaggtggccatctggttccagaaccgccgcgccaggtggaagaccaagcagctggagaaggactacgacgcgctgcgccggcagctcgacgccgcacgcgccgagaacgacacactcctgtcccacaacaagaagctgcaggcagagatcatggcgc

SEQ ID NO: 26649 - DNA, 514 bp, Sorghum bicolor
  Clone ID: 30977151
atctctgagttttccaacacagcaagcataaaccccggcgcttccttctctccatctccggtgcccgctccgcgcctccacgcgccgcggcagggaccaccgcctgtattccacggcgctagcagctagcttcccgactcccagtgcttaaccccagccccaacgtcgacggccggccggccgcctcgtcgctgcaagcaccgcgtccccgggcggctggaggctggagcccgcaggctcccagggcccgccgcaggtgcgtttagtgccgctcgaggctcgccgttttgctggatccgtgctgcgctttgccggcattgtgccctccgtggcgtagaggggcgtgcgcgttgctgcggtgggggaaggggacggccatcggctaggttggccacggcccgcggcccgggctggcggcgtgcgggcattgcggttgcgtgctggaggctgctcttgaccgttgcttgctaatctatctacagcctgtacaggactactgaattccactcttctg

SEQ ID NO: 26650 - DNA, 675 bp, Sorghum bicolor
  Clone ID: 30977157
taacttgtagaaacgaagacatgacaaaagtgttcactcgggatgacgtcgcaaaacacaacactgtggaagatttttatacgatagttggcaacaaagtatacgatatgacgcaatatgtacacgaacatcccggtggatacgatttattgtttcgaaatgccggaaaagactctacaaaagattttgacgccatgttccactcaatgaaagcgcgtaatatactagaaaaatcatgtcggtgatttggacgcgtcatcggcacaatccatgacgtcattgacgccaaactatttgactcgttttgcgaacaaaaacaatattcaaggtggcggtggatacccgaatcgctccaatttgatcgtacaaacaaatccatacgacaaacctcaaccttcattccccttcccaaactctcgcgtgatgggtcactcgttcaaagtaccagggaaagtacccgtactcaatcccgaaaccaatcaacaagtattttcatctccagcgatacagttagaatctaccgaagaagatgttgccatgagtgataaaaagtttaaaaaatacaaattgtcacaagtcaggaacgtatctcatgatacaaaagtatttatatttgaagttgcaaatggaaagcgaattccacttggagcaggtcaacatgtacaaatttgcgtg

SEQ ID NO: 26651 - DNA, 634 bp, Sorghum bicolor
  Clone ID: 30977163
agtcagccgacagacaccagcgcaaagcccccccacgagaagatccgccctctcctcctcctcctccggtcctccgcgttgctgtcgcgccggcgtcgaggctcgagagaaggcggcggcggcggtggcggtggcgggtgagcgcgtggctgtggggtgtgtccgtccggtgagatagctgggggacgcgccggctcgtgctgtgacctggaagctctggaggcgctgaaagcggcctggcaggcgggcgatggggtgggggtggtcttcgtgctgcaagcggtcggacggggctgagcctggtaggaggaagaagaagaaggacacgacgtggcggatcttctcgctgaaggagcttcagtcagcaacaaacaatttcaattatgataacaagctcggcgagggtggttttggcagtgtctattggggccagctctgggatgggtcacagattgccgtgaagaggctcaagagttggagcaacaaagctgaaagagaatttgctgtcgaagtggagattttggcacgagtgaggcacaagagcctttttagcttgcgcggatattgtgctgaaggccaggaacgcttgatagtctatgattatatgccaaacctgagcatacactctcaactt

SEQ ID NO: 26652 - DNA, 663 bp, Sorghum bicolor
  Clone ID: 30977167
aggctagggggaacagaacagtagtcgttggcctcttgctttgcttttggtttggagccgccctgcgctgcgctgcgcttttgtttggtgagcaacggagcggaatcgtcatggagggcctgctgccgttcctgtaccgggccatcctccacctcgccaacggcgggcagacgcccatcggcaacccgttccgcaacgagtcgccgccggagtcgccggcgccctactacgtccgcctcgccgccgccggagccgacgtgccggccttcctctcctccgcggcgcgcggctactacgatcgcgggtgatcccgatcgatcaaatcatcggccggctgatgatgggtccgaggcgatacgatacgaggcgtgcgaagaagaagaattctcgtgagctccttcctttagttccgtgttgagtatgtgagtccctcgttgattctcctctccttcttgttcttggcttcttggagattctccccctcctttgctccttggaataaaggcacgggtggatggatggatgagtgccagccgtccaggggggcgcctttgtgaaggtggctcctctgcatcttgtatatacgtgatcagtcgggtgcttgccaaattgcaggctctgagacacggcgaatttgaaactgctactgatatgtacatgttt

SEQ ID NO: 26653 - DNA, 654 bp, Sorghum bicolor
  unsure (1)..(654): unsure at all n locations
  Clone ID: 30977181
acctcatcgcactcttcttccttcgtcttccttctttctcccgccttctcctcctagctcccagcaaagcagcagctgcgagctcttcgaacttttgaatactagtcatcaatcatccagcagccagcagtcgtcgtcgtccgccgctcatcagccgatcaacgtctcaaggggatcgatcggaagaatctgatggacatggcgcacgagagagacgcgagcagcgaggaggaggtgatggccggcgagctccggcgcgggccgtggacggtggaggaggacctcctgctggtcaactacgtcgccgcgcacggcgagggacgctgaagcgcactggcaagagctgccgcctccggtggctcaactacctccgcccggacctccggcgcggcaacatcacgccgcaggagcagctgctcatcctggagctgcactcgcgctggggcaaccgctggtccaagatcgcgcagcacctcccggggcgcaccgacnacgagatcaagaactactggcgcacgcgcgtgcagaagcacgccaagcagctcaagtgcgacgtcaacagccagcagttcaaggacgtcatgcgctacctctggatgccccgcctcgtcgagcgcatccaggccgccgcagccaacgccagcgccggcgggg

SEQ ID NO: 26654 - DNA, 636 bp, Sorghum bicolor
  Clone ID: 30977188
aatgcggacgccttcgggcgggcgggcgcgcggcctaattcttcttcccgtctagctagctagctgctgcctgatctcccgtccttcttccccctccctccacagagccagagtagcaagcaacagcaacgccaagcctgcgtacacgcatacataggtagatccgatcccgctctactgcccctgccctatagtggcgtcgtgccgtcgtcgtcgtcgtttgcgctgggcaacagtcccttctccgcccagcaacctccagcggctgtcatcgcatcagcggaaccgagctacccagctaggtagcagccggccggtggagaggagtgaatcgaagaagcaggtggcggaaccaagctagggaggagcaagaaataccagaggaagcaagcaagcgcagtcgagtagaggtacagctctaactgcttcgggtaagtggtagtagctatatggaccagttcgccgcgagcgggagattctctagagaggaggaggcggacgaggagcaggaggacgcgtccaattccatgcgcgagatctctttcatgccggcggcggctgcggcagggaccgcgccgtcatcttcggcggccgcttccgccgcctccaccagcgcatccgcgtctgcggcctcgg

SEQ ID NO: 26655 - DNA, 658 bp, Sorghum bicolor
  Clone ID: 30977196
aggcaaccttgctgtcgactgtcgtgcgcctccttgccgagactccaatgcccctgccgcacctgctcccgcggctttcccacacgccgcctccacttcgcgccggggacaggggtaacgccgccctgctgtctccggggggaagaagaagaagaagaaggccggcgcttctcgccgtcgtccgggccaagagaaaggatgaggcaagcttcgccgaccgcatcctcgactacatcgagggggggccaaagttaagaagatggtatggagcacccgatttgcttcccaaggatggggatgggggtgccgaggatgaggaggatgagtctcaagtagatattgaggagcctcgggacgctgtgctagtcactaatggcgacagtgagattggacagatggtgatattggcactaattctgaaaagggctagaacaaaagcacttgttaaggataaacgaaccaccgaagaagcctttggaacttatgtggagtgcatggttggcgatatggaagacaagtccttcacgaagaaagcattaaggggcgttcgtgctataatttgtccagctgatgatggtttcttctctgaaccaaccgacctcaagggtgttcaacacattgttctgctatcacagctggctgtctacagaaatagtgg

SEQ ID NO: 26656 - DNA, 597 bp, Sorghum bicolor
  Clone ID: 30977206
atgtttcatcatgaaattcttcaatgaagatgctacttcgtcacaaattagtaatatcctttccccccatatagttaataaggtttgagtgtactgaacactaacaaatgcagctcgtgaaagtaaggcccttgattttcgtcatagaacatgagcagctacttcaattgcggcactcacgtgaaaaaaaaaatccactctgcatgctggggattcggggcgaatgaagtgtgtggggctcagctgcacctagttggcatccaaggaacttaggctgacttcagcaagagatgcaccttcgactaaacttgttggttttatttcttgtggttttgattcttcacttctgtttgttgtgttctgccttcactgcaccagtggttgaatatgcttctgtctgtggtaagttattcttggtaatggctctttttctcctgatcagtgtatgttggactttctgatagagttagcgtcaattgtagtataaatatgtttcctatggaagataattgtaataattctatgtggatagtcagagaacatacacagatttgaggtctaatctgctctcggcaaatgagtttttttttctgtaag

SEQ ID NO: 26657 - DNA, 512 bp, Sorghum bicolor
  Clone ID: 30977234
tcaggcgcatcctccatcggtgggacccccttgtacgccgcttggaacccgatggcaggcgctcctttgatcaggcatccctcatcaacaacttcaacacatgtctctgacgccgtcgccgaacaccaccgagtggtatgctgactctggtgccggttctcacatgaccgctcactttgacgcggagcgtgatcgccaggtgcaatagcacgggcgatttatacccgttctttccaactaccagcagcagcagcacacatatcctcaccgccacccctacatccaccttgtggcatggtcgtctcggtcatcttggctccgaagcattgtctaagctcattagcacccaggttattccatgtaataaaccacaacatgaacacatatgtcatgcttgtcagttagggcaccatgttcgcctcccttttcagttgtctagctctcgtgctgtcaaattattcgatttaatacattgtgatctttggacatctcctattgttagcgtgtccggt

SEQ ID NO: 26658 - DNA, 595 bp, Sorghum bicolor
  Clone ID: 30977246
actgcgttttgtttgtgggcagaggtggctgctatgcgtgatgtatcagctacagaaactgcaattatttatggtctggaacctgtatggggtgctgcttttgcatgggcaatgctcggtgagagatggggcacgacaggatttgtcggggctatcttgatcatagctggcagcttgatggttcagatatttggagcaatccctgatgtatctagaggagacaattatcagatgaacagttaaatgtacatattacagaagatgaagcaagttgtaattcatgatgaagcaacctttttcttttcttttatagggtagctatctaataacctagcaatagcaagcatgtcagcacaaagaaatccaacaattgttatgacactagtaggcagtagtgcagggaaccgaagctctctggttgacccaacacacatttgtgctgaattctgacttttctatgcatttagatatatactatgtttagatacataatgaaagtaatgtatctagaaaagccagaaatgtcttatagtttgcaacggagggagtagataggaaccagttcttcaagcagattgaaaaagttactttcacc

SEQ ID NO: 26659 - DNA, 624 bp, Sorghum bicolor
  Clone ID: 30977247
ggagaacccttaacttatgattacaggtttgtgcattttggagagaaagtgaagtgtcattgcgaggcagtgaactgccagggatacctgggcagccaaataaagaacccaattcaaagcattattgcttctgcaacatcacaagggcagttgcgagaagtttcgtccacacaacaagaagcttcaagattgaagccaataaaacatttattaccctggaccaactgtatagaggtctcttttaacctgagaagcaaaaggaaaattagccggctatgctgggcccacaagaagaagagaacatccctcgaggcatcctcaacaagcatgccaacatcgatgagtgaagttcctgctgcggatatctgactgcccttccttgagcccctgctaaaagagcaagccttgtcctgtataataatttcatggtacattctttacatgcattggttggaaacgattctttcacattgttcatctatgttgttgtaaactgcaacattcattatttgatttcatagggaattcagtcagtttacaggtggtagtttgcgaaaacatgtgctcaaattttctgatcaaacaaatgtttgagcttcatgtaatgtttgcggctgctctttt

SEQ ID NO: 26660 - DNA, 643 bp, Sorghum bicolor
  Clone ID: 30977270
tggacacaggtctctctacctactcgcctgcccgccgcccggtgctctcgtccgctcgcgcatcgcctccttccggttccggaaccttctcctccgggctccctccggctagatgttccttcccaagcatccgagttcttcccgtccatggcgcccctcccttcaaccaggcgctcatctcattcgccctcgcccccgcatcccggcgacgacatcgtcaggacggaggcacctccttcggccgtcggccgctgcctcctccggctctccgtccagagattccccactcccagtccctcccgcgaagcggtcatcaaagaataaggcgccggatgaaatcgggaggtcgaaggcggtgcggccaggaatgcgcgagtccgctggccctgaaactgaaactgaggatccatcaccgcagcggacggccctgtggtcggcgaggcggagggcgcgcgctgcgtggcggaaggtggcgtcttgggtgcccagcaaggcccggagtctcgtactactcaacctggtcacccttatatttgctagcaacatttcagttgtgaaacaggcggaggctcttttggaccctgaccttttcaatatgttaaggttcactatagcagccatcccttttgtgccgctgttacta

SEQ ID NO: 26661 - DNA, 620 bp, Sorghum bicolor
  Clone ID: 30977280
tctcctcccggagggagattcctgctcctgcttctcccgacgattatcccatccgtccactctgctgtctgctgccgaggcccactaggatacctgctaggagttgaggagaatggctgttggtggaactcaaccggtcctcaggaagtacctaggtgccctcaaggacacaacgactgtgagcttggcaaaagtgaacagtgattataaggaattggacattgcaattgtcaaggccacaaaccatgttgagcgtccatcaaaggagaagtacataagagaaatttttcattccatttctgctgctaggccacgagcagatgtagcttattgcattcatgcccttgctagacgtctttcaaagacacgcaattgggcggttgcgctaaagacattgattgtcattcatcgtgcccttcgggaagttgatcccacttttcgtgaagagcttatcaattatggcagatctaggtcccatatgttgaacatggcctactttaaagatgactctagtgcagaagcttgggattattctgcatgggtgcgcatttatgctttatatttagaggagaggctcgaatgtttccgagtgttgaaatatgatgtagaaactgatcctc

SEQ ID NO: 26662 - DNA, 639 bp, Sorghum bicolor
  Clone ID: 30977302
aaaaaaaaaaaatctccgttgctttcctatggaactgaaatctctatttttcctacgttttttccttcattccaagcagttgcaatccaaacggcaccttaactcaaaaccacttttttgcaatcaaatcacaaataaaactgttgggattccttttatccggaggtgtgaacaggtcgatttgaactgcctaggcctagggctagggtgggttgcttgcagcacgctacagtcactgtcactcatcacacccaggctatggaggaggcatcagcgagggagcggaagaggccgcgcgaggtatggaagaggctgctcaaggcggcggcctgggatcctcagtacacgtacctgcctatcgccgacaccctcaaggttcccggcgtccaggtctgcctcttcgccgtcgtcgccgagatcggcgccgctgtccacagccttggcacggatttcactgttactttgaggattgtggatgaatcacgcaaggatggaatatctgcaacattttttgctgaaaacactgccctattgccctgtgttaagtcaagtggagatgtgatcaggctccataacgtcgtggtaaagcatcatcatggggagttctttcttacatttgacaaaaagttttcttcattc

SEQ ID NO: 26663 - DNA, 586 bp, Sorghum bicolor
  Clone ID: 30977317
taagtggaatatgtctcctaggacttgattgccaatttttcattgctattgcagtcagtagtacatatataggtatttcattgtcatcagtacaactctaattcttggacttgctagttcggtggatagagaaaggtgaaggtgctaatgtctaattctgtagtacatatatagatagttcattttcagtagtacaactctaattcagtagtatattcgatagttaattgttagtagtactacagatggactatggtacctgattgagtgtgtcccttcgtgggtacttgatacaaatttcagtgctaattactttttgcttgttgtactcacatatgccatggatacttggtggtatgttcggtgctaatttctgtgcataaagaaccggtgctaatttctatgcataaagagccagtgctaatttgagcacaaattgatgaacctgatggccaaatatttatgccttgatcattcgtgttgcctgatgaatccaggtgctagccccagcttgctgcctctgggatcaaatgactgcacacatccgggctccaggtgatgcatcttttttacattcatttcatat

SEQ ID NO: 26664 - DNA, 623 bp, Sorghum bicolor
  Clone ID: 30977340
ttcgatggtaggataggggcctaccatggtggtgacgggtgacggaatcgtgcattactctaactatcatgatggtacgatcccgtaacctctcgcttccgcaattctagcccgcgccgccggtcttccagatcgccgcgacctcctaactcgcgctgccggtctttcagatcgccgcgaacccgtcgatctcacgatcgcgccgtcgtcgctgagtggctccactcgccagcttcccccgacgccgctgcaaccccgcgcgacgcgtgcgaagcctcgggatcgcgtcctccgtcgcccgcacgcggcgtcgacgcttcgacggccacttcaatcgcgactcaccaggagctatcgtggagtacgtctacaccagcaggccagtgatccgcaaggtgctgtacgtctacgtgatcctgccggacggccgccgagtgctgtacatctacgctaggacccgatggccggtgaagactccgacgcttccgccgccgcgcagaagcagcgcgaggatgcagaggccgtcgacaagctcctcaccacccaggagacggccaacgccgcccttcacgccgcggcgatcgccttccacaacatcaagggcgccatctccgtcgtgctcg

SEQ ID NO: 26665 - DNA, 630 bp, Sorghum bicolor
  Clone ID: 30977356
cccctacctacaggccatcgccaaggagaccctgcgcctgcacccggcgttcccgctggtcgtgcgccgctccacggagccctgcaaggtgtccgggtacgacgtgccggctgggtcgacggtgttcgtgaacgtgtgggcgatcgggcgcgacgcggcgtgctgggcgccggacccgctggcgttccggccggagcggttcctggagggtggtgaagggagaggagatagcgcggggctggacgtgcgcgggcagcacttccacctgctgccgttcgggtccgggcggcggatttgccccggcgcgtcgctggccatgctcgtggtgcaggcggcgctggcggccatgctgcaatgcttcgagtgggcgcccgtcggcggcgcaaccgtggacatggaggaggggccagggctcacgctcccgcgaaagcgcccgctcgtctgcaccgtcaaggccaggctccacccagtgccggttcccactgccgctgctgctgataatggcgtggatggaactctccattgtgcatgaccagttccaggaacatatgaagtcttatgtgtaacactaataacttcaaacattatctgcatcatgtgctcgtgctcaagtactgaagtttggaagtt

SEQ ID NO: 26666 - DNA, 153 bp, Sorghum bicolor
  Clone ID: 30977366
ctgccaaccattttgctttttttttcggtatatccgagggttccccaggaaaggcttttggtgtttctcaataaaatttaaggccctatttcgtgttgtggactaggaagggatcgtatttactatttttacgcggtatatataaatcgataa

SEQ ID NO: 26667 - DNA, 533 bp, Sorghum bicolor
  Clone ID: 30977374
ccaaaattcggtgaaagccgtgatgatagctcctttgggaggtttgattccttcagatcccgagacactggattcttccctcaggaaagtcgtttctccaggtttgactccattagcagctccaaaggcgagaatgtatcacgattcgatacagggaatagctcacaaaattttggccggtttgactcttttgatgacgccgatccatttggttcaagtggcccttttaaagcatctggaagccggtctccacccaagttatgatatgctttttcctctgattagggttttgtgtcatgcgagttgatttgtcaatacaaggtttagattctttgagcgaactctggcgtaacatggatatttttttttgcatgacatttgtgccattttccttgtgtgcaattttccagtccatctcacgtacaaagtggacaggtttgggttactatatctttgtttttgtaaacatttttttctgtatcttgtaaattaattacgccaagtctgtctttgtttatatagtttataatata

SEQ ID NO: 26668 - DNA, 649 bp, Sorghum bicolor
  Clone ID: 30977387
gatcattgcgtgaacacaaagattctgatgaatatgtaattccatgtggtgactggtttggtcgtgtgtcttgccctcattaccttgctgaactagtactatattttggcatgttgatagctagtggtggatcagacatttcggtgtggttcctgtacctttttgtgataacaaacttatcctttgcagcggtacaaacacataaatggtatcttcagaaatttgaagattaccctcgttctcgctatgcaattattccatttgtatgctagatgtgtccagaaatgccaacagcatttgttcgctgttttcatctgcttgcacaagttcaacatgcaacagatattcatgtaaatctgactgtaacagttgaagcgctgcaatgtttgacttaagtagttccgatcattctgaatgtacttataaggttgtgtttgtgtatgtagattataatacacagatagttgatgtacagtagtattaattaacactttttagcattgaaaataaagtccttcagaaccagagacttatcaagtactttctccattccaaattgtaagatgttctggcattcagaaccagagacttatcaagtactccctccattccaaattgtaagatgttctgcattcagaaccagagactt

SEQ ID NO: 26669 - DNA, 650 bp, Sorghum bicolor
  Clone ID: 30977399
tgtgcactagttgaggtgcaggattgtggctcccttgtgaccgaggaacagccttatgcgatgctgatgccaatggagtacttccttatgggatatggactttatagaccgtatcagctaagcagcagcccacgaagtccactaagtccatgctgtataccgcctgagctgctatctcctgagagtatgggtgtgaagctgaagccgataaagactcgggttgctatcaatttctaacactggcaagcaagccttttgcatcagaatgaaaacagaccacctttcttagaaacctgaagacagccacaatctgatcgctctaggcacagaagtggtggtcacaactcggttgtataacatggcaaatggccatttctgttggagataacctatataatgtacatcacaaaaaaaaacagggcaagggggaccctgtagttgagataaccagtatgtgtctttgttcaattagtttgtgtagtcagctttcagcacaaatgtaaatctcaaagtagtttgacagaaacaataagaatccatctccagggtctcagatgttcaaatttcataatgacaaaattttgtcatgtgttgcactactgcacctgctgtttctggattacaaaggactagatatacacacttatttg

SEQ ID NO: 26670 - DNA, 550 bp, Sorghum bicolor
  Clone ID: 30977402
ataaacctgggtggtgacacatggatgagggttggcatatggctgctgatgggtgttcttgtgtacgttttctatggacgaacccacagctccctaacagatgtcgtctacgttccggtagcacaagctgatgagatatacaggagttcatcaggatatgtatcatagaaaagaacagctgcagtcatgtgacatgatagatttacagaaagaccgaccggatgatatattatttacttaaaaggtggttgttggccatctgttgtagataattggttatcagccaggaaagacgggaactgactgttatttctttaatgcttggccaacaagatctcgtggatgcaactttgaaagatatgttcacgaggcaggtcaatttacacattgttggagtgtgtgtagatgtggtgtatataaacccaattgggtggaatatgtgatacataatttgtgtaatccatgtatagccctttgtactgaaatgtgagggcattcagaggacctattgaaacagaacacggatggcaaaagaagccagctttttttt

SEQ ID NO: 26671 - DNA, 661 bp, Sorghum bicolor
  Clone ID: 30977435
atttatgtaatcgacagaccatcgtatgaggcaagcaagaagaaccaagttatccctagtctcatctctgctgtcttcaatctcaccttgtgctgggcgtccagggaagaaccctggcgccagcattacccacctgcagctacgagttgagaagtcagggacctgccactcggggacctgaggtccttgacaaaatataggcttgctttcgaatttatgtgaatttcgagctttgaattgattgtttcatatttttgcatgtttctccaacttggtgtaacaaatggtggtgtgggcaccagtagcatgcatgctttagtatttatgttgatttttttttcccaaagtaataactgtgaaggagtttgcagtttttcttgctatttcttttacttcctatcagttgtctccctgatgactaattgtttttattttgctaggttgaaacttgaagtttgattatggcattatgcaattggggactttgatttagtatgttttttgaattgtcgtagaagttatttgtctacatgatctagttcatggatgcttgatgatactgtatatcttttctgctccctgtagcaatccacatttgctatccatcttaaaacttattatagttttgcacctgatgcagttcatcaattattctttattc

SEQ ID NO: 26672 - DNA, 652 bp, Sorghum bicolor
  Clone ID: 30977450
agcagctagctagctagagctcgctggtcaactctgggcaggcagagaggaagtcaccatggaagtggccacatcacgagaactcatcaaccccacagccttctccattctcgtcctcgttgccggcctcaccaccgttttctacgtgctccgccgccggtgcagcggcaatggcggccttcgcctccctccgagcccgttggcgctgcccgtcctgggccatttccacctccttgccccgctcccccaccaggcgctgcaccggctggcgtcccggcacggcccgctcctgtacctccgcctcggctccatgccggccatcgccgcctgctccccggacgccgcccgcgaggtgctcaagacccacgaggcggcgttcctcgaccgcgccatgcccacggcggttcaccgcctgatgtacggcgggcaggacttcatcttctcgacgtacgggccctactggcgcttcatgaagcgcgcgtgcgtgcacgagctcctggacggccgcacgctggaacggctccgccatgtgcgccgcgaggaggtgtcccgcctcgtgcgctccctgtcccgcagcgccggcgacgacggcgcggccgtcgacgtggacgccgtgctcatgggcgtcacgggcgacatcgtctcgcggatg

SEQ ID NO: 26673 - DNA, 633 bp, Sorghum bicolor
  Clone ID: 30977459
attgtttccgcctttgaccaacgcacgactcggaatactcgttgccgagctgagcacgcccgccgccgagcacgcccgccgccgcgcccaccgccagccctctccgccggagacgttctcggacctcgcccgccgccgcgccctctccgccggagaagagccggaggtcatcgtcagcccctcgcgctaatcgccccccctcgcgccctgctcccttccatcctctgcggcgccccctcccacttccggctcctcggcgccccgctcagatcctcgacgcagagccacccctcatcctccacggcgccccgctcccgtatcctccgcatcgcccactcccggatccggcagctcggcgcagagccacttccggcagcccagatccatcacatgtgcgcctcccctcctcgattcctctcttcgtgctcatccacgccgccgccgcgccctcaccaagatcctcccatccgcatcacgcattcccctccgtcctcccccaccgccgccgccccagcccctgcaacgcctctcctcccacgatgactgcaacgactgtcgcgcgatccggggcacccgtctgcgctgccttcgtttgcgatccgtggcatccgtctctactgcctccgtcaatca

SEQ ID NO: 26674 - DNA, 658 bp, Sorghum bicolor
  Clone ID: 30977465
ctagagcctagccctcacgcgcgccgccacagccgccgccgctacgccccgcgcctcgcttgctttcccgtcgccaagatggtacgtcgcttcaccctcttcctcccgattcttcctgtcaccatggtttctatctcctgttgtttgtcgtacggtgaatgcctagttctgtctggccgctttttatgatgtgttgcgcgagatctggttttcgacttcgcagtccagctccagttcgatatgtattcgctccatagattagttttcgggacaggagcatgatcagcgatcatacttttgatcagtcgctgtgttttgatgtaagttgaaggtcgctgtgcttaaagtgcaatttagtgctagcctgcctgtaaggccatgcgggtagttggattgtgctagccttgattgtgcaatttagagtggcacactgccttttgtgcaatgtagccgtgtagttttgagaagttgctacctcaggtacgccactgtaaggccacaacgcatcagtgtggttttgatcctgagtgcatgtgcaagttccagcagattggaaaaatacatttttagtaaactcgctttggtcacctgacaccttttccatgtttaatctgaagcctgcaccaggcagcatgaatcttgaaagtagtatccagta

SEQ ID NO: 26675 - DNA, 244 bp, Sorghum bicolor
  Clone ID: 30977471
tatagcatatgaattgacttgtttagtactttagtggagactgaagtactaaaagaacaagagcttaaactgtgaacaactgctgcaccgcttaatatattattgaatatgcaagcccgagatgcatggttgtaggttgtttgtactgtcttatttgttatatttggaaatagagtttcaactctgtcctattttgtattctaactgaactgcttaatacgaatttacagatatctgcacattt

SEQ ID NO: 26676 - DNA, 659 bp, Sorghum bicolor
  Clone ID: 30977492
cttcccagtcgccccattcattttgaactcgccagctgctccattcgactagatctacacatcgagggccgactcagtgcgtcgccaccgccgtaggctggctggtagtcttggacgggcgagccccatccccttcacgcgtgcacagcgctgtacgagcctccttctctgttgtcgtgaagctgcatgcacaaatgctcattacaatgaagcttctccagatggagtgactagcagcaaggcgttgagtctaggctaaggaggccaccgttgtcactgcatatcagttattcatgcttctcctagcaggctagcacctgggcttccggtgtcgtcagggccagcccgcgcacggcgcagactttgcttccctcaccaggagcttcgagtgggatgaggaagcgagcagattgataaggtgtgctttttctcctcccttgctcagtcccttcatacctccgtcaagatccaatagattttaatgtgtccatcgccgcctctggatcgtccatggacatcgtcagccgccacgacactaggcgtggtcgccatattgctcggtagtagcttcgcttcacacatggccagtgcgttttctatggcccgcttggctccttggcaggatacgatgatcgagctcctgaagtccgagcgagagt

SEQ ID NO: 26677 - DNA, 637 bp, Sorghum bicolor
  Clone ID: 30977500
agagcgagcaacaagtttccaacagagacgataccagaagaacgcacgcgagagggaaccgcgagccaagaaagccagaggggttagctgcggccgccgtccgagctcttgccgtccccatccacccctctcgtcctcctcttcctcctcctctctctctgtctttcgctccgtccagccgccgcgtaatccgcggaaccaaccagatgcacttatccgccctctgatcgaatccggcgagaagattaaggccggttctttgtcctgccgagccggcgatcttgatggcattggaggcggggagcagtggcggcggcgggaggggatggggcggcgggttccggagcctgatgcggcggaagcaggtggactccgatcgggtccgcgccaagggccagccgcagctcgccaaggagctcaacgtgccggagctggtcgccatcggggttggttccacagttggagctggagtatacgttctcgtgggaacagttgctagggagcacgctggtccggcattgacaatttcatttctgatagctggaatagctgccgcgctttcagctttctgttatgctgagcttgctagtcgttgcccctctgctggaagtgcctaccattattcatacatctgtgt

SEQ ID NO: 26678 - DNA, 642 bp, Sorghum bicolor
  Clone ID: 30977516
ctgttcgctcttgtaatttacttgcacaagcttacttatatacaacaagcccacatctctttgaaggagatgctgaagatgcatttattcgtgtaaggaataaggtgaaagtcccactttatggctgtgattgttatgcttatgctcttctggcttctggttttgtggatattgttgttgaatccggtttgaagccatatgatttcctctccctggtacctgtcattgaaggagctggaggatcaataactgattggagaggggacaatctccattggcctgttactgcagaatcacggcccacaagtttcaacgtggtagcagctggggatgcccgtgtccacaaacaggcccttgatacgctgcagtggtgctagtgtgctgcttagataagcattatactactacccatatttagatatttacaggtgatatttatatgatcaataataagctttacctgtatgcttgttgcttggcctcaatcttgctgtaataataaactgcatggttgtaaactatgaagcagtggcttgctgtttgcaccaagcagagattatgtcatgggaatgataaatatgcgaggtcgtaccgtagtgtgagctgcccttgcacccaacaattcagcgccctgtgcggtgt

SEQ ID NO: 26679 - DNA, 644 bp, Sorghum bicolor
  Clone ID: 30977544
tgttcgcgagcccgcgcgtcggggacggcaacttcaagcgggcgttcgcgtcgttcccggacctgcgggcgctccacgtgaagaacgccggcgacgtcgtgccgacgtacccgccgctcgggtacgtggacgtggccgtgcagctgcccatcgcgacggggcggtcgccgtacctgaagcagcccgggacgatcttgacgctgcacaacctcgagtgctacctccacggcgtcgccggcgagcagggcagcgccggagggttcaagctggaggtggaccgcgacgtcgcgctggccaacaagggggaggacgcgctaaaaaaaccagtacccggtgcccgtctcctggtgggtcgccaagaacaacttcatggtcaagggcaccgacggccactgggcgctccaggacttcgagcagatctgatcatcagagcagagctagctcgcgcggccatgcacgatgtttccagtatgtctgaataatgagtgccaataggcaatacggcatgcatgtattatcattcaggttttctctgtgtgtgtgtgatgcttgtcagttgtcacctcttcctatcctatgaaccggaaattgcgatgaggagtcaaatattatttataaataaataaaccatcttctgattgtga

SEQ ID NO: 26680 - DNA, 180 bp, Sorghum bicolor
  Clone ID: 30977580
cgtgaaccgcgccgtggtcgggagacgcgtgggggcctacttcaagctggacgcggcggaagagcaccttcaccgaggagctccgcgcgggcgccgccacgttcctcaccatggactacatcatctccgtcaacgccgccgtcctcaccgactccggcgggccgtgcacggcgcgggact

SEQ ID NO: 26681 - DNA, 658 bp, Sorghum bicolor
  Clone ID: 30977602
agtgctccgagcgtcatcctccgccgcgacatttaaaccttcgctcccgaccgccgccgccgactcctcatccccaatgctctcctcctcctccaccaccgctcactcggccacctcgcccctccccggccccgcctccacaaaccctaacccccgctcccgcctcctccgcctccacgccgcatcgcgcgtgccgtccgcggccttaaacgcgcgcgggcgcccgccgatgtgttcggtcagcgcttcgtccgccgctggggcgggcggctggggagcggcggcagtgggggagttggcgacggaacggctggttgaggtggcgcagcgggcggcagacgcggccggggaggtgctcaggaagtacttccgccagcgggttgagatcatcaacaaggaggacaacagtcctgttacgattgcagatagagaagcagaagaagcaatggtgtcagttatactgaagagcttccctactcatgccatttttggtgaggagaatggttggagatgtgcagagagttctgcagattatgtttgggttttggacccaatagatggaacgaaaagtttcataaccggcaagcctctttttggtacacttatagcacttctgcacaatgggaagccggttattggtgtcattgaccaaccaatc

SEQ ID NO: 26682 - DNA, 650 bp, Sorghum bicolor
  Clone ID: 30977617
aaggttatacgcatagcaatatctgctcttgtttttttaatcttattgatgcttatagtgtgttcctttgaaatttatggtcagttctaaacatatggtctatgcttctagtgtatttgtcttctatgtttggatttggataatagtgatgaaattgtgtgatgcagtgctctctgatgtctccttttgaactcatctgcagcatagaaataagatgggttaagaataaatagtcataccatagcaacatttttaatgtacttggcaccatttgacatggttaacacgttcttggtgttgtctactttgtataccaaacacgtaactgctgtatttccttgacaaaaatgcgacacacttaatctttttaagcctaaagaacctttggtaggcatgtaacatgcttctttacttattgatgtatgctaggtggacatgtaacatgtaacatgtttctgtactttttattatactctcaacataggtgcatggttatgtttctattaggtggagtgtgaccttattccagcctgaccagtttctcaaatataactggcagtacgcattgtattagactattagtgctccatgatagtttgtaagttatgcacttgcaaaagaactgttaaactctgcaagctaactaaaat

SEQ ID NO: 26683 - DNA, 647 bp, Sorghum bicolor
  Clone ID: 30977651
gaaagcgggcagcggcggccggccggccggcaggcaaacgcaatgatagtagctgctgcccctgcgcctccagttccagcaccaccagccaaaccgccccttcctatcctctcctcctccctccgccgcggcttctccagctggtggttctccaacggcaacgcccatggaagagacagcaccacgagcagcagggcgacgaggaggaggtggtggtccgaccccgacggcagcgaagaagactatgggtcctcttctctagaggacgaggagtacgattacgattacgattacgacgatgaggctgcgttccccggatttggaggggccggggagctgttcgacgagccctggttctccaaggtatttaagatgtacggattcctgctaccggtgatgcttgtgtccatgtttgctgcaacgggaacaaaggcctttctaatggccatggtgttcccgcttggtcagtcagccatatcatttcttcttgacgctgtatggggaaggagtaggaaaggcaaccgcgacgataggcggtggaggagaccagtccaagaggaagattaccctgaggacaccaccgactttgcgacaggtggtcgaggcaatagatacagcggcggcaccagcagctattatgaggggaa

SEQ ID NO: 26684 - DNA, 552 bp, Sorghum bicolor
  Clone ID: 30977672
aaaacgggatggatcaacctggagacctgacacgcgaggagtaccttcacgacacggttcggatcgacttctacaagaactacctgacggagctgaagaaagggatcgacgacggcgcaaacgtggtgggctacttcgcgtggtccctcctggacaacttcgagtggctgtcgggctacacgtccaagttcggcatcgtctacgtcgacttcacgacgctcaagcggtaccccaaggactcggcgtactggttcagggacatgctctcagggacgggctcgaaggccgccgccgccccgcagaccggttcaggcacccgtccggctgcctcggcttcggccacctcgaatggcgctgccctgctggtctctctgttcgtctccttgtgtgtcctgcttccatccgtcttcatggtttcctcagtttaattaggagtatttttttttcttctagtgtgaattttgtagtggatggcagcgtgttgcttttaagacatgttgcatcaaggagggacctgttgtaggaatgagactatgattgagggtggtctga

SEQ ID NO: 26685 - DNA, 247 bp, Sorghum bicolor
  Clone ID: 30977677
aacagaaaggagttgatgaattggattgagcccgtgctgtaaagtgacccgggtcggtttgcgctgttttcgcatttgaagcaatttccgttggcaaggatgtcagcgaagggggcggtggtgcatgtactttagcaactgtatttagcgtacaaattgttcaatgaattatgctgaatttggcagctgcagttaaccctgctttaatggatcgggtaataattggagtttttaaaaaaaaaaaaaa

SEQ ID NO: 26686 - DNA, 638 bp, Sorghum bicolor
  Clone ID: 30977684
gcgtcgtgcaccaggatggatacatcgagatcaaggaccggtccaaggacgtgatcatcagcggcggggagaacatatgcagcaaggaggtggaggaggtgctgttccgccacccggccgtggccgacgcggcggtggtggccatgccgcacccccactggggcgagacgccgtgcgcttttgtcgtgcgcaggaacagcgctgccgagctcagtgaggacgacgtgctcgcgttctgccgcaagcgcatggcgcgcttcatggttcccaagaaggtgcaggtcgtcggagcgctgcctaggaacgcgctcggaaaggtcgagaaggtgaagctccgggaggcggcacggaagctggcacccaccgtaccggcgcagaagcccaaggggaagacgacaacctcatcgacgacggtcggcggtcgccgcgaggaccagccggtggcgcacgtcatggcggtgtcaaggctataggtagcacaacactacagagcatagctggtgctacatagtctttgccatagttttggagctacttacacgtgccacagctccaagaataagaaggatggcgtagttttcaacatcttttatgtgcagtgatagtgtaggtacggatgaggatcactcgcacacatt

SEQ ID NO: 26687 - DNA, 642 bp, Sorghum bicolor
  Clone ID: 30977686
tccaattcaacaagccagtatgttttttcttacttctccaccactttctggaaagatcttatcaatctttctctttctttagtacttacaaaataatattatttgcagaaatgacagtggagtatttgttcttcaattactaaaatcttatgatggccaaactcacctttatttcaaagaggagcacgcaaagcctattcgtgaggcattgacatactatttgtgtacccatgaggacaatcaattcttgttacctgcaatacgtgacatagctaagcaacatggtataaacctttcaaattatacatcaacaagctatagaagatctacgaattgaagaatcagatgttgagattatcgctgcacaagttacaaaaacatttatttatcttggtttttcaagggtgcatcatcattctatggaatgtattatgcaatttaagttgtaaaagttacttttatcttatcccccacccttttataatccctcttcccatttcccgaatgtttagttttccaaaaagagaaaaaaaacgactcttcaaacgtaaaagagaatgcaggagaataactaagttagcaatgtaaagttattcctggaagttatgttgtctaaaagcactgctaagtttatcgtaaaag

SEQ ID NO: 26688 - DNA, 123 bp, Sorghum bicolor
  Clone ID: 30977691
aagaatacagagtcagagttagagagagacgctcaatttttgggtgtcattcccctgttattgatttcactatcatatttcctcatcgaaatgtttagatttgtaatagcaatcggcagagaa

SEQ ID NO: 26689 - DNA, 547 bp, Sorghum bicolor
  Clone ID: 30977698
aagagcttaagctgtcagttcctcagcagtacgggcctctgaagcttcaagtgttcgaccatgacatgctatcaaaggatgacaaaatgggcgatgccgagattgacctgcagccgatgatcagtgcagctacagcgtttggcgaccctgacctactcgcggacatgcagatcggcaagtggctcaagtcccccgacaacgcgctggcgagggacagcgccgtcaatgtcctcagtggcaaggtcaagcaggaggtctctctgatgctacagaacgtggaatccggggaggtagaactagagctggagtggatacctctcaatcagtagaatttgaattcaccggttcgcttgtctaaaaagccatgactgaaagtactgttcgctgaatttgttacgagaaaaaaacactacagataagttgaagcgaacagggttgagtcgcgatgttcttggccaacttgagattgtcaggatgcctacagtgttgcacagtatctttgcgcctgtcagcctgtgatgctgatggagcatttgatgattatgta

SEQ ID NO: 26690 - DNA, 594 bp, Sorghum bicolor
  Clone ID: 30977709
ttccagaaatggcgaagctgctggagcttgacgacggctatttcattgaccagtttggcggcaaggctgacgcctatgccaggttcagctactatcctccatgcacgaggccggatctcgtcttcggcctgaagcctcattctgatggcacattcttcacgcttctcatggtagacaacagcgttggtggacttcaggttctccgagatggtgtctggtatgacgtgcccaccagacctcacaccctgctcatcaatctaggtgaccaaatagagataatgagcaatgggatcttcaagagcccagtgcatcgggttgtaacaaatgctgagaaagaaaggttatcagtggctctgttttattcaatagatcctgaaagagaaatccagcctgcggataaactgatagatgagaaccatccagcactatataagaaggtgaaaatcaaggaatatattgctggcctctatgaacacgtcgctcgaggggaaatggttatcgagactgcaaagatatagatgtgatatctatgtaacgaataagggacctgaatgaaaccttgcaattccaaatattaataaaattttctttagt

SEQ ID NO: 26691 - DNA, 597 bp, Sorghum bicolor
  Clone ID: 30977718
ggcccaagtatatgctttgtggatacctcaggaatcgaagggctagagaagcgtccattctgcaatccattgagaatggggcccaaactctgtttgatatagtttcaaagacttacagtgatgtcgacaggaagttttggattcctgcttctttcaatgtccgccttcatgttgatcatctgaactccctacataaattgcccaaggatttctctttggaaatgttcagtcgaagttgtgatgattttatctctaaagtttgatggcaagatttctcattggagaactttaaggaaagctgtggagtgcatttcatattccgttgggcggtggcatatgtgcattccaggagctccccagctatccttgcggcaagtgccattgctggtggtcttgcaattgcttgtgctctcagaaggaactaatggaagcaatcatagattctttaggtcgataattttccagctacatgaacattatattattattcccagtattctgctaccagtatgttgagtcgaaaggtgagttgccaaaactcttattccgcaattagtgaccgtgattaccaaatctatacacaagagaagtatccag

SEQ ID NO: 26692 - DNA, 665 bp, Sorghum bicolor
  Clone ID: 30977744
cagcatcatttcacagcagcgcggcgccgagaagatgggctccccgtcctacaagcttgcggcggcgatcacggtcccctcgaccggcgagttcctcgtcgtccggcagccgcgcccgccatccccacccgatgaggaagaggactaccggcggttcgtcgacagcgacctctacgacctcccgtccgcgcccctcgcgccactcgcggggacactccggtcggaggtggccataggcggcgcggactctgtcgccgtgcgcctcgacctctcgcgcctcgacgtgtccgccgcccttgatcagatttttgatcaatttggcttgccggatgggatgcgtggggagtggaggctcctcaagtatgtggaggaagcagagtttggcccggatgctggcattaacacggtgtacatcatcgggtcacttgagtcgaaattggatgcaccacaagagtcatgtaagtggatgtccaaggagtgtgcattgaggttgctttcagaagcgaagccaggtaatgatcgcataggacagtatgcatatattggaattttgaattcggagctgtcatcaaacaccacaacttcccctgcattgccctcccaggaatacccacctggaataacacttgtacctatgaagagtaggacactagcaccattccgta

SEQ ID NO: 26693 - DNA, 603 bp, Sorghum bicolor
  Clone ID: 30977752
ctactggaatcttcctctctcttcgtctcgccgtctccaccccccaaaaccctagacgccaccctctaccgccgccgctcgccgccatccgcggccatggatctcctgcgttctcatctccacaaggtccggatcccggagcccaccaaccgcatccacaaggacgagtgctgcgtctccttcgacaccccgaggtcagagggaggcctgtatgtggacatgagctcgttcctgggcttcgggagggagtacgtggagtggaacttcgagaagacggggaaccccgtgtacctccacatcgtgcagcgccggaagccggagcccgacgaggcggatcgcccgcttaagaagcccaccctcctcgctataggtgtggaaggaggttttggtgatcaagaaccagaatatgatgatacttttgaaattgtcatcttacctgattttgtctctcttccatttccatcagttgatttgccagagaaggttaggcttgcggttgataaagttttacttgctgaaagtgctgataggaaagaacaattggctgcttgggttgctgacaagaagaacattagtgcatatgctatggacctgcaacagcta

SEQ ID NO: 26694 - DNA, 601 bp, Sorghum bicolor
  Clone ID: 30977774
tctggattgaaccgcggaagagcaacagcccactcgagccagcggaaccccaaaatgttcgtcctccgcaaaaccctcctccacggcctccctgcgccgccggccgccgccgcggccgccccctctcggatctcctccctcctccgcctcctcccctccgcctccttttccgggggcagcggaggtggggacgaatggggcgcctcctccttccccggaggcggcagcggcgggggtggggacgaatggggctccacctggtccaccggcctcaccaaggaccacttcgacggatcctcgccctccgtcggccgcccggccccttcgccctccgtcggccacccggacccttcccagtccgcgcccatctcccatgagcgggcggccgttcgctccatggacgagtgggacgagatgatccgggatctggagcgtagcgatgtcgaggcgaaggcgtttgtggattcatgggacgaccgttggcgggagacctgtgcgctgctgaagcaggtgcgggagccgggcgctcggggctcgtacctcaaggactcggagaagcaggagatgtaccggctgcacaaggaggaccccgcgacttaca

SEQ ID NO: 26695 - DNA, 637 bp, Sorghum bicolor
  Clone ID: 30977777
actgactgactgcgtctgcgatctgttgagagtgagtgagcgaactaggccgtgcttgagctgatactgccgtgccgctctagctcgccggccgggatgggcgccgccgccgcggggcctgctgcggctccgccggcgacgacgcattgccgctccatccagctactgctgctggcgctggccgtcgtgccgctcggcagccgcgggcttcgcgtccgagccgtcggggcggacacgggagggctgagccgggacgcgttccccaaggggttcatcttcgggacggcgacgtccgcgttccaggtcgagggcgcggccacgtccggcggccgcgggcccagcatctgggatcccttcgtccacacccccggaaagattgctgaagacgggaacgcagatgttacaacagatgaatatcatcgctacaaggaagatgttgatctcatgaaaagcctaaattttgatgcataccggttttcaatctcctggtccaggatcttcccagatggcgaagggaaagttaatgaagaaggagtacagtattacaacaatcttatagactacatgattaagcaaggtcttactccttacgccaaccttaaccactatgatcttccacttgcgcttcagaaaaagt

SEQ ID NO: 26696 - DNA, 655 bp, Sorghum bicolor
  Clone ID: 30977790
cctagctcctcgcctcacctcgcctcagccgtcaccacacgcacacatcctccatctcctcctcctccttgcacggctgcacgcgagcagcgacagcgagcgaacgacaagctagctaggcatggaccagctccccaagcgcccggccaactacgtgccgctgagccccgtgggtttcctgccatgcgccaatgccgtctacggcgaccgcgcgtccgtcatctacgggcgcgtccgcttcacctggcgccagacgtaccaccgctgccgccgcctcgcgtccgcgctgctgtccctcggcgtccgcaggggcgacgtcgtctccgtgctcgcgcccaacgtgccggccatgtacgagatgcacttcgccgtgcccatggccggcgccgtgctcaacaccatcaacacgcgcctcgacgccggcgccgtcgccaccatcctgcgccactccggcgccaagttattcttcgtggactacgactacgtgcgcctcgccagcgacgcgctccgcctcctcgccgccgacggcacgcccgccgtcccgctcgtcgccgtcatcgacgacattgactcgcccacgggggcccggctcggggagctcgagtacgaggctctcgtcgcgcacgccgaccccgacgcggacctcccgccgctc

SEQ ID NO: 26697 - DNA, 208 bp, Sorghum bicolor
  Clone ID: 30977792
gtatgtcttttcgagtaattttttgtttgcaagttagtatgttcaatcatatttaagtttattctcctgacttataagtttaactttgtcatgtaactttgtattgtctagttaggttctgcaagttattaagttagtatgtttaactgcaagttattaagttagtatgtttaacttgtatgttctatctttactcataagttgtttt

SEQ ID NO: 26698 - DNA, 596 bp, Sorghum bicolor
  Clone ID: 30977800
aaagacggagaggagaacgataggggaaggggaaggcccagggggaagccacggccaccggcgcgatgaagccgtcgcagtccaagaagaagggcaagaagaagaagaagtcctcgccgccggccgcggtgccggccccaccgccgccggcggagggggctgcggattcggaggcctgctcactgctgcccgaaaccctaaccatatccgccgccgccgccgccaccgcggcggtttcggagacggagtccagcagcagcggcgaggcgtcgacgtgcgcgtcgtcggcttgcttcaccgcaagctcgtcggggacggcctcctcgtcctccttctctcccttctcctcgtcggcgtccacggcttcgtcgtcggccgccggcgaggagcggcgggacctcacgtggctgctcgacgcgttcgccagcgccaccatcgaccagatcgactccgcctaccgcgaggccggcggggaccccttcgtggccgctggtatactcggctccacgcaggacacgcagccgccgcagccaccacagccggcggcgcagcccccgccaccaccggatctctcgccgcgcagtggatctggtgga

SEQ ID NO: 26699 - DNA, 616 bp, Sorghum bicolor
  Clone ID: 30977819
gtaattatggcaaaaacattacaattttgactctcataattggaaatgggaattttgactctcatgataggtgaaaggtccttgtttggttttggtaattgagtgacaacttaggtggactaatagtgtttatgtgagatacacagaagattagtccacaagtgattatgtgatgatggaggagctcattgcatatgagacatgacatggagtcatgtgaccaaggtggagaagatcaagataaggcttggcttgatggaccggttgcaagagtgaagggcaagtcggaggctttgaagcgagggaccgcgtgtgacggtgaagcttgagcaagacttggcgccgatggaccgaggcaacggtgaagagcaagtgaggtcaagatcgatgaaccaatacggtcacgtgatgatatgaagtggatcatatcatttggtgattggttggtgcatgtgttgcatcaacattggaggagatggaatggaaagcgcaaggcaaaggtataacctagggaatttccatttcaccggtcataggtgtgtagagaagtttatgaccggatttaggatagatggccgtactatcaagaggggcaaacttgtttgcatatcggtca

SEQ ID NO: 26700 - DNA, 612 bp, Sorghum bicolor
  Clone ID: 30977827
gggccgacgagcgtgggctcaagcgcgccgccgtcaccaacgcgcccagggctaacgccgacctcatgatctccatcctcggcctctctgacttctttcagctcgtcgtcaccgccgaggagtgcgagcgatttaagcccttcccggacccgtacctcagggcgctggagctgcttggcgtctcgccggagcacgccgtcgtgtttgaggactccaccaccggcgtgcaggcaggcgttgcggcagggatgcccgtggttgccattgctgaggagagccgggagggcaagcttctcgccgtcggtgccacgcttgtcatcagggactacgaagatcccaagctgtgggcggcattggacaaactggacatcgccaagcctgaagctgctgctgaggccaatggaactcatacacaactgtagctgaggaccacaaatactagtagcgaaaaacaatttcttgctatatttcactttcattcacgcatgattgaattataacccattcgtgtatgatgtattttgatgagattgaggtcatacaaaattgcctgtaggccaggctgttacacagatgagtgataacaaaactgattgcgagaaaatacagaat

SEQ ID NO: 26701 - DNA, 601 bp, Sorghum bicolor
  Clone ID: 30977828
acggaggtggacgtgtcgtcggcgaacgagcacgtgcgcgccgacgacctggaggtgatgctgcgggaggcgtacgcgcacccggccgtggagggcgtcatgctctgggggttctgggagctcttcatgagccgcgacgacgcgcacctcgtcgacgccgaggggcaggtcaacgaggcaggccgccggctgctgcagctcaagcgcgagtggctcacgcactcgcacggccacgccgacgagaacggcgagtacaagttccgcggccaccacggcgagtaccacgtcgacgtgaccaccgccaccggcaaggtctcccagacattcaccgtcgacaaggacgacgcgcccctggtgctcaacattaaagtgtgacagcagtgcgtgcacgttcaaatcatgcatatatatggcgggaaatacggtgcctatatatggcgggaaatcatatttattttactcgatcccagccgggtaactactctcatgagaggaataagggcctgatcaaattgatctatatgtagtatctttattatcgactcgatcgtggtatttatatatgcacatgcatgctgtgtatgtatcacttgttcacaac

SEQ ID NO: 26702 - DNA, 547 bp, Sorghum bicolor
  Clone ID: 30977837
taactatctgctatgctcatcgtttattaagttttttacaaaatcagtacaatactcaggtttacctatttaaaaaaattcagttcagatagtctgtacagattgacaacacagagtttctacggaaagtgaagattgataatttggagtgaagctaacaaatctttttctgctttgcatgcttttcttgctgcaaaggatgatatgggcatatcctacattacacacgtccagatacattttgcatcatcaccgtgtctacctaatgcagatcaaggtccgacgagtctaagcactaggccaaaggcggcagccgtcaggcctcctcgagccaatggacctgatcacctgttcctataaagctaagaaggatttcagtccaccccaagaaaagcttgtcttatgaaaaacctgctcctcagcctgtagtttttatattaggctttgtttagttccaaaaagatttcggatatcggcactgtagcattttcgtttttatttgacaaatattatctaattatggactaactacgctcaaaagattcat

SEQ ID NO: 26703 - DNA, 483 bp, Sorghum bicolor
  Clone ID: 30977861
gaaaaaagtaaggctggcgaagttgggcgtgacgattgtgatccctctagagcctgtttctggaaaatggatggagatgatagtgatcgtccatgcaggtggcctgtgcctgagccacgttggcttcgcccagacgatttggttgaggatgaatctgaggatgatgagttggaaattgaactcccaagcggccgcaagaagagatatgggtacttggatggaagaaaagttatattattctagaagccatcacatcctcgatacgagtcagtcagcgctatataatgttgacgtcgatgcacgatgctggaccctatttcttgcctagtactagtatttgtaaagattaggccctgtttgcggaatctgtagtactttgacttttcagatagtgctttgagcctcgactttttagataagcaaatagacttacatgtgcttatgattttatcttctctggatctggaattattacccagcaag

SEQ ID NO: 26704 - DNA, 624 bp, Sorghum bicolor
  Clone ID: 30977880
caaggcgaagaacatcgatgcaaacccaaaggattacctctccttcttctgcttgggtaacagggaggtgaaggtaccggatgaatatgaacctaaacgtcacccgacacctgggaccgactacgatcgggcccagaaggcgcgccgctctatgatctatgtccactccaaactaatgatcgtggacgacgaatacatcattatcggatcggccaacatcaaccagcggtccatggacggagcaagggactctgaaatcgccatgggcgcgtaccagccgtcccacctcaacaccaatggtgatgttgccagaggacagatccatggcctccggatgtcgctgtggtacgagcaccttggtgagctgcaggaggatttcaaggaccctggtagtctcaagtgtgttcggaaggtgaacaagagggctgaggagttctggaagatgtacaccagcgataacctggaggataacctccatgggcacctgctcagttaccccattgatgtaaccagtgaaggcacggtgacagagcgtgaaggggtgaaatttttcccagacacagaggctccagtgctcggcacggtacccctgcgggttcagcttggcagtgcattcacagatta

SEQ ID NO: 26705 - DNA, 664 bp, Sorghum bicolor
  Clone ID: 30977903
gcacaccacaagtagcttcagtagtagcagtgctcactacattatatttgttcctcagctgatcttgatctgtcgtggaagtaccaggaggagcttttgctagcaatggctgccatgccgctgctgcatggaaccctggatgctaccatcttcgaggccaaattcaacaacagcaaccaagttaccaagtttctccaagggctgattccacaaatggagggccggcccactggtctgccagtacagatgtacgcaaccatcgacttgaacaacgctcgcgtgggccgcacccgcatcgacgacagcaaccccgacaacccacgctggaacgagtccttccacatctactgcgcgcactacaccacccacgtcgtcttctccatcaagctccgcctgcccatcgacgccgtgctcgtcggccgcgcctacctccccgtccaggaccttctagctccgacccccaacgaccaggaggacaacatcgtcgacaggtggctagacatcctcgacgacgagaagaaaccactcccgcacgggccgaagatccacgtgcgagcacggttcaccgacgtggccggagaccccagtttcggcagcggcatcgacggcaagaagtacgccggcgtgccgaggaccttcttcaagcagcggcagggttgcaggg

SEQ ID NO: 26706 - DNA, 641 bp, Sorghum bicolor
  Clone ID: 30977918
agatgccacgccgagaccgcgacctcccgctacaccgacgcattggccagccgttctgcttccccgtgctgcccgcacttggtccgcgattgaagcgtgcggctggggcaggtgggcagagcggaggattagggtggcggcggcggcaccagcgctcccttcccgcaccgcacaagaagaagaggccaccctctagatctccgctcgaacccagctaggccgtcggcggcggccgggcggcaaaatccggcacaccgtacaacaagggcgtctccatgtctacactgaacgccacttggatctcagcctcactcctgaacaatttcctcatcttggaagcatgaagatagctggcagaaaggaacaaagacgctgcaaggatggctggttggctccattatcttagtgatgaaaagaggtttccaaaaacaagacaggttgaatttgatcttgttcttggttcaaatggcaagcagttccgaacccgcagtattgaggttgttcgatttgtaaagttacttgatgaggctaaatcttagagcacatcagaattactatagttgctcactgaaaatgacaaattggactattttggaaccttatctttatcctccaggtgactatgatattattttttgttc

SEQ ID NO: 26707 - DNA, 197 bp, Sorghum bicolor
  Clone ID: 30977923
atcgcacccaccacgctgcctcggtcctccgatctgctaagccccccgccggatcgggttgcgggtcgccaccccccgacccagatccaccacagctcgccgccggccgccgccgccgccgccgcagagtgggcgatcgtgtttgcggtaacatgctggagccaacagcaatggaggtgcccattgctggcccagtg

SEQ ID NO: 26708 - DNA, 665 bp, Sorghum bicolor
  Clone ID: 30977926
acagatcaaaagaagccccagtttggcatccagcagcaaccggccatggaaaggtaatcctgcctacagccatcatcatctagagtattttctgcatgatttcattcacttttatctattttccccagagagacaaactctcaagatttcatttcaatgattcaatccaacaagttctttgcaaccatggccatcccagttgatccctctgactctgtgcgtggttgcagcagtgggatcggcagagtggctcccctggaagcggtgctcttcgacatcgacggcaccatggccatctcggacccgttccaccaccgcgccacgtcggagatgctcctcaaggtaggctacaacaacggcgtccccatcacgccggagttcggcatggcgcacatggccggccggagcagcgaccagatcggccgcttcctgttcccggactgggaccaggcgcggctcgacgccttcttcgccgagaaagaggcgctcttcgcccggtacgccggcgaggggctcagggagatcgccggcctcaccgcgctctgccgctgggccgacgagcgtgggctcaagcgcgccgccgtcaccaacgcgcccagggctaacgccgacctcatgatctccatcctcggcctctctgacttctttcagctcgtcgtcaccgc

SEQ ID NO: 26709 - DNA, 620 bp, Sorghum bicolor
  unsure (1)..(620): unsure at all n locations
  Clone ID: 30977928
atcagcagatcattaaccagccagctcgagtaaccaactggtagcagatcaagtcgtagtaagctcgatcgatcggcgctcgagacttcactgcgatatataacaatggcggcgatcggcggcgacgacgcggcggggctcgtcgtggtggttggcgacggcgccggcgacgacaacatcatcctgaacccggagttcgacgacgggcttgacaactgggccgggaacgggtgcaagatcgagctgcacgactcgctggacgacggcaaggtgctcccggccaacggcaagtacttcgtggccgccacggggcggaccgacacgtggaacggcgtgcagcaggacgtcacggcgcgcctccagtgcaagctgctctacgaggccacggccaccgtgcgcctccactcgtcggcggcggccgtggcgccgtgcgaggtgcgcgccacgctcggcgtgcagactgccgacggcaggcagcagtacctcggcatcggcaagtcgcaggtgtcggacaaggagtgggtgcagctgcaagggaagatcctgctcaacagcacggtggccaaggcgtccatctacatcgaagggccgccggccggcgtcnacgtgctgctcgacag

SEQ ID NO: 26710 - DNA, 553 bp, Sorghum bicolor
  Clone ID: 30977939
tggagctcgtcccgacgcctccgccgctcccgacccccgccctccctccctctctcccgagtcccgacgcaaccgaggcgacggcacagagcgagctcggcggtggcaagcgctcggcacggaggcggccaccctcctccatgccccttccttctcgcgccgcaagggcttgcggagtggcgtcggcccctgcagggtgctgcgccgatgcagcatgtcgcagcggcgctggacgtcggccccgcggcaaccatccccgcgagctgcccccactactgtccgccgacgctgctagtccgcatttcctcgtgtcatcgacgaaaccctaggtgcctcggctccaggacccagaggcgtctggcctcttcctcttcggcggcggcaccgacggctcaatttggttgtcggattttgccgtacctcacccctccacctagggttttgcatcggaggtgacaacatcaggtcatccccttcacctagcctctcccgctatcccgcgtagaagcatagccaccagaaatttctaaggcaggccggtactttccatggc

SEQ ID NO: 26711 - DNA, 604 bp, Sorghum bicolor
  Clone ID: 30977940
atgcagatgcagttttgcacccatctcaatctcatggcctccaaccaaaacgcggcgcccctcagtccctcacccgcatcgcatgcttcgccgtgcttcctgcgccgcttgaccccaggtcaaaccccctgcggggctgccggctgccggctgcggcagcccttcataacttccgctccgtctcgccggctcgtctcgtctctcagtgagtgactcgtctcctctaaccactcgctgctccatttactccctcgtatccacccctgcttcccgctcataaaactcgccaccgccaccaccaccagcagcagcagagcaatcgcgcgcactactctactctgcagcgcggacactcccggcccggcaagtccagccacccttctcgcgtgaacctgccaggagagagagagagagagagagagagagagaggaggaggaggaggatagctgcgtagccattcttgcgggcaagggattgaaggcgcgcgcggctgcctctcctgctccgtacgcctgcctctgaaccggacgaggtgtgcatggggaagggggccgggatggggagggaggcagcggccgccgtggtggcggcggagctggagga

SEQ ID NO: 26712 - DNA, 536 bp, Sorghum bicolor
  Clone ID: 30977960
gatacagatgctcagtctcttgaggctagtttggaggagaaatccttggagatcgagggaaaacttcatgctgcagatgccaaacttgcagaggcaaaccggaagaagtctcaagctgatcgggatttagaagaggctgaagctcgtcaacgtaggttggagaaggagaagctgtattttgagacagagcggaaggcccgagaaaagcaactcaaggagcaggaggaatcactgcaggagtgggagaaaaaactcaaggaaagtcagaatagacttaatgacttgcagagatctataaatgagcgagaggagagagcaaataagaatgatcaacttttcaagataaaacaggatgaactggaggaggcaagaaaaacagtggaggccgctaaagttactctgaaagtcaaagagaacgatattaacaaaagactaaatgaattgcattcacaggaaaaggatgctgactcaaagcgcagtgccttggaagagcgggaaaaaaagttggttgagagagaggccaaggtcactactag

SEQ ID NO: 26713 - DNA, 564 bp, Sorghum bicolor
  Clone ID: 30977965
accgccgccggctccttgcagcgcagcgccgacgctcatcttcctcgcagcgccgctcaggctaggtcccttcccccactcgcgctcaggctcggtcccagggatcggatcttccgcccgtcggcggctccccctcggcggcgtccagcgacggaggggcagtcccaggctcggcggcggcgtcggcggccccgcccttgcctgcgtcctccgcgcaccggccggcgaccctgctcttgaagaagatgaggagaacaaagaggggtgatggtcttgcaggaagatcgcataagagcacaacacctcccaatggtaaaagaaagaacaataatctattggcctcagccatagaaaagatacagaaaactaagaggggtgataatgatttcacaagaagattgcataagagtataagaggtcgcaatggtaatggaatggtaactgaatcaatggccttaggtgacttgcatggggactctaaccgatatgactggactaggctcagtgatgaactcaagtcaaatttgtctagaagtgttgcctcacttgctttgtgcaatggag

SEQ ID NO: 26714 - DNA, 567 bp, Sorghum bicolor
  Clone ID: 30977983
tcagatcggaatacccccgcagactgcgtcagcgacgtcttcgttcatggtcctgttctgtgcatcgatgtccatggttcagttcatcctgctgggcgtggaaggcatcgggcaggcttccatttacgctgggatatgtttcgttgcctcggttgttggggtcgtcgtgatccagcgagccatcaggaagtccgggcgggtctcgctcatcgtgttcctggtcacggccatcatggcgctcagcactgtgatcgtcacctgcttcggagcgctagatgtctggatgcagtacaccagcggggaatacatgggcttcaagttactttgctgacatggtgttactgttatgggcttcgttttggcttgtccttttttgagggggaggaggaagcctttatggccttctgaaggaagattttgcatttgtgctcatgaccttgtaatgtgcggtttggggcttaccttatactgaaatagttttcctatcggtgagctttctggaaagaggcatgactggttgtgggcactgattgtgattgtggcttccagtttttcagattttatagt

SEQ ID NO: 26715 - DNA, 588 bp, Sorghum bicolor
  Clone ID: 30978009
gatacggcgtgggcgatgaggtgagcgcagaggggattggaggaagagatgagactgagaattggaacgcagagggtagcgaggaatcccggcggtaggaacttcttcgatggcggcggctgaatcgcctgacgccaccgtcgaagggtaaaaccccaccccgataatcgcctgacgccaccgtcgaagggtaaaaccccaccccggaggtttattccttcttcaatacctattacaatctactaaggtgcctctttatagacaggtgcacttccataactaaaccaatctactaatttcctccctgtccttccttttctaaacaaccagcaactaggcctattggccacgacctgggctggggccctgtttgggccgacgcctatattggcgacccacaaacgagtccacaacaggctcccagtgttacaagctggaaaatcttgtgtaaccgttcaaatttttagtctgcatttgcagtgtgttgagagaaatgtcaagcaggcaacttatatagttgctgtcggtttatcagtgttggaacttattgcaaatgtttagcatgaataaatggtgtatatagaacaa

SEQ ID NO: 26716 - DNA, 569 bp, Sorghum bicolor
  Clone ID: 30978022
tactgggattcgtcataatccaaccgaggggtttccctaatccctacctccatggctgccgccgccgccaccatcgtgcatccttcgtgtcggccgccaccgtgcatccatcacgccctcttgccgccgccagcccggtgcatctgcaacgtggcatggctggcgcggcgcgcgcagccgcgcacctgcctctgccgtcggcgccatcacctgctgcctgttggttcatcacgagcttgtggcttctctactggggcctagccgccatcgaaatcgagatgctcgcctgcggcaagggctgccccgtggtcgccaagacgtgcaagcctgcaaggtcgtcgctgtcgccggggtgtcattttgcgctcgtcctctcctttggtgtgcagcactgcagcgtgctaccaggccatccgctaccgacatcgagacaaccaagggtgcttgtttcgaagagcttcgccgcaatgcgcgaatcgttgcaattcatcctgctcctggccgttggtgctcttctcaagggacttgcctttgtgtgtgtgtgtgtgtgtgtgtgtgaacagggttca

SEQ ID NO: 26717 - DNA, 470 bp, Sorghum bicolor
  Clone ID: 30978042
tgctctgccggcggcacttgaacaggaagcgtcgtcgccagctcgccgccgcggcaaccgaacgaacaccatcgcttcgccgcctgctcgcgcctcttccaattccaagcaaaacaaacaaaccagcaatgccgcgccagggcccgcgccgcctccctgccggagaacgcaaccgtcgcctcgccgaggaggtgctctacctgcactccctctggcgttgcggaggccccgccccagccccgttccagtcgcgctccgaccgacgcgaacaacgcgaacgcagcgggctcatcagcgccctccgccacgaagaacgcgaccgcctcaggctcgaccgcgcccaccgccgcaaagaacgcaagcgacggaagatcgaccgcgccgccgccgagccggccttcgcgccgtctccgcccacctcttcgccgggaaccttggcggaagccgccggcgcctcaaccccttccacc

SEQ ID NO: 26718 - DNA, 650 bp, Sorghum bicolor
  unsure (1)..(650): unsure at all n locations
  Clone ID: 30978046
cctactaaactgaaacaatccaaagccgagggcnggagtagaggcacaaggtcctgatgcctagagagatttcccggtcgcctccgcccttccgccggcgaggctcccctcctccgcggtacgccagccggagaaacagacgagatcggagccgctccccttatgcctcccggcgaaaaactcggtctccttctccactatgggataggagcaactcaccaagtccaagaaggcatagaagcccaccatctccaaggagacacaaaagacagagaagtcggagcacgacaagttcattagaaaataactcaggcagtccaagtcatgtatcagagaaaataaaccccactgtaaaacaaaggatggaagaagaaaagaaaaggcgtcaaaaggaagccgaatttaagttgctggaagaggagcttgctaggagagtcgaagaagctataagaaaaaatgtcgaggaacgtctgaactctgaggaggtgaaacttgacattgaacgccgaattgaggagggtattagaaagttatttgatgaggttgactctcagctacaaaaagagaaagaagcagctcttcatgaagccaggaagaaagcagaacaagaaagaagagagagggaggagttggacagaatgcttgaanag

SEQ ID NO: 26719 - DNA, 322 bp, Sorghum bicolor
  Clone ID: 30978049
cagagcacgaagccgacgatgacgcggactactcaactcttccctctcgtcgcgccgccatcgcggttccttcctgtcagcggcggcgcgtccaacaccaccacctcgtcactccaaagcctcctcgccgaagtgtcgcagtggcgggaaacccagctgggcgacccttcctcgtccccgggcggggcgcggctcatgctggcgtgcggccgaacatcgcgcgtcatgggtgctctccttcctggcgggtccgtgtcgagcgccggggcgtgggcggcgggcgctgttcctgcccatcttgaacctggtggggggtgggctg

SEQ ID NO: 26720 - DNA, 231 bp, Sorghum bicolor
  Clone ID: 30978061
gcctgtgcagcgtgcagccgagcacaccgccgcctcctcccatccccgctccgccgcacgccggctcttcgtggctgcacccgccgccgcgcacactccgccgaagccccgctccaccgtcgctccggtggagtggagttgagcggaggggagatccgtccgcacctgcactgatttgtcaggacattgttgaattcgctgaagtgtgtgctttggtaaaggcttgctaaa

SEQ ID NO: 26721 - DNA, 575 bp, Sorghum bicolor
  unsure (1)..(575): unsure at all n locations
  Clone ID: 30978068
cctactggagcttagctgaaagcttcaaagggaggaagagggagcctgagaggaggtggaggaaatggctgcggcggcggatgtgtcgacggcggcgaggactagtagcagcccggcggcggaggagggggggcagcggggcgagcacgagagcgagagcgagggggaggaggtgggtgtggcggccgtgctggacttcgacatgctgtgcgcgtccgtggcgctgtcggcggagaggaggaaaggcgccgccgcgccggagggggcggntggcgnctgcggcggcngatgcggaggggtgcagaggatgtgggagggcgacgtcgtgctggattgcttggaggaccggcgaatcgcgctcgaggcgtcctgctgcccatgctatcggattggtaagaacatgcggagagccaatctcggatcttgcttccttcagggaatggnttactgcattctgttagctgctggcctgatcagcctaattgccttttctgtaacaaggcatcatatatatttatatatgggacttggctctgtcctcttgatagcgatctatactggttatttccggagaa

SEQ ID NO: 26722 - DNA, 370 bp, Sorghum bicolor
  unsure (1)..(370): unsure at all n locations
  Clone ID: 30978075
cacctgatctacgcacaaagggagcacctnccagacctngccacncgaaaagcaccatggacctgcacatcatctggtgacttaaatcaatttgattgtttccccaaattatttcagattagctggtcagtggtcactgtggcatgccttgtctctgtgatataataagcaaattggggtcatgctcgatgctctcatcttaagacagcaaatagtcaatagtgaatcttgtttcttccccaaaaggcatcattgaggaatattccacaatccacatcccctcccatccggcgaaccgcaatgaagtctccgatcgccgtcgctggctccgccgcagatttttctgacgctctgccctccccgacctccc

SEQ ID NO: 26723 - DNA, 451 bp, Sorghum bicolor
  unsure (1)..(451): unsure at all n locations
  Clone ID: 30978076
tactggttgcttgctctgctgcttgctgctgcctcgagtgagtcatcactgagctgtgagctgtggacctgtggtggtcgtgtcgtgatcttcttcttcttcatcttcttcttccctcttgctggttcggttgctgtgtggccatggcagcggcggcgccgtacgcgcgggtgatggaggacatggtgaaggggcgggagtacgcgacgcagctgcaggcgctgctccgggactcgcccgaagccggccgcctcctggaccggatcctccnnnncttgtnccgtatcttcttctcggccaaggccgccgccgccgaggaggaggaggcgtcctatgtgcagagcgacgtcncctgcgccggcactgccggcagtagcaagaggaaggccgctggtgttggggacaagagggcctcctgtcggaagagaggccagcaaggatcntcggttgt

SEQ ID NO: 26724 - DNA, 445 bp, Sorghum bicolor
  Clone ID: 30978115
agcaggccgttcagggacatatttgactacgggatggacatgaagcgtgtcactggtacagcctgtagggcatatgaaggcgcatcgagaattggacgtggcaacctagcagcatccaataaggtaaagaaatgtgggctatttgttacaggctcagtgaggcctaataaggcagtagcagcagcaacaacaacaatgcttcccggcactcgtgttatcatcaagaacttcttttagtagagacgaagcatgcatatgtgctcccaaacatgtggtaactaataaagtttaaaaaataaacatgtggtaactaagggatgtgatgtatcttccacaaatgtgggtctcattgtgtgtgttaatttgtcgttgttaagaataattgtgtcgtcaggataatgtaattgtgtcattgtatattatttcaataaacaagactacaaag

SEQ ID NO: 26725 - DNA, 587 bp, Sorghum bicolor
  Clone ID: 30978131
caggaagccgcgggcaatcactggaaacgaacaggccggtgcgagtttacaaacaacgctcgtcgctggggatggagaaagttcatctcgctggaggatttcaaggactcctcaaatggctatctcatgaaaaacaagtgctgcatcgaagctgaggttgcaatcgttggttcatcaaagatggagtagtgtgtatccttgtctatatttgtgggctgaatcgcaatggtgctgaggtttctcgacgtgcgtgtaatgtgtcttgtattgtgtttgttttgttcgtgctgaagatactgaaagtgtaaagtgccaaataaaggttcggcgccgaagatattgttcagtttgcccgccatcaaggccatcgacctcccgatcctgggcctcctcttcggcaccatggtggtcagcatcttctgtcatccatttgtaatgttaaaattcctgttttctcgaatacaggacaactgcatatgccactgcatataagtgtttcaacactacaaatgcctcgaactttttctccatttttttaaattaaaagatgtgttataaatttattattcatagaaagtttttcaggt

SEQ ID NO: 26726 - DNA, 667 bp, Sorghum bicolor
  Clone ID: 30978138
ggatttggatgggatttgatcgagcatcctatacgaactgatgcgcagagttcagtgcgatcatgatgcaatgctaaatgctggcgcgataccattttattgaccaaccaaccatggacacggattgcaactttggaagttgggaggactcaagcttggggacgattgttcaacgaagttggtgaacttgctagtcgatgaggatagtttatggatcgttgagaatactttatggatcgttgcgcggctggaaaattcagtgttttggtcaggatggagatcatcagcagtaatattgttgaattttacgaattattgttacatcaattagaacagagtggaaaaggaggaagatgaactccaacttattcgttccaatcaagtgcaggtgcagcagatagaaatacaagaaaaaaaaatctgtacattcatttggcatgcactgaacctaggagaacaaactcattggacgaggaaacaaacaaatcctggcttgcagttcatgacgcgtacgtaacgcgttcatcgaattgcgatcttgtcatcttgtgtagtaggttcagtcaggtgtgctgtcatcgattggacggatcatggagtccgttacttgcgtatgtcgttgggactgctctaattgcaaggctggaacattagtacgcttattaaa

SEQ ID NO: 26727 - DNA, 560 bp, Sorghum bicolor
  Clone ID: 30978160
aaccagagccactgctcgtcgcgcatcccatccagcgcctcgctccccgcttgtgctgtgaccgacgaccggcaccgaccggcggcggcagagagaagggatcggccggcggccatccacgacatgtctcggtacgtggagatgctggacatgggcgtgcgcgtcgccgcgaggttccactcgcactgcccgcagacggcgcgcatgtactacaagccgccgcagacccagacgacgacgacgtcgtcgtcgtcgtcttcctcggccgacgacgccaacaaggccacgagcttcggcctcgacgcgccgtcagtcctgcggcggccctccgcgctcgcggcggcgggagagttccgcgccggcgaccggtcgggccatcatcagcttcacgatttcggcttcgacaccgcgcaagtcgtcgtgtacgaggtcgtgtgaggaattgacagacggaagtcgggaggagaacagcttcttgcaaattgcaagtgccgcaagaaatttattgcgagatgtgtaatgctagtgctctgttctttgatttgtgcatatctgtgtcg

SEQ ID NO: 26728 - DNA, 622 bp, Sorghum bicolor
  Clone ID: 30978170
ttgggaggtctaaggtcgtcgggatcgggaccgctgctgatggaggagaggtacgaggcgctgaaggagcttggggccggcaacttcggggtggcgaggctggtcagggacaagcggaccaaggagctcgtcgccgtcaagtacatcgagaggggcaagaagattgatgagaatgtgcagagggagatcatcaatcaccagtcgctccggcaccctaacatcgtacggttcaaggaggtttgtttaacacccacacatcttgctattgtcatggaatatgctgctggtggagagctatttgagaaaatcaccacagcagggcgattcagtgaagatgagtccaggtatttctttcagcagttgatatcaggggtcagctactgtcactctatggaaatttgtcaccgtgatcttaaacttgagaataccctccttgatgggagtccaacacctcgcgtgaaaatttgtgactttggttactcaaagtctgctttgctgcattccaaaccaaaatcaacagttggaactccagcatacatagcgccggaggttctttccagaaaagagtatgacggaaaggtagcagacgtttggtcctgtggtgtcacactgtacgtgatgc

SEQ ID NO: 26729 - DNA, 486 bp, Sorghum bicolor
  Clone ID: 30978175
accgcgtggggaaacgggaggcgggaggtgcggtgtctttaccgcccgcgcgcgggcattaactccgggctctggtacctggccaccttggcatgcggataagcacgacgccatgggaggacatagctgacctcgaggaaggtacttgaggaggaagcctctccgattccgctatactcgcttgcggatttggggtctccggcgtctgatctgccgcttgatgcaagaacctcgcgttccccagcggtgaaggaggaagctgggcggcgagatggagcgggccggcgagaagaggcatttcttcccgctcaccagcttgcaaatcggggatttacagtcgtatcttgcagaactgacaatatttctgtgccctcataccaagaagttccttatattgcttgacaaccgcccatggttgctagatcaggatacaaaacctgctcatctatggcagttgatggttactaagtcaaggttttccccttt

SEQ ID NO: 26730 - DNA, 449 bp, Sorghum bicolor
  Clone ID: 30978198
gagttctttaaccaggtcatggttggagcaacccttcgctgcccttcctgatcccgctcggcctctttgcgtggtttgtcgaacggtgggttgtgccattctcaaactgggttcccctcgctgctgctgtttgggcaaccattcagtatgggaggtttaagaggaggacaactgtagaagatttgaacaaaagatggaagcatcttatactgaatacagcacccaccacaccaattgagccttgcgaatggttgaacaaacttttgttagaagtttggcctaattacatggaaccaaaactatcgaagaggtttcagtctaccgtcgagagacgtttaaagaatcgaaaaccaaaattaatagataaaatagaattacaggaattctcacttggctcttgtccacctaccctgggagatcagggcatgcgttggattacttctggtgac

SEQ ID NO: 26731 - DNA, 541 bp, Sorghum bicolor
  Clone ID: 30978202
tctcgtcagtgctattgcactactgcagcaagccagcaacagccttctcctctcaatccccgccgcttctcaatcctgccccaagtgcccgtgcgccgcgggaaggttctggaagcttcggagatgaggaggagtagatgccacgaaggaggtggggctgccgccgccgctgccttctctgcgctgctgctgggctgcgtcctcatggccctcgtcggcggcggcgccgcgcagggcccccggctcccctccgactacaaaaccctcagcggtgccgctccacttgtgatcgccaaaggcgggttctcaggagtgtttccagattccagccaagacgcctactctttcgccaaggtcgccagcgcgcctggcacaggcacagctatgtggtgcgacgttcagctaacaaaggacggcgttggggtctgcctccgggacataaacatgaacaactgcaccaccgtcggccaagcggaccccgcgaggaagcggacctacgtcatcgacggtatgcacaagactggatggtttgtctccgact

SEQ ID NO: 26732 - DNA, 525 bp, Sorghum bicolor
  Clone ID: 30978212
ataaaaagcctgcaaagtcgccatgcatgcaaacgagaagtgtgtgaatgttgtcgtcggcgacgtggacgttgacctgtacccattcctactccgatacaaggacggccatgtcgagcggttgctgtgcagccctttcgtggcagcgtccgagaacccgacatccaaccgcggggtggcaaccagggacgtggtcatcgacgccggcaccggcgtgtcggcacgcctgttcctcccctgccgagccacgtccggcggccggagtaggaggacgacgacgaagcttcccctcgtcgtgtacatccacggcgggtctttctgcacggagagcgccttctgccggacgtaccaccgctacgcgacctccctggcggcgagctccggggcggtcgtggtgtcggtggactaccgcctggcgccggagcaccccatccccacggcctacgacgacgcgtttgcggcgctccggtgggcggcgtccctcgccgacccgtgggtagcggagcacgtggaccctcaccgcac

SEQ ID NO: 26733 - DNA, 162 bp, Sorghum bicolor
  Clone ID: 30978217
cagtgctcgccagcagcctgccagcctcgcctcggaacattgaagcacacagtagtgtctcactcacccgggcaatccgcgggaggtgcggcgcgcacagctaggaccaggaggcgaacgggcggcgcgacgtgagtcgagttcgggccttgcaggcggggt

SEQ ID NO: 26734 - DNA, 506 bp, Sorghum bicolor
  Clone ID: 30978244
cgccgccgccgccgccacggcaggcgccttcccggacgtcaccatcaccaccgcgttcagcctcagcagcgtcgccaccgcgagcggcaagctgagggtccacgagtgctccatatgcggcgccgagttcgcgtcggggcaggcgctgggcggccacatgcggcgccaccgcccgcttaacgcgccggaccgcgcggtcaccgtcaccacggcgatcgttgccgcggacaccaccggtaacagcaacagcaagaaggaaagcagcgcaggcatcaacctggagctggacctcaacctgccggcgccgtccgacgaggaagccgtcgtgtcgcgtcttccgccaccgccggccgtcatgctcggtctcggccagttcaacgacggcaagaaagctgggctcatgctgacagcctcagcactggtggattgccattattaacgacatgagcgccgccgccggccctgcatctgaatgcctggcctagctagcactagcagccagagag

SEQ ID NO: 26735 - DNA, 471 bp, Sorghum bicolor
  Clone ID: 30978250
ggagctagtgatgaagagttgtagcacccccatgctctccatatatttctcagtgtgggcatgggcaatggccaagctgcagctgggaaggaacactggtcactcagttgactcaggtttcagacaaacagcagcagcggcaacctcctgaaggtgcaggcactacgtatcagtgatttgaagggtgagaataggaataccagtgtggcaacctagagacaacgcactgaaggatgcaaccaagctactgtatctttggaagcaggtggttcacttgagggcatggttgtaagggacagaatgatgagtgctaggccttcctctttcttgatttctctttaattcatgaggctgtaaactggtatatgtgaagtggatgattactaactgatgatgctgcagcaccagcttgtaaccacctgtaagcactggagtcccatggtcaacttctgttgacttgtaaaaggatgt

SEQ ID NO: 26736 - DNA, 556 bp, Sorghum bicolor
  Clone ID: 30978261
cacaccaaccacaacaagcaccaccaccacggcggcggcggcgcgcgcatcttctccgccggcgcgttcgccgtccgcccggagctatgcagccagaagggcatcttcttcccgccggtcccgctggtacccgagccgcccaacatcggcggcgtgccaatcccgccgaacccggtcacgccggccccgccgtctctcgtgccgccgctcctgcctactccgtctccgccgtccgtcctgccaccgcttgtcccacagccgccgccgtcgtcgatagtaccgccgttgttgccgccgttggttaacccgcctccgccgccgccgccgccccagctttttccccccgtgccgcttctccctccggtggttcctggcgtaccgccggcctccgcttccaagaaccgccgcacggggaatccctgagggaaaacatcgagttgtgtacttgtgttgccttttttacattaaccacgcacctacgcactggcgtcgactgtaattttcttgttcctcaaccttactgtatttacccctggtttggtatcagttcaggaaa

SEQ ID NO: 26737 - DNA, 530 bp, Sorghum bicolor
  Clone ID: 30978304
actggacttgtgctccctccgcttcggcccttcttgcttctccggcgatggccgccgccgccgctgccgtcacagcaaccttccgcaccctgctccagcacgcagcggttggcggcgtccccgtcccgcttcccagcgtccggttccagagcctgcagcgccaccgcgtcggcctccgcctcctcgcgcccccgcgtgggcgccccgtcctactcccgcccgtcgccgccgccgcagccggcgaggaattctcttccgacggagaggattccaccggcgacgagtacttcgatgaggaagaggcctccgagtcggaggaagaagccgaggccccgcgcgcctactcgccgccacgaagccgcccgacgcgcggcgacgaccccggccggctcttcgtcggcaacctgccctatacctatacctccgaggagctcgtccaggtcttcgctgaggccggcagggtcgacgacgcgcagataatctatgacaaggtcaccaacaggagccggggctttgccttcgtcaccatg

SEQ ID NO: 26738 - DNA, 557 bp, Sorghum bicolor
  Clone ID: 30978364
gcttatcagtcgacgtcggctgcacttcatatttcatattattagtattgttatatcatctaccaccgacgtcgtcacgcttcgatgggttatgatcagtcgaagtcgaatgatggcgatgtgacggccccgatgatgctacacgggcgcgtggccattgtcaccggtggagccggcggcatcggctccgccgtgtcgaagcacctggcgtccctgggtgcgcgcgtagccgtggcgtacatcggcgacccagcgcctgctctggagctggtgagcaccatcaacaagaactcatcgtcgtcgtcgtcgtcgtcggccggcggcggcggggatcagccgcgcgctgttgcggtggaggcggacgtgtcggacgcagcgcaggtgaaggctctcttcgacgcggcggaggcggcgttcggcggcggcggggtgatccacatcctggtgacggcagcggcggtgctggacttctcgtacccggcgctggcggagacgagcgaggcgtcgtacgacgccacgttcggcaccaacgcgcggggcaccttcctgtgctgccg

SEQ ID NO: 26739 - DNA, 646 bp, Sorghum bicolor
  Clone ID: 30978378
atttacaggtaaactgtgcaattagtttttattttcgtctatatttaatagaccatacatgtggtgtaagattcgatgtgacgggaatcttgataagattttgatttttagggtgaaattaacaaggcctttgtctcgagtagaaacttttacttatgatccgcagcaacaaaatggggtgatttggtagttctcttcgttgaattcagagttgaggccataacagaaaaccgggcatcatttctgtcattctatgactaaatatagtaatgatatatagtacttatatagctttaatttccatcgaatgcgctagcatagcgtgaagcttttgttggtcagcttgttgcctaccgtccaagtgtacaaccgacgcaacactaccaccctgcgcttgcaaatatacagctaagatgctgagttgatagaaaaattacctcagggacaaacgagagtcgtacaaaaatcctgctccggcttcccacgagacaaaacctaaagtgaaaggagctgtttggttgtagaaatggaaacgcaaacgcaaacgtaaagaaaaatgaactccaaatgttaccaggggtaacagatttgaactatctagcctttatgattgtgttactgtataggaactaaacaagtcgtaact

SEQ ID NO: 26740 - DNA, 729 bp, Sorghum bicolor
  Clone ID: 30978380
agcaaggatttcatagataggagcaagagaaactccaaaaatagatccaacttgaaaattcttcatcacagtggtagcaaaccatacagacagatcatatgggacaatggtggcaaggaaaacaatcctccaactttggataaattattttctctcactcatatgaaggatggcacctttgtggattctgaaacctctaccaagcacgcagagattgaggtggaaaggctattgaaccctaccctttctaacgtggaacttatggacaagtgctttgaatctaataggcgtgaccatgttgttggttatggtggtggaataagagcaagagacatacggagtccgactgttaccaaagctgaactaatagaaaaacttacacagtctgaacaggaaaagaaagaacttcaagaagataatcaaacacttcacgaggaaaatcggacagaattaaagagcagaattaaagagcaatatgagtgctagtttaactcgtggataaagagtgattatttggagcaagatgaagagcatcgtttctagcatgatctcacagttgttcatcagaaggcatttgatgggtggatcccttcaagcatagcttagtactaccttatgttagccactattagtttcatgatttcaattgtgttttctccttggtcacatgaactatccaggaccattgtgaagttgaatttgtgaaatgttgaaaattaattcatttat

SEQ ID NO: 26741 - DNA, 604 bp, Sorghum bicolor
  Clone ID: 30978388
cggcaaggacgttctggaggcgctaggaaaagacggggtcatcgtgaacatcagccgcggcgcgaacgtcgaccaggcggagctggtcagggcgctgcaggagggtaggatcgccggcgccggcctcgatgtcttcgagaacgagcccggagcgcccggcgagctcttttccatggacaatgtcgtgatgacacctcatgtggctgttttcacggcggaatccatgtccgacctccgagaccacaccattgctaaccttgaagccttcttctccggtgagccgttgcttacgccggtgcttccccactcaccggtaatgtagcaagtcatggtgtttcgctgccatttacattacgtgattgaaactgaagccagcggattttttagctctgttttgtaacttggcactgtttaaacttctcataatggatttgtggtctctggattgttgcttagcttggacaccatgaaaagtccatcactgcaacataaacaagcaacctgcaacatctgaactctgttttcagcaacactgtaacatcagtaagacagtaatctgcatctgtttctgaagattcaagcaaacatcacaacaacctattca

SEQ ID NO: 26742 - DNA, 200 bp, Sorghum bicolor
  Clone ID: 30978416
aagccccccttcgtcgacctcgccaaccgcctcttcgacagcttcgagacgctccaggaggccgtcaccgccaaggacgacgacaggataagcggccgctacgcggagactaaggtcatcctccaggagctcatggcgaagatggcctagttaagccatgccagatatatatgattatgatgatatgtataaataatccc

SEQ ID NO: 26743 - DNA, 511 bp, Sorghum bicolor
  Clone ID: 30978420
gcgtccaccgcatggccgcgccggagtcccacatcgccatcatcggaggcaccggcaagtacgagaacgccaagggcttcgccgccatccagacgctgcaccctggcgacgagcacaccaccgacggcgtcgagactctactccagttcaacgttcacctcatttaagctgctccatcaccattagatcgaccattaccccctatttcgtgcaatgttcgtgattccaacttccaagtactgtgcccgctttcggccatgtatgtaatgtactaataggtgctatgatcgcatcagcatactgtgagattgtacgagtaaatcaagtagtatgtttctgctattctgagatggctactcctaaaagaaatggcatgagaatatgacatcatcctacgtgaaatggagctggatgggattcaagaagagtaaactccatcgccagtccataaacttgtattgtcgtgtcatcctgatccttaatctcacaaatcgaccgtttagatcttcaa

SEQ ID NO: 26744 - DNA, 687 bp, Sorghum bicolor
  Clone ID: 30978421
tccttgagaatgctcgccagatactaaagattgttgatgaatttggatcctttgatcggtactgctggggttttctgaaccacaagcctatagtgagcaagttccgatatccaagacaagttcctgtcaagagcccaaaggcagatataatcagcaaagacatgatgagaaggggattccgaggtgtgggcccaacggtcatatattccttcatgcaggctgcaggtctaacaaatgatcacctggtcagttgcttccggttcgaagaatgcaatgccattccaactctttgcacaagtgacattgacagggtaaacatgaaggcagatccgaaaaaagatgagatgacaacgaagatttattgtgaagagattaccacaaacccagagatgccaaggacgattgatgctcttattgtttcgtagcaccatgtggtggtatagcaacatggctactgatcttgtgttatctctatgtagacaatgtgttaggttatccttgaattgaggtcaggaatcaaaatgcttttgtaaaaatcatttctgttgctaacacatactctattgtaaattgaatggttagggaagccaaggatgatgaccttttcttactgatcaagaaactatgaaattattattgctgtcaatcatccagcagttttctcctgatcactgctgtttatcagaa

SEQ ID NO: 26745 - DNA, 211 bp, Sorghum bicolor
  Clone ID: 30978425
ctcagtgcgcgcacctggcgagacggatgtgacgattgtttgagaaaaatttacagctcccgccgtggatgatgctatcagctatatatatcccttggagcaccgctggcaatgtgggaatttacaagttccaaaccaatatgccctacacgtagggagtaaataaattcggtgtagaccagtttgatgtttcgatcaattccatttcttt

SEQ ID NO: 26746 - DNA, 552 bp, Sorghum bicolor
  Clone ID: 30978432
gcgcagagtgagtgctgctgcaggtcgaccagtctcctccccgcccgcttcccaccgagctcacactgcacactcccactcccactcccactccccgctgcaggttcacgggaggcgaggtccctgcgcccctgcattcttcccgtattcgcggaccggtcctcgccgcgggagggcgagccgccagaagtgcgttcctgcgatttcggagagagtggagggggcgagtagaaaagaagaggcgttgctatctccttgccttgctgacagctgagctagtgagctgagctgtggaagcacagcggcgccgcggcggtgtggcgactggggaagagcatggcgagggcgcgcggtggcgccgcgtgggtgctgctggcggcggcgtgggtgctgtgggcggcggcggcggcggaggccaggtcgccgtccgggaggagggtgcaccggcacctcaagcgcctcaacaagccggccggcaagagcatcgagagcccagatggagacatcattgactgcgtgcatatctcccatcagccagcttttgatcatcct

SEQ ID NO: 26747 - DNA, 187 bp, Sorghum bicolor
  Clone ID: 30978437
tggcgacttatctcaacgcaccgccggcagctaccaccatggctgcaagctactgccatgccttctccggcggcagcctccgtctgctccggccgagccgacccacgctgcacgtgacgtgccaagcctcctcgtcctcctcccagcagcagccgtccccgtccaggaggtcagcctgcctcggcct

SEQ ID NO: 26748 - DNA, 544 bp, Sorghum bicolor
  Clone ID: 30978441
tactggacggcaacatcaagtactacaagcgatcgatctactgagcaagagctggttggctacacgccagtcctcctcgctcttgtccagtgtacattcaagcctgcgtgcctgccttgcggaaatggccaagaacgcggcgcaagccgtcagggcggcgctgtgcctggcgctcgcgctcgcgctcgctgtggcgaactgcgcattcgctggtcgcgtcctcgacgagcaggctgcggctcccctgccgactgacccgctgcccgccccgacggatcccccggcagacccagtggtggcgccagcggccgccggcgctgcgggagcagcgagtgctggtgccgccgcgacgggcaacgcaggagccgccggcgcgggcgctggggaccacccgctgacgttcttcatgcacgacatcctcggcggctcgcagccgtcggggcgcatcgtgaccggcgtggtggcgagcgcggcggccaacgggcagctcccgttcgcgcgccccaacaccaacatcttcccgatccagggcgcgatgccgctg

SEQ ID NO: 26749 - DNA, 597 bp, Sorghum bicolor
  Clone ID: 30978453
ggagcgtcccagcaagcaacactaacaatggcccgaggggacggtccagctccagctccagctccaactccagcccgcggcgctcgcgtcgtgctgtgcccactgtcgttccagggccacctcagcccgatgctgcacctcgccggcgcgcgccacccggccgggatcaccttcgtcgccgtgccggacgtcatcccggaggccgtggcgcccgcgacgaacaacggcggcatcgccaagctcctcgccctgaacgccgccatggagtcctcgggccacgtccgccacgcgctcgcgtcgctcctcgcagaggagggggcaccgcggctggcgtgcctcatcttcgactccaccctctccgccgcgcaggacgccggcgctggcctcgggattcccacgctcgtgcttcagaccggcagcgccaccagcttccggttgttcaggtccaacacctacgacatgctccacgacaagggctatctgccggccacagagtccaacctacacatgccggtaaaggagcttccacccttacaagtgagggacctgtttgacccaagcaagcttcccaacaaagagatcgtgcacaagatcttg

SEQ ID NO: 26750 - DNA, 631 bp, Sorghum bicolor
  Clone ID: 30978468
cctactggacctttgccaccgctgaactctagcgtatccgcaaggacggtttctacggcggcgtggatcatcgagccgccgcctcacaagaccctcgccctcctgcggcgtccgtcctctggctgcccttccatctgtgcgcctcctgccgcagcagtccacggcttccctacacctcctcctaccgtcatctcctcctgacgcggatcgtggagccgccgcctccccagcccttcctgcgacggccgtcctcgccgcccctccgaccgtgggcagtccatactgcttccctgcaccagcccagaggagcccttctctactcgtactgcagtggcctccccatcgttgtccacctgtgccctgtagttgagaaggctgtagtgtgttatcaaagggagtgcatcctctgatcctaaaaaggcagtggcaaaacagtacagaaacggcaaggccgtggaagaaacaaatgtaagaaggttgcaaaactcaaggcaggcgagaaaattaaagtagtgttctacaacaatcgggctttatctaaaacattcccaaggcagttgggtagaatagtccgtgattctaacattaccccaattagagtgaagaaatggactgatataagtccagcagc

SEQ ID NO: 26751 - DNA, 542 bp, Sorghum bicolor
  Clone ID: 30978504
ctggtcccaacgacacctgctgcgtcgtgctcaccgagttcatcctcaagctggccgggcagaacaacctgcccccgcagccgttcctgctggccctggcgtccagctccaacatcggctcctccgccacgcccatcggcaacccgcagaacctcgtcatcgccgtgcagagcggcatcaccttcggccagttcctcgtcggcgtcttcccggccatgatcgtcggcgtcgtcaccaacacctgcatcctgctctgctacttctggaggtacctctccgtgccggagaaggaccaggagggcggcgcagccgagagggggcctgaggtcgtggccgacgaagaggtcacctcgcacaggttcacgccggcaaggatgtcgcacgcctcctccgtcaacggcggcgtggacgtcgactgcatcagcgagcccattcgccggaccgacagcctcaacagggccgacacgatgagcatgaggagccggagctacaactccgagggcgacatccaggtggccatcaggtccatgcgcgcctccagc

SEQ ID NO: 26752 - DNA, 299 bp, Sorghum bicolor
  Clone ID: 30978513
tgctgcagcagctccagtccccccctgcgcctctcccctccccgcggctgcctcgccccgtccctccgccgacctagggcttccaaatcccctcagcttcccctgatttcacttttccccggcgttgtgcaggctccgggcactggccgtccgccggggccgtgtcttggtgtttatcgggttcctgcgctcctccgtgcaatgctgggcctaagcgcggctggggttggggttcttggcccggagctcgctccactttgaaatttttttggaggctttttttttagggagggaaaaga

SEQ ID NO: 26753 - DNA, 390 bp, Sorghum bicolor
  Clone ID: 30978522
aagcaggccaggaagttccaaacctggtccattgccggttacctggtcgcccgcatgatgctggaggacccatcgacactgatgatgatctccatggaggaggaccggcctgtgaagccgaccatgcggcggtaaaaatcatggaatgcctgaatgcgtggatagctgtttctgaatcaaggaaattcagaatcaaaggtttatacggatttgtgatttgttcagaacacaaaagttgaacgctgatgtgatttgttgggaccacaaaagttcaacgttgattatagttgaactctgtcaaataggacagaaagtgtataccatgcatagaggatcataggagttacacaagattttgccacaccttttttgtttttgtttcagaacaat

SEQ ID NO: 26754 - DNA, 611 bp, Sorghum bicolor
  Clone ID: 30978528
atgccaataccaaagggaacaagtgtagaggccatggaagtagtggaagatttcatctacttgaactgcagtagaagccctagtatcattcagatatggttgagagagaagcagcagaaagtaggaaggctatctgcaggaagcaagataacgagcttgttcactgcaaacgacatgattttctgtggtacagaaactgggttaattaaggcctggataccgttgtgaagagtcgaagcaaaaaggagcaggtggaaggcccaatcttgtaaatgcaaaggaaagctacagtgtacaggaaacatgaaaaagaggagcataccatcgtacaagccctcaggacacaacacagcagcacagttcgtgcataaactccatgatcagcaagttgttcaaaataatgagtagtaggttcatgatgtaaatactaactagtgtgtgcgtgtctgttttagttttgggaaggggtgagttgtgaatgttaataaagggtagggtaacttagatctacatatatatacttgtgcaatactatcctagaattggaattttaagagaacactacatactacctcgggtgacaaaaagagatgtcattttggacaatgaca

SEQ ID NO: 26755 - DNA, 235 bp, Sorghum bicolor
  Clone ID: 30978532
ctgctgttactggttggtatgtatttattactgtgcacgcatacaccacgctggagcacatatatagtatgcaagctgttttaaatttacattttaggcctttgcggcactcatatccacctcaattgacatgtgttgagatgaatacaagtgtggcgaaataagtcccaggtctagtgaggcaaaagtatgtgtatgggtgggtacaagctaaaattatattttttgttgtgta

SEQ ID NO: 26756 - DNA, 624 bp, Sorghum bicolor
  Clone ID: 30978539
gtctcagaggtccaagctcagaagaaaggtagaggaaagaagcccgctgctgctgttaagccgaaggctcctgcccccaggaaaagggcaccggctcagggcaaggcaacgcagaagaaaatagatgagatgctccagggcattgaggataacaacaccagtcctgagaagaaggtccggaagatgaggccctctcccttcaacaagaagagtggctcaatcttacagagaggttcgactgctgcaagctctgaaactactgctgaagcttcaccaccctctggcagctctgcagagccagttggtgcagcacaacctagaaggacagccagggccaccaagaagcctgtctatgttactgatagtgatcccgaggatgaagttgtggagttgactgatgattctgactttgatgtcgatggtgactctgacgagtgaaggtagctgtcattcgtgtgctatgtgcaacagtatctagtttgtgtgtcgttgcatgtgctactttgatgatgcatttcttgttcgttgtatgtgttcattgtgttctgtggactgttgttgccaagaggcaagagcccaagacaataacctggttaactggtttgtctgtgttatttttgcata

SEQ ID NO: 26757 - DNA, 616 bp, Sorghum bicolor
  Clone ID: 30978546
cgcgagggtcggccccgtggtgatcgcgagctccgacctgctcaagacggccgccgacgacagggcgttcctgaagcgcgccggcgaagggtggggcggcgtggacgagatcctcctccccgccgagcccgccgcgctgcggaagctcctggagctggcatcctaccgcccgccgccgcggctgatgacgccggacttcctgctctgtgacttcatcaagaaacttttcacggagaacagggagcggcttgttcacctcctgaagggaattacggtcggcacagataaattccaagtgacaccgatacctcaggacgcgctgattgtgtggggagaccacgaccagctgttcccggtggaaaaggcgtttgcagttcagagggctctgaacgggagcgctagactggaggtcataaagaagacaggccacgctcctcagccggaggatcctgctcgcttcaacagggtcatgctggacttcttgctggcttctcacaagcctgatgacccatcggttaatcctagctcgcagtaagctgcactgcattggtgattggtttatgtagccgactcgattgtttgtaataagatcgctgtacaatcagtttcagtcaat

SEQ ID NO: 26758 - DNA, 659 bp, Sorghum bicolor
  Clone ID: 30978552
gaaaggaggtggtatgtattggtttactgatttgacgactcctgataatttattcattctcccagtgttaacatcactgacctttctggctacagtagagcttaatatgcaagatggcatggaaggaaatcctatggcaaaaacaatgaaaaaggtctctagattttttggagttatgtttgttccatttacaataggctttccaaaggcaattttcttttactgggtcacatcaaaccttttctcacttgtttacggtgctgttctccggaatccagctgtaagactctgcttaaatcttcctcccttggaatctcatcctacacctgcacaagtgcaacccttaaacctgtcgcgcggacccgaggcaagtcctggagtagattctcctatttcagacaaggaatgtgagcaatcgagttctgtgctaagtactggagccgattctcctatagcagacaaggaatgtgagcaatcgagttctgtgctaagtgaccgtatcctttttgttgcgagcaaaggatacccaaactgaggtataattttgaagaggcggaaattttttcaacatatatgggtcgaccatgtttccgtgaataaattggtgtagtatcggcttgtaaaatcgttgcacagtatgatataaccttactagctaa

SEQ ID NO: 26759 - DNA, 633 bp, Sorghum bicolor
  Clone ID: 30978569
tcctaaagagtatgagacttttgttgttaactacaacacacagccagaggggtgggatttagagaaggtgattgctatgtgtgtgcaagaggaagaaaggctcaagaatgcaaatggtggttctgtgaactttgtgaaaggaaagaacaagaagccattctacaacaagaaagctccagatgcctccacctctcagaacaagggaggaagcacttcacagcctaaagcacacccaaagcaagacaaccagcacaggcaggaggacccggatcgctgtagatggtgtaatgagacagggcattggaagcatgactgccctaagttcatgaaacattgcctagtgaaagggattcagtggagggagaacccttcaaagaggagaaagacagattaaggtggccactggtgttgaagctgaagttcaagctataggaaatttatctctagatttagctagtggcttcacccttgagttgcatgatgttctttatgttccctctttagctagaaatttaatttcagtttcatgtttgtcagactatggttttgattgccatttcagcaagaatgattgtaagctacagttaaataataaatgtgtgggtcttgccttccgacaaggcaaactttatt

SEQ ID NO: 26760 - DNA, 582 bp, Sorghum bicolor
  Clone ID: 30978582
cctactggaaatcccaattcccaccaccggccaccgcaccaccgccgtctatcgccccaactccccgccaccctccagatcgcggcggcacccataatggccgcctcgccgtcgccgcgcgccgcggcgctccggggcccctccctgatcgcccttctcttcctcgtcgccgcggtggtgtcggttccccccgtggcggccgagatccgggagaccgcgatccgggccgacccgcgcagcatcatcccgctggacgagttcggcttctcccactcgggcgtgctggagctcaacgtctccggcatcgccttcgacccgccggcctccgcggagctggacctctcccagctcggcttcttcctctccacgctcgacgcctgggttcacgtcctccgccaactccaggaccttgacgtcacctgcgcgctccagtccgagctcgtcaagctcgcctcctccttcgacctcctccgcccgccctccaaccccgccggcgtcgaggtcgctcgctcctcctccttctccaccgccttccgcgtcaacgagcccgggcagtacacgctcgtattcgccaactgcctc

SEQ ID NO: 26761 - DNA, 682 bp, Sorghum bicolor
  Clone ID: 30978584
gagatgcctcgggagaagcagcattgggatttaagacccttcctccttttattagctgtacaaacggcagagagacaaaggtacacaagctaactagatagaggtcaagagcatgtcatccaagaagaagagggccgcgatagatctctccctagaggtagagaggagtgacgaagaccatggcagcggcggcagaggcaaaggcgatcgccgccggggcaaggatgatggtgaggtggacaagaaagaagaacagttcaaggagcaaggcgaggaacccaaagaggaaaccggcgaggaggagaaggtggtagttgaagtggttgtagaccaaggaggagacggcaccaaggagatcaaatataggactcaacaaggagaggagatggaggacgacaagcaatcgccagcggatgcccacggcgacggtgagagcgatggggccgaagctcgtgcgcaggacaagcacgtggtagaggccgccggcaacggcgacggcggggacgatagctacaccaccatggtgcaagacgaggtaagtgcgatgcaggaggagatggagaagatgaaggaggagaaccggatgctccggcgagtcgtcgaccgaaccgtgcgtgactactacgagctgcagaagaaggtagaagcctgctatcagcagcaacaggcagatgagcctaag

SEQ ID NO: 26762 - DNA, 571 bp, Sorghum bicolor
  Clone ID: 30978590
ctgggataggtgcattgttgtccacttgttatttagttgctgccggatgccgaggaggagaggacttgcagcaaatgcaagtcaacatggctcatatcagcagagcttccacatctaggctagctcgcccctctccgtcgccatgctcgccgatctgttgcgatacccaccggagccagagataatgggggtcatcaaggcggcgtcgtattccatggccatagccttgagctgagcttctctgctgccactggtgccatggcgacgacagaccaagcgctgaatgcgatgcacttcattagtgcaattccaaagttgacgggacagaactatgttctgtggcgcgaggaacttgatgctgctctagcacttgctgagatagatttggctcttcaggagccaaagcccactgagccagaggagcccgaaagggctcagaatgagaccgatgaagcttttgctaatcggaagcgagactttgctcccatcagagcaaagtatgatcttgagaagtacaagtgggaaaagtcaaaccgcaagtgcaagattgtcatcaagaaaaccatcacag

SEQ ID NO: 26763 - DNA, 687 bp, Sorghum bicolor
  Clone ID: 30978592
acacacagcaggtcgttgcattgcatttgcatgcatgcacacttcattagccaatagctattagctatatatattccagccacttctcgttcccccttgtacaaagcaatcgacgagctagctagctagcagtgccattgttgatctgtaacatagagcatatatttcttggcccatatattccccatttggaagataagataggatgaagaaggcgtccaggtacctgaagcagctcttctccgccatcgtggcggcggtgaaggccaggtccaccgccgtgggcaccaaggccagctccctgcggacgcgcctcatcgtgctcggcatcatgcgcaacaagaagctcctgctcagcgccatccagagcaagatccacgccatcatgggcggcggcagtagtggccaccaccagcaccagggcagcagcagcagcggcggctacggcggcaataatggcaatgcggtggccagcggccacggcggcggcggtgagggcgagcgcggcctcttcctagccagcagcagcggcgccaggaaggccgcggtgctgcagagcctgccgagcttcgccgtggagcaggaggcgagggccgtcgtgctgctcagcagcctgccgagcttcgcgctggagcgggacgccggcggcgccaacgaggacaaggacaccgtcgaagaagcagcagc

SEQ ID NO: 26764 - DNA, 612 bp, Sorghum bicolor
  unsure (1)..(612): unsure at all n locations
  Clone ID: 30978598
gactgcaagacggcagtctagaaacaaccnctgcagggatacgcgtgccgcagcatcaacangctcgtgctctgacgcgaccagcgngacgaggctacatctgtaagtgcaaccaaggtttcgagggcaacccttacatttctgacggctgtaaagatattaacgagtgcaaacatccggataagtataattgttccggagagtgcaccaatacaattggttcgtacaattgtcgtccgaaagaggctttgccgcgtggagcacggatcgccgctggaattttgctcggatttgtggttgccctgattgcgtttctttccaccgaagttttccgcaacaaggagaaaaagaaaagacaagggttctttcagcagcacgggggccagatgttgttgcgaataatagaaaaagatgccaacaacatcgccttcaagttatacgagagaaaagacctagtgaaggccacacgtcgcttccacaaggacaacgtcgtcggagaaggaacacatggcaccgtctacaaggccatcctcggcactgcaaccactgtcgctgtgaagcgatgcaagcagatcgacaagagcaggacggatgagttcgtgcaggagctcg

SEQ ID NO: 26765 - DNA, 696 bp, Sorghum bicolor
  Clone ID: 30978612
ctggtgtactatggtaaaaaataccattcagccttgagaatcacaaaagatcttagccgaggctacggttactttaatgactatgagaatgactcttcaaatctttctcacttagatatggacgctgaacagtatcatgttgatcggaatgcatattgggatggaccttcattttaccaaaggaagttgacttcacgttttggtggcatgggaccaatgttgttcaatgttaaccttaaagttcaggccagctaccaaggagagcatgtccctcttgtctccttaatgagcagacttaatggcaaagcaattgttggacaccctatccaaattgaaatagttgaagatggttccacagatcatctggtattctgcggtgacagtggtatgcaagagagcacagctactccacctgcttggccaacaggtagaagaactgccatgcaaagagttccccgttcaaatccgtcaggagcactgttggatggcgataatgaaggtggtcttgtgtattctgattatgagatgaaaccaaccttaagaaagtactcgtcttcttcgaatcaccaggttaaggtgaataagaaaagcagttcgaatgctaggaggtcctcagctaagtcccataagaagtcatccaagaaaacaaaccttagagctctctcttccatttccgccgcaaaaaaacaccacgga

SEQ ID NO: 26766 - DNA, 664 bp, Sorghum bicolor
  Clone ID: 30978617
cctactggatgctgtcagtgtagttgctgcattgtcaatatacctgtctacgcagtagtgcttctgtaggtatatagaaaagaaaggcacagttgtctcactctcagaactctgaagatatatacttccatgagcaggtgtcttcaggcaggaagatctggaagcccttccatttcgagatggttgaattcttcggagaacgaaccattcagttgatcgtgaaggaattagcacggtctctgcatcaaaatctggtgttcatgggtttgccgagctgaaggactttctcagcattgcagatcaagatttccagaaagataccaaagggagttctgatagcaggtgcctccatgagatgctccaggagtcccagtctgattcgcctgtttccttctactcacatcttgattctagtgaagaaagtgatagtgaggcagctccatatgacaaaggcaggtcagcaaagatcatgcccatagatgcagatttcttggcagctaaactccatgaaagatcaaaccacaacaagaatctgacgtggtgcacatctcctgaaaatgcaatgatatacgctccagaatctccaatgtacaaggtagatgaccatgagatgaaatcaaaccgcttgcaatcaaacagatctcatggctcactgaataatcta

SEQ ID NO: 26767 - DNA, 529 bp, Sorghum bicolor
  Clone ID: 30978622
accagcaagcagaatcgaggcagcagcagcagcagcagcagccaaaagcaagcccgtgttcttgcatcaccgcctactgcaaagctagctagctagcaatggcgtcgggcatggacgccgctggagagccgggaaactctctgcacgggatgacgggtcgggagctggcgttcgccttctccacggcggcggccgagcacgacggcgacgatgcggcggcgagcaaattcgacctgccggtggactcggagcacaaggcgaagagcatccgtctcttctccttcgcgaaccctcacatgcgcaccttccacctctcctggatctccttcttcacctgcttcgtctccaccttcgccgcggctcccctcgtccccatcatccgcgacaacctcaacctcaccaaggccgacatcggcaacgccggggtggcgtccgtgtcgggctccatcttctcccgtctcaccatgggcgccgtctgcgacctgctgggcccgcgctacggctgcgctttcctcatcatgctgtcggc

SEQ ID NO: 26768 - DNA, 665 bp, Sorghum bicolor
  Clone ID: 30978624
cctactgggcatcgcaattcacaaagacaatcgaaattgcagcagcaaactgctgtgcaccagtagctcttgagccaccaatggcatccacctcgagcctccctgcagtggccctcgtcgtggcgctcatgctagtcctaggcaacagcggcacttgccatgcggctcgcctgctcgccgacgccacggcgcctgccgcggcaccagctgctgccgtgccaggcatcccggctctgccgaagccgacgacggtgccagcgatccccaccgtgcccgtggtcaccatgccaccaatgcctgccgttcctgcggtcaccgtaccgtccatgccagcagtgcccgcggtgacgctgccaccaatgcctgcggtgccttccgtccccgcggtgcctgccatgccgaacgccgccgcgctgccacccgttcccgccgccgtcgtgcctaagttgacaacactgccaccgatgccgtcggtgccttccatccccaaggtgacgctgccgccgacgccctcctccatccctggcgtgccaacaatgccattcctcgcgccacctccaaaggcctaagagagttttactgtcttgcacccaagcctctctgcttctgcagttgtgtgctctgctccgttctgcacttgctttgttctgttgtgcacacctttc

SEQ ID NO: 26769 - DNA, 300 bp, Sorghum bicolor
  Clone ID: 30978626
aaaaaaaaaaaaaaaaaaaaaaaaaattaaaaaaaaaaaaaaaaaaattcctttcttccgtttgtccctcccaccaccaccaaccaaaacccccaaccgccgaggtcgccggggactccgtccgctccgttcctcgccggggggatgtcgttccactaccccaaccacgggttgtccatggacgttgccgcggaagcggaagcggttgcggcggccgcggaagccgcgtcgtcgccaaaccctaggggtttctcctcccccggcgtcttcggcggggaaagggaaaagggggccatcgcg

SEQ ID NO: 26770 - DNA, 535 bp, Sorghum bicolor
  Clone ID: 30978641
tactggatgtgcacttgcaaactctggctgccagctgaaggtaccggaccagcggtagctcagtgccatcaaccagagcctatgggggccagcctgagcctcgtgccggtgctcgactacttcgcccgccgcgagtgcctcggcgccggcctccaccagaacgccgtcacgctcccgtaccccgacggcggcgccggtgcgacttgcaccgtccagtactgggctccggagggggagccgcagctccctccactcctgctggtccacggcttcggtcctcgggccgactggcagtggcgctgccaggtgggaccgctctcgcgccacttccacgtcatcgtccccgacctcctgggcttcggcggcagctcgtacccgttcgagacggcgccgccgccgacggaggcgacgcaggccgcggtgctggcggcgctgctggacgcgctgccagggatggagggccggcgcgtggccgtggcgggcaccagctacggcgggttcgtgtcctactggctggcgcgcgccgcgggggccg

SEQ ID NO: 26771 - DNA, 640 bp, Sorghum bicolor
  Clone ID: 30978650
cctactgaaagccacgcgaccgcgcgcggtcgcccgaagtagcgtagcgcacttgcgctcagcgcacgtcttctttcctggcgctagccaagcggctgcctccctgcaagggagcggacccggccgacgagccacgccgacgctagggtttggtttcgccggccatggacctgcctccgggcgccgctcgccgcaccacctactccctccttccccagttccccgacgacgccgcccccgcccccgccaacgtcctgcagcgccagtccagcggcagcagctacggcgccggcagctctatctcgacctccagcgactacccattccacctgcaaccccccgcctcggccgcgggggtcgcgccgcctggatcggcagcggcgccgcccggggctgctggctctccctgcaagagctgggcgcagcaggccgaggagacctaccagctgcagctcgcgctcgcgctccgactctgcgccgacgctgcgtgcgccgctgacccgggcttcctcgacccaggcgattcaggaagcgggaggggcagcggtaacgggagggccttcccgctcgcgcagcccgcgccctctgcggggtcgctctcgcatcgcttctggggaaatggttcgctatcatacaacag

SEQ ID NO: 26772 - DNA, 331 bp, Sorghum bicolor
  Clone ID: 30978651
tactggactccctctcaccaccgcctcggaccgcgatctccccgccgccatggctttctccgcgcggaggagcctcgccaccagcctgtcccaccacttctcccgccgcctccacccctccatctcgcacctcatccctcctcaccacgtcaactccgaccccgctccctccccttcctcctcccccgtggcccccttccccctccccttcgctctccacctcgctgcccaccgccacttctctgcctcgccccccgacacggacgtcttgacggacgccgccgccgccgcggcccccgtgtcggagctgctctcggatggggtggcgtcc

SEQ ID NO: 26773 - DNA, 767 bp, Sorghum bicolor
  Clone ID: 30978653
cctactgctgtgactttcaacatcatgctgaagtcatacattcaacatggaatgcttgaagatgcgaaagatctactctatgatattctgaattgcaggataaggagtaaagcggattctagtcaagtggcaactgctgacaagtttactttcaatactttcctggaggcctgcgctgcagcaaaaaggtggaatgactttgagtatgcgtttcgccagatgttattgaatgggtaccatttcgatgagcgaagacacctgcgtatggtccttgacgcttataggcatgggaaggaccagctgttggatgatctgtggcactacctgtgccatcacagccgtgtcccgcccacccctgtcataatggagagattctgcctaaaactgatgcagggagacacattggcggcgatctcttgtgtcagcagcttcaaggagggcaagatatgcaacatatcctccacgtcttggctcaatctgctgaaccgcaacacggctaggctgaaggaggagcatgttaccaagttagctcatgagcttaacaacctcgttagctcaaggagttcctctaatagcattactctgtaccaaaagattcttagtagctgtacagccttcctttctggagccaccattgtagaaaaggcgccttctgaccaatagatggtgttacagaaatcatagttaccacaactagtccattatagtactccaaatcataattaccacgactgatagagtatattgcatttaacgtttggttatcg

SEQ ID NO: 26774 - DNA, 554 bp, Sorghum bicolor
  Clone ID: 30978657
tcttcgaattcccctcccctcccctcctctgcagcgccagcgccgaccaacccaacggccacggcaagctaagcgaggctgggaggcggtggccgagggttcgtcaagccaagccaagcgaagcggagcaagggtttgctcctcccccccatccgccccgccgcggacgaggctctgcttctcagcgtgacaagcctggcgaacaagctgccatggacctggtgggatccttgctgatgaacacgacgcgtctgcttgacccctccgggctccactttttgggctggctcgtcaccgcaggatccattggcctcgccgcgctcatctacgctctcctcaggctgcagcgcgaggcggcgctgtactggaccaaggcagccagggagaagcgcgccgcgtggaggaggtcgcggtgcccgagctcctgccactcgtggtccgaggaccgcttccacggcggccagccgtcgacgtgctgcgtctgcctgtcgtccctcagcggctccgcgcagggcgccgacgacgtggttcaccgctgctctgtgtgcggcgtg

SEQ ID NO: 26775 - DNA, 608 bp, Sorghum bicolor
  Clone ID: 30978663
ggcaacgacgcgagccccaagatcaagaagttcgtccaggtcatggcagtggcaggcaacaagctccggcaggacggcaagcagctggagggaaacgaggcgagacaggtggacactctcgatcgggccctggaacaagatcaggtgcacggcgacggcggcatcaaggaggtgtatgccggcaccacggcgagcgcgccgccgcccctgcctcgcaacggcgtcctgatcagcggctgccagacggaccagacctcgggggacgccaccacggcggagggcgtgtcctacggcttgctcagcaacgccgtccagaccatcctcgccaggaagcacgacggggcggtgacgaatagggaactggtgctcagagcgcgggagctgctgtccaaacagggggtcactactcagcaacctggcctttactgcagcgatgagcatgccagtttgcctttcatatgctcgagtagagacgcaagcggctagcccattacacgactgtattatttttctatggtatgtggtggctatgattgttgaaattgagaatgagactgttatgcacaaaatgatctctttgtgcctatatatttaatcatatgattcgt

SEQ ID NO: 26776 - DNA, 554 bp, Sorghum bicolor
  Clone ID: 30978683
agcgcggacggcggcggggacgggtccagccccgcggcgggtgggtggagggcgcaacacgggtgcaagttcagcacgcaggtgtgcgactcgcacgcgcgcaacgtggtggcgtccagggcgtccaggatggggatgagcccgtagcccctgtacgtgcagtgcagccgcgtcctttggcgttcggttcagacatgggaatttttcacgcgatcgcgagagaatcgaccggagatcaggtgtggacgagaatggctgagaagttccagattttttaccgctccaaagtttcagtttcagcctctcacgttttcatttttggtccgtggacgtgagaggcgtgatggtcatttccctctgtgtcgccccagatgggcgaggatccgtgtgcgttgtcttgtctgtaccggagggctgtttgtaatgtgctaccaagccggttccgttcaggttgttttttgcactcaagtgtctggttatccacatagagtgccctagttgcctgaacaaggccctagtttcctgcgttatacttgtacaacacgtgtttggtt

SEQ ID NO: 26777 - DNA, 668 bp, Sorghum bicolor
  Clone ID: 30978694
cgacggcggatgcaaagcgaagacgagtagcggaggtggcagcaagggaagctcggaggggaagaagaagagatcagaggagcagcaagggtcggaggggaacgccaaaaagtccaagaatgaggcctcctcgcccacgtcgtctctcaaggcatcgcaggtgccgaaagtgaagttaggagacaagatcactgcacttcaacagatcgtttctccatttggaaagaccgatactgcatcagttctgtatgaggcgataaattacatcaagtggttgcatgaacaagtgcagttgctgagtgatccatacatgaagacaagtagtagcaaggactacaacgcatggggagggtcggataggaaggagaagtcggagacagagatcgacctgcgaagtagaggcctgtgcttggtacccgtctcatgcacgcctcaagtgtacagggataacaacggcccagattactggacgcccccatatagaagctgcttataccgatgaactgattcctagctatttattcgattggttaccttactgagtggtaataatttgtggtgaatatatatattattgttaaagaagacacaaaacatgatgattgattagccttataagtttagagttcaatttgtgtacaaccacgatttcgttatttaaattaaaa

SEQ ID NO: 26778 - DNA, 581 bp, Sorghum bicolor
  Clone ID: 30978707
agacacaagcaaggtgctgtcggggaagatgcagctggaggaaggcgagttcagcatggcggatgtcaggagtcggtgaacatggccaatgtggcgggcgtcccggcaaggggttgcggtggtctgggacccctgtgagttctcggtcgtgagatgtgcggccgtcctcggggacagcaagcacttcaagcagatcctggacaacctgctcagcaacacgctcaagttcaccgatgaaggctacgttgtcctccaaggctgggcgacccaacccatcgctaggagcaatgtcagtgctccgtcaaggtttgcgcacccatggcacagtggcggcagttccttgggatgcttgttcagagcaagggaggattctggtgattaggtcatgtgcaaaatgaccctaatttggttgagtttcactttgaagtggttgacaccggcattgagatccccaaggagaagatgatgtctgtgtttgaaagctatgttcaggtaaacaatggccaaggcggtacaggcttggggctcggaattgtgtaatcctttgtaagttactactacaatatactatatacatatat

SEQ ID NO: 26779 - DNA, 346 bp, Sorghum bicolor
  unsure (1)..(346): unsure at all n locations
  Clone ID: 30978734
acgaccgccgcttctcccggccattgtcgagggagagagcgcgcgagcgacctaggtcgtcagtcggcttcgggtgttcggcgccgtcagctagctatccgcgacgatgggcctgcgcgtggccgccaccgcgccagctgcggccggcgtgcgcgtgctcggcggcggcgccgcgagcgtgaagccgcgaccgtgggtggcgctcggaggcaggagacgcctctccgtgcggatgtccgtcgccactaccgaggtcaccttctccgccgccgccgccgtgggcgcctcggaggaccangcgctggaggctaggaactccaggacggtggtagcggtcatcctcggc

SEQ ID NO: 26780 - DNA, 568 bp, Sorghum bicolor
  Clone ID: 30978744
tactgggtcaacaggtcacttcactctgcaacaaaaccctcaattattttgttcgttcaccggagaaacatggcactgccggcggctaacccgggcgtccgtctcggctgccaggaggctccggcgatgggcttggggttggcgccgcggctggcactgcgtcgtcccgccgcggtctcccggcataggtttggtatctctgaagtcttcgatttcagccgtttgttcgttcatatacggagagttgcagtcagttgaagcgctaatctggttctttcattttgcttccttagtccgcccgttcaccgacgcaattgcaaaatcgtatagtccataattccatgtcctcaaaaactgtcctcgcaaaaaaaaaaaaagaagaagaagaagaagaagaaaaagaataccgtcggtttgttttgtttgaaatccacagttttccccattgtgtacacaatataaattagctccacagaacgtagatcatcagatgctgcttagcaggatttgagtggtggagaattagaggccaaggatgagcaattgttgccttggatcgtgtgaatca

SEQ ID NO: 26781 - DNA, 545 bp, Sorghum bicolor
  Clone ID: 30978745
tctgggttttttacccgcagacggcaggaagctccggcgacgcgagggcgagctgcgcctccgatgtccctccaacccggcgaggcagcggtctcggcgtccacctcgcgcgcgacgaggcaagtgccgcctcggcagccagcaggcccgcgggtccagggaaacggttgctgcacgagcttggcgaggcaagcgataagcctcctaaaccacagtccaccaccactcgtacagccgattcctctcaccgtgctggcaccgatggcgacgaacccgggcgtcctctgccgcgcttcaccccgaccaccgcctgcgtcaacggccgccgcccatttgcactccctctcttcctcctccgcctccgaacacattccccattcgactcagcgcggccgcctcgccgcagctccaccaccaccaccccgttgtgtagctagtcctacaattgctagtgtgaaagaccaaactgaggccgaagttgcaatggggtacactatgactgaaatctgcgacaaattcattgagttcttcatgtataagaaacc

SEQ ID NO: 26782 - DNA, 644 bp, Sorghum bicolor
  unsure (1)..(644): unsure at all n locations
  Clone ID: 30978758
atatgaatgtactcgtacacggtgaccctcgtccgcgtctccaacgaatagaaaatagcgagggaggaatgaactctgcacctcgcacgagggcaccggcactcgatctccaccaactctgcacgagctgccagatcggcgccaaagaaaggccaatcgacaactcgttgccgcacgcaccaacccgatcgagttccattccggccgccaccagcgcaccacctcaataaccacgcgaggaagcacaagcgcgtcgcctgcttcaactaccctggccggaacgacgagctgaagggctgcttcaacgacgtgacgcgcatgcgccgctgcctcgtggagcgcttcgggttcgacgaagccgacatccgcgtcctcgccgacgccgacccgtccacgccggcgcccacgggggccaacatccggcaggagctcgagcgccttgtcggggacgcccggcccggggacacgctcttcttccactacagcggccacgggatgcagctgcccgcggagaccgggcaggacgacgacaccgggcatgtacaaactgcagaccaagatttcaaggagctcgtggncaaagtcccagatggctgcatcttcaccatagtttcagactcgtgccacagtggcgggctgatcga

SEQ ID NO: 26783 - DNA, 405 bp, Sorghum bicolor
  Clone ID: 30978769
ctactgggttgtgatctatctattcccgcacagcccaggtgccaggtttgcccgattccgaacggcggccggttgcgggacagttcccggccggcggcgaccctcccagctcccgccgccctaccgctgcacctctgcgcccctgtcctcggtggctcaccgttgaatcggcaggcggtgccccctccctgctcccggcggcccgccccgctacagcacaagcctttgcgcccctaatccaagcatccctaggcgggctcaccgtcgaatcggccggccggccggctttctgcatcccagcaagattcaatcgtcggtgaagagcgagatgtcggaataccagaacgttgttggggggaggctgaagctgaagggcaaagcgctggacgtgaaggaaggtggagt

SEQ ID NO: 26784 - DNA, 583 bp, Sorghum bicolor
  unsure (1)..(583): unsure at all n locations
  Clone ID: 30978782
cctcgaggggccaggcatgggttctgcaccacgggngctgcccagcgacgtcgtcttcgaggtggacgacatgaccttccacctccacaagtttccgctcatgtccaagagccgcaagatccaccgcatactcagcgagcaggaggagcagcgtccgcggcggcgacggagacagatgaggagtagcagtgacggaggcggcgacggtgctgcagagatagagatcgaggaagcagaggaggaagaggaagccgagcccgagcaggagcaggttaggacgggagagggcgacggccagccgtacagcattgcgttcccggacttcccgggcgggccgggcacgttcgaggcggcggccaagttctgctacggcgtccgcgtcgagctcaccgcctggaacgtggcgccactgcggcgcgcggccgagtacctcgagatgacagaggaccacgccgaggacaacctcgccgcgcgcgcagaggcgtacctggagcagaccgtgctgaggcatcccggcgacaccaccaaggcgctcaagtcctgcgaggagctgctgccgctcgccgaggagctcggcattgtc

SEQ ID NO: 26785 - DNA, 393 bp, Sorghum bicolor
  Clone ID: 30978790
ttcgcgcacgcccagcccagcaatgtcgctccggccgctgcttcgcctcctcctcccatcgcctccccaccggaaccctccgccgcctccctcttccccacccgtcgcgtccaccagccgccgcgccgctgccgcagccgtcctcctgctctccgcggccgcttccgccccgccctcgcgctccgcccgcgccgagcccgagggcgaggacgtcgacgaggcccgcgtcgttcgcttgttccaggaggcgtcgccgtcggttgtgttcatcaaggacctcgtcgtcgcggggccgcagggccggggaggtggcggggaggaggacgatgacgagggggagggcggcggcgctaaggtggaggggacaggctcgggatttgtatgggactccgc

SEQ ID NO: 26786 - DNA, 196 bp, Sorghum bicolor
  unsure (1)..(196): unsure at all n locations
  Clone ID: 30978796
ttcctgtaagctctctactgaggctacgtcgagtctgcaaggaatggtggaacatgatcagcgcccctcgcttcatcaaagagcatgcctattgtgcacccaagcacctcctcctttacttgcctaaattgagtatatctgcctcccttcatcccaagactgccnaaccctgccatgcaacggtcattgatgaaaa

SEQ ID NO: 26787 - DNA, 556 bp, Sorghum bicolor
  Clone ID: 30978797
ctctttgcttggttacattctcacacatgcgcttctccatttcgaggaaagttttgcctctaccttctttaatcgattgctcaatgatagatcagtgctaacaattaataatagggcgccggcggcgaggttggaaggagcatgcaggccgtgcacgacgcccacgacgacagcgagaacttcctcgagctgctcaactcgaggacgctcgcgccggagctcttcgccgagcccccggcctgcgactacctcaagaagatggagtacggaagcagccacggcggcggtggcggtggcggtggtgggtggccggaccaccagttcacgacagccgccctggagaagcacctgagctccggctacggcggcggcgcgctcgcgcaccaccatgcggcggccggcggcggcgggccggagcggctcacggcgaacctgtccgacctcgtgagcaactggtccatcgcgccgccgaacccgtgcctcggcgacgcgcaccaccgcgccgcggcatgcgataacaacaacgccgccgcggtggccgccttgggccacggcg

SEQ ID NO: 26788 - DNA, 537 bp, Sorghum bicolor
  unsure (1)..(537): unsure at all n locations
  Clone ID: 30978798
gcgctgcactgcaccaccnatcgcagggnacacacnaccggcctgtccgccgccgccgcccgcccgccatgntctcgctgctgcccctngcgcgagtgccgcnctccaccaccngcgcccttcctcctcccttccatccccgccgcttcttccaggagcggcggcggtggcggcgccttcttcagtgctgccgtgggccggagcaggctgcggtgcggaggcgggccgagacacgggcacgcgacggtcgcggcgggcagtaaggacaacgggggcggcacggcggagggggagaagggagaagacgacgccccggcgttcaatccgttcgggttcgtgacggacaacccctccagccgcagcgccatccagctgccagcggttcccgccgaggacggcaatgtcggccagatgctctacaggatcgaagacaagggcagggagtacggttcgtatgtcagagcaggagagtttcgatggttcgtcagagaaacagggtcacctgatgctcgacgtgggactattgtgttccttcat

SEQ ID NO: 26789 - DNA, 359 bp, Sorghum bicolor
  Clone ID: 30978804
aggtgctcctcctcctgctggccggttcggccggctctcacagttgtagtaggcttgtagctcgatctgcacggcgccacgggcacgcacgcaatggcgacgacgacgggccgggcgccgctgctcttctgccttgtgctgtgcctctgctgctgcgctcctcgtctgtgcgcagaggtcgtcgccgccggcagcggtggcgggtacgctgtccgcgccgtgacggtggacaaaggaggggcgcgcctccgcgccgagctcgcggccgtcgctgccggcggcggtggcggtggcgtgcacgcggcgtacggcgacgacgtgcggaacctcgacgtgtatgccaaacttgagacagacag

SEQ ID NO: 26790 - DNA, 413 bp, Sorghum bicolor
  unsure (1)..(413): unsure at all n locations
  Clone ID: 30978814
gacgacgcgatgccggntgaccggngatcgacgacctcntcgccaagccgccatcaccatgccngtgtccgcaggtgacgtgactcttgccgctgtcggacgtcggacgacctcgccaaggcatcgtcgccgtgccgctgctggaggtgaccaggatcgatgacctcgccaagccgctgtcaccgttggacgggccgatgtcggacgtgactcctgccgctgcctaccggatgcaacaaggcgcctgagaccctgtgcccgcgacgtcgaagccgttcggaaaccaagcagctcacggcagctaccctccctgcatcgagcgccctctacctgcgtcgtggcctacgtgccatgttggccaaggcagacaagagtggcgaggcacacctagagctgtgctgcgtgctgatggg

SEQ ID NO: 26791 - DNA, 415 bp, Sorghum bicolor
  Clone ID: 30978819
cggtaacgaaatagttgggatttttgacacatgattgcccccccccccccccctgtaacagccgttcttattgacttaatcatcacgtgtggagcttatgagacctgatggagtaactagaaacttaattgtctactgctttcgtcaaacaaagtgggtgcagagttgcagacctcaaggagtcaaggtcttgcgcatccaacttgtctgaatgaagggctcctactcagctgccaaatcaaggggggacaatgtgaacgacctgacagttgaagggctgccataattcaactttggttacctgtattattttggccactctgtccgatgtttatgagtcatgtgtgcccattgcaacatgcatctagtaatgtacactggcaagaatatttttacctctaacgtctgtcagtgc

SEQ ID NO: 26792 - DNA, 628 bp, Sorghum bicolor
  Clone ID: 30978829
gctgcaaaggcatatgcaaattcattgtcgctctgtaaggaaacatttttctcagcacaaatggatgatgaacttgtgttaaggtaccaagcattaatgaaggagagctcaaaattgccactgtttgacttacggaagctaaatgcatcactgcctgtaccttctgtgccagaaattaccacagaaattcttgtcatgggtgcaagaaatgatttcattattgattctgaagggctttatgaaacttcaagattttacggagtgcaaccagtatgtgtggaaggtgtagctcatgacatgatgttagattgctcctgggataaaggagctgaaataatcttgacgtggttagagaaactcacaccatgattgggataaacttgacatggtttgacaatttggagccctggtttttcttgatcttttttggtggacatctgttggtagggactttctaggttgtgctttgaagttgcttccagtattattgttttgattgaaacgaggtccagattatcatttcattgttttgttagtccagattgccatggctcttattcccatgttttatgtgtgatagctcctccacaacaataatgtatgtttgcaaaaccaacatttttttagc

SEQ ID NO: 26793 - DNA, 615 bp, Sorghum bicolor
  Clone ID: 30978830
gaagcacatatgcatagcttgatcgcaagggagtgggaggagctcaatagggagtgtttatgcacgaggaccttctcctctaacttcacacaggtctgcttgaacatcgcgagaatggtcagtgtcatgtactcgtacaacaaggaacaaaggcttcttgtccttgaggactatgcaagaatgttgatactttgaagctttgctccatgcaagtccatgtgccatgcctaatttatctcactccttgttagttgagaccaatatagaaatcagagcatgtaagttagatagatggattaaaatatttgggcaaagaaggatgatatatccatcttcttgaaaaatgtattgttgaaatatacaatggaagtaacagttttgtaagagccatcacaaatatgaggcatgtcaacaaggttaccaatggcattttagagctaccatgggtactatatacagaggaaggggtgagtgctagtatagacactaaaggaagatgtgtatggtcttgtgcaatactattgtgctgtaataaagttatgttcttgtaagtgttagtcaattgattaagttgtataatttggaagtacttattgcataagttattgtgatcca

SEQ ID NO: 26794 - DNA, 532 bp, Sorghum bicolor
  Clone ID: 30978831
cggcgagcccccctacgccgagacgctgggcgacaacctgaacctgaccatccctgcgcccgggccggacgtcatccggaacgtgtgcggcagcatcaggtgcgtcgtggtgctcgtctccgggcggccgctggtggtggagccgttcatggatatcatcgacgcgctggtggcggcgtggctgccggggacggaggggcagggcgtcagcgacgtgctgttcggcgactacgggttcacggggaagctatcgaggacgtggttccgctcggtggatcagctgcccatgaacgtcggcgacgcgcactacgatccattgttcccgtttggcttcggcctccagacacagccgtccacatattagagggtaattgcatggcctaaatttgagctaaattcttagatttccctgtgaaattaatatgctaagagagactctgaaagcttacttagcttgatctatgtgagtagtactgtagtagacaattaataataagatccggaatgtccgatggtctctcttcgggaaaaa

SEQ ID NO: 26795 - DNA, 652 bp, Sorghum bicolor
  Clone ID: 30978840
cagtttcatcatggacgtcgtggtcaaggagtgcagcgacgtctttcaggggattagctcccttgtcgacgtcgccggcgggctcggcggcgctacccagaccatcgcgaaggcgttcccgcatgtggagtgcagcgtgctggatctcccacacgttgtcgccaatgctcccactgacaccaatgtgaaatacattgccggtgacatgtttgagagcattccgtcagcaaacgcggtcttcctcaagtggattctgcatgactggggtgatgccgaatgtgtcaagatattgaagaactgcaagaaagccatagcatctcaaggaggaaaggtggtaatattggatatggtggttggagcagggtcgtccgacgagaagcatgtggagacgcaaatcttgtttgatctctttatgatgtttatcaatggtgccgagcgagatgagctagagtggaagaagattatttttgaagctggatttagctcttacaagatcatccctgttctaggtgttcgatcgattatcgaggtctatccatagaaatctactatgtaagcgtgtgaagaagtgttttgccgtgtgtcttaaagttcttagaatacagtcctcaacaacgtgtaataaaatgatttgatccccgccggaaggaag

SEQ ID NO: 26796 - DNA, 638 bp, Sorghum bicolor
  Clone ID: 30978841
atttgctacagctttcaacagttactgcagccttgtcgacaacgcaaggctctacagtaccaacaccttgggtgttcctaagttaataggatggaaggatggcgagagcagcttactggtggatcccgcagaaatcggctgcttggacagactaagaagtttgaacgaggaggccaactgcgtccatgagctatacgccgacggccaaccgacaggaggctcgtcgtcagcatggcaggacctggtcatgtcgccattgagggcatcggcgcagggggagctcaaggctgccatcgaaaggaacgaggcacgcttcaatcctgcattgccgtagctgctgtcttactggtgcatcatcccaaaagtggggaaaagatgaatttcatgtaatgcaacattcaattttttgtttcttttcaaacataggaatttctcattaggtcttgtttggatgatatcgaattcacctcaattcacatgtgttggggtggaatttaattctagttctactccattccacctaacacatgtaaattgatacaaattcgattacattcaaacaaggccttaggattccaatgagtatgctatctaaaatgattcctatgtgtttgcaccgcaaatttaatgctgtacag

SEQ ID NO: 26797 - DNA, 735 bp, Sorghum bicolor
  Clone ID: 30978890
acgccgcgccgcccgtgcccccatccccactggccagccggtacctgtgccgtccatggctctgctccgcctccacctcccgaggcctccgctgccggcccgccgcatccccgccctcccttccgctctctcctcctccaccacgtcgtgcttgtggcgcggccgtcttcccgcctcgcgcctcctctgctccagccaccccgcctcgtcccccgacgcctcctccgccgccccgccctccatcgtcgccggcctcctcgactacctcaacgagtcatggacgcagttccacgccacagctgaggccaagagacagctgctcgacgcgggattcaagctgctcagcgagagtgatgactgggacctgcagcccggcggccgctacttcttcacgcgcaacatgtcctgcttggtcgcttttgccattggggaaaagtacagagttgggaacggtttcaacataatcgcagcccacactgatagtccctgtctcaagctcaaacccaggtctgccaccatcaaatctggccaccagatggtcaatgtgcagacatacggaagtgggctgtggcatacatggttcgatagagatctaactttggctgggagagtcatcctcaaggctacagacggttcctttaagcataagcttgtcaaactcaccaggccactgatacgtgtacctacactggctatccatcttaaccgcacagtgaatactgatgggttcaagcc

SEQ ID NO: 26798 - DNA, 553 bp, Sorghum bicolor
  Clone ID: 30978899
cctactggtcccagtcccatcaccccctcgcctccagcagagaccgcctccatggcgtcctccaccgcggcctcgccgctcacctgccaccacctcggcagcgttggcgcccgccccagcctcccgtccctctccttcggacccctccgccgccgctcctcctctaagcccatctccctctcccactccctcccctccaagccctcctcgctggccccaccccccgccgcatccacatccgcatctgcatccgcatccgcctcctcccgccgcggcctcacccccgtctccgcctccgcctccgccgcggcggccccagccccggacccggtcccggtcccagccccggccccagccccagccccagccccggcgccggccgccccgccgaagaagcccgcgctgcagggcgcggccatcaagccgctcctcgcctccctcgcgatcggcgtcctcatctggttcctcccggcccccgccggcgtgccacgcaacgcgtggcagctcctcgccatcttcctctccaccatcgtcggcatcatcacccagccgc

SEQ ID NO: 26799 - DNA, 497 bp, Sorghum bicolor
  Clone ID: 30978903
tccagaagcagggttgcatcgggcagcacggcataacacctccctccactgatccacttccagtcgcccaacgtcttctccttcgcaaagcaagcttcctgttcagctcgatcagctgcaggtcgccgcgcccatggcgctgctctccgccacttcacccgccaaggcgcacttctcggcgctcctcttctgccacgacgagccgcagcagcaccagcaccagcaccagcacgcgctccccggcggcggtaacagggccaggcaaaagcgggcgcggggcaggtgcgcggcggcgccatcaatgcggcctcccgacgcgtccgtcgctcccgcggccgcggccggcgaggcgcggcggaagaagaggccccgggtgctggtggccggcggcggcatcggcgggctggtgttcgcgctggcggcgcggcgcaaggggtacgacgtgacggtgttcgagcgcgacatgagcgcggtgcgcggggaagggcagtaccgcg

SEQ ID NO: 26800 - DNA, 572 bp, Sorghum bicolor
  Clone ID: 30978924
atcgtcattcttcatctgtttggcgccttccatggccaccgccaccctcgccgctcctcctctctttctcttctcacgaccggcgccagcgcaggcgcggacggcgaggaggaggacagcgaggcccttcctccgccccgcttgcgcctacgctctgcaagagggccagtcccgccgcttccaccgcttgccgtgcggcctcgacctcgaggtcatcgcgcagtgcccgccggcggcgggagagcgcccgccgctggtgttcgtgcacgggagcttccacgcggcctggtgctgggctgagcactggcttcccttcttctcgcgggccgggttcccctgctacgccctcagcctccgcgcgcagggtgaaagcagtgttccacaagaggcagtggcaggcactcttgagacacatactggtgatattgctgatttcatccagaaggagctccccttgccacctgtactaattggacattcattcggaggcttgattgtgcagcaatatacatcatgcttgcaagaacttctgcgtccaaagattgctggtgctgtccttgtatgttctgtgc

SEQ ID NO: 26801 - DNA, 600 bp, Sorghum bicolor
  Clone ID: 30978926
ggaaaaaaagttcagccctgaaaaaaggcgcaaaaaaacagaggaaagagctaagcctcaatgcggttcctgaatctctagccaactttcgcaaagaaaataagagcaaagtctcttattttctgcagccttccatgaataaagatgcagttgaaccatcaaggagggcagctgcatttggcatcatgactggaattttctctgccgcgcacactctggggagtgtgttttcaaggttcctgcctgagaagtggatttttgaggtctcagttgtcctgttgatctgctctatcatctacatgaaaatatatttggttgagacagttcaaagagcttctacatcttctcagcatttgtccatgtcatctttgcttgtcaagttaccaaaagaacgttgggaatctatcaaggagaacattagcatagtcaaaaacagtgaaacacttaggagaatatcatacgctgccttcttttataaattgggcatgattggcattagcgacgttctaatgtattacctaaagtccgtattcggctttgacaaggatcagttctcagaaattctaatggtggtcggcgttggttcaatcttttcacaga

SEQ ID NO: 26802 - DNA, 515 bp, Sorghum bicolor
  unsure (1)..(515): unsure at all n locations
  Clone ID: 30978927
actggttgcaaatcccttcgggtgccgctctcgccatctcccaccagccgcactcttcctcatgcgtggcacacttggccatcctccgccatcaccattgcccaccaccctcacccttgccctcgcacgaatccgactgctactcgcgcgcgattttggttttggagcaaaaattccatcccggccaccatatatgccttctcatgtgtcttcttcaaccccaatccacccctgtgttcacccaagatgtcgacgatggagagcaaggcagtggctttggctaggaagaagaagggcacgccatcactagcagtagccatcaccatgccgccatagcacctattcccattggttgacgcggcggcggcaacagctccctcagccggcttcggcacaactaccttgacttcctcccaggccggatttcgcgcagcggcggcggcagcggcttcctcctaggccagatttggtgtggcggcgacggcggcttcctcctangccagatttggtgtggc

SEQ ID NO: 26803 - DNA, 543 bp, Sorghum bicolor
  Clone ID: 30978947
gtgggtccctttttcgcacgtgcgcgccgaaaccggacgccgtcacgccggtgccgtcgccgccaaaatccgccgcggtttcgccttggcgcggccgcccaccatttctgcgcggccaccccacagaaaagcttcgcccatgccgtcgctgccgacgccgacgccgacgcgtcgtcctcttcttctctctccacctcattcgaacccgccatggccggctccaagccccttccgctccgcctcgcggcgccgctggccctcgccctcctcctcgcgctcgccctcgtcgccaacttcctctgggcctcctcctctcgtcgagtctccccgctctcggcctcctcttccagaacggtgatgcggaagcgcgcaaaggcggtggggcacctgaacgcgacgtacgcagacctgccggcgccgcactgggactgggaggagatgcccgcagcgcccgtgccacgcctcgacggggcgtcggttcagattgggaatctcctctacgtcttcgccggatacggggacatcgaccatgtccattctcat

SEQ ID NO: 26804 - DNA, 583 bp, Sorghum bicolor
  Clone ID: 30978959
cctactggaatctgctgagccgccccggagggacgccccttgcaatcgtcgccgtcgtcgccgtccacctcctctcccggcgtggagcgggagagaacctgtccgcactcagagcctggttgtcattccgtgatattgctagagatgttgggtcatggtctagccaccgatgcctcaagaaccttgcaatgtccagctacttcaagggtatcaagtgcacccttggggcttgtttcttcgatgagtttcaacaggagatgcaaggaaaagaacaaaatcttcaccaatgtggatagatacacaaagtacagtacttctttctgttatgcaccaagaaatgccagaatcacaccactggcaactgcatcgtttggggatatggctgattcttcaactcctatctttcccagaatccatgtaaaagatccatatcagcgtctcggaatcagcagggaagcatcggaagaagaaatccgtgctgctaggaactatctgataagcaagtatgcaggccacaagccaagtgttgatgcaattgagtctgcccatgacaggattatcatgcagagtttctttgatagga

SEQ ID NO: 26805 - DNA, 581 bp, Sorghum bicolor
  Clone ID: 30978973
gaaagcctcaacatcaacggcaagataagtgagctgcccacttgggttagacagcttcatcgacttaccaagataaccctgtgccgtaccagcttgagaggagaagatgtacacaggctgggtgagcttgccaacttgcgctgcatcaggctcttgcatcagtcatatgccgaacagaagctcactttcagcacgagagaattcaggaaattggagctccttgtcatcgaggacttgggaatatctgacgtgaactttgctgagaatgcagctcccaatctcaagaagatggactggagtttcaccagaaaggacattactctgtctggaatcaaaaagttatccaacctaaaggaggttcatctcaatggccactgtgatgacaacaccctgagtaagattaaacaggacctcaatgagaattcaaacctcccaaaactttctgtcagatctatgagctagctaccttgctaggccaacgctgatgttgctactaccgctgctgccgccaccgctgcttcggctgcaggtactgcagttcaaccaatacctatatcctgacgctccgaaggagagactat

SEQ ID NO: 26806 - DNA, 506 bp, Sorghum bicolor
  Clone ID: 30978976
ttcttggcctatcctgggtttacatacgacttgagccagaagacggctatcttcttggtctgttttcctccctcctgggtctccatgtatgcagatgagtggaggggctatgtgcatctcgaggggccttatggcttgaagaattgctaatagtatctggattggctgggatagaggagtcggacaggacagtgacacatgattctttttctcattttatgttttcttcttctacttgtgggttttgaggtagtaagtctggttaggtacattcacgggggtaacataacctgctgttgttttttgttgttatatgtttaccaggccattttcttggatgcaggtatatggatgttatttgggcagattattggtttggtttgaattggtttggtttggttgttctggtggtactatggatgagttttcgactgcgactcgacctgtgcgtcgtcgcttggtactatttgtgttggcgaggcatacatatattaggctttcatttg

SEQ ID NO: 26807 - DNA, 558 bp, Sorghum bicolor
  Clone ID: 30978993
aaagaaggcgaccaaggaggaagtcatgaaaggcgaggactaaccgcagggagagttggaacttctgagcaaacagtagatgaagagaacttccaattggacagtgaagatgatgacgaacaccctttagttaggattcgttctaggcgattgcgaggcagaactacggagccagcagaaactgtacaaaggcttgacaaccccccctcaagtcctcaacctcatgttcaaattggtcatcagcatagtgggggttttccttcagaagagtggggtggtatttcttctgaagagcatgatgaagctcttatgcttgaggctgcaatgtttggtgggattcctgaaggagcaccatatccattttccttcccagcccgtggcaggtcgactcgctatccccaagtagcacgtccgccgtcaccatcattaacggcgcagcggttgttaagggagcagcaggatgatgagtatcttgctgctctccaagctgatcgagaaaaagagttgaaggctgcgcaggaggctgaactccgcagggtagaggaagctgcagcaaga

SEQ ID NO: 26808 - DNA, 451 bp, Sorghum bicolor
  Clone ID: 30979003
accgcctccgccaccgggaagggcagtggcggcgtccggagccgctccgcgcgcctgcaggaggcctcgtccgcgtccgcgtccgcgccgccgcgctcgaggacgttcttccggtccctctccgtgggcggacggcgcaagaacctgacgatgccccggccgctgtccgcctccccgccgccgccgccgccgctgccagacgcctcgacgtcaacgtcgtcggggtccaccacgtaaacggctccgtttcttctccagaacattatcttcttttattacagtcttcttaccttacttttactaaacaactctgtgcatagtattattatttgaatctttgctagtagtagtgcgtgcctactagctaggagtagtaatttgttaaaaaaaaagagtagtgcttaccgtggttaattgattcgggttttaaataccggttgttggtactaaa

SEQ ID NO: 26809 - DNA, 655 bp, Sorghum bicolor
  Clone ID: 30979006
ccatggcgcccctgacactggaccgtgaccgtgcaagctacctcctcaacatggcagctctggagctatgcatggtgaaaagcttttcaaaagcggcagtcgaagactctgctgtctgctcctacctcttgctcctggccaacttggcacataggcaggaggacgtgcacgagctacgggtgagtggtctcctgcagggaggaggaggcctcaccgacgaggaggcactccggttcttcactaatcttcggaatatgcgccgtggaagatcctacgaccgtgtcatggcacagatcgaggtttacaaggagagcaagtggaaggaggccaaggtctatgcgttctattacaaaaacaagaaaaccattgctgcgtttgtcaccggcatcggtgcacttgttgggatcatagggacactcttgtcaatcaagaaatctttatgatatatattagcaaatttgtccgtgcgtagtcaacatgtgcagcgaaatggaactgaaatgctatagtacaaacatccggcgtagtcaaggtgtggctgtggccacaactttaatttgattgtggctctgccctgagaccaagtgtgtatatgttgtcataacctatgtgtgcaatgtatgatgtcgcccatctgccacaactttaatttgat

SEQ ID NO: 26810 - DNA, 491 bp, Sorghum bicolor
  Clone ID: 30979007
acggaaattcctttgcctgcactttggaactctcaagtcctactttgaaacaatactagagcccgagctcaagaagtacatggccgacatactgtcagtgcaagctttgacaatgtccactgaaggagaaagggcatcttgccaaagagactttattttgcattggacacaaaaaggaattacttggcacggaggcagaggcagaggcagaggttgatgctcagatgggtggaaatcccctcaagattttttaagatatattttatcctgttcttgataatctcgactgctctttgctgatgggtggaaatcggttgatgacaacttctgatggtgactccaagataaactccaaggcaggagcccccaaagctctgtggtcactcaggtgtggaggttgtctgcagtttcaattaatactgtcaaaatgggtgttgtgctgcactttcaaataaagccaaattagtgttgaaatggaaactccctgccat

SEQ ID NO: 26811 - DNA, 636 bp, Sorghum bicolor
  Clone ID: 30979023
gaggaggaggatgaggagccctcagtgactgccgcagcagctgcaaagaagcagcagaagaagaaaaagaagaagggtgcgtttatgatggatggtgagaacgtcgatgagatccttgcggggatggaggaggatcctcagctcgcggatgagcctgagcgagaggatgtgaaagctcaggatcctgtggctgcccctgatgcggatgatgccgcggggaagaaatcaaagaagaagaaaaagaagggagggtttatgatggatgtggatggtgaggacatcgaccagatccttgcggggatagagggtcgcccacctcctgcagaggagcctgagcctgaggacaccaatgatgatggaactgtggctgctgctgcccctgtggaagatgctgaagggaagaaatcgaagaagaaaaagaagaaaagcggaagcacagcaaaggaagaagaggagttggagaaggttcttgctgagcttgatttagtccctcctgctgcagagggcaagccagcgcaggtaccacaatctgctgcattggccaaggaggacgttggagctgcagaggatggtaatgtggaggacaaagctgaggaaggaggagaggtggaatctgctgctccaagaagaagaaga

SEQ ID NO: 26812 - DNA, 675 bp, Sorghum bicolor
  Clone ID: 30979042
cctactggattcatcatctatcgagcagagcaggcgatcgatctagctagccctatagctcacgcaccattgtattatattaattatacagaaaactaagctgctaggacgatgatgatggggcggaggcgcgccggcatggcggtggcggtggcggtggcggttctgctggcgctgtcgtcgtcctgcggcgtggcgtcggcgagggggccgaccaggaccaggaaacccccggccaagaagacgctgccggcagggcagaagccaccggcaaaatccaagttcttcccgctcaccccgggcaggtttgggcacaagcgcaactacgaggcctcctgcgccgacgagggcggtccgtcctgctacgtcggctgcccttccgattgcccaaaatcctgcctcgtcttctgcgaatactgcctcgccttctgtgcttgtgacctccggccgggcacctcctgcggcgaccctcgcttcaccggcggcgacggcaacaccttctacttccacggcaacaaggaccaggatttctgcatcgtgtccgacgccgacctccacatcaacgcgcacttcatcggcaaccacaacccggccctcaaccgcgacttcacctgggtgcaggcgctgggcgtcaccttccgcggcggcggcgacgacaaccaccaccggttctac

SEQ ID NO: 26813 - DNA, 544 bp, Sorghum bicolor
  Clone ID: 30979072
tactggttgcttccagacatccattccatcgtcatcatttagtttgcagtcgctgtgtgttgctagctagttcgttcgcagtcgcagccaggtccaggtggtcgtagctagcaagatggatatgatcggcggcagtgcccagagcgccgtggactcgctcctcggccgcctctcgtcggtgttggtggaggaggcgcagctgctgcgcaacgtgcacggcgacatgcagttcatcaagcgcgagatggagagcatgaacggcttcctccaggacgcgaccgacgacggccacggcggcggcggcgtcagcaaccaggtccgggcgtggaggaggcaggtccacgagctcgccttcgactcccagagctgcgtcgaccgctacgtccacacgttcggcgcgagccaccccgccgcgggggccgggctgctcgcctccttcggcagggtgccggagctggtgcggacgctgcccacccgccaccgcatcgcgacggagatccgggagctcaaggaccgggctctcgaggtgggcgagcgccgccag

SEQ ID NO: 26814 - DNA, 646 bp, Sorghum bicolor
  Clone ID: 30979090
tactggcagtcggctattcggccagtccccaccaaatcctccatctatccaaccaatccctcgccgccaaatgccgccacgggctgcctagggttccggcggccgccgccccctcgccggcgcgatggggaacacctgcgtgggccccagcaccccctcggaccgccacagcttcttcaacaccgtctccctcgccgtgctctggcgccccccggccgccgccgccgccgccgcccgcgccgagccttccccgaccactgaacccagctcctccactccctccagggcacctgaccccgtcaccatctccgactccgagcacccgccacactccacctccacctccaccgcctcagtcccggccgcagcgccgcccaatcctaacggcaagcccaagcccaaggtgaagcgcgtgcagagcgcgggcctgctcgcgggctccgtgctgaggcgcgactccgagcggctcaaggacctgtacaccctgggcaagaagctcgggcaggggcagttcggcaccacctaccagtgcgtcgagaaggccacggggaagcacttcgcctgcaagtccatcgccaagcggaagctcgtcaacgaggaggacgttgaggacgtgcgccgcgagatccagatcatgcaccacctg

SEQ ID NO: 26815 - DNA, 490 bp, Sorghum bicolor
  Clone ID: 30979091
aaatcaaaatcctcctcgcgttttcttttcccttcccccaaaccgggtaccccgctccacccccaccaacccccgggccttcgcgagcggcggccggcgatggcggcgagcaacatcgggatgatggacggcgcctacttcgtcgggcgcaacgagatcctcgcgtggatcaacaccacgctgcagctcggcctctccaaggtggaggaggctgcgtcgggcgcggttgcgtgccaattgatggacgcggctcatcctggtgccgtgccgatgcataaggtgaacttcgacgccaagacggagtacgagatgatccagaactataaggtgctgcaggatgtgttcaacaaactcaagatcactaagcacattgaggtgaacaaacttatcaaagcaagaccccttgacaatctggagttcatgcaatggcttaaacgatactgtgattctgtgaatggtggcttcatgaccaactacaatgcttctgaga

SEQ ID NO: 26816 - DNA, 584 bp, Sorghum bicolor
  Clone ID: 30979093
gcttcgcgactcctctccggctctccgcaccgccccccacaaacctcctcgccgttgcatcgccgcggcggcccccccaggccgctgcgcctccagccatggcgcggccgccgcaggaggcgatcgacaccttcgtcagcatcacgggcgccgacgaggccgccgccatccgcgtgctcgagcaccagaatcaatcaaaatcctgtgcctgccacttctagttatgatgacatgatggagctggatgaaccacttgatcccatgttcaacagacctttgttccctagaactttgggcaacccttttgcacttttggatccaggttttgctgacttaactgctggtgatatatttggacgtggaccccgagttacacaacctagggacgtgaggcagatacctattgaagttaaggacagcaatactcaatcaggcagttctggtcagggtccaattattgaggatgttactggacgtgaatcttattatggtccagaggtccatgggactgttatagttgatgaagatgacgaagacttaccatcaacaccatctgctcatgatcctatgatcccaagcagcgc

SEQ ID NO: 26817 - DNA, 687 bp, Sorghum bicolor
  Clone ID: 30979096
tgttgcaccaggagaggggaggtttagctgagaggggttcatggagatggaggggaggggcctgtctgatttgttcaggaacaccagcgaggagatcttcctcaaggcagtgatggagaactcaatgggagtggcagcagcgccaagcatggagatgctggggttcaagaacatgtcgcaaggtctcagagaagatagcgaggagttgttcaacagctggcttatgaatggagagatcccagtatttggtgcagtgaacaatcgccctcgacagccatctaggttgtcatcagaagctgcaggccagccgaatcaacagcatgacattgctcaacaaagttttatcaccgacaacttggttcaacagaatttagcaatcccttcagtcgaatatccaaataaccacaaccagcaatcactcaaaaatgcagcagagaagggaatgcaagccagtgacctgcttctagcaaaagcctggttccacagcactcaaccaatgactagaagtcgttcgtcagagttaaggaggaggtatgctgcaatgcaaactaatttggcaccaataactataggaagcattgaagcaactaaccaattacaacaagattttacaaacacaacaaacagcacaccagtgagcaacacacctgttcatacaccaaagtttgtatctccttcaagttcatc

SEQ ID NO: 26818 - DNA, 471 bp, Sorghum bicolor
  unsure (1)..(471): unsure at all n locations
  Clone ID: 30979102
catcgtcgtcccagcaaagcacagggctctctncccggtcacccctctcgctcacgagtcacgagcatcccacctcagctagctccagcagctctctatcttcccggccagcgcttggacatgggttctccattggcctcctggccatgggcaagcctcggctcctacaagtacctgttgtacgggcctgtggtggcgcaggcgtggagggagacggggagcctcctgccgctggcgctggggtcgtcgtggtgcctgcacctgctgctcctcctggcgctccgctcgctcaccttccagctctggttctcctacggcaacatgctcttcttcacccgccgccgccgcgtcgtcaaggacggcgtcgacttccgccagatcgacgccgagtgggactgggataacatggtgatcctgcagacgctaatcgcggcggtggtggtcggcagcccggcgttcccgggcgtgtcg

SEQ ID NO: 26819 - DNA, 439 bp, Sorghum bicolor
  Clone ID: 30979103
gttgtcgccaagctcaccaggattttcctctccgagtcctccctccttcgcctctcaatcccccaccaccctcgcaaggatcgcctctcgccggcccggccgattccgccatggcttccggtaactgctacccccgagcgcccccaatccactcctcaccaccgctagtccccgcagctctcgctgctctctgttgtggtgctttgtttggtcgcgttacttggttgtccgtgtgattccttggcgcgctgcctgccagcttagatccgcacagggctctacgtttttagttctttttttacttgtttggggcatttgatttgtatatggataggttttattgccttattggtgcggcaggggagggaattgcaggggacaacgtttctgggccggggaattaatctgcgtgctgaatcagtaggagggatcgagggag

SEQ ID NO: 26820 - DNA, 477 bp, Sorghum bicolor
  Clone ID: 30979109
gatctcgcatttccccagcaaaacgagcaggggaattcagggcgacgacgcccagcgcgggattttcgctgttcctacagctcctgcctggtacgggcgcggcgcggcgcggcggcccagtcaccattcagtcgtggtattcaccaaggcgggtcgcggcctcgcggcgcgggtgccggggtgcgcgcgtgcggggcgcgagttgcgccacccccaccctccgcccccgccccaccttgtctcgccagccgggcgggcgaccagtgccagccgcgcacaaggtaggtagctagcttagctacttgtgaaattcgccgagcaagcgcgcgcggcgcgggggagcggtgccggccgccgacgcgacgggagacgcggcggcgaggcggattgatgggctcctcggcgggctccactccgacggtgcgggcaccgcggcagcagcagcagcagcagcagcagcgcggcgcgggcgaggca

SEQ ID NO: 26821 - DNA, 693 bp, Sorghum bicolor
  Clone ID: 30979112
tataattaaaggctgtgcttcttccgcctggttgtaacagactaacaggcttattgctgcatcaaattcagtgagcttaacatacggtgtgatcatatggtaatggaacctgctgcagcatggggaccttcttgcgagtttcagctagcaaactggaccgttgaagaaccagctgctgaagtttgggctccagctgttggcctccctctggagtatgcatccagcgacatatttggtacctgtccccaggcatatgtgcctgaatcgatcggagaaaagcaactggttgagtttgagtacaactactcttcagcctcacggcataacttgtcgcctgaggctatcgtcgttgatgggcagaatcggcatgaggttgtggatccgcagaaattggaaacaaggattgtcgtctccaacgacagctatgctacaaatgtgttcaatcaagtagagcacgcgttcaaggttgatataaacctgatggcagagaagatgcatagataccctgccggacttggagatactatcggtgaaagttataccgtgccaaggattgtggccatcggcccttaccaccaccaccgagaccatctcaagcaggcagagaaggtgaagcacatggctgccatatgctgcgtcaaggaatctggacacctattggaggagatgtatgctgcagtcgcctccatagcg

SEQ ID NO: 26822 - DNA, 515 bp, Sorghum bicolor
  Clone ID: 30979123
tcaaggagctcatcaagttcaagggcttccaggtgccgccggccgagctcgaggctctgctcatcgcccacccatccatcgccgacgcagccgtcgtcccgcaaaaggatgacgccgccggcgaggtccctgtcgccttcgtggtccgcgccgccgactccgacatcgcggaggatgccatcaaggagttcgtctccaagcaggtggtgttctacaagaggctacacaaggtgtacttcaccccctccatccccaagtcggcgtccgggaagatcctgaggagagagctacgcgccaagctcgcggcagccgcatccacctgaggagcctgagactcagtcagaccccgtgccttgttacgtgcaattcatttagtagtgtcatttagttccaattcagtgtgtgtacgaccgtgaaacatgaggtgccgacattgtaagatgtatcaacatgcattgtatgcgaacgcttcctcagttgaggaccacccatttatttatgtgatgatttttttc

SEQ ID NO: 26823 - DNA, 584 bp, Sorghum bicolor
  Clone ID: 30979124
tcatcgccgggaaggggccgtgggagaaccggtacatggacctgggacgcaacgccaaggtgctcggcgccgtgccgccggggaagctcaaggcgttctacaacgcgctggacgtgttcgtggacccgacgctgcggccgcaggggctggacctgacgctcatggaggcgatgcagtgcgggaagccggtggtggcgacgcggttcccgagcatcaagggcagcatcgtggtggacgacgagttcgggaacatgttcgcgcccaacgtggagtcgctgctggagagcctggaggccgtggtggcggagggcgcccggcgcgccgcgcgccgcggacgcgcgtgccgggagtacgccaagtccatgttcgcggcaaccaagatggcgctcgcgtacgagaggctcttcctctgcgtcaagaacgacaccttctgcgggtacccagccgagttcgactgagtaaatagtaattatctgctcactgtgcatgcgttttttctaataattatacacaagtgttgtacggtgttttttctcccgtttttgcgttcaactccctcccaggtatagaatatagatatttaa

SEQ ID NO: 26824 - DNA, 552 bp, Sorghum bicolor
  Clone ID: 30979135
gaaaatcctggttggtttggcaaaccctgaagacctgcagctgagcacggcagagaggaagctggtgcagacctacaatcagaagcctgtgctatctcgcccacaacacaagttctacaagggtccaaattactttgagatcgatctcgatgtccatcggttcagcttcatatcgcggaaagggctcgagaccttccgggagcggctcaagcatggtgttcttgatcttggtctaactattcaggcacaaaaggctgaggagttgccagagcatgtcttatgctgcatgaggctaaacaagatcgacttcgccgacaatgggcagataccgacgctgataactgcagctgatgagtaaaatctgtcatgttactgtagggctctaactttcaggaaaaaagcaaaagagagtgtggtttgtatagagcggcagataattgtaggaactaactcaagtttgtgagctaagaaatactgcacacagatttgtgtaaatacttgttgatcattgccccaaaagaggagaaaaaagatattgcagcaatcttcgtt

SEQ ID NO: 26825 - DNA, 165 bp, Sorghum bicolor
  Clone ID: 30979153
gcgtgatggcatctggcatatctgcggagcaagtggataggatctgcaattctgcatggagattagagtgctggagagcacacacaccagtatgattgtatgaaagctatggttcctagctacctatctttgctttttcttttcctgtgaacacataaatgatga

SEQ ID NO: 26826 - DNA, 756 bp, Sorghum bicolor
  Clone ID: 30979158
cagaagatgaacaaggtgttcatcgtgcaggagatgaagctcggggtggagatgaggggatacgacggcgaggtggtggcggcgggtgaggtggagacgaaggtgaagtgggtgatggagtccgagggtgggcgagcgctcagggagagggcggcggcggccaaagatgcggcagccaaggcgatgatccgggaagggggctcgtctcatgctgacttcatcagatttctccagggcggcgggcgctttcgtgacgcactgcgggtggaattcgacgctggagggcatcacggcagggctgccgctcctgtgctggcccatgtacgcggagcagaagatgaacaaggtgttcatcgtgcaggagatgaagctcggggtggagatgaggggatacgacggcgaggtggtggcggcgggtgaggtggagacgaagttgaagtgggtgatggagtccgagggtgggcgagcgctcagggagagggcggcggcggccaaagatgcggcagccaaggcgatgatccgggaagactcttgataacatttcgtcgcgttcgtgaaggggcgccggcatgctctgctgtcttcttgatcaagtgttgtggaatggagtagcggtacgatgtattgtatggatagatgactgtctcttggtattctgtattcgtgttgccaaccgtggacattctagtctgtaatttttggggttctactgtatttccctacaggctatgtgttgtgattggataaagcctacta

SEQ ID NO: 26827 - DNA, 605 bp, Sorghum bicolor
  Clone ID: 30979174
ggatcattagctgccataccatttggtacgatggtggttgttttcatcctgtgggctttcatctctttccctcttgcccttttgggaactgttgttggtagaaactggagtggcgccccaaacaatccctgtcgggtaaagactattcctcgacctattcctgagaagaaatggtacctcacaccctcagtcattgcgcttatgggaggatctacaggaacataaagtgtgactaagtgaagataatatcgccccattttgggtcagtgcagagaaactgtatggcagagccttatttgattgggcgatcactgattctacaaccaagaagccagggcgttgtgtggaatgtgatcatcgtttggcgctgagctgaaagccatgtatttcaattcttgtcatttttgtttctctcctatctcttctgggcttgggcaggcaacaaattttcatgttcaattagttatatacagtagtaattgtagttgttgagtagtaggtctgtagcatataccacaattgttatccttgaacccagtgatacctcagattgatgggtataaactgtaacatttacattacttgatgtttgacgatgaacacag

SEQ ID NO: 26828 - DNA, 380 bp, Sorghum bicolor
  Clone ID: 30979212
gggggacgcagtcgtacgcaacagcccgcagccactcaccgcggccgcgcacggcacagttacgcacgcaggcgcccaatggctgcgtcactccgctcgccgcctccgccccccgccgccttccgccgctcccgcgtcgtcgtccgcgcctcctcctcctcctcctcctcgtcatcatccgccgtctcgtcgtcatcgtccgcccccaaggcgcggttcgtcgcccgccgctccgagtccgtccccgtccagcagctggcccgcccgctcgcggagtacatgagcttgccggccagccagtactcggtgctggacgccgagcgcatcgagcgcgtcgacgactccaccttccggtgctatgtgtaccgcttccgcttctt

SEQ ID NO: 26829 - DNA, 597 bp, Sorghum bicolor
  unsure (1)..(597): unsure at all n locations
  Clone ID: 30979223
gccgtgtaagctagctagctaaagtcccgtgcgctggtacgcaatttnggcagaggaaattgatcacggtggctgcaccnggaggcgcagccgcaggtggcggcgcccgcggcgccggaggagactgtgttccggtcgaagctgccggacatcgacatcgccagccacctgcccctccacgagtactgcttcgcgagggcggcggaggtcgcggacgcgccgtgcctcatcgcggcggccacggggaggacctacacgtacgccgagacccggctcctgtgccgcaaggccgcggcgtcgctgcacgggctcggcgtcggccacggcgaccgcgtcatgatcctgctccagaactccgtcgagttcgtgctcaccttcctcggcgcgtcgttcctcggcgccgtcaccaccgccgccaacccgttctgcacgccgctggagatccacaagcagttcagggcctccggcgccaagctcatcgtcacccagtccgcctacgtcgacaagctccggcacgaggccttcccgaggatcggcggcgaggacaaggacaatgccctcaccgtcctcaccatcgacgacgtggncgacaccccg

SEQ ID NO: 26830 - DNA, 509 bp, Sorghum bicolor
  Clone ID: 30979232
ctgtcgctcccagcctcgagtgctcgctcactccagtagtggcggcgagatgcggagacagatccctcccgtctcctgcctcgtactcctcgcggcggctctcgccgcggcgtctgcagcgtcgccgacgccggcggccgtcgcggtcaacgtcacgggcgtgctgtcggcgttcccggacctcagcgacttcacgcgcctgctggcgtccagccccgtgctggcggagctcgcggggcggtcgtcgctgacgctgctggccgtgccgaacggcaacctcccgcagtcgccgtcggcgttcgcggccgcgtcgggcgccgacctcgccgacgtcctccgctaccacgtcctcctcgagtacctcgcccccgccgacctccgccgccttcccgcctccgggaagctcgtgaccacgctgttccagaccacgggccgcgcccccgcggacctgggcgccatcaacgtcaccgccgcgggcgcctccctcgccgtcgtccgctcgccagcac

SEQ ID NO: 26831 - DNA, 467 bp, Sorghum bicolor
  Clone ID: 30979236
actcgaatgttgctgcaactaacagtggtacctgcaatgatgaggagttctgcagtagcacactgaaggaacttcaggctgcaatgtcgccgcggccgtcgttcccggcgtcgattccgagcaacaaggtccagccgatgccgatcgttggtgtcagcccgcaccatcagcagcagaagaagaaaacagccgtggtcaggctctcgttcaggaggaggtcatatgagggtgacgagatgaccgaaatgagtggttctgcaaattacttgtaccgcccaagggcaggtttcacggtggcgtgttcaaccggcgagaaactgtcagaaggttgctggtcggttcttgagccatcgacgttcagagtccgaggggagagcttcttcaaggacaagaggaagtacccagctccagactgctccccttacactcctattggagcggacatggtcgcctacacgaggaagatt

SEQ ID NO: 26832 - DNA, 489 bp, Sorghum bicolor
  unsure (1)..(489): unsure at all n locations
  Clone ID: 30979260
agccgtgcagctagcaatgaagaagaaaactgtggttctctacccgggcctcggcgccggccacctgatgcccatgatcgagctggccaaggtcttcgtccagcacggcgtcgccgtcaccgtggcgctcgtgaagccgcccctcgacctcgaggcctcgacttctccgcggggtcgccgcgccgcgtcctccaacccgtccatctccttcgacgcttgcgcggcgccgcctgcgaccacctcttactctggtcggctccggcgatggtcgtcgcagaaagtactacgtcctcgagatggtggactgcctcaggcatgaacgctccgctccgcngattcctccgggtgctgcccgccgtcgacgcgctcgtcatcgacatgttctgccccgacgcgctcgacgtcgcggccgactcaggcgcccgtctactactcctacgcctcgtgcgccggggacctcgccgtcttcctccacctcggcttcaccaa

SEQ ID NO: 26833 - DNA, 509 bp, Sorghum bicolor
  unsure (1)..(509): unsure at all n locations
  Clone ID: 30979264
ttcatcccgatccacnngccgacgcacgcactccaagaatctatctatctatctatccttctcccaatgcatgtagtatataaaccatttccttgttgctatctaatctaccagcagtcagcagcaacccggcgccctgtgtcccctgatgctgaatccaacaaataaccatccatccatctatcggccaatgcaaatgcccttctgttgggacaagcggagcccggctcatgcgccggcggacaaccacgtcgccatcaatggcaccgtcgtcgtctcctgccacttgggcctctcgtcgccggggaagaccaccacgctccggctcttcagcaccacgcagatggatcccaacacggggaaggggaagctgagcccggaggcgccgctgaggagcggcaagaagaccaaggcgaagcagggcgccgtgaagaccaccaccatgacgtaccaggtcaccttcttcgtggacgccgacttcggcacgccgggcgccgtcgtcgtcaaga

SEQ ID NO: 26834 - DNA, 262 bp, Sorghum bicolor
  Clone ID: 30979279
aagccaacctacattcgcttcctcacaggcttgaaagcctactcaagaattttttctagacttgcttttggtgctcgaagaaacaagtatgttactgaggattagttgtccgtgctgccagcttccaactgaagagattaggaccaattcttttcattaagcgtcacttacttttctcagaagatagaatgtattacaaatgtcatctcagaagagaatccagtgatgtactcttctgtacagtagtagcaatttgattacc

SEQ ID NO: 26835 - DNA, 491 bp, Sorghum bicolor
  Clone ID: 30979281
tttgggttgggttttgaaaggatgattctttttgcacccggaatggagaacatcagagatgttatccccttcccaaggtccccagggagggctgatctgtgatttttggaggcctgtgattaaccagatgctagttgaatcaacatgctactaatgattttgagatgttttccccgttcagttcctaatttgcccattttaggtatattggagtccaaggtatggttgtcaaatgtcaggtaattctgtattttatttgcatctgcaggatgcgactgatcaactttttttttttgtctttgctatagttgtgttcaccaggcaatgtttttccaaaagagaaaaaaaaccaagtcaaaagttggactgtttaattaattgccagctgtccctgtaacggacgtgagtttgggttatttagggtggagttaatatttttgtccggattatattatgaagtactgtgctgccgatttgaagctcaaatattt

SEQ ID NO: 26836 - DNA, 621 bp, Sorghum bicolor
  Clone ID: 30979284
ggcctggaggttgggctatcatccgtgataaactcgggatccttgacccattggagacaatcttgaaatcactgcattgggaaattgtcatgaccttcagaaaggacaaggaaggtatcatgtctgtaaagaaaacaacatggcgtccataagctgacctgagaatcacaaggctccagcataccaatttttgcactatactgctgttgatttccccaggttgtgtgataccaacattttgtgaatctgtggtagatgtacaatatttgttcattcgttactcatcactgctcaccacatctctgtcgggtagtttaagcccagttcgatggttggttgtggttggcgttacattgatcaattcttttgaagcagcatcaaagacgaccagctctagtttcagagaaaaagactcttcgattccacaaacagggttgtatgagatacaagattgcttcttgttgtttgcaaatgtaacaatatatgtaaagattgccactgaattaacttcttggtggtgttgtaagttgcaacaatctgtaaagattcaacacatgaactttctcattgtaaattgtgagcaaacagcaaaagagtttccaatgtgtattttgctctcat

SEQ ID NO: 26837 - DNA, 630 bp, Sorghum bicolor
  Clone ID: 30979293
tcaaggagcttcagcgaaggatacaagagctggagtccagtagggaacttacaacgcacccatccgaaacgacaagatcaataaagaaaactcgtggcaatgggagtgtcacgaagaaaccctatgcgggctccaagaggaagagcccagatgacctggagaaaaagcatgagcacccctggatcctccccaaagacggcaccagcaacatcaccgtcactgtcgggaacacggacgtcctgctagaggtgcaatgccggtgggaggagctcctgatgacacgggtgtttgacgccatcaagagtctccatttggatgttctgtcggttcaagattcggcaccagatggctttatagggctcaagatacgagctcagtttgttggctccggtgctatcatgccttggatgatcagcgaggctcttcgcaaagctatagggaagcgatgagggggcagtagtttgaatatcgatctacgtggaaagcttcatgaatcgaagcaaatgtgtattccttgtggaagcctattatatttgtgtaaaatctagtgtactttgtgcgaacacgttgtggatatatattcatgtgtaagaatgatgagtgattatcaagagatgaccgagctttggt

SEQ ID NO: 26838 - DNA, 350 bp, Sorghum bicolor
  Clone ID: 30979311
ctttgagacattttggctgctctgtgctttatttgttggctaagcagaagaggaaggcaactggtggataacgtcggagtccggatggggggtatggatttggatagttttggccgggtagggatttgaaagccaaaggtcctgggatggtagtttttttgcaaaaaggctaaaggagaaattgtatactatatatatatagttgatttgaggaattaattgtctgtttcggatccatgaatccaatgatcgatcgaatgatcgctgctgcagatcattcaactaactgtcggagtcccttttgatctgtaactgcaatgcaactaattaatctgatctgtttgccgggt

SEQ ID NO: 26839 - DNA, 518 bp, Sorghum bicolor
  Clone ID: 30979316
gcggcgggggccaaccggagcctgacgtgggtcgactggtcccacggcggcccgcacccggcgaggttcacgaggatggaggtcaccgtcgacttcctccggtggctcaggggcggcgccggcagcacgtgcacgtacaacggcaggaccaccaccgtctgcttccttttcgccaggaagttcctgcccaactcgctcaccaggttcttgagattcgcgcccaaggtcatgggttttggctaaaccagcgaccatcgacgacgacgatcgacaacgggagggggcggctggcattgaaattgaaccgaggcctacaattttttaaggatgggatgggaacgtgattgttttgtgaggaacctcaaatacattcattcattcattcatgtgcagatagctgcgtgtgcaaattttttttcttttgaattctctttttgtaaagataaagaaaagtgtacagaggaccggaaagagtgaaaacaaagaaaagctcatcgttgctgtcatgcaggatttct

SEQ ID NO: 26840 - DNA, 668 bp, Sorghum bicolor
  Clone ID: 30979320
gcagtgcagatttggcagtggatgaacatttacaacgcaccatgttttccagtaaagaagcgacagcctttctttctcaaaggtggaaagaagcaatagctgcagatcatgtgaaacttgttttgtgtcctgaaaagtgaaagaatggtgaactaaagaaattctgttgagggcaacagcatggaagcacaggctgagttgtcggatcccacagccatacaacataggtagtgcttacctagcctgcagggtgctatgaaagtttggaggtcaagtttgtgttgcggcatgagtgattgtaaaatggcgggtgcattttgcagctgacttgatattgaagcagagggttccagttttagaaggggatagcttgtgtggtgggatctgtttttggtaagacaaggatgtgatttgaacatggtttggtcgcataagttcctaatcttttgtactcattagagtctgctaagcatgaaatgcatgtgtgctaaacgtgtagtgctcgcggttttcatattgtcccaattctttctgctggcagttcacgtattcacattcattttgtatcgttcgtgctgtataatccctattattcgctatatattttagacgttagaagaaattaagtacttatctatattgaaattattgatgatgacttgatgagc

SEQ ID NO: 26841 - DNA, 450 bp, Sorghum bicolor
  Clone ID: 30979330
caccaccaccaccaccatgatgatgatgatggtggcaatggcggtagtaacaacagcatgctgaaggaggcaggcatcgtagatttctacagcccagcggcgctaatcggctacaaccaggcagcggctcctaccaacagggcggcggcggctgcttctgctcacctgatgcctaactttgaggtgcacactacagcggggacggctggctttggtccctgaccaagatgtgtgcaagtggaactactcgactgatataggttagaggccggggagagtgatgcaggcagataatgcatggcaccggagtttactgaaagctggacaataagaggatcggaatatatatggctggacgtacagatgctgaagtgtaggaatcgatacgactatacattgttcattaattgttaccacatatacgtaacttgacgctatcaattttttgtt

SEQ ID NO: 26842 - DNA, 481 bp, Sorghum bicolor
  Clone ID: 30979332
ccccagatgatgcaacagttggcttggatgtagagaacaagaggaaggtcagctagacagggtgatcaggattggggagctcacctggtgatgatcacatagctctagttctgctacaagtccaatgagttggtgagctaggcttcctgacaccagcgtgtggccaggacgagtggccggatgtgaagaagtggccggcgcgatggcttcctggcaccgacggcactggcggcaagatgctctgtttccgccggcggcaagatgctctgtttccgccagagacaaatttgaaatactcccgcaagtactgtagagagagagagagagagaggttgcggtcgtgtactttatttcaaattgtcttggtgtgccagctgtcacccgcaagttgcagacgtacttcacttttctttttgcggaggggtagaagtgacattttgtttgataccttaatctctgctaaaaatcccagaacgccttt

SEQ ID NO: 26843 - DNA, 664 bp, Sorghum bicolor
  Clone ID: 30979335
gcgtgcatgggcgactggagacataggcatgcagtagagacaagggttcaataagaggttggcatcggtggtggtcgccctgacatggaagtggtgtttgatctctttcctagtgttggtttctggtggtgttcttcatcttctcgccgtcgccgtcgccgtcgcgagttcatgtgttttgctgaccatcgactttaatgggggctctaacacaccagagagtacaaaaattcaggggtcatgatgatacatagcttgatcgacatctcttggtcgtctctctcatttctgatctttcacttgatctgccatggtagctgcttcactgtagtaccgagggcttgggaagcttgtttttaggccggcttcaagttagacggtaaacatcagtgtgttcacgccacacactgacacaaggtttagtgagtgtgtttggttggtcacaacaacgggtgcagtgtgtaaaactttgaagctactggtgtaaagttagtagatcttaatttcaaggggacttgcaagtttgtgtattcatccaaattactagatgagatattcattttgtttttgacttgctactttaattatgatggagtaggcccatatataacagtaccaagtactttttatgagaacaaaggtttttttgagcgcatgtaatgtt

SEQ ID NO: 26844 - DNA, 553 bp, Sorghum bicolor
  Clone ID: 30979338
ggaaccccaacggttactggaaggcgccatacgggttgatctaccggaacatggcaatccttggtgtggagggtttctctgtcttgcccaagcactgccttgcgctctccgctgggttcttcgtgttcgtgtttgtcttcagtgtcgcccgggacgtcctaccgcggaagtacgcaaggaaggaggctatgttcatggtgcctgcggttgcgtctggtttgatctgtggagatggcatatggaccttcccgtcttccgtgctcgctttggccaagatcaagccaccgatctgcatgaagttcacgcctggaagctagaaacattatgggcagttcatgaagttgtagaatgtgagatacagtgaaggcatgaactgtgattattggtagtggacacaataaactgaagccatgtcccctgtattatcattgttgtttgtgtggggttctccaggagctgatcagcctgctcggctgtactcattcgtctgcagttgtttgctgtttatgtttgtgttttagaaaaaaaagagatgctacagtacattcaaccg

SEQ ID NO: 26845 - DNA, 724 bp, Sorghum bicolor
  Clone ID: 30979343
gcaacgactagcacagcaaacacgcccccctcgctcgcggcacggcgactgcaatccaccgcggctcgctcgctgccttcgccggtgatctggcctcttcgagtccgggaatcagatatccccagcccctcccttcccgccgaatcggcgcgggagaggatggcgtcccggcggggcagcagcagttgcgcgctctgcgagggatccaacctgccgtcctgttgcgccgtgtgcgtcaacgcgaggctgctcgagtaccacacgaggctgcgcatgatgaggagtctccgcgactccctccaggcccgaatcgccacacgcctcgaagccaagaacaaaacagatgagcagaggatctggagagccagcaaagcacaggatattaaggagttgagggatcggctcactgaattgaagagaaaaactgccatagacaagaccaaggttgagcaggcatcgagtgatctcaaggcaaaaactgcgtcattgaatttggcttttgtcatgctgaaaaagaggcgagctgatgcagtggccatgcacaccaatgccatgaaaattgcacagatgaatctcatggcaaccacctcagattgtatgaaaatgcaatcaaaatctgtaaagcaactttgcagattgtttccaatgcgacgagttattaaagagggagaaaagaaaacgagtacagtggtccatatgattcgatatgtggggttcgtcttcc

SEQ ID NO: 26846 - DNA, 695 bp, Sorghum bicolor
  unsure (1)..(695): unsure at all n locations
  Clone ID: 30979351
aggctttcgatcgatctccctctctctctctatattccactctactcgtcaggccttaaacgaggagagactagatagagagggcgagatcgatcgtcttcgtcatcgtcgacggccatgacatggtgcaacagcttcaacgacgtgcgtgccgtggagaacaacctggccaccgccgcggccgtggccgccgccaagaaacagcagcaggcctcctcccacgtcaacctcatcaggacctgcccctcctgcggccaccgcgcgcagtatgaacaggtgcaggcggcggcgacgatccaggacctgccgggtctgccggccggcgtgaagttcgatccgacggaccaggagctgctggagcacctggaagggaaggcgaggccggacgcccggaagctgcacccgctcatcgacgagttcatccccaccatcgagggcgagaacggcatctgctacacgcatccggagaggcttcctggtgtcggcaaggacggcctcatccggcacttcttccaccgcccgtccaaggcttacacgaccgggacgcggaagcggcggaaggtccacaccgacgagcagggcggcgagacgcggtggcacaagacgggcaagacccgtcccgtgttcaccaacggcaaactcaagggctacaagaagatcctggtgctctacaccaactacnggaagcagcggaa

SEQ ID NO: 26847 - DNA, 594 bp, Sorghum bicolor
  Clone ID: 30979353
accctagatccagatcgagcctcccaaaatcaccggcatcttgctccgtgcctccgccttcccccaaaatcatcggcgtctttgagcccctctaatctagcagcgcttcgcttaccttcaaaactgaatccacaaatgcctcaagtgctagcagctcgggagctggatttggggcggcgcaagaaggcagcggcggcacaaagagggcagcggtgacggcgcccatctagatttagtgtacgtacctcctccaccccaaatcttgattaggaatcttgtatggtttgataaaaacttcatcttttcactgatttggttggttaatatgcactgcgtcgggggaggctgtccacgccgtcggcccgggcggcgcatggttcggcgaggtggtgcacggcaccttcagcttctgccccgtcatcaacagcgacacgacgttcaacgagtccctgtggcgtgccatcggcggtgttctccactagtgtgccgccaccgcccaataagcgttgttgctgcaacgctggcggcagctgtgccggcgaacgtcatctgttcacgacactatggattggacgagcacagccatcagcacta

SEQ ID NO: 26848 - DNA, 762 bp, Sorghum bicolor
  unsure (1)..(762): unsure at all n locations
  Clone ID: 30979355
aaaggagagagggagaggcaaggcaacacgagtgtgacgagagcgatcatctcatcatcccccaccccctccccaccctcctcctacctcgagacgctgagatcgagatcgatcacgcaccggaggagcactcacttgcagatccttcgcctcgccttcagggattcatgcgaaatgccacctgaatatggaatgcctactagaactgctgctgatgctgttgtaaataggaggcctcgtcgcctgtttgggagatcatcagagaggaagaacccactcaaccttcagtttgagcgtcaagtagctcgtctcgaggcacggcagcaacaacagaggtgtattattgtgacagttattcccttcaatttctgttacgacttcaaatcaccatcacttaccgagagtgcaagtgatgatccttcatctcaacctacatctccagaagagagccctgagacttcatccttgtcaccatcctccccatcgattctgttcctgcaccttaatgctcaagatggatctcacagaagatggctggataattcatcaaggctactggaagataagcccacaacatccaatagcatgtctgattcagatttcttagtcaacagctttaccaagccaagtgataatgcaagacattcatcaagaaggaagagcaaaaagaaaagcaagaagcacaggcnacgctgtaggaagccgactgatggatctgaagctaaattcagagagagcaatggcgctgtccctgcagttgat

SEQ ID NO: 26849 - DNA, 636 bp, Sorghum bicolor
  Clone ID: 30979360
aaaccttgtgatgcagctcaccgccttggggttgcgcttgtaagcatcggcctctacgcttctcgtgaggcaggcgggatcgaggccgccatggaccgcgcgcggagcggtgccgctgccgcggacgatgaagagatcgagaagcaccagccggtgcctgaggacatggagtctgacccggcggcggcgcgcgagaaagagcaggtgccgccgtggcgggagcaggtgacgctgcgcggcatggtggcggcgctgctgatcggcttcatgtacaccgtcatcgtcttgaagatggttctcagcacggggccgttgcccacgctgaacgtctcggcggcgctgatggcgttcctcgcgctccgcgggtggacgcgcgtgctggagcgcctcggcgtcgcgcaccgccccttcacgcggcaggagaactgcgtcgtcgagacctgcgccgtcgcgtgctacaccatcgccttcggcggtgggttcggctccacgttgctgggcctggacaagaagacgtacgagctggccggggcgtcgccggccaacgtgccagggagctacaaggaccctggattcggctggatggctggattcgtcgcggcgatcagcttcgccggcctcctaagcttgattcct

SEQ ID NO: 26850 - DNA, 674 bp, Sorghum bicolor
  Clone ID: 30979378
atggctcgttctgctgtgcagtctcactcccaaccaactgccgctgccacgctctgctgcttctcttctcccagcctccacggctccgcctccagagtccacgccaaccactagcaccgccggcggcggcggcgggcacgctcaccggaagccccgccccgtcccgcaccgccaactgccttccacaatcgcaccgccgcagctggaattggaagacgagcctagtgaggatgacggcgaggaggatgatcccgaggcggcaaagaggaaggctccaagtaagaagaggaagctcccgcctttgttcagcccgggtgcgcattaccactggaagctttgtggcgccaagagcggctaccactatattccttgtgtggatttcgatggggatgggagccagaggcaccatgagcgcagctgcccaaggtctcctgttacgtgtttggtgtcactgcccaaggagtataaacagcctgctgcatggcccgagaggaaggacaaggtttggtatgggaatgttgggcatcctaggttgtcaaattatgttaagggacacaactggctgaaccacagcggcgagtacttgatgttcccgccagacgaatgggagttcaaaggtagcgcaagacattatgttgaatcaattgatgagatggctcctgacattgactggg

SEQ ID NO: 26851 - DNA, 614 bp, Sorghum bicolor
  Clone ID: 30979385
agcaccaagccagccacgagccaccatggctccaccaccacctctgctcccgcttctcctcatcctcctcgtcaccgttcctctcttccccaccgccgcgccgacggccacgaccctgccgctgtaccgccacctcccgcacgtggccgaggccgaggccgaggacgcgcaccaccacccgctgtcccgcctggccgccgcgtcgctggcccgcgcgtcgcacctcaagcgccggggacgcgccagccaccacagccaaaaaggatcatcatcaggcggccacaagtcaatcccagccaccgccgcactgtacccgcactcctacggcggctacgccttcacggcgtcgctcggcacgccgccgcagccgctccccgtgctgctcgacaccggcagccagctcacctgggtgccctgcacctccaactacgactgccgcaactgctcctccccgttcgacgccgccgtgccggtcttccaccccaagaactcctcctcctcccgcctcgtcggctgccgcaacccttcctgcctgtgggtccactccgccgagcacctcgccaagtgccgcgccccctgctcccgcggggccaactgcacccccgccagcaacg

SEQ ID NO: 26852 - DNA, 671 bp, Sorghum bicolor
  Clone ID: 30979387
acagacccattttcgattccaaggctcgcggtatatctgcaggcatatacggcactttcgtcttcctcccttccgcctcaacagctagagcctacagtatcaggaatagcagtaaggcgcgcgatggcaccatcagcttccccggttcaggaaggactgcagcaggccgctgagaggcagttgatgaggaaccagctcgctgcagccgcgaggagcatcaactggacctatgccttcttctggtccatttcaagcactcaaccaggtcgcagggtgctgacgtggacagacggattctacaacggcgaggtgaagacgagaaagatctccagctccgtggagcttacagccgaccagctcgtcatgcaaagaagcgagcagctccgggagctgtacgaggccctcctgtccggcgagtgcgaccgccgcccggcgccggtgcggccggtcagctcgctgtcgccggaagacctcggggacaccgagtggtactacgtggtctgcatgacctacactttccggcctggccaagggttgccgggcaggagttttgcaagcaacgagtatgtctggctgtgcaacgcgcacctcgccgccagcaaagccttcccccgcgcactcctggccaagagcgcgtccattcagtcaatcgtctgcatcccgcttatggg

SEQ ID NO: 26853 - DNA, 657 bp, Sorghum bicolor
  Clone ID: 30979401
ctgccagccagacgcgccgtgccgccgccccccgcctccgtctctgccagccgccgcgatggaggcgctccacgaggagctgcccttcgacctcgacttccacccgtcttcccctctcgtcgtcacctccctcatcaccggcgagctctgcctgttccgctacgctccggagtcgcagccagagaggttattttcggtaaaagctcacaaggaatcatgcagagctgttcgttttgtggactcaggaaaagattttttggaggaagaggaactatcacgttcttagaccttgctgaccaacagccagtgtggagaagggctgacttaaaatcagcaagtgtggagaagctgtatggatgcttcgactaatattttgtgccaaacgaaggaagtaaattgctggatcattaagccaccaatggaggacagggtggaggtggatgcgtgggccaggaggaaatgatgacatggagggctgtgggttcagaaaaaatgctagtgggcttttgctttataagatgattttgtcggggtcagctgattgctcagtccttgcctcagatgtagaatcaggcaaggccattgcccgcttggaggatgcgcatgggaatgccataaaccgccttgtctgtcttactgagactacgattgccacag

SEQ ID NO: 26854 - DNA, 584 bp, Sorghum bicolor
  Clone ID: 30979411
aatttggccgtgtccacgtccgtccgatgctcactcatctccgtcccagtcaacgccaccgtcagtcagtcgaggatgccgtcgccggcggccgtgctcgtcagcaacggcgccatctccccacacgctcccccatccgccgccgccttcctcgactccacgccgggcgcctacaccaccgcccgcggcaccctgcactggtggccacgccatctccgccgcctcgccgaatccgccacgctcctcgcccgttcccaccccgacctgctcggcctccccgttccccgatcgcgcgccctcgacctcgacttccactccatccagtctctcgtcaacccctccgtacaggtagccatccacgagatgcgcgctcggctgcccacgaccaaggacgacgacgatttggcgctcacggccctggtcagaggagcaggagcaggagccgattccgtttctgcttctggggacggcctcgacgtcttcgtccatgtggggacgtattccccgccgatcttcggagagtcgggggccaggcttgctgttgccggcaggggaagggacgccgccgctgccaagtacgcgtc

SEQ ID NO: 26855 - DNA, 579 bp, Sorghum bicolor
  Clone ID: 30979437
aaagatacttctttattattcttagctggaaagggagatggtaatattagatattatgaagttgtagatgaagctccttacattcactatatttctgaattcaaatctaatgtacctcaacgtggtctctgcatgttaccaaagagagctgttaatgtatctgaatgtgaagttgtaagattactcaagttgtcaaacaaattgaacgaaccaatttcattccaagtaccaagaaagtctgacatcttccaaaacgatttgttccctgataccttctctggtgaacctgctttgactgctgaacaatggttaggtggccaaaatgctgaacaaaagactgcttctttggaaggtggttttgtcaagaaacaaaatagttccttcaaccctgacaagcaagttgttgaagaagctcctctctctgaaaaggaactcaaggaagaagttgaaaaattgagaaagagagttgcttacctcgaagctgaagtcattaagaaggacgccaagattaaggaacttgaaactaagtaaagacttcttttgtattaaatacacttttaaaaaacccctttgtagtag

SEQ ID NO: 26856 - DNA, 152 bp, Sorghum bicolor
  Clone ID: 30979439
ttttttttgacagacactaccattgttggagtgtcagaaatcaatagcaattcaggaaattattttgctccagaatacatgtatgggtgtcttaagacctgttgacatggttgtgatttttcgacacatacatcacctttttgaagtcaaga

SEQ ID NO: 26857 - DNA, 676 bp, Sorghum bicolor
  Clone ID: 30979440
gattacttcatccatgaagaattcatgacctcaacgtgggacattattgctgaaagactgggtttcatgctggtgtttggtgatctagttttcatccctttcaccttcactattcagggctggtggcttttgaggaacaaagtagagctgtcccttttggctggtctagctaacttatgcatcttccttatcggctacctagtgttccgaggagctaacaagcaaaaacatgtgttcaagaaggaccccaaagctcctatatggggaagacctcccaaagttgttgggggaaagctactcgcatctggttactggggcatcgcaaggcactgcaattatctaggagatctactgctagcgctttcatttagcttgccctgtggagtcagttccgtgatcccatacttctaccccacgtacctgctcattctactgatatggagggaaaggcgcgacgaggcgaggtgctcgcagaagtacagggagatctgggcagagtactgcaagctcgtgccctggaggatcctgccttatgtgtactgaagagaacggtagaagcaagggcagcagatggtcctaggctagcaaacccttatttatttatttgcccttgccgagggttggtgaatgttgatgtagtactttttttttgaacttatgttgatttagtacttgt

SEQ ID NO: 26858 - DNA, 572 bp, Sorghum bicolor
  Clone ID: 30979446
acttcgggcaccagatggaggtggtcaccaacgggcgcgtgcgcgccggcgagcaccgcgcggtgaccaacgcgcgcgctccccgcacgtcggtcgccgcgttcgtcatgcccgccatgggctgcgtcgtgtcgccggcgcccgagatggtggcggagggagaggcgcccttgctcaggccctacacgtaccaggagttcgtcggcgtgtacaccgcggccaacggcgacagagacgccgtcctggcgcggcttcagaacaacaatggctgactcactgactgaccgactgctcgtcgccgccttctttcctttttttccccctctcgaaaaacaatcagcaataagtgtgccggtggtgtcaactgtaagctgtcactatctttttcttttagagagaaaaactgtcattatctatgtcgcgttagattgatgcggtgcaacgcaacgcaacgttgttccgacgtgtcgccatgtcgcgattggacatggacctgaacgtcctgccgctgctgccttttcatttggcagaaaaacatatctgaataattgatatattcaacttataagctc

SEQ ID NO: 26859 - DNA, 681 bp, Sorghum bicolor
  Clone ID: 30979462
tcatcaggaggtgaagctcttacgtttaatagtttgaagactcttccagtggctaccaaggagcagcaactgcataccggggtgcaagatagcaaactgttagatgccaatttagtagaagaggctgcaaaatttctaaagggactgcttggacttacaatatttggatttgatgtcgttgttcaagaaggcaccggagaccatgtcatagtggacctaaactacctcccatctttcaaagaagttcccgactcagaggcggtgcctgcattctgggatgcagtcaggcaggcatacgaatcgcggcgagggaacgcccagtgttaagctcaacgcttccccaagaagtgaatctaccagaaaagcctagaagaggttgcttgtcatgtagaggagagcttcacttgaggcaaagtgatgttcactggctgtaatggttctggagcaaacacgaagtaatgttcagctctagctgcgggaataagtgaaatagggagcgtaatactaataattaacactgtgacgcaccgccttgttgaactgttgatctcaccgccgtggtgtgctctatcacggtgtcagtttctgttactgttgctttttcgaagaaccgtgaaactgctaatttatagcccactctgaaacggcagacgcgtagcatgtttgtagatttctttgttc

SEQ ID NO: 26860 - DNA, 477 bp, Sorghum bicolor
  Clone ID: 30979488
aagataactgaagatgatctcgtcaagttaagatatctacagcttgtgatcaaggagactttacggctgcatgcaccggtaccactcttgctccctcgagaatgtcgtgagtcatgtcgggttatgggttatgatgtgtcaaagggaaccaaggtgtttgtgaatgtttgggcaatagcaagagacatgaaactgtggcatgatgcggaggaattcaggccagaaagatttgaaagtagcagtatcgattttaggggtaatgacttcgagtttactccgttcggggcaggcagaagaatatgccctggcatcacactcggactagccaacctagagctggcacttgctacccttctttaccattttgattgggatctaccggatggcgtcagattggaagaatttgatacaacagagatctttggtataacgttaagaaagaagtccatgctttggctccaggccagcccttccaat

SEQ ID NO: 26861 - DNA, 616 bp, Sorghum bicolor
  Clone ID: 30979513
ctgcaaacttgtcccatcccctggcaaaaaaaatggacatcaggatcctgtatattgtggccttcgtcttcctcgccctcctccttctcaggctcatccttagctactcccgcacgaagccatcatcagcgcttcgcctgccgccagggccatggcagctgccgctcatcggcagcctgcaccacctcctcctgtcgcgcttcagcgacctgcctcaccgggcgctgcgcgagatgtccggaacctacgggcccgtcatgatgctccgcttcggcgccgtgccctcgctggtggtctcctccgccgaggctgcccgggaggtgctgaggacccacgacctctccttctgcaaccgctacctgggcgtcaccctcgagaccgtcagctgcggcggcaaggacatcatctgctccccctacaacgcccactggcgcgagctccgcaagctgtgcatgctcgagatcttcagccagcgccgcgtgctctcgttccggaacatccgggaagaggaggtggcgaacctcctccgctccgtctccgaccagtgcggcggtggccccgtcgtcgtcaacctcaccgacgggatctgccgcatgataaacgacgtcgccgcgcg

SEQ ID NO: 26862 - DNA, 612 bp, Sorghum bicolor
  Clone ID: 30979528
aaaaaattttatatattgcaaggatgtctgttagagtagtccgtcaatccaaatttcgtcacgtatttggtcaagttgctaagaaggaagattgttacgatgagttgagaatcaccaagactgcttgggattccaattacatcgcagcaaacccaagttattttgccgttatttgggacagtggtggtggtggttctctcgccgttattccttggtcacaaaagggaaaaatcgacgcaaacattcctctcattgctggacacaagggacctattttagatattgatttcaaccctttcaacgataaccttatcgtttctgtctccgaagattgcactggaaaagtctggggaattcctgaaggaggattgaagagcactatgtctgagccattgcaaactttgaatggacatcgtcgtaagattggaactgtcttgcacaaccctgtagccaacaacatccttgcaacttctagcactgatttatctgttaaagtctgggatattgaaaagggaaaagacgttctcagcattgacgctcaacactctgatattattcaatctgttgactggaacggaaacggttctcttttggcctcttcttctaaggata

SEQ ID NO: 26863 - DNA, 354 bp, Sorghum bicolor
  Clone ID: 30979530
attgcgcctcatagggttctcccaactccaaatcgttgccccgagaaaccaccaaaactgttcgtaacgcaccaagcaccaaccgtccggcagcccgtggccactccatagggttctcagtctctcaccccttgcctgcgctgcgccaccgccaccgccaccgctcccccgtggcggcttcaagaggaagctcccggaaccaaacaacccctgggcgcccgagtttttctgaaagcggcttcagagatctcgtcgtccgtggccatggcgggcccgtgctgagtgctcgggcggggagcaggtgaaggtctccgagctcgagatcccgatgcacatccaggagggccccgcgcg

SEQ ID NO: 26864 - DNA, 633 bp, Sorghum bicolor
  Clone ID: 30979531
tacgccgttccgttctacgacccgagtccacgccacagcaaccgcaggcgcccaccaggccaccacgagatccccgccgtgacggagaatggaggccgccgccgccgtcctccccgcgctggtgccctccgggagcgcggtggtggtactcgtcgcctacctcgggtatctcgccgccgccggagccatcctcccggggaagctcgtcgatggagctatactctccgactcctcccgcctccactaccgttgcaacggtttgctctcgctcctgctgctgctggggctctcggcgttgggtgtctacatggggtggatgtctcccacggttgtagctgacaggggactcgaacttctgtcagtgaccttcatttttagtgtcattgtctctttcgcactctacttcgccggcatcaagtcccgccacaaaagttcttctttgagaccacatgttagtgggagcttcatacaagattggtggttgggagtgcagcttaatcctcattttatgggaattgacctcaaattcttttttgtgagggcaggaatgatggcatggttatttattaacctctctttgtttgcaaagagctacttagctggttcagctaatctttcggtcattctctacca

SEQ ID NO: 26865 - DNA, 599 bp, Sorghum bicolor
  Clone ID: 30979537
ggcttccaggcctgcatcccgcgtctctcccccttcctccccaacaaccccgccgcctccgacgttgacctcggcggccgccgccggcgaggacgcacctcgccggccacccaccccctgctactcgatccgtatctcctactccgaggatccgcgtagccgcctccggtcgcccacccgcgcaaccctagatctccgataccccgcgcgccgtcccaccgacggccacccgatcggaatgggccaaaatcttcagtagtacggtccaaggacccaagtgtaccctcctccgcctccgcctccgccttcgcgcgtgcgcgaagcgccgccgcgatggcgatccgcatcaccatgtcctactcgggctacgtggcgcagaacctggccgcgtccttcggcctgcgctgcaccaccgccgccgctgcgggcgctggcgcggcgcccggcgcggggtgccgcttcctccaggacgcgctatcccgccccttctgcctcttcgcctcctcccgccgcgctgacccccaccatgacgccgaggatcacaatcacccgaagcagcccatgcccaggcccaaggctctgccccctgccgccgcagc

SEQ ID NO: 26866 - DNA, 565 bp, Sorghum bicolor
  Clone ID: 30979539
aacaagaaacaacccggcgtcagaggaaggagatggccgagcccctctccaatggcgccgtctaccattcggtgcctgagtcgtacgtgctcccggagcacaagaggcccgggagctcgccgtcgtcgtgttccgcagcggcgatacctgtagttgacctcggcggtgatgacaccgacaggatggcggagcagatcgtcgccgctgggagagagttcggtttcttccaggtgatcaaccacggcgtgccggaggacgtgatgcgcgccatgatgagcgcggcggaggagttcttcaagctcccgacggaggagaagatggcgcactactccaccgacagcgccaagctgccgcggttccacacgagcgtgggcaagcagcaggagcagctcctctactggcgggactgcctgaaaatcggctgctacccgttcgaggagttcaggcgccagtggccggacaagccggcggggctcggtgccgcgctggagccgtacacggcggcggtgaggggcgtggcgctgcgcgtgcttcggctcgccgcgtcggggctggggctcgccga

SEQ ID NO: 26867 - DNA, 682 bp, Sorghum bicolor
  Clone ID: 30979550
gtgcaccgccccgttatcgccgtgctgctctgctccgctcctcttcgagaggcgcacgccgcgccacggcgagccacagccactccactcccactcggcaccggcaccggcacggcggcgacatgctcccgctcatctctcctccgcgccctggtgccgcagggccccgcgccatcgccaacgcaggcgccactgcccccgccaccgccagtccggccgtcatcctcccagttgcgccctctccctcaccttctctcccgctgcttcctcttgccctctcgcccgtgtgcgtgacgcgcggcgtgttgtcgtcgtagtggcgcaggggctcgggaacaacacgggcgactacgcgcggctcgccgcggcgctacgggacgaccacggcctccccgcggccgtcgtggcgcgggtcacccgccccgactggctccgcaacgccgcgggcctcgccgacgccagctactggcggggcaccctccgcccgcgccccgtgctcgactggtacctaaagagggtggatgacgcggtgtctgaggcgagggagctatgcgcaccaggtgggaagatatcactgatagggcattcagctgggggctggctcgcgcgtgtgtacatggcggagtttgaggcttccgacataagtttactgctcacccttggcactcctcacttgcctcct

SEQ ID NO: 26868 - DNA, 725 bp, Sorghum bicolor
  Clone ID: 30979556
agaaaccgaactcaggctttcttgaaaaggttgcaagctcacacttgtttgactctatactacttctcgcaaaaagtgggaatctttctccaactgaattaatgttagaatggagccggacaagtttttgtttatatgtgacttcaagagttgacaaaggtttaatttctgagcttcagaatcagaactggagagttctttctgtaggtaatgaatgtagcatagatgttcctggtgttttaaatgttcagaggcttcaggagttgcttctcaccttggctactctaataaaaagggaaatatgtggctcatcagttctggtgattggatatataatgaaaaaatcccgtgaggaagacttcacaaagagaggagcatttcccatatatcctagtaaggacagtcttatcttcgttcccctctctttcgaagttcctttaagtttgcaactgcaagaagttgatatggtcctccacaaaataaccgatgagattgtcaagatcgatccaaactgctccatcgattttccaaaagggatttcattttctgcaggaatgtctgaaattataaggtttgtggaagagcaccctgatttttgcgtcatggattcatttaaaaatatttacccattgctcgatcgtcttcaaatccaaaaaatccttgtccggttgcaagaacttagcactgaaggaaagccaaaacttcgagcaccatattctttgaag

SEQ ID NO: 26869 - DNA, 554 bp, Sorghum bicolor
  Clone ID: 30979598
atgtagatggatcattactgtatcaagcatcactaggccacatcagtattcgaaatactgacaaaaacacagagttccctccagcagaatcttgggtaactgaaggtgattacatctcgtggtcaaaaagttctaacggatctgaacttgtgagtctgaaaatcagctggaagctgaagacccctgacgaacgacaaccaccattcagcaagtacaatatctacgtggagaagttgacggcagattcagacgtgaaagctcccagaagctatcttggagttgctagtgttgatgccttctacgtatcgggcttagagatttccaacgaagtcaccagtctgaaattcttcattcaagcgtttgcacacgatggaagctggcaagaacttgaggaatgtccaaacttctttttatcccctgtccattctgagtgacattcattgaactctggtgtgcttgattcagttattctttcacacatgtaaaagaccccccacagaataatctatgttatccatacagaaataagaaggataaaaaatgaataataatgc

SEQ ID NO: 26870 - DNA, 655 bp, Sorghum bicolor
  Clone ID: 30979609
aaataatggtacgttccaaaatttcggtttcagctgataataaggagtttacttgtcatgacaaggtgcccgttattctaattgtgtcctgggtgaatggcatccctatggatcttgacctgaaccttgttgagactggatcattggttatgacagtatttacaactgcttttacacttcaggatggcaaatggcattacttgaaaggcttcaatttgacactatgttacattgtaatagcagtgtgctttttcaccataaaggccatcccaacaccaaagaagcacatgcctgagatgctgggtttggaatcaaattgaggcatctcaattcaaggttgtggattggcgttccctcgagcacctgaggccctgatgatcaagttgtttgtgaacacaccggtgaccagcatatttgacactgacagtttgtcatgtggaagtattgctaatctatctccacctctcttactcctgtcaaaattaagtacggccaatcacaaggaaggtaacataggatgtgatgtgatgatagtgtgtgttagtgtctcatggaaaacatttgtgactcgatcaaataatggcactatcaaagcatactccaagagaatttgtattgtagatgtttgtataaatttcttgatttaaaaaaatga

SEQ ID NO: 26871 - DNA, 625 bp, Sorghum bicolor
  Clone ID: 30979610
gttcctgctttcagacagaacttttgtttcatcggctgccaaatttcttctagtgctctcccttggtctctttatccatggtttgctgccttcagaagtgtttggttttacagttgagaaggttacacctgagcattttgaagtatcacacttagcattgaggaattcacttatgtctctggcttctgcatggaatgggagcattcataaactaagggttctagcagaaggtgaaaactggagcttacttttgaaggtatttgcatttctgtacagcatcaaactaatgctgagctttcagttcagaattctgatgggtcttgtattggcatccatgttcattgtcttcattgtctatgaacaatgcgaggaagaaattgacagtttggtggcaattgcttcagtcaaaatcaactggctaatagatagagtagttggaaatttgccagcctctttgaaggcgtatatagcctagaggagacatctgaaggatgtgtcgccaactagcaatggtgctcctatctgtaaaaatcttagctcgtttaagctaacatgtcctgtgtgatttacccaaatgtttgactgacactttcatatttttgttcaagtttcactttatgtgggg

SEQ ID NO: 26872 - DNA, 477 bp, Sorghum bicolor
  Clone ID: 30979623
cggcgccggcgccggcgccggcggtggtggtggtggtggggacgcctgctgcttcctcccaagctcttgctctgggtgcaaggatgctgctctcttgctgccaagaggtgagaaggaactctgcagcaaccaccaatggaacgaagggctgctgtttggtgaaagggctatcggttcactggactcatcggtgaaactgaagccctgactgaattctccgtcctggattttggcagagcctatatatgttaagtgatgaaccatccttctctccttgttgagaaattttgatctgaaatggatgtatgacctgtgctgggaccaatgttatccgtgatttgtccctgcgtcttttggctgtactaggaactgatgacaaatgttgagcagttcaactttgttgcagtcagatactgttgagttggtatgcccttgtttcatctgttataaggttcagtctgaggttcatgtataaaa

SEQ ID NO: 26873 - DNA, 233 bp, Sorghum bicolor
  Clone ID: 30979640
ctattgtccaatatgtttcttggttaaactggtagctaattaactcaaatactgtaagatagtatttaacactttgatgctctaatgaaagctgtggcatgattttcagctaattatgctctggtaatgacattctcacctaccctaccccttcaatgttggagaaagcatagttgttcaagcttgttgagatgcttataaatggcatcattttagttcctcgaacacgcatt

SEQ ID NO: 26874 - DNA, 690 bp, Sorghum bicolor
  Clone ID: 30979643
ctactggatagcctgccctgcacaccattgtcatggtcatcactactcaccagagcgtgttcctctcagtgtgcgtgaccatgagagagacccacacttgactgaactccataggaaagagcaacatttttccaatcaatcagatcaggcctttgcgtgttagcttctcgtaatccatcgttttctgctgtcatcagttggggatcaaccttctcaaaccacgcactggattcctttccgtcccctgatttccgatgcagcatgccaaggatgatggatggctctatgatttactagctgacacctgagtgtgagtgagtgtgtgtgtgtgtgtgtgtgtttctgatcatttctttggtctgatcattttgtttggcctcttgcttctcccctctccctccctgttcgtctctctttcgtgaccacctgacggtttcatcatcccaatctcagatcactcgaccgatcccacgagctgcgtgcttgctttgctgtctgattctgattcttgtccacctcactcgctcgctaggatcgatttcaatcaatcatccagtcgtatatcttgcaactctactctgctcagattggattaggctcggctcaagttggaacagaggatcgggttgaatttcttggctgcagcaatgctgaagaaagcatcaggaagagctgccgccgcaatgggct

SEQ ID NO: 26875 - DNA, 558 bp, Sorghum bicolor
  Clone ID: 30979644
cctccaccccacccaaaggggaatcagtcctcccacaccaccaacccttcttcttcctccctcttccctcttccccaccgccgccgccgccagcctttcccacttcaccgccggcgcgtccggccgttccggatcggctgccgttgttcccaaccagcagcgtcgggaatcaagctaagtagtaaccaacacctcctaccttggatcggactcctcgacttttccccttctcgcgccgcccgcccagatctgagctgacctgagcccttcccttcccttcccttcccttccccggatggcgacgccgtcctccccctccccgacccactccccgacctcctcctcctcttcctactggtgctaccagtgcgaccgcttcgtgcgggccaccgccgctcccgcctccccagcctgcccttcctgcgggggcggcttcctcgaggagatgggcgcgccaccaccaccacgaccagcctacctccgccgccaccgcgcgcacaaccaccaccaccaccatcaccaccaccatcacatcgccgccgcagccgccgacctccg

SEQ ID NO: 26876 - DNA, 531 bp, Sorghum bicolor
  Clone ID: 30979673
tcaggtcaatgttccaattcatgctttgatggctttgatgcgaagagtgctgttagttgatggatcattgcataataagttgttcccttctacaacttcattgcatcaagagcttatttgttttgagcttccatcgctacattcaagtttcttggatttgctcaatgcaactattaaaggaatgcgaagccaactcttacctcatggtgctagtatcatacgccttataacagagtacttcaaaatagcaaaactgcctactttgaggacaaaagcttatagcattctgcagctgttgctgacctccatgggtgctgggacatctctgcacctgcttgaggcaatagtcagcaatgcaattgctgatctgaatgatgatggtggaagtgacatgactgtaatcaacacaaatccatcacaattgacaaatgaatcatcatcgaaaatttattcgaagaagaggaagctagaaccacagatgcaaaactcaaccatatcaggttcagagaaagtagcagtcagcccaaggaa

SEQ ID NO: 26877 - DNA, 679 bp, Sorghum bicolor
  unsure (1)..(679): unsure at all n locations
  Clone ID: 30979680
acagaaccagcagctcatcagttgatagatgatgagctgagagcctgagtacgtacgtgtagtggtgcacgtactaataaggaagaaagctagctactaggatcgtcatggcggccatggaagagcagccgctgagctccagcagtaccagcatggccatcgtcctgtcgctcttgaagaacaacccagctgatgccgtcctgctggcactggtcgccgtcgtcaccgtcgtggccttgcgccattacttgatctcgtcatggcggcagcaggagcaggcccgccggctgcccccgggcccaaggaggctcccggtgatcgggcacctgcacctgctccggccgccggtgcaccgcaccttccaggagctggcgtcccggatgggtcccctgatgcacatccagctggggtccacgcactgcgtggtggccagctccccggaggtggccagcgagctgatccgcggccacgagggcagcatctcggagcggccgctcacggcggtggcccggcagttcgcctacgactcggcgggcttcgccttcgcgccctacaacacgcactggcgcctcatgaagcgcctctgcatgtcggagctgctcggnccgcgcaccgtcgagcagctgcgccccatccgccgtgccggcaccgtgtccctgctgggggacctgctgctggc

SEQ ID NO: 26878 - DNA, 488 bp, Sorghum bicolor
  Clone ID: 30979681
ctaataaggaaagtaaccctgaactccttccggatgctgttacctacacaacattacttaagggtttaggaaataaccgggacctttattcagttttgaatattgttgtggagatgaaatcttcattaatatcactcgacaggactgcatacactgctatggtagatgccttgctagcttgtgggtccattgatggggccctttgtgtttttggtgatataataaagcatgctggcaagaacaaagatttgagacctaaacctcatctctatctttcgatcatgagagcttttgctaccacaggtgatgttgatatggtcatgagattgaacaagcgcatgtggccggattcagttggagcaattagccgtgctgccaaagaagaggcacatgagctattaatggaagctgctgtaaataataatcagatagatttggctagaggccttctaagacaaatagtgaacgagaaggaatgtttctcttgg

SEQ ID NO: 26879 - DNA, 297 bp, Sorghum bicolor
  Clone ID: 30979687
tgctcggatccctcctgctgctctccctcatcagggccaagttctccccgattggtaaaacaggggacgccatcaaagcagaggggcagcaggcaatggcgaaagacagcgtctagatggcgaacgcgcatgacgctgcagctgcagccgaggaggaatgcgaggagactcggtccaaccccaccgactccaactctggcagcggcggcagcggcggcggcgtgagcggcacggccattgtggtcggcgacgcccacaccgagagggcgagcaaaagcaagccggtgtgctacgagt

SEQ ID NO: 26880 - DNA, 214 bp, Sorghum bicolor
  Clone ID: 30979695
gcacgatgcagttcctggatctttagtgatatggtatgatgcaatcactgtgaatggtgaccttgattggcaggataagctcaacaagtacaataagccattctttgatgtatgtgatgggttattttccaactatacatggaaggaaaattacccacaagattcacctacacttgctggagacagaaaatatgatgtatacatgggtattgat

SEQ ID NO: 26881 - DNA, 642 bp, Sorghum bicolor
  Clone ID: 30979706
actcaggcctgtttcgccactccacgtttggcccctacagatttatcagcggaagtgctgatcgaacgcgtcgttcaattcggtctgttgccgagactgttgggggggcaccatggcgtctcccaacagcggcgaggtcggcgcagcaggcgacctcctagagaccggtctgctgctggccgcctccaagcaggaggaggcggcgccgccagctgccgtggagacgacgacgacgacgacgtcgtcggggcggcgtctggcggagcacgaaatgacggcgacgcgctcgcgggtgcggcaggtcgtccggcgcgcggcggcgcagttgcaggaggtgtttctgggcacgaagctgttcccgctcttctccgccgtgccgctagcagtcgccgccgagcacttcagcttcggccgggcatgggtgttcgttttcagcttcataggccttgctcctctctcagaacgtgtgagcttcctaagcgagcatgttgccgatacagcaggaccaacagctggagggcttctgaatgcaacttgtgggaatgtacctgaactagttattgcactgtttgccctgcacaaagagaagatgggaatcctaaagtggtctcttttagggtccatattatctaatttgctcct

SEQ ID NO: 26882 - DNA, 632 bp, Sorghum bicolor
  Clone ID: 30979707
ccctcgtgctctcccccatttcttcttgtcccccaccccacctccgccccactcccaccccaccaccgatggcgaccgccgagcccggcccgcccccgccgaagcccgcctgcgccgtcacgttcggtcgctgcaccctcctcggccgctacctggccgcggcgctcgctgcctccggccgctggtcagccgtcgccatcctcgacccctcctcccccacctcgccgtccccggcgcccggcccgtctgcctcccacctcgtctaccaccacgacgtcgacctctcggaccacgagcgcctcgtctccgcgctcgccggcgccgcggctgtcttccatgtggacgccaccaccgcggccgcctccgggagcgacgggtccttcctctccctgcaccgcttcgccgtcgagggcacgaggcggctcctcgcggcctgccgctccgccggcgtggagaggttggtgtacaccggctcggccgacgtggtcgcttctgttgcccgcgatgtgatcaacgccgacgaggactccgcgccctaccctgacaagtttggaaatgcggtgagcgagctgagggcgcaagtagagatgatggtgctcggtgcggacgggggggacgggatgaggacatgc

SEQ ID NO: 26883 - DNA, 611 bp, Sorghum bicolor
  Clone ID: 30979711
aatctgctgtgctggtgcaaccacttagcatacatgatcttaacacgtcaggaaaccttgttactgtggatatccctttacccctaaaaaatgatgatcagtcaattgaatctgtggtagctcaaactaatttgccaaaggaacagatcttagatttgacttctgtattgaaagacctatctagtaaatttgagctgagcacacttggctacctccgtctactgagacttcacaggattgatgaaccagataaatttgacccagaaaatgtaagctaccagtgggtgcctttgagcttggagttcgggattcccttattcagtccaaagttgtgcgagaagatttgtgaaagggtggttgcatcctatatgcttcagaaagattatctcaatgagcattctgatgtgatgcaaaatgtgagaaggcagctgagagaactttgcagtgaatatcaagcaactggtccaatagctaagttatttaacaagcgtggaagctcaagggactcgccacgtgccttgatcaatagtattagtggcagatggaatctctctaatgacccttcaacaccaactagtggagaagccccaagtgaacacgagaggctaaaa

SEQ ID NO: 26884 - DNA, 441 bp, Sorghum bicolor
  Clone ID: 30979715
ccacattggcttttgcatatttgctgccattgctcctccaattatattccgcggaaaatcgttaacgggtatactggctgcaattgacaccttttttgatcatgcaatagttgggattttttactttgttggatttgccttgttttgcttggagacacttgtgagcatatgggtttttcagaaagtatacatgtacttcagagggcacaagtaggctatggaagcacttgcaatagtcaaccgagtaccatctggttgctctgtggttttgtgcatacacataagtaagtacatgtcagtcgttgtatgttaccgacaatgtatatttttccctttaaagtttgtatggtgaagggtatatacgattatattgtagtgtctttttggactgatctgttttaaaccccaattttttgcccatatatacaaattgcactttgt

SEQ ID NO: 26885 - DNA, 437 bp, Sorghum bicolor
  Clone ID: 30979718
cagtccaagaatgcatggcaggcactgctaaatgaattaccagatgatacatcagaacatgtccttgtggccgtaggtcatcctgccattcacatagctctaatctgccggtgtcttgatttgccaatggagtacgtgtcgtcttttcacttggacgatggcagcatcagtgtgatggatttcccagatgggccgaaaggaagaggtatcatcagatgcataaactacacagcccatttgggaagatggtcaatacccattacaaggccaatggagaacgatgaagaattctaacatggtaattaaccctctgtatagcatccttcagaaacacatctcatgagtaaatacctcatactgctgtacatataattttgatctcaacatcgcaatatttatgtacataaaaagtatatttattatccattgttcagttc

SEQ ID NO: 26886 - DNA, 582 bp, Sorghum bicolor
  Clone ID: 30979720
atgcagtccaaggagcttcataacaacttggaactggcacaaaagaatattgtagaccacacttctgctcagagaaaacgaaaggcgagagtaatttcagagtatgctgttatggcccgttctatcattcgtaagaagtttcagcagctccaggaatctgctatagctgaaagactgaaagaagagaaggctgtgaatgatgccaaatctgatacagtgaaggatcatgtgctggcaaatacttctgccattggaaagacacagaacatagataccaacttgggcatggcaaccaacgatgatgaaggcggggttccggaagttggagattcagtctatgttcctaagctcaagaacgaagctactgtagtcaaaatagatttgtccaaagatgaagttcaagtccaagccggtatgatgaaactcaaactaaagttgaaagatgttaaggttcagaagcggaaagtatccagatagaacatttagcagagattcagataagtatgcatatgctgtttcatccaattcctaccatttcactggcctcatttttcagcaataattaatatatatctttcaagg

SEQ ID NO: 26887 - DNA, 755 bp, Sorghum bicolor
  Clone ID: 30979744
gaggaagggattctgaaggagctagagttggctggatttcagtacctcggtgggcccacagatggagacaagaagatagagctcaagcctggtttttacatggagcatgacgaagatgtgggagcagttgtggtcggatttgatcgctactttaactactacaaagttcagtatgggacactatgcatccgtgagaatccagggtgccttttcatagcaacaaacagggatgctgtcactcatcttactgatgcccaagaatgggcaggtggtggatcaatggtcggtgcaattcttggttcaactaaacaagaaccgctcgtagttgggaagccatctactttcatgatggactacctggcaaagaagttcggaatcacaacatcccagatatgcatggtgggtgaccggttggatactgatatcctgtttggtcaaaacggaggctgcaagactctgcttgttctctcaggtgtgacttccctgcagacgcttcagagccccgacaactcgatccagccagatttctacacaaatcaactttcagattttctcaccctcaaagcagcaactgtctgaaggacgagcccgccttccttttgcataggcagcatcgaccattttttttgtgtgtaacaaataaggaaacacaaaggatggttttgtttttctctgtgtaatcatgagatatcgctttgtaacatcagtcatgcacatatcacaaggatgccaagaattaatctagattctgcagt

SEQ ID NO: 26888 - DNA, 485 bp, Sorghum bicolor
  Clone ID: 30979756
ctcgccacgccaacatggtgcagttcggcggtgaggtcgtcaacacccggccgtcggggtcgcacacggcgacacagatgggcagcggccacttccccagagagggcttcgaccgcgccgcctacttccggaacctgcaggtggtggactgggacaacaacctcatcccggcagccaacctgaaactcctcgccgatcaccccggatgctacgatatccagggaggctctaacagctactggggaagctacttctactacggagggccagggaggaacgtgaaatgtccctgagattatccatctttgttttccctttgcttgtttgaagctgttttctcttgtcatttttctgatagcatgtacctttctaggattttgtaggtcttatacgtctttaacggtagaatgcatcaacagttgagacttgagaggaatttgtaaatttgagaagtacctgccagatcatgcattcaattcgcagaa

SEQ ID NO: 26889 - DNA, 439 bp, Sorghum bicolor
  Clone ID: 30979761
atgagcaacagggtgtttcagaggcatcagtaccccatctaactgtgcatggccagagatagtaatattttcccttctcagggttacatatgttttatggaaatagttagtagttcatttatctgtctggtctgctgctgcgcttggtacatggttcttcgtctagaggtctagtggtctacgcatgtgcgagaagatttctatgtgaaggatgtcaggttctgagatcttaatgaatatgtgttgtccaattgttccttctgatgtgtttcatccggtgtttgaaagggattctccgtaagggctcatgcccttcagtaatgtgatgtgtgaattaaatgcagggttgatggtgatgggcacaagagtgcatcatgtaaatttgacaatgtccttcagggcaaaaaaaaaacgaaaattgtatcttattgccaaactt

SEQ ID NO: 26890 - DNA, 223 bp, Sorghum bicolor
  Clone ID: 30979784
aagccccggacgccggacgggacgccaggggagccccaatccatccatccatccatccatccatccatctgccatataagctagctatagcctataggcgaggagacgagagacgccgccggattgcccactcgtgtgcagcgcctgtgttcctctgtgcgcgtgacgcctgccagcagagggccgtccatgaaggaccgccgtggcagctccggcggcggcg

SEQ ID NO: 26891 - DNA, 546 bp, Sorghum bicolor
  Clone ID: 30979796
gctttttttttatatgttgatgaaaacggcgcggtaacagagtaacaagtgaaattacaacactcccagcactagtagctcagtacttacaggttacagccctcatggcttctacagatgccatattgtcttcgccagtggcaagcgacggcttcaagagcaagttcttggcgagcccagtagttcaggtgcctgcagatgccagcagcagcagcagcagccaaaggcagcaggtgaagatggagctcaccagcggcgagattgcttgcaagcagcagcagctgaaaccgcggttcgccctggaattggacgggctcaactgcttcgaaaccctggtcccccgctgatcgacgagcaataatccatttagctggagtttttttttatcttttcttttttggtggttttgcacttttgattgtaatttcccaagttaagtaggggttctattcacacgatttatatacatccatcgacgcaaatgtttgttcatgcctaatgactggaagtgtaaaccgagtaccgtattggaattttttatatttt

SEQ ID NO: 26892 - DNA, 431 bp, Sorghum bicolor
  Clone ID: 30979799
ctactggagtgaaagagatgagagcaacttgaaccggaagcgacttgggtagtcggtcagtccactgcaccaccacgcccgacacgcccacccctcccaccgcttccctctccaggtctcccccgcggcaacgaccacagcccaccgagcaccgatcaattcgctgctccgccagaagcagaagccgaggccgacctgtccacggcagcgagcatgcaccacgatcccaaccccttcgacgatggcgccgacgagaaccccttctcgaatggaggcggaggagcgcgtggcggaggcgtcaagtcgcagtacgggttccggccggcggagcccgcggggttcggcggcggcggcggcaggggcgatgcgaccgtcgacatccccctcgacaccatgaacgattcgaagggcaaggcgaaggagctgtctca

SEQ ID NO: 26893 - DNA, 353 bp, Sorghum bicolor
  unsure (1)..(353): unsure at all n locations
  Clone ID: 30979806
ttcnatccaaaaataaatcgcaccattttcacccatcactcgcaggtcgcagcctcttcctgatgcttcgcctctccatcgccgccctcacctcacctctcctaccgacgtccgtccccgccgtccgaccccatccgcgtcgcctactccgcctgcgcgtccgctccctcgccgccgcctcctcgctctcgccgtccgcccgcagcctccgcctcctcgaatggggcaaggtgtgcgacgccgtcgcctccttcgccggcactgcccacggccgcgacgccacaaagaaacaactgtgggaggtggaagatgtgagctatgagcttagccagaggctgctccaggagacggag

SEQ ID NO: 26894 - DNA, 597 bp, Sorghum bicolor
  Clone ID: 30979823
atttccgtggccagtgattcctccgcctcttcgacatggccgccatctccgcccacctcaccgccactcttccgtctctcccagctctccggccctgtcgtcgccggcttcagccgagcaccttcgcagcatccgtggccccgaaccgaacccccggcgtcgccctccgtgtctgcaggtgcgttcccttccctacttaacctaccgcaacgccacagtttcgttggcattcgctggaaaaattctcgcctcgcttgattttagctgttgcattgtgccttgataacccgactgtatgattggattcagttacctcgggatacagtttactagaaaggcaatagaacggggactgatttataagtgatgctggcgctgctgaagcaatctgaaataacggattagatatgctcaccccttttgcaatttttctgctgctgtgctccctttcttaagaaaactgtactgatgtgtaagtgcttgaatagactgtttctgccactcactttacaatggtttatttcccatatatggctgggaactgcttagattatacaatgcacaattccatagtccgtgttgaattgatttcaaaca

SEQ ID NO: 26895 - DNA, 626 bp, Sorghum bicolor
  unsure (1)..(626): unsure at all n locations
  Clone ID: 30979832
ccccgctagcaggtcaacagcagcacacgcattcacctttctccagtctgtatctcatgacctctgcttctttcccccttcctgcaacctgtgacgctcaggcttgcttcactaaatccacacccatggctggagctcttcagctattactaacccaaatcaagttccccagagcactagttgctatctgtctattttccctttttgttctttagacaatattatcaaacagaacacatccatgtaacaatgagcaacatggcaatactttgagtgaggtttgggatggtcaagagcttatgctcacttttagaagaaatgtgtctgaaactttatgagtatgacgtgggatttatgcagcatggttgagggaatctctctcacttatgaggaagatcaaatggtatggagctttacttctaatggttttgtagtggagttttccctatgtatatgtattcaatttggaagttggtaataccccctanggtttaattcttcttatggctgttgtcacacaatagattactgactagggacaatagtctagcgaaaagaagggatgtcagtgacttgacctgccttttctgtacagagaaggaatcaattgcccattttttctttga

SEQ ID NO: 26896 - DNA, 615 bp, Sorghum bicolor
  Clone ID: 30979833
tactggggtcgcggttcctgcgccccgcccaaatcataacgcacaggcacatcacacaaacgccaaccaaacgccacccgataaaaaagaacagagcgccacgagcgggcgcggcgatgctccaggttcgcgcgtccccgaccttcctcccctccacctcctcatcctcgtcgcaggcgccgacgcactccccgttctcggggaagagccagcggcgcggcgggctggcagcggcgccgtcggcgaaccgcgtggcgaggcggtccggcgtcgtcatggcagcggccgcggcggcagccaagctcgaggacgccgacgcgctcatcgactccgtcgagaccttcatcttcgactgcgacggtgtgatctggaagggcgacaagctgatcgacggcgtgccggagactctagacttgctcagatcaaagggcaagaggctggtgttcgtgaccaacaactccaccaagtcgaggaagcagtatggcaagaagttcgagacgctgggaatgagcatcgacgaggaagagatcttcgcttcgtcttttgcagccgctgcgtacctgcagtccatcgatttccccaaggacaagaaggtgtatgtcattggagaggaag

SEQ ID NO: 26897 - DNA, 113 bp, Sorghum bicolor
  Clone ID: 30979834
agttagaagtcgagaataacgtgaaacgtgagaaaggctgatcgtattcttattgcgctttgcgcgctgtggctttctatatgggctgaaccacacatgatggtccaagacgt

SEQ ID NO: 26898 - DNA, 531 bp, Sorghum bicolor
  Clone ID: 30979835
tactggctgcgccctcgtcattctcctcgcaacggcgagtcggtgaggcagcggacgcctcccccccccagtcccgattcccgaaccctcgtttcgccttctccgtttccgcgaacctggttgcctcgtcgtccccaccacacagccgaccacgcggccgcgccccgcgttccactcgagcgaagctactctactctactactggttgccgtgggcggtgccgtggagtggggatccgtccggactttctacctttcgctgttgatgtcatcatgctgagcattttgtggtagagacgacaagatcttctctttgggttccagcatacaactcctgcccacaaaatttgcactagaaaatatgtcgacacaggcctctaaccggtcatacagatatccagacaatacccaactactgtaccacaatggcaatccaatgcatgttgggggcaatggtaattactatgtgcaacaaaatcatgatgatgttaactacatttcctctgatgatggatcacagagcagtaattct

SEQ ID NO: 26899 - DNA, 581 bp, Sorghum bicolor
  Clone ID: 30979837
gaattctcctcacaaatgcttcgccaccgccacctcctcgtcccgattccgtaccgccacgaccaattcatcttaccgatcgcccgcccatggacgccgacgacccttctgccgccaccgccgcctcagacgacgacaccttcttcgacgcccttgactcgctcccctccccttctccttcactttcgccttcgccttcgcctcccccttccccttccgctccccctctccacaccccctcctcctccacgctccgccgccgcccgcgccgcggaaagagtctaaagcagcccgactccgtcttctccccttctccctcggcctccgcagccacctccaccgtcaccgccgtcgaggacgagcctctcaagcccgattcctccgaggccaccagcgccgcccctcgcactgtccccgcatccgaggtggaggaggaggaacaagaggagcacaataaggccacggatgcggatgcggatgttgaggtggaggcgcgagctcctacgccgacgccgacgccaacgccgacgccggccccgagcatactcgagtaccttgccgtgctcgtcattaaggcagtg

SEQ ID NO: 26900 - DNA, 639 bp, Sorghum bicolor
  Clone ID: 30979839
agtatctcattctcatccgatcctacagccagtgttgttctagaccagagttcgagcaaggagctagctgagcacttgcacacagctctgctcgatcgtgtagctagcgaagccacagtgaccgactttgctgtagcggataaaccaccggaccaaaaccgatccatccatccaaccacagaacacgtacgcgtatactagagacatggcctccgcgatcaaggctgcatcgacctcccggtggtcttcgtccccggcggtacagtcgtcgccgctcccgaagcgggtcgccatgccggggcgccggaggtctgtggccactgtaagatcggtcgccgcggtagctccggctgccccggcgccggccaggctcaccggtgccggcctgacggtgtcgcagaccatgtccaagctcagggcgcagggcaagacggcgttcatcccgtacatcaccgccggcgacccggacctggcgacgacggcagaggcgctgcggctcctggacgcgtgcggcgcagacgtcatcgagctcggcgtgcccttctcggacccctacgccgacgggccggtcatccaggcgtcggcggcgcgggcgctggcgagcggcacgacgccggacgctgtgctggcgatgctcaa

SEQ ID NO: 26901 - DNA, 395 bp, Sorghum bicolor
  Clone ID: 30979847
gctagaagcagacaagcagctgcgggagcaaaagggggccatggcttcttgcagtagcttctactttgttcccttgctcctcctgttgatgctcttgctggtctctcctaccgccactgcagcacagccctcttccgagcctggcggcaatgccactgctgcaaggctgaggccggggaaggagctgctcaggcacaagaggatcagggctctgctgaccaagcttaacaagcctgctctcaagacaatccagagtccggatggtgatatcatagactgtgttccctctcacctacagcctgcatttgaccacccaaagctcaggggctctaagattctggatccaccggagaggcccaagaactgcaacttcacccttggcggcagcagagtca

SEQ ID NO: 26902 - DNA, 401 bp, Sorghum bicolor
  Clone ID: 30979851
aaccaaaccagagctgctgctgctgccctgtttcttgtccaacagctgctgctgctgcttcacttcctctgcttacacagagcaaccagttgtcagcagcaatgtctgcacccatggtggacgccgattacatggccgagatcgagagggcgcggcgggacctccgcgccctcatctccagcaagaactgcgcgcccatcatactccgcctcgcatggcatgacgccggcacttacgacgccaagaccaacaccggaggccccaacgggtccataaggctcccacaggagtacagccactcttcaaatgcagggctcaagattgccattgacctgctagagccaataaaacagaagcacaccaagatcacatatgcagacctgtatcagctcaccggagtt

SEQ ID NO: 26903 - DNA, 528 bp, Sorghum bicolor
  Clone ID: 30979853
tcatttttcaatggattgttcacgcagcaactccaatctggtggccttacccattccttgacttgacatcaaatttggcacctttgtggtaccttgcggtggcggtgttgcaactgccgtgatacgtggtgttcaggctggtgatcaagctgaagcaccacctgctggccaagtggttcccggtctcttacgtaagaggctagctaggggcacaagccaggccttcgtcttctccgcctccattgcagctgcttcagcgaaagcaatgcaagctacagaataatggcggggtccgggttgtttattatttggggggagcgattcttgtgcaggtgccctctccgaccaaagaatagaggggagtggcacattggatgcatgcgtgcgtttttacaggggtataaaactataaatagtttggtgtacattggatggaagtgaagcagcatagtagtttttaagagttatttttttttcttttttgccgtggtggaaagtgaacacataaaagagatagaggacagcagg

SEQ ID NO: 26904 - DNA, 438 bp, Sorghum bicolor
  Clone ID: 30979865
tcaccaaactggagataacgaagacagtctcaggtgtactctactttggctacatgctcattgcctcctatgccttctttgtgctcaccggcaccatcggcttctatgcctgcttctggttcaccaggctcatctactcttcagtcaagatcgactagaaatctagggactacagttgtaacactgttttgtgggtttgcgaaagcagaagaccaaaagagaaataattggtaacgaacatgagaagttgagaatgtagctagtagcgtgcattatacaaggtgaaactttaaacgcaggttgtgtattcagatagggtatttacagttgattctggaacactacattagtttacttcgaagccactaattcagtgtgtacccttatagagaaggtttgtgatgttacaatcaaacggtttaacattttaaccatatc

SEQ ID NO: 26905 - DNA, 598 bp, Sorghum bicolor
  Clone ID: 30979880
aggatgaaaaagaaatggtatccaggactgtgtattgtactaacattgacaagaagattggagaagatgaagtgaagcaattcttcgagggaacatgtggtgaagtttctcgtctgaggctacttggtgattatgtgcactccacatgcattgcctttgttgagtttgtccaagcagatagtgctattcttgctctgaactgcagtggcattgttcttggaacgcttcctgttagggtgagcccatcaaagacaccagtccgccctcgatcgccccgtgtgacgtcatactgagttcggctcatctgaagccgtcgtccagggcagcaaatttctgggcagcaaagccttagtcgtgtggccttagagactgtcgtttcgcggatcagtaattgttgttgagcagagttctcgttggttaaaatctagtctagtagaaggcccctcagctgatgtttctcggatcagagacccaccatctgtatggtcgctgatgggagatctattttgacctccttttttttttggtctttgttatcatggttggattctatgacagccttgacagtcattcgaacaataatgtctatggttctctt

SEQ ID NO: 26906 - DNA, 550 bp, Sorghum bicolor
  Clone ID: 30979903
ggcggggcaggcgcagtgccagaactaccaggccaggatctacaacgacgccaacatcaacgcggccttcgcggcgtcgctgagggccggctgcccggccggcggcgggggcggcgcgaacgcgccgctggacgcgtccacgccgaacgcgttcgacaacgcgtactacggcgacctggtcgcgcagcaggggttgctgcactccgatcaagagctcttcaacggcggctccacggacggactggtcaggagctacgcagccagctcggcgcggttcagtagcgacttcgccgctgccatggtcaagatgggcggcattggtgtcataaccgggagcagcggagaggtccggcgcaactgccggagggtgaactagctagcttgcagaatgctgcattgcatgcatcgcacttctgaaagaaattgagtgtgctgagctatccaaccatggttaaaggaagttgtaaagattaaggggcaacgagttcatatagcttgtgttgatgttgggattaaagaagtactcttccattaaattctaagatatttt

SEQ ID NO: 26907 - DNA, 574 bp, Sorghum bicolor
  Clone ID: 30979905
cgccgatgcggaaaaccccatgccgtcgccgcctgggactgggactgggagcgcctggggccggcgtctcggggttctcggtgtgcatcagcccgctcgtgcggcccagcctggggaggcacctccgcggcggccacccgccggacgcgatcgtcgctggagagcttcgcccgtcgccgctccacccgctcacttccagcgcctcgctccaccactgccgctcctggaagctcgccgacggcggccggttccggtgaactcatcgacgactccctgtccatgtgaccctgtaaaactcctttctcactgttctccaacatgctcggtccatttttcacacagaacttacacgaccattgttacttcgtgggttttatcctttttatttttccttttttttattttggttttaccttgacgtgaaagctagggaaaacaaggaatttgtgcctcgcaagctgttccactgacatttgggcaccgacatttctaacggtgccgtttgtcagcggaacatgttgcaacgctgtaaaaaggatcaagctccccgtgctcagtgttcatgtacagctta

SEQ ID NO: 26908 - DNA, 546 bp, Sorghum bicolor
  Clone ID: 30979927
atcgaattttccaatcgggctgcagagaaagagccagtcgacagaagataccaacctgcctaccatcaggagctgaccacgctgacagcctcgccacagaaacgacctctactacccgtgccgtgagtaacgaaaagggggagagagctcgctcgctcgcctctggcctccggcatctccttccattcctctctgctcggtgcccgcgtcgcgagagagatcacgagaggtaaggtaatggccgaggcagcggcaaggggagcgcgatgaggtgcgcaaggcacccgtacgagggcggcgtcggcgtctgcgcgccgtgcctccgcgaccgcctgctcgcgcttgccgccgcgcagaacgccgcgtcctcgctgcccccgcccctacccccaccggagccgcccgagcccgagccggtgttcccgagatccgtgtcgtcgccgtacgtgtgccgccgcaagtccgacgcgtcgtcggcgccgcgggggcgcccgccggggagcctgctcttcttccggacgccgcaggtcggccccgcgtacggcg

SEQ ID NO: 26909 - DNA, 504 bp, Sorghum bicolor
  Clone ID: 30979955
cctactgggcggtccaaaaaaccaaaagggggagaggaaaaaaatagagtgagagaagttatcggagagagaaagtaggcgagaagcgagagcgagagagagagataagaagggaaacgcggagctgaggtgtggagacggaggcagcggcggcggcgcggccaaaccctagccgacggcggcgtgttcgaggcgggaccctctgtaggccccgcctggcggccggattcgagccgccggcgtcggcagctgcagatcggcggtcgcgccgacggaatcggcggggatcccggcgggatgggcgttgcgaggcccgtgctccggttctgagtttgcttggtccgtgggttctggctctgggctcgcgagcaaggttctgagctcggcgtcggcgctttgtttgcttgctgtggctttttgggcggtttcgagcgggttttgcgggggatttgggagggatctgccgggaaggcccgaggttttggcgggtttttgagagctgga

SEQ ID NO: 26910 - DNA, 391 bp, Sorghum bicolor
  Clone ID: 30979957
agtccacagtggccacgcgtcgcttccttctcccgccgctcctccgccggaggcgccccggcggaagaatccaatgagttttggctccgtgtagtgtaggcgcgcgcactggagatgccctgcctgaccctgcaatgcaatccgtcgccggtcgctgatcagtcgagctcctgatttggaacctttttacggatttcttgggggcccatcgccgtgtttcgttccctgcccgctttggccgtgcattaatagccgcttccttgtgatagtcctctccctccgtcctcccttccctgttccctcctcctctcctctctcctctcgctcgcctccttggtcggctctgttcttgggagtgctgccagtctggttgcgttgcggcagcaaaaac

SEQ ID NO: 26911 - DNA, 604 bp, Sorghum bicolor
  Clone ID: 30979958
cctactggttttattcacaatcacttcacatttctggtgaagtatcacaaggatgcaaacacagatcttgccaggattgttgcctttgaggttaaaccatacagtattaagcatgaacctgatggcgattggagggggaatgctacaccccttaaaacatgtgatccacactcaagacgccttgtcgtagattctgattcacctcaagaagtagatgccaacaaagatatcattttcacctatgatgttaactttgaggaaagtcctatcaagtgggcatcacgctgggacacctaccttctgatggcagacgaccaaatccattggttttctatcgttaattcactgatgatagtcctcttcctctctgggatggttgccatgatcatgctccggactctttaccgtgacatcaacaagtacaaccagttagaggaccaggaggacgcccaggaggagacaggatggaagcttgtccatggagatgtgttcaggcctcctgccaatgctgacctgctgtgcgtatatgtcggtacaggcgtgcagttctttggaatgctgcttgtcaccttgctggttgctatcctgggcctcctttcacctt

SEQ ID NO: 26912 - DNA, 658 bp, Sorghum bicolor
  Clone ID: 30979982
ctactggaagaggcgcccccagaaacctgccctccgcctccctcacggctccctccgcgcagccaggaacagctctgccgttcccttggaagaaaaacttcaagggcagcagcggcggcggctggcaccacttctcctaatagcttcaaggcagcaccgcgacacggcaaaggcaatttcataacatcggccggcctttcttcctggcttgagctatctttgcaggaaatatcaattcatcagaaaagcaaaatgcgtagcagaaagcccttggggattcaactttttgagtgtgcccgggggagtcccatctccttcagatcatgtcaggctcttgtactagttctgacgttcttatcatacgccagctaccatgccactagaaaaaccacaagcattgttaagagtgttcttgatcctaagacaaacctaggtatgttgcattggcccagtcatctctaccttcaaaatttgaaaggtgcagagaacaataatgcgactctctccggcggttgggctccgttcaacgctgaagatggcactgtattgcttggggagattgacttggcttttcttggtgtatatgcaattgggatgttctttgctggccatttgggcgacagggtggatctgaggatcctgctgactataggaatga

SEQ ID NO: 26913 - DNA, 664 bp, Sorghum bicolor
  Clone ID: 30980002
attactttattgtaactttctgcattattttgcatttcttgttgcagtgctttgaggttgacatcggttgagaagtacttttacatacgaggaagttgttattattattgtctgcaaatctcagtgtgtttctgtgaacttatgttcagtttgctgccatgagcatatttatatgagctccgaacatgtttctatgatattaaaatgggttaatgcattcttgctagtgtgggaatctccattttaaagttttaatctgaacacctaattttatgagatcagcagattatttaattctcatattatttctgttaaagttttaatctgaacacctaattaaatcattcacttagcatttacttgtacttgagaagtggaccatttgtatgatctttaatggcgtaatgaaacttagctgatgcaagtcttctatacttctgtaggttttcttcaaaccccggatgaaccttacgaagacgcggataggctaaatcagtggtgtgaagattgaatatattatatagattagagtagattcttactgttttgaggcaaagttggtttgtgccattacttgtgatattcctaattgttggtgccatttttgaacttgatataacatggattgattgtattatacttgtcatttgaagaatctagtcat

SEQ ID NO: 26914 - DNA, 111 bp, Sorghum bicolor
  Clone ID: 30980004
agtttgttttttatagataccccgagatacatataaatcccagggttttggttttagggaaccgttgtccctttatgtccagtacaaagcaacccctttagcagcacgttt

SEQ ID NO: 26915 - DNA, 692 bp, Sorghum bicolor
  Clone ID: 30980016
agattgatgcttgtttacatagcaatctgttcattaatgggatcccttacggttatcagtgtaaaagcagttgccattgctttaaagctatcatttagtggatcaaatcaattcatctacgttcagacatggttcttcatagtagtagtcactatttgctgcttggtgcagttaaactacttaaacaaggctttggactcattcaacacggctgtggtttctcctgtatactacgtgatgttcaccattctgaccattgttgcgaacatgatcatgtacaaggactgggcctcgcaaactgcaacacagatcgcaacacagctatgtgggtttgtgaccattgtcgcggggacttttctgcttcacaagactagggatatggggaatccaccaccacctgaccaaatatgcctggaagaagccagagaatgtggtccacggtcaacaaacagctctagctgaacacacataagatgttaaaatctcagaaccttttatagaattggagttttgagctctatggtgacctttgtagatatattaggaaggaagtgaagattggagtgcctggtagttggacttaccgatgaagcgttttctggaccaagaaagaatgaactgtatgaaagcatcggaatcttgtcaagacataggattcaaaatctatatagatggttcgttgccctttttaa

SEQ ID NO: 26916 - DNA, 459 bp, Sorghum bicolor
  Clone ID: 30980032
agctaaagtccctcaaggaattgaaaactgtccctgtcttaagaagctttggctgcttggtctccatgaggacttcaaagctcaatggaacaataagcgcatgaaacaaaagatgcagcatgttccagagatccgcatctagggggattatcactatttcttcagcagtaatcttctgaatcataggcagatgttcaaattaattactgccaaaacatggctatctgcctttgcctcaaggaagtagttacctgcgtcagcctgcgttgttcagttatttctcatattagctccatgtagagatgaaaacggtacggatatttttccgactgtattcgagaccgaattcatttagagaggtttagatctgtctgtatccgaatccgaatattgaacatctgataccgtatccgtatccgaatatttaaatcgtatatttatgatgtcgatattcaatca

SEQ ID NO: 26917 - DNA, 425 bp, Sorghum bicolor
  Clone ID: 30980045
gaagaatttcatgccatgacatggtttagcagctgggctgtggacggtgatcatagctacccagattccccagtgggggctgaagaaatgtcctttgaagtcagagaactagagaagcctgatcaggacgccatcggaattgagagaataatccgaagtatcccagcaggggagagggcctttttgggatccatgtgtaaagatatcattgatacggggaggctattatggcttgggcagaagggtttagttgctgatcttgtaagctatgttccatccaaaatttccccagaaaaccatttactcatcgcaaaatgtacattttgattaggctgaaaagcacgtgcatgtatttcagccctgcaaatttgcagaaacttggatcgtaaaagatagtttcaacaaatacaattttgagtttttca

SEQ ID NO: 26918 - DNA, 640 bp, Sorghum bicolor
  Clone ID: 30980061
aagttcctttgggatgttactgcacacatgttggaaaacgaggatagcgggacagatcaagttctgttttgcaggaagaaattctgggctattgtttgagttatattctgggctattgtctgggaaggtgccatcttatatcctcgaacaaacaatcttccttgcgaccttctgggctattgtctgggaaggtgccatcttatatcctacctttggttgccctttgtatcactgagaacagaatgtaaggagagctttttggcatggtggatatttcattgcacgttctctgcagttgagagtagtgcattgttgagaaagcatatggtacggtggtgccgttgagaggtttattcagaaactagctcggatatttttttgcttttgagctgtactgtttgtctatgaaggacatgggtgagccggtaaggtgtagtcttactgacagtgttttgtagtttctcccataaggaatagccgttaattcatttgttatcctattcactaatgactgattaggtttaggttctcaacaatgtgttgatagtgtagtttctgttgttccaattggggatcatctgtagtactataaaccttatggaaggtactgtttgcagcgaatggcgaggtgtgttgttac

SEQ ID NO: 26919 - DNA, 453 bp, Sorghum bicolor
  Clone ID: 30980081
ctactggagcaatgacgacagctccgccgcgaccgggaccggccgcggcggcggcggttcacctcgccgaccacctcgagtccgcggctttcgcgccaccccctccccctccgccgcaggcctcccccaccacaatcctcaccgcgtggtcgcgcctccgggacccttccacctcccccgccgacgccctcggcgcgctacagacgctccaccaccaccgccgcgctctccgcctctaccccgcgcacgcctcgctcctgctcccgcttctcccgctacacccccgcctcgtcgccccgctgctcgccgcggtcccgcacctcgtccccgcctccgtcccggccttcctccccttcgcacctcgcctcctcctcctcggcgcccgtgcctccgccaaggatctccccggccatgccagcttcgggaaacccgcttctaccgcgaagaatcccg

SEQ ID NO: 26920 - DNA, 157 bp, Sorghum bicolor
  Clone ID: 30980083
tccccggcgctcgtactgcccgcctcgaggtcccgatcgcccgattccttcaatgccgaagatgttccgatgtttacaaacagagtttctcgtaagtaccgggcgaaaccagtcgcagttccagatcatggagttgatgtgtgtcctttggaataca

SEQ ID NO: 26921 - DNA, 708 bp, Sorghum bicolor
  Clone ID: 30980092
agctgctactccctcctcctctcatctctcagccgccgcacatctctctcgtgcgtgcggactctgtcctatcgagggtctcgtctgagggcacggcacggccctctagcgacattgcagacccaaggcgtcggctcgtacctcaggctgcggtagcagcccgatcggtaggttcccctccctcttgatgtggacttgatttcgatctccatggtgtagatccagtggaggagaagatctacggatgatgtggcgccatggaccaaggactccatctgctggtaggttcttgctttggagaatgagggaggacgagtaggtctagagatttggctttgattgaactattaatatctagtgcggcctcatggtcttcttgattcagaagcccgaacaagcaatagaaatccggatagcaaactgtgaattctggatagttgagtttagttgctacctggattatgttgtgtcacatgtggacaaatgtaaaatctggttgttccttcacgtttgaaatatagttgcctcatgatttattgagataaatgaggtggaatgcacaaactttatctgtaagttcagtagaactgtatacatgtccgtagctgattaactgctattatcctctctgtattgaatctaatatgctgctaagtatgctaatttctgtcagccacattactttattgtaactttctgcattatttt

SEQ ID NO: 26922 - DNA, 676 bp, Sorghum bicolor
  Clone ID: 30980094
gcctactgaattcctccgtctgtcccctcgcaaacccaatggcgtcgcggtcgcgcgatgacgattccgcgcatccaccgccgaagcggccccggcgcgatgccgaagcggaggcggacgccgcggagccatcgccgcgcgtggtgctcaacccggcagactgcgatctcgacttcgatgtcgacggtggcggtctccgggggagcgcgctgcacgagggcgggttcgcctactgctggtccggcgcgcgcgcgacggttggcgccaggggcggcgggcggtactgcttcgggtgcagaatcgtcgccgagcagccggtggagatggacctcacgacccccgaggagcgccacctctgccgcattggggtctcgagaggggatgatcccgtaggggtgctcggggagtcccagcacagcttcgggtttgggggcacggggaagttctcccaccagcgcaggttcgtcaactacggcgtcaagttcggggtcggggacacggtcgtctgcgccgtggacctcgattccaagcccatggcgtcgatcgggttcgcgaggaacggtgaatggcttggtatcgtgaggcattttgatgcgagtgagaaagggcttggtctggttgatgctcctctgaggccgatgcagtggggatccgcactctttccccatgtcctgct

SEQ ID NO: 26923 - DNA, 286 bp, Sorghum bicolor
  Clone ID: 30980100
ataaaccagacaaagaagagtctgcagcttgtgaaagtcaggcgacaccagatggcagcgacgtatgcctcatttgatttccctttgctcctggagaagcctcagagaaggttcacaaggtcgttgctcaagacaaaggttgagagcagtttggttggatccaacgatgcgctggacagtgcatctgactcccctccatcagtgaagaatatggagatgaagatgtcaaagaaagttgcatgcctcacgaagcaccctggaaacattacggagctgcttaacacag

SEQ ID NO: 26924 - DNA, 559 bp, Sorghum bicolor
  Clone ID: 30980112
tactggacagagagagaaaacgaaacgccgttgcctcgcctcctccccctctccctccctccctggtgcccgtcacgttcacctcgctcgcccgctcgttcgccggcggcgtcgcttcccagctcggcctcccgctgtccgccgcccgcggaggccaggccccccccggggccgcccgctcggtccgccgcggaggcaaggctatgagttgggaaggtctgaagtttactatctgttcggtattagcaaggacgtgaagtgaaagtatcatattcaaagtgtttgtcgtgattccaagcagttttctttttctgttgtggattttaaccacaaaactgaaactcgaagaaatcttaggaattagatcttttatagtacttgacagaaaaatctcttccagacatggtggtgtctttagacaatgtgaggggcttaactttggccatgtcatctagtgcattcattggttctagctttgtgatcaagaaagttggattgaagaaggctggggataatggaaggcgtgcagcttctggaggtttctcatatctatatgagc

SEQ ID NO: 26925 - DNA, 528 bp, Sorghum bicolor
  unsure (1)..(528): unsure at all n locations
  Clone ID: 30980121
gagctcgatagctgaacaagtaaagcagcagcaggagcagctagatagtaagatagtgatcctccatgggcaacacctgcggctttggccaaatccttggcctctgtagtggcctctgcgccgacgtcgacgtcgccgatctgatgcaggctgctggttcaaacattggacacctgaggagcagtggggtacttgccaacagagtggtgggttctcagtatcaattcaacaccgaggacattgacgagtcgtctgccgaggagctgcgcgacgccaagagctatgcgaaggacaacgcaatgctgatccaggtgcaggtttcaggaacagcaacgaagacattctggcgattatctgacgaagccacaaggatcagtagaaaacttgcactgatactggggaaccaccactcagcctgcaagtgcctcagtgatcctctgcaggtgtccaacgtctgggntgggagcactgggaatgtcaagctaaggggggcaaaattcaccgacaaaggcttcagcatagagcgtg

SEQ ID NO: 26926 - DNA, 875 bp, Sorghum bicolor
  Clone ID: 3421473
gatcagtaccaaaactggcagcacaatgcccctccaccaccacctgaccatgtaatcaagattagttcacatcctacccctccacctcccccgcttaatgtacatagcagtggctccgcttcgaatcactcaggtggtgagagccgccctccgctgtcacctggaactgtccttagcttttcaaggagtacattcacttatgagcagctgatgacggcaaccaatgggttttctgatgctaatctgctgggccaaggcggttttgggtttgttcacaaaggagtgcttccaaatggcacagaggttgccgtgaagcaattaagagatggaagtggccagggagagcgtgagttccaggcagaggttgagattatcagcagagtacatcacaagcatcttgtctcgttggtcggctattgcatttctggagccaacaggctgcttgtctacgagtttgttccaaacaatacattggaattccacttacatggtatgttctcttcctgtgtctgcaccgtaattacttcatctcgttcaaaatgctttgtatgatctctcaaaggcaccttagaaaatatgtaatattgttttccatatttagcagccacatatgtcgtagctaatacatgtatcgtcatacactaaagtatcctagtaaaaagtacagatgatttgcaacggaaaacttgtgaaatcaaggtacacatatacaccaattgttgaatatttttgtcgttccatttcactgaagcaaggtaagacatatactaaggatatgtttttcgttgctcagaataattgattactataggaatttgatttgttgaagtgcactatagcgacctgcctctcctatgttttcaagaattcgtcaa

SEQ ID NO: 26927 - DNA, 528 bp, Sorghum bicolor
  Clone ID: 6672290
gtgtggcgaggctttccgatacaaaaaagaccttatccgtcatcaagcgtcaaaacatcatgagatcgtgccacacctccctatttggtactgttcctactcgaactgcaaattctctcgtgaacgagggtcgggttttgcaagaagagacaattgcaacagacatatccagactcaacatggcgggtgcatctcaggtccataagagagcgagcgggcttgtaactgccattaatgtactggtgctgccccaaactgattaccttcatcatatctaaatcgtgtgcgtgtatgtacggtatattgtgtttgcgaagctgtatcctcttgtttgctgtgccatcccgcctgatttatttgaagagcgaaaggactcgtgggacttgggcatgctattttttgtcggtcgacggcggcgtcagaggatgcctcgcgatgctcgaaggcggtatggtcttctagtttcgtgtcacggaggcctgcaatgttgtacatgcaccagatccagaattggactgtttactttct

SEQ ID NO: 26928 - DNA, 413 bp, Sorghum bicolor
  Clone ID: 6672303
acaacacctcaatcaaatgactcacattggacgataatatttttttccatgtattccaggaactatccccagttttgttcactctgatgaagagtaccgagcctttccttgacgagtactacatgttggatttggaggagacaatgagaaaagtcggctttgttaacgtttgctccatcctgacagaccccaggcacagaacagtcactgcaaccgtgccttactaattgggtcagaccttcaaatcccaaacccggccggtacacaacaattgactatttaaaattttgtatgcttactgagatggttgcatttgtataaagttgaatatattctgcatgtctgttcacgcagtgaacaaccaaccaaagtacaccaacttatgaagtccaacactgcgactgatatgatca

SEQ ID NO: 26929 - DNA, 433 bp, Sorghum bicolor
  Clone ID: 6672306
cgcacctaaaggccaagactgtggcagctacatgaaggatttcttcgccaacggaggtccaggttatcttgtcaataatgctacgagtgtatgcgagtattgcgcgtacaaggttggagaccaatttttcgagccactcggacttgagttcaggcatcgctggagggatcttggtatcctggctgctttcatcgggtctacgctcgctattctgttcttggctgctcgtttcctcaactttaatcgccgatgaggaacctaacctcgtagttgtacggtaccttctctcccgttgtattaccacgttctagatttttgccttggcgcgtaaacatagatgagccgcgcttccatagcttcttcggaagatcattgcataatacaccgtacgagcattctagttttgggatagtgtaatgaagacgtcactgct

SEQ ID NO: 26930 - DNA, 502 bp, Sorghum bicolor
  Clone ID: 6672308
ctggagggaatgtctgtatttcccagacgaacttgtcttgtcccgagaatcggagggtttgattcgaagcttcctttgcgatgctgagcatcgtattggtaacgaaggtggccaacacggcggtgctactcaaatcaaaaatcaccctttcttccgcggtgtggtctgggaccagttacgcaacattcgtgcaccattcgagcccagacttagctccaatatcgatgtgtcttacttccccattgatgagattcctcaagaagacacaagcgcagcgcacagagcacaggttcgcgcaatgcccgaggagcaggaggctgaaatgagtcttcctttcattggctatacctataaagccttcaatgcgtttcaggtgaactaaatccaacacatctataacacaggatttccgtgttacagatggcatatcttgtacctgcattgagagctttggttatattgacacgaacaaaatccaacttgaagaaagtttttattcctt

SEQ ID NO: 26931 - DNA, 427 bp, Sorghum bicolor
  Clone ID: 6672310
tgatgacgacccagagaagaacatgccgccgcctccaccacccgcttacggtctctggcgtagtagcgtccgcgtagatccaaatcttctccactggcagcgtgtagatgccgtatctgaacgcggcagtgcaatgtcgcaccaaacacaatcacgtgccggctctgtaacagaacaaattccgcccgtgccctcacgtgcacattctgccgtagcagagggcccccgacccccgtcctacgtctccgaagacggcatcagttacgtggtcgaagccgcaccccgctccactgtcaatcgcgacagccatacaggatatagtgaaatacatcctgcgtggcgcccagggtacgccatgagtgaaatcagaggcggagagttgcccgcgattgggaactaccagagatgaagcaacaacaaaacatga

SEQ ID NO: 26932 - DNA, 529 bp, Sorghum bicolor
  Clone ID: 6672331
gcatttagctctaacattatgctgcatggttgttatatcatcgtggagtatagcaggttgcttggtttaggtgtactccaacagaaatttctccttgctctctgagaacttgtaaagaaaatattagaaagttgggatttggggataggatgttctggtggattattgcagtagcggcatctcacaggatcgtcgcttggaatgcctcgatggattgtagctcccagtttccagtaggcggtagtgggggactgatcaggtttattgtatcccaaaggtcaattggtcaagtagcaaatcaccgcatcatatataggcagtgttgtttggattctttatccctcctatgtattttgttaccaggtttatttatttttactaagcagtacgtttttgtttcatgtatgtgcacgcctatttgtttgatgaaatgtcttgctaatgcaactactggatgcactattacatttatttcaaaaaatagtaggccccactgatgaacataaccaaataattttgtttgggattt

SEQ ID NO: 26933 - DNA, 449 bp, Sorghum bicolor
  Clone ID: 6672334
atgatagaggcccggatgtagtgtttgactgcgcgggtgtaccggaaagtctcaatacagcgtgtcaggctgtgcggcccaggggtactgttgtcaatgtggcgatttgggagaaggaagtcccatttaacccaaatctgctggtgttcaaggagtcaaagtacacagctgtactggggtaccggagagaagattttcaagcagtggtggatttgttggctgagggcaagttgaaacccagtaagatgattacgagaaagattcagctggatgatctggtagaaggtggtattaaggctcttattcccgataaggagaatcaagttaagattttggtggaggtaggagcggcaatggggcgtgtggactcggccatacattgagggtgtttgttttctcctagatagtcagttgttcatcttttttgtcaacaagtcccagtactttgt

SEQ ID NO: 26934 - DNA, 507 bp, Sorghum bicolor
  Clone ID: 6672337
ggagcgaagttgctagtgtcgtaagtggagatgaaatgggagcgcatcattaaaagagaaagaaaaattagccaaggcgttctacaagagagaaagggacattacaaagctttctactgatattcggataacattattttgcaagtttagggtattgggtacaatttggttcaaggcaatgggatatggcgtatttcatcatcatcaacatcatcacttttgctttccctgtttttttctttttccacttgacacatgtctatgggttgattaataaggcaacgtttggaatggtataacaggactttgatatagctaatgttgctataaagttttgctgcaagacattggggaaaaaaagactagatttgcattcctatctctatcctgtcgggccgtcgaccatcgtacctcttttctatcgttctttatccaatcaataccccccctctataaatagtcctttttcctactagaataatctcttaaaattaaaccagattgata

SEQ ID NO: 26935 - DNA, 444 bp, Sorghum bicolor
  Clone ID: 6672365
tggccagcactgcctgtgactcagtgcaggcagtcccagttgcaccaccaagccattttatttgccctatactcaagagggtaatgcagaatccatgcatcgcatctgacgggtactcatacgagcgggttgcgattgagatgtggcttcatgagaatgatgtgtcaccattgacgaagacacggcttcctgacaagaacttggtgcccaatcatgctctgctatgcctgatcaattgttggaagggagaagcaggagctactgggctcatttgctgagctttactacccacggatatcgcattagaagctgattctgtacaggtttgtcttgataacctccatttactgtagataccgtggtcaagtgagttctctgtaagtagcagttttgcagcatctcttagacagtactacaatgtgatagatcccgaaggttacttct

SEQ ID NO: 26936 - DNA, 518 bp, Sorghum bicolor
  Clone ID: 6672383
aatactctgatgatgattttgaaaatgaagatatgaatgaagaagttgaagaatatgatatgtttgatcgtcgtgataattctgaaaatcgccgacgtgaaaatgttgatgatgatgaagttcaagaaccaattatgaaaacaaaagttatggaatacaaccataagatttgtttctctcttaaaccagtaaaagaatgtccacgtggaacaacaatggaaaaagcagaagatatcaagattccattcacatgcaaagatcgttcatctacagaagttcgacgtcttcttcgtgaagcaaaatccaaggatatcactcaacaacttgaattcaataaaccaagctttgttgaaactgttcgctcagctcgcatttgtgtttaacttcgtcgaagctaacaaatatcctcccctccccccaaatttaacattgtgcccccgttttttcagaaacaatgtttttaactcaaattgtagttcgtttgtgttaaatagtagtgaataaattttgcaaatgtc

SEQ ID NO: 26937 - DNA, 270 bp, Sorghum bicolor
  Clone ID: 6672387
tccccggatccaacgcagcattgtcccttgcgtttccttttgttttgactcgacagaatcacattttgtcggtcgttgtaatgttcatggaaaccaaaggttgtctgtctttgaaccccccgactttctttttctttttctttttacacaagggcttttgtactcccaatcggtttttgtttgtatggcttttttttgatcgggggaagaaaaatggaggttgggggagggatggataaggtgtaaaagtttcaatggtatggtgatttc

SEQ ID NO: 26938 - DNA, 560 bp, Sorghum bicolor
  Clone ID: 6672397
gcatttccttcatcgtatttttctttgctttcttttaatttgcacggacgtttgctctggtcttttgagtctgctcctacctgtcggagatagcttctggggaggcatttcaggagttgtgttgctggtaaagctagtctcaacaccatgtcgcgaacgacaagcctgttacggatagcagcccacgttggccgaggatcgtggtgcagtggcagatggaacagtgggagttaccggcctacgtcaaggtcagctccggtatcctactggtcgacttggtggatggaatcaggagcttcattggggcgaacaagttgacacaagttgctacaaccttcaaagacactgcgttggcgcggcagctgacatgacactcccatcatgaagcccaaggtctggaaatcgggtattgacgaaacttcccagcaaaggacacatggttgatgagccaacattctcaactgccgggttgagcagccctgcatcttgcgtacatccatccacccctcattcatttcttgatcgcacattaggtagtctacaaattcattctgttttgg

SEQ ID NO: 26939 - DNA, 234 bp, Sorghum bicolor
  Clone ID: 6672398
agaatggacgctgggagcccaagattacgctgcctgcggatccggagcaggcgatcgcccccgcccaggcattcatttggcctgctgctcccgcgcaagccgctcctcagtagtagatatattcccgaaattctcacgaggattggagggggaccatttactcagcgttcagagtgtaccccatgtattaaccagatcatgcagtattttgctaattaagttcgttatgcttct

SEQ ID NO: 26940 - DNA, 548 bp, Sorghum bicolor
  Clone ID: 6672402
cagcattcccagatatcacgagtatatcgttcaagggaatccatgggcggggtgttcgggtgcctgtccgtgctcatggcagcgatgtcatccccatcagggacatcagcttccaggacatgtcggtaggcatcggctacaagaagaagcacatcttccagtgctcctacgttgaggggcgcgtcgtcaggcccgtgttcccgaaaccatgtgagaacctggacatctatgacgagcaagggcagcttgtcaagcgggcagtggccctgaacagcacagaacttgactacgatatatgaggcgcataccataccacagcattgacagttggagtagtggaaattggtgctctctaccctcagaaatcaattttctccaattctccaggtttttttgatctagaattgtaaatagaggagattctcctcttgataggtttgctgcttacagtggctgattgtatctcaccgctcaccggtgatttggccatggacatttcgcatcgccagaaccttcctggcgacaaatgcatgctgtcaatatattgt

SEQ ID NO: 26941 - DNA, 469 bp, Sorghum bicolor
  Clone ID: 6672409
aagccattcttcaagtcatggtacatgcagatttcgaatatacaaggccaattgtcatcatcatgccaaacacaaaattcctgcaggacaagtcccgggagcttggctttagtgatgatgatagtaccttgagcagcgaaagaatgtcagcatatgtcctcgacgatctccaggatatagccaggcggtccggcttatccaagattgaaacagtaaccggagttgttataacggatattgaatggaccccacagagtggactagtcactccgacgatgaagcttaaccggaggttcatcttgaactactttagagatgaagtggaaaagtgtatgcaaagcattggatgaattaacgggttcggttgagagggtggtatagagatcttcaggatgaggttcagatgataatgagtgcgtcagtcgtcgtcatcaacaccatcattataacagaaagcaaatcaatctca

SEQ ID NO: 26942 - DNA, 471 bp, Sorghum bicolor
  Clone ID: 6672419
agacttcacagaagaggaggtacattcactgaaagcagcaggtgcggctcctgtcggtcttggtccatgcaggctacgagttgagacagccacaatatccctcctatctgctctcatgttatggtcagatgctaaagaccagtaaagagtcaagacagcaatgcaggtaatcaaacggcagtcgtcagtcatctttgtggtataatagtgtcctctttcaggtgactacgacaaaacacctttcaggatctagttggactcagcgtgttcatgggtaattattccattggatcttggtacacatttcgtgaacatctaggtcttgggcttgaccagcatggaggatgaacaactcaatacatgtttgagttacgttatattcatgtgttggttaaataacatttttgtatcgacaacctacaactcctctcaccttcacttttgatgtaaaacattaaaaacacttcagtc

SEQ ID NO: 26943 - DNA, 432 bp, Sorghum bicolor
  Clone ID: 6672450
agctcattacaaatgccatcagtgtttgttggcctcggtagctagcctcgcgtgcgtgtccctgcattatcacgcactttgcacttttaattccacaaagtagcatggcaaagtgcccttaattatactccagctagcggcagcgctcatgatgagcgccgcgctaagccgtattgtagtgccctaacccatctgcttttttatcctgtcgatcatcagctgacattacgggtttattcagtaggtacaagctactctataagtacgtatccatgcgcatggccacttgcccagacccaatcagtagcctgctgcagggcatcctaatccacccatgccgcacacttgggcccgttctaaacatgcaaggtcgcaaggagcatgcatgcatgctcagacgacagtcagacctcagagctagatgcccatcgt

SEQ ID NO: 26944 - DNA, 512 bp, Sorghum bicolor
  Clone ID: 6672474
ggacaagcactcgggcactattgtcctgtcggccaactccaaagtccgcatcgaggtgtggaagttcgtgcgtgaccactgggactcggacattttccccaccctgtccggcaacaaggtcgtcctggagcgcttcctccggtttggtctgaacaagtttgcggaagagagcgtcgcggatgagattaaaaagttcttcgagggcaaggatactaggggatataacaagggattggaggtgattgatgataccattcgcagtcatgcgaagtatcggaccagggatgagcaggtggtgagggagtggttgaaggctagcggctatcttggatgaccggagataggggcgaggttgtaggtggtcgggacgccgctaccttttcaaacgtgggtgcatgcatgcatgattatgggatgaggaaagtctccctgcatcaaaatacatttgatacagcatttagtaaagtttgattcaattgcattgtataatcaatggtatcatttctcctctt

SEQ ID NO: 26945 - DNA, 523 bp, Sorghum bicolor
  Clone ID: 6672476
ccagctctcaacttcagatgatcagcacactgtatctgagtcttatctaattaaccctggaagatggatcctttaccacgtcggtgatttcgtcatatcgagttctgacgaggtgacagaactcaagttctctatgatgcagattgattgtacgcatacaaaaggcggcctgtgtgttgattcagtctatatataccccaaagatcttgaatttgaggaggactgcgtattctgccagcaaattttgtaggggtgcttgaattcgttggctagcctatttcttcttctcgggtcattcttgtccaaaagggtagcgtgcatattcgttttctcagagttttgcatgaacaatttatttatttttgtaagggcttattctgtatttacattttgtagtcttaagtcaaataagtagggaggtcaggatgtagatgtaggtatagcgatgtatgattggagcgcttgacacgcgagtgtagaaacagatgcttcattatatgtatagagatcttgtgtttataca

SEQ ID NO: 26946 - DNA, 393 bp, Sorghum bicolor
  Clone ID: 6672484
acaagaacaaagaggtgttgcaaatggcatctcgatgactctaatgtcattgttcaaaggtgtagctccggcggcggcaggaattttgttttcatgggcccagaagcacatgaatggtgggctattcttaccaggtgaccagatcatgtttctgacgataaacatggtttccatacttgggctaattctgacgttcaagccatttttctccatgtcaaatgcgttgaggcgttcctagctatgtatacttagttgccacttatgggataaatcaggggcacttcctcgggtctaaaactgtgatagtctacgtgatacatgggtctgtaattatcaccaaatttctagatatgtaatcaaagtgaaggggctatctaaattttttgggggtgt

SEQ ID NO: 26947 - DNA, 126 bp, Sorghum bicolor
  Clone ID: 6672491
cagttctggggatgtgtggtggcttgaggccattacgagttatggcttataatgcataatggggtcgggatggcgttgtccttccgtagatttagttatgataaccaatgaatccatgggtcggcc

SEQ ID NO: 26948 - DNA, 400 bp, Sorghum bicolor
  Clone ID: 6672496
ggagggcggaaagaggaaagaggacagaggataacgagggcaaataaacaagccgtggggcagcaagccgcagcaaaggccaaaagtcttggtgaggaggcaattgaccgcgctgccaacggcggcagtgcaaaacagcaaccacacaagccgcagaagccaggggatgccgagagtcccgaggagaggagggggatgcttgcggtgaagctcgcaagcaaaccgcaggccttgcatgttgtttgtgggtaactgcagctcaggaggctgccatggtgttaagttgggtggcttgagtccgagactgtgagcaatcaggtatatatacgactagccgcttaagtgagcctggatgtctcttggagcgtgcaactgagattgctctgctccatttcctttc

SEQ ID NO: 26949 - DNA, 410 bp, Sorghum bicolor
  Clone ID: 6672498
catccgcgtccaccagaccctcgccacgaacatagctgggtccaccgaccaccctatctggacctaccagccccgtacccgcctcatctacatgcacgtcgacggcagcacgtggaagtgggccaccaacaaggccaaccacgaggagagcaccttcaacatgcgctacgtcgtcgtcgacatcgacctcaacgtgaacaggtggctggccgcgaagccccagctcgaggcaatcttcaagcaggtcaccggcgctacctttaagcagtacggcaagatcaagttcccagcccccattgaccctggtgcccagtaggtctagttgacgggaggcgctgtgtctggaaggttagctgtagctagttctggatatacatgtcagtaaaactggaaagggtactttcagagtt

SEQ ID NO: 26950 - DNA, 393 bp, Sorghum bicolor
  Clone ID: 6672499
catggccgcttttcttgccggcagcacaaagaaggaggacagcggcagctcaaatggcaacgggggaagctccgccaagtcagacaagaagaggaagtgaaacgcttgaacagaagggacggtgttacttggcagtgaaggggcagtagaagtgaaaggtcatattcgagcttctagccggctgcgaccggcagtatgcggctgttgtcaggatattatgtattgctctccagctaccaaggtgtgccatgcctactgcacgtattcagatacaagcaggcatatgctgggcaccttcaaacgcgagtcttcgtaaagtcggctgcgagaggtgtctgctcttcgcttatgtacaccaaaaactatgttgctgccttcagcaacacccaccgg

SEQ ID NO: 26951 - DNA, 408 bp, Sorghum bicolor
  Clone ID: 6672514
ggcccacagacattttacgagcagagctgtgaggctacaaatgagattgtctttggcgcagtccaggaggtggacagcaagcggcgcatggtcgagatcaaggctgtgaactatggagacacattctatgagcagtacgggatgcgctaccgcaacaatttcatcggctacaacaacaataataactattgaacagcccatctattttaattttccctgcctctttttttttttgttttgcccgtcttagttacatggttagatttactggtcgtctccttatttccaatcctccatattccctgtaacaaaaaaatagaaggtggaggcagcagaagctatcacctgttttaacttgtacaatggggaaactgggttttggaagtacatcgtgatcatatcttcctt

SEQ ID NO: 26952 - DNA, 536 bp, Sorghum bicolor
  Clone ID: 6672521
atcctttcgaaaatatatgctttatgttttcgacatgcgggaaaaaatgctcatcatgattaaccctagacctcttgaagagtggtgtaaagacacaccagcgcttatgtatgccaaatacactcttggacttagctacaactacatggccgcatttaataaacatattcctggatgagatgaggatgttttcaaatggaaatttaaacggacagaaaacattgcagatgatatagataggtacttaagtagatttctcatcctacaatatatgtctacatggaatagaccaaaagccacgcatatttatacagatggtacggagatgcggcgaaatttatttgtggatttactggcacacgaaagaaatagatatcggacatatcttcttgtcgatataaacattatctttgtcgtatcacggaaagatctataaagtagagtttgtaagcctataacgtcgtgctcttcataactatgtttgatttcacgaactttgtttctttaagtcaaatgtaactttatagttggtattt

SEQ ID NO: 26953 - DNA, 312 bp, Sorghum bicolor
  Clone ID: 6672535
acagatgcagaaatcgactatgtcctcaaagctgtccaggagcgcgtaacgttcttgcgagagcttagcccgctttgggaattggttcaagagggtgttgacttgaacacaattgaatggagtcaacactagagaaactggctttggtgtaatctgtatattaagacggccgatcattacttttggcagtacttttgaggccacgctcactgaggcgttaacgattggtacgatttatgttctatgtactatactactattgctctgcacatatttgctctgagctgtcaatctgatacttcttgatccccc

SEQ ID NO: 26954 - DNA, 425 bp, Sorghum bicolor
  Clone ID: 6672549
aaataacgttaatgatgctttctcacctgttgccacttggctccgtcaaaacaaccgccaagctatcctgactgagacaggcggcggtaacactcaatcatgcattcaatacctttgccaacagttccaatatataaaccaaaactccgacgtctaccttggctacgttggatggggtgcaggctcattcgatagcacttatatccttacagagaccccaacaggtagcggaagctcgtggactgatacgtctcttgtaagctcatgccttgcccggaaatagcgttgaaccattgagtccagtcgcaaaagcttttacattctcgtttattcttctggttgaacatagttgttatttcatggtctttctgtatttatcatatttttcacatgttttcattaaaattgtagagaatttcttgtcc

SEQ ID NO: 26955 - DNA, 565 bp, Sorghum bicolor
  Clone ID: 6672556
caaatgatgattgatgttgagatggatgtacttaatgtctttgattatcaaccagtcaatcaaccatttcaagcaagtgatctacaaatcatcaagtatttagctcgttatgataatataccatcaatcaaacgattattaattcaatcctatcaacaactctatcaaatcaatcaatcaatcaatcaaccaaacttagtgattcgtttacatgtacagtgtcatagtccagctgcctatgtcatctttgagagtcccgttgatggtcattgggatgataatggattcttatgtacaccacaaacaagtggtcgatatttaacgttttatccaacggatcgaacaattgatcataattattttcgaaccacgttgaattattatagtgtttgggacacctataatcgggattgattgattgattgactgattcattaaattatcttatcgatcagttgattgaaaattgattgatcgattgttgctctgcttcattgaatcactgtgtgacaatggttgtgaggcaggtaagtacgtaaagtgtttatagataaaatgtgtattg

SEQ ID NO: 26956 - DNA, 515 bp, Sorghum bicolor
  Clone ID: 6672557
catggaagggtgggcgcgagattgcagaggtttcaaggccaaacaccaaagagccaccgattatgattgtatccgatggcacagttttctgatcgttcattacaaatctcgggcatattcttttcgaatatgacgagcctttatacttcgattctgttcttcgtctcgacttttcacttcaccttttgctcaatacagaacgtctttgattgatgatgataccaatggttaaatgagtttccctatcacgacggcaaagaccataacttgattgcgatgcaatctacgcattgcatgactacatcttatctaccagcataataatatcagaaaatcgataccatcgacgcatcgacttcctttcttgacagacgacgcagtctgtctaatttttcgcttcttacaacccctttgtttacttctttgcacgccttttgggtccccggtgtgatatatatttgagcttatatttatttatattcggattgtagagaatattaccttatttcttctct

SEQ ID NO: 26957 - DNA, 485 bp, Sorghum bicolor
  Clone ID: 6672579
tcggcctccctgccggcgcccagctcagcgcccccgtcttcgacaccgtcatccgcatgatcaccatcaagggcagctacgtcggcaaccgtgctgatactgctgaggcgctcgacttcttccgccgtggtctcatcaccgtgcccttcaagactattggcctgagccagctacaggaggtgtacactctgatgcacgacggcaagattgccggccgtatcgtcgttgaccctacgaaataagtggacaagagtaagcgatacacgataatacgctcttctccattcataacttttaaagatgaagaaaaaagtaaaacaaaagtgattggtttagatatctgggcgaatataggcgggtgggttagcggcgagtatgggcggttgcatgggctatttcgatatacaggatggcggagcgttgtgagatgtaaagtatgattatgacgagcttcttttttttagttaattgatgagacatgatcc

SEQ ID NO: 26958 - DNA, 461 bp, Sorghum bicolor
  Clone ID: 6672601
ataaagaagatgacactgccacacttgaaggacacgaccgcggctttccccagcttcgttttcaatacacaagtcgaagactagggcgatggacagttgattgtacagtgggtttgtggcaacagaagatggagatgaacagtcggcaaagaaagaaacgggagctctgaaaacgtatgctgctcttgatagcagcagcgtggtgctccgctggcctgccccgtcttcagtccagacagattgatgcgcaagcaaagctgcttctcccaagagtcagcttcatattcaatcacgtattggcaatgttgtgacttgagtaaatcttacagcgacttctagaggcattccatttattggataggggtacaatcgtacataattttttttctctcaacttgcagtcgcgtattgtttagtgctccagtattttatcaaggcaagaagtactttcagttgccgtc

SEQ ID NO: 26959 - DNA, 507 bp, Sorghum bicolor
  Clone ID: 6672611
tagcatgtgcatcagatgtgcaaggaaaatatttaatgtggtggatgatgaccctgccccaagagctgaggtttttgcgtttgctaggagtttgatacagaggagatatcctgatctgataactgaaatcattgatgccaactctacaggcttggattatcaagaaataattatacctgcagagaaacgggtttctaatgctcggatgaagcaggaacttggtattaatctgcttcatccaacttatagatctggcctgcagagtatcattgatgcttggcaaattcaatctcaacttcccaatataagtcagtgatgttttagttttggaaagccatggctgaaaatatattgctgcctgtcagaaaaagtacggcttataagacaagcgaatgaagtagtgcatatgtccttgatttggttcagatgtaataatctagtggatatagacaccctatacacgttgtagcttttttgcagagttggtctggtgctcttgttatttct

SEQ ID NO: 26960 - DNA, 473 bp, Sorghum bicolor
  Clone ID: 6672613
ggtgaaaaacgtgcaaaaaatactggtaattctgactcatctgataatgaaaccccctcaaaagatgatgaaaaatgggcacaagaaatcgaaaaaagaattcaagctgataaagaacgtggtcataaaacagaagaacaagaagcccaagctaatgaaccttcctcaactgaatctgatgaagaagctgatgatcaaaccgaaagtgatggcgaaattgaagacacccaagcaatttaaagctccaaatttatcaaatcttatttcaacatttcataaatttaattgtttagaattattatttcaactttaattgaaatataggtttattttcaaaagtatttttatttttttattttttaaaataactttcaaaagtaattaaaatatattataaaatttattttaaaatttaatttttaagttttttatacttatttaaaatttttgatttaatttaaataaattttttt

SEQ ID NO: 26961 - DNA, 439 bp, Sorghum bicolor
  Clone ID: 6672618
caatatgatatacaaagctgcagaatgcctctcccttcccttccgtcttcatcacattacagtcccagtatcctccaattcttattggcttttcgtcacgttcgtcaaagaacaaattgctacccgctcttgcgcctgtcctcaagaccaatcccagacccgttgactcaaagcaaagtcgatttcgtagagatggtagaaggctagacgtgtcgagatatcctaacagagttggggcatagtcgttgagggaaaattctccgttccactttcatgacaaaggggccttggatatccccagtacgccgctttagctgaagtactccagggaaaatagaagagtaaatcgcaggtaatcatcgccgacaaaggaaaatgtttgatgtgcgtgatcatcaaagtgaccgaggtatccaagaaataaaatactccaatcccc

SEQ ID NO: 26962 - DNA, 333 bp, Sorghum bicolor
  Clone ID: 6672640
agttcgtttcatctcatctcagagtgtaaaaaataggaagataaagatgggagttgggaggagacgctgagggcaaggagtggtcgccgttgctcaccttgagccgccgccgccgccgcagcggctcgccctgggaagcgtcggaggatgatggtgcggtgccacactggctgtgtttttggcggtgaaatttgtgtggcggtggtcgtgaggtttcatgccgagctgcgtgttttttcgtctctccgcggccgcgagtctaatttggtggtttggtagctgtgtgagctgcggtccatctatatatatcccacgcagtcaaatctctgcctc

SEQ ID NO: 26963 - DNA, 513 bp, Sorghum bicolor
  Clone ID: 6672649
ggcaatgtctatcatttctcgtgcgtttcattagaatggcgcggcggttcaacaaagggatttacttgatttgctgagtgatggcaagggtggctcgaggagtagatgtcgattccccctcaaaaagaatgttctaaatgaaaaaaagtccctccccgatcatcgaaccacatttgcactgccctcacaagaaggaatttaaaacacaagagaccgacaatcaacaacaccatgatgatgaccgagactttgtgtgtggagactctttcaaacctttgggctttgtgataaggctttgatgaatggatatggatctttttcttcgttgatgggcgttttaagggttctggaagttgatgtctttactcccgttgatcatccaaggacgccagagttcggcggacgggttttatgagtgatggcgatttggaggtgatcttgttacgcttcccaaacggggacagggtctcgcatttgcacaataggagtagaaaaggaaaggctcttgtttga

SEQ ID NO: 26964 - DNA, 559 bp, Sorghum bicolor
  Clone ID: 6672650
acatcaagagtaaatgttatgggggttcgtgcaacggctacccagtcgaccgagccttgttgtgcaaagccgggagatctttgagctggaacgactgatgaattgtcggtcatactgagtgggatgaattcaataggagatggttcacgtcaaactgcagaccatgcaaggtggagcgcataaatagaagtcgaaaatttttgaaaggaaaaatgaaaatgaagaagaaatcgaccagcctgatggcatacggttaggcaggagcacgctgaacagccggatgtcaacaaggctgtcgctatgtgaagttgtatgagctcagcctcgccgtcgggatcttctctttagcgtgacgccttgattgggcatcttcccctcttgaatcctcataatagcctgcttttcttcattggtttttcgggcagattcaagtggtcgatatcagtcttcttttattggccaccattcgtgcaagttcccggcaactgcatgtttggactgtctgtatcctgcgtctctgtattttgctaggtacgagcaggaagaattgagcaccgtc

SEQ ID NO: 26965 - DNA, 388 bp, Sorghum bicolor
  Clone ID: 6672668
tcgctgtccaagccaaccaaatctcctggcaattctacgctggtggtgtcatcaagaagttgtgcggtgacaagctcgaccacggtgtcctcactgtcggttacactaccgtcaacactgatgaagcctggatcgtcaagaactcctggggtgcatcttggggtaacgaaggttacctttacatctccactgacggcactgccaacaagggtgctggtgtctgcggtatcttggcctctgcctcttaccccaccaagtaaggagtattcgggaaaatccgaagatatctctattagatactatggaatattgatatctatctctatacctaatcgccgtatgactctaatatgagatttaaaattaatacttatgaggactagttccg

SEQ ID NO: 26966 - DNA, 457 bp, Sorghum bicolor
  Clone ID: 6672670
cttcctcgagcgcggctgcggcgctgacttcctcatcaacatcctgttgaccatccttggttacattccgggtatcatccacgccctctacattatatttaaattctagccgaggtgcggacgaatctctacgatgccgcccgtaacgacggtgtgactataatgtccaatcacgatacccatttttccttttgttcagcaacgccaaggccttccacctagttcggcggagaagcgtctctcgatacttttctatgctgggttattctcgacatgggcttcgtcgggcgacgcggaccacgacggctgcgtcggttggactttgagcatacgatactgtaatgacctgatttgtacgatggcgtccctgactccctgggttactatttggcttgcttgtagcatcctagagcattccgaggagcgtagtgtaataggaacttaatcgagcatttta

SEQ ID NO: 26967 - DNA, 475 bp, Sorghum bicolor
  Clone ID: 6672677
cgtcgaataagcgtgcggatcccaatcgcgtgtcgttcgttgtgtctgcggccacgcgccccgtcgtcgttattataacagttgatagataatggtttggcgatcgcgccgcgtccggacgttcgtgtgcgcgtggtccagccgtgggctttcatcttcgctttcctctctcgttcctcgctgctgcgtctccgccgtccgctcccctcaagtcttcctccacgttcctcggtcgtctgccgattcgctggcgtctctttcgttggctgcttctaagcggccgcattgagatccagtggcagacaggggaatggaggagatggaagggaaggtaggtggtggtgggtgcagtgtggggaattggatgcgatggacggcgtggagaacttggtcctccctgcggaaaagagtaggtcgtaggataagcctccgcgtagattgtatataaatgcagcgtcccgcactcccccatttc

SEQ ID NO: 26968 - DNA, 527 bp, Sorghum bicolor
  Clone ID: 6672702
aacaagactcccctcgaagcgttccccctggccgtggcgtcctctgcctcggttccggacaaggacgttgtccccgtcgagcaccggtatcccgatggttatcaaggctggactgccgctatccatcacaacccaaaccagaagtggtactacctcagcggcatgacgggtagcgagagactgctgcttgagtgcttcgacagcgaatctctaaagcccgggtccaacatcggtggccgtgttcctcacactgcattccaggacccgagaaccaggactgatgccgagggtcgtgagagtatcgagatccgagccttggtatttggcccctgaacttgttagttactcttgggccaatggctcatggtgatgtggaagggatcatggcatatattatgatgtagcggtttgcagtatgcggaagtttgttttaggacatgggcacacatgtagttgatgaagggcttggtatttctatatctatgtaccgaggccatgaattttgagacctgaatgaaaccaaaacg

SEQ ID NO: 26969 - DNA, 459 bp, Sorghum bicolor
  Clone ID: 6672708
gctgtggaagcacagtgttaaatgctgccatattcattgcatatcacagtgcatgtccaaatgcaattgattatattttttgggatggcttccatcctaccgagaaggcctacaatattgtagtggataagctcattcagcaagcttcaaagtacctgatgatgtgaagaaattgatattgcacgctctacaatagtcttaatgcccccatagaacaacctgacctgtgaccatggttccacattgcaatgccatttgccaaatgtacgaaacatatatattgtgtgccgatcttatacagactaattaatttgtatttttagctcaaaatccttatgaccatgttgtacacagcaatcaccacagatctgtaactagttgtaacaataatcaaaatgcctttatatttagagaaccatccttgggggagaacctaatataaaaagttgccccattccc

SEQ ID NO: 26970 - DNA, 455 bp, Sorghum bicolor
  Clone ID: 6672738
aacaggacgtgctgttcagaatcagccatcaactggatttgcacctatcgtggaacctccggagtcctccgttgctatgctggtctcgatgggctttgatgacaataacgcaaggcaggcactggtgagggcaagaaatgacatcaacgtggcaacgaacatcctactggaagcacaatctcattgaactaacgcactgcaactttcggtggtaaatttgagggaagaactggttatattccaagatgacaaacaatatgagcacattgaactagagatcggtagattagtgcctcatttcatctactttgaactggagttgttcgatacctccttgcaggccgacagtttaggaaatcagcctatacatttgcggcagttagtttgatcgtgtcaatacttagataccttacatacaaagaatgtaatattacaatttcagaggggggcccggt

SEQ ID NO: 26971 - DNA, 440 bp, Sorghum bicolor
  Clone ID: 6672739
gaggagattcaagcttaattcatcacatcttgcctcagtattgcactgcccgaatatacaaggtcattgatcattagtacaagctgaatcttcgactatacagacaggtgtttcagacttccacgttaacttgcttgctgcagatttcccatcccaaatgcatccacatcatcactattcacaaaacaagatgatggggaacctcattcttcatattcaggaagatgtatcctaagcttttctatgccgtgtgctaatattttattacaaccagtttattgtctgcttgcttgtctacaaaatggaacatattgcgtgtgttttattggagtggtttgctaaacctatgttgttcactcagttctgagtcatcaacttgttgtaataaagatttgtatgaactctgaagcagaatctatcatcacgtgccatatattctg

SEQ ID NO: 26972 - DNA, 441 bp, Sorghum bicolor
  Clone ID: 6672767
acttcctacgcttccaagctcagctcttggtacatcgaccagaaggatggcatctcctctcttctcgaagcctgcagtgacgtccctgaggtcagctctcgcatcgctgacctcaaggagactgccaccatttgcgacaaggtcacttgggccaaggagactggctcttcttcctccagtggcgatggttcaagctccaccgccgacaagggcaacgctgctggcgtcaactccattaaggctattggcgtcctcgctgtcgctggtcttgctggtgtcatgatgctgtaaaagcttcacgcttgatgggggaataataacggacaatacccgtgggtgatggcgtcttggcttttcgattcatttggcctggtgtactggtctctagttttactataaaaacactcaatacaagcgttttggctactgtagcctttctgt

SEQ ID NO: 26973 - DNA, 433 bp, Sorghum bicolor
  Clone ID: 6672778
aacggttgccaggcgttgaaggactaccaggacttcgccaagtgcgctgagcagggcgcgcacgcctacgggcacaacggtatcggcagcgtcatgcgcgacgtgtatgcttctcccggtgacccagtcttctggctccaccacggcatggttgaccgtcacttccgcatctggcagaacgccgacagtgcccgcactggctacattgacggcactgctgctggcaacacaccgcttaccatggacacctcgatcgttctgaacaacctcaggcccaacatgaaggttcgcgatgtgatgaacacagtcagctaccccatgtgctacaagtacagctactagacgagacactttcttttgatctcctttccatatagactcaataccattcataccatcttttttctgtcgcgaattctggcgcagcatcttc

SEQ ID NO: 26974 - DNA, 462 bp, Sorghum bicolor
  Clone ID: 6672780
ttgagcgcctgatccacggctgggaagatgtatataacgatgtccaggagtggcggtacaaggatatccccgccgtgtttggcgctgaagagggaagcgtcctgacgtaccgggtccagaccaaggacgagttggagaagctgttccaagacgaagagttttcgagtggtgagaccaacaagatgcgctttgtcgagctcgtcatgccatgggatgatgcgccggccgcgttgaaggcggttgcagcggccgcagcgaagaggaatgcggagtaaatttcttttttcttttcttttccaaaacttcctaatttcttgatgggcctagaataaataggactggagtaatgacggttacgaatgatggactgactctcttctctctctttctttgtacctagtagaaggcatattcacactatgcatatttgggtagaatcctataaaacaatttcttcgtcgt

SEQ ID NO: 26975 - DNA, 477 bp, Sorghum bicolor
  Clone ID: 6672788
gccagtgacggtgtctggcgaggctgctagcagggagctttgagaggagcagaagaaacgttttttttctttggtaatgaagtcacgtctgcatgcatatctatgggagggggcttggaacacgtctgtcatggactctgggagtttgcgagttttgttttttggtgtctgtgttgccactgggggttctttctgtggttggagtcgatggggcggcgttgggcatggcgttgcatggatcgggaccaatgtatgggaaggctggatggggtattccgttcgtccacggtctgatggttaatgactaggatatgttcctcgatgctggaacccatgacgcaacggcttacaggcacgacgttgtgggcgcagaggcggcgcatggctatggtggcttgtagatatgtatacgtgcctgtgtagtacgtgttttttgtgtacacatatacatagatacatgcatacatacatacatct

SEQ ID NO: 26976 - DNA, 338 bp, Sorghum bicolor
  Clone ID: 6672789
cgccgtcgtccggcgtaccagcaaccgcaggaaccggcactggatcgaagacgacgccgacggcgccgtaccttatgtccggcggtgcgtccatccgggggacggtgagcctggtgctagcattcgcggctgtcgccgtttatgccatttcggccgtgtgacaatcttggctcatttagttctgttgccgatggcgtttggggattcagacattcaggatgtgttgtgtcactgtaccgtattggttgagcattgtcaagtataaagaattgggcgtcgcatttgtattattgtttgtatttggttgtcaaaagaagaaagaaaattgttcgttttga

SEQ ID NO: 26977 - DNA, 494 bp, Sorghum bicolor
  Clone ID: 6672790
atccgttgctgcccgcatcaagggcgccatcgagcggatggatgacgagctagtgcggtccgcgattgactacttcgagatggccgagatggacaagagaccagctttgagagggaccttgccaccgacagatatgcatattactagttggttcggtaggccacagtacgatgcagattttgggtggggaaagccgcaattcatgtcgagggcggagtccgtccgtggtggctatgtgcacttgatgaacgatgaggggacaacggatgatggtggtggcagcggcgatgtccgcatgctcgtgtgcatggaggctgtaaatataaaggagctagggcggctgctttatgcaaagctctagcaagctgctagtactgagtactaatcataaggttttgtaacaataataatgttttgtacttaccatataaggttgtatatggttgtatgcagtgagatacttatatgtaaattaagtgctacttgatttgtgt

SEQ ID NO: 26978 - DNA, 231 bp, Sorghum bicolor
  Clone ID: 6672798
gaagacagtttgtctaataatctgggagtttttttttgttttcttgttgatatcattcatcttcatgacgatgcccgacccatgacggaaattacaagcatgtattacggattgcatatgggaatgggtggtggtggtggtagtgttaaaaatgagtaattctgctttttcacccttctcttgtttgggtcagagaagcccaaataggatagaataatccccccctattgt

SEQ ID NO: 26979 - DNA, 588 bp, Sorghum bicolor
  Clone ID: 6672810
gacatgctaatcagcaatcacaggaaagtacttgcttgtgttgtctgcggacgtctaaaaagtgcgttccaaatagcctcacgaagtggaagtgtcgctgatgttcaatatgttgctcatcaggcattacatgcaaatgcattgccggtacttgatacgtgtaagcaatggctcgctcagtacatgtgataccatagatgctgacttgctgagagcgttcttgtgtgaagacagaaaaacaaaataatcaaagcaaggaacataattcttgtctgggtacgaccatctgaaagctgaaggtgttcaatcctcattccccatttcaacatctttccactttgtgtaacacaaggcatccatgtatatatggctcttaagtgcatattcgttatactatcccttgtggagaggttacgcctcttgcatttttggtctctgctatgttgtgaagccttgtaattccattacttccccatccagtgagacgagtttaattgtaagcgcttggcagcccacaaagcagccagtgccaacttctccttgctctcaccgatcattgagaaaattttggtcgattctcttattctc

SEQ ID NO: 26980 - DNA, 320 bp, Sorghum bicolor
  Clone ID: 6672812
ctgaaatagaaaattttggttagggtctctgcagcatctgtttgttgttggcaatagccggtgtgtatgtactgtcagaccagttttgtatcagtcaatattgatgttttcactgctctgatttcctgcaagagccttggtggcgctcctggtcgcagatcctgacaggaagctcattttccctcaggccttgtttagtttccaaatatcaggttctctggtctggaaagcaagattcttgtttctttgaacatctccaggtctcctgctgccttgggccctgtaatctgttggtcatgaattggatcagtttggaggtc

SEQ ID NO: 26981 - DNA, 539 bp, Sorghum bicolor
  Clone ID: 6672822
tcgatctattcgctattgtgtggaactctgaagtggagatccgtgatttactcaaaaacgcattcttgcctgcatggatactcgacgtcattgacagtttctggggatacctcgcctcgaaataccatctttacttcgcggggcatgccctttcaggtgaccctaactaccttatgcatggccgaaatcttcaatgggagccaacagaggatgatggtaaagaattcaccaattccttgagaattggattgacctatgtggatcctagtcatcctttgtacaatattggaagagaccagcagagctccacagaaaactgcgctttctgggatgaagtcgctgctgaaatttcggaaattggcgcaaaggacgccggtacattcgtgggcttcagggaccagagtgatggggtgacatcgttcgagctgtagacgtctaggtagtagcgatcgtgggtctctttcttgtcgtcgccattgtcaacatacatcaatgacgagggactctagtaggattcatctacaatgccactcttacta

SEQ ID NO: 26982 - DNA, 405 bp, Sorghum bicolor
  Clone ID: 6672823
cattctcaacaacttcctgcaccagtaagtggttgttggagtggtatcagtcaatcggatacggaaggctgagtgtacgagagcgggtgtggtattgtacagcttgagatgccaatgagtggttatgaaggtgtgtttgtcctgtgtgttatgtgtcgtgtgatgatcagcaggcttgttgtctgctgatcgagcacgtatggctcgctgtggcttttgtttgtttccatatttttgtagtttttcgttatgtgatgtgtgtacgggtactttgtttgttgctgaattgatgtcgcttccagtgtgagacgagtgtgctttgtctgactttcatgtttcggcatgttgcgtcaggttatcgtgacagaggtgtctcggacgctaacaatataagttcttttccct

SEQ ID NO: 26983 - DNA, 467 bp, Sorghum bicolor
  Clone ID: 6672827
tgtcgagaagggtggttacactgccaagaaggccgccgccaaggaggagcaggagtccgagttccgcatcaccatcccttcgctctctgagcttgaggatgactttgagaaggccaaggagtctgctggccgcaaggctcaccacgtcggtggcaagctccagcacctcgaggctgagattgaggacttcatcgctgaagagatggagtccatgttcgagaaggtcaaggagcgcattgccagccactaaatggcgacatcttcgtaattagcacgcgatccatgtgatctactgctcttcggtacgggaatcaactagggtctggcgtcgggtttgggcatgggtcatatggtttgttatttcattagccacaatttgatgcgctgtacgctatgggaacggattgaatacgaaacgcaaaccgaaacagagtaggatatctgcaatgaatcttgtcatctctccc

SEQ ID NO: 26984 - DNA, 465 bp, Sorghum bicolor
  Clone ID: 6672838
caacagttacattagccgacatcgacacttccctcctcgatccagcgcaagctgcaatactttcacaattgcagctttcatccacaataaccgaagagcagccgtcctcggcctccacgttcacatacacaaccccctcggctctgcaatcgcattttaacaaactcactcaaactctcgagccgaatatcgacctctttgcagacggcgtgcacaagatcgagcaataccgcagtacggcagaacgggtggcggaccgcgtgctaggcaccgcagccaagcgattggaagagagagatagagaaacgaaggaacgagctgggtcggacggacttggtgtgggtgatgtgctgcgtggtctggcgagtgtgctaggggactcgtgagagcgatgctgaagtcgagatgaaactttgcctgttgttgatatgactcaggcggtcgaagaacgagaagtcgtcactg

SEQ ID NO: 26985 - DNA, 482 bp, Sorghum bicolor
  Clone ID: 6672855
gtcgcccgcagacagggcctccaattggaggctgcggcatttcggcaatgctgttgagcggtcttgattcgacagagcacccggccgtgttttttgtgacaggtcgtttgcaaccgaaactgggcttacctgtctggggaactggaaccacgatgcctcgctctctatggcccagatgggagggggatctctctctcgttctttagcctcggggcaccatgcgaacaaagactacgaaatgacgatcacagccatgattttggttcttttttatttgttttattttttgcttcctttgttccgcacaagttcttttgagatacccccatgtttgctaaattatgcacggcgacttttggggcagaaaagacgggtaccgctaggccgcgccgagctgcaagtgacgaatagcttggcctaccagttcatatgcgcgacaggggtcttagccttgggctcttgcaaaaaaaccaagagagagc

SEQ ID NO: 26986 - DNA, 454 bp, Sorghum bicolor
  Clone ID: 6672864
ccttgactcctgggtccgatacgaaggccaggtcaagcagcgacagcagaaggagctcgctcagtccgttatcgcaaaggtccagaaggagcttgagaaccccaaggtccttcagcagatcctccagcagagtgttgctgatgttgagaagatcgttgcctccaaggcccaatagataattacacgccgccgctagagtctcggtccctagattccacggtttttctttgtaccacttctgtgtcataacaacacctgtgcattagccgaatcaatcaagaccctagttacttcactgtcggaaagctgttacccgtgagatcttgggaagttttgggtcgattgttctcaattgggtttgtcggagcttgtaaattgctcgtcgggaaaggtcggaatccgccgatatcgcctattctcggtgtatagcaaatgtccaaaacaaaacatttca

SEQ ID NO: 26987 - DNA, 469 bp, Sorghum bicolor
  Clone ID: 6672880
gagaacaagaggctaaatgaggaggtagcaaaccatgccaagcagctggccgaaattaaggcgttcctccagagtcaaaatggggggggggggctttgttcagtcctcatgcgagtccttctcagtcaaccgtgggttcgaataacccacctcaactgcaagcaggcgaccgatctatgccttcgtcaggccatgccaggcaaattgcttcaccagacgactagtttcccgtcaacctctagtttgctttctcttttcgccgcttgatggacatgtatattggacatattctgcttgtgtgagatatgtttcgtttgatggacatgttatgtttggacatgtcgatgttcgatgaacatattaggttgatgtgatatatatgtgccatattgtgtttgtgatgtcaaatatgtgtcatgtatattgtatgtgatttgtttgtgaacacagaaataaaataaaaaaatta

SEQ ID NO: 26988 - DNA, 429 bp, Sorghum bicolor
  Clone ID: 6672886
ctacgatttgaagaatcgcatctggcacatccaaggctcttgtgcgctcaaaggtgatggcctttatgagggcttgcactggctggcaagcacactgaaggaattgcaagcttcaggccgcctaccctctggagggacatcgttgttctaagaagcaagtctgcctgtaagatccttcggctgatatactagtaataatggatcaagagatttttttttgtgtcatggtctcctggctttgtacaaatacctagggacttgtcagtgatctaacctgtgatatagggaccttgtaaatttcgttgagagttcatacaaagctaaccggtggatgcatttgtcacatgtgagaattgagaagtcaacttccacaatactattattgtaagaatttctgtaaattgaagttggcaaacaaaaatttttctc

SEQ ID NO: 26989 - DNA, 396 bp, Sorghum bicolor
  Clone ID: 6672893
cccgcccatggcggaagtagccgttgggcgtcctaatcatgttggttaggggaggcgtcagcaccggggacgggggagcagggagcccatgtgccgccgcactggcactgctgcaggctgcagcggaggtgcttggcacggcctgatactcctgccgtgccaagcccccagacgtgtcgtggtgctgcgcatgtggggtttcccctgcccaagcatcggcaacggctactagtgcaggacatggctgtcgcctcctggccatcgatctcggccgatctgtaccacgacccattgtactctctagcgattgatttcgtgtaggggcctgcttggcttcctgggatcttgtctttaatctcgtttcaccaaagcaacaacgaccgcgttttttgtgcc

SEQ ID NO: 26990 - DNA, 398 bp, Sorghum bicolor
  Clone ID: 6672954
agatttaagccttgtttgcgagataatgcaattggaggcttttggtgatgatatgcggaacaaatttttgggaggtcatgagaggatcctcgcttggatcgccaacgtgaagaaagccccgagtcctctctttgaacaagcccatgtattccttttcgaagtgaaggcacaaatgcaaagcaaggcccccgtggcagcaaaactgggtgcttccgaggcaagctcaaagcccaaattcgcatcgaagctttgatagattgtgttgagagagaagcgacgagggttcaatatagttagattgaaagaagagtataaactgtgtcccccattttgctgcctaggccctggatttttcctggggttaaaattgatccatcctttcatcctttggcgtggtg

SEQ ID NO: 26991 - DNA, 504 bp, Sorghum bicolor
  Clone ID: 6673057
tcctgaatcttgcaggtggttacttttcccggcagatacctcgtctttttttattatcaccactggcatgcgagcgggacctttgttttatgtatgtgcttgtcgcgcatggggaaggtgggccagatgtcttttttcttattggaggggctgttgaggaggaggatgaggagtggctctcgttccacgctctcctgccaggtctgttggtcactgcagactgacagatgaggaattatcagggagaggtgtcaggaggccgagagaggctctgtgggctggtcacggcgagagcgtttgtgtctgcttgtgtgtgaatatggggtccggctgggggaaccaagtcggtccaggccataaatcttttcgttttttctcttgaagcctcgagaccgttacttagaccatggagatgggacatctattgcgtagggcctgcctgtttaatctcttgattttttgtatatcctgtctatctgttttggtgatgttattgtacgtaca

SEQ ID NO: 26992 - DNA, 374 bp, Sorghum bicolor
  Clone ID: 6673062
tgtctgcggagcttgatgatgagcatgggggctttaccgcggatagcttcaaggtgctgacaaagagtggcagcacaggcatccgatacgcctcggtgtcagagggctagtttgttggttgagcagtactggaactgactccatcccggtgaaccaatatttaccggttgcttattacattctgtccccattaattcagcttgcaggtggatacacctggtgttctacatatacttgattctgagttcgtaatgtagtagctaggattgctttgtttgtttcatatagcatggtcagtgcaggggatgaataaacaaacgtgctagtagattttttgaagtaggaataagtggattgcctttttaaccctttcc

SEQ ID NO: 26993 - DNA, 511 bp, Sorghum bicolor
  Clone ID: 6673063
gcaggctctcactggcggcctcggtggcgccagcggtgaccgtctcaacacgggcatgtccttcgtcaaggtcaactagatacgtcaagcaatctacagctctccacctctttaggaggctctctcatcttgcctgttcttttgcgccagctatacaaatctctgatacccaaccatataccacataggctagcgcaggcaggatcagcgctttgcacgagaaacatgaagcaccaaatacagcataaagcggatcaaactcatcggggagtctacccttgtttttggagaacacgtgtatcttatctctttggccttgcctttgttctcttctcgacactcctttttcacaagacatttgattacttcttctctgtataccaactttagggatattgctttggggttacaagctttttgggttcgggcggttcggtctcgcatgagtaaccggtgaccttgggaagtagctaggcgtttcctgaaaagaaaaatctatgtggctttgccc

SEQ ID NO: 26994 - DNA, 573 bp, Sorghum bicolor
  Clone ID: 6673065
tggggtaacatctgtgttttggtatttctttgtaatataacatcatatatgtactaggaacagtcacttattttctcactatttttttagataatttccaagagcaagccttaaattattaaagacagatgttgctgtcagggttagtaatatggttatgtgttttgtaaatagccatttgaaacctcaaatttttcggatgtcataatgaattaggaattgaacgggttcaacatccaggagctgaccatatggccttgtttcagcagaagtatgacatcaaggacttaaaacttgagtatgatggcgctacaacaaattttcaaagtgatgctctctgaggaaccaataactatgtgaaagcaacatggagataatacaggcggatagaagtcaaactcagaataactatagtatatagcaacatggaaccactttcatctacatggagataaagcgtatagatcaaagtggaaacccataatgtattcatgtttttataagcataatgtattcatgttagggatatggatgaatggatccgtgttgaatgcaccttggttgcgaagcgct

SEQ ID NO: 26995 - DNA, 213 bp, Sorghum bicolor
  Clone ID: 6673073
acacgaaacctttacgatcattactatgcgatggatgaatgaaatttaagattgatatgggatttggaatgattcgcttttcccggttttggtaggggatggctttggccaaaccgccctcgaacattaccatccacacgcttcatggcaagcattttttgggatttagttagttgctaaggacataacaatgaaaacatatctggttgttgg

SEQ ID NO: 26996 - DNA, 451 bp, Sorghum bicolor
  Clone ID: 6673087
gagaaatgtcgcccgaagaagcacgcaaacgaaaatccaataacatgctccaagacgccgctgccgtgggtattgctgcacttggtatcaagtcagcctactctgaatggaaggagatgaatgagcagcgtcacagcgttaaggagctcgaagcccgccgccgcaagagaagaaaggcccgcgaacgacgagagaaggaggcccgcctcaatgcactcggcaacatgaatggtccaggcgctaatccgtacgcatatcccgtagcggccaaccagccctatcccacgtcgtatgcggatgccaatccctatggcgcctcggtgccgccgccgcccatgggtgcgaggtattagatacttccccctggggtcgatctcttcttgatggtggttttgttattgcgttaggagttggaattagagacattgttaactactttttcttcttcttt

SEQ ID NO: 26997 - DNA, 381 bp, Sorghum bicolor
  Clone ID: 6673097
gttctggattggtgatggtgatatgtgtctgtatagggtttgcattattgctagctgtaagtattggttagcacataagtagtggttagcccaccccacccaccatagtgcatagtagcatatagtagtgtactagtatagcatcatatcattatttgggtatcttaaaaataatgtaattaagctgtatgtacgtacgtagcctagcaaaaaactcgttgaagtcgatgacttggggcttcacagattaggtagggtctgccatcagatcatgacgtccagacttggctgcttcggagcatcacatgatgtattgtgatcaatgatcatggctcatccctctgattgatggctctcaataaattgtattgttgctcgtgc

SEQ ID NO: 26998 - DNA, 584 bp, Sorghum bicolor
  Clone ID: 6673116
ggcgaggatgcaaaattcagtttgccagagactggccttgctattattccgggtgctggaggaactcagcgccttcctaggattgttggaaggtcaagagcaaaggaactaatattcactggccgtagatttgatgcagtggaagctgcaactatgggagtagtaaactactgtgttcctgctggcgaggcttatcaaaaggctcttgaacttgcacgggagataaaccagaaaggcccagtagcggtaaaaatggctaagaaggccatcaatcaaggggcagaggtagacatgccctcggcattggctgttgaagaagaatgctacgagcaagttctgcacactcaggatcgtcttgaaggtctagccgcatttgccgagaaaaggaagcctgtatataaagggaagtagggctgtagatggtctttgattcatcataaattcataatggaaagttacattaacatgccatcccaatagtggcatgactgcatgatatgtgcaaattcatgtcttttctctgtaactttcagaaaataagatgcatctgggctgctagcctgctagctacgtattttgaagtg

SEQ ID NO: 26999 - DNA, 481 bp, Sorghum bicolor
  Clone ID: 6673143
aactgtagcagctgcaacaacgggttcgagctgatgtcgacgacgccgcacagctgctgcagcaaccaccacctgccgtggctggagctgggcacgagcggctacggcggcgccgcctccgccggcgtcgtggaccactacggcgcggcgctggacgagctcaagtggtccgactacgtgttcgacggctacggcggccagccgggacagagcatctacggcgacagcaaggacgccgtgcagttcgtggacgccagcgcgctcagcagcagcagttggtgcttgaattgatccatcgtcggcccaacgcgctcggcggcgagcaattaattaattaatcggccggccgaacaattccaactccaacacagacacaattacacaaacactttatacgtgtgcatgtgctctcttacgaattatacgattgattgatgtagctcatgcatgtttgcatttggtgagcttcgatctggtttgt

SEQ ID NO: 27000 - DNA, 288 bp, Sorghum bicolor
  Clone ID: 6673152
agagtcgtttgtactcagcaatctgggcatctttgctggagcagatgagactggcccttggcgtatttctcagctactctttacgcagagcgcggacacttcaggagggccagtgcagtttagcatgtgctcggtacgtggagggcccatggctgtttcgctctcctgggaagcagcccttgtgcaggagaaaatgatcgatacagtctttaatacattcgaatccctgataaatgatatatgtgccaataagttgtacccgcttatcttatttttctggtgattcct

SEQ ID NO: 27001 - DNA, 419 bp, Sorghum bicolor
  Clone ID: 6673168
gcacgagaatacggggtcttggaatggtgactacgagtccgcagcatttggcttttggccatggcagacacgcttgccccgggcgattctttgtcgcgcacgaattgaagttaattatgattcatatactgctcaattacgacattaaactcgttggcaaggtgcctgagaagcaatggataggcggcaccatcattccgcatctgaaagcagagattcagattcggcgaaagaaagtgtcggcgtgaggtataagggactaaataatatgcaatgatgaaagaaagaaaaaatattggaatattcgatgcggcgttttgtagtgctcacttgtatttagcatgtataccaagagaaggctattgaagtgcacaggatcaggaagcatagccgcaaatcttgattggatcatttcaccc

SEQ ID NO: 27002 - DNA, 544 bp, Sorghum bicolor
  Clone ID: 6673177
ccgagatgagcgcgcggggcatgacgaagccgctaactcccctgcccgctggcaccgaggaggacgaaaagcgcgggccaggagttcgtggccctattctcagtggagacaaagtcggccgcggacaaggtggtttctggaagaagctgcgttgttggtaggctatatgatgacaatgatgaggtcggatgccaaacgagaaggggaatggggagtaagagaagaaaagagccaatgtctttcgttttccgttttaatagttttcctttttcattgtctgaattcctgctatttgcttacacaactgggcatattctcctttgttttctttgtcgttgttcacagataccatggatatgtatggcgggcgtcagggagaaatatgatatggaataaaaagcatcgtgagtggagatttggtggacaagagtctgtatttttactattggaagcgtcatgtataaaagtttcacgtgtatgcagcatattgcctccttatgggcttaattactcgaagcaaatatcaaggtgtttttgccttgtg

SEQ ID NO: 27003 - DNA, 244 bp, Sorghum bicolor
  Clone ID: 6673181
cctagtaagctttcctttcatccatacatgtctcaaatgtttctttctccaatttaggtgtttgggatgtcgggttttacaattggtgggagttttatttttctcccatgctcgctcgtactaacacgccatgacaactgctaacacccgtcatggtgtgttacttgaactctcttagcagttgcgagttcagctgctattagagtgtgcgaggagattcataggggttccacggggtcctcta

SEQ ID NO: 27004 - DNA, 505 bp, Sorghum bicolor
  Clone ID: 6673203
cggcgtcgagtacgtcagcatggaggagctgctgcgcgcgtcggacatcatctccatccactgcccgctgatggactccacccgccacatgatcaacgccgccaccatcgccgccatgaaggacggcgtcatcatcatcaacacgtcgcgcggcggcctcatcgacacggccgcgctcatcgacgcgctgcagccgggcaaggtcgccttcgccggcctcgacgtctacgagcacgagcgcccctacttcttccaggaccgcagcagcgagatcaccatcactgacgccatgctcgctcgcctctcctccatgaagaacgtcatcctcaccggccaccaggcctacctcacccacaacgccctgcaggccatcgccgaggtcacgctcggcaacgtcaccgagttcttctggcagcgcaagcagcagccgctcaagaaccaagtcatcgacgaatggcaaaaagctcaacaaggcaaactctaaactcagttcaatcttggtttc

SEQ ID NO: 27005 - DNA, 535 bp, Sorghum bicolor
  Clone ID: 6673208
tgtgggtgtacagacagaacagtaggatgccgattcaatcactgttgtaggcccactttggacaggtcctctccatgatgccgctttccttaccgaaatgctaagcttggccaacgaatggggatgggcatgcacaattgaaaatggtgtcactttggaaaaacttcttggcatgatgattgaagagagtgacccgaggttgcctcctggatatataagaattgatgagatttcgagacgagcaaaagttaactctcccccgctcggtaccctcatcaattcgttgcggaaggagggtttttctgcttgtagatctcatataggtgcaaatataatcaagaccaactgtccaattgcttcttgcatcaatgtcgcccgggacatccgaaacataagatgaataccaactacactgtgattccccaagtacaaagttcctttgtaggcatgcagcacaaatgcagctgtgagctgagcacttgttcctggttctcatcattattcaccctccagagtcagagggaacctttcgcta

SEQ ID NO: 27006 - DNA, 495 bp, Sorghum bicolor
  Clone ID: 6673210
cacgtggtggtggcgcacacggcgctgtgcgagctgcggaggtactgggtccgcggcgcccgggcgggcacctccgactccgagaccttcgcggagctgccggggtacccggacaacctgcgcgccgacggccgcggcgggtactgggtggcgctgagcaacggcgtcgccgctgcgggcggcggcggcgaggaagcggcgcccacggtcgccgtcaggctctcccgcgagggcaacgtgacggaggcgctggacgggttcagcttcgtgtccgtgagcgaggtggccgagcgaggcggcgcgctctgggtcgggtccgtcgacacgccgtacgccggcgcgctgaagcggcgtaccagctagtgctttcgtcttctgcaactatatttgtaccgtgcagacgcgccgttttgtcatatgcaactgtactatatgtgcgtgcatgcatgtatatgtggtggcatcagcagcgtgaaagacatgcaatttgcctgt

SEQ ID NO: 27007 - DNA, 156 bp, Sorghum bicolor
  Clone ID: 6673225
gaggcgttgcattgtaaaattttgtaactccccctcgaaagggttttgggattccccccgaaatgaccgaatttgggtgaaattcccccatttgggtgaggtccgaaacaacattatcccgtccaaaaatttcgattaagttggaatttttggtcc

SEQ ID NO: 27008 - DNA, 402 bp, Sorghum bicolor
  Clone ID: 6673227
acttacggctatcgtgatgagatcattcatggccgtcagaatgtcgtagttaggccggaggttggtgacctatggttcttcaactcaaggaacatgcatcaggttgagaaggttgagccagagccttgccccgagcttggcctgccgtacagaccacgactatgtctcagcagcttcattggacttctacccgagcacaagactggaggccgtcctcgattgatactgtggtcgtgaagtcttaaactcagggagcaagtcagggcctgccgcattgcccacaggttcatgctgtgtttacgacaagttggtttcacaggttaccgcatctgaaaagattgaaagacttaagaatcgtggacggctagtgctagtgattcgcagaataaacctctgcctgtg

SEQ ID NO: 27009 - DNA, 317 bp, Sorghum bicolor
  Clone ID: 6673229
aaattcacagcaagaagaacatggtgtcggagccaaagagcaatggagttgccccagcaatggcagggacgaaggtccttgtcccaggtccggcgcaggaaatcccaaagagcaagtgctgcagttccatgtgatgcttctacgtttggtgttgggtgtgttcaaaatattcatgtaatattgttttggttgtaaaccccggctgaaatgcttggattttggcgggattgtgttggtacactggtgtattttagatatttgtcaccaattgtgacatgagggaaggatgtgctgatgtattggtcctcgtgttctct

SEQ ID NO: 27010 - DNA, 455 bp, Sorghum bicolor
  Clone ID: 6673243
ccacggcaagggactagacaagccgacctgcggcaagaaacagatgaagcaaagcacccagattgtaacgggtcagcaacagctagttggtgagtccaggcccgccttcaacagcaccaaatgcaaagctgtgaaaccgcagacagtttctagggttgctgcatcatcatcagcacgaacagccaaaacagcaagtggccttgtggcaccttcccgggttggcaaggagaggaaggctaccgtgaaactgtcgaggtttcaaacaacagttgcttgagttcgtgcatgatcaggggagaaaaggagaacaggagactgttgacaatggttttattgtctgctccaagcctccaacgacgtgttctatatttacgccgtcgatattcgtttctggattttgttgacttatgtacactgaccatttctttccgtgaatcatgtggtggaattcttct

SEQ ID NO: 27011 - DNA, 596 bp, Sorghum bicolor
  Clone ID: 6673245
cccctcgcgccccaacgccgctcgctactgcgaacacgtgtttgaccgaattggatgccagtacaacgcacctgctgcttatgctcccaacgtcttcgagtcgtgtctcggtgacagccaggacttccccggagtctacaccggtgctaatggtgtcgtgagcacatacagccagcctcccgagtccctgggagccatcactgctctcccatacactgcccgtatcccggcaagctcctcgtgcacgccctactcgagctctgcgctctacacggccaatcctagcgtgtccatctcgagctcgagcagctcgaccagcacctcgcgcacaggcacgacgtctcgctcgacctcgacgcgcaccgtcacctcgaccaacacgtcgtcgacgcctggtgctggctttatgagtgcaaaggcctcgcctgttctcgcctttgtcgctgcattggcaggattcgccatgttctaaggtgggggtggatcgtaaaaggaccattgccggttcgtgggtgtttggacatttttgatggttggccagttttggacacttttttgtggttagccgtttattatatgacttggttttccctctc

SEQ ID NO: 27012 - DNA, 561 bp, Sorghum bicolor
  Clone ID: 6673252
gagatgaaggctctgctcggagaaaaagcctgcggttaaaattgttgtgcagatcgagaggaaatggagtgatgtgcgtttaaaaactgtgctctgtttggaatcaatcctagctagtaaaaaaacccaataattagagtgtagtcttgcaaacagtacattcagtctagtggtctacgtagaaccatactactagtgtgtgatttgttgagtggaaactggaaacataccgtcttgaagtattcgttgtttatctgaaatgcaaatattgctacattgtcagcagtacgacacaagcagaacgtgagtcatcgggcgagggacaagatgcagcgactgaagaatcaagcgtgacgcgtccaagaaaaggggctcgagccaggcggccaaatgttctcgtcagtggacccgaatgggcttgagccagcgactaaacgcagctgcgcctgcgggctcaagtctggacgctgcccatgtataaaacggagtctgtgaaacccgaggggggcatcaaacaagaacaaaccaaaccagtattaagattcctattaccgttacctt

SEQ ID NO: 27013 - DNA, 199 bp, Sorghum bicolor
  Clone ID: 6673329
atggcgaatggctttatgccgattttgatggaatttttatttcaagatcagaattgactgtgtaggcctgttcttatgttatgtgtgaacttgtaagaatgtcccatagctgaattacatgactagtgggaatactttggatgcttcgacagtatcttttgggaaaaaaaaatatttccctttgaaaatccttgcctcc

SEQ ID NO: 27014 - DNA, 466 bp, Sorghum bicolor
  Clone ID: 6673330
atgacgttggtgatcaagtcccagaacttgtccacagaggtcatgtcattacacgttcacaatgcagggaagcagagaccgaaatgtcacgtagaaatgcgagaaagaatgcaagacagaacggcaggtccagccctacacagagaaagagacgagactctgctgtttttttgtccaagacttttcctggcggtattggtaccgaaaagggtaattgaagtagttccgtgctgctatgtgctaggctaagaacgatcctatcaacaccagcatagtcgtcagagctttctccttccttccttctaagtctctttctttttcttcatctttctcttaatttattctcgtttgttctttccttctgtcgttctttgtattcctctctctccagcaagcattctcctttaacacatcgtttagtatagttccttgtttcacgcttgatggtacggttgttttagcagtg

SEQ ID NO: 27015 - DNA, 515 bp, Sorghum bicolor
  Clone ID: 6673346
tgaacctgttgatgttgttgcccctgactttattcgttcttcatatgaccgcttttggtccctccttatagacggggtaaaattctttccttgtcttctttcttctctattcgacatgttccatgtcgctttcaggcgacagaccatgtgttaacatgggtgaacggattcggcatcctttttttttcctactccctttgtcatgtttgcttctcgcactcggtatacccccagcccggcgttcgtctgtctcagtctcagcggaacgactacggcttctcctcatgtacgatcacatgctgtcgatttaccagctttgtctgggtctcttttgttttgctgcgtggaacaggtatgggaatagatagatttctatatgttaagagtggtttaggaggagagggttaacacagagcttttgacggtctgcaaggtggatagtggtgtatgataggacagtatggcacggtcgtgtacgtccagtttagacgcaatcaataaagcaatattcggta

SEQ ID NO: 27016 - DNA, 379 bp, Sorghum bicolor
  Clone ID: 6673360
acaaccagaaagacccgagaagcaagacttcttaatctgaggatcccttgatgggatagctatggatatcctcttccgatttgagatcggttgaggtctgctgcaatggaaaaggaactgtccctttatgcttggatatgcttttgatggacttggtatggagtttgcactggatattagcgcggttatctttatggtttttgggatcttggatttgcgggaaagtatggcctggttttgaaggggaagagtaagggtaaaagggataaggaaagaaaagacttttttagtctagatacttagaggcttgggaaattctttatagttattatgtcttttttattaagaattgctaattgttagtaatttaactctcttt

SEQ ID NO: 27017 - DNA, 424 bp, Sorghum bicolor
  Clone ID: 6673371
ggaaacaggtgcagcgcctattaacagtcaaccactgaaagagcaacccatgagtgatcatcgtgttcaaaatatcaacagtgctgatgctgtacctcctcgttcccctaaacgggtttataggagaaaacgcagtccagaggcatgaggattatctgaatgctaaaagcaagagctgtcattctttcattcctctatttagtcaccttattataacagttcctgaactcccatccttcaaaaggtagacctccctacattattatcttaggttaggtggtgctggctcttccattgcatccctactgaaacagagaaccttgatgtagtcacatatggttagatttgatggaatttagaatgtatgttactctgtgtacagacctgtcgtttctctcgccaaatcaaattggtagttcgtctt

SEQ ID NO: 27018 - DNA, 416 bp, Sorghum bicolor
  Clone ID: 6673377
attgaggagcagttcatgggtccccctattcccatctacgagcctctcgaggatggtacgaaggacaacatcttcatctccaagagctacgatgccaccagccacttcgagaccaccaccgacgacgtcaaggacatctaccaccgcgccacaggtgaggagctcaaggttgagggtttgagggaaggtatccaggttgccgaggagcagtaaagaatctcagcaaccttcctagcaaataggataaaagagtaacaaggccacaccactgtaacagagcgggcagggtaggaggattgttttgctttttcagaagattggccgataccgatggtgcgtcttgggcacaatctcattatacctctttcgatagcatctcacacgacaagtcaaatgaatattgttgaattgtattc

SEQ ID NO: 27019 - DNA, 501 bp, Sorghum bicolor
  Clone ID: 6673386
ggcattggctctcagactcaccttgaccccggtgccgcgggccaaattcagggtgctctcactgctctcgccaactctggtgtcaaggaggttgccgtcactgagctcgacatccgcactgccccctccaacgactacgctaccgtcaccaaggcctgcctcaacgtccccaagtgcattggtatcaccgtctggggtgtctctgacaagaactcttggcgcaaggagcacgacagccttctgttcgactccaactacaaccccaagcctgcttacactgctgttgtcaacgctctccgctaaatttggctggcgtgacaagatcagatctctggtcttgaggggcagcatcgttgcagttgcttttggtcatcaccgtattcttcttttataactctgtatatagttgtttgtttgtacaaaatctcgtcaaatggtaactgcttggtcggttgttggaagatagctgggctagtagtcaatacatatccttaccattgt

SEQ ID NO: 27020 - DNA, 303 bp, Sorghum bicolor
  Clone ID: 6673410
atcggccagaacttcgcgctcgtggaggccaagctggctctcagcatgatcctgcagcgcttcgcgttcgagctgtcgccggcgtacgtgcacgcgccctacaccgtcctcacgctgcacccgcagcacggcgttccgctcaggctgcggcgcaggctatgaagaatatcatcagtgtgctatttccattcagcaataatttctccattcaatacccacagatcgactctcaacctatactatactagagcatgtaaaagctagcaccacggtatatgtatatatagacagatgttgcccctc

SEQ ID NO: 27021 - DNA, 459 bp, Sorghum bicolor
  Clone ID: 6673422
tcatggtcaagggctctatccctggtaccaagaagcgtgttgtgaccctccgtaagtccatgtggactcacacctcaagaaaggctctggagaagatcagcctcaagtggatcgatacctcctccgagttcggtcacggtgctttccagacccctgcggagaagaagcagttccagggtactctcaagaaggatctcacctccgcataaatgcgaggcactgatttttttcctttttgagtttattcgtcgggtcatcattgcattggtgtcggatttggttttgccttaggcttttctggggctgggtttgggctccataatgggatgagcacgaaaagaaaaagtttttcagttagaagtctgaaaaaatttcaaatgagatttcctattacaataatggaaatcccacgcatatatgcatgccaaagtagccgcgccaatacaaaaatgtgtgccc

SEQ ID NO: 27022 - DNA, 452 bp, Sorghum bicolor
  Clone ID: 6673438
aacagcccttcaaactcctttagaagctactcagtctcaagctcagaaggggaaaaccgatgtggagctgtagtagcttgcctatctcggaaagtaatgccttctggagctgccaatggtgttgggacatcaaaggtgaccccttttcctctaatggctactggtcagggcaccgaaggtgctcctcgccttcagcggagccatgctgtttcaagagacctcgtcagaaactggaacttcgatgagattgtttttggaaactagagtagggtgctcaccgtttggtctagattggacagaaactatcatctggcaggacaagccatcacttgatgaatttactagcatacatctgtgtatccatgtaatgtatcagcagtttagcactcgttccatcaacaagcaaatcattaaaagagcactgatacttgaagaatcagtacctggtttga

SEQ ID NO: 27023 - DNA, 373 bp, Sorghum bicolor
  Clone ID: 6673454
ccgcatccactcaccacagcgagctagggcagcagcaggcggagagactgcgagtggaggtggaggacgtcacccgcgaagcagccaacactgccgcaccccacagccagcagcacgcggacgacgagcagcactaccacgagcacgagcatcgctacgtgacggacccgatggcgctgtccacatccccctccgtctcgctctcatctcacacaccgccaagcgacccgagcggcggcgacagcagcgaggccatgcacgcgcgagcactgcgtctcattcgagagcggcaagacgagctgagaatcaaactgacaaccagcagcgcagtcgaagcttgacatgcactgtgcagtgatagatatgtgtaact

SEQ ID NO: 27024 - DNA, 468 bp, Sorghum bicolor
  Clone ID: 6673456
tcttgcccggagcacgcgtgcgtgtaacggcgcgcgtaggtacgtctgattgatagccgagagaccaagcagatcgaccggaacgctgccggcattttgaagatccattggagaatttcgttgccttcttgtttccttcaattagtcgtcgactccaccatgtcgacgaagctgtacatgtgtgtttttgggtgtgtctcgtccgttcgttaattagtttattttgttcgattcgattgttggagtgccctgacgcgaactgttgtagctgcagctgcttagctagtgggttagtcgccatctggttgtgccaaactgccaattgctttgcactgctaagcgcgaactggtgaggagatcgatccaccgatcgctctacagatacggcacctaccaacacttctgcaaatgccagccgtgccaagtgccaacatgatgtaatctctttatatataagatatttatcca

SEQ ID NO: 27025 - DNA, 412 bp, Sorghum bicolor
  Clone ID: 6673461
gccgattcaccagtccttggccctaagattttcgctcctttggcggttaacacgaagcatcctgccccgagcggctttaaggagatgagcgctgctgagcgacagaggcgcctgagcttcgagcgttctgctttcctgtccaacatctactagatgtttttgtgcagtcatgggctacacctcatcacacctcgtgacttgcaggtgaagaaattccactgcaacagcccaagcgctgcgggtgtttacgacgttatgataccatttcatttttttttcaaagtcaatatcaacatcacaaaaagatcactcgcggatggtggctacggatggcatggataggcgtttcaatttttttttttcacttgtgggtttcaaaccaggtagcttaggaattagcggccacatcaca

SEQ ID NO: 27026 - DNA, 111 bp, Sorghum bicolor
  Clone ID: 6673467
ccaaatgtggttcctagtaagcttgtctaaagtatttgggtaaaaatttggattgaaagtgggtttcttgttggaaaattttggatggagccctaaagctgttgctggtcc

SEQ ID NO: 27027 - DNA, 476 bp, Sorghum bicolor
  Clone ID: 6673472
tcttctccagcatccccgagtccgttactccccaccccggcaacggaacctccaccaagactagcggagcttccaccccccactggaacttctggctctggttctggcagcgagagcagcgccagcagtgttcctactggtaacgctgctgctgttgctggccctgccttcggtctcctcgctgccgtcggtgctgtccttgctctgtaagagctcgggcttatatctgtttgcgtataatttcatcttcaccacggaacattgaatgggacgcagtcaattgacatttacgatacaaggaaattaataatgcgttgttcaaagatccatggatagtgtatcacttcttttttttttctctcccaagggtacccacggttgattagcttgccatcgagagcgatgggaaaagtagttcaagtaatagacatgtaccagcttagttacggagtagtaataaccaagcattggaacta

SEQ ID NO: 27028 - DNA, 414 bp, Sorghum bicolor
  Clone ID: 6673486
ggtaacggcgaacgggatgtggtcgatgtgtacggatgtgagccagattgggtgtggacatttgcggcgaaacagcagccaacaggaagtagcaggcagactctatgagggcccagtccatggagagtcttgatactatcgcggtgcgtggaaaggacttggcggctaaggatatggatggagatggaaattggcatacgtctgaagacgacaatgactgaaatggtctatgatgacgatgatacgagctcgtcgatgatccatttacttgtttgtttggaattagttcgattcattgaaacaacctccggttccaggtgatccggtcagttgtacaatattttatggcatggataattatctggaattacatagttttcgcgcggcgagcatcaaacaaagaatatccatctc

SEQ ID NO: 27029 - DNA, 439 bp, Sorghum bicolor
  Clone ID: 6673491
ggactggaccgacgccaaagacgacgccaccgtccgcggtgtctccatcgccaccaccgacactttcaagcagcagagcaagcagcgcggcttggacatcccctacattttcatgaacgatgcatctcgcgaccagaaccccatcgcgggctacggatccgccaacgtgcagaagctcaagaccatcgcgaagaagtacgatcccactgctttgttccagaatcagcaacagggtgggttcttattgaagaatgcgtaaatgatggatgatggggttgcatatatagaatagggtgtggactttctagtttctaatgttggtgtacataatagggtggaagaaggctgaccaggtactgggaagcatagaattatggggtatatatataagatatgaaaaggtaatccatagtcaatcgccgctgattgcgggttcttg

SEQ ID NO: 27030 - DNA, 406 bp, Sorghum bicolor
  Clone ID: 6673493
atctggatccgtcgtgctggtcccaactaccaggagggtctcaagaacatcaaaagcgtcggccaggagctcggccttgacatgcatgtctacggtcctgagatgcacgtctccggtatcgtccctcttgctcttgtccccggcaagaccacggacatcaaggagttctctggttagagcgttgtacactagaattgctcgttgcgtaggttttggctccgagaagcggagtttagggtcggttagacaaacagtcaggcttggattgcacgcatgatatgggtgggaggtggacggacagatttaggttgctatgcgcgattcccatctagactgttgcgcacttccgggagttgcccggcgggcgcatacaaagtacaaaatttaatatatccctcttgatgcg

SEQ ID NO: 27031 - DNA, 343 bp, Sorghum bicolor
  Clone ID: 6673494
ccagttgcacgcctactcagactgttgcgaaggtcagagaggagccgaacgcctggctcgctgcaggtttccgcggtctagccaccttcggcgcactgctctagtttgcgcccggacgttacgtgtagcaaagcagttttagaacaggtttcaaaaattcagcagcgccgtttgagccggcacctcgccgtggaacgctaacctgtggtttttcctccaccttctcttaatgaaacatgtgcaacgcacgatttcgatatatatatatacacacggtagcggaatattattctacaccctaggtgtagaatattattctacaccgtaagttaagtagaaaaaa

SEQ ID NO: 27032 - DNA, 372 bp, Sorghum bicolor
  Clone ID: 6673497
cttgcttcctcggaatgaacaattctgtgctttggatacttccttcacacagcttttgcacatatggagactagggctcattcctcgttcttgggcccttttgtacctaccatcctttcatcagggcatgttttcagaaacatgcgttattttctgtctcggtttcagcggtctttaggcggtgctttcatggttgctgccggtggtgggagcaatgtataggccgtaatgtatttgctgttggtctaggcctagagttgaccccgcttgttttggagttggaggaaggacaaaagctgcgattgtgtctttgaggtgggtgcttggttatgggtgattcgtatatagcaatcaaataccgttgtcgggtcc

SEQ ID NO: 27033 - DNA, 433 bp, Sorghum bicolor
  Clone ID: 6673523
gatggacgattcgttacgatggataccccgcttgattatactgttcgatcttttctcctgcgtctgctgtctaacttcctagcgttctgttgcacacgcctacatggaactggtccctggcatacgtcggtctggctaccgaacgataagccatactgtcactgcgctcacggttcagaactgatcatctcgttcaagtgagattagacgacgaatgggaaaatcggattcagaaaagaaaaaaaagaaagagaacgtaaggggaactcagatggacaagatcctgtgttacgtactcacttatcaagtggcttggtcaacttctcaccattgaatgaggtcctcaaaggggtgtataggcttagagtcagcgatgatggtccggcgttggatctgaagtataggagaaacgtgtttaaggattaaagcttgt

SEQ ID NO: 27034 - DNA, 253 bp, Sorghum bicolor
  Clone ID: 6673531
ttgcggcacagcctgtacttactacatcaacctgcctttccatttcttttgttatttttctatgaataggggcgcattacggcggggcatctatgttccctcaggagagcagggtcgggtttagtcccttgtttcggggcgtttggctttggttctttttgggctatcatgagcggtatgaagccagtcaaaagagacggatcagtggatgaagaagataggataaatcaatgccaaagagcagttcctttct

SEQ ID NO: 27035 - DNA, 510 bp, Sorghum bicolor
  Clone ID: 6673541
aagcaggtgtttccgaggaattttcagaaaggggctctcatcggcggcggtacgcttgatccaaggatacctctgagcaagcaagaagacttgatcgtgtggatgcgaaccgcggcgctgccgacgttccggaagctgtacggcaggatccaggtggacctccgtgccggcgagctgataacggtgacgatgcagaacaactacaacacgtacagcttcggcgggaagaaggcggtggtgctgtccacggccggcgtgctgggaggcaagaacagcttcctcggccgcgggtacgtcatcgtcggcctggcctgcctcctgctggcgctgctcctcaccatgctctgcctcgtcttcccactgaaagaggagcatcttgcgctgcagtaccctttgccccggcctgcacggtgaccatgcatagcctagatgtctacggtgtacagattgaaacagtttcttttatatatactgggcctgtttggtgttttcttgcacacaggaacagct

SEQ ID NO: 27036 - DNA, 480 bp, Sorghum bicolor
  Clone ID: 6673557
gaccgtcaagtgctggtcgttgctgtgggatcggcggtggcgcaagtccagccggcgggacccgggcgcgccgtccagcgagagcgagtccgccatccgcgccgcgtcggccgccatccttaaagcggccaagcactccactccgccggccaatatctgagccgtttcatttcgtctgctgccggatgcgttgctggcttccagttgcagctttgtgttctacgtctgtctgtacatatgctctgcgtgtgatgtgatatactgaattactgatgcgttttgttttagcctgctcgctcagttgtctctagtatagtaatattcacttggattggactattacgtacgtacaacatagggcttttgtacttcttcacatggcttgtgtttcccattgaaaagaaatggaaaatacagctggtcagacaaaagcagtgtggttgatatactgaagcattggggggtatgaactttcagtta

SEQ ID NO: 27037 - DNA, 518 bp, Sorghum bicolor
  Clone ID: 6673569
gaaggacatccagaagcgagcgcttactgctgagatcaagttccactatggtgcttccataagcaaactcgaccgctggcaggagctttgcaaggaggttggtattgagaagactcccacctccatcacccagtgtcaaaaggttctgaagcccgtctttgtcaacctcttcaacctggtggatcaccgtcgtaacccagaccaccaggttctgcgcttcaagtcgtacggagagttcgtcaagttcactcgcaagggaaatgagttccctcgggactgcgcaaagcaggagggcttcatcaaggttctgctgaagaagatgtaagggttcaggagactggggagatccacgccagacgtcgggccggcaatctgccatatgggccgcactgtaccacacgcccagtaaagttgatggcagagcgtcgagacttcgggtttgaatatagcgacgaagttttagggccgggtttcaggtagaatactgctactagtgaccaaattcaagtgtgtcactg

SEQ ID NO: 27038 - DNA, 486 bp, Sorghum bicolor
  Clone ID: 6673570
tggccttttccaatcgggggccatataggcccggtattgtcggcttggagtggactgaccccacgatggatgaagagaatagagcctggggtcgaatgattcaggccaagtgtcgacaagccgttatcgacagcaaggaattttctgacgatactaaaacctcgttggaatatgccaactatgtcgaacctggcgatcttataaccgataagcctttcggcggtaatcaggaacggctggccatattgaaacataaatacgaccctgatgtcatgtttaacaaaacaagccccatcacaccactccgtgccgtggccaactaacaattagcattacatgatcagcttctcttttaattttggcattcgtttaatgaaggaatacttgcatctctgtatttaacgcatattggtctctaatgctcaatagtatagctttttggggagattagagatctttcaccactcaattgcacagtcaatcatc

SEQ ID NO: 27039 - DNA, 564 bp, Sorghum bicolor
  Clone ID: 6673576
agctgctacgacatcgcttggcgcttgcaaaatgagtggcgtgttttttttttctctcttctttttttttttttggtctagaagtaggtatggggattgggtggatggaaagggtgaggaggtggacaatacgcggtagctagggacgacaatggtgaggcaaaacggagcaaaagcaggtgcaagtacaaagcttgaagggaacaggagatccagttttagcaggtcacgggatgggttgggctatttcaacgggtttattagggaattttgttggttggccgcgctgaccgatgtaaaatcaacgccattctgacaggagatggatcttgcttgagataagggctcacctcaatatatcgctgaaatttagggtggattttggtgtgactaaaattaaatctctaactctactttgcaattttgcattgactcattgtctcattccaaccgttggattcctgagggcattttcttagaggaacctttgtaacgctagattttttttccgttttctgctctgtaaaaatggaccgattcccatgaaatttctataggatttct

SEQ ID NO: 27040 - DNA, 360 bp, Sorghum bicolor
  Clone ID: 6673578
cgctgaccaaggtcagcgaattggaagtgcggttcgctaggctgtggacacaatgtcagcgatgccagggcagcttgcattgtgaagtgatttgcgcgagtagggactgtcctattttctatatgcggatgaaggctagaaaggacgtggaggattcgggtaaagagctggtgaggttcgataacgatgcagcgctgtggtaacgactttatcaagatgacagtgcaggcgttattgttttatggcgtaagtttccttggacattgaatactctggagttcatggaaacagtaagatgtatatgattctatggataccagcgcctgggtagcataataaattttcacatttaatgtcccc

SEQ ID NO: 27041 - DNA, 447 bp, Sorghum bicolor
  Clone ID: 6673581
ccagctttaacgtaattatgcttgctaaatatcatacagggttagcggagacagaaatcagcacctgctgataactgactatgatagggccaagggcctcgctaaacctaccttctatgaaggtagtgctcacttgaatgaaaattcaagccaacttggaaatgattggatcaactctaatcgcaagtacgagctcaatttcaaacaggatggatatcttagtttggaaacaggttaattggctaagtcgattaatcaatggttcaatttctcacagagaatttggctactcaagcgccctttgagccctgcatcggaaagtggagaaaagtcatcgacgattcatcagcaggtttacaagaaagaaaaaagagatgttaagctcaagaaaagaaaaacaattaccaaatggaagataatgatctcaatacaaactcattgctacct

SEQ ID NO: 27042 - DNA, 449 bp, Sorghum bicolor
  Clone ID: 6673582
tatacattataacgggcaaagtaaaccgtggctggagattggttttaaacatcttcaaccattttggacaaaatatgtgaactactcaaatgaattcataagaaactgtcatataatggagcctcagttgtagattgtcgtgacaatataaataaaagcatatattaagtgaaattaaatttgttattttggagatcaacagcagagagtttatgaagggtaaccggggagctcagtaatccccacacatggttacatgcgctgatggagaatattcaatgaacagaaaggaaatgttattttttccccatttactttaggacccttttcctttaatttattccatttgtatcatagctcatgaaattacgatattgtttaggatggttcttttgtatttgatggagcaatatataagttgaattgatggtagtccccatcattattgt

SEQ ID NO: 27043 - DNA, 525 bp, Sorghum bicolor
  Clone ID: 6673583
gagcacctaaaaattgcttgcttatgcttgcatgacatgccatcaaagcgtccgacaatgctgaaagtcatggcaatgttcaaggagttgcaggccagttcggcggtggactcaaagacttccgaatgcacaggtgccatggatgatgcatgcttcggagatgtggagatgacgaccctgaaagaagacaaggaggagaaggactagcaaaggtcaccgacacgcgagaaactgcccaggggttagtagtggcagctacacggccagtcagaggcaaaatgcccgtaggaatcagttggtcaggataccatttgaagtctcttcttgagcttagcattcccttctgatggtacaagacacaagttttccctcatagcttcgtcagttgaagatgttatgtacctatgggagtaggttgatttttcttttcttctttttttttcaagctttgttcatctcttctcgtcacacttcagtaagagctgtgtatgtacatatataaaatggtgatttttcttcggtgcg

SEQ ID NO: 27044 - DNA, 571 bp, Sorghum bicolor
  Clone ID: 6673587
gactggacccaactatttcagctctgtccaagcacagacagcaaagaccccaacaacatctgccttctcaggcatgggaagcgcctccagcgttgcccccagcggccctactactatggctaacatgaagcccgttactagctcatcagccaagccagcgcctgctgccggtggagatgcctttggagctctctggggcaaggccagtggaggtgtcaagaagccagagacacccaagactggacccgcaatgggtcaacttgccaaagagaagagcagtgctggaatctggggagccccagcagctccatcttccagcggcagtgctcctcccaagaccggcggatctgctatggacgatctccttggttaagcttatgtgctaaaatctatcttgagagtggtggatcataacctggaactgagacgacggctggggcactaatgcctctgttggtcgagcgggcttgagaatgtacagaataataagcagtgggacagcatgtttgtattcatgataggatcctagataggcgtctggcgcaacaaaatgaactgacatgtcacgtcg

SEQ ID NO: 27045 - DNA, 327 bp, Sorghum bicolor
  Clone ID: 6673597
gccaagttattttgacgactattgagccacaagatttctccctccattggatggcactgcaatctttgcatactcctacatcagtgttttcatcgaagtgttatgttctcaatataaatatcgtcattgtatagaaatagcttaaaggttacatgaatgtagttgaagatgggaagtttcagcaaaatgtctcacccacttgcatgtttctgtaaaaaatgctcagataaacctgtaacagtcaaggatggtaatacccaacccagaaacatcaggtgtaatagaagcaattccctctcacgcattgcaacagagagtaaaaagtag

SEQ ID NO: 27046 - DNA, 613 bp, Sorghum bicolor
  Clone ID: 6673614
aggaaggtatctgttcacacttccaacctgcggggaaagacctgaatgtagccagtggccccctccaggattgtgatcaattgctgcagcacgagcaacaggaattcttgcagtctcgggtacaggctcatatggaccagtgaacgattcgcctgttatgaatggatgatatagagcctgcaatggtgaccatcgcttatttggatcaaattcaaggagtcccttcaagaaatcaactaatcccaaacgatctgttttttctgtctctgacagttcagaattgttccaaggataggtacatatgagtttgtcaagcttcaggtgtgggaagtaccactttcccatctttggcctcttggaatctctcacttcaacctcttcttcacttaaaattctgtatgcactagatagaccactaggtgcctcattgccaggatatattccaacatgtttaaaaaatcttatagtgtttttagcttcccttagcagttcatctggtggttggcccccgagaattgtcatcattcgctgaagcacatcatattctgacgctccaggaaacaatggcaagcctagaaacagttcagcaactatgcagccggggggggcccgg

SEQ ID NO: 27047 - DNA, 375 bp, Sorghum bicolor
  Clone ID: 6673634
acaaccgccgatttaaatgtgcattctacgaaaactgcccgtacgatgcaggagaacccaaggacttatacagacactactgggtgcaccacaaggcatatgcgaaggaaaacaacatccccagcccgcaaggaaagtgtctagcttgtggggagagtttcggtcggaaagatgccgaggaatgtggcttgttcgactttactgttgatttcattgcttgggctagttgaggtctgtttttgttgtttttattgtttgagtttccgtataccatgccgcagtgtctcttagttcaatacagtctgtcttttgttacatgattccaccctgatcaactctaccattctaatacaagcgtctcctccctaaattagg

SEQ ID NO: 27048 - DNA, 369 bp, Sorghum bicolor
  Clone ID: 6673636
agaccaaaacccctggccctggtttgttaacccggaacttcattgtgtacataggatgctactcgatccagtccccactgacagcaacgcgcagaaagggtggtaggagaggaaggaggctgcaacttcaagtgtcatggcgccctgtcagatgtagcggttcaagtctgtctgcatctaatatactcctactgaggaagttttttgttctgtattgaatgaagttttgaggtgtcaactcttggacgttttctgtttataatcgttcttgacaaattatgtggcattcaacatagcaaggcacgattaaggagaatccacttttttttggttgttgtgatagtggtttcaattattattattagctct

SEQ ID NO: 27049 - DNA, 168 bp, Sorghum bicolor
  Clone ID: 6673639
aaacgtgatatcagggagggagtaatgtttagtttcgccccttggcttgctttcagcaaccctcgagagggagctttttgcccagaagcctccgctttttttaggttcgcataaaagttgggtgactgaaagttaacccggattgtaaaattatttgaaaacttcggt

SEQ ID NO: 27050 - DNA, 400 bp, Sorghum bicolor
  Clone ID: 6673651
caacgagggcttcttcctatttgccgagaacctccgacaaggccagcttgtcagccagactgctgagggcgcactccgaaatcttcgatgctctcctcctatctttgacggaatggaggttctttcagcagccgaatcaccgcgaccaaccaacgccgtccctgatatggacatgagaatggactagagaaacctcgtccgggaacgttccgaatttttttcttcatgcatcttgtacttgctatttacggagttacgtgtttgccgtgcttatggactgggaatgggaatgggaaaggagccttgggatggacgggaaagaaaggctaccgagagcgaatgccatagaccggatagtcatggcttgatatcatttgattgcaatttacattattgacca

SEQ ID NO: 27051 - DNA, 512 bp, Sorghum bicolor
  Clone ID: 6673655
tgggaaacaagcgaacgcgcaaaacagcaaggctagtgttgtcgaaaacgccattgtgcacatgaagagccttgagaaagaaaacggcgatctgaagaaagaggtggaggaacttaaaagacgactggaggggctgcaagggtcaacagacgataaagaaaaagtatgacaacgaggatctgggtgcatctagttcaccacatgatatacacgggcgctgaacaggcgggaacctccctggtgcataattggataggcctggcacatgatggggtcaactctcttcgtaatatcctcaagggcggcagcgattttgtgtcggcgttttacttacggtgttgaacagggcgggatactagacgggtgcctcggggcctagatgggcttgttgtagagtgtatttgttgaaatcgctagaagaagcagtggatgacctggtaaacgaggaattgacggcctcagaagagttgtggagcacgggaataccagaactaaataacaaaggtcaagtt

SEQ ID NO: 27052 - DNA, 501 bp, Sorghum bicolor
  Clone ID: 6673657
gatagcacacaaatcgctatttgataacaaccatgatgacgtatggacaagcaagtattctaggtatatacacgagggtcgtctttctggggcggagttttgcggttgaataagttttgcttcttgggataccactctttccttctgtatttctttcttctctttctcttcctttttttttcttttttttttccccctctcttttcttgcatcactttattaatggagttgcttgacgaatttaaaatgacagcatggcgtattgaaattgattgggattgtatcgacggcaaaaaaaaggggctcgctcaaccaaaaaaagaggaggaagcattttttggagtatcaagattgagagacatcaaattgggagtcaagtctttttttgtttaattcaacatttaccatgtaaaatagtagtttcatgcctcagtggtaatacatagccttttgtaaacatgccttaagcgccatcaataacagttgatagaatcccagctc

SEQ ID NO: 27053 - DNA, 535 bp, Sorghum bicolor
  Clone ID: 6673661
tcacagtagttatgagatgcacatattgccagaagagtgccatatatcacaatatccatctgaagaccacgggatttcatatcattgatcaattccattgccttcgtgtagccctgcttcaacttcatacaccctgacagcagggtgctgtaggtgaatggatcaggagatagaccttcccgtatcatctcgtcatagagcttgaagctgctgtccagcctcccattcttcaccaagcacccgagaaccgaattacagacggagacatggaccttcatcgtttggtctttgatggcaccatacacttgaagcgccctcgcagggtcacggcttagtccaaggtacttgaagtagctgctataagatgcagcgttggtcatctcgcgctcctgcatccactcgaagaccttagagaggtcatcccaacgcctagtgtccccgcagtggcgcagaattatgttgcagtcttgtgtctgcagtacctcctcaaacctgttgagggagagaactagtctcgagagggggcccggtaccc

SEQ ID NO: 27054 - DNA, 499 bp, Sorghum bicolor
  Clone ID: 6673673
gggagacacactggcgacgaggtctcaaggcccgccgtgaggttatggagggtgttggcgcttggttcgttcagattggcgatcttaacacagtccaccatctgtggcagtttgccaatctcgaggagcgtcgaggccgtcgtgaacagagctggcaggtcgagggctggagcgacacagtccacaagacagtgcctcttattcagagcatgaagtccaggatcctcgtcccaatgccttggtctcctgttcgataaatgctcaagcgacaacactgctgccgctctcactccacagtattctgatcatctcacccgcctggtcaaatccaggctgaacatgcctcctgtacgagataagaggctgtctctttgcgttcttacagcgtagtccattttgtttatgtcaagagtctttacggttttagcagaggagcggtggaatgtggtcatgggttgcatggatagatgtattatctaaatttctacaaattcatctg

SEQ ID NO: 27055 - DNA, 560 bp, Sorghum bicolor
  Clone ID: 6673680
acctgtgggcgcactgccccaagaccgagtacgacatcatggcgcgcatctacgagtggaagaacatctactcgaacaaggacttccgcaaggaggcgctgccctggttctgggagaactacgaccccaacgccatgagcctgtggttcgccgactacaagttccaggacgagctgtccgtcaccttcaaggtgtgcaacctgatcggcggcttcaaccagcgcgtcgacggcaagatcctgcagggctcgttcggcaactggctcatcctcggctccgagcccaagctggccgttcacggcgccttcctgttccgcggcctcgacatccccgagggcttcaaggagaaccccgacttcaccgcctacacctggacgcgcgtcaacctcgacgaccccgagcagcgcacctggctgcaggacctgtggggctgggagtgcgaggaccgcaagttcgttctgcccaaggttctgggcggcgacggcacccccttcgactgcaccgccgacaccgtcaacggcaacaccctcaagtaaatgctctgtttggcgttcttcttc

SEQ ID NO: 27056 - DNA, 532 bp, Sorghum bicolor
  Clone ID: 6673690
tcggccgccttatgctggagaagtatgggacggatttttatacgctggatcagtttccgttggagattaggccggcgtatacgatgccgtcgccgaagaatccgaagctgagtaactcgtatgatatgtttatgcgggggcaagagattctttcgggggcgcagcgtattcataatgcgaagttccttgcggagcagatgcggaagcgggacccgccgattgatcctgagagtccgggtatcaaggagtacgtcgatagcttcaagtatgggtgtccgccgcatggaggcgcgggttttgggctggagcgcatcgtcatgttctggttggggctgccgaatattcgtctcgtgagcatgttccctcgcgacccgcagagagtcacgccgtgaggaacgactcgagttgagtcggtggatggggctggagtagctttgcaaagagggaaaaaggaattatgtagttgcggcaacacgtagatgtgcgattaagctcctacgaacggatatctatcgaatagaaagttcaaacc

SEQ ID NO: 27057 - DNA, 539 bp, Sorghum bicolor
  Clone ID: 6673695
gtcaccttcgggctcatgaggctcttcaaggccagcggcatatgaaggccaaaaggaccggaggcgtacgtggccagggcgggtctctcatcccaatattccatccggccatccatcacgcttctggtgtgtcgatcgatcagtcgggtgggtcggttcggtagtgtctctgctgctgctagctctgcttccttcctttgtcatccgatccatgccggcccttgttgcttccatgcgtgcatctcctagctaaccatgcataagaaataatatatatatatgctaaatagtagcaactagtatatgattgatatatatgatgcacgcacgtgtgtgctactatatatagcttgatcaatcaatccccttgctagttgcatctcgtctatgcgttgcgttgcatgtgctgctgttgaacaccgatcgaagcttgctttgttaccatgcatgcatgcagatctcagctaggttttgagctaatgtaatacaccatatatatatatatcatgcttgtattggcctagcgaagctagctagct

SEQ ID NO: 27058 - DNA, 499 bp, Sorghum bicolor
  Clone ID: 6673702
gtcgagaagtacactctgcctgacggccgtgtgatccgcatcggtgctgagcgtttcgaggctcccgagtgcatgttcaacccggctctcgtcgaccaggagagcgttggcatgggcgagctcgtcttcgactgcatcaacaaggccgatatcgacacccgcgccgagttctacaaccacatcgtgctctccggcggttcgaccatgtaccccggtctgccctcgcgtctggagaaggagatcaagcgtctctacttcgagcgtgtggccaagggcaacaaggtctccatgcagaagttcaagtgccgcattgaggacccgccgcgcaggaagcacatggtgttcctcggtggtgccgtgcttgctgagatcatgaaggacaagacggccttctggatgaacaaggccgagtacgaggagcagggcgctcgcgtcctccgcaagtgcttctaagcgctctgcgcacccaatacacggcgcgctgcccttatcgtcgtgc

SEQ ID NO: 27059 - DNA, 283 bp, Sorghum bicolor
  Clone ID: 6673703
tccgcgcgctgcccaatgtccggcataaacaattgggatgggaaaggcaaataaatccccccctgtaagtaaccgcgtgtttcgaaggtttaatgggtcgaacaattacagctggattgccccccttgtttcccaaaagtcccattgacgacgaaaatggtggtggtcggagtggaaaccctaggacccgttggaaaagcgcccggaaaggcctcatggtggtcatgccaattgaggatcccccatagatatcggctaccaacccaattgcccagcatttccg

SEQ ID NO: 27060 - DNA, 583 bp, Sorghum bicolor
  Clone ID: 6673709
atcagcatagcgattctcttctttccccttgtctaccatggggctcttgtagggactcaagttgcatcacggtccggctgagatttcgttttattgcgcgtttctcctttgaacgctcatgacggcgtcgccatttcttttctcaacgcgctggccttgccagtcttctacactatgggacggcaacgtcgattttgggtaccttgctgcctttgtcgcttgagcatggcggttgtttcttcacgtcgggacctggttcacgacttcatccatacttggtttttgttctttcctattgtttccttttgcatatcggtttctttgttttgctctcacaacactcgagattggccttgattgtttgatgtatctattttgcacagcgtagcgagcgttgacattttccctttttttacgtttaccacgaagacgaagaatttggcaacgaaggacatgggacatgtatcgacgagcatgatcagcgacgatttgtacatgacggtatatgagaggaggaacatcacacacaaagttggacatttatttgttgtattgaaagagacgatgtctgttttcccccttg

SEQ ID NO: 27061 - DNA, 192 bp, Sorghum bicolor
  Clone ID: 6673715
ttaaaaacgatttgtgcctttttagctgttgtggttgttgctgcaaactggtaaaaaagtttggtggtagttcggactaatttagcttttgcttcaatgggttttcaactaaatttgaaacccagttggccagttcccttagccgtgtttggaagttaataaatagaaaaggaagacctggattctcatttg

SEQ ID NO: 27062 - DNA, 477 bp, Sorghum bicolor
  Clone ID: 6673720
caacagaggccaaggatgttgttgccaagatggagtttcttgtgaaaggcgatgctaaacttgcttgggggaaggttgttgctgaactttctttcaaagagggaccgccaaattcgaatccatgatttggtagaggcatctgcgtttcttctgattgattcatgcattttggacttcgaatgatgatggcgaagaagataggctttcaacatgggatccaatgttgccttcttgttgtcgctggactgtatttcgcaaggtctgtggttagatcaggatgtaatggatgctccctttactgtaagaacttgctcaattttgtgtttttcaataatacttgaaatgatgttaaagtttgacatttgtcaagtgcttaggagatcatgatagatgatacatctactatctatcattgtaacatgtttgttgtaatgtgtgtttgatgccacatcgcataattactctgtttttcctttg

SEQ ID NO: 27063 - DNA, 446 bp, Sorghum bicolor
  Clone ID: 6673725
tttggtaaactccgccgaaattattaggcccaatttgtccattcgtgaaggcatagaaataattgtttcaggaggaatgactatgccacaggtgatcacgtcactggaaccaacacctcggaagagccagaacatccgtttagacagagtgaggactgtatgaggcatgaatgaaagcgttgggtgtttcaggatgaattgtttggttaccgattcaaagctggggcatgaagcatgaggcaaatcagtttgtagattgcattcagaactcgggtgtgcattagagatacatgacaacctgcactgtcttgcgttgccaatcggttggtgacacaaaaattgcagctcacgagatgcacctaactgatttccagcagtgtgctagatcgtatttgcctgtaatgttgaacgcgattcaatgcagcatctaccagtgttacttgtgt

SEQ ID NO: 27064 - DNA, 135 bp, Sorghum bicolor
  Clone ID: 6673726
cccccctttattttgaactgcaatggaaaaaagctcaaaggtttcatttacaagcccctgtaatccaagtgtgccctgctttcctactactatatttctgttcgaactgcatgcaaattttcctgggtcccagtc

SEQ ID NO: 27065 - DNA, 161 bp, Sorghum bicolor
  Clone ID: 6673739
aaatgcccttaattttggttctccggtcagtagggttaccggtggcggtgctgcccatttgcatgtttatcgtctgttcatcatcctatgcggcattgctgtagactttgtagttgctgctgtatcaataaaagttgattctgtgaggtgcagggatgggt

SEQ ID NO: 27066 - DNA, 482 bp, Sorghum bicolor
  Clone ID: 6673749
acctctttccatctatatcctgtcgctgcctctgccgtatctacccgaaggaacagatttgagcacatcttttttgattggtgttgctaccttagtgctcggactgcttctatacaatcttcctcaaaaatcaaccaatcaagtaaagaaagattaatctaaacccatatcagatataaggatgacaggaagctattggtgctccactaggaaaaggagctgcattttgttgacagtggctgcacaatttggcacagaacttatgaagagcagtgttcttctgctacaaacatttgaggcaccagctgacttaaaggctttgaaacagcaagttctcgtttcatcttttaacaaaatcctaatggattatgcagctatcttttaactccacttgagcgaatgtaactgccaactagtttcagacgagtaagggcttcacaaatacattggtcgtataattgttgtcactattttttttggtt

SEQ ID NO: 27067 - DNA, 483 bp, Sorghum bicolor
  Clone ID: 6673752
acgatcgcagggctgaggtgcgacgtcctcgtcggcttcaaggacaggcgagcgagggcgaggaactacaggacctgggcgagggcgaggaagactccaggacctggcaacgcaggttcaaggacacggtcgggcgagggcgacgaagactcacctggcaacgcaggtcgggcgtgggcatcgggtgagggcgacgaagaatacgcaggtctggcgagggcgtcggacgagggcgaggctggacgacgcacgaggtccggcgagggcgagggcgactcctcctggacgacgcacgagggcgagggtgactcctcctggacgacgcaacgcacgaggtctggacgacgcacgagggcgagggcgactcctggacgacgcaggatggatgttttgtttccttacccgtgaccgtaatttttgctacgtagaattggtaagtgctactgtgatgaaattttatatcaggaatcctttatttttttc

SEQ ID NO: 27068 - DNA, 424 bp, Sorghum bicolor
  Clone ID: 6673755
tttgctgggaacattcctgtctgaaaagattatagcatacattggagggagcctgttcttggcctttgctgcaattaccatagttgagatagttacttgaaaaggagttccagcttccataattcatcaaataaaaggaacttcattgtttgcatgggaagtcctaggtttgcatagagtgatttgttgctggtgatgagaattctgcatttttatccaagaacaatcttttgaaacacttcagtcaaaggttgggtggaagatgaaactaggtgggaaactatgaaacccatgtagcttttgaatttcctcttacattatttacaagtatatggatctaagcattgtaaaggcaaatgatgacccttatggaactattttaggatttagcattcatgagaacttaattatttaataggcttgc

SEQ ID NO: 27069 - DNA, 424 bp, Sorghum bicolor
  Clone ID: 6673766
acgtcacagcaaacgatatatcattaaaatttacagaagcggagcgtgcgatactttctctctatagagatagaaagtcctcgccacacgatcaagatgaagatggaaaaggtcacgctatgctagccttggagacaatactgggcgcattcaatatgtttcttgtcaatgatgtcaatgatatcactcaatggactcacaaatcactctcgttatcggcgatgggtctgatcaaaacacttgctagtactgctggcgatggaaatgaaagaatgtaagcaaagagtcctcataaaaaggaaacacaaaggctgatttctttattatgcgatagagatcctttccattaccaaagacttctaagaattgagtgggaaagtctagctcagttttgtttaacaacatttgatatagatttgccggt

SEQ ID NO: 27070 - DNA, 453 bp, Sorghum bicolor
  Clone ID: 6673789
agacgatgatgctgattttgatgatatggatgattttgatgacacagtctcaaatggaggcatgtacggtgatgactttgatatctgaagcaacaagcaagaaactaattggaacagcttttccgtgccccttgtgtagtgctgtgacctggaatggttcggcatccccttgtgtttgagattcgggtagctaggatggaatctccatgatgtttatacttttgcgcctctccatttgttgtatgaagcttaagtagctaaactggttctaattgatgtcgaccggttggattttatattttgaactttttaaattgatattttaataacctagggccaaacaaatatgtgtatatatacctcttggccatgttaaagatttgattacatgtttgcatgtgattatggatgtcttaatttttgattttttgaacaacccgaaataaatttttt

SEQ ID NO: 27071 - DNA, 420 bp, Sorghum bicolor
  Clone ID: 6673800
gaaggcagagactgctgcgagtgcccccttgaagctgcaggttgagaaggctatggtggtggctgtagacaggagaagccaaagggtccgtaagcccaaagtttttgctgaatgaagaagtagagagacttcctagggtccctgatgcatgtgtatgtatcgcgtgcgctcgccccaaaattcgggtggcaatattttgttcctatatataggaaatgctggatctcgcagcctaagtgtacatattaagggtgaaaccgtgaaagcaagtcacccaaatagtaggtaggtcagtagatcagtatgttggttggttctttttaaccctctctcttagtctcttggttctggggtagcagactaatagtatcatgctgtgtagcctctatataaaaaagaaaaagaactgagaattattgc

SEQ ID NO: 27072 - DNA, 350 bp, Sorghum bicolor
  Clone ID: 6673806
aagaaggccgccaggaacctgcaggatcagctggcgcgtcatcagggaggagacgtgacgaggcacctgctcggcggagaagcttcggtgaaagacgaagaagctccggccatgctggcgtgaagcgtgatgatcgtttagtcgtcgaccaaggatggacatccgtagtcgttttgcatttgggaacgtatatgagttgtgtgatttcagctgttccaatcaggcaaccaagaacaagtgtgcatgggttgccagtgtggaacagtagccatgctgctgtgactctgtgagtctactctgctgctgtagtgttacactgtgcagcgtataagtataaaatcacttcatcc

SEQ ID NO: 27073 - DNA, 491 bp, Sorghum bicolor
  Clone ID: 6673821
taccagaccaagtacttccgtcctccctttggtaacgagggtgctcgtatgcgctcgcgtctcacaaaggccgttggcaacgatgcttacattgtcaactggagcgtcgacgtcgaggactggctgtgggctgagaccgacacccccgagcagcaaaaggttgctttccagcgtgacgtaaacaagggtggtaacttggttgtgctgcactacctctaccccagcaccgtcagctacctgagggagtttatccagattgccaagaagactggaaagcagcttatgcgcgttgaccagtgcatggaggaccccaacgcgcctccgttgtagacgcgtagttagattttgttgttgtttcatccgtttggtgactgttgtatagctagatgacaccttgatgtgaatgagtcagaaaagtcctgctgtagatacaatgttctggccatgtgtatgaacatcgaaggagaattaattgtcaatatgaatctttg

SEQ ID NO: 27074 - DNA, 505 bp, Sorghum bicolor
  Clone ID: 6673835
tcaccacagcatgatcccccctccttcaccgggtggcttcatttcgctccctgagacgccaaatccgttgcgccagctcagcgccagctctctgactgcgtcgcttgcaggtccttctgctatccattcttctggccttgattcgccgtcgccatcggtcaatagcatcactcactactatccctcgtcttctcatccatcctgattagtttatgacaccagcttaacacttttcagtgcgcagctgttcttactctgcttgtgcgaatcatcgggaacaattgtcgatatgcgactgacgaacttgcgttatcggtgctcgcggtacttgcaaaccatatactctgtggttgatgtttcccgactagtttgctcataagttagatttgtttgtcgacaaagcaacgttgagaggccagctcaccaaagctagcttgcattttccaacagtcatacttactgtatcgctactagcaataaattatcagtacgtatcagtacccgt

SEQ ID NO: 27075 - DNA, 362 bp, Sorghum bicolor
  Clone ID: 6673840
ttgtacgtgctaatatgtcagagaacacctgagaaaccatgcttgaacgacgtaagcgatgttggaagttggaggagggcagccttgatagcttcagtgtttcttgttgttttgactctcattccgttatgggatgaactcgcggaggaactaggtgtagggcttgttacttcgttctgagacagatacggtgcttaccgatagaattaggccgtgatgtagcgcaattttgtattggaaggtagcgtcccatagtggagctgttgtaaaggcatgtggaatttccggattaggtgagcaatgatatcacaatgtgagtgtaatgaaattgtgctaagatagcccattttggctttgttgtg

SEQ ID NO: 27076 - DNA, 527 bp, Sorghum bicolor
  Clone ID: 6673846
gccagcactttcaagggtgttatccgggctctgcgagacttcgcccctaagctgatcgagcacaatgtttccatctgggtgcgacgtgccggtcccaactatcaagagggtctgaagaacatgaaggccgccactcaggagctcggcctcaacgccaagatctttggccctgagatgcacgtctctggtattgtgcccttggccctcgtccctggcaagtgggaggagagcaaggcacaggagttccaggcttaagcggtaaaactttaccaggggattggtatagtatgaagggatgaacgattttagtacagcaagatagacaaacgggtaccaggtggtgcgatgcaattcttggggcttgggaccaaaaatggtcgaacaagccgtgtacggcagtatttgagctataacggaaagaaagctaatagatctgatgacacttatggattagatgagcctctcggtttttcaatatgcttatggatcaagatgctgtatagcagcccattgatgttcgattgata

SEQ ID NO: 27077 - DNA, 134 bp, Sorghum bicolor
  Clone ID: 6673855
acggcgttttgtttgtaaacttttggagttttctggttattatctggcccaatggatggatagctagcgccctgggatacagagcccagcatggattgccaggcctttaaaaaatcaaaaatttgaatttggtt

SEQ ID NO: 27078 - DNA, 435 bp, Sorghum bicolor
  Clone ID: 6673856
agtacacggcagacaaagttaaacttttcacagtcgcagaagggcgggacgcagagcaaggctgttgagattagcgatgatgagatttcggatgatgatgcgtttgagccggcgcctccgacgacacggagtacgaggaggagatagagatgtgtggaagaataccctgcatgtgagaaaagtataaagagttatgatgaattgagcaaactgtcacagctacagcacatgagacctgtcatagactattctgcgatgtggttatcatgaagacttacaaggctgacgatgtccaccgggcagcaaccgtcttcaaagacgacaagtgttcccccttgatggcatttacaaaggttcaccccagtgcccccaagtgtatatcgtttatgcttaaccatgtctcacaataatgctcctcgtaagagcaacatgatg

SEQ ID NO: 27079 - DNA, 436 bp, Sorghum bicolor
  Clone ID: 6673865
ggaccccccggacctggcggacctccccaggagttctaactccatttgcagtaatttgaccacgaactcgttgacgaaggggcttttatacgaccaatccccggcacttatatttccttgggctcagttatcttgccttatcatgagctatcgcgtagcagttgtatctgcttttcggcagtttacgagtgatacccaaccttgatttcgatttgggatcatgactttaagttttatggcagctcaggatttcaacacgacaccacgctcactccatttccttgggtctgaatcatgattggcgttggagatctttggtcccccggtggattgtcatcaattcaattcatttaagctacttgcctgtaccctctgcgtttactttagtcactcactgctttttcctttttgcttttaactgtctgtcactgtcttt

SEQ ID NO: 27080 - DNA, 512 bp, Sorghum bicolor
  Clone ID: 6673867
gaggcagtcaaatttgttcccgaagttgccggcgccgccggtgccgtccttgctgtccttatcagcctgatcttcgtcgttgtcggtggtggtgccgccgctccttccaaggagcaggtcaaggcccagagcaagaaggccaaggacgctgctgttgaggcaaaggataaggccgctgcagctgtcgctactggcgctgagaaggcacaggccgaggtcaacaagcgcaccacccgatccaacgcttcatagatgttgtttgtttcctggtagcgagcgtaaagagtgacagaaagaaagtgcagtgcagatggtgcagagggaaccacgcaaaaaattccagtgtgcttgttagcttgttttggacgaatttcgagtgctttgatatcttggatctggggatagtcatatattgatttaggacatggcgcttcgagtgtattataggcttgcacaagaatgaaataatgaagtcatggttgtcgtatgccacagcccatgtatatgtctgt

SEQ ID NO: 27081 - DNA, 400 bp, Sorghum bicolor
  Clone ID: 6673879
aaggaacaacaaactcaaaaggtgccgttgcggctgcctgcccagctgggtcgatgctgcggcccccccacgtggttgtacacaaaaacccgtgtcggatcgttttcgtatgttcctgagatgaaggagatcgcgaacaggaaaggagagggtccacttccagaagcaccgcccctcctgcccccgggagggaccggacctgctctgggtttcttgcaaagaaaagagcacgggttcgtgctcgccggcttcaaggggaaaccgctgaagctggtagtggcacgccccgcctgctactgatgtatgcgtggtcttggactgggcgatgtgtggaaggtccgagctagccatgcggaaagccgagcaatgggtagatgacggtttgaatctattccattgg

SEQ ID NO: 27082 - DNA, 443 bp, Sorghum bicolor
  Clone ID: 6673899
aacgacacaggcgtgggactgattccgtgggcacccctttgccgtggccatctggcgcgtccggcgtcggcctacggtgagacgattcgctccgaaggcgagaagaaggctggtacttcgactacaggcccacaggtcgaagcagaccggaagaccatcgagcgcgtggaggaattggcgaagaagcatggttggagcatgagctcggttgcgctggcttggatcaacaagcgggttgcgtcgcccatcatcggcttcagctcggtgaagaggatcgacgaggcgcttgaggcgagaggcaagacgctgactgaggaggaagagaagtatctcgaggagctgtacacaccgaggaacattgttggacactcgtagaggatgaggggtagttctaataaaggataaacgctatagatgtacaagcacatggacgttctttagcc

SEQ ID NO: 27083 - DNA, 135 bp, Sorghum bicolor
  Clone ID: 6673913
accattggaacaaatggatatcatgagttcaggaatctggattccagatcatcctgaatccacttgaggactatcaagcaacatctttagaagtgtagtcacggtcatactagaatcgatcatattggcaatctg

SEQ ID NO: 27084 - DNA, 525 bp, Sorghum bicolor
  Clone ID: 6673924
acgaggttctaagattgtacccgcctatactgctacttggccgggagacatatcaagaaacagagcttggaggggtcaggtacccacctggcgttgtattttcattgccaattgtgtgcatccaccacaacccgggagtttggggagaagatgcagacgaattcaggccagagaggttcgcggagggcgtctccaaggcatccaaggacgcgccggcgttcttcccgttcggctgggggtcgcggatatgtgttggtcagaacttcgcattactggaggccaagatgggcttagccatgatcctgcagcacttcttgttcgagctctctccgtcttacacgcatgcaccgtgcgcggtctccactctgcaaccacagtatggggcgcagataaagcttaagaaactctaatttttactaagtggccagcgagccatagaaatatgtttcccataactagtgcttagctggtgatcttggaaggggtcgtatggctgtcaatttatgattataaatatataatcta

SEQ ID NO: 27085 - DNA, 527 bp, Sorghum bicolor
  Clone ID: 6673940
gtgctttcctcccattttttcctccttctagcgcttttctgagaggaccgcgttgggagacagggaagatgtgctgacgttgaaagtcgacatttttgtgcctgttgtacggatggaagtatcctcgtcccttggatgaagggttggtttttgcgttctttttgaacgccgcctgagttgatcctgtgaggcgcttgcgcccgggacttgtttttacacgcgttctagaaatggtgatggtgccaaatggcccgacgaatccactcgagtggcctgtcagcgggtgtgaaaattgggggagatgtggtcttgctcagattgtacgtattcaagaccatcgatagagaatggcaaatactctccctcatcttgtacttccgggctttttttgcttgaagccatttcacagacacactcgctcatgcagcacccactctccttctgttctttgctcaaataggcccgttaatcgggtagagcaccttaggtagattaggtagaatatcaatacaagtatctggtctcta

SEQ ID NO: 27086 - DNA, 543 bp, Sorghum bicolor
  Clone ID: 6673942
tggcgggtgctgaagcggtccttggacgacggcgggttcaccgcctgccggcgcttctgccggaacagcacaaagatgaacctgtggatgccaatgtttggctttggggtctcgtagctcaccacctctctcccaaaagaagcatcagtagtcccaggaatatcagtaacaatccagtgaaggtgctccctcaggtagggatcactaggtcctggaacatcagggtcagtcatcaccaatgtgaagaaggacctgaggtcacccccttggacctcaacacgcggcttggcggtgactgcggaagggaagaactcatgtccgttgaagacctgcttgttggagttgtaggtgaccaccatcttcaccgtggggttgaaatggtccagcacctcaccaatcactttccccacaatgagaggctccaacacccttgacatgtctaacagtacagttgaagcaaatctcagctgaacctaatgacctacgatgatccagcagttggtgttttgtgcttcctaaatggtgatgtgcaggagcttcagt

SEQ ID NO: 27087 - DNA, 120 bp, Sorghum bicolor
  Clone ID: 6673954
tctatgtgctccaaagttttaattttcatcctgtgtggagtctgctttgaactattatactgtacatactatttcattaatacgtcaatagacaaagaaaccttatcacattgagaagcc

SEQ ID NO: 27088 - DNA, 468 bp, Sorghum bicolor
  Clone ID: 6673971
catccacaacagctactgcccgggcatggtcgacacgggcatgagcgacgtgctgcccatctacctgcgtctgcccatgaacctcatcaaggccatccgcgcgcgctcggtcgacgtcgccggctggactgcgctcaacgcggccgtcgtcgcgggcccggagtcgcacggtcaattcctcgaggacaaagacattgcacaacccgccgcgtacgtcacctccgccgagggcaagaaggtccagaagatgctgtggaacgagaccatcgacgagatgtccaagtacaccaccgtgccgtcctggatgaagaaggtctgagtgaggggaaaccatctcatgtcttcatttctttcgtccctgcggaaacatatagtgtcctgataccaaacgatgtgcgatggcgtgggcgttgggtattgttacgtgcatgtgcctgggtaataatatcatggcgtggtttgctttct

SEQ ID NO: 27089 - DNA, 532 bp, Sorghum bicolor
  Clone ID: 6673975
gaaattcgatttgagattcgatagcaagtcgatgggataggacaacaattttgttaaactatatgaaaactagcagattctgccagctaccttttttgtgactaagaaagcagcttgtttcaagttgtgtcttcagtctgtttcaacatgctctgtcttgccagggagcaatcaagtagggatattggaggggaatactgtgggtttctccttactgcatgacgcggcgtatgaggtgtggttttttaaagactctgactccggaggggatgagacttactgggtaaaagtattggaagaagcggcgtcctcgaaagcagttggggggatatcatggactgctggaggagataatcgtggggatgttttgaaacctttttttcatggaatctagcgggtgcggttagacctcgttatacatttttttcttcctttttattcatggtggcctgttccttttgttttactcctggcctatactttgttaatagtagacgatgtcgatacactcgctggaactgattaagattta

SEQ ID NO: 27090 - DNA, 219 bp, Sorghum bicolor
  Clone ID: 6673981
ttcttggccgcgaccgaggccgagtatgccgcgtgtatggagcgggcgctggtcatcaagaacgaggagccaactacctacgcggacatgcaacgaaatgcgcgccgctcagcccagcgcttctccgacgagacctttgtgcaggcttttgtcgcgtgtctcgtgcccctcgtccttgctgctcgccaagaaagagaagtctctcctttggcctcctcg

SEQ ID NO: 27091 - DNA, 493 bp, Sorghum bicolor
  Clone ID: 6673996
cttgcggctggggggaagtctggagacacactgagctacgacaaacacgttcattttccagcaaagcttgagcaggtcttcccaacaacatagtatagcaggcgaaccatggatctatgggtcttatgtgatctgggcgttcggcaccaccaacactacatgtaggtatctggtccgccgaacgtagcttattgttgcactccatctacaccataacttccttgcattgtttttgtacacagtcatactctactcgatatgtttacgccaccagggtcagcattaagttgtgacccatccgaggtgaggtaatcaaaattagcgcgtttctcaccaaaactcgctatttttaagaggggatatctttactacgagaggattctttaaaaacctaaataagctatttactagagaaagacttagtatatctttatttaagtttttaaataattttataaggtagttctccttctactaagaaaatcgtatttta

SEQ ID NO: 27092 - DNA, 203 bp, Sorghum bicolor
  Clone ID: 6674006
gccaaaaaaaaaagatcccagccaaaaaaagttgggttccctattttgggaaatgccaagttaaaaaagccaaacccttggagatggacttatttttcctttggcaaaacgtttagggacttggcaaattccatcaaatggcaaatttcaattgtaaaactgttggaaatgcttttagcaatgaaacaagttgggtttcatgg

SEQ ID NO: 27093 - DNA, 305 bp, Sorghum bicolor
  Clone ID: 6674023
ggaagaaggttgattactaagttttttttttcctctcattctcctttggggttccctttttctttctctcagttttggttttcgagtttgggggccatgaatgatgaactgcctgtgggagaagttcgccccccaagcgggaaaatatgcgatagtatttattcagattcatttgtgattctttagcttggtcctgttgcgttcgcgaggcggtgccgcctcacgaatggccctcttgtgggttgcaataataccaatatgtgtagggaggaatgaacttgctgaagaaaatggcagtggcatga

SEQ ID NO: 27094 - DNA, 137 bp, Sorghum bicolor
  Clone ID: 6674054
gcctcctattgctgactcagctgatcaaccaaaccatactctctctccaagttggccgtagatgttaattaccctaggcatttcttctttgttgtggtagatgctggaaaaaagacatatacaggatagttgttctt

SEQ ID NO: 27095 - DNA, 184 bp, Sorghum bicolor
  Clone ID: 6674061
agtattacgagggacatagtcccaagtttttggatggaaagagaattcggtaatgtgggcaaatgagggattctggataattgagcttttgacgcggttgaatactcgatcaaaagtgtctcctatttcacgcaaacttcatttgcgaattgatacccggcgacgacgctcgcctgattttgcg

SEQ ID NO: 27096 - DNA, 492 bp, Sorghum bicolor
  Clone ID: 6674076
agcaagcccctagtcggggagaagatgctgctccgcctgcgcagcgccgtcggcaccaagaagctgcagcaggcgctctccaccgcccagtccgacgccgccgacctcgaggccgcgcgcgccgccacgaccacgtcctacacctagctagaccggccgccggataatcaaccgggcagctagctgtgatgagcattgatagctccggccagtattggctgccgtacgtgtggagcaggcagtaggcactaggcagtgcgctctcgatcggcactcaatcggcaacaagaagcgtacgtggctgcatgtggatcggatgatatcatttatactgtgtatgattttgatccaaggtccatttacacggtgaccatgcatgtacgtagctagatagacgagagtcgctgcttgtaccgtttcttttcccgaaaaatcaaccagcatgaactacagcgatagtatctcctagagtctttataaacctcactttct

SEQ ID NO: 27097 - DNA, 434 bp, Sorghum bicolor
  Clone ID: 6674080
ctacatctgtcgttgagtcagccaaggcggtgaaataccctgttccccctgtagcgtccaagggatcctcgaagagtgttcccaagaaggggaccaagaagggctcccaccgatcgcacaaggcgcatagtgctactcatcgtcgatgccgccacggtagtcaccgtcgtggccgctgcaccaactaatcatagcaaataatgctgttatttccagcaaaggcattgctagcttgcactattggataatattccagcgataacttgggctgtaggattctttctgaaatttttctttcacttgtacttataatttgcgcctgggatgcgcttggaagatattcgtcttttgctggccggtcaagacgagtatttcgctattgagaactagatggatagcatggctagatagcccatctattgatcggtggtccc

SEQ ID NO: 27098 - DNA, 367 bp, Sorghum bicolor
  Clone ID: 6674082
atcggcgtctgcatcttccatgtcagtgttgacgaggagatgaaggtggagaagtcagagtacttttacgagcgcggcaacttcctcgccagcttcttgagcgcccctgccgctgatgcggcgccaggctcaggctcatcaggctgccccgtgatgcacgggaactgaatatatgtctgcaacatgacattggaaaacttcgcattaattattggaacattgggattagcattagcgacttcagaacacgtaccgaatccgctgttgttaatgatgtaattccatgtggcattaaacataagtgtttgaataataaacatgtcgacatgttcgttgcttcgacacattagtagaaacggaggaagag

SEQ ID NO: 27099 - DNA, 506 bp, Sorghum bicolor
  Clone ID: 6674085
ggtgttgacgatgctggactgaaggagataatcggtgctgcagttaaaaggaagaaagctaaacatgctgggatgtttgatattgccaagacagcaaatagacccatgatacatataggtggctgagaatttcctcatgtccaatgtgaacgaataaaatggattgtcaactgctgggttgctgccttgtttttacatggccgatcatgaaaaagttttctgacgcaatgggccaacttttcctgagtggtttaaacattagaggaagtgaagtatatggtcactgcagtcattaaaatagatccatatacttgaacagcattacagaaactcagtcttcacgtgcaaaggtgtttttggttgtatacttgtatgttgtatgctcataagtcataatgtcacgttgtgtaagctatcttttgaaacctcacagtttgtgaattaaactgctaccgtgagatcaatcgtacaaccttgtttcccattttagaaatataagcatttca

SEQ ID NO: 27100 - DNA, 392 bp, Sorghum bicolor
  Clone ID: 6674094
acaccaacaagaacgcctgggagttcgccgtcaccaagaagttcaccggaggagataccgtcaagggcacctacgccgcctccaccaagctgttcggtctcgaatggagcagggactctatcgctggcggctccttcaaggtcgggacgacattcgatttgtctgaccaaagcaaagcaccaaagctaatagcagagagcacgtggaactacgagatatgatttttgcctgaggcagcagcaggcagctccttatatctccccataaaaatgaaagcgcccttctcatatcacacatactgcttgattcgtgtatcctcctgaactatagaactattgtttttcgggtcggcgcgccccatggtggttaatttatatatctggttctgttga

SEQ ID NO: 27101 - DNA, 473 bp, Sorghum bicolor
  Clone ID: 6674104
cttcacagggcttccactactgtattcttaaagcggtacttcggccggaaagaaagcggttctggtccggtcgactcccgtgcatgctcctctgggtcagcacgaaaagcagttgttgccttgtccggataagtgggaaggtgcagacttcctttgtacagctctgttaaagagctttctcagggggatacgattattcatcccacaacccagccctattaggaagcgatagaagtggaaagatagctggtttcagatcggcatcccatctcctcacttaccagaggatgatgaagggaggcaagatgggcatgggccaactccacccacggcttcttccagccaccttccggtagaggtaagagaaggatcgcgaagaaggtgcagatcaggcagaggaaagacacatacgcccccgccttaatgaaacaacaggagtacagttatggtgagaaagagttatcaaatattga

SEQ ID NO: 27102 - DNA, 356 bp, Sorghum bicolor
  Clone ID: 6674122
ccgttcccggtgcacctgttccagggcgacgaggacggcgtcgtgcccgtgcagctgcagcggcacatatgccgcaagctcggctgggtcaactaccacgagctccccggtactggccacttcttgtcagcggtgacaggactcggcgacaggatcgtcagcacgctcctgtcatcgccgccggcgtcggcgtgaaatgatccaggactcgcatctagcgagctacgtagtacatgactgatctgttgtagctgcatgtatcgaaccaatgctggtcggtgaagaaaggcaattcctgtgagctcaggctttactgctattgtaccaagaaactgaatagaagaaagcacattttt

SEQ ID NO: 27103 - DNA, 427 bp, Sorghum bicolor
  Clone ID: 6674134
ctggttacactccagtcttggattgccacactgcccacatcgcttgccgattcaacaagttgttgcaaaccatcaacaagcgtaacggtgaggtcttggaacaggaccccaagttcatcaagtccggccaggctgctatctgcgagttggtcccatctaagccaatgtgtgttgaggctttctccaagtatgctcctttgggtcgtttcgccgtccgtgatatgcgtaagactgttgcagtcggtgtcatcaaggtcgtcaagcgcaagactgagaagggtgattggatcatctctggcggtaaggaagacggtaaggccgtcaagcctgatgtcgccatggacaagaaggccctcaaggctgccaaggctgccgctggtgagaagaagtaagtgcatctgattcgtagactctccagttttcattg

SEQ ID NO: 27104 - DNA, 515 bp, Sorghum bicolor
  Clone ID: 6674140
gcaatgaatgctgctatgagcgactttgctgcccagtccggtgaaggcagcactgccgccaacacacgcgattttggaggtcaggatttccaacaggccatgaacgctcgtgtcgtggaaaacttctagtgccgtgcctcgaatgagggctagctgctgactctttgagtggctttggtggtttagcgtggtctacttgatttcgagaagcgacttccatcgttttcaatgacgtctacgactttttcccatccgagtctcttcaagatgaatgccatgccttgcgctttcgatatcgcgactcagctctttcgttttgagttttgctccccgtcgattattacacgctctacgtctcgtttacgctcgttatgatgtgttttgtaatgtatgttgataccaaacaaaggtggaagtggatcttggggtgagggtgagaaagatgattgcttgacatgtatgatacccaagatacccaggagaatgatggccaataagcaaaacgttagttaata

SEQ ID NO: 27105 - DNA, 542 bp, Sorghum bicolor
  Clone ID: 6674160
tccactagttgattactcatggcgaatggaaatggggggaagtttgaaggaggaaggtttgcctgtgtaaacatgttcttgtcggtatagctgtcagacatggtggcatgtgcatatggtcatctgaatctaggtgacttgtgcaggttgagaatcggcagatgaaaaatgctagaaaagttcaatagatggatcatgaatgttagttctgaactttgactgctgaaatgaagaacagtctgtgatgcagacattgtcgaggtaccgtgatcgttgaacggtgctgttgaaatttagattcaggatctagggatagctcctttgttgcacttgcacacattggtagcaagggttgcagaaggcctgtacactttgaaaggtggggtcaaaatgatgctgatgatggtttgtaaatgattttctttgttgacatttacactgtagagattcagagaacatcatttacttgcactatcaatagtcagcatcatcaaaatttgttgttccttacaaacttatttgtctggaagaatatattgcgc

SEQ ID NO: 27106 - DNA, 414 bp, Sorghum bicolor
  Clone ID: 6674176
aacaagctattcaccaaggttctcaagaagggtgatgtgtttgtattcccccaagggctcatccacttccaattcaatcctaaacatgacaagccagcagtcgcaatcgcggcactaagtagccagaaccctggggctataactattgccaacgcagtctttggatcaaagccaccaatctcagatgatgtcttggccaaggcattccaggtgcaaaaggggacaattgattggcttcaagctcagttctgggagaacaaccacaactaaataaatcatgttcggccattgtatgagttctgcaataatttgtatgggaatatagaatttttttgcactttacttactactgtatgtttttattatttctatgctactaatgataataaaataaatggtcagtatttctctact

SEQ ID NO: 27107 - DNA, 401 bp, Sorghum bicolor
  Clone ID: 6674182
tctcaaaacggattgttttctgcaacttgaaaatatgaaggaggaatcgccagtaatcgcaaatcagaaaagttgcggtgaatttgtacttgagctctgtacaaaccgcccgtcacggtctgagaggtggtttgcttcaagtgggaaaagtgattacttttgctttcaagtttagtaattaacagctcacgtcggtgatctgctgattgggacgaagtcgtaacaaggtaactgtacgggaacgtgcagttggataaaaaaacttttataaaaaatttttaatatttaacggctaaatttcgatttagaaaccgttgtttttactttaatataaatatttttttagagactcgtattaatgttgaaatgttgagtaatcgaaaacaatcgatttttatccc

SEQ ID NO: 27108 - DNA, 456 bp, Sorghum bicolor
  Clone ID: 6674188
gccactacaaggtacgtatacagtacgtaggtaggagaatcggctctcgcagtcgcaggctccgcacgctgccatgcatgttctgcaactcgagatggatgatggacgacgaatgcgcgcaggtggcgattcctcttcaccggctgagggcggcgagcccgtcagccaacaagctgaagcccgcggagaagttcatccagctggtgtcggtggacagccacgagttctggttcttgggcttcgtcaactacgacagcgcggtagcgcacctgcaggaagcgctgagcggcttccgcaacctgcaggcgtgacgtacgtgaattgattcaacagagcgtttcttctgttccccttgtcgaatcgtttcattcagatttcagagaagagaccatgattatcctggtgtggttgccattgtctgcgagagaacagtcgaatcgtttcattcagatttca

SEQ ID NO: 27109 - DNA, 451 bp, Sorghum bicolor
  Clone ID: 6674190
tggatcagcgaagtcgagcagattgctccccagcgaacatagtcggagaagcagtcagagttgcctacaaatcccggtaccttggcttatgctcttgacgaacgggtttgcttatcgggtagttagcctgaaagccaaatgaggcacggccttatgtgagatgatgacttaaagaaaattcaaggatagtcgatagatgaatgtggtcgatgacatgatgatgaccaagggccggaaaacctctctggaagatagagtatgccaccattgcggatcattcctttggccagttttttcgacgagcatcatatgttccataatcagtttacagttcagcctgatgaaccgaacaaattactgacaagactcgcttcatagttatgaacataatgctctaacatattcgggacgttgttgttacaaaattaataagtatccaacttataactcg

SEQ ID NO: 27110 - DNA, 495 bp, Sorghum bicolor
  Clone ID: 6674204
gttttggcatgctggtgttagaaatggtaagtggaaggaggaactcagacccaagtgttgacagccaaaatgaagtttacctcccagagtggatctttgagagagtaatcactgagcaggacttggtactttctagggaaatgactggagcagagaaagaaaaggtgagacagctagccatggtggctctatggtgcattcagtggaacccaaaaaatcgaccctcaatgacaaaagtggtgaacatgttaacagggaggttggagaatctgcagatgcccccaaagcctttcgtctaatctgaattctgaaagtcatccagtgtcataaaaattatattggagaatacatcatcattgtgtactgaatatttgagacataaacttagctcctgtgtgttgcagagtactagtccatagtgcctgcatgaaaatgtatttgagtttttccactgtatctgtatctgatgaattaatagtaacttgttggcttctc

SEQ ID NO: 27111 - DNA, 461 bp, Sorghum bicolor
  Clone ID: 6674216
gccctccgagatataggccagagggacatagcagaaatggtgccttatgatgattactactatgaaggtgcatcacttgtggccaaccagagtttccgagaaattgagcggaattctgacacttcaacgaagcggggatccatatccttccgcacaatgatcagagaagaccagcttcagcaggatggtacagatgagattggcttctcatctcgcagtggtgtccatattggatcaccctcaggctcttcgccaagcgcagcaatgccgatgctccctctcaaggaaatccctagatactaagaagtattcacctgtgcctttttcccctcttctatgttctcccccttttttcccttctctttcctcttactaccttaatgataacagttttgtggcaatcaaaaggtttttgtaaagttttttccaagtagcttaactcatcattagcccagtactct

SEQ ID NO: 27112 - DNA, 534 bp, Sorghum bicolor
  Clone ID: 6674223
attgtgagaaaattcaaggcttatgatgctcaaattaagggcaccggtaatgaatacagggtgtctgtttcaccagcaagaagcaagagtaattcacctgatggcaaggaagaagcttatgcaagcagatatcaaactgaacctaagaagaaagtgtttacttctgtgcaaaagagcgaagctgcttcatcaagaaaagatagcaatgcctcacaaaaacaaaagggaagcattcaaggaagtttgagctccattaattctggatatggatctgtgagacgtggtgaggactcaaagaaagttggtagtgtcgctggatctgttaaaagcaagggcttttaaaataccataagaaatatttatttatgaattctttttttttcttcataccataaaccaaaatgttgtcaaaaatttgtgtgtgtttgcaagtgcctttttttcgatttcgaataaattaaacaaattatgcgtaattatgatctgttgtaactagctacatatatattagctttttctctcaaatctcaacct

SEQ ID NO: 27113 - DNA, 516 bp, Sorghum bicolor
  Clone ID: 6674224
tgccaccgctcgaagactatcgcactgtcatggtccagcgcgcaatcttccagagtgtcgccagtatgggactgcctgctttcactattcatagtgttgtgaggtattctggccgcgccatgaagaacatgaagaaccaggtcatcaggacttgggctccaattggtctaggcctcgcagtggttcccttcctcccagctatgttcgacgagcctgtcgagaatgccgtcgagtgggcattccacaaaggattcgagacatttggaggtaaggacgcagtcggcaatgcgcctacgacgggtcgcgaggatatgctggccaagaggccaaaggagaaggaactgtaatacaaggctttgcacaacaaacttggcgttcggggaggtggaaggcgctcgactcatgttttaatgttcaatcaatgtataggaatattgtttgcgacaccgagtcggtcactgacttaaaccattccaattatgcaacaatgaactccgtggcggggagaccccgcga

SEQ ID NO: 27114 - DNA, 298 bp, Sorghum bicolor
  Clone ID: 6674228
accgacaaccccaaaaggaagcttcccgaaaggaggaaggagcgcatccctctcgctcagtcgattgttgaccagttcgctgccggtggtttttacgctagcattacctccaggcctggccagtgcggccgctgcgacggctacatttttgagggcgaggagctcaacttttccctcaggaaaatgcaaaaaaagaagggtaaggctcaccagtaaattgttcatcattttacctctctcctatcgatcgaacccttggtcggcccaggcgactcaaaaaataaacaaaaactccccc

SEQ ID NO: 27115 - DNA, 470 bp, Sorghum bicolor
  Clone ID: 6674232
tactatgcaagaagctgcaactggatatcaatgagatcactgtcgatgcgacgaccacaactggtgaagcttcgttttatgctgacagttgtccggcacctgccctaccctctgagagtaagactgcgactggtggtgccaagtcaagcaaagggaggccagcgaagaaaccaaagacagaagtaggatccaagaacatcaaagatatgttccgaagggtcacaaggaatggatcaggatcatgatgcctcccttataaccttcgtgtgactgaagcctcacgtggcattttgatgcatttggagctgcaagattaatttcaaaattggattagatgacatgccatttttttttggctcagtccagcaccccctttgtgaaatctatgtatgtgagttgcagaggctaacaatagattggaattatattgtagcgttaattggtgattcaggtagtgaactccgctagtc

SEQ ID NO: 27116 - DNA, 303 bp, Sorghum bicolor
  Clone ID: 6674238
ccggagactaaatgaagtaacgacttgtttgatgttcatcataaagtagaaaaccatgccttttggagtttggcgtcgggaaaaggacatcgtggatagggtggttctcattagcgaaaaggacaattgatcatggaggttgcaaattatgtgagaaacaggaatagatgggaagcaaagagctattctagagtgatgatcattttggtgcatttcattcctggagggtatcatgacagtcagataatgttacaaattgtacaatgggactaataggtagtctcctctcattttttccccccc

SEQ ID NO: 27117 - DNA, 505 bp, Sorghum bicolor
  Clone ID: 6674255
cggtagaatgtatgatctgtagatagctagtaaactcacatatcaatggtggagagatgctacagatttgcacgtaagcatgcatcacggaattgtgcttgctgggtgatggcctcctgtcacatacagagcagagagattggcggcgtgtgatagctagttgctcggctgcaaaaagtagtggaataggttggttgacataaccttgtagtctctagacatagcagatagacagagtaagttcgccatgaaacaaacaccagctagaaacagaagattggattgtataacatacatagaacatgaatggtgagaaggttcgtgtaagtgctcaccatgtttcagctagtacgaacggcagcggcgtgtggccgggttctacctggacaggggcggagctagaatttaaacatagggggggccgtgcaaaccaagaacagttatgtatatcaaaatattacatgacaaaggtgtacatagcagcaaaataaacgtttgcgtcacg

SEQ ID NO: 27118 - DNA, 292 bp, Sorghum bicolor
  Clone ID: 6674257
tgaagattatgcaactgaaaataaatttgatcctttttttcctaaacattggtatgcccaccctcgttacaaaattatggcaaaccagggtgctgttagggtaatgagatcccatagaaacagtgttagccaagctcttttggattttttcccttctgttaactttaatcctttgaagcttaaagctaaatagttcccaataaaccctgggtttggccttcggtcccaagtataaaccaattcatgttaaatagaatggtaaatattataggtattaaaattgaaaacgttt

SEQ ID NO: 27119 - DNA, 540 bp, Sorghum bicolor
  Clone ID: 6674258
taaaggagttactcatcaattcattgttggagatctctcacatcctcgcataaaagatattttgttaaaatggcatgagattgatactaggattagattggaggagggttacatcccagacaagaaggaagttttgcttgacattgaagaagaagagaaggagggtgctcttagccggcatagtgagaagctggcaattgcatttgctttgattagtatgagtgacaatatgcctattcggatattcaagaacctcagagtttgccatgattgccatcatgtcaccaaactaatatccaaagtatatgggagagaaattattgttagagatagaacacgcttccatttgttcaaagatggcagttgttcttgcaaggactattggtagcagttaacactttctgcaatcaaattgtacctaattcacgagtatcgtcttgatgaatacatcagggattcccaagcagagggaatcaagttgtttaaagggcaggttcctcgcagacatctgcacctatataaatatgctgctgccaattc

SEQ ID NO: 27120 - DNA, 472 bp, Sorghum bicolor
  Clone ID: 6674278
cgcctggccaagcttggctactgctggcagttcatcacgcttgcaggcctgcacacaacagcccttatcagcgaccagtttgccaaggcatacagcaccgtcggtatgcgcgcttacggcgagctcgttcaagagcctgaaatggagcagaaagtcgatgttgttaagcaccagaagtggagtggcgcaacctacgtcgatgagttgcaaaagatggttacaggtggcatcagctccacagctgccatgggcgccggtgtgactgaggaccagttcaaataaatcactgctggtgaaggagaggtggacaacaacggagcacataaatgaataaagatcaacatgggctgagaaatgactggaggttgttgtgggagcgcaaaaaaagagcggcaagttctttgtctttggggcattttgatatcacactactggtttccgatttttaattgccatattactttgcatacgg

SEQ ID NO: 27121 - DNA, 357 bp, Sorghum bicolor
  Clone ID: 6674279
ctggtggtcttgctggcctccaaggcgcctcagccttgctcaaccgaccaggtgcccaaagcttcgttgtcggtggcacccaaggattccttccaggacaaggtttccgacgataaattgttgagatgatgatgaagggtacccacacacatataccaatacatccactccgtgcacattgaattatataaacccaaagatatacataccctctctcttttctctacaacatatgatatgaaaagaaacaaacaatactctcattgagagaagactactgaaaacatcaatagaacttctgacagagtgcttcctttttggacttctgtctcttgcattttcaacttcccatctttg

SEQ ID NO: 27122 - DNA, 527 bp, Sorghum bicolor
  Clone ID: 6674286
ttgagaagatcaagatcgctgttgtgcgacgagccaattactcaaaaccccaatatctcaatgacgatgatgtgctatcaagtttcatacaaggggaagacgactacctcggccttgaccacgtagatagaacgaggacattgaggaacggcgttggggacctgttccttaaataaaggatgctgaatgagaaggagatcatgttagttcgagagcatgtaagcaatgaggcaatgagtgtcgccgatgatgaggcagagacactgagtatctagcatatatgcctgcttgccgcttggaaaccgcaggcgttcaagcatcgtacattcgcagtcaaaaagcattggtgctgctgttcaactgaggagcacaaagccgtggaaatgagtatacgcaggggcgcattacatgaggtgaaatgcgggctttgcccagtcatgatgatgaatggaaggcatgcgaagtgaaagcatgaattaaggtgggttagggcgatgattacggcataaatttcattcttactattc

SEQ ID NO: 27123 - DNA, 492 bp, Sorghum bicolor
  Clone ID: 6674309
tccttgcgattggtgaagcaagcaggatactggatggcaaacaagacttgttagacggagacagtgctagatcttccagcgcaagtccagttccagacctggagaacaaacaagtagaagcagaatctgaagcagttacaggaggaaacaacaactcctgattttatcttctgaaatggaaacaggacgcatccagaatagaccagcggtttggtttctgtccgcgaagattgaggagcatgaatgaatggttataaagcgtcacagctggttgtacagggctttacactaactacattgtgaacaaatacaatccaggaggattgtacagggcaagctggtgtatattcacaagaccctgtgacattttcttatttctgtttggtcaccgatagcttttccacggctttgtactaaccacatacatcaagtcattgattgatgacatgccaatgttgattgatacggacaccaccgatgatgccctaaaaa

SEQ ID NO: 27124 - DNA, 556 bp, Sorghum bicolor
  Clone ID: 6674313
tgaccagtgcgcgcatccgtgagctgaggaaggagcaagggctcggtgaagactgggacatttggcgcgatggctgtcctggcggagagtcccccgaggacgtgacgacccggctcgacgcgctgattgcagacctacgtgcgcgcttccacaacggccgtttcggcaagaatgcgggctggaggggatcggatgggaccggtgccaatgacgttttgatcgtggcccatggacacatcctccgtgcctttgcagcaagatgggtgggcaaggacttgagggacaacccgagtttgatactggaggctggtggcgtgggcaccctgagctatgagcatcacagtgttgaggaaccggccatattgcttggaggagccttcgtggtcgatgtggtagagaaggagcaggaggaggcacacaagcactgaacgaggatggagcaggtggagaatttgaagagctcgagctctgcaaggtacatcgttcagcatccgcgagccaggcttgcccttaattgacagcgcgcacacacccaaagccaccgcttaccgtttcg

SEQ ID NO: 27125 - DNA, 509 bp, Sorghum bicolor
  Clone ID: 6674319
aggaagattttccttttttcttgctcccaccatctccagaatcaccatgccaaaactgtagatatcagatttgctgcttggtcttccatattgtcttgaaaacacttctggtgccatatacccaatagtgcctcgtgcaccagaaatagtgacctctgtttcctttttttttgcagagctttgctaatccgaaatctgatatcttcaggcacatgttctggtctaacaggatattctctggtttaatatcaaaatggagaatctgtgttctgcagccagtatacaaatagtctataccccgtgccactcctacgacaatctcatataacttctgccagtgaagttgttttgtctcaactgaatctatgcttccaaagtgtgtataaatttaaagaaccattctgcatgtattcatagaccaatgccctgtgagagccttccaagcaataccctaagagagagattatattgaagtgacttgcccgactaatggttgtaacttcattttc

SEQ ID NO: 27126 - DNA, 500 bp, Sorghum bicolor
  Clone ID: 6674324
ttgattctgctgcttgcagctttcatcatttgagctttaatggcacgactttcgattgactgtcgtcttgatttctatttttttttaagaagcaaagggggtttacttcttcctgctgattataactgttcgaaggacgcatggatttggatgacatgaaggtttgaaatagcatcaatgctgtaaccctttaatggtataattaggagcgtttgctagtatgcactggctagcatgagaaagaatgtaaagttccactttttcagaagttctggggaactgaatatttatttccataactagcatagtagcactagatttgctcaaaattggacttgtaacgaatcagctagtagttctgataatgtagctctctgatgcctcataatgtaacaatccactttttttggaagttctggggaactgaatatttactccctctctttttacaaactagttttattaaagcaatgatatccaaagaagagcggcttgttaga

SEQ ID NO: 27127 - DNA, 479 bp, Sorghum bicolor
  Clone ID: 6674332
tcgagcctaatccgatcaaaaacgccgacgtttactggcttcgatacgtgatgcacgattggtcggacgagttttgtgtccggattcttgcggctatcaagcccagcatgggctcgcggtcgcggattctgatctgcgatcaagtcatgaacacaacgctgggatcggaggagcttgccgctgcacctgctcctctgcctgcaaactgggggtattacactcgttactcgcatcaacgcgaccttgcgatgatggcgttgttgaacggcattgagcggacgcctcgcgaattccgcgtcatcattgaaagggcgggattgaagctgcataagatatgggactgccgtagccaggtctcgttggtggaggttgtactgccaaattcggagctcgtgtaagatgcggttgttgaagtgtcggagtaacacaaaggtggtggtggcgggacaggtgattagtcagtattttaaggacagctt

SEQ ID NO: 27128 - DNA, 539 bp, Sorghum bicolor
  Clone ID: 6674334
acgttccccactccgagaaccgcttccccggttacgacatggagtccaaggagctcgatgccgagaccctccgcaagtacatcttcgccggtcacgtcgccgagtacatggagactcttgccgacgacgacgaggagcgctacaagtcccagttcggtggctacgtcgaggacgacctcgaggccgacggtcttgaggagctctacgccgacgcccacaagcagatccgcgaggacccgtggaagaaggaggagtctgacgagcccaagaagaccaaggaggagtggaagaaggagtccctcaagtaccgcactcccaagctcaccaaggaggagaaggagaagcgcgtgcaggagaagatcaagcagctcaaggcttaggtctgtgcagctctgcctctgtgaaatggaacgacaaaagcaggtcacacggcgtctggggatgctttgggaaacggatactgtacctggctagcatcatcgagctagtagccacatgatgaatgggcattaccactttcaatgattcatgataccccc

SEQ ID NO: 27129 - DNA, 361 bp, Sorghum bicolor
  Clone ID: 6674338
tgactccccccccccccccttctttacacacacacatacagaaggctgatccgagccaattgatgcgacaccattgtcgctttcggcatgattctacgaacggcgttcctcattattgtctcttcgacactcttttttttttgtttgttggcatgggcaggcgtttgggactaggcactgtcctccctttggcgttttgggtctttgtttgttgcttgttgccatcttctttgtctacggcatgcgataccccccagctcacacgaatggatactctacagatgttttccatggctcttgacgccgcaacatgcaggcttttccttttggtagtcatagaccagaatacaatcattttttg

SEQ ID NO: 27130 - DNA, 531 bp, Sorghum bicolor
  Clone ID: 6674339
gaaaccgagctcgaaaatgtgcctatggtaactacagaatccggtctgcaatacaaggatatcaaagtgggcgaagggccaagtccacccattggtttccaggttgctgcaaattatgttgctatggtgccaaatgggcagattttcgacagttcactggagaaaggtcagccctacatattccgtgttggatcaggacaggtgattaaggggcttgatgaagggattttgtcaatgaaggttggaggactacgtcggttgtacatacctggtccattagcgtttcctaagggtcttacttcagcacctggaaggccaagagtacctccgagcagccctgttgttttcgatgtcaatttactgtacataccaggtctcgatgatgagtgaagcattcgtggcgacagtctttttttttttggtatactccaagagcaacatactgtacatgtagagcaacaattctttccggctataaagtgtatgaagtatccatgttaaggacatagtgaactctcgaaaattggagtg

SEQ ID NO: 27131 - DNA, 493 bp, Sorghum bicolor
  Clone ID: 6674340
tgtgaaggtgttctcaaagaacaaaggtcgtgttaccaatgtggcaaaggagtctgaccctgccgctcaacgggcaccagacgaatttattgagatgggaggtaagggcgaccaagaattattcgcggatgatgattcgagcatttacccaataggtgataatggcgagaagatcaaggcgaacaaggccaagcgataaatcagtgggtttggaatgttagagttgagtatgcgggatctgggagtatttggctttgttctggtgttactatcattgagttggtattcgatattgattgtttgaaggagtatcctctatagagacggtacatgggatcatctggtgtcttgtattggatgttgttctttctggtttgtttcttcgcttgcatacatcttcaatcacagaggaaaggggatggatatgttgagaagggctgctcatcagcccagtagtaacttgaaagcgtacgaaaagtcttgattgtttttt

SEQ ID NO: 27132 - DNA, 412 bp, Sorghum bicolor
  Clone ID: 6674344
attggcgattgatgaagacgatactgactagatgccatgtgtacgacaaggagaggtactacgttccgttcgatgagctcgtgccggaggaatcccaaccaatcaaattccttaggaagttcatgcccgattatgcatgatgctgtcacagctgttgactagttgagagtattgtcggcacaagcggacagtcagtttcagtggcttagagagaggggacacttcctaacagcaactatgcatatcccaaaattttgactgaaatactccatgttacactagtatttatgcaataggaaagcaatgatttgtaccgaaatatttgtatttcaggaaatagacaaagacatgcttgtagaaaatggaaaatatttgtatttcatgaaatagacaaaatatttgtattttcagg

SEQ ID NO: 27133 - DNA, 466 bp, Sorghum bicolor
  Clone ID: 6674346
tgttcagtggcaaatgtgggtgggtgcctgggtggtgtgcaaccgagctaagtaggaggttgattggcgatatacattttgcatacttcaaatgtggttctaggatataccgatgatggcgataaaaatatttgtaggcttccctcattgtgtttgatatattgtaacctatgcagtgatgctgcttgattgttattacatatggattaccctaagaaatatcttctgctaatgcaggtattgcaccatgattggaactttcggtatagataatgcgtatgtgttgcttatatatgcttgtgatagcatggttattggataaccttgtggtgttgtcaaattattggttactggataaacttgtggtattgtcaaattatcttgagttttagacctccgaattgatgtgatattttggttgggttattttaaaaaaatatctaatttattcttaccaagtttgaga

SEQ ID NO: 27134 - DNA, 346 bp, Sorghum bicolor
  Clone ID: 6674357
ctggtccaccgcacggacaagtcggtcacgcgctacgagctgggcaccgtgttcatctccggcttctcgctctccgtgggcggccgcagcagcagcagcggcaggcccaccgagtcgctctcgctcaacttccgcagcgtcaacttcaccgtgcaggcggccgccgaggacaagtcgtcggtcgggtacgacctcaccaccgaggaggtgagcttcaacggcgaggccgtcaagcccttctgggagaagaagaaggacgacgacgacaacgactactgagctgtcccctctctccctgtacacaaaaaactaaactttttaactaaagttcaacacgtcacacgtc

SEQ ID NO: 27135 - DNA, 459 bp, Sorghum bicolor
  Clone ID: 6674360
gaacctttgctatctatgccgctgtgtctgccatggccctcattttcgtgtgtttgtgggtgccggagaccaagggaagaacattagaggaaatcgcattctcattccgctgacacgtcatgatctaggtatgagaagccaccatgtgctattgagtcatgccacagggccattcagttcatggattccgcggcaatcttgcagccattctttgcttggatgtatcatcttcagtgttcatatgaatgtacattgtacaatatgaggccatagtagaaggcaagtgtgtttatatatatatatgtatgaggtacgatggaatagtagcagaggcattcaacccttgcacgggttgtggaggagagcaatttatttgttgtattcatcagctataatatgtccggttaaataccgggcacgcattggaattttgaaacaataaattttgagcaaatttgt

SEQ ID NO: 27136 - DNA, 504 bp, Sorghum bicolor
  Clone ID: 6674368
aaaagggagtcaaaattcatttgcccaccgacttcaagattgccaacaaatttgctgatgatgctgaaagcaaggtagtcactgacaaggatggtattcccgagggctggatgggactggatattggccctgagtctggaaaggcctttgctgatgttattaagggagcaaagaccgttgtgtggaacggacctatgggagtttttgagttccccaatttctcagccggaactgacgccgtaatgaatgccttagttgaggccactaaggctggtgctactaccatcattggtggtggagactctgccgcctacgctgcccaatcgcatcatgaaaacgatgtaagtcacgtatctactggtggaggtgctacactcgaattgttagagggaaagcctatgcctggagttaccgcactcagtgacaaggataaagtccaagctaatctctgaaaaattaaataaagcctgagtgctgatacagcacactaatttatttacattt

SEQ ID NO: 27137 - DNA, 474 bp, Sorghum bicolor
  Clone ID: 6674369
ccaccaagcctgctgccaccaagcccgctcagcctatcaacaagcccaagacaacccagaaggtccgtggaaccaaaacccgaggaagctgcccggccaagactgacgctaccgccaaggcgtctgttgtccctgcttattaccagtgtggcggttccaagtccgcttatcccaacggcaacctcgcttgcgctactggaagcaagtgtgtcaagcagaacgagtactactctcaatgcgtccccaactaaatggtagatccatcagtttcgggagagaccataaaacgtctcagaagggatcctctcatgagcagcttgtcattgtatagcatggcatcctggaccaggtgttcgacccttgttgtacatattagatcttcattgtatatatttagacacataaatagcctcttgtcagcgacaattggctataagacttggcaggcttgttcaatatgacatagtttcctcc

SEQ ID NO: 27138 - DNA, 519 bp, Sorghum bicolor
  Clone ID: 6674371
ccaccccaagcgcctcggtcccaagcgcgccaccaagatccgccgcttcttcggtctcagcaaggaagatgatgtccgcaagttcgtcatccgccgtgaggtccagcccaagaaggagggcgccaagccctacaccaaggcccctaagatccagcgtctggttactcctcagcgtctgcagcacaagcgccacaggctcgcactcaagcgccgccgggcggaggcttccaaggatgctgccaacgagtacgctcagatcctttccaagcgcatcagcgaggccaagactgcccacgacgaggcccgcaagaggagggcgtcttccatgaagcactagaggatcatcatgagttcatgattgggtcgtgagatggttacattggcgtcggcatgaaaaacaagggagtgagctcctatatctgaatgaaaacttcgggcattctaggggataggcgcttctcataccactgactgtttcaagcagttgtctgaataaacaattgcatcacttcacgaccg

SEQ ID NO: 27139 - DNA, 511 bp, Sorghum bicolor
  Clone ID: 6674374
accccggtccattgccacccacataccctgtccgatatgcatcacctcctcccccacagcagcaccatccatggccatcagtatacccatatcaatatggatcgccgccaccccctccgctgcattgatagaaagaatctcaaacgcaaggaaggatagttggttttgctcttgtccctctggcaatggctagtagttgccagattcagcatgtacgtggtcattgtcatgcttagcaaatagtgttggttgatggctacaggcctcaagagagcgtggtaagctccacagaattttctaaattatgttttgtaggtgtcggtccagccattggtgctgaaagggattggattgaaggtgatggatttaggcttgggattggtggttaattggctgtgaataagaagagtttgagagggacagaggaggattgtaggtgcagggatatatcatatatctggttgtatagagaagtttcagttctgttaagttcagtcagacaaaagtttag

SEQ ID NO: 27140 - DNA, 450 bp, Sorghum bicolor
  Clone ID: 6674377
acggtctgggaccggtgctgtcgggcaacacaacgtatcccgtgatcaattgtccgccagtgaagccggagaatgtgaatttggacgtttggtccagtttgaatgtgccatcgggtctgggatgcagcaccgttctctatccggaagctgcagccttgcaggcggctcagatcattggcttgggagactttatggtctggtccaagttgcgcgtgaaactgttgagtaatttgaacagtatccgattggccgaccaaaagttgaacgcgtaaatttggctcttacccattcggtgtgtgctacacatgttccgtttgtcacattccgcatattgcattttcttcgtttgtaattttctaccctttttctactctaccacttagtatacaaaacgcattattgtcacgcatgcatttgataatataatgaaataaaacttctgttttatcc

SEQ ID NO: 27141 - DNA, 508 bp, Sorghum bicolor
  Clone ID: 6674379
cgacgtgactgaggctatggccggagcctccctggctgagcgccctactcagagcgtccccggctcccctgctcgctcctcatccaacgccggcaacctgcatcgtactcgttccgattccaaggtacctgtggcggaggctgtcgagactcgcctcaccaacaaggagaagtacctcagcttcttttcgcttcgcgaggagggtggtgactacatccaggatgtgacagagatgacaagggtaccggttatcctgaagacggatctcaccaagagcccaccttgcctgaccatccgatctctgaacccgtatgctctgtgaaaggacaaacaaaagttagctggcgattgtaatgggaatgcgtagtttttaggacggactacttggtcgaggaagaaggtatatctatgtttgtgtgaggagtattgccagacggagaagattgccagaaggagacggacttttaggtagtggtattaaacggcggaagtaatctcatcttttctc

SEQ ID NO: 27142 - DNA, 585 bp, Sorghum bicolor
  Clone ID: 6674380
actacaaacgctgcgactgactcggctgctcgtcgcgaagtgacccgtgcgcttgcgacgaatttgttcagcgatgcgctcgatgcgtttgtgctgatattctacgctgcgtggtctgatgattggggaaatccgattgcggtcattgtcatctctgctgtcatggcgatctttgagcatttgacgctgtggagcttgagtgaggatgattgggctgcgcatgagtatgggagtctgggagatgataagaaggcgaggatgaatgcttggctccgagagttggagcgatatggtcctgaggagtaccgacctgaacagtctgtcgggccatcttcgcgagcatcgttcagacaatatggtgctattgtttagttgttgatgagttatgggtttgatgaaaagttacggctaccctgtctgttctgcatggcgttcatggtatgtttccatctggggtcgttttcaagatggttgatcgtttggagttgggagggcatgttgcatgatgatggatcatggcgatgtttttatgcgatgcatctggttatgcagtttgtaccttcaataccattgcttttgagtttg

SEQ ID NO: 27143 - DNA, 326 bp, Sorghum bicolor
  Clone ID: 6674389
ttgaaatctgcattttcatgttttctttgcatctctgttgggctgggtcgctattgtcatgtctgttacgttagctgaaacgacattgtcgcattctcatggcgttttgatgatctaaattgggttgtcgggataaggcatggcatgcgagttgggggttctcaaattgttaactgccctccgatcgatggcatgaaacggtcgtcgaaagcaaattcttctcttctgtcgctcgttctcgaacatagggttgtcgcatagggcctggtgaacctgggctggtattaggtagctcaccccttgaatgaaataaacccttgaaactg

SEQ ID NO: 27144 - DNA, 508 bp, Sorghum bicolor
  Clone ID: 6674397
ccgcgccatctgctggctgttggatcctgtaaacagaagtttccattgtgtacatccatggctctctgctttcgttgccaaactggttatcctggcataggtctggtctggactctgtagggcatggcttttgttggtgtattagttatcatcaagctgtgttcccttcatcatctcagaaagacattgagtaaaaacaaatccatagctctttgacaggttgggttggaggtagaattacttctaatgggagtgtcgcggcaatctgtaatgtgcaatgcgattccccgtggggcttggcgttcttgtgcatcaggcaacaaaggcaagccccttaggtcacagttggctcgagatgaggcaatggtgcgacgaactccgaaacaactggggtagagtagcctactggtatactttctctatgacattgtacatcttttgagcctcagaaacgggtgcttttgcttgattgcacccttctaatgaagtttgccatacctctatttcg

SEQ ID NO: 27145 - DNA, 406 bp, Sorghum bicolor
  Clone ID: 6674402
gtctgcagaagttccagcaggctggtgctggtggaaacggtcacatccccctcatgcacgagacctacgccagcacggtgcagactctcactcctgccttgatcaactgggctaagcagaacaacctcaagctcgtcactgttgctgactgccttggtaacgctggtggtgcttaccagtctggaaccttcaacggcaacggacaaaaccactgctaagtgaccaattaggataactgagaagtttgttggaacaaatctacgagtttctctttgcgatgttgtttttaagtcgaggtggttgtatcaacggggttttcaagtctagtgattcagatagctgagctacatcacaatgccaagtacatatttctttctgcaaatggcttcgcctgacgcagcgtaca

SEQ ID NO: 27146 - DNA, 476 bp, Sorghum bicolor
  Clone ID: 6674404
atcgcccgcgtcgtgctccaggagggaaccggcaaggtcttcatcaacttccgcgacgctaaggagtatctgcagggaaatccaatgtggatggagtactgcaaagtacccttgatgactctagggtttgagaacaactatgacgtctttgtcaaagtacatgggggtggtctctcaggccaggcccaggcaatttgccttggcgtagcccgtgcgttggtgaagatcagcaatgccaacagagttcctctgaagtcagaaggtttgctgacaagggacacccgtattgttgaaaggaagaaggctggtctcaagaaggcacgcaagcggccccagttctcaaagcgttgaggatgttcacttgctgcagttgttgtattgccacttccacagaggtcctcttttttcttttttccctgtcaactgttgtgcaaattctgtcatggacgcgatatatctgtagtattcttttcctg

SEQ ID NO: 27147 - DNA, 505 bp, Sorghum bicolor
  Clone ID: 6674423
ccgccacccgtgtccagcagattctccaggagtacaagtcgctccaggatatcattgccattctcggtatggacgagttgtctgaggccgataagcttaccgtcgagcgtgcccgtaagatccagcgtttcctgagccagcctttcgctgtcgcccaggtcttcactggtattgagggcaagctcgtcgacctcaaggagaccatccgctcattcaaggctatcctgtctggtgagggtgatgaccttcccgagggtgctttctacatggtcggtgacttcgcgtctgctcgcgccaagggagagaagattctcgctgatctcgagaagtcatagacgggcctcgatggtgggtaaggagtcggcccatgtgtccggggcaattcgctggtagtttcactgtgtacaaaagatatacctccgaatattcgagattatgagcgagtgccctgacgtgcgtggctttctgtagtctatgttgcatgaagaatcagcttttcttgttc

SEQ ID NO: 27148 - DNA, 536 bp, Sorghum bicolor
  Clone ID: 6674424
gcgtggcccgaatgagcagcgcatagtatggctgcgacgtctggtatgcagtgcgtgtaagacagttgccgctcgtcagcccacacaagacggctatgtcgaggcatcggaggtgcatcagcaggtcaacaatctgcgaaaccccagtgagccagccgttacggctgatgaaatcaaggaggcgtgcgatatcatcgataccactcaaaccaacggcggtggctctctcgaatacaaggagtcaggccctggccgcctttcacacatcaagtttgttgacgtggcggcgcctgcacctgcaactctgggtgagattggcagcccagtcccaagccacagtgttttggtgggcgggtttggtaaccccaggccgttccctggtcttggcccacagggcttctaagcaaacgtgtagaatttctgttccttttttttgtggcagcagcttgcctcagtgcggtcgctgcgtggacctggactttattcgactctttagctagtctctatcgatgctcctcctcacatggaaggcagcc

SEQ ID NO: 27149 - DNA, 510 bp, Sorghum bicolor
  Clone ID: 6674432
aaaacctccgcgacgaaacgaacaatgctccccctcctctgagccttgcttcagacttcttccaacttggtggcgacatcatgggattagcacagattgcatcgatactggaccatgaggaaggttggaaggtaagggtcgaagatctacttgatcaaccggtctttgtggatcaggtgaagctgcttgccgtcgagcgaaagaagcaaatcgagagggacgagatgaacccatggggtgagaaagggaaggctaatggcaagaatggggtgggtgagaagatgacattggaaagaaaggaaactggtctgggcgcattggcaagaaagatgggcctcggaacgaagcgcaaggacactggaaagggtccaaaagacggacagggtgcaaggaagtagagggttgggtctggtgtttttgtgtttaccgttgaaggagtttgtcatgtacgatagatagtggtacctaccgagagtcatccttttcgaatttaactgcatggtagtcccg

SEQ ID NO: 27150 - DNA, 444 bp, Sorghum bicolor
  Clone ID: 6674445
aagcagtaccgtgtcctcgacatggctgacggcttcgtcactgccatgaccgagaccggcgatgtcaagcagggtctgtctgtcattgaccagtccaacctttggtctcgtctccagcaggctttcgagtctggccgcggcagcgtccgtgtcctcgtcctcaacgatggcggccgtgagctcgctgttgagatgaaggtcatccacggctctcgcttgtaaacaagctctgctttgttttcaggaagggttgtccatccatcctatggatattccaggctcggttctagtctgaataatgtgaaatataccccatgggcttggagggtgcgcggaacggattgtcatttttggatcggttagggttgtattttggttatgaggcagagtgtccagtagataggatctacctatatgccgcactgtaattaagatggattttgc

SEQ ID NO: 27151 - DNA, 454 bp, Sorghum bicolor
  Clone ID: 6674447
tggacgcctccaacgtgctgcggacgctggaggtcgccgacctgagctccagcgcggcgctcagggagcgcgccatggacacgctggtgcaccacgccgagcaggtggtgttctcgcccgagtacgacgacttcgccgtcaggaacgccgggctgtgcgtcgagatcacccgggcgctgctgggcaagatgaagaccgcaccgttgtagacagatagctagctagggccaagaaatcacacctctaaacctaagctactagatcgggatcgggttggacggacgtaggtagtgtgggtaaagttttctttgccctcgagggcataggccctcactcttctacccattgtattcgctttgagaagtgtgcaaacacacatctcaatgcgaaactgctttgagatgtgtgtacgtgaccttgtttagggtaaaaaaactgcgtccacctagtgtgt

SEQ ID NO: 27152 - DNA, 462 bp, Sorghum bicolor
  Clone ID: 6674455
attgtcccgatggagtacccatatggctcccgcggcccagcagtcctcgacgacttcaccgcttcctacggctacaagttcagcgatgccgccggctaccaatggcccatgcacgacggtcaagctccaaacaagctctgagccgcccctgatactgtagcgtagatacgactgaaacgtctcttatctacgagccgtacgactgccaacctgctacccacgtctggacatgtcccaaatccaagaactctagcgtccctgcaagcgctcaatacgaccgagactatatagatcctcttacatgcaagatacgacagcccagcggtatgcgatgagatgggctaggaccgatcctttattctggcaggcgaatgttttgaaggcagtgctttggtggggcgtgtcctgcatggcgtacgtatagtaagaaaagaaatgcacagaataaattcgatagaggtc

SEQ ID NO: 27153 - DNA, 436 bp, Sorghum bicolor
  Clone ID: 6674456
gcggtgttgccggtatcctggtgcaggatccgcagatagcggagagctcggaactctcgtacctctcgacagcccaagcaggtgccgtcattctctcggaggagcagtctgtccgggccatgggtattttggagccactgcttaccaaggagtcgtagggcggtggtcttttaaacttgtaacaaaaggggagatgagttgttgacagatttgtaacaccaaggactttcaaacctaaggagaggcgtttggagatggcgtaaatgattttcatgtaaggtagctgggcggcagagcatgatatgatgctggggaactgtatcccctatgtaatccaagacgtggagtggatggtgggcggcttttttgtgtttgtgtctggcgttcttcgggaggagctgttctgttccaaatcgagataccatgatgattgtgt

SEQ ID NO: 27154 - DNA, 510 bp, Sorghum bicolor
  Clone ID: 6674466
gccaagttctgtaactaaactctggtgttttcagtcaattgcacgatgacgaatcaaaagtctatgtgcagctacatgggccactggagaaaatcgttcagtgctatgctgtttgcacatccttgactactcttcctgaatcactggacatggaaatattcagcgacgtctccctcatgcagctctactgcttagccgcgcagttggatgatgatcatgttcggggcctggtgctggatcaatggcgtttgctttcggagcaaaacaaggaaattgaacttgtgcttggtgagcttaacttactcttcgatagtacgagctgcagtgatccggcgcgtgacatttgggcaaagtcggtgtgtgcggctggactagttggagacctgcttgcaatggatggatgcggatcagcgttggctgactgtctccgaagcctggcagcggaggcgagtgtggggtattggttttgaatttcgtattcgttttcttaatctaatctataataaatgg

SEQ ID NO: 27155 - DNA, 357 bp, Sorghum bicolor
  Clone ID: 6674467
gtgtctgcgaggccaggttcccgccggcggagttgttaccgttgagcccggtgtctacttttgcaaattcatcatcgacccctacttggagaaccccgagcagagcaagtatatcgactcttccgtgctcgccaagtactgggatgtaggcggtgttcgtatcgaggacaacatcctcgtcacggagaccggctatgagaacctcaccactgccatcaaagagcccggccagttggaggccctcatggcatctagctagatgcagcaaagccaaatagttaaaacaaaagactgtaaaatagcttaaaaaaagaacaaacgaaatgatagaagaatgatatcaatctcgctccttgc

SEQ ID NO: 27156 - DNA, 358 bp, Sorghum bicolor
  Clone ID: 6674475
tatggtgtaccgtcctggtctgcggcttcagcgaacttgcgttgatggcggcaccatcgtactagtgctcttcctcaagcatctggtggcaactcagctggtgggaggcctgatgcctacaagtggtgtgtgttggggctgttacaatatttgttgattttgtgtttctaaatgtgcgtgcatatggttctatgtatggctccaatgtaacttagtatgttttctatatattgttttttgctttcctttttggttactatgcttgtatgaataattttgtgttcttatatttgtgcggataatttttcacacattgctaaactatagtttaggatctatacattgttaacaagtttgt

SEQ ID NO: 27157 - DNA, 298 bp, Sorghum bicolor
  Clone ID: 6674480
ctttcctgatgaaggaatggaaggagatctatcgacgccaaagtgcctggcaaactttttaacagtagtaggcttgacggtcatctgcttgtacctaactcttttttcatctgtgtggttcaaggtctatgttctagcaagctgtgcttacctttcatttgttacctattactccatactacccccccaactgataggttccccggagggtgatgtcaaggccaaaaaggctgtgtaaatgttgatgtaacttgcgatgaaaacttatatgcgcgaaggatgtttactgctggaattc

SEQ ID NO: 27158 - DNA, 445 bp, Sorghum bicolor
  Clone ID: 6674481
agaccggcaacgccaggagctagaggaaaagaaggctcgcttggagagcggccgacccatcgaagaaaagggcaagcgcaagggtttctcgcttcgttaagcccaccgctttgcttcttcctctccgtgccgttgacggccgctgctgaagttgccatttcagtcatgcagtcccgctatctctcgctctcttttttttgatcccccacctttttgaacgggtaccatatctccttgcttgtcatctatcttccacactcccttaccctggacgcctcgcggcctccttttaacgcacacctctgttgcagcttttctttccttgtcttccactggatgggcccacgcatcgcgaaacaaaaaagagaagaattggttattgattaatacgatccgcgggggtcgaccaaacctggggaaatcaaatcgtaattaacctgttttt

SEQ ID NO: 27159 - DNA, 497 bp, Sorghum bicolor
  Clone ID: 6674493
cagcggggaagggcgcgcagagcaagagctgctgcaacccctgggtggacgacgtggacaggtaccctcccaaggcgtacgtctgatgggccacgtcacgtggctgcatgacacaacaattgtatgatccgattcgagtttcctcacgacgaaggagcaacaagggcgtgtgagggagaaaattatacttgtatgttttattttccacttttcttttctttctttctttcttttgtttcgttttcccagtaagtataggttggcgtgagtagacagcgctggcttttggaattcattcagagatatctgtggtgtaaaatgaattccaaaagctagcagagtgccattctttctcctctatttgttgtctagccccttggtcttctttggcgttctctagacgcccgggaagttggaagggacacagacgaacaccagtgtgcagttcacatgactagagagtcatcgaccaagtgtgaattactgattcaagtata

SEQ ID NO: 27160 - DNA, 467 bp, Sorghum bicolor
  Clone ID: 6674494
tagaacgggttgattccccctctctttttccctgcttttctcccggcgcactactgttgttgcatcagtcatcctctctcctcttatgctgctttagtccctttccgtggtactttggtcactcccatctcatctcctcccaaaaaaaagaaatagtaattgcccagcagaccccttttttgtttacggtattacgacaacttaacactcctgactctcctctcctgcttgcaagagagagtacattgacgaaactgcgtttctttcctttgttccagggtacgaagtgtattgttgtctacacacgtgggggctgtaatggagaagaaggttgaaggaatctagtttccttttctcgttctttcgttctttttcaagtaaagcttggtaccgtctctgcgcttgaacaggtcagactgcggaggaatatcttagcggtggcaataatgagaaactcggccgcctct

SEQ ID NO: 27161 - DNA, 459 bp, Sorghum bicolor
  Clone ID: 6674496
cctcgcccgacaaggccaccaagggcaccaacctgtccatctcgctcctctccggcgtgattgctggtgtcgtcgccgccatcgtctctcacccggccgacacgctcctgtccaagatcaacaagaagggcgccggcggttctggcagcacgacctcgcgtctcatcgccatcgcgcgcgagatgggcttcgtcaagctctgcctcactggcctccccgctcgttgcatcatgatcggcacgctcaccgccggtcagttcggtatcttcgactccgtgatggctgccatcggtgccaagaagttccacttccacaaccccgacgaggcccaccactaagcccatccccccgctctctttgtgccattgccaactgctcctgccgccgttgtgcatatcttaccagtaaactgctacaccctcacctgattctccacacgcgagcgaggaagagggcatc

SEQ ID NO: 27162 - DNA, 412 bp, Sorghum bicolor
  Clone ID: 6674502
ccgcagagcgtcagcaccggcatgccctacagcaccatgctgctgttctcgctcgacgccgccgagtcgctcatcgagctggtcttcaacaacgtcgacctcgaccccgccgactggctgaccggcgagctgttctaccaccacaccaacgcccatcccgaccagcccaacacctggggctacgctccgaagatcttccgccacatcggccaggtgtccagcaagggcgtcatcgacaccatacccgccgagtgctcccaggacccgccgctgcacgggccgttcgtctgctggcagcagtgcgacaggttcttccagcgagagccgcccagctgcatgccagagccgagcgacagctgcaccgacacgcactttcatctcgatcgccgcaacttgaataaaatgaacgtct

SEQ ID NO: 27163 - DNA, 226 bp, Sorghum bicolor
  Clone ID: 6674511
agcgcgaggcaggggctgtattgatccatcccatcaagagccgagatctccaggccagagggggaatctctcgcccgatcaaagctcgcgaggaggagatcgatgccgaggaggtcgatgccgaagaagatgtggactccgaggctgatgctgagtgattcgagtttgcgtgccacaatttgttgagtaacctcaaaagaagaatcaatgtgaactacgtgctttg

SEQ ID NO: 27164 - DNA, 457 bp, Sorghum bicolor
  Clone ID: 6674517
ggtcgtaagctgccagcagcaatgccacctccacagcattcattcgtgtcgaaaccagatcgccatttccacagcaatgcgaaggaattggtggacagtgggacgaaaccagctcccaatgaagcaagtgaggagttgaagaaggcactcgaggcccggaggaagtaaagaaggaagcacctagctagggcttgctgacattgcaagccctacaatatgacattgctgctgacggctgtgtcaagttttgtgcttaataataatatttccttgctggagaagattggtaagggcagtttacatccctcgctggaggcaagtgaggttgccatttgccatagccataggtgatgtagtagttttgcctcaattctatttccattgcttgtgttaggatatcctgttctgtataaattcgcatctttcaattttaaatgaatgaaggattagttttttc

SEQ ID NO: 27165 - DNA, 384 bp, Sorghum bicolor
  Clone ID: 6674524
aagtagaatttgctgagttagcaattcgaaagttactagagttggatccaaataatgctaaccatgtttccagaaacttgcatagctgcataactttcataaattgtcttcattgttgggaagtcatgaacttaacttctgtgtggtaaacaaagtgggcttcactaagacaaacatttgcccttagctcacacatttattggaggtacacaaggtgttccatcaaagccttgcatcaagctacttcatggcaaaaggtacagcaaaagttagttctaatgcctgaactggactgtacttatgttatgtacaggatctgtgtttttctgcttcaaaatgccattatgcaaatgtggaagtatgcatatattttcatttgattcc

SEQ ID NO: 27166 - DNA, 510 bp, Sorghum bicolor
  Clone ID: 6674545
atggccaaggcaggagctcatatcatagttgcacatatgggtctgacaactgcagggtctattggggcaatgacagctgccactttagatgatagtgttttacgagttcaggccattgcagatgcggcacttggggttaatcctgatattattgttctctgtcatggaggccccatatctggaccccaagaggctgagttcatcttgaagaatactaaaagggttcatggattttatggtgcatcgagcatggaaagattaccagtagagcaagctataacgaacaccgtgagagagtacaaaagaatttccttaaaatgagaatcattgttcacaggtgtgatttgctgcctgctgttctttcgatacacttcgcagatttctatgtctggcttgcaatgttagattatccggaagctcggctctttattaatcatgtacattttcttaccaatgtatctttcttgttggaatataaacatggaagaataataaatattttctttgtcg

SEQ ID NO: 27167 - DNA, 421 bp, Sorghum bicolor
  Clone ID: 6674561
tccacgatacggggatcatggctgcgcaaggcggtaactggttccggtcattcttcagaatcatctttgtcgacttcatcggcggcatcctcaatcgactctttggccgaaagcgcgagacgtaaaattacttgctgccggggctgcggcagccttggtaggtgtggcctggtggagggctccgagtaacatgaggaggtgatcggcgagattggcaatacgattgctagactaggggaccgttgcttttcttgttgatgcatccatcgcataggattcgaagagggtaaaaagttgatgtttcgttcaggagcgacaaaacccgaacagggcaatgcatcggcgttgcatgattcaaaggcaaatgacgcgtatgacatagtttcttgagcattgcaagtaataatacctctcctcttca

SEQ ID NO: 27168 - DNA, 434 bp, Sorghum bicolor
  Clone ID: 6674575
cgtaaagaagaaagaatcagtccaacgcgaagcggaacgacaagctgagcggccgcggaaggatgtggcaaatcatcagtttggaagaaaacaagctcaacgagaacgacagtcacgcatgatcgagcagcagcttgcgcaatcattgaagcgatcacgggatgacgaagcgacacaaagggaagaagtcgaaagagcttcgaagagccggaagacagagggcgagatctcaagtgcgaaggaacgatacctagctcgaaaacgagcggccgaagaagcgaagaaggctgctgggggaacttagatacccaaactcggaaattgaagaaggttggatacaacgacatggcatggctattgacacagtatcccactcatgtctcctccggttcgtctattgccctgttctatccttaatcgattcttcgtacatg

SEQ ID NO: 27169 - DNA, 487 bp, Sorghum bicolor
  Clone ID: 6674577
tggtcaggtggtggattcagtaactattattcccgtccaaaatatcaagatgaagctgtcaagacctatcttgcctcaaaggcagctcctccaacctcatactttaatgtttctggtagagcttatcctgatgttgctgcattcggagtgaactatcaagtattcgtcaatggagtggttcaaaacgttgctggtactagtgcttccacaccttgtttcgctggtattgtatctttgatgaatgatgctcgtttcagagctggtaagaaaccacttggtttcctcaatgtctggatctatcaacatgccggtagaacaccaaatgcattctatgatattattaagggtaataatgcttatggagattgccaatatggtttctctgctacacaaggatgggatccaatttcaggtttcggagtgccaaactataagattttgcaacatttagctctccttaaataaattttttgtcattttatcttct

SEQ ID NO: 27170 - DNA, 553 bp, Sorghum bicolor
  Clone ID: 6674580
gataaggtagtaggctacagtccatgcgattccctttccgtggtaggcaggtgcggttttttgatcaacatcatcctttttgtcgacgtctggcgggccgatgggcacacctgcctcgaccccaacgcgaccgtagaagcgggggagccccatccagttgcaaaaggcatgggcgaggatacatgtgtagacattgccggtgcgcacgaagacgaaagcagcgaagaagccgaacagcgatgtgtaggtgaactggaagagggagcgagcaacggccagaatgaatggcacacgtgggtgggtgatgcggaactcgtacaggtggtggacatgggcgatgccaaagtagagtggggtcaggaagatgatgtgcttgcccgagaagcgggctaggacatggaggggcacgatcaaggagcgccagacgagctcttcgctgacgggtccctagcggagttaggcggcgggttcgagggatgggtttggtggggaacgtaccacgacaaagttcctgtagcctatccagctgctcagcgacgcgtataggccgttt

SEQ ID NO: 27171 - DNA, 537 bp, Sorghum bicolor
  Clone ID: 6674583
ccgaagccaagaaaaagcttgatgaaattatcagtgatctcaaacctgataactttagcactgtccgacctgcgagtcgatttggtcaagctcccgcttggaaaaatacttttaccaatattcaacctactttgacaagcccaatgtttattgcagagcatcaaagatttgacagaacgcctcaagcgagtgtactcccttctaatgaggataaagaaagaaaaaagcgtatccaatctgcaaaaattgaaaccatcaaacaacatcatgacatcctctcaaaaagagttgaaaaagatactctcaagcaagacaatcttgaacaaagtagactgaaaactaagcttctcgccgtcaacactcatgaattcaacgcacgtctccgaaacaatttttaacctaatcaaattcaattatattttttcccatcatgtttagtttttgcttgtaaatttttttatcacatgttttattgattccacctcaactcattatctatacttttttgtatttctaactgcattcaattctaaactc

SEQ ID NO: 27172 - DNA, 404 bp, Sorghum bicolor
  Clone ID: 6674594
agagcacctgagaatcgcagctcgtggtggtatgcgcggggggtgttgcgtgccgcttctaggggattgggagaatgggaagaatttgcggcgaggtttgtggatggcgaggctacgaaaagtagtcatgcggtggaatggttggctgatgtttatgcggagagtgagaaggccaagtctgtgaaaatgctcaccctgttgaaggaaaagtatgaccccattcggaagaattactgggattatcgaatccgacagttgggggaagtagcgtgaggtcacgttccagggcggaaactacaatgtgcaatttacataggtgtctttctagaacatctctcgaacgatagtacgtccgacatcgtctgatggaagtaagatcataaagcagatttaattagtcgtgt

SEQ ID NO: 27173 - DNA, 505 bp, Sorghum bicolor
  Clone ID: 6674600
cttccatccccgtttgctgatattaccaactatcccggctacaatgactatttaacgggcttctggattccactggaacaagaaatggttcacgcaccactcgaattgtgaaagcccagtattgcaggaagatgcttgacgatagtgatgttatgctttcctctcagctggcggttagtagtcattcagttcacctatttctaaaaggctcccggaccaaaagcagttgtttcgatttgttcgttcacaccgagagaacctagacgtcctcgctcctccattctttgtgctgagttgagacacgaactaccaataaagattcggcggctcccctagtcatgcctattgtctacgccatacctacgacagtcttatcctccgcaggaagccttgcctaagctaaaaaaggattcgcatgaaaattgcatcgcgtggggggctgccttggtcttcatggacgacactgacaggcgaatgagtacaacttaagaataatcaatcatct

SEQ ID NO: 27174 - DNA, 462 bp, Sorghum bicolor
  Clone ID: 6674609
ttgatttgacaattttcgaatcaacaaataagaaaggaaaaagaaaaaacaaggctaaaaagagaaaaacaaaaaagcaagaggtgaacaaaaaggacccccccaactgtggaaaaagatggggagtgggcatcttcagcttcggttgaatggaacaagagaatcgaatcatacgggattaggattgaggtgggcggctttggtctggatcctgtgaaagcaagagtcttgaaaggctggaaaagaaaattggagcgaggtttatgctgttttgcatttccttattatctctctctcattatctatctgtctatcactgagaaaggattgaaaaattagtggaatcgaaggggggaggactttactgtctctactccctacctaggatgctggaaacattggatcttggcctacagtagcactattgatagcggcaaatcatgattccagtcctttccggat

SEQ ID NO: 27175 - DNA, 481 bp, Sorghum bicolor
  Clone ID: 6674612
gctatcaccagctttgcgatgacttgtccaatgtaaattatacggcatgggtcgtcaacacaaagctcatcgcccactcagtcgccacctacgcgcgctccttcaagggattccctgaacgtaccatcgatgcagacgttgcgaccacctcgtataacaaggagatcaagtaccgcggttccaagctgttcatttaagaaacatacacataatatgctatgaagggtcaacgagaaattgagggaccggagacagtgtactagtacataaacgcggcgttgttttctgtcatcatagcgagcaatatattgggtgctgtggcttggaaggaaatgcttgtttagttactcgttgcatatcaataagaaagaaggatcagtccatattctggaaggatctgacgtcttggtttatgaccgcagttgtgtttacaggtagtggtggtggattgttttgcaatatcaatcccatgtcacttcgc

SEQ ID NO: 27176 - DNA, 408 bp, Sorghum bicolor
  Clone ID: 6674633
catttgatcgagcattccaccctgttcccaccaacagagtcaggacttggaaggagtatgacactttcttctctcagtacttcatcatccctggtaagaaggaccaagatgtcaaggcagagctcaagaagggcaaggtcgagtatggtcacattgtgaaatctgagttccctggtggtgtgagggaggttagggagtggttgtcacggatccgtggtacgctcgtcgagatgcctcttgatttcttggttgacgctggagatatcgctaaggaaggtttgaccttgaataatctcacaaatgagctctacacttgatcgaggctgcttgaaactggttctttatatcttgcttcgttcataggtcaatattagacatggactaaacttaagagatatctaaaattcg

SEQ ID NO: 27177 - DNA, 531 bp, Sorghum bicolor
  Clone ID: 6674634
gcctctcaaagcccaatcagatgtagtaggaaagagaaccaagctgtcaacacatcccactttatataataagaggcagcaaatcaagcaaggatcaagtccccactgtgcaactgctactgctgaagtgcaaagatcgaaatcaagcctttttggtgagaggaaagggtctgatacatatgggttgcactggactgaacatgacgaatctgcctctactgaggccactactgatgtagtggtggaagatgaggtgcaccctgatttcatctagtctcatattggattgaaatgccaaatgctttgtgttttggtagtgggtagtttgacagagacaaattgtgctgctggcaacaccttgttaagacaaggatgtgcagtccttggtatctgaggctgaggggaagaaaatgtgctgttcccaagatgttatcctgtatgttggggtgctttatagtagattgtgttgtaagaacaaaagctgaatgcaaaataggataatcatcaactttctgaaactataattttata

SEQ ID NO: 27178 - DNA, 492 bp, Sorghum bicolor
  Clone ID: 6674639
catggctcagcgtgctttcgcccaggagaagatgcccaacgaccccatgttcaagctcgtctcccaggtctacaagatcgctcctggtgtcctcaccgagcacggcaagaccaagaacccttaccctaacgtcgatgcccactccggtgtccttctccagtactacggtcttactgaggccaactactacaccgtcctctttggtgtctctcgcgccatcggtgttcttccccagcttatcatcgaccgcgctcttggtgcccccattgagcgacctaagtctttctccaccgacaagtgggccgagctggtcaagaagctgtaaggagtttaaaaatgaaaggggaaaaggagatgggaggataatgcccagaagatgggcggaatggattgccaagttaatggcatttgtacaacacaatgggactgttttagtttagtaatgagcaagtcgtcgcggcgcgccgattgaaatgaaatgatttaacagtt

SEQ ID NO: 27179 - DNA, 458 bp, Sorghum bicolor
  Clone ID: 6674654
gccatcccttcagaacgttcgggttcgccttgatggagaggagacattgagtgaagagttagcattgaaagtaaaagagacactgaggaacgaggcacgtgcccaccccaaccatcctaatattgatatccgaattgatgagaagtggatccagctgtgcatgtctactctacgatcatcgcctttaacatagattcaccaactccacttttcacggtgcagctttactctacgatcgacatcaatggccaataattggccataactacactcacattgttcttgtgtactcaatcatgcttgacgaacatatctgtagatccacttggcttgctcaaggtttcagtttactatgttcgttagactttcagtaacagtagatcatgccgagctgacggctttatataatattatcctatcatgtacgtacaattaagtttgtgccatacacttgcttc

SEQ ID NO: 27180 - DNA, 440 bp, Sorghum bicolor
  Clone ID: 6674679
ggagccgctacagcagccacccgaggaccctgcagacgcgcacgccgccgtgtgagtgttctgtccagaggctttgtcgatcggagagccaatgcgaggtggtgctggccggatgcagcaggaacgccgccggccggtcggggctgtccttgtcctgtccggctgtccgtggaacgaacgaagcagggcaacgccatcatcgatgatgtgactgatagattggtcggtagtacagtagcttattagcagctaggcagcgcttgatgggcagagacgacgatacatgcatcattgcttcttcattgtttccagttagttatcgacgcgaccggttccggttgcggccggttgtgctcaacaacaactagctaagctagcgctgctggtacaccaacaccaagaccattgtatgcacgcaaatctggagcttttcgtccctt

SEQ ID NO: 27181 - DNA, 428 bp, Sorghum bicolor
  Clone ID: 6674688
gaaccctgcgagaagccatcaatactgtgtcgaaatacgcagggggcgcattgcccgaaaacgcacgaatccttgtgcgacgtcatctcaccagtctaccccaacgattccgtgtcgccaccatgaccgacaggaatgccgggcaacaagacaacgagactgctctaactgaaggtgcacacaaagttttggtcttggccaaagaaggcctggacatggttgtccaagtaagtggtgtcgtagatggaacaattgtcagcgctgagcaatggctcgaccgtatgggtaaacgaagagcccaagaagatgagaagccaatgcttcctcaaaccgaggttaatggagatgtgaaaatgggttaattgggaacgaaaacgagggcgatacttgcgagttccaatatcacgaggagctcatttatttccttg

SEQ ID NO: 27182 - DNA, 439 bp, Sorghum bicolor
  Clone ID: 6674689
cgacactttttttttctctttctttacttcttcttataccacagccgtcgctagcctcgcacctttgagagactccggctttccactcacttattctaattggatcttcttttttaataacgacgacatgcgacatgctttgttttctgttgctgctggaattttcccccaactcgagagttgggagggggcggatgggaaggaaaacatggaacaagcgaacacgccctcctcctatcttaccctctctccctctcattccctcactcttgcacgcttacgaactcttaaacaccgggcggaaaagcttgtcttgttccgcgtcgggaaagcaaagaaaaaaacattctagatatgtttttgctaaatgtgccaatctgcacgcctcatgtagattttatactctgctcgaataccaatgaatcgagatccacatggg

SEQ ID NO: 27183 - DNA, 437 bp, Sorghum bicolor
  Clone ID: 6674703
cagccgcggttcttgcttcaaggcttcactcagcttcgcgggacgtttagaggcatcatggtcccagagggcctgaagaattcgagctgcatgcgccaactcttgtgacaatgtgttgatatcagccgaagtccgagatgcctcatgctcgatctcctcagagacgtttaaccaacataatgacagaattcgggcgacgttctccatatgctcagtttctaggatacgaggccatgagttagtaatgatggcactcatggtttgcgtcgccgctatcagggtcggaggatgagactgcaaaggggtctgtcatgactaatgataccattgagagtagaggctggcgcagacgtgttaaagaaagcccgaggcgtttttcagtaataagtggttactcacagttaagtgtttgattgtatagatacccagactattga

SEQ ID NO: 27184 - DNA, 441 bp, Sorghum bicolor
  Clone ID: 6674713
gaccaggacggtgaggatcatcctctgcatatatcacgcccttccagttggattggcaatggccgggcttacacggatgatgcttcaacctaccgaaggatgcatccctcgcagaaccgaaatcaagttgtctaaatgggcagcttgacttgccttttatatctttgtatttacatgaccatcgctcgattgggtatgtttcataagcctcacagggcttgccggcgtttatgtgttttcaattacgggaggcctcgaaccatgggaattatagacaaggcgtacttttggatgacgagctctttggctcggatgatatctacacaatgttgggtccagaacaatgcacagggaaaacgatcgatgaaggatgacccttgtataattaatacccttgaaggatatgatagcaaagaagaatgatgaacaatgtgttcaagg

SEQ ID NO: 27185 - DNA, 484 bp, Sorghum bicolor
  Clone ID: 6674727
gaagttcgcggtgctcaacacggggatccacgagtgccgctcctgcgggtaccgctacgaccaggcggcgggggacccgtcgtacccggtgccgccgggcctgcccttcgcgcagctgcccgacgactggcggtgcccgacctgcggcgccgcgcagtccttcttcgagagcaagagcgtggagatcgccgggttcgcgcagaaccagcagttcgggctgggcggcaactccctcacctccggccagaagggcctgctcatctacggcagcctcctcgtcggcttcctcttcttcatctccggctacttcctgcaatgacgctgccctttctgctttccgtttgtgtgaatacttacgtactccccattcccagagacgattttgtggcaatcatcgttcagcatatcatatccatcaattaactggagtagaaaaccttggcagtagaatttgatgatgcagagatcgttaagttttgacttc

SEQ ID NO: 27186 - DNA, 529 bp, Sorghum bicolor
  Clone ID: 6674730
ggaacgcgaggggtacgtgctgccagacggggacggccaagacgagggtgtacctctgcaacccgacgacggccggaacgtgccggaacgccagcagctacgtgttcttcgacggcgtccacccgtcggaggctgccaacgtcttcatggcggagtccatggtcgacgcgggcatcgagctggtcacctaggaaccatggcgtcgatcgataacacagctgcagatgccgcagcgatagacggtggaccatagacgtgtgtgtctctgctcatctgtttcctgctccatcgaacaaaactacagtgtctggaattaattactaatagcctgtgaaattgcaccgtcggccggccctgtcgttttcgtaatgttgttaattaatcataatatgcgtgacagtttcctgttccatccaagaaaacaacagtgccttgaatagcctgtgaaactgcaccgtcgccctaccatttttgtaaatattgttaaccatatactctctgttttcctatatatacatcagacgtttct

SEQ ID NO: 27187 - DNA, 532 bp, Sorghum bicolor
  Clone ID: 6674741
gatgcatgcgttggttgtcagtacatgacactgaatatgcatcagaactcaaaagtggtgaaagtagaccaagggatacaagcatcaaatttgagcagaatgaacaagaacacagaatactcaagaatgaagatggcatggtgaaatctgaacggccacataagtcccgaaagaggcggcacactgaggaatgatatttcattgaggctgaagattttgtttaaatacaaaggatgtatgtgaaagtcatgttcgcttcaatggttctgctgcctgtaagcctgttgatgtttattgggcgaagatgcctctccagttggaggtttcttcatagaaatgtatgatgatgtaaaacaaatcaagggttgcatttgcaaatggtcacttgttttaacccgacggtaactgaactcatccaagaaagcattaggtttagtggcaaatggcaatcccatatttcgattatagcccctggcttatgttgggtgttgtgccttttatgctgtaaaatgcattgctgatctagcttttg

SEQ ID NO: 27188 - DNA, 604 bp, Sorghum bicolor
  Clone ID: 6674743
cgaatggtataagcccaaagttgcctcctttgacatccacatccgaatgtgatccacctggtaggaacctagcagggcggaactctagtgggtcaggccacaaggccgggtcacgtgcaatgccccacacattgactagcagctcgcagcccttggggatgctgtagccagcaatctcacactcctctgcagccatgcgaggaagggagaggggcgttgatgggtgcaggcgaaacgtctccttaatgactgcattgaagaaggtgaggtgtcggaggtctgactcggtgaccaaccttccacggccaacgactgtgtctagctcctcttgtgcctgcttgaggatgtccgggtggcggatcagctcggctagcgaccactctgctatggtcgatgttgtgtcggttcctgctatgaacaggttcaaaataagtgccttgacatcggtttcggtgatcctgacttcgtcgtcgcttccctcgtcctccaccatggacagcagcaagcccagcaaatccttgctttcctctccgtctgccggcgtagccctggccttcctgctatctgcaatgatcccgttcatcatgtcgaggggggggcccgg

SEQ ID NO: 27189 - DNA, 418 bp, Sorghum bicolor
  Clone ID: 6674746
taattaccacttgatgatggacaagtttcatatgtggaagacggttgtgcacaggtttttttttcttttgtttgcagctgaactcatttcgtgtactaagtgcaccatacgttgactgctgatgttaattctccttaggaatggaaaggagcaaaaatcgcaggacagccttagaaattagaatagcctaggcaggatccgttgcagcaagtttgatgacgtgcgtaccaatgggttccttttttttaatgacgtgcgtacgagcaacaccaagaggtctgtttgattatagggtttgtttggttggtgaccaaaagctgccatgctaaggccttgtttagtttgcaaaaattttcaagattctctgtcacatcgaatctttggttgcatgtatggagcattaaatatagataaaaat

SEQ ID NO: 27190 - DNA, 490 bp, Sorghum bicolor
  Clone ID: 6674747
gataaggaagaaagagaatggcattatcaagattcaagggaggaaggaggggaggaatggtgtccttcagtttgacactgagatctttgagattacagcatcctaccatctcattgagatgaaacaaacaagtggtgattcagttgagtaccagaaactgttggaagaggacatccggccagggctgaaggacattgtctggtcctggcatggagatgatctgcagcaaaagcaggagtagcttcggatgtctcacatagattttgttctgaaaattcgttggattttcagctcagagtgattctgttctacatttgatgtcttatttttttagcagctatattctttttatgtattggaggagcatggtgttgatgtgaaccattaggctatatatattttgttgagttgttgtgttacattccgaagattgttccagttttgtaatggctgtaaatatcaataatgaaattaaatgttgttgatcctt

SEQ ID NO: 27191 - DNA, 138 bp, Sorghum bicolor
  Clone ID: 6674749
caaaatcgtttcgaaaggagaagtttgagatttgatagagctttttaactggtttccgttcatcccccccccaaaaaaaaaaaattccattctgtgaaaacccacaggattgttactggagtaaattgcagaagacca

SEQ ID NO: 27192 - DNA, 534 bp, Sorghum bicolor
  Clone ID: 6674754
cgatgtctatattgccggccaagttctcaaaaagtcactcagcacctataacaaggtcgagggacaggaggtcgtctctgccaaaaaggctgagcttatctatggtgctcttgacgctcaccctgatgtgtatagagttgttcctgacaagtctgttcgttcaaggatgaacatctgcttccgagttaccaagaatggtgacactgatggcacagagaaggccttcctcaaggaggctactgcgcagggtctcaccggccttaagggtcaccgaagcgttggtggcattcgtgccagcagctacaactccattcctttggagggcgcagaaaagcttgccaagttcatcgagacatttgctacctcttaaaaaaaaatcccaacatgaaaactttgagctggatagcttgagaattttatgaaattgatcagatgcgtgtacgacatcaaggataaaagtcaacctagatggatgttgaattcaacatgctccatgagaataaagaataaaaataaaaataaaatgaataaagc

SEQ ID NO: 27193 - DNA, 484 bp, Sorghum bicolor
  Clone ID: 6674760
caagggcgagaagaagatcctacgagagcatggaatcaaagcattttccatgcacgacatcgacaggcacggcattggcagggtcatggacatggcgcttggctggatcggcagcgacaccccgatccacctgtcgttcgacgtggacgcgctggatcccatgtgggctcccagcacaggcacgccggtgcgaggtggattgaccctgcgagagggagacttcatagccgagtgcgtggccgagacaggctcgctggtggcgctggatctcgtcgaggtgaaccccagtctggacgaacaaggtgcgagcgacacggttcgggccggttgcagcattgtcagatgcgcgctgggtgacactttgctatagcctgctgcggctggatagattgaggctgaatagagatagagatatttgttcagatgtagtctagtccatttgttcgaaccctgtaggcatagacccaaatccagacgtccaatc

SEQ ID NO: 27194 - DNA, 527 bp, Sorghum bicolor
  Clone ID: 6674763
tatcaccagtgatggtgactccttgtcaggcagccctcgcgacagcacttctactttcgaccaccccagatcacctccagcaccacccacatcttcgggcgcagccagcggacctatgaaggttctcgacgatcttgctgttgagtaccaaatcaagtggctgccgttgtgctccgattatattgcgtcgccaccttctgaccccaagaagcgagaggaagaccaccgaagactttctgagagcatcatgatgcacatcatgttgaaactggacggcgtcgaggctgaaggcatgcccgaagtcagagcgcgaaggaaggaattggtgaaacaggtccaaaagacactgaaggatcttgatattgcaaaggaatcttaagcccgcggttaagcgatggcgttgatgttgagtgcaaaagattgtctggtttgagtgcaggcgttactgggaatactccattattcgactacctggccattgctcttcatatagaacaagctgtacaatagattcaaggattaccttg

SEQ ID NO: 27195 - DNA, 529 bp, Sorghum bicolor
  Clone ID: 6674774
ctatgtaatgttctaattgcattttgtgttctatatgtagtacatgtaagcgttcatatactattatgtttagctagttagtattactttgcatatttgtgttttttgtacttacaccttattgtggatatctcactctagaattactatcatgcaagataaaaatgttgctattacatttcccataaacaacaccattactattactaagaagtttcttgtattttgagtgtaggaacatgttggcaacaccaactcttctgtttacttcaactaccccaactaccgcattttgtttccaatttgggcacttggggagtatcgccgtaaactatttgccaagaataattaaaaggaactcaagtaaagcaaaaacatcatacacaaaattgagttttactaagtggaaccaagaaaaccacttgtatttatcattgtttataattttggatccactcagaaggttacaattccagctagaaattgtatattttaatacttcatatatatgcttttgcatgcatgcttg

SEQ ID NO: 27196 - DNA, 444 bp, Sorghum bicolor
  Clone ID: 6674781
cgaaccttctgttcccaaagggccaaaggctgacgtaaagccccccaccggacctgcttcgcaccgcgacaagcgacgcaagagtggcgctgcaggagacgacaacattgccaacctcttcactgccgggctgcggaagaacgcaaaagctcgacgtggaggtgtcaggaccgagggcgacgtggagcgcgagatgatggagcgagaaagggagaggcgatagggcaggccgataccttggtcttgaaaaattgaggggactggcatagtgaagagtttggaggtgcagtgagctggttgctggaggtgcgatctgggatggtttaatctgcttcttttttcgtattataccctgcattacctgagtggcacgagaatgagagtatgtatgctgtaatgaggttgggtacatatatgtactaataagaatacatttgcccaggc

SEQ ID NO: 27197 - DNA, 461 bp, Sorghum bicolor
  Clone ID: 6674800
agaaggagaccatcgaccagctctttgcccagctggaggacaaggtgcaggactcgaagaagcgcattggtgagctccacgagctgatcgctctgcttgaggagacccgcacgacgctcgccaccaccatggacgaggtcacggccatgtacccagaggtcgccgaggagatcgacgacgaaattgccaactacgagtgggagaaggacacgcagggttaaacagcccaccgacacaagtcttgtgacgtgtggtggcgagttcccggtcgacacccgtggcgtgtcgaggcgatacgttctgtctggcggagtgctgagaggctcatgtctatcacccatggccgctcgctcgccgtcgggcagtgtgtacactgtctatcgcctcgatccgcgcggttgttccgttgagcctattcgtgcaacccgataactaataaaaccaaaaaaaatctacaactc

SEQ ID NO: 27198 - DNA, 501 bp, Sorghum bicolor
  Clone ID: 6674830
acgccaccatcgatgccggcaacatccacttctacgacgtctatgacgacaagaccatcgaccgcttcaccgcgcacattgagaaggccgccgagtcgtacggtaaggtctgggtcaccgagttcggtctcaaccccggctccgctaccgaggagcaggccgccagcttcctcaaggagttcatgaactacctcgacaactcggacaaggttcagggttactcgtggttcatggtcggcactggtgagaaccagctcaactcgggcgagggtctttcccccatcggcaagatctacgctggctctgcttaagcgttcctagtcgaaacctccccttggcaaggtttattaactagtactcttcttcttctcccctctcgataagggacgggcctcttttttggtgtctttttttttctcggtgatgatggatggcggagcatcggaatggagtctgtttgtgtgttgtacatacagctattatatacacgtatatgacctg

SEQ ID NO: 27199 - DNA, 508 bp, Sorghum bicolor
  Clone ID: 6674832
caccgtttccgatgtcaatggcaccaagacgcttgtcctcaacggtactctccctaatggcaccaccgcacctggcggttcggatggtgccgcggctagcttgagggttggcaattatgctggctactatgctatcgccatgcttgtcgtcgctggtgtcatgttgtaggaggggacacagtgatgttttctcgacacgccaacatttttcctttcttcttttcacttcacgactcattctccctgtacatatgcaacgaagttatgatttccccgacaagggaaggcgttctgggtagaataatggtctatttcttggtggatcagatgaccgttgtctaaaacggactgcatagtcggttagagccagtgtcatgactgcacagcttggattataccctcatgttttgtttgcttgttttttttttagttttcagttggctggaaggccttgagtatgctgtagaagttattcatacgatcgttcaaaaaacacctttcttctttc

SEQ ID NO: 27200 - DNA, 175 bp, Sorghum bicolor
  Clone ID: 6674834
gttggtcgattaatagttagttgcgattatgtactgtaccacaattggtgaaaactccaagattgataggaaagggccgaaaaggatggaatgttgagtttggaccaaaaagagcaaggcaatccaggtggtggagttttacgagagatgaaaacatatatgcaataaaccatca

SEQ ID NO: 27201 - DNA, 456 bp, Sorghum bicolor
  Clone ID: 6674842
aacaagtgcaacgccgaattcggccgtggaagtgatgctcgtcgaaaggcaatcatcagaggagctttgagcgatgaagatttattcaccaaggtcatgagaagtctcaaagacagtttcaaggccaattcagaggccactcagacaaagatacaggatgcaactatagagtatctacgcgttattgagcaacggtttgacctcgtgcggagtgagaacgtcgcccgggaaagcgagcaggatccagactttcgacttcgggttgagcaagttgcgcgagctgggagagagactatgcagagggttcaccaagttatctgatttgatcttcatgtccaattgacttttgttatcctgcattgcctattcaggaagcggggctggttgtaagaaggcgttacatcactcaccaccttctgagaacatcagaggataaaacatttcgtcgaggtctgt

SEQ ID NO: 27202 - DNA, 440 bp, Sorghum bicolor
  Clone ID: 6674846
attcagtgcaatggaggttgagacgttggtgaggtaccagctgcctgtcgttgtaattgttttcaacaacaacggtgtctacggcggtgaccgaagaagccctgatgagataaccggaccctacaaagatgaccctgccccaacttctttcgttccagcagcaggctaccataaaatgatggaagctttcggagggaaaggctatcttgtggagacaccagacgagctcaaatctgccctttcagaatcgttccgcgccaggaaaccagcagtgattaatgttatcattgatccttatgccggtgcagagagcggtcgaatgcagcacaagaactgagcgtgtttggtttataccataatatcatagcaggatgcagatgcgactttacaaataagcaacaaccttgagtttgagtgtcaatatatcaatccttggtctt

SEQ ID NO: 27203 - DNA, 185 bp, Sorghum bicolor
  Clone ID: 6674891
ggaacggttgattcaaataattggggcccccgttggtcgaaaggcccccatggggtcaagctcccatttgttggataaaggctgaaccccttttaagtccgaatccatgctaaatttttttttaagaagaagaagaagaaaaccctgtgttttttttaaaaagaaaaagaataagaaatctttcc

SEQ ID NO: 27204 - DNA, 553 bp, Sorghum bicolor
  Clone ID: 6674896
catcaagagccccggccaccgcttcttcatctgcggcgtgcccggccactgcgccgccggccagaagctcaacatccgcgtcctcaagacgacgcgctcctctgacgccccttccccttccccggcgccagccgccgcgcgctccggctcctccgcggcgtcccccagccccagcaccgagccgagcggcgcctcggcgtcgccgcccgcgtcgtccacggacagcccgcccgacgcgacagccaccaccgcgcccgcgcccaacgccaacggcgcgggggtcagtgcaagcaactgccgggccgtcgtcggtgccatggcgctggcggcggtcgcctccatggcgatgctgcactagatcaccacgcagctagttgggccggccgggtgcatttgttgatctacatgtgattcttttgccatacatgatgacggtggaggtttattttcctttcttgggtgtgtgtactgtgtatgtgttagctgctgatgtggattatattgttgagatgttatgcttttctcaggtttcttatattcaatgtttttgtcg
